United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 116

SEQ ID NO: 4106733 - RNA, 16 nt, Streptococcus pneumoniae R6
uagccauguuuuucuc

SEQ ID NO: 4106734 - RNA, 20 nt, Streptococcus pneumoniae R6
uagccccagcuaggagagcu

SEQ ID NO: 4106735 - RNA, 14 nt, Streptococcus pneumoniae R6
uagccccuagauau

SEQ ID NO: 4106736 - RNA, 18 nt, Streptococcus pneumoniae R6
uagccccuagauauuuug

SEQ ID NO: 4106737 - RNA, 12 nt, Streptococcus pneumoniae R6
uagcccuucaua

SEQ ID NO: 4106738 - RNA, 14 nt, Streptococcus pneumoniae R6
uagccgcaaacuug

SEQ ID NO: 4106739 - RNA, 13 nt, Streptococcus pneumoniae R6
uagccucagcaaa

SEQ ID NO: 4106740 - RNA, 16 nt, Streptococcus pneumoniae R6
uagccugugauuuucu

SEQ ID NO: 4106741 - RNA, 17 nt, Streptococcus pneumoniae R6
uagccugugauuuucuu

SEQ ID NO: 4106742 - RNA, 16 nt, Streptococcus pneumoniae R6
uagccuucauuacuua

SEQ ID NO: 4106743 - RNA, 15 nt, Streptococcus pneumoniae R6
uagccuuccauauag

SEQ ID NO: 4106744 - RNA, 15 nt, Streptococcus pneumoniae R6
uagccuuguauucau

SEQ ID NO: 4106745 - RNA, 18 nt, Streptococcus pneumoniae R6
uagccuuuggauauuuug

SEQ ID NO: 4106746 - RNA, 17 nt, Streptococcus pneumoniae R6
uagcgacuuucuucgaa

SEQ ID NO: 4106747 - RNA, 17 nt, Streptococcus pneumoniae R6
uagcgauagauguuuuc

SEQ ID NO: 4106748 - RNA, 20 nt, Streptococcus pneumoniae R6
uagcgauagauguuuucaaa

SEQ ID NO: 4106749 - RNA, 19 nt, Streptococcus pneumoniae R6
uagcgcccuuguucuccaa

SEQ ID NO: 4106750 - RNA, 13 nt, Streptococcus pneumoniae R6
uagcgcugugaag

SEQ ID NO: 4106751 - RNA, 15 nt, Streptococcus pneumoniae R6
uagcgucaaagaagg

SEQ ID NO: 4106752 - RNA, 17 nt, Streptococcus pneumoniae R6
uagcguugacaauggca

SEQ ID NO: 4106753 - RNA, 18 nt, Streptococcus pneumoniae R6
uagcuaacugcuucacua

SEQ ID NO: 4106754 - RNA, 13 nt, Streptococcus pneumoniae R6
uagcuaauagaac

SEQ ID NO: 4106755 - RNA, 17 nt, Streptococcus pneumoniae R6
uagcuagaguuucaauu

SEQ ID NO: 4106756 - RNA, 13 nt, Streptococcus pneumoniae R6
uagcuaugaauau

SEQ ID NO: 4106757 - RNA, 19 nt, Streptococcus pneumoniae R6
uagcuauuagaccugccau

SEQ ID NO: 4106758 - RNA, 12 nt, Streptococcus pneumoniae R6
uagcuauuucuu

SEQ ID NO: 4106759 - RNA, 22 nt, Streptococcus pneumoniae R6
uagcucaaaagcuuguuuaaaa

SEQ ID NO: 4106760 - RNA, 22 nt, Streptococcus pneumoniae R6
uagcucaaaaguuuaucuagaa

SEQ ID NO: 4106761 - RNA, 15 nt, Streptococcus pneumoniae R6
uagcuccaucuccaa

SEQ ID NO: 4106762 - RNA, 16 nt, Streptococcus pneumoniae R6
uagcuccaucuccaac

SEQ ID NO: 4106763 - RNA, 20 nt, Streptococcus pneumoniae R6
uagcuccaucuccaacugcu

SEQ ID NO: 4106764 - RNA, 18 nt, Streptococcus pneumoniae R6
uagcuccuugugcacacu

SEQ ID NO: 4106765 - RNA, 22 nt, Streptococcus pneumoniae R6
uagcuccuuuaacauuugagug

SEQ ID NO: 4106766 - RNA, 19 nt, Streptococcus pneumoniae R6
uagcucuuuuguuaauaac

SEQ ID NO: 4106767 - RNA, 16 nt, Streptococcus pneumoniae R6
uagcugaaccaugucc

SEQ ID NO: 4106768 - RNA, 22 nt, Streptococcus pneumoniae R6
uagcugauuauguuuuaaauaa

SEQ ID NO: 4106769 - RNA, 13 nt, Streptococcus pneumoniae R6
uagcugauuuuug

SEQ ID NO: 4106770 - RNA, 18 nt, Streptococcus pneumoniae R6
uagcugauuuuuuacaau

SEQ ID NO: 4106771 - RNA, 11 nt, Streptococcus pneumoniae R6
uagcuggucaa

SEQ ID NO: 4106772 - RNA, 23 nt, Streptococcus pneumoniae R6
uagcuuccuaguuugcucuuuga

SEQ ID NO: 4106773 - RNA, 13 nt, Streptococcus pneumoniae R6
uagcuuccuugau

SEQ ID NO: 4106774 - RNA, 13 nt, Streptococcus pneumoniae R6
uagcuugcaauuc

SEQ ID NO: 4106775 - RNA, 16 nt, Streptococcus pneumoniae R6
uagcuuucaaguuuug

SEQ ID NO: 4106776 - RNA, 18 nt, Streptococcus pneumoniae R6
uagcuuucaaguuuugau

SEQ ID NO: 4106777 - RNA, 19 nt, Streptococcus pneumoniae R6
uagcuuucaaguuuugaua

SEQ ID NO: 4106778 - RNA, 17 nt, Streptococcus pneumoniae R6
uagcuuucuaguuugcu

SEQ ID NO: 4106779 - RNA, 23 nt, Streptococcus pneumoniae R6
uagcuuucuaguuugcucuuuga

SEQ ID NO: 4106780 - RNA, 18 nt, Streptococcus pneumoniae R6
uagcuuuugcagcaccag

SEQ ID NO: 4106781 - RNA, 13 nt, Streptococcus pneumoniae R6
uagcuuuuuaauu

SEQ ID NO: 4106782 - RNA, 18 nt, Streptococcus pneumoniae R6
uagcuuuuuaauuuugag

SEQ ID NO: 4106783 - RNA, 18 nt, Streptococcus pneumoniae R6
uagcuuuuuauauauaau

SEQ ID NO: 4106784 - RNA, 12 nt, Streptococcus pneumoniae R6
uaggaaaccaau

SEQ ID NO: 4106785 - RNA, 20 nt, Streptococcus pneumoniae R6
uaggaaagaagguguuuuua

SEQ ID NO: 4106786 - RNA, 13 nt, Streptococcus pneumoniae R6
uaggaaaggaaaa

SEQ ID NO: 4106787 - RNA, 18 nt, Streptococcus pneumoniae R6
uaggaaaggaaaauugau

SEQ ID NO: 4106788 - RNA, 23 nt, Streptococcus pneumoniae R6
uaggaacgauguuugcagcacca

SEQ ID NO: 4106789 - RNA, 19 nt, Streptococcus pneumoniae R6
uaggaagauuuuuuggauu

SEQ ID NO: 4106790 - RNA, 19 nt, Streptococcus pneumoniae R6
uaggaagguuauuuggauu

SEQ ID NO: 4106791 - RNA, 15 nt, Streptococcus pneumoniae R6
uaggaaguuuagauu

SEQ ID NO: 4106792 - RNA, 16 nt, Streptococcus pneumoniae R6
uaggaauauuauauaa

SEQ ID NO: 4106793 - RNA, 13 nt, Streptococcus pneumoniae R6
uaggaauauugaa

SEQ ID NO: 4106794 - RNA, 16 nt, Streptococcus pneumoniae R6
uaggaaucccuggagg

SEQ ID NO: 4106795 - RNA, 17 nt, Streptococcus pneumoniae R6
uaggacaauuucucgga

SEQ ID NO: 4106796 - RNA, 17 nt, Streptococcus pneumoniae R6
uaggacuaaauacaaaa

SEQ ID NO: 4106797 - RNA, 22 nt, Streptococcus pneumoniae R6
uaggacuuccuuuucuuaucca

SEQ ID NO: 4106798 - RNA, 18 nt, Streptococcus pneumoniae R6
uaggagaaaaagaaguaa

SEQ ID NO: 4106799 - RNA, 23 nt, Streptococcus pneumoniae R6
uaggagaaaaagaaguaaaucuu

SEQ ID NO: 4106800 - RNA, 14 nt, Streptococcus pneumoniae R6
uaggagagcuaggg

SEQ ID NO: 4106801 - RNA, 18 nt, Streptococcus pneumoniae R6
uaggagauucuuauaaau

SEQ ID NO: 4106802 - RNA, 18 nt, Streptococcus pneumoniae R6
uaggaucaugagccacaa

SEQ ID NO: 4106803 - RNA, 21 nt, Streptococcus pneumoniae R6
uaggauggcuccagaaauaau

SEQ ID NO: 4106804 - RNA, 21 nt, Streptococcus pneumoniae R6
uaggauugacaaaauuugguu

SEQ ID NO: 4106805 - RNA, 16 nt, Streptococcus pneumoniae R6
uaggauuucuccuguu

SEQ ID NO: 4106806 - RNA, 14 nt, Streptococcus pneumoniae R6
uaggcaauaaaaua

SEQ ID NO: 4106807 - RNA, 18 nt, Streptococcus pneumoniae R6
uaggcagaacaagagucc

SEQ ID NO: 4106808 - RNA, 17 nt, Streptococcus pneumoniae R6
uaggcauaaacaggcuc

SEQ ID NO: 4106809 - RNA, 20 nt, Streptococcus pneumoniae R6
uaggccaaacuugaaaugau

SEQ ID NO: 4106810 - RNA, 22 nt, Streptococcus pneumoniae R6
uaggccacaaaugcuucuuuga

SEQ ID NO: 4106811 - RNA, 22 nt, Streptococcus pneumoniae R6
uaggccuuguggaagaaguuuu

SEQ ID NO: 4106812 - RNA, 21 nt, Streptococcus pneumoniae R6
uaggcgcaaauccgaaaauca

SEQ ID NO: 4106813 - RNA, 14 nt, Streptococcus pneumoniae R6
uaggcgcuucacua

SEQ ID NO: 4106814 - RNA, 15 nt, Streptococcus pneumoniae R6
uaggcgcuucacuag

SEQ ID NO: 4106815 - RNA, 21 nt, Streptococcus pneumoniae R6
uaggcucgagaaaggacaaau

SEQ ID NO: 4106816 - RNA, 14 nt, Streptococcus pneumoniae R6
uaggcuggauacga

SEQ ID NO: 4106817 - RNA, 20 nt, Streptococcus pneumoniae R6
uaggcuucgauaauuuucug

SEQ ID NO: 4106818 - RNA, 14 nt, Streptococcus pneumoniae R6
uaggcuucuucucc

SEQ ID NO: 4106819 - RNA, 15 nt, Streptococcus pneumoniae R6
uaggcuuucaacugc

SEQ ID NO: 4106820 - RNA, 14 nt, Streptococcus pneumoniae R6
uagggaaacaaaag

SEQ ID NO: 4106821 - RNA, 15 nt, Streptococcus pneumoniae R6
uagggaaacaaaagu

SEQ ID NO: 4106822 - RNA, 17 nt, Streptococcus pneumoniae R6
uagggauuugauaagaa

SEQ ID NO: 4106823 - RNA, 18 nt, Streptococcus pneumoniae R6
uagggcuaggcuaacacu

SEQ ID NO: 4106824 - RNA, 21 nt, Streptococcus pneumoniae R6
uagggugacaguaaaaaauca

SEQ ID NO: 4106825 - RNA, 16 nt, Streptococcus pneumoniae R6
uagguacgacaggcau

SEQ ID NO: 4106826 - RNA, 14 nt, Streptococcus pneumoniae R6
uagguauaaaccac

SEQ ID NO: 4106827 - RNA, 18 nt, Streptococcus pneumoniae R6
uaggucaaccaacuuuuc

SEQ ID NO: 4106828 - RNA, 12 nt, Streptococcus pneumoniae R6
uagguccaagcg

SEQ ID NO: 4106829 - RNA, 14 nt, Streptococcus pneumoniae R6
uaggucuagacuau

SEQ ID NO: 4106830 - RNA, 17 nt, Streptococcus pneumoniae R6
uaggugaauuagugaag

SEQ ID NO: 4106831 - RNA, 22 nt, Streptococcus pneumoniae R6
uaggugagauuggauuuucuga

SEQ ID NO: 4106832 - RNA, 21 nt, Streptococcus pneumoniae R6
uaggugagcaucaggaaagac

SEQ ID NO: 4106833 - RNA, 16 nt, Streptococcus pneumoniae R6
uaggugcgagacaaaa

SEQ ID NO: 4106834 - RNA, 19 nt, Streptococcus pneumoniae R6
uaggugcgagacaaaaaaa

SEQ ID NO: 4106835 - RNA, 22 nt, Streptococcus pneumoniae R6
uaggugcgagacaaaaaaaaca

SEQ ID NO: 4106836 - RNA, 23 nt, Streptococcus pneumoniae R6
uaggugguuggaaguagugaaag

SEQ ID NO: 4106837 - RNA, 17 nt, Streptococcus pneumoniae R6
uagguuaaagguuuuau

SEQ ID NO: 4106838 - RNA, 16 nt, Streptococcus pneumoniae R6
uagguucgguuuccau

SEQ ID NO: 4106839 - RNA, 23 nt, Streptococcus pneumoniae R6
uagguuucgcuaucucuaggaau

SEQ ID NO: 4106840 - RNA, 14 nt, Streptococcus pneumoniae R6
uaguaaaaauugcu

SEQ ID NO: 4106841 - RNA, 13 nt, Streptococcus pneumoniae R6
uaguaaaagaauu

SEQ ID NO: 4106842 - RNA, 13 nt, Streptococcus pneumoniae R6
uaguaaacagucc

SEQ ID NO: 4106843 - RNA, 16 nt, Streptococcus pneumoniae R6
uaguaaacuucuucuu

SEQ ID NO: 4106844 - RNA, 19 nt, Streptococcus pneumoniae R6
uaguaaacuucuucuucca

SEQ ID NO: 4106845 - RNA, 13 nt, Streptococcus pneumoniae R6
uaguaaagagcug

SEQ ID NO: 4106846 - RNA, 18 nt, Streptococcus pneumoniae R6
uaguaaaggacaccagca

SEQ ID NO: 4106847 - RNA, 13 nt, Streptococcus pneumoniae R6
uaguaaauagaag

SEQ ID NO: 4106848 - RNA, 19 nt, Streptococcus pneumoniae R6
uaguaacgagucaaaaaag

SEQ ID NO: 4106849 - RNA, 16 nt, Streptococcus pneumoniae R6
uaguaagaguugaaaa

SEQ ID NO: 4106850 - RNA, 23 nt, Streptococcus pneumoniae R6
uaguaaucaauauagucuacaau

SEQ ID NO: 4106851 - RNA, 16 nt, Streptococcus pneumoniae R6
uaguaaucuggucuua

SEQ ID NO: 4106852 - RNA, 18 nt, Streptococcus pneumoniae R6
uaguaaugacuuguguuu

SEQ ID NO: 4106853 - RNA, 19 nt, Streptococcus pneumoniae R6
uaguaauuuugugauaaaa

SEQ ID NO: 4106854 - RNA, 22 nt, Streptococcus pneumoniae R6
uaguacaauaccuuuccuccga

SEQ ID NO: 4106855 - RNA, 15 nt, Streptococcus pneumoniae R6
uaguacacaacugcu

SEQ ID NO: 4106856 - RNA, 16 nt, Streptococcus pneumoniae R6
uaguacaccuuuacuu

SEQ ID NO: 4106857 - RNA, 21 nt, Streptococcus pneumoniae R6
uaguaccaguuaccauugacu

SEQ ID NO: 4106858 - RNA, 20 nt, Streptococcus pneumoniae R6
uaguagaaaaugaaauacau

SEQ ID NO: 4106859 - RNA, 21 nt, Streptococcus pneumoniae R6
uaguagaaguguauuauucua

SEQ ID NO: 4106860 - RNA, 15 nt, Streptococcus pneumoniae R6
uaguagaccucagcu

SEQ ID NO: 4106861 - RNA, 14 nt, Streptococcus pneumoniae R6
uaguagauugaaau

SEQ ID NO: 4106862 - RNA, 16 nt, Streptococcus pneumoniae R6
uaguagccaaaauccu

SEQ ID NO: 4106863 - RNA, 19 nt, Streptococcus pneumoniae R6
uaguagccaaaauccuuga

SEQ ID NO: 4106864 - RNA, 16 nt, Streptococcus pneumoniae R6
uaguagccaauugagg

SEQ ID NO: 4106865 - RNA, 22 nt, Streptococcus pneumoniae R6
uaguagggaaaccacuagcaua

SEQ ID NO: 4106866 - RNA, 16 nt, Streptococcus pneumoniae R6
uaguaguuucagcgau

SEQ ID NO: 4106867 - RNA, 22 nt, Streptococcus pneumoniae R6
uaguaucaaguguaucaggaau

SEQ ID NO: 4106868 - RNA, 19 nt, Streptococcus pneumoniae R6
uaguaucagguauugaaaa

SEQ ID NO: 4106869 - RNA, 17 nt, Streptococcus pneumoniae R6
uaguaucagguguugaa

SEQ ID NO: 4106870 - RNA, 17 nt, Streptococcus pneumoniae R6
uaguaucccauucuuca

SEQ ID NO: 4106871 - RNA, 13 nt, Streptococcus pneumoniae R6
uaguauuuuaaaa

SEQ ID NO: 4106872 - RNA, 17 nt, Streptococcus pneumoniae R6
uaguauuuuaaaacgaa

SEQ ID NO: 4106873 - RNA, 22 nt, Streptococcus pneumoniae R6
uagucaaagggaaaucugaaaa

SEQ ID NO: 4106874 - RNA, 21 nt, Streptococcus pneumoniae R6
uagucaauugaaacaagagca

SEQ ID NO: 4106875 - RNA, 18 nt, Streptococcus pneumoniae R6
uagucagaauagauaaca

SEQ ID NO: 4106876 - RNA, 13 nt, Streptococcus pneumoniae R6
uagucagcugucu

SEQ ID NO: 4106877 - RNA, 21 nt, Streptococcus pneumoniae R6
uagucauaacugcuuugagau

SEQ ID NO: 4106878 - RNA, 17 nt, Streptococcus pneumoniae R6
uagucaucaauauuaga

SEQ ID NO: 4106879 - RNA, 12 nt, Streptococcus pneumoniae R6
uagucaucagaa

SEQ ID NO: 4106880 - RNA, 17 nt, Streptococcus pneumoniae R6
uagucaucagaaaaaag

SEQ ID NO: 4106881 - RNA, 14 nt, Streptococcus pneumoniae R6
uagucauuccaugg

SEQ ID NO: 4106882 - RNA, 19 nt, Streptococcus pneumoniae R6
uaguccaaacguccagccu

SEQ ID NO: 4106883 - RNA, 21 nt, Streptococcus pneumoniae R6
uaguccaaacguccagccuug

SEQ ID NO: 4106884 - RNA, 20 nt, Streptococcus pneumoniae R6
uaguccaacuguaaagacau

SEQ ID NO: 4106885 - RNA, 23 nt, Streptococcus pneumoniae R6
uaguccaagacguucaaagauau

SEQ ID NO: 4106886 - RNA, 18 nt, Streptococcus pneumoniae R6
uagucccagcuucuuuuu

SEQ ID NO: 4106887 - RNA, 19 nt, Streptococcus pneumoniae R6
uagucccauuuucagaaag

SEQ ID NO: 4106888 - RNA, 20 nt, Streptococcus pneumoniae R6
uagucccugguaaaagagca

SEQ ID NO: 4106889 - RNA, 22 nt, Streptococcus pneumoniae R6
uaguccucccuucuuucucaaa

SEQ ID NO: 4106890 - RNA, 19 nt, Streptococcus pneumoniae R6
uagucgaaggcuuguaauu

SEQ ID NO: 4106891 - RNA, 23 nt, Streptococcus pneumoniae R6
uagucguaaauaauauuauucua

SEQ ID NO: 4106892 - RNA, 22 nt, Streptococcus pneumoniae R6
uagucguuuaaggaaguugagu

SEQ ID NO: 4106893 - RNA, 20 nt, Streptococcus pneumoniae R6
uagucuacaauagcuuguuc

SEQ ID NO: 4106894 - RNA, 17 nt, Streptococcus pneumoniae R6
uagucuacaauuucucg

SEQ ID NO: 4106895 - RNA, 20 nt, Streptococcus pneumoniae R6
uagucuauaauggcuuguuc

SEQ ID NO: 4106896 - RNA, 19 nt, Streptococcus pneumoniae R6
uagucuggauauccuuuuc

SEQ ID NO: 4106897 - RNA, 17 nt, Streptococcus pneumoniae R6
uagucuguucuauaaaa

SEQ ID NO: 4106898 - RNA, 21 nt, Streptococcus pneumoniae R6
uagucuucuguacauuagaau

SEQ ID NO: 4106899 - RNA, 18 nt, Streptococcus pneumoniae R6
uagucuucuuuucuuuua

SEQ ID NO: 4106900 - RNA, 19 nt, Streptococcus pneumoniae R6
uagugaaauuaacaaaaag

SEQ ID NO: 4106901 - RNA, 22 nt, Streptococcus pneumoniae R6
uagugaaauugaacuuuuucua

SEQ ID NO: 4106902 - RNA, 15 nt, Streptococcus pneumoniae R6
uagugaacugaaucu

SEQ ID NO: 4106903 - RNA, 23 nt, Streptococcus pneumoniae R6
uagugaaugauucugaaauaacu

SEQ ID NO: 4106904 - RNA, 19 nt, Streptococcus pneumoniae R6
uagugaauggauuuaucag

SEQ ID NO: 4106905 - RNA, 17 nt, Streptococcus pneumoniae R6
uagugaauugaaauaag

SEQ ID NO: 4106906 - RNA, 14 nt, Streptococcus pneumoniae R6
uagugacuucagag

SEQ ID NO: 4106907 - RNA, 10 nt, Streptococcus pneumoniae R6
uagugagucc

SEQ ID NO: 4106908 - RNA, 13 nt, Streptococcus pneumoniae R6
uagugauaucuug

SEQ ID NO: 4106909 - RNA, 20 nt, Streptococcus pneumoniae R6
uagugcuauaguagauugaa

SEQ ID NO: 4106910 - RNA, 21 nt, Streptococcus pneumoniae R6
uaguggaaagaggacuuuuug

SEQ ID NO: 4106911 - RNA, 17 nt, Streptococcus pneumoniae R6
uaguggguugaaaaaaa

SEQ ID NO: 4106912 - RNA, 19 nt, Streptococcus pneumoniae R6
uaguggguugaaaaaaagc

SEQ ID NO: 4106913 - RNA, 15 nt, Streptococcus pneumoniae R6
uaguggguugaagaa

SEQ ID NO: 4106914 - RNA, 16 nt, Streptococcus pneumoniae R6
uaguggguugaaguca

SEQ ID NO: 4106915 - RNA, 18 nt, Streptococcus pneumoniae R6
uaguggguugaagucagc

SEQ ID NO: 4106916 - RNA, 21 nt, Streptococcus pneumoniae R6
uaguggguugaagucagcuaa

SEQ ID NO: 4106917 - RNA, 23 nt, Streptococcus pneumoniae R6
uaguguagaggcguuauuugaaa

SEQ ID NO: 4106918 - RNA, 13 nt, Streptococcus pneumoniae R6
uaguguauaaggu

SEQ ID NO: 4106919 - RNA, 13 nt, Streptococcus pneumoniae R6
uaguguuucucug

SEQ ID NO: 4106920 - RNA, 17 nt, Streptococcus pneumoniae R6
uaguuaaacuaauguaa

SEQ ID NO: 4106921 - RNA, 20 nt, Streptococcus pneumoniae R6
uaguuaaauguaguuggauu

SEQ ID NO: 4106922 - RNA, 20 nt, Streptococcus pneumoniae R6
uaguuaaucuauacauuuag

SEQ ID NO: 4106923 - RNA, 22 nt, Streptococcus pneumoniae R6
uaguuaaucuauacauuuagaa

SEQ ID NO: 4106924 - RNA, 14 nt, Streptococcus pneumoniae R6
uaguuacuuagauu

SEQ ID NO: 4106925 - RNA, 17 nt, Streptococcus pneumoniae R6
uaguuaguguauaaggu

SEQ ID NO: 4106926 - RNA, 15 nt, Streptococcus pneumoniae R6
uaguuauaaaggcuu

SEQ ID NO: 4106927 - RNA, 16 nt, Streptococcus pneumoniae R6
uaguuaugaaacuaug

SEQ ID NO: 4106928 - RNA, 15 nt, Streptococcus pneumoniae R6
uaguucaagugcuuu

SEQ ID NO: 4106929 - RNA, 16 nt, Streptococcus pneumoniae R6
uaguucagaauuuucu

SEQ ID NO: 4106930 - RNA, 14 nt, Streptococcus pneumoniae R6
uaguucauaagagc

SEQ ID NO: 4106931 - RNA, 22 nt, Streptococcus pneumoniae R6
uaguuccaauaacuuuaagauu

SEQ ID NO: 4106932 - RNA, 18 nt, Streptococcus pneumoniae R6
uaguucucaaccacaaaa

SEQ ID NO: 4106933 - RNA, 12 nt, Streptococcus pneumoniae R6
uaguucuguacu

SEQ ID NO: 4106934 - RNA, 11 nt, Streptococcus pneumoniae R6
uaguucuucca

SEQ ID NO: 4106935 - RNA, 15 nt, Streptococcus pneumoniae R6
uaguucuugaaauga

SEQ ID NO: 4106936 - RNA, 22 nt, Streptococcus pneumoniae R6
uaguucuuuaagguuagcugca

SEQ ID NO: 4106937 - RNA, 13 nt, Streptococcus pneumoniae R6
uaguugaaaucaa

SEQ ID NO: 4106938 - RNA, 15 nt, Streptococcus pneumoniae R6
uaguugaacuuuaga

SEQ ID NO: 4106939 - RNA, 22 nt, Streptococcus pneumoniae R6
uaguugaagggcguugacaauc

SEQ ID NO: 4106940 - RNA, 18 nt, Streptococcus pneumoniae R6
uaguugaauuaucauagu

SEQ ID NO: 4106941 - RNA, 17 nt, Streptococcus pneumoniae R6
uaguugcauuaaaauca

SEQ ID NO: 4106942 - RNA, 15 nt, Streptococcus pneumoniae R6
uaguuggauuuccac

SEQ ID NO: 4106943 - RNA, 16 nt, Streptococcus pneumoniae R6
uaguuggauuuccacu

SEQ ID NO: 4106944 - RNA, 23 nt, Streptococcus pneumoniae R6
uaguuggccaacuucuuuuugau

SEQ ID NO: 4106945 - RNA, 20 nt, Streptococcus pneumoniae R6
uaguugucgcuugagagaag

SEQ ID NO: 4106946 - RNA, 12 nt, Streptococcus pneumoniae R6
uaguuuaaaaca

SEQ ID NO: 4106947 - RNA, 16 nt, Streptococcus pneumoniae R6
uaguuuaaaagacuac

SEQ ID NO: 4106948 - RNA, 15 nt, Streptococcus pneumoniae R6
uaguuuaugaacacu

SEQ ID NO: 4106949 - RNA, 19 nt, Streptococcus pneumoniae R6
uaguuugcauuggcuauuu

SEQ ID NO: 4106950 - RNA, 13 nt, Streptococcus pneumoniae R6
uaguuugcucuuu

SEQ ID NO: 4106951 - RNA, 22 nt, Streptococcus pneumoniae R6
uaguuugcucuuugauuuucau

SEQ ID NO: 4106952 - RNA, 22 nt, Streptococcus pneumoniae R6
uaguuugcucuuugauuuuuau

SEQ ID NO: 4106953 - RNA, 21 nt, Streptococcus pneumoniae R6
uaguuugguagggugaagagu

SEQ ID NO: 4106954 - RNA, 20 nt, Streptococcus pneumoniae R6
uaguuuuaccacuaaacuac

SEQ ID NO: 4106955 - RNA, 22 nt, Streptococcus pneumoniae R6
uaguuuucacuauugaugaacu

SEQ ID NO: 4106956 - RNA, 22 nt, Streptococcus pneumoniae R6
uaguuuucuaaagaauuugaaa

SEQ ID NO: 4106957 - RNA, 12 nt, Streptococcus pneumoniae R6
uaguuuuucccg

SEQ ID NO: 4106958 - RNA, 20 nt, Streptococcus pneumoniae R6
uauaaaaaagucugggaaaa

SEQ ID NO: 4106959 - RNA, 14 nt, Streptococcus pneumoniae R6
uauaaaaacucucu

SEQ ID NO: 4106960 - RNA, 14 nt, Streptococcus pneumoniae R6
uauaaaaagaaaug

SEQ ID NO: 4106961 - RNA, 23 nt, Streptococcus pneumoniae R6
uauaaaaagaaaugucaucucga

SEQ ID NO: 4106962 - RNA, 13 nt, Streptococcus pneumoniae R6
uauaaaauuuaau

SEQ ID NO: 4106963 - RNA, 20 nt, Streptococcus pneumoniae R6
uauaaaauuucuugacauac

SEQ ID NO: 4106964 - RNA, 23 nt, Streptococcus pneumoniae R6
uauaaaccacgaggguaaagggu

SEQ ID NO: 4106965 - RNA, 18 nt, Streptococcus pneumoniae R6
uauaaaccucauuggaaa

SEQ ID NO: 4106966 - RNA, 19 nt, Streptococcus pneumoniae R6
uauaaaccucauuggaaaa

SEQ ID NO: 4106967 - RNA, 22 nt, Streptococcus pneumoniae R6
uauaaacuuugguuauaaaaaa

SEQ ID NO: 4106968 - RNA, 23 nt, Streptococcus pneumoniae R6
uauaaacuuuuucauaaauagau

SEQ ID NO: 4106969 - RNA, 17 nt, Streptococcus pneumoniae R6
uauaaauaauuauagaa

SEQ ID NO: 4106970 - RNA, 18 nt, Streptococcus pneumoniae R6
uauaaauaauuauagaaa

SEQ ID NO: 4106971 - RNA, 14 nt, Streptococcus pneumoniae R6
uauaaauauagaaa

SEQ ID NO: 4106972 - RNA, 18 nt, Streptococcus pneumoniae R6
uauaaaucucagaaaaac

SEQ ID NO: 4106973 - RNA, 13 nt, Streptococcus pneumoniae R6
uauaaaugaugaa

SEQ ID NO: 4106974 - RNA, 15 nt, Streptococcus pneumoniae R6
uauaaauuauuucuu

SEQ ID NO: 4106975 - RNA, 16 nt, Streptococcus pneumoniae R6
uauaaauuauuucuuu

SEQ ID NO: 4106976 - RNA, 21 nt, Streptococcus pneumoniae R6
uauaaauucauuugauuuucc

SEQ ID NO: 4106977 - RNA, 20 nt, Streptococcus pneumoniae R6
uauaacaucugcuauaauag

SEQ ID NO: 4106978 - RNA, 21 nt, Streptococcus pneumoniae R6
uauaacaucugcuauaauagu

SEQ ID NO: 4106979 - RNA, 11 nt, Streptococcus pneumoniae R6
uauaagacuuu

SEQ ID NO: 4106980 - RNA, 14 nt, Streptococcus pneumoniae R6
uauaagauacaaau

SEQ ID NO: 4106981 - RNA, 15 nt, Streptococcus pneumoniae R6
uauaagauacaaauu

SEQ ID NO: 4106982 - RNA, 18 nt, Streptococcus pneumoniae R6
uauaagauuuaacuuuuu

SEQ ID NO: 4106983 - RNA, 13 nt, Streptococcus pneumoniae R6
uauaagcccaaau

SEQ ID NO: 4106984 - RNA, 19 nt, Streptococcus pneumoniae R6
uauaagcggcuagcgucua

SEQ ID NO: 4106985 - RNA, 18 nt, Streptococcus pneumoniae R6
uauaaggaccaaauauac

SEQ ID NO: 4106986 - RNA, 22 nt, Streptococcus pneumoniae R6
uauaagguaggagugaaaaacu

SEQ ID NO: 4106987 - RNA, 14 nt, Streptococcus pneumoniae R6
uauaagguuacuuu

SEQ ID NO: 4106988 - RNA, 20 nt, Streptococcus pneumoniae R6
uauaagguucauuagaacac

SEQ ID NO: 4106989 - RNA, 12 nt, Streptococcus pneumoniae R6
uauaauaaaaug

SEQ ID NO: 4106990 - RNA, 22 nt, Streptococcus pneumoniae R6
uauaauaaaaugaaauaagaau

SEQ ID NO: 4106991 - RNA, 20 nt, Streptococcus pneumoniae R6
uauaauaaaaugaaauaaua

SEQ ID NO: 4106992 - RNA, 12 nt, Streptococcus pneumoniae R6
uauaauaucaga

SEQ ID NO: 4106993 - RNA, 18 nt, Streptococcus pneumoniae R6
uauaauggauugaaauaa

SEQ ID NO: 4106994 - RNA, 17 nt, Streptococcus pneumoniae R6
uauaauuauauauaaaa

SEQ ID NO: 4106995 - RNA, 16 nt, Streptococcus pneumoniae R6
uauaauuauucugcaa

SEQ ID NO: 4106996 - RNA, 14 nt, Streptococcus pneumoniae R6
uauaauuucaacua

SEQ ID NO: 4106997 - RNA, 12 nt, Streptococcus pneumoniae R6
uauacaaaaaag

SEQ ID NO: 4106998 - RNA, 23 nt, Streptococcus pneumoniae R6
uauacaaauaaacggacaaaacu

SEQ ID NO: 4106999 - RNA, 18 nt, Streptococcus pneumoniae R6
uauacacgaccuauagaa

SEQ ID NO: 4107000 - RNA, 19 nt, Streptococcus pneumoniae R6
uauacaggggauugauuau

SEQ ID NO: 4107001 - RNA, 21 nt, Streptococcus pneumoniae R6
uauacaggggauugauuaucc

SEQ ID NO: 4107002 - RNA, 20 nt, Streptococcus pneumoniae R6
uauacagucccuuuugaggg

SEQ ID NO: 4107003 - RNA, 15 nt, Streptococcus pneumoniae R6
uauacaguccucccu

SEQ ID NO: 4107004 - RNA, 22 nt, Streptococcus pneumoniae R6
uauacauccguuuuucuccucu

SEQ ID NO: 4107005 - RNA, 23 nt, Streptococcus pneumoniae R6
uauacauccguuuuucuccucua

SEQ ID NO: 4107006 - RNA, 18 nt, Streptococcus pneumoniae R6
uauacauuuagaaaggua

SEQ ID NO: 4107007 - RNA, 19 nt, Streptococcus pneumoniae R6
uauacauuuagaaagguaa

SEQ ID NO: 4107008 - RNA, 20 nt, Streptococcus pneumoniae R6
uauaccaaaaaaacuccaaa

SEQ ID NO: 4107009 - RNA, 21 nt, Streptococcus pneumoniae R6
uauaccacucuugcauuucuu

SEQ ID NO: 4107010 - RNA, 12 nt, Streptococcus pneumoniae R6
uauaccauaaua

SEQ ID NO: 4107011 - RNA, 16 nt, Streptococcus pneumoniae R6
uauaccauaauaaaag

SEQ ID NO: 4107012 - RNA, 15 nt, Streptococcus pneumoniae R6
uauacuaauacauuu

SEQ ID NO: 4107013 - RNA, 16 nt, Streptococcus pneumoniae R6
uauacuaauacauuuu

SEQ ID NO: 4107014 - RNA, 18 nt, Streptococcus pneumoniae R6
uauacuaauauaguuguc

SEQ ID NO: 4107015 - RNA, 13 nt, Streptococcus pneumoniae R6
uauacuauaaaac

SEQ ID NO: 4107016 - RNA, 15 nt, Streptococcus pneumoniae R6
uauacuauaaaacaa

SEQ ID NO: 4107017 - RNA, 13 nt, Streptococcus pneumoniae R6
uauacucaaugaa

SEQ ID NO: 4107018 - RNA, 23 nt, Streptococcus pneumoniae R6
uauacucaaugaaaaucauagaa

SEQ ID NO: 4107019 - RNA, 14 nt, Streptococcus pneumoniae R6
uauacucaucuguu

SEQ ID NO: 4107020 - RNA, 20 nt, Streptococcus pneumoniae R6
uauacucaucuguuuucaaa

SEQ ID NO: 4107021 - RNA, 20 nt, Streptococcus pneumoniae R6
uauacucuuagaaaaucucu

SEQ ID NO: 4107022 - RNA, 14 nt, Streptococcus pneumoniae R6
uauacucuuuagaa

SEQ ID NO: 4107023 - RNA, 15 nt, Streptococcus pneumoniae R6
uauacuuacucuuau

SEQ ID NO: 4107024 - RNA, 22 nt, Streptococcus pneumoniae R6
uauacuugauauaguuaaaaaa

SEQ ID NO: 4107025 - RNA, 15 nt, Streptococcus pneumoniae R6
uauacuuuuaauauu

SEQ ID NO: 4107026 - RNA, 18 nt, Streptococcus pneumoniae R6
uauacuuuuaauauuucc

SEQ ID NO: 4107027 - RNA, 17 nt, Streptococcus pneumoniae R6
uauacuuuucucuuaca

SEQ ID NO: 4107028 - RNA, 17 nt, Streptococcus pneumoniae R6
uauacuuuuucaguuuu

SEQ ID NO: 4107029 - RNA, 16 nt, Streptococcus pneumoniae R6
uauacuuuuucuuccu

SEQ ID NO: 4107030 - RNA, 19 nt, Streptococcus pneumoniae R6
uauagaaaaaagucuuuaa

SEQ ID NO: 4107031 - RNA, 23 nt, Streptococcus pneumoniae R6
uauagaaaaaagucuuuaaaauu

SEQ ID NO: 4107032 - RNA, 17 nt, Streptococcus pneumoniae R6
uauagaaaaauccccca

SEQ ID NO: 4107033 - RNA, 15 nt, Streptococcus pneumoniae R6
uauagaaaauuaacu

SEQ ID NO: 4107034 - RNA, 14 nt, Streptococcus pneumoniae R6
uauagaaggcaauu

SEQ ID NO: 4107035 - RNA, 19 nt, Streptococcus pneumoniae R6
uauagacacauucguuccu

SEQ ID NO: 4107036 - RNA, 16 nt, Streptococcus pneumoniae R6
uauagacaggauauca

SEQ ID NO: 4107037 - RNA, 21 nt, Streptococcus pneumoniae R6
uauagaccaagaacucuucug

SEQ ID NO: 4107038 - RNA, 15 nt, Streptococcus pneumoniae R6
uauagaccugaucaa

SEQ ID NO: 4107039 - RNA, 19 nt, Streptococcus pneumoniae R6
uauagacuauauugauuau

SEQ ID NO: 4107040 - RNA, 23 nt, Streptococcus pneumoniae R6
uauagagcaauggggcuuuauuu

SEQ ID NO: 4107041 - RNA, 20 nt, Streptococcus pneumoniae R6
uauagaggagauuuaaaaau

SEQ ID NO: 4107042 - RNA, 16 nt, Streptococcus pneumoniae R6
uauagaguguuaucug

SEQ ID NO: 4107043 - RNA, 22 nt, Streptococcus pneumoniae R6
uauagaguguuaucugaaaauu

SEQ ID NO: 4107044 - RNA, 15 nt, Streptococcus pneumoniae R6
uauagauaaaaaaca

SEQ ID NO: 4107045 - RNA, 21 nt, Streptococcus pneumoniae R6
uauagauucaauauacuauac

SEQ ID NO: 4107046 - RNA, 14 nt, Streptococcus pneumoniae R6
uauagcguuuugaa

SEQ ID NO: 4107047 - RNA, 13 nt, Streptococcus pneumoniae R6
uauaggcuaguca

SEQ ID NO: 4107048 - RNA, 17 nt, Streptococcus pneumoniae R6
uauaggcucuuugucaa

SEQ ID NO: 4107049 - RNA, 13 nt, Streptococcus pneumoniae R6
uauaguaaacuga

SEQ ID NO: 4107050 - RNA, 14 nt, Streptococcus pneumoniae R6
uauaguaauuccac

SEQ ID NO: 4107051 - RNA, 21 nt, Streptococcus pneumoniae R6
uauaguagacugaaucugaaa

SEQ ID NO: 4107052 - RNA, 21 nt, Streptococcus pneumoniae R6
uauaguagcucagaagucggu

SEQ ID NO: 4107053 - RNA, 22 nt, Streptococcus pneumoniae R6
uauaguagguugcaguugaaau

SEQ ID NO: 4107054 - RNA, 16 nt, Streptococcus pneumoniae R6
uauaguauaguagacu

SEQ ID NO: 4107055 - RNA, 13 nt, Streptococcus pneumoniae R6
uauaguauauuga

SEQ ID NO: 4107056 - RNA, 13 nt, Streptococcus pneumoniae R6
uauagucaaaggg

SEQ ID NO: 4107057 - RNA, 11 nt, Streptococcus pneumoniae R6
uauagucuaau

SEQ ID NO: 4107058 - RNA, 15 nt, Streptococcus pneumoniae R6
uauagucuugaauag

SEQ ID NO: 4107059 - RNA, 14 nt, Streptococcus pneumoniae R6
uauagucuuucaaa

SEQ ID NO: 4107060 - RNA, 16 nt, Streptococcus pneumoniae R6
uauagugguguuucaa

SEQ ID NO: 4107061 - RNA, 21 nt, Streptococcus pneumoniae R6
uauagugguguuucaagucuu

SEQ ID NO: 4107062 - RNA, 19 nt, Streptococcus pneumoniae R6
uauaguuaaauuaguuuuu

SEQ ID NO: 4107063 - RNA, 11 nt, Streptococcus pneumoniae R6
uauauaaaaua

SEQ ID NO: 4107064 - RNA, 23 nt, Streptococcus pneumoniae R6
uauauaaaugaaaaccuuagcug

SEQ ID NO: 4107065 - RNA, 18 nt, Streptococcus pneumoniae R6
uauauaauagauugaaau

SEQ ID NO: 4107066 - RNA, 18 nt, Streptococcus pneumoniae R6
uauauacccaaaacacaa

SEQ ID NO: 4107067 - RNA, 21 nt, Streptococcus pneumoniae R6
uauauacccaaaacacaaaaa

SEQ ID NO: 4107068 - RNA, 17 nt, Streptococcus pneumoniae R6
uauauagcggauaaggu

SEQ ID NO: 4107069 - RNA, 16 nt, Streptococcus pneumoniae R6
uauauaguagccaaaa

SEQ ID NO: 4107070 - RNA, 20 nt, Streptococcus pneumoniae R6
uauauagugacuauggacau

SEQ ID NO: 4107071 - RNA, 17 nt, Streptococcus pneumoniae R6
uauauauccauucuuaa

SEQ ID NO: 4107072 - RNA, 18 nt, Streptococcus pneumoniae R6
uauauauccauucuuaaa

SEQ ID NO: 4107073 - RNA, 16 nt, Streptococcus pneumoniae R6
uauauaugcacagaca

SEQ ID NO: 4107074 - RNA, 18 nt, Streptococcus pneumoniae R6
uauauaugcacauauaca

SEQ ID NO: 4107075 - RNA, 19 nt, Streptococcus pneumoniae R6
uauaucacuuuauaguuuu

SEQ ID NO: 4107076 - RNA, 23 nt, Streptococcus pneumoniae R6
uauaucauauagauaaaaaacaa

SEQ ID NO: 4107077 - RNA, 19 nt, Streptococcus pneumoniae R6
uauauccauucuuaaaauu

SEQ ID NO: 4107078 - RNA, 14 nt, Streptococcus pneumoniae R6
uauauccuaaaaaa

SEQ ID NO: 4107079 - RNA, 13 nt, Streptococcus pneumoniae R6
uauaugauuucaa

SEQ ID NO: 4107080 - RNA, 22 nt, Streptococcus pneumoniae R6
uauaugcaauuucuuuauauaa

SEQ ID NO: 4107081 - RNA, 14 nt, Streptococcus pneumoniae R6
uauauuauaaauuu

SEQ ID NO: 4107082 - RNA, 20 nt, Streptococcus pneumoniae R6
uauauucucucuuacuauac

SEQ ID NO: 4107083 - RNA, 21 nt, Streptococcus pneumoniae R6
uauauucugaaugcuuuccaa

SEQ ID NO: 4107084 - RNA, 14 nt, Streptococcus pneumoniae R6
uauauuuaguauca

SEQ ID NO: 4107085 - RNA, 12 nt, Streptococcus pneumoniae R6
uauauuucuuaa

SEQ ID NO: 4107086 - RNA, 14 nt, Streptococcus pneumoniae R6
uaucaaaaccaguc

SEQ ID NO: 4107087 - RNA, 20 nt, Streptococcus pneumoniae R6
uaucaaaagauguuagaaaa

SEQ ID NO: 4107088 - RNA, 12 nt, Streptococcus pneumoniae R6
uaucaaacagga

SEQ ID NO: 4107089 - RNA, 20 nt, Streptococcus pneumoniae R6
uaucaaacuuuuuaguuuuu

SEQ ID NO: 4107090 - RNA, 23 nt, Streptococcus pneumoniae R6
uaucaaaucccuagcucauggca

SEQ ID NO: 4107091 - RNA, 17 nt, Streptococcus pneumoniae R6
uaucaaccuuucucaga

SEQ ID NO: 4107092 - RNA, 19 nt, Streptococcus pneumoniae R6
uaucaacucaagaauuauu

SEQ ID NO: 4107093 - RNA, 15 nt, Streptococcus pneumoniae R6
uaucaacugccuggu

SEQ ID NO: 4107094 - RNA, 18 nt, Streptococcus pneumoniae R6
uaucaagagucuccucaa

SEQ ID NO: 4107095 - RNA, 16 nt, Streptococcus pneumoniae R6
uaucaagauaagaaaa

SEQ ID NO: 4107096 - RNA, 20 nt, Streptococcus pneumoniae R6
uaucaagcaaaucaaagcua

SEQ ID NO: 4107097 - RNA, 15 nt, Streptococcus pneumoniae R6
uaucaagguuuuuca

SEQ ID NO: 4107098 - RNA, 16 nt, Streptococcus pneumoniae R6
uaucaagguuuuucaa

SEQ ID NO: 4107099 - RNA, 18 nt, Streptococcus pneumoniae R6
uaucaagguuuuucaaaa

SEQ ID NO: 4107100 - RNA, 16 nt, Streptococcus pneumoniae R6
uaucaagguuuuucug

SEQ ID NO: 4107101 - RNA, 20 nt, Streptococcus pneumoniae R6
uaucaagguuuuucuguacu

SEQ ID NO: 4107102 - RNA, 22 nt, Streptococcus pneumoniae R6
uaucaagguuuuucuguacugc

SEQ ID NO: 4107103 - RNA, 19 nt, Streptococcus pneumoniae R6
uaucaagguuuuugaaaaa

SEQ ID NO: 4107104 - RNA, 21 nt, Streptococcus pneumoniae R6
uaucaagguuuuugaaaaacc

SEQ ID NO: 4107105 - RNA, 15 nt, Streptococcus pneumoniae R6
uaucaaguuuucaca

SEQ ID NO: 4107106 - RNA, 12 nt, Streptococcus pneumoniae R6
uaucaauaaaau

SEQ ID NO: 4107107 - RNA, 21 nt, Streptococcus pneumoniae R6
uaucaaucucugcaauuucua

SEQ ID NO: 4107108 - RNA, 18 nt, Streptococcus pneumoniae R6
uaucaccuccuucuccaa

SEQ ID NO: 4107109 - RNA, 23 nt, Streptococcus pneumoniae R6
uaucacgauacuguaguuuuucc

SEQ ID NO: 4107110 - RNA, 22 nt, Streptococcus pneumoniae R6
uaucacuaaauccaccuaauua

SEQ ID NO: 4107111 - RNA, 18 nt, Streptococcus pneumoniae R6
uaucacucaguuucugac

SEQ ID NO: 4107112 - RNA, 16 nt, Streptococcus pneumoniae R6
uaucacuccaaaaaua

SEQ ID NO: 4107113 - RNA, 12 nt, Streptococcus pneumoniae R6
uaucacugguca

SEQ ID NO: 4107114 - RNA, 20 nt, Streptococcus pneumoniae R6
uaucacuuuauaguuuucac

SEQ ID NO: 4107115 - RNA, 16 nt, Streptococcus pneumoniae R6
uaucagaaaauaaaau

SEQ ID NO: 4107116 - RNA, 17 nt, Streptococcus pneumoniae R6
uaucagaaaauaaaauu

SEQ ID NO: 4107117 - RNA, 20 nt, Streptococcus pneumoniae R6
uaucagaaaauaaaauuccu

SEQ ID NO: 4107118 - RNA, 17 nt, Streptococcus pneumoniae R6
uaucagauauucuaaaa

SEQ ID NO: 4107119 - RNA, 17 nt, Streptococcus pneumoniae R6
uaucaggaaagucaaau

SEQ ID NO: 4107120 - RNA, 15 nt, Streptococcus pneumoniae R6
uaucaggaauaaauc

SEQ ID NO: 4107121 - RNA, 16 nt, Streptococcus pneumoniae R6
uaucagguauugaaaa

SEQ ID NO: 4107122 - RNA, 14 nt, Streptococcus pneumoniae R6
uaucaguaaucuca

SEQ ID NO: 4107123 - RNA, 18 nt, Streptococcus pneumoniae R6
uaucauagaaauuuuuac

SEQ ID NO: 4107124 - RNA, 13 nt, Streptococcus pneumoniae R6
uaucauauaaaua

SEQ ID NO: 4107125 - RNA, 15 nt, Streptococcus pneumoniae R6
uaucauauaaauaua

SEQ ID NO: 4107126 - RNA, 16 nt, Streptococcus pneumoniae R6
uaucauauaaauauag

SEQ ID NO: 4107127 - RNA, 20 nt, Streptococcus pneumoniae R6
uaucauauaaauauagaaac

SEQ ID NO: 4107128 - RNA, 17 nt, Streptococcus pneumoniae R6
uaucauauagauaaaaa

SEQ ID NO: 4107129 - RNA, 18 nt, Streptococcus pneumoniae R6
uaucauauagauaaaaaa

SEQ ID NO: 4107130 - RNA, 19 nt, Streptococcus pneumoniae R6
uaucauauagauaaaaaac

SEQ ID NO: 4107131 - RNA, 15 nt, Streptococcus pneumoniae R6
uaucaucaaucaaga

SEQ ID NO: 4107132 - RNA, 19 nt, Streptococcus pneumoniae R6
uaucauccagauuuuucug

SEQ ID NO: 4107133 - RNA, 13 nt, Streptococcus pneumoniae R6
uaucauuaaagac

SEQ ID NO: 4107134 - RNA, 16 nt, Streptococcus pneumoniae R6
uaucauuaaagaccaa

SEQ ID NO: 4107135 - RNA, 12 nt, Streptococcus pneumoniae R6
uaucauuuugaa

SEQ ID NO: 4107136 - RNA, 15 nt, Streptococcus pneumoniae R6
uauccaaaacaacca

SEQ ID NO: 4107137 - RNA, 16 nt, Streptococcus pneumoniae R6
uauccaaaacaaccaa

SEQ ID NO: 4107138 - RNA, 21 nt, Streptococcus pneumoniae R6
uauccaaagauuaaucuucaa

SEQ ID NO: 4107139 - RNA, 19 nt, Streptococcus pneumoniae R6
uauccaacucaggaaagau

SEQ ID NO: 4107140 - RNA, 23 nt, Streptococcus pneumoniae R6
uauccaaucuauuuaugaaaaag

SEQ ID NO: 4107141 - RNA, 13 nt, Streptococcus pneumoniae R6
uauccacaaccuc

SEQ ID NO: 4107142 - RNA, 21 nt, Streptococcus pneumoniae R6
uauccacaaccucaaaacagu

SEQ ID NO: 4107143 - RNA, 23 nt, Streptococcus pneumoniae R6
uauccacaaccucaaaacagugu

SEQ ID NO: 4107144 - RNA, 18 nt, Streptococcus pneumoniae R6
uauccagccuucauaaaa

SEQ ID NO: 4107145 - RNA, 20 nt, Streptococcus pneumoniae R6
uauccagccuucauaaaagu

SEQ ID NO: 4107146 - RNA, 24 nt, Streptococcus pneumoniae R6
uauccaguuauucuuaaaugacau

SEQ ID NO: 4107147 - RNA, 17 nt, Streptococcus pneumoniae R6
uauccauucacaacauc

SEQ ID NO: 4107148 - RNA, 12 nt, Streptococcus pneumoniae R6
uaucccauucuu

SEQ ID NO: 4107149 - RNA, 13 nt, Streptococcus pneumoniae R6
uaucccauucuuc

SEQ ID NO: 4107150 - RNA, 18 nt, Streptococcus pneumoniae R6
uauccgucacgauuucuu

SEQ ID NO: 4107151 - RNA, 19 nt, Streptococcus pneumoniae R6
uauccgucgcauauuucau

SEQ ID NO: 4107152 - RNA, 16 nt, Streptococcus pneumoniae R6
uauccgucguuugguu

SEQ ID NO: 4107153 - RNA, 20 nt, Streptococcus pneumoniae R6
uauccgugaguucucuaguc

SEQ ID NO: 4107154 - RNA, 11 nt, Streptococcus pneumoniae R6
uauccugcccc

SEQ ID NO: 4107155 - RNA, 15 nt, Streptococcus pneumoniae R6
uauccuuuuuuacuu

SEQ ID NO: 4107156 - RNA, 22 nt, Streptococcus pneumoniae R6
uaucgggaucaccgagggaagu

SEQ ID NO: 4107157 - RNA, 15 nt, Streptococcus pneumoniae R6
uaucguaucuuugga

SEQ ID NO: 4107158 - RNA, 13 nt, Streptococcus pneumoniae R6
uaucguuuuccua

SEQ ID NO: 4107159 - RNA, 18 nt, Streptococcus pneumoniae R6
uaucuaaaaaaaugauaa

SEQ ID NO: 4107160 - RNA, 19 nt, Streptococcus pneumoniae R6
uaucuaaaauagaaggagu

SEQ ID NO: 4107161 - RNA, 18 nt, Streptococcus pneumoniae R6
uaucuaaacuauuucuua

SEQ ID NO: 4107162 - RNA, 20 nt, Streptococcus pneumoniae R6
uaucuaaacuauuucuuauu

SEQ ID NO: 4107163 - RNA, 15 nt, Streptococcus pneumoniae R6
uaucuaacaauaaga

SEQ ID NO: 4107164 - RNA, 16 nt, Streptococcus pneumoniae R6
uaucuaacaauaagau

SEQ ID NO: 4107165 - RNA, 12 nt, Streptococcus pneumoniae R6
uaucuaagaugu

SEQ ID NO: 4107166 - RNA, 13 nt, Streptococcus pneumoniae R6
uaucuaauaccaa

SEQ ID NO: 4107167 - RNA, 15 nt, Streptococcus pneumoniae R6
uaucuaauacccauu

SEQ ID NO: 4107168 - RNA, 16 nt, Streptococcus pneumoniae R6
uaucuagaauuucuuu

SEQ ID NO: 4107169 - RNA, 17 nt, Streptococcus pneumoniae R6
uaucuagggcauuaauc

SEQ ID NO: 4107170 - RNA, 22 nt, Streptococcus pneumoniae R6
uaucuagggcauuaaucauucc

SEQ ID NO: 4107171 - RNA, 14 nt, Streptococcus pneumoniae R6
uaucuagguaaaaa

SEQ ID NO: 4107172 - RNA, 22 nt, Streptococcus pneumoniae R6
uaucuagucgaagcuuccaaua

SEQ ID NO: 4107173 - RNA, 22 nt, Streptococcus pneumoniae R6
uaucuauccuaucuucuagaau

SEQ ID NO: 4107174 - RNA, 18 nt, Streptococcus pneumoniae R6
uaucuaucucaacaaauc

SEQ ID NO: 4107175 - RNA, 14 nt, Streptococcus pneumoniae R6
uaucucccauacca

SEQ ID NO: 4107176 - RNA, 15 nt, Streptococcus pneumoniae R6
uaucuccucauauuu

SEQ ID NO: 4107177 - RNA, 19 nt, Streptococcus pneumoniae R6
uaucugaaaguuuaucucu

SEQ ID NO: 4107178 - RNA, 19 nt, Streptococcus pneumoniae R6
uaucugaauaccuaaucuu

SEQ ID NO: 4107179 - RNA, 21 nt, Streptococcus pneumoniae R6
uaucugagguguaaguccucg

SEQ ID NO: 4107180 - RNA, 19 nt, Streptococcus pneumoniae R6
uaucugaugcugacaaguc

SEQ ID NO: 4107181 - RNA, 12 nt, Streptococcus pneumoniae R6
uaucugcaaccu

SEQ ID NO: 4107182 - RNA, 20 nt, Streptococcus pneumoniae R6
uaucugcaaccuuaaaacag

SEQ ID NO: 4107183 - RNA, 16 nt, Streptococcus pneumoniae R6
uaucugcacucucauu

SEQ ID NO: 4107184 - RNA, 14 nt, Streptococcus pneumoniae R6
uaucugcuaaaaca

SEQ ID NO: 4107185 - RNA, 18 nt, Streptococcus pneumoniae R6
uaucuguagaguuuuggu

SEQ ID NO: 4107186 - RNA, 20 nt, Streptococcus pneumoniae R6
uaucugucacaauccagccu

SEQ ID NO: 4107187 - RNA, 19 nt, Streptococcus pneumoniae R6
uaucugucuuaccacaaac

SEQ ID NO: 4107188 - RNA, 20 nt, Streptococcus pneumoniae R6
uaucugucuuaccacaaaca

SEQ ID NO: 4107189 - RNA, 18 nt, Streptococcus pneumoniae R6
uaucuuauugauuuuucu

SEQ ID NO: 4107190 - RNA, 15 nt, Streptococcus pneumoniae R6
uaucuuauuuuucua

SEQ ID NO: 4107191 - RNA, 17 nt, Streptococcus pneumoniae R6
uaucuucgcaacugucu

SEQ ID NO: 4107192 - RNA, 17 nt, Streptococcus pneumoniae R6
uaucuucggauuuuucu

SEQ ID NO: 4107193 - RNA, 15 nt, Streptococcus pneumoniae R6
uaucuucugcuugca

SEQ ID NO: 4107194 - RNA, 14 nt, Streptococcus pneumoniae R6
uaucuugaauauuu

SEQ ID NO: 4107195 - RNA, 15 nt, Streptococcus pneumoniae R6
uaucuugauauucuu

SEQ ID NO: 4107196 - RNA, 21 nt, Streptococcus pneumoniae R6
uaucuugauuuucuuuaaaaa

SEQ ID NO: 4107197 - RNA, 19 nt, Streptococcus pneumoniae R6
uaucuuguaagucugcuuu

SEQ ID NO: 4107198 - RNA, 22 nt, Streptococcus pneumoniae R6
uaucuuguugaaugagcuucca

SEQ ID NO: 4107199 - RNA, 17 nt, Streptococcus pneumoniae R6
uaucuuuaaacuuuucu

SEQ ID NO: 4107200 - RNA, 21 nt, Streptococcus pneumoniae R6
uaucuuugaaauaaucaaaau

SEQ ID NO: 4107201 - RNA, 16 nt, Streptococcus pneumoniae R6
uaucuuugauuuuacu

SEQ ID NO: 4107202 - RNA, 14 nt, Streptococcus pneumoniae R6
uaucuuuuaacuaa

SEQ ID NO: 4107203 - RNA, 16 nt, Streptococcus pneumoniae R6
uaucuuuuuucauuac

SEQ ID NO: 4107204 - RNA, 14 nt, Streptococcus pneumoniae R6
uaucuuuuuuugau

SEQ ID NO: 4107205 - RNA, 17 nt, Streptococcus pneumoniae R6
uaugaaacuauguacga

SEQ ID NO: 4107206 - RNA, 14 nt, Streptococcus pneumoniae R6
uaugaaaugagaaa

SEQ ID NO: 4107207 - RNA, 14 nt, Streptococcus pneumoniae R6
uaugaaauuuaaaa

SEQ ID NO: 4107208 - RNA, 16 nt, Streptococcus pneumoniae R6
uaugaaauuuaaaaag

SEQ ID NO: 4107209 - RNA, 19 nt, Streptococcus pneumoniae R6
uaugaaauuuaaaaagaaa

SEQ ID NO: 4107210 - RNA, 16 nt, Streptococcus pneumoniae R6
uaugaaggaguuucac

SEQ ID NO: 4107211 - RNA, 17 nt, Streptococcus pneumoniae R6
uaugaauaacuucaaua

SEQ ID NO: 4107212 - RNA, 18 nt, Streptococcus pneumoniae R6
uaugacuauaccacucuu

SEQ ID NO: 4107213 - RNA, 13 nt, Streptococcus pneumoniae R6
uaugauaaaacgu

SEQ ID NO: 4107214 - RNA, 21 nt, Streptococcus pneumoniae R6
uaugauaaaacguacaguauc

SEQ ID NO: 4107215 - RNA, 16 nt, Streptococcus pneumoniae R6
uaugaucuuaaauuuu

SEQ ID NO: 4107216 - RNA, 23 nt, Streptococcus pneumoniae R6
uaugaugcguuuuauaauuuuaa

SEQ ID NO: 4107217 - RNA, 15 nt, Streptococcus pneumoniae R6
uaugauucuuucuaa

SEQ ID NO: 4107218 - RNA, 15 nt, Streptococcus pneumoniae R6
uaugauuuaaacuag

SEQ ID NO: 4107219 - RNA, 20 nt, Streptococcus pneumoniae R6
uaugauuuaaacuaguuuuc

SEQ ID NO: 4107220 - RNA, 13 nt, Streptococcus pneumoniae R6
uaugauuuucauu

SEQ ID NO: 4107221 - RNA, 20 nt, Streptococcus pneumoniae R6
uaugcauaauuuccauacca

SEQ ID NO: 4107222 - RNA, 22 nt, Streptococcus pneumoniae R6
uaugcgacuauuaaccuugucu

SEQ ID NO: 4107223 - RNA, 16 nt, Streptococcus pneumoniae R6
uaugcguuuuaucaua

SEQ ID NO: 4107224 - RNA, 17 nt, Streptococcus pneumoniae R6
uaugcguuuuugugauu

SEQ ID NO: 4107225 - RNA, 22 nt, Streptococcus pneumoniae R6
uaugcguuuuuucugauuucaa

SEQ ID NO: 4107226 - RNA, 21 nt, Streptococcus pneumoniae R6
uaugcguuuuuuugauuuuaa

SEQ ID NO: 4107227 - RNA, 20 nt, Streptococcus pneumoniae R6
uaugcuagacucuuauuucu

SEQ ID NO: 4107228 - RNA, 16 nt, Streptococcus pneumoniae R6
uaugcuauugaaagga

SEQ ID NO: 4107229 - RNA, 16 nt, Streptococcus pneumoniae R6
uaugcuugccaaauau

SEQ ID NO: 4107230 - RNA, 19 nt, Streptococcus pneumoniae R6
uaugcuugccaaauauugu

SEQ ID NO: 4107231 - RNA, 22 nt, Streptococcus pneumoniae R6
uaugcuuuccuuucaaaauauc

SEQ ID NO: 4107232 - RNA, 19 nt, Streptococcus pneumoniae R6
uaugcuuuuuucuaugauu

SEQ ID NO: 4107233 - RNA, 11 nt, Streptococcus pneumoniae R6
uauggaaacuc

SEQ ID NO: 4107234 - RNA, 13 nt, Streptococcus pneumoniae R6
uauggccugcuag

SEQ ID NO: 4107235 - RNA, 20 nt, Streptococcus pneumoniae R6
uaugggcaucaacagcucca

SEQ ID NO: 4107236 - RNA, 22 nt, Streptococcus pneumoniae R6
uaugguauucauuaagucaaca

SEQ ID NO: 4107237 - RNA, 14 nt, Streptococcus pneumoniae R6
uaugguauuuguaa

SEQ ID NO: 4107238 - RNA, 15 nt, Streptococcus pneumoniae R6
uauggugcguuuuuu

SEQ ID NO: 4107239 - RNA, 18 nt, Streptococcus pneumoniae R6
uauguaaacaguaauaaa

SEQ ID NO: 4107240 - RNA, 20 nt, Streptococcus pneumoniae R6
uauguaugguuacugacuuc

SEQ ID NO: 4107241 - RNA, 12 nt, Streptococcus pneumoniae R6
uauguauuuaua

SEQ ID NO: 4107242 - RNA, 20 nt, Streptococcus pneumoniae R6
uaugucggcuucacauugcc

SEQ ID NO: 4107243 - RNA, 17 nt, Streptococcus pneumoniae R6
uaugucuagccaguauu

SEQ ID NO: 4107244 - RNA, 20 nt, Streptococcus pneumoniae R6
uaugucuagccaguauuuuu

SEQ ID NO: 4107245 - RNA, 18 nt, Streptococcus pneumoniae R6
uaugucugaauauauaau

SEQ ID NO: 4107246 - RNA, 19 nt, Streptococcus pneumoniae R6
uaugucugaauauauaauu

SEQ ID NO: 4107247 - RNA, 15 nt, Streptococcus pneumoniae R6
uaugugacugacuuc

SEQ ID NO: 4107248 - RNA, 19 nt, Streptococcus pneumoniae R6
uaugugcauaguauuuguu

SEQ ID NO: 4107249 - RNA, 18 nt, Streptococcus pneumoniae R6
uauguucaucuucuuucu

SEQ ID NO: 4107250 - RNA, 13 nt, Streptococcus pneumoniae R6
uauguugcaaauu

SEQ ID NO: 4107251 - RNA, 15 nt, Streptococcus pneumoniae R6
uauguugcgucagga

SEQ ID NO: 4107252 - RNA, 22 nt, Streptococcus pneumoniae R6
uauguuguaggugcuuauuuca

SEQ ID NO: 4107253 - RNA, 18 nt, Streptococcus pneumoniae R6
uauguuuuaaauaaacuu

SEQ ID NO: 4107254 - RNA, 23 nt, Streptococcus pneumoniae R6
uauuaaaauaaguucaacaaauc

SEQ ID NO: 4107255 - RNA, 16 nt, Streptococcus pneumoniae R6
uauuaacaaaagagcu

SEQ ID NO: 4107256 - RNA, 14 nt, Streptococcus pneumoniae R6
uauuaacaauaauc

SEQ ID NO: 4107257 - RNA, 21 nt, Streptococcus pneumoniae R6
uauuaacaauaaucuaugaua

SEQ ID NO: 4107258 - RNA, 20 nt, Streptococcus pneumoniae R6
uauuaacagcuaaagcaccu

SEQ ID NO: 4107259 - RNA, 13 nt, Streptococcus pneumoniae R6
uauuaagaaaaau

SEQ ID NO: 4107260 - RNA, 13 nt, Streptococcus pneumoniae R6
uauuaagccucuu

SEQ ID NO: 4107261 - RNA, 15 nt, Streptococcus pneumoniae R6
uauuaauauauaaaa

SEQ ID NO: 4107262 - RNA, 20 nt, Streptococcus pneumoniae R6
uauuaaucaccguccccaaa

SEQ ID NO: 4107263 - RNA, 14 nt, Streptococcus pneumoniae R6
uauuaaucacuaau

SEQ ID NO: 4107264 - RNA, 18 nt, Streptococcus pneumoniae R6
uauuaauuucauuacuaa

SEQ ID NO: 4107265 - RNA, 14 nt, Streptococcus pneumoniae R6
uauuacauccacca

SEQ ID NO: 4107266 - RNA, 17 nt, Streptococcus pneumoniae R6
uggcaagaucaaguuca

SEQ ID NO: 4107267 - RNA, 14 nt, Streptococcus pneumoniae R6
uggcaauaaacauc

SEQ ID NO: 4107268 - RNA, 20 nt, Streptococcus pneumoniae R6
uggcaauuuuacuucuuccc

SEQ ID NO: 4107269 - RNA, 23 nt, Streptococcus pneumoniae R6
uggcaauuuuacuucuuccccag

SEQ ID NO: 4107270 - RNA, 21 nt, Streptococcus pneumoniae R6
uggcaccgaauuuuucaagua

SEQ ID NO: 4107271 - RNA, 23 nt, Streptococcus pneumoniae R6
uggcagaggaggagcaguaugca

SEQ ID NO: 4107272 - RNA, 19 nt, Streptococcus pneumoniae R6
uggcagauagagacauaau

SEQ ID NO: 4107273 - RNA, 18 nt, Streptococcus pneumoniae R6
uggcaguucuugcucaau

SEQ ID NO: 4107274 - RNA, 13 nt, Streptococcus pneumoniae R6
uggcauaagucau

SEQ ID NO: 4107275 - RNA, 18 nt, Streptococcus pneumoniae R6
uggcaucugguuuuuccc

SEQ ID NO: 4107276 - RNA, 13 nt, Streptococcus pneumoniae R6
uggcauggaaagc

SEQ ID NO: 4107277 - RNA, 14 nt, Streptococcus pneumoniae R6
uggcauguccuagu

SEQ ID NO: 4107278 - RNA, 20 nt, Streptococcus pneumoniae R6
uggcauuccugcuccuccga

SEQ ID NO: 4107279 - RNA, 19 nt, Streptococcus pneumoniae R6
uggcauugaugaauugauu

SEQ ID NO: 4107280 - RNA, 13 nt, Streptococcus pneumoniae R6
uggcauugcuuca

SEQ ID NO: 4107281 - RNA, 18 nt, Streptococcus pneumoniae R6
uggcccgcuucgcuucca

SEQ ID NO: 4107282 - RNA, 22 nt, Streptococcus pneumoniae R6
uggcccgcuucgcuuccaaucu

SEQ ID NO: 4107283 - RNA, 17 nt, Streptococcus pneumoniae R6
uggcccuaccugcucca

SEQ ID NO: 4107284 - RNA, 15 nt, Streptococcus pneumoniae R6
uggccgaugauggua

SEQ ID NO: 4107285 - RNA, 18 nt, Streptococcus pneumoniae R6
uggccgcaagcagcuaaa

SEQ ID NO: 4107286 - RNA, 22 nt, Streptococcus pneumoniae R6
uggcgauuuuuuugauuucugg

SEQ ID NO: 4107287 - RNA, 20 nt, Streptococcus pneumoniae R6
uggcgcuucuacuccaagca

SEQ ID NO: 4107288 - RNA, 17 nt, Streptococcus pneumoniae R6
uggcgugggucaucaag

SEQ ID NO: 4107289 - RNA, 19 nt, Streptococcus pneumoniae R6
uggcguguuugucaaacau

SEQ ID NO: 4107290 - RNA, 13 nt, Streptococcus pneumoniae R6
uggcguuuuauuu

SEQ ID NO: 4107291 - RNA, 15 nt, Streptococcus pneumoniae R6
uggcuaaaaagcuac

SEQ ID NO: 4107292 - RNA, 20 nt, Streptococcus pneumoniae R6
uggcuacaagaacagucucu

SEQ ID NO: 4107293 - RNA, 17 nt, Streptococcus pneumoniae R6
uggcuacagaugcugca

SEQ ID NO: 4107294 - RNA, 17 nt, Streptococcus pneumoniae R6
uggcuaggcgcuucacu

SEQ ID NO: 4107295 - RNA, 18 nt, Streptococcus pneumoniae R6
uggcuaggcgcuucacua

SEQ ID NO: 4107296 - RNA, 21 nt, Streptococcus pneumoniae R6
uggcuaguaaauaucauuucc

SEQ ID NO: 4107297 - RNA, 23 nt, Streptococcus pneumoniae R6
uggcuauuaacgauugaaauaac

SEQ ID NO: 4107298 - RNA, 19 nt, Streptococcus pneumoniae R6
uggcuauuccaaguuccuc

SEQ ID NO: 4107299 - RNA, 18 nt, Streptococcus pneumoniae R6
uggcucaggacgaacgcu

SEQ ID NO: 4107300 - RNA, 21 nt, Streptococcus pneumoniae R6
uggcugccacaccaccugcca

SEQ ID NO: 4107301 - RNA, 17 nt, Streptococcus pneumoniae R6
uggcugguauuaagaac

SEQ ID NO: 4107302 - RNA, 19 nt, Streptococcus pneumoniae R6
uggcuuauuccaauugauu

SEQ ID NO: 4107303 - RNA, 19 nt, Streptococcus pneumoniae R6
uggcuuucacguuguucaa

SEQ ID NO: 4107304 - RNA, 21 nt, Streptococcus pneumoniae R6
uggcuuugagauauuucuucu

SEQ ID NO: 4107305 - RNA, 17 nt, Streptococcus pneumoniae R6
uggcuuugauucaucuc

SEQ ID NO: 4107306 - RNA, 16 nt, Streptococcus pneumoniae R6
ugggaaaccaaacgga

SEQ ID NO: 4107307 - RNA, 16 nt, Streptococcus pneumoniae R6
ugggaaauucuaauua

SEQ ID NO: 4107308 - RNA, 19 nt, Streptococcus pneumoniae R6
ugggaagaguugcuuguca

SEQ ID NO: 4107309 - RNA, 14 nt, Streptococcus pneumoniae R6
ugggaagaugaaga

SEQ ID NO: 4107310 - RNA, 15 nt, Streptococcus pneumoniae R6
ugggaagauguauaa

SEQ ID NO: 4107311 - RNA, 20 nt, Streptococcus pneumoniae R6
ugggaagauguauaauggau

SEQ ID NO: 4107312 - RNA, 17 nt, Streptococcus pneumoniae R6
ugggaaggaauagugga

SEQ ID NO: 4107313 - RNA, 15 nt, Streptococcus pneumoniae R6
ugggaauugguuuuu

SEQ ID NO: 4107314 - RNA, 17 nt, Streptococcus pneumoniae R6
ugggaauugguuuuuua

SEQ ID NO: 4107315 - RNA, 18 nt, Streptococcus pneumoniae R6
ugggacagaaaugcccaa

SEQ ID NO: 4107316 - RNA, 19 nt, Streptococcus pneumoniae R6
ugggaccuguccuaggucu

SEQ ID NO: 4107317 - RNA, 15 nt, Streptococcus pneumoniae R6
ugggacgauuuucaa

SEQ ID NO: 4107318 - RNA, 23 nt, Streptococcus pneumoniae R6
ugggacgauuuucaaaaagaagu

SEQ ID NO: 4107319 - RNA, 15 nt, Streptococcus pneumoniae R6
ugggaugacuuucca

SEQ ID NO: 4107320 - RNA, 19 nt, Streptococcus pneumoniae R6
ugggauggucacagaacca

SEQ ID NO: 4107321 - RNA, 23 nt, Streptococcus pneumoniae R6
ugggauuauuugccuaugaaaug

SEQ ID NO: 4107322 - RNA, 20 nt, Streptococcus pneumoniae R6
ugggcaaucgccaauucuuu

SEQ ID NO: 4107323 - RNA, 22 nt, Streptococcus pneumoniae R6
ugggcacgacgggcuuggaaau

SEQ ID NO: 4107324 - RNA, 14 nt, Streptococcus pneumoniae R6
ugggcacguacaga

SEQ ID NO: 4107325 - RNA, 13 nt, Streptococcus pneumoniae R6
ugggcagaaguuu

SEQ ID NO: 4107326 - RNA, 19 nt, Streptococcus pneumoniae R6
ugggccagauuuauggucu

SEQ ID NO: 4107327 - RNA, 14 nt, Streptococcus pneumoniae R6
ugggcuaauucucu

SEQ ID NO: 4107328 - RNA, 19 nt, Streptococcus pneumoniae R6
ugggcuggacguucuucaa

SEQ ID NO: 4107329 - RNA, 17 nt, Streptococcus pneumoniae R6
ugggcuuucauccaaga

SEQ ID NO: 4107330 - RNA, 18 nt, Streptococcus pneumoniae R6
uggggaucgguuagacca

SEQ ID NO: 4107331 - RNA, 22 nt, Streptococcus pneumoniae R6
uggggcaccauuuucagcccag

SEQ ID NO: 4107332 - RNA, 22 nt, Streptococcus pneumoniae R6
uggggcgauaggauugacaaaa

SEQ ID NO: 4107333 - RNA, 18 nt, Streptococcus pneumoniae R6
ugggguugagaaguggga

SEQ ID NO: 4107334 - RNA, 15 nt, Streptococcus pneumoniae R6
ugggguuucaucccu

SEQ ID NO: 4107335 - RNA, 22 nt, Streptococcus pneumoniae R6
uggguagcauagucgaaggcuu

SEQ ID NO: 4107336 - RNA, 22 nt, Streptococcus pneumoniae R6
uggguaggcgaaaagcuacaau

SEQ ID NO: 4107337 - RNA, 15 nt, Streptococcus pneumoniae R6
uggguauauaagcuu

SEQ ID NO: 4107338 - RNA, 21 nt, Streptococcus pneumoniae R6
ugggucuguuuuugaagaaaa

SEQ ID NO: 4107339 - RNA, 19 nt, Streptococcus pneumoniae R6
uggguuaaaauuuuaucuu

SEQ ID NO: 4107340 - RNA, 14 nt, Streptococcus pneumoniae R6
uggguuaagugcau

SEQ ID NO: 4107341 - RNA, 14 nt, Streptococcus pneumoniae R6
uggguugaggccga

SEQ ID NO: 4107342 - RNA, 22 nt, Streptococcus pneumoniae R6
uggguuuuaaagccgacccagg

SEQ ID NO: 4107343 - RNA, 11 nt, Streptococcus pneumoniae R6
ugguaaagaau

SEQ ID NO: 4107344 - RNA, 13 nt, Streptococcus pneumoniae R6
ugguaaagacucu

SEQ ID NO: 4107345 - RNA, 14 nt, Streptococcus pneumoniae R6
ugguaaagacucuu

SEQ ID NO: 4107346 - RNA, 15 nt, Streptococcus pneumoniae R6
ugguaaagaggaaau

SEQ ID NO: 4107347 - RNA, 18 nt, Streptococcus pneumoniae R6
ugguaaugcuuuccauua

SEQ ID NO: 4107348 - RNA, 15 nt, Streptococcus pneumoniae R6
ugguaauguucuucg

SEQ ID NO: 4107349 - RNA, 14 nt, Streptococcus pneumoniae R6
ugguacuauuuaau

SEQ ID NO: 4107350 - RNA, 21 nt, Streptococcus pneumoniae R6
ugguagaaagucuuuaacauc

SEQ ID NO: 4107351 - RNA, 16 nt, Streptococcus pneumoniae R6
ugguaggcuuuaucaa

SEQ ID NO: 4107352 - RNA, 12 nt, Streptococcus pneumoniae R6
ugguaguugagc

SEQ ID NO: 4107353 - RNA, 15 nt, Streptococcus pneumoniae R6
ugguauguguauucg

SEQ ID NO: 4107354 - RNA, 14 nt, Streptococcus pneumoniae R6
ugguauuaauaauu

SEQ ID NO: 4107355 - RNA, 19 nt, Streptococcus pneumoniae R6
ugguauugguugugaaggu

SEQ ID NO: 4107356 - RNA, 13 nt, Streptococcus pneumoniae R6
ugguauuuagauu

SEQ ID NO: 4107357 - RNA, 14 nt, Streptococcus pneumoniae R6
uggucacagaacca

SEQ ID NO: 4107358 - RNA, 13 nt, Streptococcus pneumoniae R6
uggucaggcuagg

SEQ ID NO: 4107359 - RNA, 16 nt, Streptococcus pneumoniae R6
uggucauggucugauu

SEQ ID NO: 4107360 - RNA, 23 nt, Streptococcus pneumoniae R6
ugguccaaguggaauucauuuuc

SEQ ID NO: 4107361 - RNA, 14 nt, Streptococcus pneumoniae R6
uggucgauaucuuc

SEQ ID NO: 4107362 - RNA, 14 nt, Streptococcus pneumoniae R6
uggucgcuuccaau

SEQ ID NO: 4107363 - RNA, 22 nt, Streptococcus pneumoniae R6
uggucguaucuggugugaugau

SEQ ID NO: 4107364 - RNA, 14 nt, Streptococcus pneumoniae R6
uggucuagcaagag

SEQ ID NO: 4107365 - RNA, 12 nt, Streptococcus pneumoniae R6
uggucugauuga

SEQ ID NO: 4107366 - RNA, 16 nt, Streptococcus pneumoniae R6
uggucuggauguucug

SEQ ID NO: 4107367 - RNA, 21 nt, Streptococcus pneumoniae R6
uggucuuauuucauuucacua

SEQ ID NO: 4107368 - RNA, 16 nt, Streptococcus pneumoniae R6
uuucagcauauuuccc

SEQ ID NO: 4107369 - RNA, 17 nt, Streptococcus pneumoniae R6
uuucagcauauuuccca

SEQ ID NO: 4107370 - RNA, 19 nt, Streptococcus pneumoniae R6
uuucagcgaccaucauuuu

SEQ ID NO: 4107371 - RNA, 17 nt, Streptococcus pneumoniae R6
uuucagcgauuuccuug

SEQ ID NO: 4107372 - RNA, 17 nt, Streptococcus pneumoniae R6
uuucaggagaaaaugga

SEQ ID NO: 4107373 - RNA, 16 nt, Streptococcus pneumoniae R6
uuucagguguuucuau

SEQ ID NO: 4107374 - RNA, 21 nt, Streptococcus pneumoniae R6
uuucagguguuucuaucacgg

SEQ ID NO: 4107375 - RNA, 18 nt, Streptococcus pneumoniae R6
uuucauaaaguuuucuga

SEQ ID NO: 4107376 - RNA, 15 nt, Streptococcus pneumoniae R6
uuucauaacuacagu

SEQ ID NO: 4107377 - RNA, 14 nt, Streptococcus pneumoniae R6
uuucauaauuucuu

SEQ ID NO: 4107378 - RNA, 23 nt, Streptococcus pneumoniae R6
uuucauaauuuuuuucauagaaa

SEQ ID NO: 4107379 - RNA, 16 nt, Streptococcus pneumoniae R6
uuucauacgauaaaaa

SEQ ID NO: 4107380 - RNA, 14 nt, Streptococcus pneumoniae R6
uuucauauuuucag

SEQ ID NO: 4107381 - RNA, 18 nt, Streptococcus pneumoniae R6
uuucauauuuucagauaa

SEQ ID NO: 4107382 - RNA, 19 nt, Streptococcus pneumoniae R6
uuucauccacaaccucaaa

SEQ ID NO: 4107383 - RNA, 23 nt, Streptococcus pneumoniae R6
uuucaucuuuuucggcuuuagca

SEQ ID NO: 4107384 - RNA, 21 nt, Streptococcus pneumoniae R6
uuucauggcaaauucaccaau

SEQ ID NO: 4107385 - RNA, 23 nt, Streptococcus pneumoniae R6
uuucauguaagaguucuucccac

SEQ ID NO: 4107386 - RNA, 14 nt, Streptococcus pneumoniae R6
uuucauguauucca

SEQ ID NO: 4107387 - RNA, 18 nt, Streptococcus pneumoniae R6
uuucauuacagaacauuu

SEQ ID NO: 4107388 - RNA, 23 nt, Streptococcus pneumoniae R6
uuucauuacagaacauuuuaauu

SEQ ID NO: 4107389 - RNA, 22 nt, Streptococcus pneumoniae R6
uuucauuccaucauaaaaauaa

SEQ ID NO: 4107390 - RNA, 16 nt, Streptococcus pneumoniae R6
uuucauuccaugaaaa

SEQ ID NO: 4107391 - RNA, 21 nt, Streptococcus pneumoniae R6
uuucauugaguauaagauaca

SEQ ID NO: 4107392 - RNA, 22 nt, Streptococcus pneumoniae R6
uuucauugaguauuacuucauu

SEQ ID NO: 4107393 - RNA, 17 nt, Streptococcus pneumoniae R6
uuucauugaguauuauu

SEQ ID NO: 4107394 - RNA, 21 nt, Streptococcus pneumoniae R6
uuucauugaguauuauuucau

SEQ ID NO: 4107395 - RNA, 13 nt, Streptococcus pneumoniae R6
uuucauugaguuu

SEQ ID NO: 4107396 - RNA, 20 nt, Streptococcus pneumoniae R6
uuucauuuaauauauuuauu

SEQ ID NO: 4107397 - RNA, 21 nt, Streptococcus pneumoniae R6
uuucauuucgacugaaaauau

SEQ ID NO: 4107398 - RNA, 20 nt, Streptococcus pneumoniae R6
uuucauuuucuacuccuuuu

SEQ ID NO: 4107399 - RNA, 14 nt, Streptococcus pneumoniae R6
uuuccaaacauaca

SEQ ID NO: 4107400 - RNA, 16 nt, Streptococcus pneumoniae R6
uuuccaacgauuuuau

SEQ ID NO: 4107401 - RNA, 17 nt, Streptococcus pneumoniae R6
uuuccaacucagccaua

SEQ ID NO: 4107402 - RNA, 13 nt, Streptococcus pneumoniae R6
uuuccaagaucuu

SEQ ID NO: 4107403 - RNA, 18 nt, Streptococcus pneumoniae R6
uuuccaaucuucuccagu

SEQ ID NO: 4107404 - RNA, 15 nt, Streptococcus pneumoniae R6
uuuccaccuucuuug

SEQ ID NO: 4107405 - RNA, 14 nt, Streptococcus pneumoniae R6
uuuccagaacuuca

SEQ ID NO: 4107406 - RNA, 20 nt, Streptococcus pneumoniae R6
uuuccagccuucauuuuaca

SEQ ID NO: 4107407 - RNA, 22 nt, Streptococcus pneumoniae R6
uuuccagcguugcgauuuuugu

SEQ ID NO: 4107408 - RNA, 16 nt, Streptococcus pneumoniae R6
uuuccagcuuuuucuu

SEQ ID NO: 4107409 - RNA, 19 nt, Streptococcus pneumoniae R6
uuuccaguaauuucccauu

SEQ ID NO: 4107410 - RNA, 16 nt, Streptococcus pneumoniae R6
uuuccauaccaaagua

SEQ ID NO: 4107411 - RNA, 14 nt, Streptococcus pneumoniae R6
uuuccauucaaauu

SEQ ID NO: 4107412 - RNA, 16 nt, Streptococcus pneumoniae R6
uuuccauuuacagaag

SEQ ID NO: 4107413 - RNA, 13 nt, Streptococcus pneumoniae R6
uuuccauuucuuu

SEQ ID NO: 4107414 - RNA, 17 nt, Streptococcus pneumoniae R6
uuuccauuucuuuucug

SEQ ID NO: 4107415 - RNA, 13 nt, Streptococcus pneumoniae R6
uuucccaccuuuu

SEQ ID NO: 4107416 - RNA, 15 nt, Streptococcus pneumoniae R6
uuucccaccuuuucu

SEQ ID NO: 4107417 - RNA, 17 nt, Streptococcus pneumoniae R6
uuucccagccuucagcc

SEQ ID NO: 4107418 - RNA, 20 nt, Streptococcus pneumoniae R6
uuucccuaauaauacaaaaa

SEQ ID NO: 4107419 - RNA, 21 nt, Streptococcus pneumoniae R6
uuucccuaauaauacaaaaaa

SEQ ID NO: 4107420 - RNA, 20 nt, Streptococcus pneumoniae R6
uuucccuuugauagcaucuu

SEQ ID NO: 4107421 - RNA, 16 nt, Streptococcus pneumoniae R6
uuuccguucucaaagc

SEQ ID NO: 4107422 - RNA, 18 nt, Streptococcus pneumoniae R6
uuuccguucucaaagcgu

SEQ ID NO: 4107423 - RNA, 13 nt, Streptococcus pneumoniae R6
uuuccuaauucuu

SEQ ID NO: 4107424 - RNA, 14 nt, Streptococcus pneumoniae R6
uuuccuacaaugau

SEQ ID NO: 4107425 - RNA, 17 nt, Streptococcus pneumoniae R6
uuuccuagauuacaaaa

SEQ ID NO: 4107426 - RNA, 17 nt, Streptococcus pneumoniae R6
uuuccucauuuucuagu

SEQ ID NO: 4107427 - RNA, 21 nt, Streptococcus pneumoniae R6
uuuccuccgauaauuauuuuu

SEQ ID NO: 4107428 - RNA, 18 nt, Streptococcus pneumoniae R6
uuuccucgauuuguuuuu

SEQ ID NO: 4107429 - RNA, 21 nt, Streptococcus pneumoniae R6
uuuccucgguuagcuccagaa

SEQ ID NO: 4107430 - RNA, 21 nt, Streptococcus pneumoniae R6
uuuccugaagucgaguuuuuu

SEQ ID NO: 4107431 - RNA, 16 nt, Streptococcus pneumoniae R6
uuuccugauuuugugc

SEQ ID NO: 4107432 - RNA, 17 nt, Streptococcus pneumoniae R6
uuuccuguuguauuuau

SEQ ID NO: 4107433 - RNA, 14 nt, Streptococcus pneumoniae R6
uuuccuucaucaaa

SEQ ID NO: 4107434 - RNA, 15 nt, Streptococcus pneumoniae R6
uuuccuucauuucca

SEQ ID NO: 4107435 - RNA, 20 nt, Streptococcus pneumoniae R6
uuuccuugaccaaguccuca

SEQ ID NO: 4107436 - RNA, 22 nt, Streptococcus pneumoniae R6
uuuccuugaccaaguccucaau

SEQ ID NO: 4107437 - RNA, 21 nt, Streptococcus pneumoniae R6
uuuccuugagcgaauccuuga

SEQ ID NO: 4107438 - RNA, 12 nt, Streptococcus pneumoniae R6
uuuccuuucaaa

SEQ ID NO: 4107439 - RNA, 21 nt, Streptococcus pneumoniae R6
uuuccuuucaauguuucgugu

SEQ ID NO: 4107440 - RNA, 17 nt, Streptococcus pneumoniae R6
uuucgagccaauacugc

SEQ ID NO: 4107441 - RNA, 16 nt, Streptococcus pneumoniae R6
uuucgaguaacaucaa

SEQ ID NO: 4107442 - RNA, 14 nt, Streptococcus pneumoniae R6
uuucgauaaaguag

SEQ ID NO: 4107443 - RNA, 22 nt, Streptococcus pneumoniae R6
uuucgauaucguuauuagcauc

SEQ ID NO: 4107444 - RNA, 13 nt, Streptococcus pneumoniae R6
uuucgcauuugag

SEQ ID NO: 4107445 - RNA, 20 nt, Streptococcus pneumoniae R6
uuucgcgauugauuuccaaa

SEQ ID NO: 4107446 - RNA, 14 nt, Streptococcus pneumoniae R6
uuucguacauaguu

SEQ ID NO: 4107447 - RNA, 18 nt, Streptococcus pneumoniae R6
uuucguauaccauaauaa

SEQ ID NO: 4107448 - RNA, 21 nt, Streptococcus pneumoniae R6
uuucguauggcaagaucaagu

SEQ ID NO: 4107449 - RNA, 13 nt, Streptococcus pneumoniae R6
uuucgucaccaaa

SEQ ID NO: 4107450 - RNA, 18 nt, Streptococcus pneumoniae R6
uuucguguuuggauuauu

SEQ ID NO: 4107451 - RNA, 14 nt, Streptococcus pneumoniae R6
uuucguuccagacu

SEQ ID NO: 4107452 - RNA, 20 nt, Streptococcus pneumoniae R6
uuucuaaacaauguucucau

SEQ ID NO: 4107453 - RNA, 22 nt, Streptococcus pneumoniae R6
uuucuaaagaauuugaaaaaaa

SEQ ID NO: 4107454 - RNA, 12 nt, Streptococcus pneumoniae R6
uuucuaaagagu

SEQ ID NO: 4107455 - RNA, 17 nt, Streptococcus pneumoniae R6
uuucuaaagcaauuuug

SEQ ID NO: 4107456 - RNA, 18 nt, Streptococcus pneumoniae R6
uuucuaaagcaauuuuga

SEQ ID NO: 4107457 - RNA, 16 nt, Streptococcus pneumoniae R6
uuucuaagcuaccucu

SEQ ID NO: 4107458 - RNA, 18 nt, Streptococcus pneumoniae R6
uuucuaaggagaauucua

SEQ ID NO: 4107459 - RNA, 13 nt, Streptococcus pneumoniae R6
uuucuaauaauuu

SEQ ID NO: 4107460 - RNA, 18 nt, Streptococcus pneumoniae R6
uuucuaauaauuuuaacu

SEQ ID NO: 4107461 - RNA, 22 nt, Streptococcus pneumoniae R6
uuucuaauuaaaucauccauau

SEQ ID NO: 4107462 - RNA, 13 nt, Streptococcus pneumoniae R6
uuucuacuaaaau

SEQ ID NO: 4107463 - RNA, 15 nt, Streptococcus pneumoniae R6
uuucuacuaaaauua

SEQ ID NO: 4107464 - RNA, 18 nt, Streptococcus pneumoniae R6
uuucuacuguauacuuuu

SEQ ID NO: 4107465 - RNA, 22 nt, Streptococcus pneumoniae R6
uuucuagccccucggauuuuau

SEQ ID NO: 4107466 - RNA, 19 nt, Streptococcus pneumoniae R6
uuucuaguccaacuguaaa

SEQ ID NO: 4107467 - RNA, 17 nt, Streptococcus pneumoniae R6
uuucuaguuuacucuuu

SEQ ID NO: 4107468 - RNA, 21 nt, Streptococcus pneumoniae R6
uuucuaguuuugguuuuucuu

SEQ ID NO: 4107469 - RNA, 16 nt, Streptococcus pneumoniae R6
uuucuauacuuuuucu

SEQ ID NO: 4107470 - RNA, 13 nt, Streptococcus pneumoniae R6
uuugauuuuaaau

SEQ ID NO: 4107471 - RNA, 14 nt, Streptococcus pneumoniae R6
uuugauuuuuauug

SEQ ID NO: 4107472 - RNA, 23 nt, Streptococcus pneumoniae R6
uuugcaaagaugaugauaacgaa

SEQ ID NO: 4107473 - RNA, 19 nt, Streptococcus pneumoniae R6
uuugcaacuggagacuuuc

SEQ ID NO: 4107474 - RNA, 21 nt, Streptococcus pneumoniae R6
uuugcaagagcgguuaauuua

SEQ ID NO: 4107475 - RNA, 21 nt, Streptococcus pneumoniae R6
uuugcaaucauuucaaagccu

SEQ ID NO: 4107476 - RNA, 13 nt, Streptococcus pneumoniae R6
uuugcagcaccag

SEQ ID NO: 4107477 - RNA, 14 nt, Streptococcus pneumoniae R6
uuugcaggcuguuu

SEQ ID NO: 4107478 - RNA, 15 nt, Streptococcus pneumoniae R6
uuugccuaaaauuca

SEQ ID NO: 4107479 - RNA, 22 nt, Streptococcus pneumoniae R6
uuugcgaccguggaguacuucu

SEQ ID NO: 4107480 - RNA, 18 nt, Streptococcus pneumoniae R6
uuugcgcuagauccuuuu

SEQ ID NO: 4107481 - RNA, 14 nt, Streptococcus pneumoniae R6
uuugcuaaucaaaa

SEQ ID NO: 4107482 - RNA, 20 nt, Streptococcus pneumoniae R6
uuugcucgcuggagagacuu

SEQ ID NO: 4107483 - RNA, 14 nt, Streptococcus pneumoniae R6
uuugcucuuugauu

SEQ ID NO: 4107484 - RNA, 19 nt, Streptococcus pneumoniae R6
uuugcucuuugauuuuuau

SEQ ID NO: 4107485 - RNA, 20 nt, Streptococcus pneumoniae R6
uuugcugacuugccuucaac

SEQ ID NO: 4107486 - RNA, 22 nt, Streptococcus pneumoniae R6
uuugcuuaaauaaaauuuuuuu

SEQ ID NO: 4107487 - RNA, 13 nt, Streptococcus pneumoniae R6
uuugcuuuuugau

SEQ ID NO: 4107488 - RNA, 14 nt, Streptococcus pneumoniae R6
uuugcuuuuugauu

SEQ ID NO: 4107489 - RNA, 15 nt, Streptococcus pneumoniae R6
uuuggaaaauaguuu

SEQ ID NO: 4107490 - RNA, 22 nt, Streptococcus pneumoniae R6
uuuggaagucaaaucaauuuuu

SEQ ID NO: 4107491 - RNA, 23 nt, Streptococcus pneumoniae R6
uuuggaauguugcugaaauggug

SEQ ID NO: 4107492 - RNA, 18 nt, Streptococcus pneumoniae R6
uuuggacucacuaaaauu

SEQ ID NO: 4107493 - RNA, 15 nt, Streptococcus pneumoniae R6
uuuggauuauuaccu

SEQ ID NO: 4107494 - RNA, 14 nt, Streptococcus pneumoniae R6
uuuggauuuuguuu

SEQ ID NO: 4107495 - RNA, 19 nt, Streptococcus pneumoniae R6
uuuggccaagguucauuuc

SEQ ID NO: 4107496 - RNA, 17 nt, Streptococcus pneumoniae R6
uuuggcgaugauuuccu

SEQ ID NO: 4107497 - RNA, 22 nt, Streptococcus pneumoniae R6
uuuggcuaggcgcuucacuagu

SEQ ID NO: 4107498 - RNA, 22 nt, Streptococcus pneumoniae R6
uuuggcuauaauuauucugcaa

SEQ ID NO: 4107499 - RNA, 13 nt, Streptococcus pneumoniae R6
uuugggaauuggu

SEQ ID NO: 4107500 - RNA, 21 nt, Streptococcus pneumoniae R6
uuugggucuguuuuugaagaa

SEQ ID NO: 4107501 - RNA, 14 nt, Streptococcus pneumoniae R6
uuugguaagauuca

SEQ ID NO: 4107502 - RNA, 15 nt, Streptococcus pneumoniae R6
uuugguaugaaauag

SEQ ID NO: 4107503 - RNA, 19 nt, Streptococcus pneumoniae R6
uuuggucagcuucuugcau

SEQ ID NO: 4107504 - RNA, 19 nt, Streptococcus pneumoniae R6
uuugguugcuacaucuucu

SEQ ID NO: 4107505 - RNA, 18 nt, Streptococcus pneumoniae R6
uuuguaggccacaaaugc

SEQ ID NO: 4107506 - RNA, 18 nt, Streptococcus pneumoniae R6
uuuguauauuuuucaaau

SEQ ID NO: 4107507 - RNA, 22 nt, Streptococcus pneumoniae R6
uuuguaucaccaagcauuuuca

SEQ ID NO: 4107508 - RNA, 12 nt, Streptococcus pneumoniae R6
uuuguauuccac

SEQ ID NO: 4107509 - RNA, 17 nt, Streptococcus pneumoniae R6
uuugucacacaaaaaag

SEQ ID NO: 4107510 - RNA, 20 nt, Streptococcus pneumoniae R6
uuugucaguaaaaaaaacau

SEQ ID NO: 4107511 - RNA, 21 nt, Streptococcus pneumoniae R6
uuuguccauuaugauauauag

SEQ ID NO: 4107512 - RNA, 21 nt, Streptococcus pneumoniae R6
uuuguccuauucuuauuucau

SEQ ID NO: 4107513 - RNA, 21 nt, Streptococcus pneumoniae R6
uuuguccuggucuuauuucau

SEQ ID NO: 4107514 - RNA, 21 nt, Streptococcus pneumoniae R6
uuuguccuguucuuauuucau

SEQ ID NO: 4107515 - RNA, 14 nt, Streptococcus pneumoniae R6
uuugugaaucauca

SEQ ID NO: 4107516 - RNA, 21 nt, Streptococcus pneumoniae R6
uuuguuaccaauacaggaaaa

SEQ ID NO: 4107517 - RNA, 18 nt, Streptococcus pneumoniae R6
uuuguuagauuuauaauu

SEQ ID NO: 4107518 - RNA, 19 nt, Streptococcus pneumoniae R6
uuuguuaguuuaaaauuac

SEQ ID NO: 4107519 - RNA, 20 nt, Streptococcus pneumoniae R6
uuuguucauaucuuauuuca

SEQ ID NO: 4107520 - RNA, 13 nt, Streptococcus pneumoniae R6
uuuguucccaagg

SEQ ID NO: 4107521 - RNA, 16 nt, Streptococcus pneumoniae R6
uuuguuccgauuuuau

SEQ ID NO: 4107522 - RNA, 20 nt, Streptococcus pneumoniae R6
uuuguuccgauuuuauuuca

SEQ ID NO: 4107523 - RNA, 21 nt, Streptococcus pneumoniae R6
uuuguuccgauuuuauuucau

SEQ ID NO: 4107524 - RNA, 21 nt, Streptococcus pneumoniae R6
uuuguucgcaucuuauuucaa

SEQ ID NO: 4107525 - RNA, 17 nt, Streptococcus pneumoniae R6
uuuguucguauccuauu

SEQ ID NO: 4107526 - RNA, 21 nt, Streptococcus pneumoniae R6
uuuguucucaucuuauuucaa

SEQ ID NO: 4107527 - RNA, 13 nt, Streptococcus pneumoniae R6
uuuguucugaaag

SEQ ID NO: 4107528 - RNA, 13 nt, Streptococcus pneumoniae R6
uuuguucuuuuuc

SEQ ID NO: 4107529 - RNA, 20 nt, Streptococcus pneumoniae R6
uuuguuuauaucuuauuuca

SEQ ID NO: 4107530 - RNA, 18 nt, Streptococcus pneumoniae R6
uuuguuucaagcuugccu

SEQ ID NO: 4107531 - RNA, 17 nt, Streptococcus pneumoniae R6
uuuguuucaauauacua

SEQ ID NO: 4107532 - RNA, 14 nt, Streptococcus pneumoniae R6
uuuguuucuuaauc

SEQ ID NO: 4107533 - RNA, 13 nt, Streptococcus pneumoniae R6
uuuguuuucaagu

SEQ ID NO: 4107534 - RNA, 14 nt, Streptococcus pneumoniae R6
uuuguuuucaagug

SEQ ID NO: 4107535 - RNA, 16 nt, Streptococcus pneumoniae R6
uuuuaaaaaaucuuuu

SEQ ID NO: 4107536 - RNA, 12 nt, Streptococcus pneumoniae R6
uuuuaaaaugcc

SEQ ID NO: 4107537 - RNA, 21 nt, Streptococcus pneumoniae R6
uuuuaaagaaauagaaaacaa

SEQ ID NO: 4107538 - RNA, 14 nt, Streptococcus pneumoniae R6
uuuuaaccagaucu

SEQ ID NO: 4107539 - RNA, 13 nt, Streptococcus pneumoniae R6
uuuuaacugucua

SEQ ID NO: 4107540 - RNA, 14 nt, Streptococcus pneumoniae R6
uuuuaagauuuuac

SEQ ID NO: 4107541 - RNA, 22 nt, Streptococcus pneumoniae R6
uuuuaagguugcagauagaacu

SEQ ID NO: 4107542 - RNA, 14 nt, Streptococcus pneumoniae R6
uuuuaauauauaaa

SEQ ID NO: 4107543 - RNA, 19 nt, Streptococcus pneumoniae R6
uuuuaaucgauuauuuuuu

SEQ ID NO: 4107544 - RNA, 17 nt, Streptococcus pneumoniae R6
uuuuaauuuaauccacu

SEQ ID NO: 4107545 - RNA, 23 nt, Streptococcus pneumoniae R6
uuuuacagaguacuaaauauaag

SEQ ID NO: 4107546 - RNA, 12 nt, Streptococcus pneumoniae R6
uuuuacaggaau

SEQ ID NO: 4107547 - RNA, 19 nt, Streptococcus pneumoniae R6
uuuuacaucuguuuuaaac

SEQ ID NO: 4107548 - RNA, 18 nt, Streptococcus pneumoniae R6
uuuuaccacuaaacuaca

SEQ ID NO: 4107549 - RNA, 13 nt, Streptococcus pneumoniae R6
uuuuacuaaaaua

SEQ ID NO: 4107550 - RNA, 22 nt, Streptococcus pneumoniae R6
uuuuacuaugggaagauuuacu

SEQ ID NO: 4107551 - RNA, 15 nt, Streptococcus pneumoniae R6
uuuuacuucugaagu

SEQ ID NO: 4107552 - RNA, 14 nt, Streptococcus pneumoniae R6
uuuuacuucuuugg

SEQ ID NO: 4107553 - RNA, 13 nt, Streptococcus pneumoniae R6
uuuuacuuuggca

SEQ ID NO: 4107554 - RNA, 15 nt, Streptococcus pneumoniae R6
uuuuagaacucuauu

SEQ ID NO: 4107555 - RNA, 17 nt, Streptococcus pneumoniae R6
uuuuagaaggauaaauu

SEQ ID NO: 4107556 - RNA, 13 nt, Streptococcus pneumoniae R6
uuuuagauuuuuu

SEQ ID NO: 4107557 - RNA, 20 nt, Streptococcus pneumoniae R6
uuuuagcaaucgcaaucuac

SEQ ID NO: 4107558 - RNA, 15 nt, Streptococcus pneumoniae R6
uuuuagcaauuguuu

SEQ ID NO: 4107559 - RNA, 15 nt, Streptococcus pneumoniae R6
uuuuaggaauauuau

SEQ ID NO: 4107560 - RNA, 16 nt, Streptococcus pneumoniae R6
uuuuagggaaaugaaa

SEQ ID NO: 4107561 - RNA, 11 nt, Streptococcus pneumoniae R6
uuuuaguagaa

SEQ ID NO: 4107562 - RNA, 16 nt, Streptococcus pneumoniae R6
uuuuaguagaaaauga

SEQ ID NO: 4107563 - RNA, 15 nt, Streptococcus pneumoniae R6
uuuuagucucuaaau

SEQ ID NO: 4107564 - RNA, 14 nt, Streptococcus pneumoniae R6
uuuuaguucagaau

SEQ ID NO: 4107565 - RNA, 12 nt, Streptococcus pneumoniae R6
uuuuaguuuuau

SEQ ID NO: 4107566 - RNA, 18 nt, Streptococcus pneumoniae R6
uuuuauaauguauugaau

SEQ ID NO: 4107567 - RNA, 20 nt, Streptococcus pneumoniae R6
uuuuauacucaaugaaaauc

SEQ ID NO: 4107568 - RNA, 19 nt, Streptococcus pneumoniae R6
uuuuauagaauauauuucu

SEQ ID NO: 4107569 - RNA, 15 nt, Streptococcus pneumoniae R6
uuuuauauaaaauaa

SEQ ID NO: 4107570 - RNA, 17 nt, Streptococcus pneumoniae R6
uuuuauauaaaauaauu

SEQ ID NO: 4107571 - RNA, 11 nt, Streptococcus pneumoniae R6
uuuuaucaaag

SEQ ID NO: 4107572 - RNA, 14 nt, Streptococcus pneumoniae R6
uuuuaucauagaaa

SEQ ID NO: 4107573 - RNA, 21 nt, Streptococcus pneumoniae R6
uuuugcccuuuuugaaaaacu

SEQ ID NO: 4107574 - RNA, 15 nt, Streptococcus pneumoniae R6
uuuugcuaaucaaaa

SEQ ID NO: 4107575 - RNA, 23 nt, Streptococcus pneumoniae R6
uuuugcuguccucaaaaugaaaa

SEQ ID NO: 4107576 - RNA, 20 nt, Streptococcus pneumoniae R6
uuuugcuuaaauaaaauuuu

SEQ ID NO: 4107577 - RNA, 18 nt, Streptococcus pneumoniae R6
uuuuggauaauauccaca

SEQ ID NO: 4107578 - RNA, 18 nt, Streptococcus pneumoniae R6
uuuuggcuaguucccuau

SEQ ID NO: 4107579 - RNA, 21 nt, Streptococcus pneumoniae R6
uuuugguugcaccaagucaua

SEQ ID NO: 4107580 - RNA, 19 nt, Streptococcus pneumoniae R6
uuuuguaaucuaggaaaac

SEQ ID NO: 4107581 - RNA, 13 nt, Streptococcus pneumoniae R6
uuuuguagggcug

SEQ ID NO: 4107582 - RNA, 22 nt, Streptococcus pneumoniae R6
uuuuguauuauuagggaaacaa

SEQ ID NO: 4107583 - RNA, 16 nt, Streptococcus pneumoniae R6
uuuuguauuucuucuu

SEQ ID NO: 4107584 - RNA, 20 nt, Streptococcus pneumoniae R6
uuuuguauuuugaauauacc

SEQ ID NO: 4107585 - RNA, 20 nt, Streptococcus pneumoniae R6
uuuugucucugaaaacaagu

SEQ ID NO: 4107586 - RNA, 14 nt, Streptococcus pneumoniae R6
uuuugugauuuuaa

SEQ ID NO: 4107587 - RNA, 15 nt, Streptococcus pneumoniae R6
uuuuguucaaaauua

SEQ ID NO: 4107588 - RNA, 20 nt, Streptococcus pneumoniae R6
uuuuguucaaaauuaagaua

SEQ ID NO: 4107589 - RNA, 21 nt, Streptococcus pneumoniae R6
uuuuguucuuuuucaaaagcu

SEQ ID NO: 4107590 - RNA, 21 nt, Streptococcus pneumoniae R6
uuuuguugacuuguacucaau

SEQ ID NO: 4107591 - RNA, 16 nt, Streptococcus pneumoniae R6
uuuuguuuaauacuca

SEQ ID NO: 4107592 - RNA, 18 nt, Streptococcus pneumoniae R6
uuuuguuuccaguuaucu

SEQ ID NO: 4107593 - RNA, 13 nt, Streptococcus pneumoniae R6
uuuuuaaaaaauc

SEQ ID NO: 4107594 - RNA, 17 nt, Streptococcus pneumoniae R6
uuuuuaagauuuuaccu

SEQ ID NO: 4107595 - RNA, 14 nt, Streptococcus pneumoniae R6
uuuuuaaucauaca

SEQ ID NO: 4107596 - RNA, 16 nt, Streptococcus pneumoniae R6
uuuuuacaauuguaaa

SEQ ID NO: 4107597 - RNA, 16 nt, Streptococcus pneumoniae R6
uuuuuacaguauuuau

SEQ ID NO: 4107598 - RNA, 16 nt, Streptococcus pneumoniae R6
uuuuuagaaggauaaa

SEQ ID NO: 4107599 - RNA, 14 nt, Streptococcus pneumoniae R6
uuuuuagcuucuuu

SEQ ID NO: 4107600 - RNA, 17 nt, Streptococcus pneumoniae R6
uuuuuauaacaguauac

SEQ ID NO: 4107601 - RNA, 22 nt, Streptococcus pneumoniae R6
uuuuuauacucaaugaaaauca

SEQ ID NO: 4107602 - RNA, 12 nt, Streptococcus pneumoniae R6
uuuuuaucccga

SEQ ID NO: 4107603 - RNA, 23 nt, Streptococcus pneumoniae R6
uuuuuaucuagcucccuuaguuc

SEQ ID NO: 4107604 - RNA, 11 nt, Streptococcus pneumoniae R6
uuuuuaugaua

SEQ ID NO: 4107605 - RNA, 13 nt, Streptococcus pneumoniae R6
uuuuucaaaaacc

SEQ ID NO: 4107606 - RNA, 22 nt, Streptococcus pneumoniae R6
uuuuucaacagcuccuucaagu

SEQ ID NO: 4107607 - RNA, 15 nt, Streptococcus pneumoniae R6
uuuuucaagcauuuu

SEQ ID NO: 4107608 - RNA, 22 nt, Streptococcus pneumoniae R6
uuuuucaaggugaaguucacgu

SEQ ID NO: 4107609 - RNA, 17 nt, Streptococcus pneumoniae R6
uuuuucaaucaauguca

SEQ ID NO: 4107610 - RNA, 21 nt, Streptococcus pneumoniae R6
uuuuucacuagagagcuuucu

SEQ ID NO: 4107611 - RNA, 20 nt, Streptococcus pneumoniae R6
uuuuucagcuggcuccuucu

SEQ ID NO: 4107612 - RNA, 12 nt, Streptococcus pneumoniae R6
uuuuuccagcuu

SEQ ID NO: 4107613 - RNA, 22 nt, Streptococcus pneumoniae R6
uuuuuccugaagucgaguuuuu

SEQ ID NO: 4107614 - RNA, 18 nt, Streptococcus pneumoniae R6
uuuuuccuucaucaaagc

SEQ ID NO: 4107615 - RNA, 16 nt, Streptococcus pneumoniae R6
uuuuucgaagcuugcu

SEQ ID NO: 4107616 - RNA, 23 nt, Streptococcus pneumoniae R6
uuuuucggcaguuuuuucuuucu

SEQ ID NO: 4107617 - RNA, 11 nt, Streptococcus pneumoniae R6
uuuuucucaau

SEQ ID NO: 4107618 - RNA, 14 nt, Streptococcus pneumoniae R6
uuuuucugauuuca

SEQ ID NO: 4107619 - RNA, 23 nt, Streptococcus pneumoniae R6
uuuuucugauuucaaagaauuuu

SEQ ID NO: 4107620 - RNA, 15 nt, Streptococcus pneumoniae R6
uuuuucuuccuuucu

SEQ ID NO: 4107621 - RNA, 11 nt, Streptococcus pneumoniae R6
uuuuucuucuu

SEQ ID NO: 4107622 - RNA, 13 nt, Streptococcus pneumoniae R6
uuuuucuucuuau

SEQ ID NO: 4107623 - RNA, 13 nt, Streptococcus pneumoniae R6
uuuuucuucuucg

SEQ ID NO: 4107624 - RNA, 13 nt, Streptococcus pneumoniae R6
uuuuugaaaaacu

SEQ ID NO: 4107625 - RNA, 12 nt, Streptococcus pneumoniae R6
uuuuugaacacc

SEQ ID NO: 4107626 - RNA, 22 nt, Streptococcus pneumoniae R6
uuuuugaagaguauaagucuuu

SEQ ID NO: 4107627 - RNA, 17 nt, Streptococcus pneumoniae R6
uuuuugaaguuuucaaa

SEQ ID NO: 4107628 - RNA, 13 nt, Streptococcus pneumoniae R6
uuuuugaauaacc

SEQ ID NO: 4107629 - RNA, 20 nt, Streptococcus pneumoniae R6
uuuuugacaccaaucaguaa

SEQ ID NO: 4107630 - RNA, 23 nt, Streptococcus pneumoniae R6
uuuuugacugauggaaguaauuu

SEQ ID NO: 4107631 - RNA, 22 nt, Streptococcus pneumoniae R6
uuuuugagcaauacuuuuucgu

SEQ ID NO: 4107632 - RNA, 21 nt, Streptococcus pneumoniae R6
uuuuugagcagaacaaugacu

SEQ ID NO: 4107633 - RNA, 11 nt, Streptococcus pneumoniae R6
uuuuugagccu

SEQ ID NO: 4107634 - RNA, 13 nt, Streptococcus pneumoniae R6
uuuuugaguuucu

SEQ ID NO: 4107635 - RNA, 14 nt, Streptococcus pneumoniae R6
uuuuugauacaagu

SEQ ID NO: 4107636 - RNA, 15 nt, Streptococcus pneumoniae R6
uuuuugauauucaga

SEQ ID NO: 4107637 - RNA, 16 nt, Streptococcus pneumoniae R6
uuuuugauuuauccaa

SEQ ID NO: 4107638 - RNA, 17 nt, Streptococcus pneumoniae R6
uuuuugauuucaagcua

SEQ ID NO: 4107639 - RNA, 14 nt, Streptococcus pneumoniae R6
uuuuugauuuuaaa

SEQ ID NO: 4107640 - RNA, 20 nt, Streptococcus pneumoniae R6
uuuuugccucaauaucuucu

SEQ ID NO: 4107641 - RNA, 18 nt, Streptococcus pneumoniae R6
uuuuuggagugauagaaa

SEQ ID NO: 4107642 - RNA, 23 nt, Streptococcus pneumoniae R6
uuuuuggcugauuucuuggaacu

SEQ ID NO: 4107643 - RNA, 21 nt, Streptococcus pneumoniae R6
uuuuugguaugaaauagccaa

SEQ ID NO: 4107644 - RNA, 19 nt, Streptococcus pneumoniae R6
uuuuuguauauuuuucaaa

SEQ ID NO: 4107645 - RNA, 19 nt, Streptococcus pneumoniae R6
uuuuuguauuucuucuucu

SEQ ID NO: 4107646 - RNA, 15 nt, Streptococcus pneumoniae R6
uuuuuguccuucuuc

SEQ ID NO: 4107647 - RNA, 21 nt, Streptococcus pneumoniae R6
uuuuugucuacgauagccguu

SEQ ID NO: 4107648 - RNA, 13 nt, Streptococcus pneumoniae R6
uuuuuuacuuaau

SEQ ID NO: 4107649 - RNA, 19 nt, Streptococcus pneumoniae R6
uuuuuuagcucuugcaaua

SEQ ID NO: 4107650 - RNA, 15 nt, Streptococcus pneumoniae R6
uuuuuucuaauuaaa

SEQ ID NO: 4107651 - RNA, 11 nt, Streptococcus pneumoniae R6
uuuuuucuugg

SEQ ID NO: 4107652 - RNA, 12 nt, Streptococcus pneumoniae R6
uuuuuucuuugc

SEQ ID NO: 4107653 - RNA, 10 nt, Streptococcus pneumoniae R6
uuuuuuguuu

SEQ ID NO: 4107654 - RNA, 12 nt, Streptococcus pneumoniae R6
uuuuuuuacauc

SEQ ID NO: 4107655 - RNA, 18 nt, Streptococcus pneumoniae R6
aucaaugauuuauuuguu

SEQ ID NO: 4107656 - RNA, 19 nt, Streptococcus pneumoniae R6
aucaauuauaauaaaauga

SEQ ID NO: 4107657 - RNA, 17 nt, Streptococcus pneumoniae R6
aucaauuaucauuucca

SEQ ID NO: 4107658 - RNA, 18 nt, Streptococcus pneumoniae R6
aucaauugcuagcaaugg

SEQ ID NO: 4107659 - RNA, 19 nt, Streptococcus pneumoniae R6
aucaauuguaacuugaccu

SEQ ID NO: 4107660 - RNA, 12 nt, Streptococcus pneumoniae R6
aucaauuucuag

SEQ ID NO: 4107661 - RNA, 16 nt, Streptococcus pneumoniae R6
aucaauuucuagcaaa

SEQ ID NO: 4107662 - RNA, 23 nt, Streptococcus pneumoniae R6
aucaauuucuagcaaaguuuuag

SEQ ID NO: 4107663 - RNA, 15 nt, Streptococcus pneumoniae R6
aucaauuucuucaca

SEQ ID NO: 4107664 - RNA, 22 nt, Streptococcus pneumoniae R6
aucaauuuguaucaccaagcau

SEQ ID NO: 4107665 - RNA, 19 nt, Streptococcus pneumoniae R6
aucaauuuuacaggaauau

SEQ ID NO: 4107666 - RNA, 20 nt, Streptococcus pneumoniae R6
aucaauuuuccuuuccuaau

SEQ ID NO: 4107667 - RNA, 12 nt, Streptococcus pneumoniae R6
aucaauuuuucg

SEQ ID NO: 4107668 - RNA, 17 nt, Streptococcus pneumoniae R6
aucacaauuccuaagau

SEQ ID NO: 4107669 - RNA, 15 nt, Streptococcus pneumoniae R6
aucacacuagcaauu

SEQ ID NO: 4107670 - RNA, 19 nt, Streptococcus pneumoniae R6
aucacacuagcaauuuuuu

SEQ ID NO: 4107671 - RNA, 14 nt, Streptococcus pneumoniae R6
aucacaguuuacaa

SEQ ID NO: 4107672 - RNA, 18 nt, Streptococcus pneumoniae R6
aucacaucgucaagcagu

SEQ ID NO: 4107673 - RNA, 14 nt, Streptococcus pneumoniae R6
aucacauucaaugu

SEQ ID NO: 4107674 - RNA, 13 nt, Streptococcus pneumoniae R6
aucacauuguguu

SEQ ID NO: 4107675 - RNA, 18 nt, Streptococcus pneumoniae R6
aucaccaagcauuuucau

SEQ ID NO: 4107676 - RNA, 19 nt, Streptococcus pneumoniae R6
aucaccaagcauuuucaua

SEQ ID NO: 4107677 - RNA, 20 nt, Streptococcus pneumoniae R6
aucacccaaaacuucugcaa

SEQ ID NO: 4107678 - RNA, 21 nt, Streptococcus pneumoniae R6
aucaccgaagucgaaaauaaa

SEQ ID NO: 4107679 - RNA, 17 nt, Streptococcus pneumoniae R6
aucaccguccccaaaaa

SEQ ID NO: 4107680 - RNA, 21 nt, Streptococcus pneumoniae R6
aucaccguccccaaaaauacu

SEQ ID NO: 4107681 - RNA, 13 nt, Streptococcus pneumoniae R6
aucaccugcaaua

SEQ ID NO: 4107682 - RNA, 18 nt, Streptococcus pneumoniae R6
aucacgaauuucuuguuc

SEQ ID NO: 4107683 - RNA, 22 nt, Streptococcus pneumoniae R6
aucacgcuaaguagaaaguuaa

SEQ ID NO: 4107684 - RNA, 16 nt, Streptococcus pneumoniae R6
aucacggaauuuuucg

SEQ ID NO: 4107685 - RNA, 17 nt, Streptococcus pneumoniae R6
aucacggcauuucugca

SEQ ID NO: 4107686 - RNA, 22 nt, Streptococcus pneumoniae R6
aucacguccaauuuugucucug

SEQ ID NO: 4107687 - RNA, 16 nt, Streptococcus pneumoniae R6
aucacguggagucuga

SEQ ID NO: 4107688 - RNA, 20 nt, Streptococcus pneumoniae R6
aucacuagcuuggucaguaa

SEQ ID NO: 4107689 - RNA, 15 nt, Streptococcus pneumoniae R6
aucacucaguuucug

SEQ ID NO: 4107690 - RNA, 16 nt, Streptococcus pneumoniae R6
aucacucaucugcuua

SEQ ID NO: 4107691 - RNA, 17 nt, Streptococcus pneumoniae R6
aucacugcagcaaaggu

SEQ ID NO: 4107692 - RNA, 19 nt, Streptococcus pneumoniae R6
aucacugcagcaaagguac

SEQ ID NO: 4107693 - RNA, 15 nt, Streptococcus pneumoniae R6
aucacuguuuuuuau

SEQ ID NO: 4107694 - RNA, 13 nt, Streptococcus pneumoniae R6
aucacuugaccaa

SEQ ID NO: 4107695 - RNA, 11 nt, Streptococcus pneumoniae R6
aucacuuucug

SEQ ID NO: 4107696 - RNA, 15 nt, Streptococcus pneumoniae R6
aucagaaaauaaaau

SEQ ID NO: 4107697 - RNA, 19 nt, Streptococcus pneumoniae R6
aucagaaccuuugagaaaa

SEQ ID NO: 4107698 - RNA, 19 nt, Streptococcus pneumoniae R6
aucagaauggguuaaaauu

SEQ ID NO: 4107699 - RNA, 23 nt, Streptococcus pneumoniae R6
aucagacuauaauauaauaaacu

SEQ ID NO: 4107700 - RNA, 21 nt, Streptococcus pneumoniae R6
aucagacuguuuuucuugaga

SEQ ID NO: 4107701 - RNA, 16 nt, Streptococcus pneumoniae R6
aucagaguagucuuuu

SEQ ID NO: 4107702 - RNA, 17 nt, Streptococcus pneumoniae R6
aucagauaaacaauggu

SEQ ID NO: 4107703 - RNA, 18 nt, Streptococcus pneumoniae R6
aucagauaagcaccuagu

SEQ ID NO: 4107704 - RNA, 13 nt, Streptococcus pneumoniae R6
aucagcagagaaa

SEQ ID NO: 4107705 - RNA, 17 nt, Streptococcus pneumoniae R6
aucagcguuuuuucuuu

SEQ ID NO: 4107706 - RNA, 21 nt, Streptococcus pneumoniae R6
aucagcuaagccuuuuucuuc

SEQ ID NO: 4107707 - RNA, 16 nt, Streptococcus pneumoniae R6
aucagcucucugauuu

SEQ ID NO: 4107708 - RNA, 16 nt, Streptococcus pneumoniae R6
aucagcuuuuucaggu

SEQ ID NO: 4107709 - RNA, 15 nt, Streptococcus pneumoniae R6
aucaggaaagucaaa

SEQ ID NO: 4107710 - RNA, 21 nt, Streptococcus pneumoniae R6
aucaggaaagucaaauuaauu

SEQ ID NO: 4107711 - RNA, 14 nt, Streptococcus pneumoniae R6
aucaggaaaucuuc

SEQ ID NO: 4107712 - RNA, 14 nt, Streptococcus pneumoniae R6
aucaggaaggucac

SEQ ID NO: 4107713 - RNA, 22 nt, Streptococcus pneumoniae R6
aucaggaauaaauccagcugag

SEQ ID NO: 4107714 - RNA, 17 nt, Streptococcus pneumoniae R6
aucagggaguuguuuuu

SEQ ID NO: 4107715 - RNA, 20 nt, Streptococcus pneumoniae R6
aucagguaggauuucuccug

SEQ ID NO: 4107716 - RNA, 15 nt, Streptococcus pneumoniae R6
aucagguauugaaaa

SEQ ID NO: 4107717 - RNA, 16 nt, Streptococcus pneumoniae R6
aucagucaaucuacuu

SEQ ID NO: 4107718 - RNA, 19 nt, Streptococcus pneumoniae R6
aucaguccuauuccuuuuu

SEQ ID NO: 4107719 - RNA, 20 nt, Streptococcus pneumoniae R6
aucagugugacccaagauag

SEQ ID NO: 4107720 - RNA, 21 nt, Streptococcus pneumoniae R6
aucaguuacauccaaacgaau

SEQ ID NO: 4107721 - RNA, 23 nt, Streptococcus pneumoniae R6
aucaguuacauccaaacgaaugu

SEQ ID NO: 4107722 - RNA, 18 nt, Streptococcus pneumoniae R6
aucaguuaucuuaucacc

SEQ ID NO: 4107723 - RNA, 16 nt, Streptococcus pneumoniae R6
aucaguucauuuuucc

SEQ ID NO: 4107724 - RNA, 14 nt, Streptococcus pneumoniae R6
aucaguuccagcaa

SEQ ID NO: 4107725 - RNA, 15 nt, Streptococcus pneumoniae R6
aucaguucuuuaaag

SEQ ID NO: 4107726 - RNA, 13 nt, Streptococcus pneumoniae R6
aucauaaaaauaa

SEQ ID NO: 4107727 - RNA, 20 nt, Streptococcus pneumoniae R6
aucauaaacuauccagagca

SEQ ID NO: 4107728 - RNA, 21 nt, Streptococcus pneumoniae R6
aucauaaccacccgucaaacg

SEQ ID NO: 4107729 - RNA, 19 nt, Streptococcus pneumoniae R6
aucauacgauugaaaggaa

SEQ ID NO: 4107730 - RNA, 15 nt, Streptococcus pneumoniae R6
aucauacuuagcuaa

SEQ ID NO: 4107731 - RNA, 14 nt, Streptococcus pneumoniae R6
aucauagaaauuuu

SEQ ID NO: 4107732 - RNA, 23 nt, Streptococcus pneumoniae R6
aucauagcuguuuugguuggggc

SEQ ID NO: 4107733 - RNA, 16 nt, Streptococcus pneumoniae R6
aucauaggcauaguac

SEQ ID NO: 4107734 - RNA, 16 nt, Streptococcus pneumoniae R6
aucauaguacaauacc

SEQ ID NO: 4107735 - RNA, 22 nt, Streptococcus pneumoniae R6
aucauagugagauugugaauua

SEQ ID NO: 4107736 - RNA, 13 nt, Streptococcus pneumoniae R6
aucauauaaauaa

SEQ ID NO: 4107737 - RNA, 16 nt, Streptococcus pneumoniae R6
aucauauaaauauaga

SEQ ID NO: 4107738 - RNA, 15 nt, Streptococcus pneumoniae R6
aucauauagauaaaa

SEQ ID NO: 4107739 - RNA, 22 nt, Streptococcus pneumoniae R6
aucauaucaagguuuuucaaaa

SEQ ID NO: 4107740 - RNA, 22 nt, Streptococcus pneumoniae R6
aucauaucaagguuuuugaaaa

SEQ ID NO: 4107741 - RNA, 16 nt, Streptococcus pneumoniae R6
aucauaucagugaagg

SEQ ID NO: 4107742 - RNA, 20 nt, Streptococcus pneumoniae R6
aucauaucaucaaucaagau

SEQ ID NO: 4107743 - RNA, 19 nt, Streptococcus pneumoniae R6
aucaucaaauugaaauaag

SEQ ID NO: 4107744 - RNA, 24 nt, Streptococcus pneumoniae R6
aucaucaaauugaaauaagaaaua

SEQ ID NO: 4107745 - RNA, 23 nt, Streptococcus pneumoniae R6
aucaucaaccucacuuaauacuu

SEQ ID NO: 4107746 - RNA, 23 nt, Streptococcus pneumoniae R6
aucaucagggaguuguuuuuuau

SEQ ID NO: 4107747 - RNA, 23 nt, Streptococcus pneumoniae R6
aucauccaccuugcaaaaaaacu

SEQ ID NO: 4107748 - RNA, 18 nt, Streptococcus pneumoniae R6
aucauccagauuuuucug

SEQ ID NO: 4107749 - RNA, 20 nt, Streptococcus pneumoniae R6
aucauccagauuuuucuggg

SEQ ID NO: 4107750 - RNA, 15 nt, Streptococcus pneumoniae R6
aucaucgccaaauca

SEQ ID NO: 4107751 - RNA, 22 nt, Streptococcus pneumoniae R6
aucaucugcaucaagaacaauu

SEQ ID NO: 4107752 - RNA, 24 nt, Streptococcus pneumoniae R6
aucaugaaaccaccgacaacccag

SEQ ID NO: 4107753 - RNA, 23 nt, Streptococcus pneumoniae R6
aucaugaauauuccuaugauuaa

SEQ ID NO: 4107754 - RNA, 20 nt, Streptococcus pneumoniae R6
aucaugcgaaucaauuuuuc

SEQ ID NO: 4107755 - RNA, 20 nt, Streptococcus pneumoniae R6
aucaugcuuuacuaguucuc

SEQ ID NO: 4107756 - RNA, 13 nt, Streptococcus pneumoniae R6
aucauggauuuuu

SEQ ID NO: 4107757 - RNA, 13 nt, Streptococcus pneumoniae R6
aucaugguugcuc

SEQ ID NO: 4107758 - RNA, 15 nt, Streptococcus pneumoniae R6
aucauuaaaauaacu

SEQ ID NO: 4107759 - RNA, 19 nt, Streptococcus pneumoniae R6
aucauuaaagaccaaagaa

SEQ ID NO: 4107760 - RNA, 12 nt, Streptococcus pneumoniae R6
aucauuaacaau

SEQ ID NO: 4107761 - RNA, 13 nt, Streptococcus pneumoniae R6
aucauuauauuuc

SEQ ID NO: 4107762 - RNA, 15 nt, Streptococcus pneumoniae R6
aucauuauauuucuc

SEQ ID NO: 4107763 - RNA, 15 nt, Streptococcus pneumoniae R6
aucauuauccaugau

SEQ ID NO: 4107764 - RNA, 17 nt, Streptococcus pneumoniae R6
aucauuccugauaaaag

SEQ ID NO: 4107765 - RNA, 19 nt, Streptococcus pneumoniae R6
aucauucugaacuaaaaaa

SEQ ID NO: 4107766 - RNA, 20 nt, Streptococcus pneumoniae R6
aucauucugaacuaaaaaau

SEQ ID NO: 4107767 - RNA, 22 nt, Streptococcus pneumoniae R6
aucauucugcauguaucacagu

SEQ ID NO: 4107768 - RNA, 17 nt, Streptococcus pneumoniae R6
aucauugaguuggcuug

SEQ ID NO: 4107769 - RNA, 19 nt, Streptococcus pneumoniae R6
aucauugauaguaacacuu

SEQ ID NO: 4107770 - RNA, 16 nt, Streptococcus pneumoniae R6
aucauugauauaaaga

SEQ ID NO: 4107771 - RNA, 12 nt, Streptococcus pneumoniae R6
aucauugauuuc

SEQ ID NO: 4107772 - RNA, 16 nt, Streptococcus pneumoniae R6
aucauugucaaacaag

SEQ ID NO: 4107773 - RNA, 18 nt, Streptococcus pneumoniae R6
aucauuuccauuguuguu

SEQ ID NO: 4107774 - RNA, 23 nt, Streptococcus pneumoniae R6
aucauuuccauuguuguuucuug

SEQ ID NO: 4107775 - RNA, 21 nt, Streptococcus pneumoniae R6
aucauuuccuucguuuucaca

SEQ ID NO: 4107776 - RNA, 16 nt, Streptococcus pneumoniae R6
aucauuucuucuggaa

SEQ ID NO: 4107777 - RNA, 13 nt, Streptococcus pneumoniae R6
aucauuuuauuca

SEQ ID NO: 4107778 - RNA, 22 nt, Streptococcus pneumoniae R6
auccaaaagcaggaguuuuccc

SEQ ID NO: 4107779 - RNA, 19 nt, Streptococcus pneumoniae R6
auccaaacacgaaaccagu

SEQ ID NO: 4107780 - RNA, 22 nt, Streptococcus pneumoniae R6
auccaaacgauuaucuaacaau

SEQ ID NO: 4107781 - RNA, 22 nt, Streptococcus pneumoniae R6
auccaaagauuaaucuucaaau

SEQ ID NO: 4107782 - RNA, 15 nt, Streptococcus pneumoniae R6
auccaaaguaaaaua

SEQ ID NO: 4107783 - RNA, 13 nt, Streptococcus pneumoniae R6
auccaacugaucc

SEQ ID NO: 4107784 - RNA, 20 nt, Streptococcus pneumoniae R6
auccaacugaucccuccauu

SEQ ID NO: 4107785 - RNA, 17 nt, Streptococcus pneumoniae R6
auccaagccauaagaaa

SEQ ID NO: 4107786 - RNA, 20 nt, Streptococcus pneumoniae R6
auccaagcgucugaggcaac

SEQ ID NO: 4107787 - RNA, 17 nt, Streptococcus pneumoniae R6
auccaagcuucuacaga

SEQ ID NO: 4107788 - RNA, 19 nt, Streptococcus pneumoniae R6
auccaagcuucuacagaug

SEQ ID NO: 4107789 - RNA, 18 nt, Streptococcus pneumoniae R6
auccaaguuuggcagaca

SEQ ID NO: 4107790 - RNA, 20 nt, Streptococcus pneumoniae R6
auccaaguuuggcagacacc

SEQ ID NO: 4107791 - RNA, 18 nt, Streptococcus pneumoniae R6
auccacaaccucaaaaca

SEQ ID NO: 4107792 - RNA, 12 nt, Streptococcus pneumoniae R6
auccacaaccuu

SEQ ID NO: 4107793 - RNA, 14 nt, Streptococcus pneumoniae R6
auccacaaccuuaa

SEQ ID NO: 4107794 - RNA, 15 nt, Streptococcus pneumoniae R6
auccacaaccuuaaa

SEQ ID NO: 4107795 - RNA, 17 nt, Streptococcus pneumoniae R6
auccacaaccuuaaaac

SEQ ID NO: 4107796 - RNA, 18 nt, Streptococcus pneumoniae R6
auccacaaccuuaaaaca

SEQ ID NO: 4107797 - RNA, 14 nt, Streptococcus pneumoniae R6
auccacacuuccaa

SEQ ID NO: 4107798 - RNA, 22 nt, Streptococcus pneumoniae R6
auccacauuuacgaaucucuuu

SEQ ID NO: 4107799 - RNA, 17 nt, Streptococcus pneumoniae R6
auccacuauaauaaaau

SEQ ID NO: 4107800 - RNA, 21 nt, Streptococcus pneumoniae R6
auccacucaguauuacaucca

SEQ ID NO: 4107801 - RNA, 19 nt, Streptococcus pneumoniae R6
auccacuugggaaaccaaa

SEQ ID NO: 4107802 - RNA, 22 nt, Streptococcus pneumoniae R6
auccacuugggaaaccaaacgg

SEQ ID NO: 4107803 - RNA, 23 nt, Streptococcus pneumoniae R6
auccacuugggaaaccaaacgga

SEQ ID NO: 4107804 - RNA, 18 nt, Streptococcus pneumoniae R6
auccacuugugucauaau

SEQ ID NO: 4107805 - RNA, 14 nt, Streptococcus pneumoniae R6
auccagaaauugau

SEQ ID NO: 4107806 - RNA, 17 nt, Streptococcus pneumoniae R6
auccagagcauucuuuu

SEQ ID NO: 4107807 - RNA, 22 nt, Streptococcus pneumoniae R6
auccagagcauucuuuuguuca

SEQ ID NO: 4107808 - RNA, 13 nt, Streptococcus pneumoniae R6
auccagcaggaga

SEQ ID NO: 4107809 - RNA, 16 nt, Streptococcus pneumoniae R6
auccagccuucauaaa

SEQ ID NO: 4107810 - RNA, 17 nt, Streptococcus pneumoniae R6
auccaguguauggagcu

SEQ ID NO: 4107811 - RNA, 13 nt, Streptococcus pneumoniae R6
auccauauucaau

SEQ ID NO: 4107812 - RNA, 13 nt, Streptococcus pneumoniae R6
auccaucacaguu

SEQ ID NO: 4107813 - RNA, 18 nt, Streptococcus pneumoniae R6
auccaugauccuucauuc

SEQ ID NO: 4107814 - RNA, 20 nt, Streptococcus pneumoniae R6
auccauggaauaccaauauc

SEQ ID NO: 4107815 - RNA, 12 nt, Streptococcus pneumoniae R6
auccauuauaca

SEQ ID NO: 4107816 - RNA, 14 nt, Streptococcus pneumoniae R6
auccauucacaaca

SEQ ID NO: 4107817 - RNA, 13 nt, Streptococcus pneumoniae R6
auccauucuuaaa

SEQ ID NO: 4107818 - RNA, 16 nt, Streptococcus pneumoniae R6
auccauucuuaaaauu

SEQ ID NO: 4107819 - RNA, 14 nt, Streptococcus pneumoniae R6
auccauucuuuuuu

SEQ ID NO: 4107820 - RNA, 22 nt, Streptococcus pneumoniae R6
auccauuuggguaggucuuuuu

SEQ ID NO: 4107821 - RNA, 12 nt, Streptococcus pneumoniae R6
aucccaaagaag

SEQ ID NO: 4107822 - RNA, 16 nt, Streptococcus pneumoniae R6
aucccaaagaauccau

SEQ ID NO: 4107823 - RNA, 17 nt, Streptococcus pneumoniae R6
aucccaacuccuccuuc

SEQ ID NO: 4107824 - RNA, 17 nt, Streptococcus pneumoniae R6
aucccaauggucaagag

SEQ ID NO: 4107825 - RNA, 16 nt, Streptococcus pneumoniae R6
aucccaugacaaucau

SEQ ID NO: 4107826 - RNA, 22 nt, Streptococcus pneumoniae R6
aucccauguaguucaaaacugc

SEQ ID NO: 4107827 - RNA, 22 nt, Streptococcus pneumoniae R6
aucccauuuauauaaaaagaaa

SEQ ID NO: 4107828 - RNA, 23 nt, Streptococcus pneumoniae R6
auccccauuuguaugagaggcaa

SEQ ID NO: 4107829 - RNA, 16 nt, Streptococcus pneumoniae R6
aucccucggcuuuuuu

SEQ ID NO: 4107830 - RNA, 18 nt, Streptococcus pneumoniae R6
aucccucuuuuuacaauu

SEQ ID NO: 4107831 - RNA, 22 nt, Streptococcus pneumoniae R6
aucccucuuuuuacaauuguaa

SEQ ID NO: 4107832 - RNA, 23 nt, Streptococcus pneumoniae R6
aucccucuuuuuacaauuguaaa

SEQ ID NO: 4107833 - RNA, 21 nt, Streptococcus pneumoniae R6
aucccuguagggggcauauaa

SEQ ID NO: 4107834 - RNA, 14 nt, Streptococcus pneumoniae R6
aucccuuuaccauu

SEQ ID NO: 4107835 - RNA, 15 nt, Streptococcus pneumoniae R6
auccgaaaaauuucu

SEQ ID NO: 4107836 - RNA, 17 nt, Streptococcus pneumoniae R6
auccgaagaaggccaaa

SEQ ID NO: 4107837 - RNA, 15 nt, Streptococcus pneumoniae R6
auccgauaauauaua

SEQ ID NO: 4107838 - RNA, 15 nt, Streptococcus pneumoniae R6
auccgcaagagauuu

SEQ ID NO: 4107839 - RNA, 15 nt, Streptococcus pneumoniae R6
auccgccguuaucca

SEQ ID NO: 4107840 - RNA, 22 nt, Streptococcus pneumoniae R6
auccgcuaucuuauugauuuuu

SEQ ID NO: 4107841 - RNA, 19 nt, Streptococcus pneumoniae R6
auccgcuugggaaaccaaa

SEQ ID NO: 4107842 - RNA, 23 nt, Streptococcus pneumoniae R6
auccgcuugggaaaccaaacgga

SEQ ID NO: 4107843 - RNA, 20 nt, Streptococcus pneumoniae R6
auccguauucuuauuucaaa

SEQ ID NO: 4107844 - RNA, 22 nt, Streptococcus pneumoniae R6
auccguucugagauaggugggu

SEQ ID NO: 4107845 - RNA, 20 nt, Streptococcus pneumoniae R6
auccuaugauacccaaaauc

SEQ ID NO: 4107846 - RNA, 20 nt, Streptococcus pneumoniae R6
auccuauucggacuuuggcu

SEQ ID NO: 4107847 - RNA, 15 nt, Streptococcus pneumoniae R6
auccuauuuauuacu

SEQ ID NO: 4107848 - RNA, 17 nt, Streptococcus pneumoniae R6
auccucaaaauucuguc

SEQ ID NO: 4107849 - RNA, 18 nt, Streptococcus pneumoniae R6
auccucaaaauucugucu

SEQ ID NO: 4107850 - RNA, 18 nt, Streptococcus pneumoniae R6
auccucuaucaugcgaau

SEQ ID NO: 4107851 - RNA, 14 nt, Streptococcus pneumoniae R6
auccugaagaaugg

SEQ ID NO: 4107852 - RNA, 14 nt, Streptococcus pneumoniae R6
auccugaauaguga

SEQ ID NO: 4107853 - RNA, 18 nt, Streptococcus pneumoniae R6
auccugaauagugaagau

SEQ ID NO: 4107854 - RNA, 14 nt, Streptococcus pneumoniae R6
auccugcaaagaua

SEQ ID NO: 4107855 - RNA, 22 nt, Streptococcus pneumoniae R6
auccugcgaaaucuuugauuuc

SEQ ID NO: 4107856 - RNA, 19 nt, Streptococcus pneumoniae R6
auccuuacggucaaaguca

SEQ ID NO: 4107857 - RNA, 20 nt, Streptococcus pneumoniae R6
auccuuacggucaaagucau

SEQ ID NO: 4107858 - RNA, 20 nt, Streptococcus pneumoniae R6
auccuugaugcgauugauuu

SEQ ID NO: 4107859 - RNA, 21 nt, Streptococcus pneumoniae R6
auccuugaugcgauugauuuc

SEQ ID NO: 4107860 - RNA, 17 nt, Streptococcus pneumoniae R6
auccuugguaacaacac

SEQ ID NO: 4107861 - RNA, 16 nt, Streptococcus pneumoniae R6
auccuuuacuuguuuu

SEQ ID NO: 4107862 - RNA, 18 nt, Streptococcus pneumoniae R6
auccuuuauuuucaagcg

SEQ ID NO: 4107863 - RNA, 19 nt, Streptococcus pneumoniae R6
auccuuuguuuacuaaaca

SEQ ID NO: 4107864 - RNA, 22 nt, Streptococcus pneumoniae R6
auccuuuuaaucgauuauuuuu

SEQ ID NO: 4107865 - RNA, 17 nt, Streptococcus pneumoniae R6
auccuuuuuuugaaguu

SEQ ID NO: 4107866 - RNA, 11 nt, Streptococcus pneumoniae R6
aucgaaaaaua

SEQ ID NO: 4107867 - RNA, 12 nt, Streptococcus pneumoniae R6
aucgaaaaauau

SEQ ID NO: 4107868 - RNA, 17 nt, Streptococcus pneumoniae R6
aucgaaagcaaauuuaa

SEQ ID NO: 4107869 - RNA, 17 nt, Streptococcus pneumoniae R6
aucgacgcuuucuaagg

SEQ ID NO: 4107870 - RNA, 15 nt, Streptococcus pneumoniae R6
aucgagcagauuucu

SEQ ID NO: 4107871 - RNA, 19 nt, Streptococcus pneumoniae R6
aucgaguuauuaacaaaag

SEQ ID NO: 4107872 - RNA, 18 nt, Streptococcus pneumoniae R6
aucgauacgauuaggaac

SEQ ID NO: 4107873 - RNA, 20 nt, Streptococcus pneumoniae R6
aucgauauaauuuuccuuaa

SEQ ID NO: 4107874 - RNA, 14 nt, Streptococcus pneumoniae R6
aucgaucuguucuu

SEQ ID NO: 4107875 - RNA, 15 nt, Streptococcus pneumoniae R6
aucgaugcccucuuc

SEQ ID NO: 4107876 - RNA, 18 nt, Streptococcus pneumoniae R6
aucgaugcccucuucuuu

SEQ ID NO: 4107877 - RNA, 15 nt, Streptococcus pneumoniae R6
aucgauuauauuuag

SEQ ID NO: 4107878 - RNA, 19 nt, Streptococcus pneumoniae R6
aucgauuuauguccuaaaa

SEQ ID NO: 4107879 - RNA, 19 nt, Streptococcus pneumoniae R6
aucgauuuguccuguucuu

SEQ ID NO: 4107880 - RNA, 19 nt, Streptococcus pneumoniae R6
aucgauuuguucuguucuu

SEQ ID NO: 4107881 - RNA, 21 nt, Streptococcus pneumoniae R6
aucgcaaucuacuugucuaga

SEQ ID NO: 4107882 - RNA, 13 nt, Streptococcus pneumoniae R6
aucgcauaaaacg

SEQ ID NO: 4107883 - RNA, 22 nt, Streptococcus pneumoniae R6
aucgccaaaucaucaaauugaa

SEQ ID NO: 4107884 - RNA, 14 nt, Streptococcus pneumoniae R6
aucgccucuucaau

SEQ ID NO: 4107885 - RNA, 17 nt, Streptococcus pneumoniae R6
aucgcgaccaagagcaa

SEQ ID NO: 4107886 - RNA, 22 nt, Streptococcus pneumoniae R6
aucgcuaucaaugguuuugggu

SEQ ID NO: 4107887 - RNA, 20 nt, Streptococcus pneumoniae R6
aucggaagcuacagagcuaa

SEQ ID NO: 4107888 - RNA, 22 nt, Streptococcus pneumoniae R6
aucggagacggacuagaaugcu

SEQ ID NO: 4107889 - RNA, 17 nt, Streptococcus pneumoniae R6
aucgguaggaugacaac

SEQ ID NO: 4107890 - RNA, 20 nt, Streptococcus pneumoniae R6
aucgguuuaucucccauacc

SEQ ID NO: 4107891 - RNA, 18 nt, Streptococcus pneumoniae R6
aucguaucuuuggacaua

SEQ ID NO: 4107892 - RNA, 17 nt, Streptococcus pneumoniae R6
aucguauguuguagcag

SEQ ID NO: 4107893 - RNA, 22 nt, Streptococcus pneumoniae R6
aucgucaagcaguaauauagga

SEQ ID NO: 4107894 - RNA, 22 nt, Streptococcus pneumoniae R6
aucgucaucaccaaucuuacca

SEQ ID NO: 4107895 - RNA, 16 nt, Streptococcus pneumoniae R6
aucgucucacgguaaa

SEQ ID NO: 4107896 - RNA, 17 nt, Streptococcus pneumoniae R6
aucguuccugucuuauu

SEQ ID NO: 4107897 - RNA, 17 nt, Streptococcus pneumoniae R6
aucguugcaccugaacg

SEQ ID NO: 4107898 - RNA, 23 nt, Streptococcus pneumoniae R6
aucguuuuacggacauguauauu

SEQ ID NO: 4107899 - RNA, 15 nt, Streptococcus pneumoniae R6
aucuaaauaauacuu

SEQ ID NO: 4107900 - RNA, 16 nt, Streptococcus pneumoniae R6
aucuaacaauaagaua

SEQ ID NO: 4107901 - RNA, 20 nt, Streptococcus pneumoniae R6
aucuaacaauaagauaucac

SEQ ID NO: 4107902 - RNA, 18 nt, Streptococcus pneumoniae R6
aucuaagauguucaaucu

SEQ ID NO: 4107903 - RNA, 17 nt, Streptococcus pneumoniae R6
aucuaaggucaaacuuu

SEQ ID NO: 4107904 - RNA, 15 nt, Streptococcus pneumoniae R6
aucuaauaauuuuuc

SEQ ID NO: 4107905 - RNA, 16 nt, Streptococcus pneumoniae R6
aucuaauaauuuuuca

SEQ ID NO: 4107906 - RNA, 16 nt, Streptococcus pneumoniae R6
aucuaauagacuaucu

SEQ ID NO: 4107907 - RNA, 15 nt, Streptococcus pneumoniae R6
aucuaaucauucuga

SEQ ID NO: 4107908 - RNA, 15 nt, Streptococcus pneumoniae R6
aucuaauugauuuaa

SEQ ID NO: 4107909 - RNA, 12 nt, Streptococcus pneumoniae R6
aucuacaaccuc

SEQ ID NO: 4107910 - RNA, 15 nt, Streptococcus pneumoniae R6
aucuacaaccucaaa

SEQ ID NO: 4107911 - RNA, 18 nt, Streptococcus pneumoniae R6
aucuacaaccucaaaaca

SEQ ID NO: 4107912 - RNA, 14 nt, Streptococcus pneumoniae R6
aucuacaaccuuaa

SEQ ID NO: 4107913 - RNA, 16 nt, Streptococcus pneumoniae R6
aucuacaaccuuaaaa

SEQ ID NO: 4107914 - RNA, 18 nt, Streptococcus pneumoniae R6
aucuacaaccuuaaaaca

SEQ ID NO: 4107915 - RNA, 19 nt, Streptococcus pneumoniae R6
aucuacaaccuuaaaacag

SEQ ID NO: 4107916 - RNA, 20 nt, Streptococcus pneumoniae R6
aucuacacccacgucacaaa

SEQ ID NO: 4107917 - RNA, 17 nt, Streptococcus pneumoniae R6
aucuacgcuuuaaaaau

SEQ ID NO: 4107918 - RNA, 14 nt, Streptococcus pneumoniae R6
aucuacuauagaaa

SEQ ID NO: 4107919 - RNA, 14 nt, Streptococcus pneumoniae R6
aucuacuauauuuu

SEQ ID NO: 4107920 - RNA, 16 nt, Streptococcus pneumoniae R6
aucuacuauauuuuug

SEQ ID NO: 4107921 - RNA, 23 nt, Streptococcus pneumoniae R6
aucuacuucuuuaacuacuugau

SEQ ID NO: 4107922 - RNA, 16 nt, Streptococcus pneumoniae R6
aucuagauaguaccau

SEQ ID NO: 4107923 - RNA, 13 nt, Streptococcus pneumoniae R6
aucuagauuugga

SEQ ID NO: 4107924 - RNA, 12 nt, Streptococcus pneumoniae R6
aucuaguaaagc

SEQ ID NO: 4107925 - RNA, 12 nt, Streptococcus pneumoniae R6
aucuagucauca

SEQ ID NO: 4107926 - RNA, 13 nt, Streptococcus pneumoniae R6
aucuagucaucag

SEQ ID NO: 4107927 - RNA, 15 nt, Streptococcus pneumoniae R6
aucuauaaacaaagg

SEQ ID NO: 4107928 - RNA, 16 nt, Streptococcus pneumoniae R6
aucuauaaacaaagga

SEQ ID NO: 4107929 - RNA, 14 nt, Streptococcus pneumoniae R6
aucuauaacaguac

SEQ ID NO: 4107930 - RNA, 21 nt, Streptococcus pneumoniae R6
aucuauagcuuuuuauauaua

SEQ ID NO: 4107931 - RNA, 16 nt, Streptococcus pneumoniae R6
aucuaucaaaagaugu

SEQ ID NO: 4107932 - RNA, 17 nt, Streptococcus pneumoniae R6
aucuaucaaaagauguu

SEQ ID NO: 4107933 - RNA, 14 nt, Streptococcus pneumoniae R6
aucuauccauuugg

SEQ ID NO: 4107934 - RNA, 11 nt, Streptococcus pneumoniae R6
aucuauuuuua

SEQ ID NO: 4107935 - RNA, 18 nt, Streptococcus pneumoniae R6
aucuauuuuuaauagaca

SEQ ID NO: 4107936 - RNA, 15 nt, Streptococcus pneumoniae R6
aucuauuuuuacuca

SEQ ID NO: 4107937 - RNA, 13 nt, Streptococcus pneumoniae R6
aucucaaaagaaa

SEQ ID NO: 4107938 - RNA, 16 nt, Streptococcus pneumoniae R6
aucucaaaagaaagca

SEQ ID NO: 4107939 - RNA, 18 nt, Streptococcus pneumoniae R6
aucucaaaagaaagcaua

SEQ ID NO: 4107940 - RNA, 22 nt, Streptococcus pneumoniae R6
aucucacguaacauauuuucaa

SEQ ID NO: 4107941 - RNA, 14 nt, Streptococcus pneumoniae R6
aucucaucuucacu

SEQ ID NO: 4107942 - RNA, 12 nt, Streptococcus pneumoniae R6
aucucauuugau

SEQ ID NO: 4107943 - RNA, 14 nt, Streptococcus pneumoniae R6
aucuccaacugcaa

SEQ ID NO: 4107944 - RNA, 21 nt, Streptococcus pneumoniae R6
aucuccaguuuggaccauaaa

SEQ ID NO: 4107945 - RNA, 19 nt, Streptococcus pneumoniae R6
aucuccuacuucccaccca

SEQ ID NO: 4107946 - RNA, 22 nt, Streptococcus pneumoniae R6
aucuccucaggaacuucaacau

SEQ ID NO: 4107947 - RNA, 18 nt, Streptococcus pneumoniae R6
aucuccucuaccugccuu

SEQ ID NO: 4107948 - RNA, 22 nt, Streptococcus pneumoniae R6
aucuccucuaccugccuuccaa

SEQ ID NO: 4107949 - RNA, 11 nt, Streptococcus pneumoniae R6
aucuccuuggc

SEQ ID NO: 4107950 - RNA, 19 nt, Streptococcus pneumoniae R6
aucucgcuguuuauuuuuu

SEQ ID NO: 4107951 - RNA, 15 nt, Streptococcus pneumoniae R6
aucucggaaagauau

SEQ ID NO: 4107952 - RNA, 21 nt, Streptococcus pneumoniae R6
aucucgugcauuucaucccca

SEQ ID NO: 4107953 - RNA, 12 nt, Streptococcus pneumoniae R6
aucucguucuug

SEQ ID NO: 4107954 - RNA, 17 nt, Streptococcus pneumoniae R6
aucucguucuugaaacc

SEQ ID NO: 4107955 - RNA, 21 nt, Streptococcus pneumoniae R6
aucucuaacaaugcuuuagaa

SEQ ID NO: 4107956 - RNA, 13 nt, Streptococcus pneumoniae R6
aucucucuauaau

SEQ ID NO: 4107957 - RNA, 15 nt, Streptococcus pneumoniae R6
aucucugcaaaccac

SEQ ID NO: 4107958 - RNA, 22 nt, Streptococcus pneumoniae R6
aucucuggguacucuuuuuuca

SEQ ID NO: 4107959 - RNA, 18 nt, Streptococcus pneumoniae R6
aucucuguuaagaaauaa

SEQ ID NO: 4107960 - RNA, 14 nt, Streptococcus pneumoniae R6
aucucuuaaaaaag

SEQ ID NO: 4107961 - RNA, 17 nt, Streptococcus pneumoniae R6
aucucuuguaacccaaa

SEQ ID NO: 4107962 - RNA, 15 nt, Streptococcus pneumoniae R6
aucucuuuauugguu

SEQ ID NO: 4107963 - RNA, 18 nt, Streptococcus pneumoniae R6
aucucuuuauugguuaaa

SEQ ID NO: 4107964 - RNA, 15 nt, Streptococcus pneumoniae R6
aucucuuugaggucu

SEQ ID NO: 4107965 - RNA, 16 nt, Streptococcus pneumoniae R6
aucugaaaguuuaucu

SEQ ID NO: 4107966 - RNA, 12 nt, Streptococcus pneumoniae R6
aucugaagaaag

SEQ ID NO: 4107967 - RNA, 15 nt, Streptococcus pneumoniae R6
aucugaaucaaaauu

SEQ ID NO: 4107968 - RNA, 19 nt, Streptococcus pneumoniae R6
aucugaaucaaaauuauuu

SEQ ID NO: 4107969 - RNA, 17 nt, Streptococcus pneumoniae R6
aucugaaugacaaaucc

SEQ ID NO: 4107970 - RNA, 17 nt, Streptococcus pneumoniae R6
aucugaauguuucccuu

SEQ ID NO: 4107971 - RNA, 20 nt, Streptococcus pneumoniae R6
aucugacuagcaucuugugu

SEQ ID NO: 4107972 - RNA, 20 nt, Streptococcus pneumoniae R6
aucugacuucgucaguucua

SEQ ID NO: 4107973 - RNA, 21 nt, Streptococcus pneumoniae R6
aucugacuucgucaguucuau

SEQ ID NO: 4107974 - RNA, 18 nt, Streptococcus pneumoniae R6
aucugagguguaaguccu

SEQ ID NO: 4107975 - RNA, 19 nt, Streptococcus pneumoniae R6
aucugagguguaaguccuc

SEQ ID NO: 4107976 - RNA, 22 nt, Streptococcus pneumoniae R6
aucugaugcugacaagucaucc

SEQ ID NO: 4107977 - RNA, 17 nt, Streptococcus pneumoniae R6
aucugauuggaaacuuu

SEQ ID NO: 4107978 - RNA, 19 nt, Streptococcus pneumoniae R6
aucugauuggaaacuuuuu

SEQ ID NO: 4107979 - RNA, 15 nt, Streptococcus pneumoniae R6
aucugcaaccucaaa

SEQ ID NO: 4107980 - RNA, 16 nt, Streptococcus pneumoniae R6
aucugcaaccucaaaa

SEQ ID NO: 4107981 - RNA, 19 nt, Streptococcus pneumoniae R6
aucugcaaccucaaaacag

SEQ ID NO: 4107982 - RNA, 18 nt, Streptococcus pneumoniae R6
aucugcagccucaaaaca

SEQ ID NO: 4107983 - RNA, 15 nt, Streptococcus pneumoniae R6
aucugccaccucaaa

SEQ ID NO: 4107984 - RNA, 14 nt, Streptococcus pneumoniae R6
aucugccauaucau

SEQ ID NO: 4107985 - RNA, 17 nt, Streptococcus pneumoniae R6
aucugccgcaugacaaa

SEQ ID NO: 4107986 - RNA, 20 nt, Streptococcus pneumoniae R6
aucugccucaagaagugguu

SEQ ID NO: 4107987 - RNA, 14 nt, Streptococcus pneumoniae R6
aucugcuaaaacaa

SEQ ID NO: 4107988 - RNA, 15 nt, Streptococcus pneumoniae R6
aucugcuaaaacaaa

SEQ ID NO: 4107989 - RNA, 19 nt, Streptococcus pneumoniae R6
aucugcuaaaacaaaauuc

SEQ ID NO: 4107990 - RNA, 20 nt, Streptococcus pneumoniae R6
aucugcuaacugcuggauag

SEQ ID NO: 4107991 - RNA, 18 nt, Streptococcus pneumoniae R6
aucugcuauguugcaaau

SEQ ID NO: 4107992 - RNA, 19 nt, Streptococcus pneumoniae R6
aucugcucaaucuuaucaa

SEQ ID NO: 4107993 - RNA, 18 nt, Streptococcus pneumoniae R6
aucuggaggcuuuuucuc

SEQ ID NO: 4107994 - RNA, 14 nt, Streptococcus pneumoniae R6
aucuggauuuucag

SEQ ID NO: 4107995 - RNA, 16 nt, Streptococcus pneumoniae R6
aucuggcgucuuaccu

SEQ ID NO: 4107996 - RNA, 23 nt, Streptococcus pneumoniae R6
aucuggcuuucuguaaucuuacc

SEQ ID NO: 4107997 - RNA, 22 nt, Streptococcus pneumoniae R6
aucugggauugguaccgcugaa

SEQ ID NO: 4107998 - RNA, 17 nt, Streptococcus pneumoniae R6
aucuggucuuaagacac

SEQ ID NO: 4107999 - RNA, 16 nt, Streptococcus pneumoniae R6
aucuggugugaugaua

SEQ ID NO: 4108000 - RNA, 19 nt, Streptococcus pneumoniae R6
aucugguuucguagcagaa

SEQ ID NO: 4108001 - RNA, 14 nt, Streptococcus pneumoniae R6
aucugguuuuuccc

SEQ ID NO: 4108002 - RNA, 20 nt, Streptococcus pneumoniae R6
aucuguagaguuuugguuga

SEQ ID NO: 4108003 - RNA, 16 nt, Streptococcus pneumoniae R6
aucuguauuuggcauu

SEQ ID NO: 4108004 - RNA, 21 nt, Streptococcus pneumoniae R6
aucugucacaauccagccugc

SEQ ID NO: 4108005 - RNA, 15 nt, Streptococcus pneumoniae R6
aucugucagugacag

SEQ ID NO: 4108006 - RNA, 23 nt, Streptococcus pneumoniae R6
aucugucagugacagaaaugagu

SEQ ID NO: 4108007 - RNA, 16 nt, Streptococcus pneumoniae R6
aucugugauuucaguu

SEQ ID NO: 4108008 - RNA, 15 nt, Streptococcus pneumoniae R6
aucuguuaaaaaaua

SEQ ID NO: 4108009 - RNA, 15 nt, Streptococcus pneumoniae R6
aucuguuuaaauuca

SEQ ID NO: 4108010 - RNA, 18 nt, Streptococcus pneumoniae R6
aucuguuuggcaagugcc

SEQ ID NO: 4108011 - RNA, 20 nt, Streptococcus pneumoniae R6
aucuguuuguauuguuuuau

SEQ ID NO: 4108012 - RNA, 13 nt, Streptococcus pneumoniae R6
aucuguuuuaaac

SEQ ID NO: 4108013 - RNA, 19 nt, Streptococcus pneumoniae R6
aucuguuuuaaacguucaa

SEQ ID NO: 4108014 - RNA, 20 nt, Streptococcus pneumoniae R6
aucuguuuuuuccguuuuau

SEQ ID NO: 4108015 - RNA, 12 nt, Streptococcus pneumoniae R6
aucuuaaaguua

SEQ ID NO: 4108016 - RNA, 22 nt, Streptococcus pneumoniae R6
aucuuaagacuaaguuagaaua

SEQ ID NO: 4108017 - RNA, 23 nt, Streptococcus pneumoniae R6
aucuuaccagccaauguauuaag

SEQ ID NO: 4108018 - RNA, 17 nt, Streptococcus pneumoniae R6
aucuuacuguccuucuu

SEQ ID NO: 4108019 - RNA, 19 nt, Streptococcus pneumoniae R6
aucuuagaagcaguugugu

SEQ ID NO: 4108020 - RNA, 22 nt, Streptococcus pneumoniae R6
aucuuagauagacucaggaugu

SEQ ID NO: 4108021 - RNA, 15 nt, Streptococcus pneumoniae R6
aucuuagcaaagaua

SEQ ID NO: 4108022 - RNA, 16 nt, Streptococcus pneumoniae R6
aucuuagcgauuuaau

SEQ ID NO: 4108023 - RNA, 21 nt, Streptococcus pneumoniae R6
aucuuaggaacacguaaauua

SEQ ID NO: 4108024 - RNA, 19 nt, Streptococcus pneumoniae R6
aucuuagguugguugcuuc

SEQ ID NO: 4108025 - RNA, 23 nt, Streptococcus pneumoniae R6
aucuuagguugguugcuuccucc

SEQ ID NO: 4108026 - RNA, 16 nt, Streptococcus pneumoniae R6
aucuuaguaguuugua

SEQ ID NO: 4108027 - RNA, 19 nt, Streptococcus pneumoniae R6
aucuuaguaguuuguauaa

SEQ ID NO: 4108028 - RNA, 23 nt, Streptococcus pneumoniae R6
aucuuaguaguuuguauaauccc

SEQ ID NO: 4108029 - RNA, 15 nt, Streptococcus pneumoniae R6
aucuuagucaaaaca

SEQ ID NO: 4108030 - RNA, 16 nt, Streptococcus pneumoniae R6
aucuuagucaaaacaa

SEQ ID NO: 4108031 - RNA, 16 nt, Streptococcus pneumoniae R6
aucuuaguuaaaauaa

SEQ ID NO: 4108032 - RNA, 22 nt, Streptococcus pneumoniae R6
aucuuaguuaaaauaaguuaga

SEQ ID NO: 4108033 - RNA, 19 nt, Streptococcus pneumoniae R6
aucuuauagcgacuauaaa

SEQ ID NO: 4108034 - RNA, 13 nt, Streptococcus pneumoniae R6
aucuuaucucuau

SEQ ID NO: 4108035 - RNA, 13 nt, Streptococcus pneumoniae R6
aucuuauugauuu

SEQ ID NO: 4108036 - RNA, 14 nt, Streptococcus pneumoniae R6
aucuucaaaaucaa

SEQ ID NO: 4108037 - RNA, 18 nt, Streptococcus pneumoniae R6
aucuucaaaaucaaagaa

SEQ ID NO: 4108038 - RNA, 17 nt, Streptococcus pneumoniae R6
aucuucaaauuuuucau

SEQ ID NO: 4108039 - RNA, 21 nt, Streptococcus pneumoniae R6
aucuucagcagcuaaaaacac

SEQ ID NO: 4108040 - RNA, 16 nt, Streptococcus pneumoniae R6
aucuucauuuugguaa

SEQ ID NO: 4108041 - RNA, 16 nt, Streptococcus pneumoniae R6
aucuuccaaaguucga

SEQ ID NO: 4108042 - RNA, 23 nt, Streptococcus pneumoniae R6
aucuuccaaaguucgaaaggcuu

SEQ ID NO: 4108043 - RNA, 13 nt, Streptococcus pneumoniae R6
aucuuccauaucu

SEQ ID NO: 4108044 - RNA, 17 nt, Streptococcus pneumoniae R6
aucuucccacaauaaaa

SEQ ID NO: 4108045 - RNA, 21 nt, Streptococcus pneumoniae R6
aucuucccacaauaaaaagca

SEQ ID NO: 4108046 - RNA, 22 nt, Streptococcus pneumoniae R6
aucuucccguagguuuucuccu

SEQ ID NO: 4108047 - RNA, 23 nt, Streptococcus pneumoniae R6
aucuuccuacauauguaagaaga

SEQ ID NO: 4108048 - RNA, 17 nt, Streptococcus pneumoniae R6
aucuuccuaggauaaag

SEQ ID NO: 4108049 - RNA, 20 nt, Streptococcus pneumoniae R6
aucuuccuaggauaaagcaa

SEQ ID NO: 4108050 - RNA, 17 nt, Streptococcus pneumoniae R6
aucuuccuuacuagcaa

SEQ ID NO: 4108051 - RNA, 11 nt, Streptococcus pneumoniae R6
aucuuccuuga

SEQ ID NO: 4108052 - RNA, 22 nt, Streptococcus pneumoniae R6
aucuucgcaacugucuuaucca

SEQ ID NO: 4108053 - RNA, 16 nt, Streptococcus pneumoniae R6
aucuucggauuuuucu

SEQ ID NO: 4108054 - RNA, 12 nt, Streptococcus pneumoniae R6
aucuucuaaauu

SEQ ID NO: 4108055 - RNA, 13 nt, Streptococcus pneumoniae R6
aucuucuaaauua

SEQ ID NO: 4108056 - RNA, 12 nt, Streptococcus pneumoniae R6
aucuucuagcua

SEQ ID NO: 4108057 - RNA, 21 nt, Streptococcus pneumoniae R6
aucuucuagcuaucuccucau

SEQ ID NO: 4108058 - RNA, 17 nt, Streptococcus pneumoniae R6
aucuucuauugcauaua

SEQ ID NO: 4108059 - RNA, 21 nt, Streptococcus pneumoniae R6
aucuucucacguccuagcucu

SEQ ID NO: 4108060 - RNA, 19 nt, Streptococcus pneumoniae R6
aucuucucaggcuuuuucu

SEQ ID NO: 4108061 - RNA, 18 nt, Streptococcus pneumoniae R6
aucuucuccaaaccauuu

SEQ ID NO: 4108062 - RNA, 17 nt, Streptococcus pneumoniae R6
aucuucuccaguuuuaa

SEQ ID NO: 4108063 - RNA, 18 nt, Streptococcus pneumoniae R6
aucuucuccaguuuuaau

SEQ ID NO: 4108064 - RNA, 16 nt, Streptococcus pneumoniae R6
aucuucuguaccaaua

SEQ ID NO: 4108065 - RNA, 16 nt, Streptococcus pneumoniae R6
aucuucuguguuugaa

SEQ ID NO: 4108066 - RNA, 14 nt, Streptococcus pneumoniae R6
aucuucuuucuccu

SEQ ID NO: 4108067 - RNA, 21 nt, Streptococcus pneumoniae R6
aucuugaacugcauuuuuuca

SEQ ID NO: 4108068 - RNA, 17 nt, Streptococcus pneumoniae R6
aucuugaauauuuuucu

SEQ ID NO: 4108069 - RNA, 14 nt, Streptococcus pneumoniae R6
aucuugagcaaguc

SEQ ID NO: 4108070 - RNA, 16 nt, Streptococcus pneumoniae R6
aucuugauauucuuau

SEQ ID NO: 4108071 - RNA, 22 nt, Streptococcus pneumoniae R6
aucuugauauucuuaucaaauc

SEQ ID NO: 4108072 - RNA, 19 nt, Streptococcus pneumoniae R6
aucuugauuuucuuuaaaa

SEQ ID NO: 4108073 - RNA, 20 nt, Streptococcus pneumoniae R6
aucuugcugguuugugaagc

SEQ ID NO: 4108074 - RNA, 13 nt, Streptococcus pneumoniae R6
aucuuggaguuga

SEQ ID NO: 4108075 - RNA, 15 nt, Streptococcus pneumoniae R6
aucuuggauauucaa

SEQ ID NO: 4108076 - RNA, 17 nt, Streptococcus pneumoniae R6
aucuuggauuauauaug

SEQ ID NO: 4108077 - RNA, 19 nt, Streptococcus pneumoniae R6
aucuuggcgaauauagaca

SEQ ID NO: 4108078 - RNA, 14 nt, Streptococcus pneumoniae R6
aucuuguaaaaccu

SEQ ID NO: 4108079 - RNA, 13 nt, Streptococcus pneumoniae R6
aucuugucaagaa

SEQ ID NO: 4108080 - RNA, 17 nt, Streptococcus pneumoniae R6
aucuuguccacucgaaa

SEQ ID NO: 4108081 - RNA, 17 nt, Streptococcus pneumoniae R6
aucuugucuucaaaggu

SEQ ID NO: 4108082 - RNA, 20 nt, Streptococcus pneumoniae R6
aucuuuaagauacuugauuu

SEQ ID NO: 4108083 - RNA, 11 nt, Streptococcus pneumoniae R6
aucuuuaaggc

SEQ ID NO: 4108084 - RNA, 18 nt, Streptococcus pneumoniae R6
aucuuuagggaaauuauu

SEQ ID NO: 4108085 - RNA, 13 nt, Streptococcus pneumoniae R6
aucuuugaaauaa

SEQ ID NO: 4108086 - RNA, 12 nt, Streptococcus pneumoniae R6
aucuuugauuuu

SEQ ID NO: 4108087 - RNA, 24 nt, Streptococcus pneumoniae R6
aucuuugcgaaguauucaagagua

SEQ ID NO: 4108088 - RNA, 16 nt, Streptococcus pneumoniae R6
aucuuugcuggugcuu

SEQ ID NO: 4108089 - RNA, 15 nt, Streptococcus pneumoniae R6
aucuuuuacuucuga

SEQ ID NO: 4108090 - RNA, 16 nt, Streptococcus pneumoniae R6
aucuuuuacuucugaa

SEQ ID NO: 4108091 - RNA, 15 nt, Streptococcus pneumoniae R6
aucuuuuauuuuuau

SEQ ID NO: 4108092 - RNA, 18 nt, Streptococcus pneumoniae R6
aucuuuugauagaugacu

SEQ ID NO: 4108093 - RNA, 21 nt, Streptococcus pneumoniae R6
aucuuuuuauacucaaugaaa

SEQ ID NO: 4108094 - RNA, 22 nt, Streptococcus pneumoniae R6
aucuuuuucgcuuggauuuuca

SEQ ID NO: 4108095 - RNA, 20 nt, Streptococcus pneumoniae R6
aucuuuuuucauuacacaaa

SEQ ID NO: 4108096 - RNA, 14 nt, Streptococcus pneumoniae R6
augaaaaaaaguuu

SEQ ID NO: 4108097 - RNA, 18 nt, Streptococcus pneumoniae R6
augaaaaaaaguuuaaaa

SEQ ID NO: 4108098 - RNA, 12 nt, Streptococcus pneumoniae R6
augaaaaaaauu

SEQ ID NO: 4108099 - RNA, 16 nt, Streptococcus pneumoniae R6
augaaaaagauuuuuu

SEQ ID NO: 4108100 - RNA, 21 nt, Streptococcus pneumoniae R6
augaaaaagauuuuuuaaaaa

SEQ ID NO: 4108101 - RNA, 12 nt, Streptococcus pneumoniae R6
augaaaaaguuu

SEQ ID NO: 4108102 - RNA, 12 nt, Streptococcus pneumoniae R6
augaaaaccaag

SEQ ID NO: 4108103 - RNA, 21 nt, Streptococcus pneumoniae R6
augaaaagaacuccagugaaa

SEQ ID NO: 4108104 - RNA, 14 nt, Streptococcus pneumoniae R6
augaaaaucaaaga

SEQ ID NO: 4108105 - RNA, 16 nt, Streptococcus pneumoniae R6
augaaaaucauagaaa

SEQ ID NO: 4108106 - RNA, 22 nt, Streptococcus pneumoniae R6
augaaaaucccucccauuuugu

SEQ ID NO: 4108107 - RNA, 23 nt, Streptococcus pneumoniae R6
augaaacaaaaacaggacaaauc

SEQ ID NO: 4108108 - RNA, 23 nt, Streptococcus pneumoniae R6
augaaaccccaagaaacaacaau

SEQ ID NO: 4108109 - RNA, 22 nt, Streptococcus pneumoniae R6
augaaacccuugauuuuuuccu

SEQ ID NO: 4108110 - RNA, 23 nt, Streptococcus pneumoniae R6
augaaacuaauagguacaaaaau

SEQ ID NO: 4108111 - RNA, 22 nt, Streptococcus pneumoniae R6
augaaacugacgaagucaguaa

SEQ ID NO: 4108112 - RNA, 22 nt, Streptococcus pneumoniae R6
augaaacuguggaaaauagaaa

SEQ ID NO: 4108113 - RNA, 21 nt, Streptococcus pneumoniae R6
augaaagcugaugcgguuuga

SEQ ID NO: 4108114 - RNA, 14 nt, Streptococcus pneumoniae R6
augaaauaaaauuu

SEQ ID NO: 4108115 - RNA, 18 nt, Streptococcus pneumoniae R6
augaaauaagaacaggac

SEQ ID NO: 4108116 - RNA, 13 nt, Streptococcus pneumoniae R6
augaaauaauacu

SEQ ID NO: 4108117 - RNA, 17 nt, Streptococcus pneumoniae R6
augaaauacugauguaa

SEQ ID NO: 4108118 - RNA, 14 nt, Streptococcus pneumoniae R6
augaaaugagaaau

SEQ ID NO: 4108119 - RNA, 18 nt, Streptococcus pneumoniae R6
augaaaugagaaauuaug

SEQ ID NO: 4108120 - RNA, 23 nt, Streptococcus pneumoniae R6
augaaauuauucucuaucuuuua

SEQ ID NO: 4108121 - RNA, 16 nt, Streptococcus pneumoniae R6
augaaauuuaaaaaga

SEQ ID NO: 4108122 - RNA, 17 nt, Streptococcus pneumoniae R6
augaaauuuaaaaagaa

SEQ ID NO: 4108123 - RNA, 23 nt, Streptococcus pneumoniae R6
augaacacuagaggggugauuuu

SEQ ID NO: 4108124 - RNA, 14 nt, Streptococcus pneumoniae R6
augaaccucuucau

SEQ ID NO: 4108125 - RNA, 21 nt, Streptococcus pneumoniae R6
augaaccucuucauucaaaga

SEQ ID NO: 4108126 - RNA, 20 nt, Streptococcus pneumoniae R6
augaaccugcuucagauugu

SEQ ID NO: 4108127 - RNA, 22 nt, Streptococcus pneumoniae R6
augaaggcuggaaaaaagucuu

SEQ ID NO: 4108128 - RNA, 17 nt, Streptococcus pneumoniae R6
augaaguggggcaccau

SEQ ID NO: 4108129 - RNA, 19 nt, Streptococcus pneumoniae R6
augaaguuagguuuuguuu

SEQ ID NO: 4108130 - RNA, 17 nt, Streptococcus pneumoniae R6
augaauaacuucaauau

SEQ ID NO: 4108131 - RNA, 22 nt, Streptococcus pneumoniae R6
augaauauauuccauuccucug

SEQ ID NO: 4108132 - RNA, 18 nt, Streptococcus pneumoniae R6
augaaucguaauuuagaa

SEQ ID NO: 4108133 - RNA, 21 nt, Streptococcus pneumoniae R6
augaaucugccagauuccuga

SEQ ID NO: 4108134 - RNA, 17 nt, Streptococcus pneumoniae R6
augaauuacaugaaacu

SEQ ID NO: 4108135 - RNA, 16 nt, Streptococcus pneumoniae R6
augaauugauuuaaca

SEQ ID NO: 4108136 - RNA, 15 nt, Streptococcus pneumoniae R6
augaauugccugaua

SEQ ID NO: 4108137 - RNA, 23 nt, Streptococcus pneumoniae R6
augaauuuacguugaauagcugc

SEQ ID NO: 4108138 - RNA, 23 nt, Streptococcus pneumoniae R6
augaauuucuacaaauguuuuag

SEQ ID NO: 4108139 - RNA, 22 nt, Streptococcus pneumoniae R6
augaauuugaaacaaugaaaau

SEQ ID NO: 4108140 - RNA, 17 nt, Streptococcus pneumoniae R6
augacaaaaauaguaua

SEQ ID NO: 4108141 - RNA, 22 nt, Streptococcus pneumoniae R6
augacaaaguacuugagaaucu

SEQ ID NO: 4108142 - RNA, 18 nt, Streptococcus pneumoniae R6
augacaaaucuaagucaa

SEQ ID NO: 4108143 - RNA, 18 nt, Streptococcus pneumoniae R6
augacaacaccgacagca

SEQ ID NO: 4108144 - RNA, 21 nt, Streptococcus pneumoniae R6
augacaacaccgacagcaagg

SEQ ID NO: 4108145 - RNA, 16 nt, Streptococcus pneumoniae R6
augacaacauggcuuc

SEQ ID NO: 4108146 - RNA, 19 nt, Streptococcus pneumoniae R6
augacaacgggguuuccaa

SEQ ID NO: 4108147 - RNA, 22 nt, Streptococcus pneumoniae R6
augacaacgggguuuccaacga

SEQ ID NO: 4108148 - RNA, 18 nt, Streptococcus pneumoniae R6
augcguuuuucugauuuu

SEQ ID NO: 4108149 - RNA, 12 nt, Streptococcus pneumoniae R6
augcguuuuugu

SEQ ID NO: 4108150 - RNA, 18 nt, Streptococcus pneumoniae R6
augcguuuuugugauuuu

SEQ ID NO: 4108151 - RNA, 18 nt, Streptococcus pneumoniae R6
augcguuuuuucugauuu

SEQ ID NO: 4108152 - RNA, 22 nt, Streptococcus pneumoniae R6
augcguuuuuucugauuucaaa

SEQ ID NO: 4108153 - RNA, 22 nt, Streptococcus pneumoniae R6
augcguuuuuuugauuuuaaag

SEQ ID NO: 4108154 - RNA, 18 nt, Streptococcus pneumoniae R6
augcuaauaguggugugu

SEQ ID NO: 4108155 - RNA, 15 nt, Streptococcus pneumoniae R6
augcuaauuuagaaa

SEQ ID NO: 4108156 - RNA, 19 nt, Streptococcus pneumoniae R6
augcuaauuuagaaauaga

SEQ ID NO: 4108157 - RNA, 21 nt, Streptococcus pneumoniae R6
augcuagacucuuauuucuca

SEQ ID NO: 4108158 - RNA, 19 nt, Streptococcus pneumoniae R6
augcugacaagucauccau

SEQ ID NO: 4108159 - RNA, 22 nt, Streptococcus pneumoniae R6
augcugacaagucauccaugau

SEQ ID NO: 4108160 - RNA, 18 nt, Streptococcus pneumoniae R6
augcugaccgcaaaagcu

SEQ ID NO: 4108161 - RNA, 15 nt, Streptococcus pneumoniae R6
augcugacgugguuu

SEQ ID NO: 4108162 - RNA, 13 nt, Streptococcus pneumoniae R6
augcugcauuuug

SEQ ID NO: 4108163 - RNA, 20 nt, Streptococcus pneumoniae R6
augcuuacuucacuucugua

SEQ ID NO: 4108164 - RNA, 15 nt, Streptococcus pneumoniae R6
augcuuccagcuuua

SEQ ID NO: 4108165 - RNA, 17 nt, Streptococcus pneumoniae R6
augcuugauucaaaguc

SEQ ID NO: 4108166 - RNA, 16 nt, Streptococcus pneumoniae R6
augcuugcaaaucauu

SEQ ID NO: 4108167 - RNA, 14 nt, Streptococcus pneumoniae R6
augcuugcauuuuu

SEQ ID NO: 4108168 - RNA, 16 nt, Streptococcus pneumoniae R6
augcuuggauccauug

SEQ ID NO: 4108169 - RNA, 15 nt, Streptococcus pneumoniae R6
augcuuuacuaguuc

SEQ ID NO: 4108170 - RNA, 23 nt, Streptococcus pneumoniae R6
augcuuuacuaguucucaaauuu

SEQ ID NO: 4108171 - RNA, 12 nt, Streptococcus pneumoniae R6
augcuuuccaac

SEQ ID NO: 4108172 - RNA, 12 nt, Streptococcus pneumoniae R6
augcuuuccauu

SEQ ID NO: 4108173 - RNA, 13 nt, Streptococcus pneumoniae R6
augcuuuccauua

SEQ ID NO: 4108174 - RNA, 17 nt, Streptococcus pneumoniae R6
augcuuuccauuaauuc

SEQ ID NO: 4108175 - RNA, 22 nt, Streptococcus pneumoniae R6
augcuuuccauuaauucgauuu

SEQ ID NO: 4108176 - RNA, 18 nt, Streptococcus pneumoniae R6
augcuuugaacaaauguu

SEQ ID NO: 4108177 - RNA, 19 nt, Streptococcus pneumoniae R6
augcuuuuauucagccaag

SEQ ID NO: 4108178 - RNA, 12 nt, Streptococcus pneumoniae R6
auggaaaaaaug

SEQ ID NO: 4108179 - RNA, 19 nt, Streptococcus pneumoniae R6
auggaaauauaggccaaga

SEQ ID NO: 4108180 - RNA, 15 nt, Streptococcus pneumoniae R6
auggaacuaagauuu

SEQ ID NO: 4108181 - RNA, 20 nt, Streptococcus pneumoniae R6
auggaagguugaguuuuuga

SEQ ID NO: 4108182 - RNA, 22 nt, Streptococcus pneumoniae R6
auggaauaguaucugaugcuga

SEQ ID NO: 4108183 - RNA, 14 nt, Streptococcus pneumoniae R6
auggacuguuauag

SEQ ID NO: 4108184 - RNA, 16 nt, Streptococcus pneumoniae R6
auggagggucaaaaca

SEQ ID NO: 4108185 - RNA, 19 nt, Streptococcus pneumoniae R6
auggaguguucuaaaauaa

SEQ ID NO: 4108186 - RNA, 22 nt, Streptococcus pneumoniae R6
auggaugauuuaauuagaaaaa

SEQ ID NO: 4108187 - RNA, 21 nt, Streptococcus pneumoniae R6
auggauuuauaguaaaaugaa

SEQ ID NO: 4108188 - RNA, 19 nt, Streptococcus pneumoniae R6
auggauuugucauucagau

SEQ ID NO: 4108189 - RNA, 20 nt, Streptococcus pneumoniae R6
auggcaaaaaauugagaaag

SEQ ID NO: 4108190 - RNA, 16 nt, Streptococcus pneumoniae R6
auggcaagaucaaguu

SEQ ID NO: 4108191 - RNA, 18 nt, Streptococcus pneumoniae R6
auggcaauaaacaucucg

SEQ ID NO: 4108192 - RNA, 15 nt, Streptococcus pneumoniae R6
auggcacaaaagguu

SEQ ID NO: 4108193 - RNA, 17 nt, Streptococcus pneumoniae R6
auggccaccuucaacaa

SEQ ID NO: 4108194 - RNA, 20 nt, Streptococcus pneumoniae R6
auggccagauaauucucuaa

SEQ ID NO: 4108195 - RNA, 15 nt, Streptococcus pneumoniae R6
auggcgccauuuggc

SEQ ID NO: 4108196 - RNA, 17 nt, Streptococcus pneumoniae R6
auggcgugggucaucaa

SEQ ID NO: 4108197 - RNA, 16 nt, Streptococcus pneumoniae R6
auggcuaacuucauua

SEQ ID NO: 4108198 - RNA, 20 nt, Streptococcus pneumoniae R6
auggcuccguagauagcugc

SEQ ID NO: 4108199 - RNA, 19 nt, Streptococcus pneumoniae R6
auggcuuaucagucucaua

SEQ ID NO: 4108200 - RNA, 22 nt, Streptococcus pneumoniae R6
auggcuucauuaugaguggcag

SEQ ID NO: 4108201 - RNA, 18 nt, Streptococcus pneumoniae R6
auggcuuguguucugcuc

SEQ ID NO: 4108202 - RNA, 14 nt, Streptococcus pneumoniae R6
augggcaaggagau

SEQ ID NO: 4108203 - RNA, 15 nt, Streptococcus pneumoniae R6
augggccaaaucauc

SEQ ID NO: 4108204 - RNA, 16 nt, Streptococcus pneumoniae R6
auggggggacauaaaa

SEQ ID NO: 4108205 - RNA, 21 nt, Streptococcus pneumoniae R6
augguaggcuuuaucaagcaa

SEQ ID NO: 4108206 - RNA, 18 nt, Streptococcus pneumoniae R6
augguaguuuaccccaaa

SEQ ID NO: 4108207 - RNA, 16 nt, Streptococcus pneumoniae R6
augguaucacauucaa

SEQ ID NO: 4108208 - RNA, 19 nt, Streptococcus pneumoniae R6
augguauccaaaacaacca

SEQ ID NO: 4108209 - RNA, 22 nt, Streptococcus pneumoniae R6
augguauguugcgucaggagca

SEQ ID NO: 4108210 - RNA, 18 nt, Streptococcus pneumoniae R6
augguauuuguaaaauug

SEQ ID NO: 4108211 - RNA, 19 nt, Streptococcus pneumoniae R6
auggucaaaauauuuggag

SEQ ID NO: 4108212 - RNA, 20 nt, Streptococcus pneumoniae R6
augguccgggcugacaacca

SEQ ID NO: 4108213 - RNA, 23 nt, Streptococcus pneumoniae R6
augguguuaauuggaaaauaaau

SEQ ID NO: 4108214 - RNA, 23 nt, Streptococcus pneumoniae R6
augguuacugacuucgucaguuu

SEQ ID NO: 4108215 - RNA, 23 nt, Streptococcus pneumoniae R6
augguuauccgucgcauauuuca

SEQ ID NO: 4108216 - RNA, 17 nt, Streptococcus pneumoniae R6
augguugggaaggugag

SEQ ID NO: 4108217 - RNA, 17 nt, Streptococcus pneumoniae R6
augguuugaugacuuca

SEQ ID NO: 4108218 - RNA, 13 nt, Streptococcus pneumoniae R6
augguuuugaggu

SEQ ID NO: 4108219 - RNA, 12 nt, Streptococcus pneumoniae R6
auguaaaucauu

SEQ ID NO: 4108220 - RNA, 17 nt, Streptococcus pneumoniae R6
auguaauucucaagcug

SEQ ID NO: 4108221 - RNA, 19 nt, Streptococcus pneumoniae R6
auguaauuucugaaaucaa

SEQ ID NO: 4108222 - RNA, 16 nt, Streptococcus pneumoniae R6
auguacgaaaagcacu

SEQ ID NO: 4108223 - RNA, 14 nt, Streptococcus pneumoniae R6
auguacuggauaaa

SEQ ID NO: 4108224 - RNA, 16 nt, Streptococcus pneumoniae R6
auguagauugacauuu

SEQ ID NO: 4108225 - RNA, 22 nt, Streptococcus pneumoniae R6
auguaggccgucucacacggaa

SEQ ID NO: 4108226 - RNA, 16 nt, Streptococcus pneumoniae R6
auguaggcuacagaag

SEQ ID NO: 4108227 - RNA, 21 nt, Streptococcus pneumoniae R6
auguagggugacgaauuuuuu

SEQ ID NO: 4108228 - RNA, 15 nt, Streptococcus pneumoniae R6
auguaguaaucauua

SEQ ID NO: 4108229 - RNA, 15 nt, Streptococcus pneumoniae R6
auguagucaaucaaa

SEQ ID NO: 4108230 - RNA, 19 nt, Streptococcus pneumoniae R6
auguauaauggauugaaau

SEQ ID NO: 4108231 - RNA, 21 nt, Streptococcus pneumoniae R6
auguauaauggauugaaauaa

SEQ ID NO: 4108232 - RNA, 18 nt, Streptococcus pneumoniae R6
auguauauuacagauuuc

SEQ ID NO: 4108233 - RNA, 22 nt, Streptococcus pneumoniae R6
auguaugaugagggaaugacuc

SEQ ID NO: 4108234 - RNA, 19 nt, Streptococcus pneumoniae R6
auguaugguuacugacuuc

SEQ ID NO: 4108235 - RNA, 17 nt, Streptococcus pneumoniae R6
auguauuugaaagggua

SEQ ID NO: 4108236 - RNA, 16 nt, Streptococcus pneumoniae R6
augucauguuagaaaa

SEQ ID NO: 4108237 - RNA, 18 nt, Streptococcus pneumoniae R6
augucauguuagaaaaau

SEQ ID NO: 4108238 - RNA, 14 nt, Streptococcus pneumoniae R6
auguccuaaaacgu

SEQ ID NO: 4108239 - RNA, 19 nt, Streptococcus pneumoniae R6
auguccuaaaacuagugaa

SEQ ID NO: 4108240 - RNA, 17 nt, Streptococcus pneumoniae R6
auguccuggauagacau

SEQ ID NO: 4108241 - RNA, 17 nt, Streptococcus pneumoniae R6
auguccuugauagcaga

SEQ ID NO: 4108242 - RNA, 21 nt, Streptococcus pneumoniae R6
augucggauugcccaaaauga

SEQ ID NO: 4108243 - RNA, 14 nt, Streptococcus pneumoniae R6
augucguuuccuuc

SEQ ID NO: 4108244 - RNA, 15 nt, Streptococcus pneumoniae R6
augucuauuuucuuu

SEQ ID NO: 4108245 - RNA, 21 nt, Streptococcus pneumoniae R6
augucucgacugguaaagaau

SEQ ID NO: 4108246 - RNA, 14 nt, Streptococcus pneumoniae R6
augucugaauauau

SEQ ID NO: 4108247 - RNA, 17 nt, Streptococcus pneumoniae R6
augucugaauauauaau

SEQ ID NO: 4108248 - RNA, 15 nt, Streptococcus pneumoniae R6
augugcuuaacaaaa

SEQ ID NO: 4108249 - RNA, 13 nt, Streptococcus pneumoniae R6
auguggugcuucu

SEQ ID NO: 4108250 - RNA, 20 nt, Streptococcus pneumoniae R6
auuagagguuugcuuagaaa

SEQ ID NO: 4108251 - RNA, 23 nt, Streptococcus pneumoniae R6
auuagcaaaaaagcaaauagcag

SEQ ID NO: 4108252 - RNA, 22 nt, Streptococcus pneumoniae R6
auuagcaucuuaucagaaaaua

SEQ ID NO: 4108253 - RNA, 23 nt, Streptococcus pneumoniae R6
auuagcaucuuaucagaaaauaa

SEQ ID NO: 4108254 - RNA, 12 nt, Streptococcus pneumoniae R6
auuagcucaaaa

SEQ ID NO: 4108255 - RNA, 15 nt, Streptococcus pneumoniae R6
auuagcucaaaacac

SEQ ID NO: 4108256 - RNA, 16 nt, Streptococcus pneumoniae R6
auuagcucaaaacacu

SEQ ID NO: 4108257 - RNA, 19 nt, Streptococcus pneumoniae R6
auuagcucgauugaggucg

SEQ ID NO: 4108258 - RNA, 16 nt, Streptococcus pneumoniae R6
auuagcugauuauguu

SEQ ID NO: 4108259 - RNA, 15 nt, Streptococcus pneumoniae R6
auuaggauagauacc

SEQ ID NO: 4108260 - RNA, 20 nt, Streptococcus pneumoniae R6
auuaggcucuuugucaacug

SEQ ID NO: 4108261 - RNA, 19 nt, Streptococcus pneumoniae R6
auuagggaaacaaaagucu

SEQ ID NO: 4108262 - RNA, 20 nt, Streptococcus pneumoniae R6
auuagggaaacaaaagucuu

SEQ ID NO: 4108263 - RNA, 15 nt, Streptococcus pneumoniae R6
auuagggcaaauaaa

SEQ ID NO: 4108264 - RNA, 17 nt, Streptococcus pneumoniae R6
auuagggcaaauaaaaa

SEQ ID NO: 4108265 - RNA, 17 nt, Streptococcus pneumoniae R6
auuaggggggcuauucu

SEQ ID NO: 4108266 - RNA, 20 nt, Streptococcus pneumoniae R6
auuagggucuuuaaugucua

SEQ ID NO: 4108267 - RNA, 13 nt, Streptococcus pneumoniae R6
auuaguaauuugc

SEQ ID NO: 4108268 - RNA, 15 nt, Streptococcus pneumoniae R6
auuagucaagaguug

SEQ ID NO: 4108269 - RNA, 20 nt, Streptococcus pneumoniae R6
auuagucggaaucuuuaaga

SEQ ID NO: 4108270 - RNA, 17 nt, Streptococcus pneumoniae R6
auuagugaaguguuuag

SEQ ID NO: 4108271 - RNA, 15 nt, Streptococcus pneumoniae R6
auuauaagacuuuuc

SEQ ID NO: 4108272 - RNA, 15 nt, Streptococcus pneumoniae R6
auuauaauaaaauga

SEQ ID NO: 4108273 - RNA, 23 nt, Streptococcus pneumoniae R6
auuauaauaaaaugaaauaagaa

SEQ ID NO: 4108274 - RNA, 20 nt, Streptococcus pneumoniae R6
auuauaaucguuuaaaacac

SEQ ID NO: 4108275 - RNA, 22 nt, Streptococcus pneumoniae R6
auuauacaucuucccacaauaa

SEQ ID NO: 4108276 - RNA, 22 nt, Streptococcus pneumoniae R6
auuauacuauaaaacaauagcu

SEQ ID NO: 4108277 - RNA, 23 nt, Streptococcus pneumoniae R6
auuauacuauaaaacaauagcuu

SEQ ID NO: 4108278 - RNA, 16 nt, Streptococcus pneumoniae R6
auuauacucuuagaaa

SEQ ID NO: 4108279 - RNA, 17 nt, Streptococcus pneumoniae R6
auuauacucuuuagaaa

SEQ ID NO: 4108280 - RNA, 19 nt, Streptococcus pneumoniae R6
auuauacucuuuagaaauc

SEQ ID NO: 4108281 - RNA, 12 nt, Streptococcus pneumoniae R6
auuauagaaaug

SEQ ID NO: 4108282 - RNA, 16 nt, Streptococcus pneumoniae R6
auuauagcauucuucu

SEQ ID NO: 4108283 - RNA, 17 nt, Streptococcus pneumoniae R6
auuauagcggauguuau

SEQ ID NO: 4108284 - RNA, 20 nt, Streptococcus pneumoniae R6
auuauaggacguuuucagau

SEQ ID NO: 4108285 - RNA, 13 nt, Streptococcus pneumoniae R6
auuauaguagagu

SEQ ID NO: 4108286 - RNA, 19 nt, Streptococcus pneumoniae R6
auuauagucgcuagacuga

SEQ ID NO: 4108287 - RNA, 22 nt, Streptococcus pneumoniae R6
auuauagugguguuucaagucu

SEQ ID NO: 4108288 - RNA, 14 nt, Streptococcus pneumoniae R6
auuauauaaaccaa

SEQ ID NO: 4108289 - RNA, 19 nt, Streptococcus pneumoniae R6
auuauauauaugcacagac

SEQ ID NO: 4108290 - RNA, 13 nt, Streptococcus pneumoniae R6
auuauauuuaggg

SEQ ID NO: 4108291 - RNA, 16 nt, Streptococcus pneumoniae R6
auuaucacuacuauaa

SEQ ID NO: 4108292 - RNA, 23 nt, Streptococcus pneumoniae R6
auuaucauaguacaauaccuuuc

SEQ ID NO: 4108293 - RNA, 18 nt, Streptococcus pneumoniae R6
auuauccaacagagaaaa

SEQ ID NO: 4108294 - RNA, 16 nt, Streptococcus pneumoniae R6
auuauccauaauaaua

SEQ ID NO: 4108295 - RNA, 12 nt, Streptococcus pneumoniae R6
auuauccauauu

SEQ ID NO: 4108296 - RNA, 21 nt, Streptococcus pneumoniae R6
auuauccuuuacuuguuuuag

SEQ ID NO: 4108297 - RNA, 22 nt, Streptococcus pneumoniae R6
auuaucggagauggguucccua

SEQ ID NO: 4108298 - RNA, 15 nt, Streptococcus pneumoniae R6
auuaugaaaaccaag

SEQ ID NO: 4108299 - RNA, 16 nt, Streptococcus pneumoniae R6
auuaugaaaaccaaga

SEQ ID NO: 4108300 - RNA, 20 nt, Streptococcus pneumoniae R6
auuaugaaauuuaaaaagaa

SEQ ID NO: 4108301 - RNA, 17 nt, Streptococcus pneumoniae R6
auuaugagcuauuagau

SEQ ID NO: 4108302 - RNA, 12 nt, Streptococcus pneumoniae R6
auuaugauuuaa

SEQ ID NO: 4108303 - RNA, 14 nt, Streptococcus pneumoniae R6
auuaugauuuaaac

SEQ ID NO: 4108304 - RNA, 14 nt, Streptococcus pneumoniae R6
auuaugcguuuuau

SEQ ID NO: 4108305 - RNA, 22 nt, Streptococcus pneumoniae R6
auuaugcguuuuuuugauuuua

SEQ ID NO: 4108306 - RNA, 17 nt, Streptococcus pneumoniae R6
auuaugcuaaagaaauu

SEQ ID NO: 4108307 - RNA, 14 nt, Streptococcus pneumoniae R6
auuauggaccaugc

SEQ ID NO: 4108308 - RNA, 22 nt, Streptococcus pneumoniae R6
auuauguaaauaaauaucaaaa

SEQ ID NO: 4108309 - RNA, 13 nt, Streptococcus pneumoniae R6
auuauguuuuaaa

SEQ ID NO: 4108310 - RNA, 20 nt, Streptococcus pneumoniae R6
auuauguuuuugaauaaccu

SEQ ID NO: 4108311 - RNA, 19 nt, Streptococcus pneumoniae R6
auuauuaaaaucccauauu

SEQ ID NO: 4108312 - RNA, 16 nt, Streptococcus pneumoniae R6
auuauuacaacaauaa

SEQ ID NO: 4108313 - RNA, 15 nt, Streptococcus pneumoniae R6
auuauuaccuugaac

SEQ ID NO: 4108314 - RNA, 17 nt, Streptococcus pneumoniae R6
auuauuaugaaaaccaa

SEQ ID NO: 4108315 - RNA, 12 nt, Streptococcus pneumoniae R6
auuauuuaaagc

SEQ ID NO: 4108316 - RNA, 14 nt, Streptococcus pneumoniae R6
auuauuuaaagcaa

SEQ ID NO: 4108317 - RNA, 16 nt, Streptococcus pneumoniae R6
auuauuuccuugacca

SEQ ID NO: 4108318 - RNA, 18 nt, Streptococcus pneumoniae R6
auuauuucuuuuguacaa

SEQ ID NO: 4108319 - RNA, 13 nt, Streptococcus pneumoniae R6
auuauuuuacugu

SEQ ID NO: 4108320 - RNA, 16 nt, Streptococcus pneumoniae R6
auuauuuuugaaagua

SEQ ID NO: 4108321 - RNA, 18 nt, Streptococcus pneumoniae R6
auuauuuuugaaaguacu

SEQ ID NO: 4108322 - RNA, 13 nt, Streptococcus pneumoniae R6
auuauuuuuuaac

SEQ ID NO: 4108323 - RNA, 17 nt, Streptococcus pneumoniae R6
auucaaaauacaaaagu

SEQ ID NO: 4108324 - RNA, 19 nt, Streptococcus pneumoniae R6
auucaaaugaauuucuaca

SEQ ID NO: 4108325 - RNA, 17 nt, Streptococcus pneumoniae R6
auucaaauuuagcugua

SEQ ID NO: 4108326 - RNA, 12 nt, Streptococcus pneumoniae R6
auucaacaucac

SEQ ID NO: 4108327 - RNA, 19 nt, Streptococcus pneumoniae R6
auucaacgaacuauaaaau

SEQ ID NO: 4108328 - RNA, 16 nt, Streptococcus pneumoniae R6
auucaauccaucucca

SEQ ID NO: 4108329 - RNA, 13 nt, Streptococcus pneumoniae R6
auucaauucuuua

SEQ ID NO: 4108330 - RNA, 17 nt, Streptococcus pneumoniae R6
auucaauucuuuaacaa

SEQ ID NO: 4108331 - RNA, 18 nt, Streptococcus pneumoniae R6
auucaauugcaggagaaa

SEQ ID NO: 4108332 - RNA, 21 nt, Streptococcus pneumoniae R6
auucaauugcaggagaaaaug

SEQ ID NO: 4108333 - RNA, 21 nt, Streptococcus pneumoniae R6
auucaauuuuauacucaucug

SEQ ID NO: 4108334 - RNA, 22 nt, Streptococcus pneumoniae R6
auucacauggagggucaaaaca

SEQ ID NO: 4108335 - RNA, 16 nt, Streptococcus pneumoniae R6
auucaccaauuuuacc

SEQ ID NO: 4108336 - RNA, 14 nt, Streptococcus pneumoniae R6
auucacgaacauga

SEQ ID NO: 4108337 - RNA, 16 nt, Streptococcus pneumoniae R6
auucacuauaacuugu

SEQ ID NO: 4108338 - RNA, 16 nt, Streptococcus pneumoniae R6
auucagagcgauaaaa

SEQ ID NO: 4108339 - RNA, 12 nt, Streptococcus pneumoniae R6
auucagauuuua

SEQ ID NO: 4108340 - RNA, 16 nt, Streptococcus pneumoniae R6
auucagccaaggcucc

SEQ ID NO: 4108341 - RNA, 17 nt, Streptococcus pneumoniae R6
auucaggugauuuacca

SEQ ID NO: 4108342 - RNA, 18 nt, Streptococcus pneumoniae R6
auucagguggguuuucug

SEQ ID NO: 4108343 - RNA, 15 nt, Streptococcus pneumoniae R6
auucaguaacguuag

SEQ ID NO: 4108344 - RNA, 20 nt, Streptococcus pneumoniae R6
auucaguaacguuagcaaag

SEQ ID NO: 4108345 - RNA, 12 nt, Streptococcus pneumoniae R6
auucauaaaaua

SEQ ID NO: 4108346 - RNA, 13 nt, Streptococcus pneumoniae R6
auucauaaagugc

SEQ ID NO: 4108347 - RNA, 14 nt, Streptococcus pneumoniae R6
auucauaaagugcu

SEQ ID NO: 4108348 - RNA, 19 nt, Streptococcus pneumoniae R6
auucauagguucaucuagu

SEQ ID NO: 4108349 - RNA, 17 nt, Streptococcus pneumoniae R6
auucaucaagagacaga

SEQ ID NO: 4108350 - RNA, 18 nt, Streptococcus pneumoniae R6
auucaucacgaucaaagu

SEQ ID NO: 4108351 - RNA, 14 nt, Streptococcus pneumoniae R6
auucaugauugguc

SEQ ID NO: 4108352 - RNA, 13 nt, Streptococcus pneumoniae R6
auucauuaaguca

SEQ ID NO: 4108353 - RNA, 15 nt, Streptococcus pneumoniae R6
auucuuuucaaagua

SEQ ID NO: 4108354 - RNA, 21 nt, Streptococcus pneumoniae R6
auucuuuuuugguuucuugau

SEQ ID NO: 4108355 - RNA, 14 nt, Streptococcus pneumoniae R6
auugaaaaaacuug

SEQ ID NO: 4108356 - RNA, 18 nt, Streptococcus pneumoniae R6
auugaaaauucacaaaau

SEQ ID NO: 4108357 - RNA, 16 nt, Streptococcus pneumoniae R6
auugaaacagcuaaag

SEQ ID NO: 4108358 - RNA, 18 nt, Streptococcus pneumoniae R6
auugaaacagcuaaagac

SEQ ID NO: 4108359 - RNA, 22 nt, Streptococcus pneumoniae R6
auugaaaggaaaaugauuuuuu

SEQ ID NO: 4108360 - RNA, 18 nt, Streptococcus pneumoniae R6
auugaaauaacccaccaa

SEQ ID NO: 4108361 - RNA, 17 nt, Streptococcus pneumoniae R6
auugaaauaagaaauag

SEQ ID NO: 4108362 - RNA, 13 nt, Streptococcus pneumoniae R6
auugaaauagaau

SEQ ID NO: 4108363 - RNA, 16 nt, Streptococcus pneumoniae R6
auugaaaugaaauaaa

SEQ ID NO: 4108364 - RNA, 18 nt, Streptococcus pneumoniae R6
auugaaaugaaauaaaau

SEQ ID NO: 4108365 - RNA, 20 nt, Streptococcus pneumoniae R6
auugaagaagacuagaccac

SEQ ID NO: 4108366 - RNA, 18 nt, Streptococcus pneumoniae R6
auugacaaaauuugguuu

SEQ ID NO: 4108367 - RNA, 18 nt, Streptococcus pneumoniae R6
auugacauaccaccaagu

SEQ ID NO: 4108368 - RNA, 20 nt, Streptococcus pneumoniae R6
auugacauaccaccaaguac

SEQ ID NO: 4108369 - RNA, 20 nt, Streptococcus pneumoniae R6
auugaccaagcuaucagaga

SEQ ID NO: 4108370 - RNA, 18 nt, Streptococcus pneumoniae R6
auugacuauagcagauug

SEQ ID NO: 4108371 - RNA, 15 nt, Streptococcus pneumoniae R6
auugacuauauuucu

SEQ ID NO: 4108372 - RNA, 17 nt, Streptococcus pneumoniae R6
auugacuauauuucuau

SEQ ID NO: 4108373 - RNA, 20 nt, Streptococcus pneumoniae R6
auugacucucaccuguugcu

SEQ ID NO: 4108374 - RNA, 16 nt, Streptococcus pneumoniae R6
auugacugucaauaua

SEQ ID NO: 4108375 - RNA, 15 nt, Streptococcus pneumoniae R6
auugacuuuucuuau

SEQ ID NO: 4108376 - RNA, 15 nt, Streptococcus pneumoniae R6
auugagaaagaugau

SEQ ID NO: 4108377 - RNA, 16 nt, Streptococcus pneumoniae R6
auugagacgacuacuu

SEQ ID NO: 4108378 - RNA, 20 nt, Streptococcus pneumoniae R6
auugagacgacuacuuccua

SEQ ID NO: 4108379 - RNA, 16 nt, Streptococcus pneumoniae R6
auugagagcgacuuuu

SEQ ID NO: 4108380 - RNA, 15 nt, Streptococcus pneumoniae R6
auugaggacaauagc

SEQ ID NO: 4108381 - RNA, 18 nt, Streptococcus pneumoniae R6
auugaggacaauagcgag

SEQ ID NO: 4108382 - RNA, 22 nt, Streptococcus pneumoniae R6
auugaggguaguaauuuucgau

SEQ ID NO: 4108383 - RNA, 15 nt, Streptococcus pneumoniae R6
auugagguccaaguu

SEQ ID NO: 4108384 - RNA, 14 nt, Streptococcus pneumoniae R6
auugaguauaaaug

SEQ ID NO: 4108385 - RNA, 15 nt, Streptococcus pneumoniae R6
auugaguauaaaugg

SEQ ID NO: 4108386 - RNA, 21 nt, Streptococcus pneumoniae R6
auugaguauaaauggacaauc

SEQ ID NO: 4108387 - RNA, 10 nt, Streptococcus pneumoniae R6
auugaguauu

SEQ ID NO: 4108388 - RNA, 14 nt, Streptococcus pneumoniae R6
auugaguucacaaa

SEQ ID NO: 4108389 - RNA, 13 nt, Streptococcus pneumoniae R6
auugaguuuuuug

SEQ ID NO: 4108390 - RNA, 15 nt, Streptococcus pneumoniae R6
auugauaaaauuuaa

SEQ ID NO: 4108391 - RNA, 19 nt, Streptococcus pneumoniae R6
auugauaaaggcagauuuc

SEQ ID NO: 4108392 - RNA, 21 nt, Streptococcus pneumoniae R6
auugauaauaguaugucugaa

SEQ ID NO: 4108393 - RNA, 13 nt, Streptococcus pneumoniae R6
auugauagccauu

SEQ ID NO: 4108394 - RNA, 21 nt, Streptococcus pneumoniae R6
auugauauaaagagcacugcu

SEQ ID NO: 4108395 - RNA, 18 nt, Streptococcus pneumoniae R6
auugauaucuggauuuuc

SEQ ID NO: 4108396 - RNA, 12 nt, Streptococcus pneumoniae R6
auugauauggua

SEQ ID NO: 4108397 - RNA, 21 nt, Streptococcus pneumoniae R6
auugaucuagcucucucugau

SEQ ID NO: 4108398 - RNA, 12 nt, Streptococcus pneumoniae R6
auugaugaacug

SEQ ID NO: 4108399 - RNA, 17 nt, Streptococcus pneumoniae R6
auugaugaagucuagca

SEQ ID NO: 4108400 - RNA, 15 nt, Streptococcus pneumoniae R6
auugaugauguuuaa

SEQ ID NO: 4108401 - RNA, 18 nt, Streptococcus pneumoniae R6
auugaugauguuuaaaau

SEQ ID NO: 4108402 - RNA, 21 nt, Streptococcus pneumoniae R6
auugauuaggaaauucaaaug

SEQ ID NO: 4108403 - RNA, 20 nt, Streptococcus pneumoniae R6
auugauuauuacaacaauaa

SEQ ID NO: 4108404 - RNA, 14 nt, Streptococcus pneumoniae R6
auugauuuccugau

SEQ ID NO: 4108405 - RNA, 22 nt, Streptococcus pneumoniae R6
auugauuugaaugccaaaauuc

SEQ ID NO: 4108406 - RNA, 19 nt, Streptococcus pneumoniae R6
auugauuuucaucaucaca

SEQ ID NO: 4108407 - RNA, 15 nt, Streptococcus pneumoniae R6
auugcaaagcaaucu

SEQ ID NO: 4108408 - RNA, 21 nt, Streptococcus pneumoniae R6
auugcaacuugguaauaccuu

SEQ ID NO: 4108409 - RNA, 13 nt, Streptococcus pneumoniae R6
auugcaagagaaa

SEQ ID NO: 4108410 - RNA, 15 nt, Streptococcus pneumoniae R6
auugcauauacuuua

SEQ ID NO: 4108411 - RNA, 14 nt, Streptococcus pneumoniae R6
auugcccaaaauga

SEQ ID NO: 4108412 - RNA, 19 nt, Streptococcus pneumoniae R6
auugcccaaaaugaggguc

SEQ ID NO: 4108413 - RNA, 16 nt, Streptococcus pneumoniae R6
auugcgauuuugccaa

SEQ ID NO: 4108414 - RNA, 23 nt, Streptococcus pneumoniae R6
auugcgauuuugccaaguuucuu

SEQ ID NO: 4108415 - RNA, 21 nt, Streptococcus pneumoniae R6
auugcgcggguucaauacaaa

SEQ ID NO: 4108416 - RNA, 14 nt, Streptococcus pneumoniae R6
auugcuaaaacauu

SEQ ID NO: 4108417 - RNA, 17 nt, Streptococcus pneumoniae R6
auugcuaaaacauuuau

SEQ ID NO: 4108418 - RNA, 16 nt, Streptococcus pneumoniae R6
auugcucaacuucuuu

SEQ ID NO: 4108419 - RNA, 22 nt, Streptococcus pneumoniae R6
auugcuggaaauagauguuaag

SEQ ID NO: 4108420 - RNA, 15 nt, Streptococcus pneumoniae R6
auugcuggagaauca

SEQ ID NO: 4108421 - RNA, 13 nt, Streptococcus pneumoniae R6
auugcuucauaaa

SEQ ID NO: 4108422 - RNA, 16 nt, Streptococcus pneumoniae R6
auugcuugagcaaucc

SEQ ID NO: 4108423 - RNA, 23 nt, Streptococcus pneumoniae R6
auugcuuuccaauaauucaccua

SEQ ID NO: 4108424 - RNA, 20 nt, Streptococcus pneumoniae R6
auugcuuucuucagauuuua

SEQ ID NO: 4108425 - RNA, 22 nt, Streptococcus pneumoniae R6
auugcuuucuucagauuuuaua

SEQ ID NO: 4108426 - RNA, 23 nt, Streptococcus pneumoniae R6
auuggaggcaaacuucuaaggaa

SEQ ID NO: 4108427 - RNA, 15 nt, Streptococcus pneumoniae R6
auuggauaguuuuuc

SEQ ID NO: 4108428 - RNA, 13 nt, Streptococcus pneumoniae R6
auuggaucuggga

SEQ ID NO: 4108429 - RNA, 15 nt, Streptococcus pneumoniae R6
auuggauuuucugaa

SEQ ID NO: 4108430 - RNA, 17 nt, Streptococcus pneumoniae R6
auuggauuuucugaagu

SEQ ID NO: 4108431 - RNA, 23 nt, Streptococcus pneumoniae R6
auuggcaaagggagguaaagaua

SEQ ID NO: 4108432 - RNA, 14 nt, Streptococcus pneumoniae R6
auuggcuaaagagu

SEQ ID NO: 4108433 - RNA, 16 nt, Streptococcus pneumoniae R6
auuggcucaucugcaa

SEQ ID NO: 4108434 - RNA, 14 nt, Streptococcus pneumoniae R6
auuggguaaagaua

SEQ ID NO: 4108435 - RNA, 16 nt, Streptococcus pneumoniae R6
auugguacauuuugau

SEQ ID NO: 4108436 - RNA, 18 nt, Streptococcus pneumoniae R6
auugguauuaauaauuuu

SEQ ID NO: 4108437 - RNA, 20 nt, Streptococcus pneumoniae R6
auuggucagauuguaaagga

SEQ ID NO: 4108438 - RNA, 22 nt, Streptococcus pneumoniae R6
auuggucgcuuccaauuuuugc

SEQ ID NO: 4108439 - RNA, 17 nt, Streptococcus pneumoniae R6
auugguggcuuccaguu

SEQ ID NO: 4108440 - RNA, 15 nt, Streptococcus pneumoniae R6
auugguguaaauaga

SEQ ID NO: 4108441 - RNA, 18 nt, Streptococcus pneumoniae R6
auuggugucaaaaaggaa

SEQ ID NO: 4108442 - RNA, 14 nt, Streptococcus pneumoniae R6
auugguguuugguu

SEQ ID NO: 4108443 - RNA, 16 nt, Streptococcus pneumoniae R6
auugguguuugguuga

SEQ ID NO: 4108444 - RNA, 13 nt, Streptococcus pneumoniae R6
auugguucugcuc

SEQ ID NO: 4108445 - RNA, 16 nt, Streptococcus pneumoniae R6
auugguucuuuuuacu

SEQ ID NO: 4108446 - RNA, 15 nt, Streptococcus pneumoniae R6
auuguaaacaaaaau

SEQ ID NO: 4108447 - RNA, 22 nt, Streptococcus pneumoniae R6
auuguaaagcgaaaggagaaaa

SEQ ID NO: 4108448 - RNA, 23 nt, Streptococcus pneumoniae R6
auuguaaaggaugacaauagcua

SEQ ID NO: 4108449 - RNA, 18 nt, Streptococcus pneumoniae R6
auuguagauguucuuuga

SEQ ID NO: 4108450 - RNA, 20 nt, Streptococcus pneumoniae R6
auuguaggacuuccuuuucu

SEQ ID NO: 4108451 - RNA, 18 nt, Streptococcus pneumoniae R6
auuguauagugaacugaa

SEQ ID NO: 4108452 - RNA, 18 nt, Streptococcus pneumoniae R6
auuguauagugaauugaa

SEQ ID NO: 4108453 - RNA, 14 nt, Streptococcus pneumoniae R6
auuguauccuaaau

SEQ ID NO: 4108454 - RNA, 20 nt, Streptococcus pneumoniae R6
auuguauccugaaaagccac

SEQ ID NO: 4108455 - RNA, 17 nt, Streptococcus pneumoniae R6
auuguauuuaugugcuu

SEQ ID NO: 4108456 - RNA, 14 nt, Streptococcus pneumoniae R6
auuucacuauguuu

SEQ ID NO: 4108457 - RNA, 22 nt, Streptococcus pneumoniae R6
auuucacuauguuuuaggaggu

SEQ ID NO: 4108458 - RNA, 21 nt, Streptococcus pneumoniae R6
auuucacuuguauccuccucu

SEQ ID NO: 4108459 - RNA, 16 nt, Streptococcus pneumoniae R6
auuucagaaaucuucu

SEQ ID NO: 4108460 - RNA, 17 nt, Streptococcus pneumoniae R6
auuucagaaucccaaag

SEQ ID NO: 4108461 - RNA, 17 nt, Streptococcus pneumoniae R6
auuucaguugccucaga

SEQ ID NO: 4108462 - RNA, 16 nt, Streptococcus pneumoniae R6
auuucaguuucgccug

SEQ ID NO: 4108463 - RNA, 23 nt, Streptococcus pneumoniae R6
auuucauagcuaaucaagcgguu

SEQ ID NO: 4108464 - RNA, 13 nt, Streptococcus pneumoniae R6
auuucauauuuuc

SEQ ID NO: 4108465 - RNA, 14 nt, Streptococcus pneumoniae R6
auuucauauuuuca

SEQ ID NO: 4108466 - RNA, 17 nt, Streptococcus pneumoniae R6
auuucauauuuucagau

SEQ ID NO: 4108467 - RNA, 22 nt, Streptococcus pneumoniae R6
auuucaugacagauucaucacg

SEQ ID NO: 4108468 - RNA, 23 nt, Streptococcus pneumoniae R6
auuucaugguucgggauaaaaua

SEQ ID NO: 4108469 - RNA, 14 nt, Streptococcus pneumoniae R6
auuucauuaaaugg

SEQ ID NO: 4108470 - RNA, 22 nt, Streptococcus pneumoniae R6
auuucauuaaauggaauaguau

SEQ ID NO: 4108471 - RNA, 21 nt, Streptococcus pneumoniae R6
auuucauuacagaacauuuua

SEQ ID NO: 4108472 - RNA, 18 nt, Streptococcus pneumoniae R6
auuucauuucacuauguu

SEQ ID NO: 4108473 - RNA, 20 nt, Streptococcus pneumoniae R6
auuucauuucgacugaaaau

SEQ ID NO: 4108474 - RNA, 13 nt, Streptococcus pneumoniae R6
auuucauuuuaau

SEQ ID NO: 4108475 - RNA, 12 nt, Streptococcus pneumoniae R6
auuucauuuuac

SEQ ID NO: 4108476 - RNA, 19 nt, Streptococcus pneumoniae R6
auuucauuuucuacuaaaa

SEQ ID NO: 4108477 - RNA, 21 nt, Streptococcus pneumoniae R6
auuuccaaaaaguaggcauaa

SEQ ID NO: 4108478 - RNA, 16 nt, Streptococcus pneumoniae R6
auuuccaaucuucucc

SEQ ID NO: 4108479 - RNA, 15 nt, Streptococcus pneumoniae R6
auuuccaaugaugag

SEQ ID NO: 4108480 - RNA, 15 nt, Streptococcus pneumoniae R6
auuuccacuaaaggu

SEQ ID NO: 4108481 - RNA, 14 nt, Streptococcus pneumoniae R6
auuuccauaccaaa

SEQ ID NO: 4108482 - RNA, 14 nt, Streptococcus pneumoniae R6
auuuccaucaacua

SEQ ID NO: 4108483 - RNA, 22 nt, Streptococcus pneumoniae R6
auuuccaucucggucaucauca

SEQ ID NO: 4108484 - RNA, 17 nt, Streptococcus pneumoniae R6
auuuccauuggacaggg

SEQ ID NO: 4108485 - RNA, 15 nt, Streptococcus pneumoniae R6
auuuccauuggagua

SEQ ID NO: 4108486 - RNA, 19 nt, Streptococcus pneumoniae R6
auuuccauuggaguaugcu

SEQ ID NO: 4108487 - RNA, 19 nt, Streptococcus pneumoniae R6
auuuccggcucuuugucaa

SEQ ID NO: 4108488 - RNA, 15 nt, Streptococcus pneumoniae R6
auuuccuagccaaua

SEQ ID NO: 4108489 - RNA, 17 nt, Streptococcus pneumoniae R6
auuuccuaguagaucau

SEQ ID NO: 4108490 - RNA, 16 nt, Streptococcus pneumoniae R6
auuuccucaauguuuu

SEQ ID NO: 4108491 - RNA, 18 nt, Streptococcus pneumoniae R6
auuuccucaauguuuuau

SEQ ID NO: 4108492 - RNA, 20 nt, Streptococcus pneumoniae R6
auuuccuucgcacuuauuuu

SEQ ID NO: 4108493 - RNA, 22 nt, Streptococcus pneumoniae R6
auuuccuucgcacuuauuuuau

SEQ ID NO: 4108494 - RNA, 14 nt, Streptococcus pneumoniae R6
auuucgacugaaaa

SEQ ID NO: 4108495 - RNA, 16 nt, Streptococcus pneumoniae R6
auuucgauugucauca

SEQ ID NO: 4108496 - RNA, 20 nt, Streptococcus pneumoniae R6
auuucguaagaaauuuugga

SEQ ID NO: 4108497 - RNA, 15 nt, Streptococcus pneumoniae R6
auuucguccuuucuu

SEQ ID NO: 4108498 - RNA, 12 nt, Streptococcus pneumoniae R6
auuucuaaaaau

SEQ ID NO: 4108499 - RNA, 13 nt, Streptococcus pneumoniae R6
auuucuaaaacau

SEQ ID NO: 4108500 - RNA, 14 nt, Streptococcus pneumoniae R6
auuucuaaaacauu

SEQ ID NO: 4108501 - RNA, 14 nt, Streptococcus pneumoniae R6
auuucuaaagagua

SEQ ID NO: 4108502 - RNA, 13 nt, Streptococcus pneumoniae R6
auuucuaacauau

SEQ ID NO: 4108503 - RNA, 16 nt, Streptococcus pneumoniae R6
auuucuaacauauuuc

SEQ ID NO: 4108504 - RNA, 20 nt, Streptococcus pneumoniae R6
auuucuaacgagugggacau

SEQ ID NO: 4108505 - RNA, 22 nt, Streptococcus pneumoniae R6
auuucuaauacaagcucaucuu

SEQ ID NO: 4108506 - RNA, 19 nt, Streptococcus pneumoniae R6
auuucuacaaauguuuuag

SEQ ID NO: 4108507 - RNA, 19 nt, Streptococcus pneumoniae R6
auuucuacuguauacuuuu

SEQ ID NO: 4108508 - RNA, 13 nt, Streptococcus pneumoniae R6
auuucuagaaaua

SEQ ID NO: 4108509 - RNA, 15 nt, Streptococcus pneumoniae R6
auuucuagaaauuaa

SEQ ID NO: 4108510 - RNA, 19 nt, Streptococcus pneumoniae R6
auuucuagcaaaguuuuag

SEQ ID NO: 4108511 - RNA, 18 nt, Streptococcus pneumoniae R6
auuucuaguuuugguuuu

SEQ ID NO: 4108512 - RNA, 16 nt, Streptococcus pneumoniae R6
auuucuauaaaucaau

SEQ ID NO: 4108513 - RNA, 18 nt, Streptococcus pneumoniae R6
auuucuauaaaucaauuu

SEQ ID NO: 4108514 - RNA, 20 nt, Streptococcus pneumoniae R6
auuucuauaaaucaauuuuc

SEQ ID NO: 4108515 - RNA, 17 nt, Streptococcus pneumoniae R6
auuucuauaaauucauu

SEQ ID NO: 4108516 - RNA, 17 nt, Streptococcus pneumoniae R6
auuucuaugauaaaacg

SEQ ID NO: 4108517 - RNA, 16 nt, Streptococcus pneumoniae R6
auuucuauuuuaaaaa

SEQ ID NO: 4108518 - RNA, 15 nt, Streptococcus pneumoniae R6
auuucuccuaaagaa

SEQ ID NO: 4108519 - RNA, 16 nt, Streptococcus pneumoniae R6
auuucugaaaucaaca

SEQ ID NO: 4108520 - RNA, 20 nt, Streptococcus pneumoniae R6
auuucugcauaagcuggucu

SEQ ID NO: 4108521 - RNA, 17 nt, Streptococcus pneumoniae R6
auuucugcuaauuuuau

SEQ ID NO: 4108522 - RNA, 16 nt, Streptococcus pneumoniae R6
auuucuggauuuccau

SEQ ID NO: 4108523 - RNA, 17 nt, Streptococcus pneumoniae R6
auuucuggauuuccauu

SEQ ID NO: 4108524 - RNA, 15 nt, Streptococcus pneumoniae R6
auuucuuaauagcug

SEQ ID NO: 4108525 - RNA, 15 nt, Streptococcus pneumoniae R6
auuucuucuggauga

SEQ ID NO: 4108526 - RNA, 16 nt, Streptococcus pneumoniae R6
auuucuugacauacaa

SEQ ID NO: 4108527 - RNA, 21 nt, Streptococcus pneumoniae R6
auuucuugacauacaacuuaa

SEQ ID NO: 4108528 - RNA, 17 nt, Streptococcus pneumoniae R6
auuucuugugcugacau

SEQ ID NO: 4108529 - RNA, 18 nt, Streptococcus pneumoniae R6
auuucuugugcugacauu

SEQ ID NO: 4108530 - RNA, 12 nt, Streptococcus pneumoniae R6
auuucuuuaaaa

SEQ ID NO: 4108531 - RNA, 13 nt, Streptococcus pneumoniae R6
auuucuuuagucc

SEQ ID NO: 4108532 - RNA, 19 nt, Streptococcus pneumoniae R6
auuucuuuauauaaaaaga

SEQ ID NO: 4108533 - RNA, 21 nt, Streptococcus pneumoniae R6
auuucuuuuacucucauucuu

SEQ ID NO: 4108534 - RNA, 15 nt, Streptococcus pneumoniae R6
auuucuuuugauggu

SEQ ID NO: 4108535 - RNA, 14 nt, Streptococcus pneumoniae R6
auuucuuuuuauga

SEQ ID NO: 4108536 - RNA, 14 nt, Streptococcus pneumoniae R6
auuugaaaaauaua

SEQ ID NO: 4108537 - RNA, 21 nt, Streptococcus pneumoniae R6
auuugaaaaauauacaaaaaa

SEQ ID NO: 4108538 - RNA, 13 nt, Streptococcus pneumoniae R6
auuugaaacuaaa

SEQ ID NO: 4108539 - RNA, 13 nt, Streptococcus pneumoniae R6
auuugaacaaagu

SEQ ID NO: 4108540 - RNA, 17 nt, Streptococcus pneumoniae R6
auuugaacaaauuaauu

SEQ ID NO: 4108541 - RNA, 15 nt, Streptococcus pneumoniae R6
auuugaacauuacua

SEQ ID NO: 4108542 - RNA, 19 nt, Streptococcus pneumoniae R6
auuugaacuugaauccuuc

SEQ ID NO: 4108543 - RNA, 14 nt, Streptococcus pneumoniae R6
auuugaccauuuca

SEQ ID NO: 4108544 - RNA, 17 nt, Streptococcus pneumoniae R6
auuugacgaacaaaaag

SEQ ID NO: 4108545 - RNA, 22 nt, Streptococcus pneumoniae R6
auuugacgaacggguucuucca

SEQ ID NO: 4108546 - RNA, 17 nt, Streptococcus pneumoniae R6
auuugacuuccaaaauu

SEQ ID NO: 4108547 - RNA, 18 nt, Streptococcus pneumoniae R6
auuugacuuccaaaauua

SEQ ID NO: 4108548 - RNA, 17 nt, Streptococcus pneumoniae R6
auuugacuuuucuaauc

SEQ ID NO: 4108549 - RNA, 18 nt, Streptococcus pneumoniae R6
auuugagagcauuuuucg

SEQ ID NO: 4108550 - RNA, 16 nt, Streptococcus pneumoniae R6
auuugagguuguagau

SEQ ID NO: 4108551 - RNA, 23 nt, Streptococcus pneumoniae R6
auuugaguaaaagacaucagaug

SEQ ID NO: 4108552 - RNA, 22 nt, Streptococcus pneumoniae R6
auuugaguaacggcuuccugug

SEQ ID NO: 4108553 - RNA, 16 nt, Streptococcus pneumoniae R6
auuugauauagaguuc

SEQ ID NO: 4108554 - RNA, 15 nt, Streptococcus pneumoniae R6
auuugauauauaaau

SEQ ID NO: 4108555 - RNA, 16 nt, Streptococcus pneumoniae R6
auuugauauauaaaug

SEQ ID NO: 4108556 - RNA, 22 nt, Streptococcus pneumoniae R6
auuugauuaggagauucuuaua

SEQ ID NO: 4108557 - RNA, 20 nt, Streptococcus pneumoniae R6
auuugauuuuccuaaucaau

SEQ ID NO: 4108558 - RNA, 17 nt, Streptococcus pneumoniae R6
auuugauuuuguaaaaa

SEQ ID NO: 4108559 - RNA, 14 nt, Streptococcus pneumoniae R6
auuuucuuuaaaaa

SEQ ID NO: 4108560 - RNA, 18 nt, Streptococcus pneumoniae R6
auuuucuuugauuuuaau

SEQ ID NO: 4108561 - RNA, 13 nt, Streptococcus pneumoniae R6
auuuugaaaauuu

SEQ ID NO: 4108562 - RNA, 18 nt, Streptococcus pneumoniae R6
auuuugaagauuguuucg

SEQ ID NO: 4108563 - RNA, 19 nt, Streptococcus pneumoniae R6
auuuugacguucuucugca

SEQ ID NO: 4108564 - RNA, 21 nt, Streptococcus pneumoniae R6
auuuugaggauaaaaaagaag

SEQ ID NO: 4108565 - RNA, 22 nt, Streptococcus pneumoniae R6
auuuuggaagucaaaucaauuu

SEQ ID NO: 4108566 - RNA, 16 nt, Streptococcus pneumoniae R6
auuuugguaauuuuca

SEQ ID NO: 4108567 - RNA, 20 nt, Streptococcus pneumoniae R6
auuuugguaauuuucaagaa

SEQ ID NO: 4108568 - RNA, 13 nt, Streptococcus pneumoniae R6
auuuuguaaaaaa

SEQ ID NO: 4108569 - RNA, 13 nt, Streptococcus pneumoniae R6
auuuuguaaaaau

SEQ ID NO: 4108570 - RNA, 14 nt, Streptococcus pneumoniae R6
auuuuguaaaaaua

SEQ ID NO: 4108571 - RNA, 15 nt, Streptococcus pneumoniae R6
auuuugugaaaaacu

SEQ ID NO: 4108572 - RNA, 17 nt, Streptococcus pneumoniae R6
auuuugugaauuuucaa

SEQ ID NO: 4108573 - RNA, 20 nt, Streptococcus pneumoniae R6
auuuugugauaaaauguaau

SEQ ID NO: 4108574 - RNA, 18 nt, Streptococcus pneumoniae R6
auuuuguucuuuuucaaa

SEQ ID NO: 4108575 - RNA, 23 nt, Streptococcus pneumoniae R6
auuuuguucuuuuucaaaagcua

SEQ ID NO: 4108576 - RNA, 14 nt, Streptococcus pneumoniae R6
auuuuguuucuuaa

SEQ ID NO: 4108577 - RNA, 22 nt, Streptococcus pneumoniae R6
auuuuguuuuugagucaagaua

SEQ ID NO: 4108578 - RNA, 15 nt, Streptococcus pneumoniae R6
auuuuuaaauuuuau

SEQ ID NO: 4108579 - RNA, 18 nt, Streptococcus pneumoniae R6
auuuuuacaguauuuaua

SEQ ID NO: 4108580 - RNA, 21 nt, Streptococcus pneumoniae R6
auuuuuacuuuauuuucucau

SEQ ID NO: 4108581 - RNA, 23 nt, Streptococcus pneumoniae R6
auuuuuagaaggauaaauuuuau

SEQ ID NO: 4108582 - RNA, 22 nt, Streptococcus pneumoniae R6
auuuuuaggaagguuauuugga

SEQ ID NO: 4108583 - RNA, 13 nt, Streptococcus pneumoniae R6
auuuuucaaauaa

SEQ ID NO: 4108584 - RNA, 21 nt, Streptococcus pneumoniae R6
auuuuucaaggugaaguucac

SEQ ID NO: 4108585 - RNA, 13 nt, Streptococcus pneumoniae R6
auuuuucaauauc

SEQ ID NO: 4108586 - RNA, 20 nt, Streptococcus pneumoniae R6
auuuuucgaaauuuauaaua

SEQ ID NO: 4108587 - RNA, 14 nt, Streptococcus pneumoniae R6
auuuuucuaaauuu

SEQ ID NO: 4108588 - RNA, 15 nt, Streptococcus pneumoniae R6
auuuuucugagucug

SEQ ID NO: 4108589 - RNA, 17 nt, Streptococcus pneumoniae R6
auuuuucuguuuucuua

SEQ ID NO: 4108590 - RNA, 15 nt, Streptococcus pneumoniae R6
auuuuucuucuuuuc

SEQ ID NO: 4108591 - RNA, 12 nt, Streptococcus pneumoniae R6
auuuuucuuugu

SEQ ID NO: 4108592 - RNA, 14 nt, Streptococcus pneumoniae R6
auuuuugaaaggau

SEQ ID NO: 4108593 - RNA, 17 nt, Streptococcus pneumoniae R6
auuuuugaaaguacuuu

SEQ ID NO: 4108594 - RNA, 23 nt, Streptococcus pneumoniae R6
auuuuugagaugggacuaaagau

SEQ ID NO: 4108595 - RNA, 11 nt, Streptococcus pneumoniae R6
auuuuugauuc

SEQ ID NO: 4108596 - RNA, 12 nt, Streptococcus pneumoniae R6
auuuuugcuucu

SEQ ID NO: 4108597 - RNA, 14 nt, Streptococcus pneumoniae R6
auuuuuggaaaaaa

SEQ ID NO: 4108598 - RNA, 20 nt, Streptococcus pneumoniae R6
auuuuuggaaaaaauaaaaa

SEQ ID NO: 4108599 - RNA, 20 nt, Streptococcus pneumoniae R6
auuuuuggagugauagaaaa

SEQ ID NO: 4108600 - RNA, 20 nt, Streptococcus pneumoniae R6
auuuuuggcugauuucuugg

SEQ ID NO: 4108601 - RNA, 20 nt, Streptococcus pneumoniae R6
auuuuuuaacagauuuuucu

SEQ ID NO: 4108602 - RNA, 23 nt, Streptococcus pneumoniae R6
auuuuuuaucgaaaagacuuagu

SEQ ID NO: 4108603 - RNA, 13 nt, Streptococcus pneumoniae R6
auuuuuuaugguu

SEQ ID NO: 4108604 - RNA, 16 nt, Streptococcus pneumoniae R6
auuuuuuaugguuuga

SEQ ID NO: 4108605 - RNA, 19 nt, Streptococcus pneumoniae R6
auuuuuucaccaaaaccaa

SEQ ID NO: 4108606 - RNA, 21 nt, Streptococcus pneumoniae R6
auuuuuucaccaaaaccaauc

SEQ ID NO: 4108607 - RNA, 11 nt, Streptococcus pneumoniae R6
auuuuuucuug

SEQ ID NO: 4108608 - RNA, 17 nt, Streptococcus pneumoniae R6
auuuuuugaaucaauuu

SEQ ID NO: 4108609 - RNA, 15 nt, Streptococcus pneumoniae R6
auuuuuugcaucaac

SEQ ID NO: 4108610 - RNA, 22 nt, Streptococcus pneumoniae R6
auuuuuugcaucaacuauucuu

SEQ ID NO: 4108611 - RNA, 15 nt, Streptococcus pneumoniae R6
auuuuuuucaaacaa

SEQ ID NO: 4108612 - RNA, 21 nt, Streptococcus pneumoniae R6
auuuuuuucauagaaaucaau

SEQ ID NO: 4108613 - RNA, 13 nt, Streptococcus pneumoniae R6
auuuuuuuuaaaa

SEQ ID NO: 4108614 - RNA, 16 nt, Streptococcus pneumoniae R6
caaaaaaaaugaaaaa

SEQ ID NO: 4108615 - RNA, 18 nt, Streptococcus pneumoniae R6
caaaaaaaaugaaaaaaa

SEQ ID NO: 4108616 - RNA, 21 nt, Streptococcus pneumoniae R6
caaaaaaagcuguuaaaaacu

SEQ ID NO: 4108617 - RNA, 23 nt, Streptococcus pneumoniae R6
caaaaaaagcuguuaaaaacuca

SEQ ID NO: 4108618 - RNA, 16 nt, Streptococcus pneumoniae R6
caaaaaaaucguaaaa

SEQ ID NO: 4108619 - RNA, 20 nt, Streptococcus pneumoniae R6
caaaaaacgcauaguaucaa

SEQ ID NO: 4108620 - RNA, 20 nt, Streptococcus pneumoniae R6
caaaaaaggucaucagcaga

SEQ ID NO: 4108621 - RNA, 16 nt, Streptococcus pneumoniae R6
caaaaaauauuuauag

SEQ ID NO: 4108622 - RNA, 12 nt, Streptococcus pneumoniae R6
caaaaaaugccu

SEQ ID NO: 4108623 - RNA, 20 nt, Streptococcus pneumoniae R6
caaaaaauguagucauucga

SEQ ID NO: 4108624 - RNA, 22 nt, Streptococcus pneumoniae R6
caaaaaauugcacuuuccucuu

SEQ ID NO: 4108625 - RNA, 23 nt, Streptococcus pneumoniae R6
caaaaaauugcacuuuccucuug

SEQ ID NO: 4108626 - RNA, 15 nt, Streptococcus pneumoniae R6
caaaaacaggacaaa

SEQ ID NO: 4108627 - RNA, 18 nt, Streptococcus pneumoniae R6
caaaaacaggacaaaucg

SEQ ID NO: 4108628 - RNA, 20 nt, Streptococcus pneumoniae R6
caaaaacauaauuuuaguag

SEQ ID NO: 4108629 - RNA, 18 nt, Streptococcus pneumoniae R6
caaaaacgauaaaagcua

SEQ ID NO: 4108630 - RNA, 12 nt, Streptococcus pneumoniae R6
caaaaacucaau

SEQ ID NO: 4108631 - RNA, 17 nt, Streptococcus pneumoniae R6
caaaaagcauucuauuc

SEQ ID NO: 4108632 - RNA, 22 nt, Streptococcus pneumoniae R6
caaaaagggggcaaaacuuuca

SEQ ID NO: 4108633 - RNA, 15 nt, Streptococcus pneumoniae R6
caaaaagugcaugag

SEQ ID NO: 4108634 - RNA, 12 nt, Streptococcus pneumoniae R6
caaaaauauaau

SEQ ID NO: 4108635 - RNA, 18 nt, Streptococcus pneumoniae R6
caaaaauauaauggucug

SEQ ID NO: 4108636 - RNA, 15 nt, Streptococcus pneumoniae R6
caaaaaucauuauau

SEQ ID NO: 4108637 - RNA, 17 nt, Streptococcus pneumoniae R6
caaaaaucauuauauuu

SEQ ID NO: 4108638 - RNA, 12 nt, Streptococcus pneumoniae R6
caaaaaugugaa

SEQ ID NO: 4108639 - RNA, 13 nt, Streptococcus pneumoniae R6
caaaacaaauugu

SEQ ID NO: 4108640 - RNA, 15 nt, Streptococcus pneumoniae R6
caaaacacaaaaagu

SEQ ID NO: 4108641 - RNA, 11 nt, Streptococcus pneumoniae R6
caaaacacugu

SEQ ID NO: 4108642 - RNA, 23 nt, Streptococcus pneumoniae R6
caaaacacuguuuugagguugca

SEQ ID NO: 4108643 - RNA, 14 nt, Streptococcus pneumoniae R6
caaaacaguguuuu

SEQ ID NO: 4108644 - RNA, 22 nt, Streptococcus pneumoniae R6
caaaacaguguuuugagcacgu

SEQ ID NO: 4108645 - RNA, 20 nt, Streptococcus pneumoniae R6
caaaacaguguuuugagcua

SEQ ID NO: 4108646 - RNA, 21 nt, Streptococcus pneumoniae R6
caaaacaguguuuugagcuga

SEQ ID NO: 4108647 - RNA, 22 nt, Streptococcus pneumoniae R6
caaaacaguguuuugaucugac

SEQ ID NO: 4108648 - RNA, 15 nt, Streptococcus pneumoniae R6
caaaaccaaacucac

SEQ ID NO: 4108649 - RNA, 22 nt, Streptococcus pneumoniae R6
caaaaccaaacucacgaagaua

SEQ ID NO: 4108650 - RNA, 20 nt, Streptococcus pneumoniae R6
caaaaccaguccuggaaaaa

SEQ ID NO: 4108651 - RNA, 16 nt, Streptococcus pneumoniae R6
caaaaccaguccuuga

SEQ ID NO: 4108652 - RNA, 16 nt, Streptococcus pneumoniae R6
caaaaccauucaaaau

SEQ ID NO: 4108653 - RNA, 17 nt, Streptococcus pneumoniae R6
caaaaccauucaaaaua

SEQ ID NO: 4108654 - RNA, 20 nt, Streptococcus pneumoniae R6
caaaaccugguacaguuggg

SEQ ID NO: 4108655 - RNA, 17 nt, Streptococcus pneumoniae R6
caaaacgagucaagaag

SEQ ID NO: 4108656 - RNA, 18 nt, Streptococcus pneumoniae R6
caaaacgcauaguaucaa

SEQ ID NO: 4108657 - RNA, 17 nt, Streptococcus pneumoniae R6
caaaacgccaucuucca

SEQ ID NO: 4108658 - RNA, 22 nt, Streptococcus pneumoniae R6
caaaacgguugagcauguaguc

SEQ ID NO: 4108659 - RNA, 17 nt, Streptococcus pneumoniae R6
caaaacguaguuuuuuu

SEQ ID NO: 4108660 - RNA, 15 nt, Streptococcus pneumoniae R6
caaaacguucccaac

SEQ ID NO: 4108661 - RNA, 20 nt, Streptococcus pneumoniae R6
caaagacuucuugagcuagg

SEQ ID NO: 4108662 - RNA, 17 nt, Streptococcus pneumoniae R6
caaagagccaaaaaaga

SEQ ID NO: 4108663 - RNA, 19 nt, Streptococcus pneumoniae R6
caaagagccaaaaaagaaa

SEQ ID NO: 4108664 - RNA, 18 nt, Streptococcus pneumoniae R6
caaagagccauaaaaaua

SEQ ID NO: 4108665 - RNA, 19 nt, Streptococcus pneumoniae R6
caaagagccauaaaaauaa

SEQ ID NO: 4108666 - RNA, 21 nt, Streptococcus pneumoniae R6
caaagagccauaaaaauaacu

SEQ ID NO: 4108667 - RNA, 17 nt, Streptococcus pneumoniae R6
caaagagccgaaaaaau

SEQ ID NO: 4108668 - RNA, 13 nt, Streptococcus pneumoniae R6
caaagagccuaua

SEQ ID NO: 4108669 - RNA, 18 nt, Streptococcus pneumoniae R6
caaagagucccuuagaaa

SEQ ID NO: 4108670 - RNA, 17 nt, Streptococcus pneumoniae R6
caaagaguucccugcuc

SEQ ID NO: 4108671 - RNA, 18 nt, Streptococcus pneumoniae R6
caaagaguucccugcucu

SEQ ID NO: 4108672 - RNA, 22 nt, Streptococcus pneumoniae R6
caaagauaaggccugauaagau

SEQ ID NO: 4108673 - RNA, 15 nt, Streptococcus pneumoniae R6
caaagauauugagac

SEQ ID NO: 4108674 - RNA, 14 nt, Streptococcus pneumoniae R6
caaagauguucuca

SEQ ID NO: 4108675 - RNA, 19 nt, Streptococcus pneumoniae R6
caaagauuaaucuucaaau

SEQ ID NO: 4108676 - RNA, 19 nt, Streptococcus pneumoniae R6
caaagcacggagaacaaua

SEQ ID NO: 4108677 - RNA, 15 nt, Streptococcus pneumoniae R6
caaagcacugauuug

SEQ ID NO: 4108678 - RNA, 17 nt, Streptococcus pneumoniae R6
caaagcaucaaucaaac

SEQ ID NO: 4108679 - RNA, 16 nt, Streptococcus pneumoniae R6
caaagccaaucaaaaa

SEQ ID NO: 4108680 - RNA, 15 nt, Streptococcus pneumoniae R6
caaagccggguuuuc

SEQ ID NO: 4108681 - RNA, 20 nt, Streptococcus pneumoniae R6
caaagccuucuugguuuuug

SEQ ID NO: 4108682 - RNA, 16 nt, Streptococcus pneumoniae R6
caaagcgauaaaaauc

SEQ ID NO: 4108683 - RNA, 20 nt, Streptococcus pneumoniae R6
caaagcgggauuuaaaauaa

SEQ ID NO: 4108684 - RNA, 22 nt, Streptococcus pneumoniae R6
caaagcgggugacgagaaucga

SEQ ID NO: 4108685 - RNA, 15 nt, Streptococcus pneumoniae R6
caaagcuacuuuuuu

SEQ ID NO: 4108686 - RNA, 16 nt, Streptococcus pneumoniae R6
caaagcucaagaguuc

SEQ ID NO: 4108687 - RNA, 17 nt, Streptococcus pneumoniae R6
caaaggaaccaaaugau

SEQ ID NO: 4108688 - RNA, 14 nt, Streptococcus pneumoniae R6
caaaggaagcugag

SEQ ID NO: 4108689 - RNA, 22 nt, Streptococcus pneumoniae R6
caaaggacuaugaucagcauuu

SEQ ID NO: 4108690 - RNA, 22 nt, Streptococcus pneumoniae R6
caaaggauuuaguucuguacug

SEQ ID NO: 4108691 - RNA, 19 nt, Streptococcus pneumoniae R6
caaaggcaucaucugaaau

SEQ ID NO: 4108692 - RNA, 19 nt, Streptococcus pneumoniae R6
caaaggcauugugcuugau

SEQ ID NO: 4108693 - RNA, 19 nt, Streptococcus pneumoniae R6
caaaggcuuuuucuucuuc

SEQ ID NO: 4108694 - RNA, 21 nt, Streptococcus pneumoniae R6
caaagggagguaaagauagcc

SEQ ID NO: 4108695 - RNA, 20 nt, Streptococcus pneumoniae R6
caaagggaugauguuaucaa

SEQ ID NO: 4108696 - RNA, 17 nt, Streptococcus pneumoniae R6
caaaggucauuuuccac

SEQ ID NO: 4108697 - RNA, 18 nt, Streptococcus pneumoniae R6
caaaggucucuucuucug

SEQ ID NO: 4108698 - RNA, 16 nt, Streptococcus pneumoniae R6
caaaggugaagccuuc

SEQ ID NO: 4108699 - RNA, 21 nt, Streptococcus pneumoniae R6
caaaggugcagagagauaaau

SEQ ID NO: 4108700 - RNA, 19 nt, Streptococcus pneumoniae R6
caaagguugcuugauagua

SEQ ID NO: 4108701 - RNA, 20 nt, Streptococcus pneumoniae R6
caaagguuugauuaguccau

SEQ ID NO: 4108702 - RNA, 21 nt, Streptococcus pneumoniae R6
caaaguacagauuugaaaacu

SEQ ID NO: 4108703 - RNA, 22 nt, Streptococcus pneumoniae R6
caaaguacugccuugagguuuu

SEQ ID NO: 4108704 - RNA, 15 nt, Streptococcus pneumoniae R6
caaaguacuugagaa

SEQ ID NO: 4108705 - RNA, 23 nt, Streptococcus pneumoniae R6
caaaguacuugagaaucuuaugc

SEQ ID NO: 4108706 - RNA, 16 nt, Streptococcus pneumoniae R6
caaaguauuaaaauaa

SEQ ID NO: 4108707 - RNA, 18 nt, Streptococcus pneumoniae R6
caaagucaucaaaauccg

SEQ ID NO: 4108708 - RNA, 12 nt, Streptococcus pneumoniae R6
caaagucugaaa

SEQ ID NO: 4108709 - RNA, 17 nt, Streptococcus pneumoniae R6
caaaguggagguguucu

SEQ ID NO: 4108710 - RNA, 23 nt, Streptococcus pneumoniae R6
caaaguggguuuuaacuacauag

SEQ ID NO: 4108711 - RNA, 14 nt, Streptococcus pneumoniae R6
caaaguuccgaaau

SEQ ID NO: 4108712 - RNA, 17 nt, Streptococcus pneumoniae R6
caaaguuccuaaaacca

SEQ ID NO: 4108713 - RNA, 22 nt, Streptococcus pneumoniae R6
caaaguucgaaaggcuuuauuc

SEQ ID NO: 4108714 - RNA, 11 nt, Streptococcus pneumoniae R6
caaaguuugaa

SEQ ID NO: 4108715 - RNA, 18 nt, Streptococcus pneumoniae R6
caaauaaaaagcuuuaag

SEQ ID NO: 4108716 - RNA, 19 nt, Streptococcus pneumoniae R6
caaauaaacggacaaaacu

SEQ ID NO: 4108717 - RNA, 23 nt, Streptococcus pneumoniae R6
caaauaaaucauugauaguaaca

SEQ ID NO: 4108718 - RNA, 14 nt, Streptococcus pneumoniae R6
caaauaagaaagac

SEQ ID NO: 4108719 - RNA, 14 nt, Streptococcus pneumoniae R6
caaauaagaaaucu

SEQ ID NO: 4108720 - RNA, 15 nt, Streptococcus pneumoniae R6
caaauaauuuaucca

SEQ ID NO: 4108721 - RNA, 23 nt, Streptococcus pneumoniae R6
caaauacucggaggacaucacug

SEQ ID NO: 4108722 - RNA, 15 nt, Streptococcus pneumoniae R6
caaauagaagauuuc

SEQ ID NO: 4108723 - RNA, 19 nt, Streptococcus pneumoniae R6
caaauagcccauaaagaga

SEQ ID NO: 4108724 - RNA, 22 nt, Streptococcus pneumoniae R6
caaauagcccauaaagagaggu

SEQ ID NO: 4108725 - RNA, 13 nt, Streptococcus pneumoniae R6
caaauauuguaaa

SEQ ID NO: 4108726 - RNA, 13 nt, Streptococcus pneumoniae R6
caaaucaaauuua

SEQ ID NO: 4108727 - RNA, 19 nt, Streptococcus pneumoniae R6
caaaucaaauuuauucaga

SEQ ID NO: 4108728 - RNA, 12 nt, Streptococcus pneumoniae R6
caaaucaacugg

SEQ ID NO: 4108729 - RNA, 14 nt, Streptococcus pneumoniae R6
caaaucaauuuuua

SEQ ID NO: 4108730 - RNA, 19 nt, Streptococcus pneumoniae R6
caaaucauugaguuggcuu

SEQ ID NO: 4108731 - RNA, 13 nt, Streptococcus pneumoniae R6
caaaucauuuuga

SEQ ID NO: 4108732 - RNA, 14 nt, Streptococcus pneumoniae R6
caaaucccaugaca

SEQ ID NO: 4108733 - RNA, 23 nt, Streptococcus pneumoniae R6
caaaucccaugacaaucauuuca

SEQ ID NO: 4108734 - RNA, 23 nt, Streptococcus pneumoniae R6
caaauccccaucuuuagcuccac

SEQ ID NO: 4108735 - RNA, 14 nt, Streptococcus pneumoniae R6
caaaucccuagcuc

SEQ ID NO: 4108736 - RNA, 23 nt, Streptococcus pneumoniae R6
caaauccuauucggacuuuggcu

SEQ ID NO: 4108737 - RNA, 16 nt, Streptococcus pneumoniae R6
caaauccuugaagauu

SEQ ID NO: 4108738 - RNA, 16 nt, Streptococcus pneumoniae R6
caaaucgauaaagaag

SEQ ID NO: 4108739 - RNA, 19 nt, Streptococcus pneumoniae R6
caaaucgauuaggaaagga

SEQ ID NO: 4108740 - RNA, 23 nt, Streptococcus pneumoniae R6
caaaucgauuaggaaaggaaaau

SEQ ID NO: 4108741 - RNA, 15 nt, Streptococcus pneumoniae R6
caaaucucauuugau

SEQ ID NO: 4108742 - RNA, 21 nt, Streptococcus pneumoniae R6
caaaucucauuugaugagaaa

SEQ ID NO: 4108743 - RNA, 22 nt, Streptococcus pneumoniae R6
caaaugaaauauuuuuuacuuu

SEQ ID NO: 4108744 - RNA, 18 nt, Streptococcus pneumoniae R6
caaaugaauuucuacaaa

SEQ ID NO: 4108745 - RNA, 22 nt, Streptococcus pneumoniae R6
caaaugacuaagcccaaagaua

SEQ ID NO: 4108746 - RNA, 16 nt, Streptococcus pneumoniae R6
caaaugacuuucuaau

SEQ ID NO: 4108747 - RNA, 18 nt, Streptococcus pneumoniae R6
caaaugagauuugcauca

SEQ ID NO: 4108748 - RNA, 23 nt, Streptococcus pneumoniae R6
caaauggauagaucuuuacuuga

SEQ ID NO: 4108749 - RNA, 14 nt, Streptococcus pneumoniae R6
caaauguauuugaa

SEQ ID NO: 4108750 - RNA, 18 nt, Streptococcus pneumoniae R6
caaauuaauuauacuaua

SEQ ID NO: 4108751 - RNA, 19 nt, Streptococcus pneumoniae R6
caaauuaauucggaaagcc

SEQ ID NO: 4108752 - RNA, 15 nt, Streptococcus pneumoniae R6
caaauuaauuuauag

SEQ ID NO: 4108753 - RNA, 18 nt, Streptococcus pneumoniae R6
caaauuaauuuauagaaa

SEQ ID NO: 4108754 - RNA, 20 nt, Streptococcus pneumoniae R6
caaauuaauuuauagaaaua

SEQ ID NO: 4108755 - RNA, 19 nt, Streptococcus pneumoniae R6
caaauuaauuucuagaaau

SEQ ID NO: 4108756 - RNA, 22 nt, Streptococcus pneumoniae R6
caaauuauuggucgcuucaagu

SEQ ID NO: 4108757 - RNA, 15 nt, Streptococcus pneumoniae R6
caaauuauuuacaga

SEQ ID NO: 4108758 - RNA, 20 nt, Streptococcus pneumoniae R6
caaauuauuuacagaaagaa

SEQ ID NO: 4108759 - RNA, 12 nt, Streptococcus pneumoniae R6
caaauucaccaa

SEQ ID NO: 4108760 - RNA, 16 nt, Streptococcus pneumoniae R6
caaauucaccaauuuu

SEQ ID NO: 4108761 - RNA, 22 nt, Streptococcus pneumoniae R6
caaauugauuaggaaauucaaa

SEQ ID NO: 4108762 - RNA, 16 nt, Streptococcus pneumoniae R6
caaauuguaaggauuu

SEQ ID NO: 4108763 - RNA, 22 nt, Streptococcus pneumoniae R6
caagaccgagaaacaagaacuc

SEQ ID NO: 4108764 - RNA, 15 nt, Streptococcus pneumoniae R6
caagaccgagaguuc

SEQ ID NO: 4108765 - RNA, 22 nt, Streptococcus pneumoniae R6
caagacuugguuuggcauugag

SEQ ID NO: 4108766 - RNA, 21 nt, Streptococcus pneumoniae R6
caagacuuucaaaccauugcu

SEQ ID NO: 4108767 - RNA, 21 nt, Streptococcus pneumoniae R6
caagacuuuuugagccaagcg

SEQ ID NO: 4108768 - RNA, 20 nt, Streptococcus pneumoniae R6
caagagacgauuccaaacaa

SEQ ID NO: 4108769 - RNA, 14 nt, Streptococcus pneumoniae R6
caagagacucuuua

SEQ ID NO: 4108770 - RNA, 23 nt, Streptococcus pneumoniae R6
caagagauuuucaaaaaaagcug

SEQ ID NO: 4108771 - RNA, 14 nt, Streptococcus pneumoniae R6
caagagcaaaaaca

SEQ ID NO: 4108772 - RNA, 16 nt, Streptococcus pneumoniae R6
caagagcaaaaacaau

SEQ ID NO: 4108773 - RNA, 21 nt, Streptococcus pneumoniae R6
caagagccuuuuuaaagauau

SEQ ID NO: 4108774 - RNA, 11 nt, Streptococcus pneumoniae R6
caagagcuuua

SEQ ID NO: 4108775 - RNA, 18 nt, Streptococcus pneumoniae R6
caagagggcuucaaucuc

SEQ ID NO: 4108776 - RNA, 15 nt, Streptococcus pneumoniae R6
caagaguugauagag

SEQ ID NO: 4108777 - RNA, 14 nt, Streptococcus pneumoniae R6
caagauaagaaaaa

SEQ ID NO: 4108778 - RNA, 14 nt, Streptococcus pneumoniae R6
caagauagcuguga

SEQ ID NO: 4108779 - RNA, 15 nt, Streptococcus pneumoniae R6
caagauaguaaagag

SEQ ID NO: 4108780 - RNA, 17 nt, Streptococcus pneumoniae R6
caagauaguaaagagcu

SEQ ID NO: 4108781 - RNA, 14 nt, Streptococcus pneumoniae R6
caagauauucuuga

SEQ ID NO: 4108782 - RNA, 16 nt, Streptococcus pneumoniae R6
caagauauucuugauu

SEQ ID NO: 4108783 - RNA, 16 nt, Streptococcus pneumoniae R6
caagaucuugucugca

SEQ ID NO: 4108784 - RNA, 22 nt, Streptococcus pneumoniae R6
caagaugauuccugucauggcu

SEQ ID NO: 4108785 - RNA, 18 nt, Streptococcus pneumoniae R6
caagauggacuguuauag

SEQ ID NO: 4108786 - RNA, 22 nt, Streptococcus pneumoniae R6
caagauuuccugagaugacaac

SEQ ID NO: 4108787 - RNA, 13 nt, Streptococcus pneumoniae R6
caagcaacaaaaa

SEQ ID NO: 4108788 - RNA, 16 nt, Streptococcus pneumoniae R6
caagcauaacagcauu

SEQ ID NO: 4108789 - RNA, 20 nt, Streptococcus pneumoniae R6
caagcauaacagcauuucca

SEQ ID NO: 4108790 - RNA, 17 nt, Streptococcus pneumoniae R6
caagccauaagaaagga

SEQ ID NO: 4108791 - RNA, 17 nt, Streptococcus pneumoniae R6
caagcccaucaauaccc

SEQ ID NO: 4108792 - RNA, 16 nt, Streptococcus pneumoniae R6
caagcccuuauuucca

SEQ ID NO: 4108793 - RNA, 23 nt, Streptococcus pneumoniae R6
caagccugcuaucuuuuuuugau

SEQ ID NO: 4108794 - RNA, 19 nt, Streptococcus pneumoniae R6
caagccuuauugcucuuga

SEQ ID NO: 4108795 - RNA, 16 nt, Streptococcus pneumoniae R6
caagcgaacaucucca

SEQ ID NO: 4108796 - RNA, 14 nt, Streptococcus pneumoniae R6
caagcgaagggcuu

SEQ ID NO: 4108797 - RNA, 15 nt, Streptococcus pneumoniae R6
caagcgcccaagcua

SEQ ID NO: 4108798 - RNA, 23 nt, Streptococcus pneumoniae R6
caagcgcuauuaaaauucguuuc

SEQ ID NO: 4108799 - RNA, 22 nt, Streptococcus pneumoniae R6
caagcgucugaggcaacaaagu

SEQ ID NO: 4108800 - RNA, 14 nt, Streptococcus pneumoniae R6
caagcucagcauuu

SEQ ID NO: 4108801 - RNA, 16 nt, Streptococcus pneumoniae R6
caagcuugaaacaaau

SEQ ID NO: 4108802 - RNA, 23 nt, Streptococcus pneumoniae R6
caaggaagaagcuguaaaucuag

SEQ ID NO: 4108803 - RNA, 21 nt, Streptococcus pneumoniae R6
caaggaagccuucuuuuccac

SEQ ID NO: 4108804 - RNA, 15 nt, Streptococcus pneumoniae R6
caaggacauugacuu

SEQ ID NO: 4108805 - RNA, 14 nt, Streptococcus pneumoniae R6
caaggauugguaaa

SEQ ID NO: 4108806 - RNA, 19 nt, Streptococcus pneumoniae R6
caaggauuucuuugaaauc

SEQ ID NO: 4108807 - RNA, 20 nt, Streptococcus pneumoniae R6
caaggauuucuuugaaaucu

SEQ ID NO: 4108808 - RNA, 21 nt, Streptococcus pneumoniae R6
caaggcaguacuuugagcaac

SEQ ID NO: 4108809 - RNA, 15 nt, Streptococcus pneumoniae R6
caagggaaaaugaaa

SEQ ID NO: 4108810 - RNA, 17 nt, Streptococcus pneumoniae R6
caagggcaaaaaagaaa

SEQ ID NO: 4108811 - RNA, 14 nt, Streptococcus pneumoniae R6
caagguagagacag

SEQ ID NO: 4108812 - RNA, 16 nt, Streptococcus pneumoniae R6
caagguagagacagaa

SEQ ID NO: 4108813 - RNA, 13 nt, Streptococcus pneumoniae R6
caagguagcaaca

SEQ ID NO: 4108814 - RNA, 18 nt, Streptococcus pneumoniae R6
caaggugacgagacagau

SEQ ID NO: 4108815 - RNA, 19 nt, Streptococcus pneumoniae R6
caagguguacuguuauaga

SEQ ID NO: 4108816 - RNA, 19 nt, Streptococcus pneumoniae R6
caagguguguugcuuuuug

SEQ ID NO: 4108817 - RNA, 15 nt, Streptococcus pneumoniae R6
caagguucauggcau

SEQ ID NO: 4108818 - RNA, 15 nt, Streptococcus pneumoniae R6
caagguuucacagaa

SEQ ID NO: 4108819 - RNA, 13 nt, Streptococcus pneumoniae R6
caagguuuccaaa

SEQ ID NO: 4108820 - RNA, 16 nt, Streptococcus pneumoniae R6
caagguuuuagaauau

SEQ ID NO: 4108821 - RNA, 23 nt, Streptococcus pneumoniae R6
caagguuuuugaacaccugauag

SEQ ID NO: 4108822 - RNA, 21 nt, Streptococcus pneumoniae R6
caaguaaaaucaggauuuuuu

SEQ ID NO: 4108823 - RNA, 15 nt, Streptococcus pneumoniae R6
caaguaaucugcacc

SEQ ID NO: 4108824 - RNA, 23 nt, Streptococcus pneumoniae R6
caaguacgauugguucugcucca

SEQ ID NO: 4108825 - RNA, 20 nt, Streptococcus pneumoniae R6
caaguagaacgcugaaggag

SEQ ID NO: 4108826 - RNA, 22 nt, Streptococcus pneumoniae R6
caaguauuguaagaauuugauu

SEQ ID NO: 4108827 - RNA, 14 nt, Streptococcus pneumoniae R6
caagucaacuugaa

SEQ ID NO: 4108828 - RNA, 18 nt, Streptococcus pneumoniae R6
caagucauccaugauaau

SEQ ID NO: 4108829 - RNA, 18 nt, Streptococcus pneumoniae R6
caaguccaagaaccaaca

SEQ ID NO: 4108830 - RNA, 16 nt, Streptococcus pneumoniae R6
caagucuguauagacc

SEQ ID NO: 4108831 - RNA, 18 nt, Streptococcus pneumoniae R6
caagucuuccgaauagcu

SEQ ID NO: 4108832 - RNA, 23 nt, Streptococcus pneumoniae R6
caagucuuccgaauagcucaaaa

SEQ ID NO: 4108833 - RNA, 18 nt, Streptococcus pneumoniae R6
caagucuucugaauagcu

SEQ ID NO: 4108834 - RNA, 16 nt, Streptococcus pneumoniae R6
caagucuugcucuuca

SEQ ID NO: 4108835 - RNA, 23 nt, Streptococcus pneumoniae R6
caagugcugcgucugcuccuccg

SEQ ID NO: 4108836 - RNA, 17 nt, Streptococcus pneumoniae R6
caaguggcauugcuuca

SEQ ID NO: 4108837 - RNA, 13 nt, Streptococcus pneumoniae R6
caaguuaaaaaac

SEQ ID NO: 4108838 - RNA, 15 nt, Streptococcus pneumoniae R6
caaguuaugcauuuu

SEQ ID NO: 4108839 - RNA, 16 nt, Streptococcus pneumoniae R6
caaguucacucaaacc

SEQ ID NO: 4108840 - RNA, 15 nt, Streptococcus pneumoniae R6
caaguuccucuuuca

SEQ ID NO: 4108841 - RNA, 16 nt, Streptococcus pneumoniae R6
caaguucuuccacuca

SEQ ID NO: 4108842 - RNA, 18 nt, Streptococcus pneumoniae R6
caaguucuuccacucaaa

SEQ ID NO: 4108843 - RNA, 19 nt, Streptococcus pneumoniae R6
caaguucuuccacucaaau

SEQ ID NO: 4108844 - RNA, 14 nt, Streptococcus pneumoniae R6
caaguucuuuucug

SEQ ID NO: 4108845 - RNA, 18 nt, Streptococcus pneumoniae R6
caaguugcuugaaaacuc

SEQ ID NO: 4108846 - RNA, 16 nt, Streptococcus pneumoniae R6
caaguuguuugacguc

SEQ ID NO: 4108847 - RNA, 14 nt, Streptococcus pneumoniae R6
caaguuuaaggaua

SEQ ID NO: 4108848 - RNA, 17 nt, Streptococcus pneumoniae R6
caaguuuaaggauagcu

SEQ ID NO: 4108849 - RNA, 22 nt, Streptococcus pneumoniae R6
caaguuuaccauucaauucugg

SEQ ID NO: 4108850 - RNA, 15 nt, Streptococcus pneumoniae R6
caaguuugcaaaguu

SEQ ID NO: 4108851 - RNA, 13 nt, Streptococcus pneumoniae R6
caaguuuucacac

SEQ ID NO: 4108852 - RNA, 13 nt, Streptococcus pneumoniae R6
caauaaaaagcau

SEQ ID NO: 4108853 - RNA, 20 nt, Streptococcus pneumoniae R6
caauaaaaagcauaguauca

SEQ ID NO: 4108854 - RNA, 18 nt, Streptococcus pneumoniae R6
caauaaaacgcauaauau

SEQ ID NO: 4108855 - RNA, 20 nt, Streptococcus pneumoniae R6
caauaaaacgcauaauauca

SEQ ID NO: 4108856 - RNA, 19 nt, Streptococcus pneumoniae R6
caauaaaacgcauaguaca

SEQ ID NO: 4108857 - RNA, 20 nt, Streptococcus pneumoniae R6
caauaaaacgcauaguauca

SEQ ID NO: 4108858 - RNA, 18 nt, Streptococcus pneumoniae R6
caauaaaacgcaucauau

SEQ ID NO: 4108859 - RNA, 10 nt, Streptococcus pneumoniae R6
caauaaaaua

SEQ ID NO: 4108860 - RNA, 19 nt, Streptococcus pneumoniae R6
caauaaaaucaaacaaaag

SEQ ID NO: 4108861 - RNA, 13 nt, Streptococcus pneumoniae R6
caauaaacaucuc

SEQ ID NO: 4108862 - RNA, 18 nt, Streptococcus pneumoniae R6
caauaaaccaucguguag

SEQ ID NO: 4108863 - RNA, 19 nt, Streptococcus pneumoniae R6
caauaaagguguucaaucc

SEQ ID NO: 4108864 - RNA, 13 nt, Streptococcus pneumoniae R6
caauaacaaaguc

SEQ ID NO: 4108865 - RNA, 23 nt, Streptococcus pneumoniae R6
caauaacacccuuguaaauaacu

SEQ ID NO: 4108866 - RNA, 16 nt, Streptococcus pneumoniae R6
caauuaaaaggcucau

SEQ ID NO: 4108867 - RNA, 17 nt, Streptococcus pneumoniae R6
caauuaagaaauuuucu

SEQ ID NO: 4108868 - RNA, 14 nt, Streptococcus pneumoniae R6
caauuaauucuaaa

SEQ ID NO: 4108869 - RNA, 16 nt, Streptococcus pneumoniae R6
caauuaauucuaaauc

SEQ ID NO: 4108870 - RNA, 22 nt, Streptococcus pneumoniae R6
caauuaauuuauccgaagauuu

SEQ ID NO: 4108871 - RNA, 22 nt, Streptococcus pneumoniae R6
caauuagcaagaaauugauaua

SEQ ID NO: 4108872 - RNA, 24 nt, Streptococcus pneumoniae R6
caauuagcaagaaauugauauaau

SEQ ID NO: 4108873 - RNA, 20 nt, Streptococcus pneumoniae R6
caauuagccuucauuacuua

SEQ ID NO: 4108874 - RNA, 12 nt, Streptococcus pneumoniae R6
caauuauauaaa

SEQ ID NO: 4108875 - RNA, 13 nt, Streptococcus pneumoniae R6
caauuauauaaac

SEQ ID NO: 4108876 - RNA, 15 nt, Streptococcus pneumoniae R6
caauuaucauuucca

SEQ ID NO: 4108877 - RNA, 16 nt, Streptococcus pneumoniae R6
caauucaauuuuauac

SEQ ID NO: 4108878 - RNA, 16 nt, Streptococcus pneumoniae R6
caauucacuauaguuu

SEQ ID NO: 4108879 - RNA, 16 nt, Streptococcus pneumoniae R6
caauucagccuuaucc

SEQ ID NO: 4108880 - RNA, 21 nt, Streptococcus pneumoniae R6
caauucaguaacugauccagu

SEQ ID NO: 4108881 - RNA, 22 nt, Streptococcus pneumoniae R6
caauucccguuaaaggugugau

SEQ ID NO: 4108882 - RNA, 17 nt, Streptococcus pneumoniae R6
caauuccucauuuugaa

SEQ ID NO: 4108883 - RNA, 22 nt, Streptococcus pneumoniae R6
caauuccucauuuugaagauug

SEQ ID NO: 4108884 - RNA, 20 nt, Streptococcus pneumoniae R6
caauuccuuacgaacaacga

SEQ ID NO: 4108885 - RNA, 19 nt, Streptococcus pneumoniae R6
caauucgguugguuuuuuu

SEQ ID NO: 4108886 - RNA, 15 nt, Streptococcus pneumoniae R6
caauucucacuugac

SEQ ID NO: 4108887 - RNA, 22 nt, Streptococcus pneumoniae R6
caauucugggauuacaagaccg

SEQ ID NO: 4108888 - RNA, 13 nt, Streptococcus pneumoniae R6
caauucuuggauc

SEQ ID NO: 4108889 - RNA, 21 nt, Streptococcus pneumoniae R6
caauugcaagagggcuucaau

SEQ ID NO: 4108890 - RNA, 22 nt, Streptococcus pneumoniae R6
caauugcaggagaaaaugaaau

SEQ ID NO: 4108891 - RNA, 17 nt, Streptococcus pneumoniae R6
caauugcuaaaacauuu

SEQ ID NO: 4108892 - RNA, 23 nt, Streptococcus pneumoniae R6
caauugcuaaaacauuuauagaa

SEQ ID NO: 4108893 - RNA, 22 nt, Streptococcus pneumoniae R6
caauugcucaacuucuuuuugu

SEQ ID NO: 4108894 - RNA, 22 nt, Streptococcus pneumoniae R6
caauuguaaaaagagggauucu

SEQ ID NO: 4108895 - RNA, 21 nt, Streptococcus pneumoniae R6
caauuguagauguucuuugaa

SEQ ID NO: 4108896 - RNA, 15 nt, Streptococcus pneumoniae R6
caauuguuuauaaaa

SEQ ID NO: 4108897 - RNA, 19 nt, Streptococcus pneumoniae R6
caauuguuuauaaaauaac

SEQ ID NO: 4108898 - RNA, 23 nt, Streptococcus pneumoniae R6
caauuguuucguacuauuucaga

SEQ ID NO: 4108899 - RNA, 21 nt, Streptococcus pneumoniae R6
caauuuaauacucaaugaaaa

SEQ ID NO: 4108900 - RNA, 21 nt, Streptococcus pneumoniae R6
caauuuaauacucugugaaaa

SEQ ID NO: 4108901 - RNA, 12 nt, Streptococcus pneumoniae R6
caauuuaucagu

SEQ ID NO: 4108902 - RNA, 12 nt, Streptococcus pneumoniae R6
caauuuaucucc

SEQ ID NO: 4108903 - RNA, 16 nt, Streptococcus pneumoniae R6
caauuucacaacucuu

SEQ ID NO: 4108904 - RNA, 22 nt, Streptococcus pneumoniae R6
caauuucacaacucuuauacuu

SEQ ID NO: 4108905 - RNA, 16 nt, Streptococcus pneumoniae R6
caauuuccauuuacag

SEQ ID NO: 4108906 - RNA, 20 nt, Streptococcus pneumoniae R6
caauuuccauuuacagaagc

SEQ ID NO: 4108907 - RNA, 21 nt, Streptococcus pneumoniae R6
caauuucucuacaaauaagaa

SEQ ID NO: 4108908 - RNA, 17 nt, Streptococcus pneumoniae R6
caauuucuuuauauaaa

SEQ ID NO: 4108909 - RNA, 16 nt, Streptococcus pneumoniae R6
caauuuguuuucaagu

SEQ ID NO: 4108910 - RNA, 11 nt, Streptococcus pneumoniae R6
caauuuuaaau

SEQ ID NO: 4108911 - RNA, 22 nt, Streptococcus pneumoniae R6
caauuuuaaccagaucuuagaa

SEQ ID NO: 4108912 - RNA, 21 nt, Streptococcus pneumoniae R6
caauuuuacaggaauauugag

SEQ ID NO: 4108913 - RNA, 19 nt, Streptococcus pneumoniae R6
caauuuuaccauucuucau

SEQ ID NO: 4108914 - RNA, 15 nt, Streptococcus pneumoniae R6
caauuuuaccuuuca

SEQ ID NO: 4108915 - RNA, 17 nt, Streptococcus pneumoniae R6
caauuuuacuucuuccc

SEQ ID NO: 4108916 - RNA, 19 nt, Streptococcus pneumoniae R6
caauuuuacuucuucccca

SEQ ID NO: 4108917 - RNA, 17 nt, Streptococcus pneumoniae R6
caauuuuauacucaucu

SEQ ID NO: 4108918 - RNA, 11 nt, Streptococcus pneumoniae R6
caauuuuccuu

SEQ ID NO: 4108919 - RNA, 13 nt, Streptococcus pneumoniae R6
caauuuuuccuuu

SEQ ID NO: 4108920 - RNA, 21 nt, Streptococcus pneumoniae R6
caauuuuucggccaccugauc

SEQ ID NO: 4108921 - RNA, 10 nt, Streptococcus pneumoniae R6
caauuuuuga

SEQ ID NO: 4108922 - RNA, 16 nt, Streptococcus pneumoniae R6
caauuuuuuauagaca

SEQ ID NO: 4108923 - RNA, 22 nt, Streptococcus pneumoniae R6
cacaaaaaagcuagauauuucc

SEQ ID NO: 4108924 - RNA, 17 nt, Streptococcus pneumoniae R6
cacaaaaaguccucuuu

SEQ ID NO: 4108925 - RNA, 19 nt, Streptococcus pneumoniae R6
cacaaaaucaggaaaucuu

SEQ ID NO: 4108926 - RNA, 20 nt, Streptococcus pneumoniae R6
cacaaacaaggugaacuuga

SEQ ID NO: 4108927 - RNA, 21 nt, Streptococcus pneumoniae R6
cacaaagaacaugaaagauga

SEQ ID NO: 4108928 - RNA, 11 nt, Streptococcus pneumoniae R6
cacaaagauaa

SEQ ID NO: 4108929 - RNA, 13 nt, Streptococcus pneumoniae R6
cacaaagauaaaa

SEQ ID NO: 4108930 - RNA, 23 nt, Streptococcus pneumoniae R6
cacaaaguggagguguucuauca

SEQ ID NO: 4108931 - RNA, 15 nt, Streptococcus pneumoniae R6
cacaaaugagauaag

SEQ ID NO: 4108932 - RNA, 21 nt, Streptococcus pneumoniae R6
cacaaaugagauaagcgauuu

SEQ ID NO: 4108933 - RNA, 17 nt, Streptococcus pneumoniae R6
cacaaauugauuaggaa

SEQ ID NO: 4108934 - RNA, 20 nt, Streptococcus pneumoniae R6
cacaaauugauuaggaaauu

SEQ ID NO: 4108935 - RNA, 13 nt, Streptococcus pneumoniae R6
cacaaccucaaaa

SEQ ID NO: 4108936 - RNA, 15 nt, Streptococcus pneumoniae R6
cacaaccucaaaaca

SEQ ID NO: 4108937 - RNA, 18 nt, Streptococcus pneumoniae R6
cacaacucuuauacuuuu

SEQ ID NO: 4108938 - RNA, 21 nt, Streptococcus pneumoniae R6
cacaacucuuauacuuuucuc

SEQ ID NO: 4108939 - RNA, 19 nt, Streptococcus pneumoniae R6
cacaaucguuucaaaaaau

SEQ ID NO: 4108940 - RNA, 16 nt, Streptococcus pneumoniae R6
cacaaugcuguuucua

SEQ ID NO: 4108941 - RNA, 22 nt, Streptococcus pneumoniae R6
cacaaugguuagaaaaucaagu

SEQ ID NO: 4108942 - RNA, 21 nt, Streptococcus pneumoniae R6
cacaccugauauuaugcguuu

SEQ ID NO: 4108943 - RNA, 15 nt, Streptococcus pneumoniae R6
cacacuuccaagucg

SEQ ID NO: 4108944 - RNA, 24 nt, Streptococcus pneumoniae R6
cacagaaacaccuuuaucagccaa

SEQ ID NO: 4108945 - RNA, 18 nt, Streptococcus pneumoniae R6
cacagaccgacacaccau

SEQ ID NO: 4108946 - RNA, 24 nt, Streptococcus pneumoniae R6
cacagaccuguccaacagacucau

SEQ ID NO: 4108947 - RNA, 16 nt, Streptococcus pneumoniae R6
cacagacugaggacca

SEQ ID NO: 4108948 - RNA, 18 nt, Streptococcus pneumoniae R6
cacaggaauacuaaaaua

SEQ ID NO: 4108949 - RNA, 20 nt, Streptococcus pneumoniae R6
cacaggcaaccaaaaucaua

SEQ ID NO: 4108950 - RNA, 16 nt, Streptococcus pneumoniae R6
cacaguuaaauuauaa

SEQ ID NO: 4108951 - RNA, 18 nt, Streptococcus pneumoniae R6
cacauagcuggucaagaa

SEQ ID NO: 4108952 - RNA, 16 nt, Streptococcus pneumoniae R6
cacauaguaguaaaca

SEQ ID NO: 4108953 - RNA, 12 nt, Streptococcus pneumoniae R6
cacauauagacg

SEQ ID NO: 4108954 - RNA, 17 nt, Streptococcus pneumoniae R6
cacauccgccugaguua

SEQ ID NO: 4108955 - RNA, 14 nt, Streptococcus pneumoniae R6
cacaucuacuucua

SEQ ID NO: 4108956 - RNA, 15 nt, Streptococcus pneumoniae R6
cacaucuacuucuaa

SEQ ID NO: 4108957 - RNA, 19 nt, Streptococcus pneumoniae R6
cacaugacaaauucuccac

SEQ ID NO: 4108958 - RNA, 20 nt, Streptococcus pneumoniae R6
cacaugacaaauucuccaca

SEQ ID NO: 4108959 - RNA, 17 nt, Streptococcus pneumoniae R6
cacaugacauuauuuuc

SEQ ID NO: 4108960 - RNA, 17 nt, Streptococcus pneumoniae R6
cacaugccuucuucgau

SEQ ID NO: 4108961 - RNA, 13 nt, Streptococcus pneumoniae R6
cacauucauacca

SEQ ID NO: 4108962 - RNA, 16 nt, Streptococcus pneumoniae R6
cacauucguuccuuua

SEQ ID NO: 4108963 - RNA, 18 nt, Streptococcus pneumoniae R6
caccaaaaccaaucaauu

SEQ ID NO: 4108964 - RNA, 18 nt, Streptococcus pneumoniae R6
caccaaaacuauauucuc

SEQ ID NO: 4108965 - RNA, 21 nt, Streptococcus pneumoniae R6
caccaaacuuucccuucgucu

SEQ ID NO: 4108966 - RNA, 19 nt, Streptococcus pneumoniae R6
caccaagcauuuucauaag

SEQ ID NO: 4108967 - RNA, 15 nt, Streptococcus pneumoniae R6
caccaaggucauaaa

SEQ ID NO: 4108968 - RNA, 23 nt, Streptococcus pneumoniae R6
cacucaguauuacauccaccagc

SEQ ID NO: 4108969 - RNA, 14 nt, Streptococcus pneumoniae R6
cacuccaaaaauaa

SEQ ID NO: 4108970 - RNA, 20 nt, Streptococcus pneumoniae R6
cacucgccaguugcugcguu

SEQ ID NO: 4108971 - RNA, 14 nt, Streptococcus pneumoniae R6
cacucgcugacacu

SEQ ID NO: 4108972 - RNA, 20 nt, Streptococcus pneumoniae R6
cacucgcugacacuggcaua

SEQ ID NO: 4108973 - RNA, 22 nt, Streptococcus pneumoniae R6
cacugauuucaaggcauuuuuu

SEQ ID NO: 4108974 - RNA, 17 nt, Streptococcus pneumoniae R6
cacugauuugagguugu

SEQ ID NO: 4108975 - RNA, 16 nt, Streptococcus pneumoniae R6
cacugcaucugguucu

SEQ ID NO: 4108976 - RNA, 18 nt, Streptococcus pneumoniae R6
cacugccauuaauuccug

SEQ ID NO: 4108977 - RNA, 20 nt, Streptococcus pneumoniae R6
cacuggauaauuucuuuaau

SEQ ID NO: 4108978 - RNA, 19 nt, Streptococcus pneumoniae R6
cacuggcauuaaggcuuug

SEQ ID NO: 4108979 - RNA, 18 nt, Streptococcus pneumoniae R6
cacuggcauuuagcacua

SEQ ID NO: 4108980 - RNA, 11 nt, Streptococcus pneumoniae R6
cacugguguga

SEQ ID NO: 4108981 - RNA, 18 nt, Streptococcus pneumoniae R6
cacugugcuuugugucau

SEQ ID NO: 4108982 - RNA, 15 nt, Streptococcus pneumoniae R6
cacuuacgacauccu

SEQ ID NO: 4108983 - RNA, 14 nt, Streptococcus pneumoniae R6
cacuuauuuuauag

SEQ ID NO: 4108984 - RNA, 16 nt, Streptococcus pneumoniae R6
cacuucacgaaugaca

SEQ ID NO: 4108985 - RNA, 15 nt, Streptococcus pneumoniae R6
cacuucaucaacagu

SEQ ID NO: 4108986 - RNA, 19 nt, Streptococcus pneumoniae R6
cacuucauguuucauauca

SEQ ID NO: 4108987 - RNA, 15 nt, Streptococcus pneumoniae R6
cacuuccuuaccauc

SEQ ID NO: 4108988 - RNA, 13 nt, Streptococcus pneumoniae R6
cacuucugcuucu

SEQ ID NO: 4108989 - RNA, 19 nt, Streptococcus pneumoniae R6
cacuucugcuucuaaaaca

SEQ ID NO: 4108990 - RNA, 15 nt, Streptococcus pneumoniae R6
cacuugaugaaaaaa

SEQ ID NO: 4108991 - RNA, 16 nt, Streptococcus pneumoniae R6
cacuugcgaguuguga

SEQ ID NO: 4108992 - RNA, 15 nt, Streptococcus pneumoniae R6
cacuugcgaugauga

SEQ ID NO: 4108993 - RNA, 13 nt, Streptococcus pneumoniae R6
cacuugggaaacc

SEQ ID NO: 4108994 - RNA, 14 nt, Streptococcus pneumoniae R6
cacuugggaaacca

SEQ ID NO: 4108995 - RNA, 14 nt, Streptococcus pneumoniae R6
cacuugguaggaua

SEQ ID NO: 4108996 - RNA, 18 nt, Streptococcus pneumoniae R6
cacuugguaggauaaagu

SEQ ID NO: 4108997 - RNA, 18 nt, Streptococcus pneumoniae R6
cacuugguguugagaaag

SEQ ID NO: 4108998 - RNA, 21 nt, Streptococcus pneumoniae R6
cacuuguguagccagugagaa

SEQ ID NO: 4108999 - RNA, 21 nt, Streptococcus pneumoniae R6
cacuuuccucuugauuuuuuu

SEQ ID NO: 4109000 - RNA, 15 nt, Streptococcus pneumoniae R6
cacuuugauuuuuau

SEQ ID NO: 4109001 - RNA, 13 nt, Streptococcus pneumoniae R6
cacuuuuuuauag

SEQ ID NO: 4109002 - RNA, 12 nt, Streptococcus pneumoniae R6
cacuuuuuucuu

SEQ ID NO: 4109003 - RNA, 20 nt, Streptococcus pneumoniae R6
cagaaaaacgcauaaaauca

SEQ ID NO: 4109004 - RNA, 22 nt, Streptococcus pneumoniae R6
cagaaaaaucuguuaaaaaaua

SEQ ID NO: 4109005 - RNA, 20 nt, Streptococcus pneumoniae R6
cagaaaaaugacaauaaaau

SEQ ID NO: 4109006 - RNA, 14 nt, Streptococcus pneumoniae R6
cagaaaaauuucau

SEQ ID NO: 4109007 - RNA, 13 nt, Streptococcus pneumoniae R6
cagaaaauaaaau

SEQ ID NO: 4109008 - RNA, 14 nt, Streptococcus pneumoniae R6
cagaaaauaaaauu

SEQ ID NO: 4109009 - RNA, 16 nt, Streptococcus pneumoniae R6
cagaaaauaaaauucc

SEQ ID NO: 4109010 - RNA, 15 nt, Streptococcus pneumoniae R6
cagaaauaaaaguaa

SEQ ID NO: 4109011 - RNA, 22 nt, Streptococcus pneumoniae R6
cagaaauaauauccgauagcau

SEQ ID NO: 4109012 - RNA, 17 nt, Streptococcus pneumoniae R6
cagaaauaucgaugccc

SEQ ID NO: 4109013 - RNA, 18 nt, Streptococcus pneumoniae R6
cagaaaugaguaagaacu

SEQ ID NO: 4109014 - RNA, 22 nt, Streptococcus pneumoniae R6
cagaaaugaguaagaacucaaa

SEQ ID NO: 4109015 - RNA, 20 nt, Streptococcus pneumoniae R6
cagaaaugcccaauucuuga

SEQ ID NO: 4109016 - RNA, 18 nt, Streptococcus pneumoniae R6
cagaaauggaaguuucaa

SEQ ID NO: 4109017 - RNA, 23 nt, Streptococcus pneumoniae R6
cagaaauugaucuagcucucucu

SEQ ID NO: 4109018 - RNA, 18 nt, Streptococcus pneumoniae R6
cagaacacuuccaauaau

SEQ ID NO: 4109019 - RNA, 21 nt, Streptococcus pneumoniae R6
cagaacauuacccauagauuu

SEQ ID NO: 4109020 - RNA, 23 nt, Streptococcus pneumoniae R6
cagaaccaaaccaaacagucuca

SEQ ID NO: 4109021 - RNA, 18 nt, Streptococcus pneumoniae R6
cagaaccccgauaacagc

SEQ ID NO: 4109022 - RNA, 11 nt, Streptococcus pneumoniae R6
cagaaccuuaa

SEQ ID NO: 4109023 - RNA, 17 nt, Streptococcus pneumoniae R6
cagaaccuuaaaaugaa

SEQ ID NO: 4109024 - RNA, 19 nt, Streptococcus pneumoniae R6
cagaaccuuaaaaugaaau

SEQ ID NO: 4109025 - RNA, 14 nt, Streptococcus pneumoniae R6
cagaaccuuggaaa

SEQ ID NO: 4109026 - RNA, 20 nt, Streptococcus pneumoniae R6
cagaacucccuguuccaaag

SEQ ID NO: 4109027 - RNA, 14 nt, Streptococcus pneumoniae R6
cagaacuuccacuu

SEQ ID NO: 4109028 - RNA, 20 nt, Streptococcus pneumoniae R6
cagaacuuccacuuccagaa

SEQ ID NO: 4109029 - RNA, 24 nt, Streptococcus pneumoniae R6
cagaacuuccacuuccagaagaua

SEQ ID NO: 4109030 - RNA, 14 nt, Streptococcus pneumoniae R6
cagaagccuucauc

SEQ ID NO: 4109031 - RNA, 17 nt, Streptococcus pneumoniae R6
cagaagcugccccaccu

SEQ ID NO: 4109032 - RNA, 14 nt, Streptococcus pneumoniae R6
cagaagcuuuacca

SEQ ID NO: 4109033 - RNA, 14 nt, Streptococcus pneumoniae R6
cagaaggcuuucua

SEQ ID NO: 4109034 - RNA, 20 nt, Streptococcus pneumoniae R6
cagaauaauuaaaucauaaa

SEQ ID NO: 4109035 - RNA, 20 nt, Streptococcus pneumoniae R6
cagaauacucuuucaguuuc

SEQ ID NO: 4109036 - RNA, 21 nt, Streptococcus pneumoniae R6
cagaaucauucacuacuuuga

SEQ ID NO: 4109037 - RNA, 18 nt, Streptococcus pneumoniae R6
cagaauccuuauuuucua

SEQ ID NO: 4109038 - RNA, 17 nt, Streptococcus pneumoniae R6
cagaauggguuaaaauu

SEQ ID NO: 4109039 - RNA, 19 nt, Streptococcus pneumoniae R6
cagaauuuaacucuuuuuu

SEQ ID NO: 4109040 - RNA, 16 nt, Streptococcus pneumoniae R6
cagacaaaacuaaccc

SEQ ID NO: 4109041 - RNA, 15 nt, Streptococcus pneumoniae R6
cagacauauccauuc

SEQ ID NO: 4109042 - RNA, 20 nt, Streptococcus pneumoniae R6
cagacauauccauuccuccc

SEQ ID NO: 4109043 - RNA, 22 nt, Streptococcus pneumoniae R6
cagacauaugaaaucuuuuuga

SEQ ID NO: 4109044 - RNA, 23 nt, Streptococcus pneumoniae R6
cagacauaugaaaucuuuuugau

SEQ ID NO: 4109045 - RNA, 19 nt, Streptococcus pneumoniae R6
cagaccaguuucuucuuuc

SEQ ID NO: 4109046 - RNA, 17 nt, Streptococcus pneumoniae R6
cagacgaguuaaaacaa

SEQ ID NO: 4109047 - RNA, 18 nt, Streptococcus pneumoniae R6
cagacgaguuaaaacaaa

SEQ ID NO: 4109048 - RNA, 21 nt, Streptococcus pneumoniae R6
cagacgaguuaaaacaaagaa

SEQ ID NO: 4109049 - RNA, 22 nt, Streptococcus pneumoniae R6
cagacuagguuagucaaaaaga

SEQ ID NO: 4109050 - RNA, 20 nt, Streptococcus pneumoniae R6
cagacugggcaguaaaucuu

SEQ ID NO: 4109051 - RNA, 15 nt, Streptococcus pneumoniae R6
cagacuguuuuucuu

SEQ ID NO: 4109052 - RNA, 13 nt, Streptococcus pneumoniae R6
cagacuucuuuuu

SEQ ID NO: 4109053 - RNA, 14 nt, Streptococcus pneumoniae R6
cagacuucuuuuuu

SEQ ID NO: 4109054 - RNA, 22 nt, Streptococcus pneumoniae R6
cagagaaaaugggcuuuuucug

SEQ ID NO: 4109055 - RNA, 13 nt, Streptococcus pneumoniae R6
cagagaaagaaaa

SEQ ID NO: 4109056 - RNA, 14 nt, Streptococcus pneumoniae R6
cagagaagaaauuc

SEQ ID NO: 4109057 - RNA, 14 nt, Streptococcus pneumoniae R6
cagagaagaggcug

SEQ ID NO: 4109058 - RNA, 13 nt, Streptococcus pneumoniae R6
cagagacaaagga

SEQ ID NO: 4109059 - RNA, 18 nt, Streptococcus pneumoniae R6
cagagacgcagaggugga

SEQ ID NO: 4109060 - RNA, 20 nt, Streptococcus pneumoniae R6
cagagacuuuaaacauacug

SEQ ID NO: 4109061 - RNA, 19 nt, Streptococcus pneumoniae R6
cagagauauuuugcauaaa

SEQ ID NO: 4109062 - RNA, 15 nt, Streptococcus pneumoniae R6
cagagcaccaaccaa

SEQ ID NO: 4109063 - RNA, 15 nt, Streptococcus pneumoniae R6
cagagcgauaaaaau

SEQ ID NO: 4109064 - RNA, 19 nt, Streptococcus pneumoniae R6
cagagcgauaaaaauccuu

SEQ ID NO: 4109065 - RNA, 16 nt, Streptococcus pneumoniae R6
cagaggagaugaauug

SEQ ID NO: 4109066 - RNA, 14 nt, Streptococcus pneumoniae R6
cagaggcacuugau

SEQ ID NO: 4109067 - RNA, 13 nt, Streptococcus pneumoniae R6
cagaguaagaaag

SEQ ID NO: 4109068 - RNA, 21 nt, Streptococcus pneumoniae R6
cagaguagaaguugcuacgau

SEQ ID NO: 4109069 - RNA, 14 nt, Streptococcus pneumoniae R6
cagaguggauuugg

SEQ ID NO: 4109070 - RNA, 14 nt, Streptococcus pneumoniae R6
cagauaaagcugac

SEQ ID NO: 4109071 - RNA, 22 nt, Streptococcus pneumoniae R6
caggagauaaaagcgccugaca

SEQ ID NO: 4109072 - RNA, 23 nt, Streptococcus pneumoniae R6
caggagcacuugaugaaaaaaag

SEQ ID NO: 4109073 - RNA, 21 nt, Streptococcus pneumoniae R6
caggagcaguugauggagcug

SEQ ID NO: 4109074 - RNA, 14 nt, Streptococcus pneumoniae R6
caggauaucaucgc

SEQ ID NO: 4109075 - RNA, 19 nt, Streptococcus pneumoniae R6
caggauguagggugacgaa

SEQ ID NO: 4109076 - RNA, 17 nt, Streptococcus pneumoniae R6
caggauguguaaaaaag

SEQ ID NO: 4109077 - RNA, 18 nt, Streptococcus pneumoniae R6
caggauuaccuuugaaaa

SEQ ID NO: 4109078 - RNA, 21 nt, Streptococcus pneumoniae R6
caggauuaccuuugaaaaaau

SEQ ID NO: 4109079 - RNA, 14 nt, Streptococcus pneumoniae R6
caggauugauaaaa

SEQ ID NO: 4109080 - RNA, 16 nt, Streptococcus pneumoniae R6
caggauugauaaaauu

SEQ ID NO: 4109081 - RNA, 20 nt, Streptococcus pneumoniae R6
caggauuuuguucuuuuuca

SEQ ID NO: 4109082 - RNA, 23 nt, Streptococcus pneumoniae R6
caggauuuuguucuuuuucaaaa

SEQ ID NO: 4109083 - RNA, 19 nt, Streptococcus pneumoniae R6
caggauuuuuaacuuacua

SEQ ID NO: 4109084 - RNA, 17 nt, Streptococcus pneumoniae R6
caggauuuuuacaguau

SEQ ID NO: 4109085 - RNA, 16 nt, Streptococcus pneumoniae R6
caggauuuuuucaugg

SEQ ID NO: 4109086 - RNA, 14 nt, Streptococcus pneumoniae R6
caggcaaagagucc

SEQ ID NO: 4109087 - RNA, 14 nt, Streptococcus pneumoniae R6
caggcauaccgccu

SEQ ID NO: 4109088 - RNA, 22 nt, Streptococcus pneumoniae R6
caggcaugggcagggucaucuc

SEQ ID NO: 4109089 - RNA, 12 nt, Streptococcus pneumoniae R6
caggcauuauuu

SEQ ID NO: 4109090 - RNA, 21 nt, Streptococcus pneumoniae R6
cagggccuuuugcauaaugag

SEQ ID NO: 4109091 - RNA, 16 nt, Streptococcus pneumoniae R6
cagggcuucuaacaua

SEQ ID NO: 4109092 - RNA, 19 nt, Streptococcus pneumoniae R6
cagggguaacgucuuuucg

SEQ ID NO: 4109093 - RNA, 18 nt, Streptococcus pneumoniae R6
cagggucuuuguucugaa

SEQ ID NO: 4109094 - RNA, 17 nt, Streptococcus pneumoniae R6
cagguauugaaaaaacu

SEQ ID NO: 4109095 - RNA, 18 nt, Streptococcus pneumoniae R6
cagguauugaaaaaacuu

SEQ ID NO: 4109096 - RNA, 19 nt, Streptococcus pneumoniae R6
cagguauugaaaaaacuug

SEQ ID NO: 4109097 - RNA, 23 nt, Streptococcus pneumoniae R6
caggucgguuuuauuaaguagaa

SEQ ID NO: 4109098 - RNA, 21 nt, Streptococcus pneumoniae R6
cagguguuucuaucacggcgg

SEQ ID NO: 4109099 - RNA, 15 nt, Streptococcus pneumoniae R6
cagguucuucaauca

SEQ ID NO: 4109100 - RNA, 17 nt, Streptococcus pneumoniae R6
cagguucuucaaucaaa

SEQ ID NO: 4109101 - RNA, 18 nt, Streptococcus pneumoniae R6
cagguugcucaaaacacu

SEQ ID NO: 4109102 - RNA, 22 nt, Streptococcus pneumoniae R6
cagguuuuucaccagauagaau

SEQ ID NO: 4109103 - RNA, 20 nt, Streptococcus pneumoniae R6
caguaaaaaaaacauauauu

SEQ ID NO: 4109104 - RNA, 14 nt, Streptococcus pneumoniae R6
caguaaccauacau

SEQ ID NO: 4109105 - RNA, 21 nt, Streptococcus pneumoniae R6
caguaacugauccaguuggag

SEQ ID NO: 4109106 - RNA, 12 nt, Streptococcus pneumoniae R6
caguaacuucug

SEQ ID NO: 4109107 - RNA, 15 nt, Streptococcus pneumoniae R6
caguaagauacagac

SEQ ID NO: 4109108 - RNA, 12 nt, Streptococcus pneumoniae R6
caguaauaaaga

SEQ ID NO: 4109109 - RNA, 21 nt, Streptococcus pneumoniae R6
caguaauaucuccagauagag

SEQ ID NO: 4109110 - RNA, 16 nt, Streptococcus pneumoniae R6
caguaaucucaaaaca

SEQ ID NO: 4109111 - RNA, 18 nt, Streptococcus pneumoniae R6
caguaaucucaaaacagu

SEQ ID NO: 4109112 - RNA, 21 nt, Streptococcus pneumoniae R6
caguaauuucccauuuguaaa

SEQ ID NO: 4109113 - RNA, 15 nt, Streptococcus pneumoniae R6
caguacaccuaaaac

SEQ ID NO: 4109114 - RNA, 19 nt, Streptococcus pneumoniae R6
caguaccggagaaauauug

SEQ ID NO: 4109115 - RNA, 17 nt, Streptococcus pneumoniae R6
caguacuagacaauuuu

SEQ ID NO: 4109116 - RNA, 16 nt, Streptococcus pneumoniae R6
caguacuuucaacucc

SEQ ID NO: 4109117 - RNA, 19 nt, Streptococcus pneumoniae R6
caguacuuucaacuccuua

SEQ ID NO: 4109118 - RNA, 16 nt, Streptococcus pneumoniae R6
caguagaaaaagucug

SEQ ID NO: 4109119 - RNA, 22 nt, Streptococcus pneumoniae R6
caguagacuugaccgcagauuu

SEQ ID NO: 4109120 - RNA, 13 nt, Streptococcus pneumoniae R6
caguagaugauuu

SEQ ID NO: 4109121 - RNA, 17 nt, Streptococcus pneumoniae R6
caguaguuggcuugucu

SEQ ID NO: 4109122 - RNA, 20 nt, Streptococcus pneumoniae R6
caguaguuggcuugucuuuu

SEQ ID NO: 4109123 - RNA, 17 nt, Streptococcus pneumoniae R6
caguauauugaaaugaa

SEQ ID NO: 4109124 - RNA, 18 nt, Streptococcus pneumoniae R6
caguauauugaaaugaaa

SEQ ID NO: 4109125 - RNA, 19 nt, Streptococcus pneumoniae R6
caguauauugaaaugaaau

SEQ ID NO: 4109126 - RNA, 18 nt, Streptococcus pneumoniae R6
cagucaagaguucuucua

SEQ ID NO: 4109127 - RNA, 13 nt, Streptococcus pneumoniae R6
cagucaauaccag

SEQ ID NO: 4109128 - RNA, 16 nt, Streptococcus pneumoniae R6
cagucagugguucacu

SEQ ID NO: 4109129 - RNA, 12 nt, Streptococcus pneumoniae R6
cagucauuacca

SEQ ID NO: 4109130 - RNA, 18 nt, Streptococcus pneumoniae R6
cagucauuaccaguggca

SEQ ID NO: 4109131 - RNA, 17 nt, Streptococcus pneumoniae R6
caguccacguuuuucca

SEQ ID NO: 4109132 - RNA, 15 nt, Streptococcus pneumoniae R6
cagucccauaaaacu

SEQ ID NO: 4109133 - RNA, 22 nt, Streptococcus pneumoniae R6
caguccucccuuguuuuuauau

SEQ ID NO: 4109134 - RNA, 23 nt, Streptococcus pneumoniae R6
cagucguuccuuuugugacaauu

SEQ ID NO: 4109135 - RNA, 23 nt, Streptococcus pneumoniae R6
cagucuagaagcaagacaaaaac

SEQ ID NO: 4109136 - RNA, 15 nt, Streptococcus pneumoniae R6
cagucucaccugcuu

SEQ ID NO: 4109137 - RNA, 12 nt, Streptococcus pneumoniae R6
cagucuccuagu

SEQ ID NO: 4109138 - RNA, 23 nt, Streptococcus pneumoniae R6
cagucuccuagucuacaaauuca

SEQ ID NO: 4109139 - RNA, 21 nt, Streptococcus pneumoniae R6
cagucucuguauaggucuggc

SEQ ID NO: 4109140 - RNA, 12 nt, Streptococcus pneumoniae R6
cagucugaaaaa

SEQ ID NO: 4109141 - RNA, 17 nt, Streptococcus pneumoniae R6
cagucugaaaaagagga

SEQ ID NO: 4109142 - RNA, 21 nt, Streptococcus pneumoniae R6
cagucugaaaaagaggaugaa

SEQ ID NO: 4109143 - RNA, 18 nt, Streptococcus pneumoniae R6
cagucugaaaaauaggau

SEQ ID NO: 4109144 - RNA, 21 nt, Streptococcus pneumoniae R6
cagucugaaaaauaggaugaa

SEQ ID NO: 4109145 - RNA, 20 nt, Streptococcus pneumoniae R6
cagucugguucccagcaugg

SEQ ID NO: 4109146 - RNA, 13 nt, Streptococcus pneumoniae R6
cagucuuaucugc

SEQ ID NO: 4109147 - RNA, 14 nt, Streptococcus pneumoniae R6
cagucuuuuugcug

SEQ ID NO: 4109148 - RNA, 15 nt, Streptococcus pneumoniae R6
cagugaacuauuuua

SEQ ID NO: 4109149 - RNA, 19 nt, Streptococcus pneumoniae R6
cagugaaggcuuuaaaugc

SEQ ID NO: 4109150 - RNA, 22 nt, Streptococcus pneumoniae R6
cagugaaggcuuuaaaugcugg

SEQ ID NO: 4109151 - RNA, 15 nt, Streptococcus pneumoniae R6
cagugaauuuaccaa

SEQ ID NO: 4109152 - RNA, 22 nt, Streptococcus pneumoniae R6
cagugaauuuaccaaggaagcu

SEQ ID NO: 4109153 - RNA, 18 nt, Streptococcus pneumoniae R6
cagugacuugugugcugg

SEQ ID NO: 4109154 - RNA, 12 nt, Streptococcus pneumoniae R6
cagugauuaaaa

SEQ ID NO: 4109155 - RNA, 22 nt, Streptococcus pneumoniae R6
cagugauuaaaacugccuuucu

SEQ ID NO: 4109156 - RNA, 21 nt, Streptococcus pneumoniae R6
caguggcagcauugucauuua

SEQ ID NO: 4109157 - RNA, 16 nt, Streptococcus pneumoniae R6
cagugguucacuggca

SEQ ID NO: 4109158 - RNA, 17 nt, Streptococcus pneumoniae R6
caguguacauacuuuau

SEQ ID NO: 4109159 - RNA, 22 nt, Streptococcus pneumoniae R6
caguguuuuaagcugacuucgu

SEQ ID NO: 4109160 - RNA, 19 nt, Streptococcus pneumoniae R6
caguguuuugagcaaccug

SEQ ID NO: 4109161 - RNA, 23 nt, Streptococcus pneumoniae R6
caguguuuugagcaaccugcggc

SEQ ID NO: 4109162 - RNA, 15 nt, Streptococcus pneumoniae R6
caguguuuugagcac

SEQ ID NO: 4109163 - RNA, 20 nt, Streptococcus pneumoniae R6
caguguuuugagcugacuuc

SEQ ID NO: 4109164 - RNA, 23 nt, Streptococcus pneumoniae R6
caguguuuugaucugacuucguc

SEQ ID NO: 4109165 - RNA, 12 nt, Streptococcus pneumoniae R6
caguuacuuuau

SEQ ID NO: 4109166 - RNA, 19 nt, Streptococcus pneumoniae R6
caguuaugauauugaguuu

SEQ ID NO: 4109167 - RNA, 22 nt, Streptococcus pneumoniae R6
caguuauuuuaguaaaaaaaga

SEQ ID NO: 4109168 - RNA, 23 nt, Streptococcus pneumoniae R6
caguucagcauaagacaauuggu

SEQ ID NO: 4109169 - RNA, 12 nt, Streptococcus pneumoniae R6
caguucaucaug

SEQ ID NO: 4109170 - RNA, 18 nt, Streptococcus pneumoniae R6
caguuccaucuacaaccu

SEQ ID NO: 4109171 - RNA, 15 nt, Streptococcus pneumoniae R6
caguuccgauguguu

SEQ ID NO: 4109172 - RNA, 22 nt, Streptococcus pneumoniae R6
caguuccgauguguuggguagc

SEQ ID NO: 4109173 - RNA, 20 nt, Streptococcus pneumoniae R6
cauagccauaaaacauuucc

SEQ ID NO: 4109174 - RNA, 22 nt, Streptococcus pneumoniae R6
cauagcccguuggcuaaagaua

SEQ ID NO: 4109175 - RNA, 21 nt, Streptococcus pneumoniae R6
cauagcgugcccaaaaauuac

SEQ ID NO: 4109176 - RNA, 16 nt, Streptococcus pneumoniae R6
cauagcuggucaagaa

SEQ ID NO: 4109177 - RNA, 18 nt, Streptococcus pneumoniae R6
cauagcuggucaagaagc

SEQ ID NO: 4109178 - RNA, 16 nt, Streptococcus pneumoniae R6
cauaggcauaguacca

SEQ ID NO: 4109179 - RNA, 17 nt, Streptococcus pneumoniae R6
cauaggcauaguaccag

SEQ ID NO: 4109180 - RNA, 18 nt, Streptococcus pneumoniae R6
cauaguaaaacgcauaau

SEQ ID NO: 4109181 - RNA, 16 nt, Streptococcus pneumoniae R6
cauaguacaauaccuu

SEQ ID NO: 4109182 - RNA, 21 nt, Streptococcus pneumoniae R6
cauaguacaauaccuuuccuc

SEQ ID NO: 4109183 - RNA, 23 nt, Streptococcus pneumoniae R6
cauaguagucuccguaaaagaca

SEQ ID NO: 4109184 - RNA, 19 nt, Streptococcus pneumoniae R6
cauaguaucagguguuuca

SEQ ID NO: 4109185 - RNA, 16 nt, Streptococcus pneumoniae R6
cauagucaagcucuug

SEQ ID NO: 4109186 - RNA, 17 nt, Streptococcus pneumoniae R6
cauagugagauugugaa

SEQ ID NO: 4109187 - RNA, 14 nt, Streptococcus pneumoniae R6
cauaguguuucucu

SEQ ID NO: 4109188 - RNA, 14 nt, Streptococcus pneumoniae R6
cauaguuacuccuu

SEQ ID NO: 4109189 - RNA, 18 nt, Streptococcus pneumoniae R6
cauaguugcauuaaaauc

SEQ ID NO: 4109190 - RNA, 12 nt, Streptococcus pneumoniae R6
cauauaaauaca

SEQ ID NO: 4109191 - RNA, 16 nt, Streptococcus pneumoniae R6
cauauaaauauagaaa

SEQ ID NO: 4109192 - RNA, 15 nt, Streptococcus pneumoniae R6
cauauaaaucuccag

SEQ ID NO: 4109193 - RNA, 18 nt, Streptococcus pneumoniae R6
cauauaaaucuccagacc

SEQ ID NO: 4109194 - RNA, 16 nt, Streptococcus pneumoniae R6
cauauaaggaccaaau

SEQ ID NO: 4109195 - RNA, 17 nt, Streptococcus pneumoniae R6
cauauacacuuaaauuc

SEQ ID NO: 4109196 - RNA, 17 nt, Streptococcus pneumoniae R6
cauauagauaaaaaaca

SEQ ID NO: 4109197 - RNA, 18 nt, Streptococcus pneumoniae R6
cauauagauaaaaaacaa

SEQ ID NO: 4109198 - RNA, 20 nt, Streptococcus pneumoniae R6
cauauagcauuguccauaac

SEQ ID NO: 4109199 - RNA, 21 nt, Streptococcus pneumoniae R6
cauauagucuuucaaagccug

SEQ ID NO: 4109200 - RNA, 20 nt, Streptococcus pneumoniae R6
cauaucaagguuuuucaaaa

SEQ ID NO: 4109201 - RNA, 12 nt, Streptococcus pneumoniae R6
cauaucaaucuc

SEQ ID NO: 4109202 - RNA, 15 nt, Streptococcus pneumoniae R6
cauaucaaucucugc

SEQ ID NO: 4109203 - RNA, 19 nt, Streptococcus pneumoniae R6
cauaucagugaagguauuu

SEQ ID NO: 4109204 - RNA, 23 nt, Streptococcus pneumoniae R6
cauaucagugaagguauuuugac

SEQ ID NO: 4109205 - RNA, 14 nt, Streptococcus pneumoniae R6
cauauccauuccuc

SEQ ID NO: 4109206 - RNA, 18 nt, Streptococcus pneumoniae R6
cauauccauuccucccau

SEQ ID NO: 4109207 - RNA, 16 nt, Streptococcus pneumoniae R6
cauauccccagacaua

SEQ ID NO: 4109208 - RNA, 18 nt, Streptococcus pneumoniae R6
cauaucuggcauuccugc

SEQ ID NO: 4109209 - RNA, 21 nt, Streptococcus pneumoniae R6
cauaucugucuuaccacaaac

SEQ ID NO: 4109210 - RNA, 16 nt, Streptococcus pneumoniae R6
cauaucuuauuucaau

SEQ ID NO: 4109211 - RNA, 19 nt, Streptococcus pneumoniae R6
cauaucuuuauaggcuugg

SEQ ID NO: 4109212 - RNA, 20 nt, Streptococcus pneumoniae R6
cauauggaagagaagcuguc

SEQ ID NO: 4109213 - RNA, 20 nt, Streptococcus pneumoniae R6
cauaugggacuuuuuuucua

SEQ ID NO: 4109214 - RNA, 14 nt, Streptococcus pneumoniae R6
cauauguaagaaga

SEQ ID NO: 4109215 - RNA, 17 nt, Streptococcus pneumoniae R6
cauauuaaagaguuuca

SEQ ID NO: 4109216 - RNA, 22 nt, Streptococcus pneumoniae R6
cauauucuuuuacacucaauuu

SEQ ID NO: 4109217 - RNA, 15 nt, Streptococcus pneumoniae R6
cauauuuucaaaacu

SEQ ID NO: 4109218 - RNA, 17 nt, Streptococcus pneumoniae R6
cauauuuucaaaacugg

SEQ ID NO: 4109219 - RNA, 18 nt, Streptococcus pneumoniae R6
cauauuuucaaaacuggu

SEQ ID NO: 4109220 - RNA, 14 nt, Streptococcus pneumoniae R6
cauauuuucuacac

SEQ ID NO: 4109221 - RNA, 14 nt, Streptococcus pneumoniae R6
cauauuuuuccuuc

SEQ ID NO: 4109222 - RNA, 24 nt, Streptococcus pneumoniae R6
caucaaagcuaguuguuuuucguc

SEQ ID NO: 4109223 - RNA, 18 nt, Streptococcus pneumoniae R6
caucaaauccuucagcuu

SEQ ID NO: 4109224 - RNA, 22 nt, Streptococcus pneumoniae R6
caucaaaugacuaaccuugucc

SEQ ID NO: 4109225 - RNA, 22 nt, Streptococcus pneumoniae R6
caucaaaugagauuugcaucaa

SEQ ID NO: 4109226 - RNA, 18 nt, Streptococcus pneumoniae R6
caucaaauugaaauaaga

SEQ ID NO: 4109227 - RNA, 22 nt, Streptococcus pneumoniae R6
caucaaauugaaauaagaaaua

SEQ ID NO: 4109228 - RNA, 21 nt, Streptococcus pneumoniae R6
caucaaccgugcagucuuuuu

SEQ ID NO: 4109229 - RNA, 21 nt, Streptococcus pneumoniae R6
caucaacuagagcccaauauu

SEQ ID NO: 4109230 - RNA, 15 nt, Streptococcus pneumoniae R6
caucaacuauucuuu

SEQ ID NO: 4109231 - RNA, 13 nt, Streptococcus pneumoniae R6
caucaagcuuuca

SEQ ID NO: 4109232 - RNA, 13 nt, Streptococcus pneumoniae R6
caucaauaaccau

SEQ ID NO: 4109233 - RNA, 18 nt, Streptococcus pneumoniae R6
caucaauaaccaucauuu

SEQ ID NO: 4109234 - RNA, 15 nt, Streptococcus pneumoniae R6
caucaauacccccuu

SEQ ID NO: 4109235 - RNA, 20 nt, Streptococcus pneumoniae R6
caucaauacccccuuaaaac

SEQ ID NO: 4109236 - RNA, 22 nt, Streptococcus pneumoniae R6
caucaauacccccuuaaaacca

SEQ ID NO: 4109237 - RNA, 15 nt, Streptococcus pneumoniae R6
caucaauauuagaug

SEQ ID NO: 4109238 - RNA, 16 nt, Streptococcus pneumoniae R6
caucaaucaagauaca

SEQ ID NO: 4109239 - RNA, 19 nt, Streptococcus pneumoniae R6
caucaaucuuagucaaaac

SEQ ID NO: 4109240 - RNA, 14 nt, Streptococcus pneumoniae R6
caucacacuagcaa

SEQ ID NO: 4109241 - RNA, 19 nt, Streptococcus pneumoniae R6
caucacgaaaauauuugga

SEQ ID NO: 4109242 - RNA, 15 nt, Streptococcus pneumoniae R6
caucacuucgucugc

SEQ ID NO: 4109243 - RNA, 22 nt, Streptococcus pneumoniae R6
caucacuuucugcaauggcaau

SEQ ID NO: 4109244 - RNA, 16 nt, Streptococcus pneumoniae R6
caucagaaaaaaggca

SEQ ID NO: 4109245 - RNA, 19 nt, Streptococcus pneumoniae R6
caucagcagagaaagaaaa

SEQ ID NO: 4109246 - RNA, 21 nt, Streptococcus pneumoniae R6
caucagggaguuguuuuuuau

SEQ ID NO: 4109247 - RNA, 17 nt, Streptococcus pneumoniae R6
caucagguuucaagucu

SEQ ID NO: 4109248 - RNA, 18 nt, Streptococcus pneumoniae R6
caucagucaaucuacuug

SEQ ID NO: 4109249 - RNA, 14 nt, Streptococcus pneumoniae R6
caucaguuccagca

SEQ ID NO: 4109250 - RNA, 14 nt, Streptococcus pneumoniae R6
caucauaaaaauaa

SEQ ID NO: 4109251 - RNA, 15 nt, Streptococcus pneumoniae R6
caucauaaaucaauu

SEQ ID NO: 4109252 - RNA, 22 nt, Streptococcus pneumoniae R6
caucauccaccuugcaaaaaaa

SEQ ID NO: 4109253 - RNA, 21 nt, Streptococcus pneumoniae R6
caucaucccgcccaucaugcu

SEQ ID NO: 4109254 - RNA, 19 nt, Streptococcus pneumoniae R6
caucaucguggucuucauc

SEQ ID NO: 4109255 - RNA, 15 nt, Streptococcus pneumoniae R6
caucaucuagaugaa

SEQ ID NO: 4109256 - RNA, 18 nt, Streptococcus pneumoniae R6
caucaucuugcuaaaaaa

SEQ ID NO: 4109257 - RNA, 23 nt, Streptococcus pneumoniae R6
caucaucuugcuaaaaaaaggga

SEQ ID NO: 4109258 - RNA, 12 nt, Streptococcus pneumoniae R6
caucauuaacaa

SEQ ID NO: 4109259 - RNA, 22 nt, Streptococcus pneumoniae R6
caucauuccugauaaaagauag

SEQ ID NO: 4109260 - RNA, 18 nt, Streptococcus pneumoniae R6
caucauuuuauucauauc

SEQ ID NO: 4109261 - RNA, 21 nt, Streptococcus pneumoniae R6
cauccaaagguucaaucauuu

SEQ ID NO: 4109262 - RNA, 22 nt, Streptococcus pneumoniae R6
cauccacuggauaauuucuuua

SEQ ID NO: 4109263 - RNA, 15 nt, Streptococcus pneumoniae R6
cauccaucccauuua

SEQ ID NO: 4109264 - RNA, 22 nt, Streptococcus pneumoniae R6
cauccaucccauuuauauaaaa

SEQ ID NO: 4109265 - RNA, 14 nt, Streptococcus pneumoniae R6
cauccauucuuuuu

SEQ ID NO: 4109266 - RNA, 18 nt, Streptococcus pneumoniae R6
caucccaguggcuaaagu

SEQ ID NO: 4109267 - RNA, 18 nt, Streptococcus pneumoniae R6
caucccauuuauauaaaa

SEQ ID NO: 4109268 - RNA, 19 nt, Streptococcus pneumoniae R6
caucccgcccaucaugcuu

SEQ ID NO: 4109269 - RNA, 15 nt, Streptococcus pneumoniae R6
caucccuugucuuug

SEQ ID NO: 4109270 - RNA, 14 nt, Streptococcus pneumoniae R6
cauccgcaucucgg

SEQ ID NO: 4109271 - RNA, 19 nt, Streptococcus pneumoniae R6
cauccguuuuucuccucua

SEQ ID NO: 4109272 - RNA, 22 nt, Streptococcus pneumoniae R6
caucgaaguuguguuugaccac

SEQ ID NO: 4109273 - RNA, 13 nt, Streptococcus pneumoniae R6
caucgacuuguuu

SEQ ID NO: 4109274 - RNA, 18 nt, Streptococcus pneumoniae R6
caucgcccaauuuaugua

SEQ ID NO: 4109275 - RNA, 13 nt, Streptococcus pneumoniae R6
cauguguuaccau

SEQ ID NO: 4109276 - RNA, 14 nt, Streptococcus pneumoniae R6
cauguguuaccaua

SEQ ID NO: 4109277 - RNA, 22 nt, Streptococcus pneumoniae R6
cauguguuaccauaguuccgac

SEQ ID NO: 4109278 - RNA, 15 nt, Streptococcus pneumoniae R6
cauguuagaaaaaug

SEQ ID NO: 4109279 - RNA, 16 nt, Streptococcus pneumoniae R6
cauguuucggaucaua

SEQ ID NO: 4109280 - RNA, 20 nt, Streptococcus pneumoniae R6
cauguuuuucaauagccuga

SEQ ID NO: 4109281 - RNA, 17 nt, Streptococcus pneumoniae R6
cauguuuuucuccuauu

SEQ ID NO: 4109282 - RNA, 23 nt, Streptococcus pneumoniae R6
cauguuuuucuccuauuuucuuc

SEQ ID NO: 4109283 - RNA, 19 nt, Streptococcus pneumoniae R6
cauuaaagaccaaagaaaa

SEQ ID NO: 4109284 - RNA, 19 nt, Streptococcus pneumoniae R6
cauuaaauuuuuuucucaa

SEQ ID NO: 4109285 - RNA, 19 nt, Streptococcus pneumoniae R6
cauuaacgaucaaucaauu

SEQ ID NO: 4109286 - RNA, 14 nt, Streptococcus pneumoniae R6
cauuaagucaacau

SEQ ID NO: 4109287 - RNA, 22 nt, Streptococcus pneumoniae R6
cauuaaucagauaaacaauggu

SEQ ID NO: 4109288 - RNA, 22 nt, Streptococcus pneumoniae R6
cauuacaauguagccaucaucc

SEQ ID NO: 4109289 - RNA, 12 nt, Streptococcus pneumoniae R6
cauuacacaaau

SEQ ID NO: 4109290 - RNA, 21 nt, Streptococcus pneumoniae R6
cauuacuaucaaaaucaauga

SEQ ID NO: 4109291 - RNA, 13 nt, Streptococcus pneumoniae R6
cauuagaauucag

SEQ ID NO: 4109292 - RNA, 15 nt, Streptococcus pneumoniae R6
cauuagcuguaucua

SEQ ID NO: 4109293 - RNA, 17 nt, Streptococcus pneumoniae R6
cauuauacaucuuccca

SEQ ID NO: 4109294 - RNA, 14 nt, Streptococcus pneumoniae R6
cauuauagaaggca

SEQ ID NO: 4109295 - RNA, 21 nt, Streptococcus pneumoniae R6
cauuauagaaggcaauuaaaa

SEQ ID NO: 4109296 - RNA, 19 nt, Streptococcus pneumoniae R6
cauuauagcauucuucuca

SEQ ID NO: 4109297 - RNA, 12 nt, Streptococcus pneumoniae R6
cauuauagcucg

SEQ ID NO: 4109298 - RNA, 20 nt, Streptococcus pneumoniae R6
cauuauaggucauaugggac

SEQ ID NO: 4109299 - RNA, 20 nt, Streptococcus pneumoniae R6
cauuauagucgcuagacuga

SEQ ID NO: 4109300 - RNA, 13 nt, Streptococcus pneumoniae R6
cauuauaguuuaa

SEQ ID NO: 4109301 - RNA, 22 nt, Streptococcus pneumoniae R6
cauuauaguuuaaguaguaacc

SEQ ID NO: 4109302 - RNA, 16 nt, Streptococcus pneumoniae R6
cauuauauuucucucc

SEQ ID NO: 4109303 - RNA, 21 nt, Streptococcus pneumoniae R6
cauuauccaacagagaaaauu

SEQ ID NO: 4109304 - RNA, 19 nt, Streptococcus pneumoniae R6
cauuauccauaauaauaac

SEQ ID NO: 4109305 - RNA, 20 nt, Streptococcus pneumoniae R6
cauuaucuaauaccaaggca

SEQ ID NO: 4109306 - RNA, 16 nt, Streptococcus pneumoniae R6
cauuaugcguuuuugu

SEQ ID NO: 4109307 - RNA, 17 nt, Streptococcus pneumoniae R6
cauuauuagcucgauug

SEQ ID NO: 4109308 - RNA, 18 nt, Streptococcus pneumoniae R6
cauuauuagcucgauuga

SEQ ID NO: 4109309 - RNA, 15 nt, Streptococcus pneumoniae R6
cauuauuuaacuaaa

SEQ ID NO: 4109310 - RNA, 18 nt, Streptococcus pneumoniae R6
cauuauuuaacuaaaucu

SEQ ID NO: 4109311 - RNA, 17 nt, Streptococcus pneumoniae R6
cauucaaagaaccugca

SEQ ID NO: 4109312 - RNA, 21 nt, Streptococcus pneumoniae R6
cauucaagagacucuuuaaga

SEQ ID NO: 4109313 - RNA, 23 nt, Streptococcus pneumoniae R6
cauucaagagacucuuuaagaga

SEQ ID NO: 4109314 - RNA, 18 nt, Streptococcus pneumoniae R6
cauucaauccaucuccaa

SEQ ID NO: 4109315 - RNA, 22 nt, Streptococcus pneumoniae R6
cauucaaugugggaaacagauu

SEQ ID NO: 4109316 - RNA, 20 nt, Streptococcus pneumoniae R6
cauucacaacaucuucugua

SEQ ID NO: 4109317 - RNA, 14 nt, Streptococcus pneumoniae R6
cauucacuacuuug

SEQ ID NO: 4109318 - RNA, 20 nt, Streptococcus pneumoniae R6
cauuccagacagcuucaaga

SEQ ID NO: 4109319 - RNA, 22 nt, Streptococcus pneumoniae R6
cauuccagacagcuucaagagg

SEQ ID NO: 4109320 - RNA, 16 nt, Streptococcus pneumoniae R6
cauuccaucauaaaaa

SEQ ID NO: 4109321 - RNA, 21 nt, Streptococcus pneumoniae R6
cauucccuuguagaaaagcaa

SEQ ID NO: 4109322 - RNA, 18 nt, Streptococcus pneumoniae R6
cauuccugcuccuccgag

SEQ ID NO: 4109323 - RNA, 18 nt, Streptococcus pneumoniae R6
cauucgaaugauauuuuc

SEQ ID NO: 4109324 - RNA, 21 nt, Streptococcus pneumoniae R6
cauucgaaugauuucucuugc

SEQ ID NO: 4109325 - RNA, 17 nt, Streptococcus pneumoniae R6
cauucguuccuuuaaaa

SEQ ID NO: 4109326 - RNA, 15 nt, Streptococcus pneumoniae R6
cauucuaaaacgcau

SEQ ID NO: 4109327 - RNA, 16 nt, Streptococcus pneumoniae R6
cauucuaaaacgcauc

SEQ ID NO: 4109328 - RNA, 15 nt, Streptococcus pneumoniae R6
cauucuacuauauau

SEQ ID NO: 4109329 - RNA, 18 nt, Streptococcus pneumoniae R6
cauucuaguccaucuccg

SEQ ID NO: 4109330 - RNA, 18 nt, Streptococcus pneumoniae R6
cauucuauuccaucuccg

SEQ ID NO: 4109331 - RNA, 18 nt, Streptococcus pneumoniae R6
cauucucccgcccuuuuu

SEQ ID NO: 4109332 - RNA, 16 nt, Streptococcus pneumoniae R6
cauucugaacuaaaaa

SEQ ID NO: 4109333 - RNA, 20 nt, Streptococcus pneumoniae R6
cauucugcauguaucacagu

SEQ ID NO: 4109334 - RNA, 14 nt, Streptococcus pneumoniae R6
cauucugcuagacu

SEQ ID NO: 4109335 - RNA, 14 nt, Streptococcus pneumoniae R6
cauucuucucagcu

SEQ ID NO: 4109336 - RNA, 16 nt, Streptococcus pneumoniae R6
cauucuucuuuuccaa

SEQ ID NO: 4109337 - RNA, 15 nt, Streptococcus pneumoniae R6
cauucuugguaaaga

SEQ ID NO: 4109338 - RNA, 18 nt, Streptococcus pneumoniae R6
cauugacucuaacuguau

SEQ ID NO: 4109339 - RNA, 14 nt, Streptococcus pneumoniae R6
cauugaggacaaua

SEQ ID NO: 4109340 - RNA, 11 nt, Streptococcus pneumoniae R6
cauugaguaua

SEQ ID NO: 4109341 - RNA, 22 nt, Streptococcus pneumoniae R6
cauugaguauaagauacaaauu

SEQ ID NO: 4109342 - RNA, 22 nt, Streptococcus pneumoniae R6
cauugaguauuauuucauuuuc

SEQ ID NO: 4109343 - RNA, 18 nt, Streptococcus pneumoniae R6
cauugcgcuugauaaguu

SEQ ID NO: 4109344 - RNA, 12 nt, Streptococcus pneumoniae R6
cauuggacaggg

SEQ ID NO: 4109345 - RNA, 16 nt, Streptococcus pneumoniae R6
cauugguucuuuuuac

SEQ ID NO: 4109346 - RNA, 13 nt, Streptococcus pneumoniae R6
cauuguauccuga

SEQ ID NO: 4109347 - RNA, 15 nt, Streptococcus pneumoniae R6
cauugucauuuaugu

SEQ ID NO: 4109348 - RNA, 19 nt, Streptococcus pneumoniae R6
cauugugcuugauaaguuu

SEQ ID NO: 4109349 - RNA, 22 nt, Streptococcus pneumoniae R6
cauuguuaaaaaucgauuugac

SEQ ID NO: 4109350 - RNA, 22 nt, Streptococcus pneumoniae R6
cauuguuagaaaucaauuugac

SEQ ID NO: 4109351 - RNA, 17 nt, Streptococcus pneumoniae R6
cauuguuucguuucuuc

SEQ ID NO: 4109352 - RNA, 15 nt, Streptococcus pneumoniae R6
cauuuaagccuuuuu

SEQ ID NO: 4109353 - RNA, 14 nt, Streptococcus pneumoniae R6
cauuuaauauauuu

SEQ ID NO: 4109354 - RNA, 13 nt, Streptococcus pneumoniae R6
cauuuacagaagc

SEQ ID NO: 4109355 - RNA, 15 nt, Streptococcus pneumoniae R6
cauuuagaacaccau

SEQ ID NO: 4109356 - RNA, 17 nt, Streptococcus pneumoniae R6
cauuuagauaguaccaa

SEQ ID NO: 4109357 - RNA, 22 nt, Streptococcus pneumoniae R6
cauuuaggcuaagagagaagcc

SEQ ID NO: 4109358 - RNA, 14 nt, Streptococcus pneumoniae R6
cauuuauauaaaaa

SEQ ID NO: 4109359 - RNA, 13 nt, Streptococcus pneumoniae R6
cauuuaucuucuu

SEQ ID NO: 4109360 - RNA, 19 nt, Streptococcus pneumoniae R6
cauuuauggaaaaaaugaa

SEQ ID NO: 4109361 - RNA, 13 nt, Streptococcus pneumoniae R6
cauuucaaccuug

SEQ ID NO: 4109362 - RNA, 18 nt, Streptococcus pneumoniae R6
cauuucaauagcuccuug

SEQ ID NO: 4109363 - RNA, 12 nt, Streptococcus pneumoniae R6
cauuucacgcgc

SEQ ID NO: 4109364 - RNA, 24 nt, Streptococcus pneumoniae R6
cauuucaguugccucagauucuga

SEQ ID NO: 4109365 - RNA, 20 nt, Streptococcus pneumoniae R6
cauuuccaccugcagcaagu

SEQ ID NO: 4109366 - RNA, 16 nt, Streptococcus pneumoniae R6
cauuuccauuguuguu

SEQ ID NO: 4109367 - RNA, 14 nt, Streptococcus pneumoniae R6
cauuucccauugca

SEQ ID NO: 4109368 - RNA, 20 nt, Streptococcus pneumoniae R6
cauuucuauaaaucaauuuu

SEQ ID NO: 4109369 - RNA, 21 nt, Streptococcus pneumoniae R6
cauuucuguguuucauagauu

SEQ ID NO: 4109370 - RNA, 22 nt, Streptococcus pneumoniae R6
cauuucuguguuucauagauuu

SEQ ID NO: 4109371 - RNA, 20 nt, Streptococcus pneumoniae R6
cauuucuucaguauaaacug

SEQ ID NO: 4109372 - RNA, 23 nt, Streptococcus pneumoniae R6
cauuucuuccgacaauacaguag

SEQ ID NO: 4109373 - RNA, 15 nt, Streptococcus pneumoniae R6
cauuucuucuaugca

SEQ ID NO: 4109374 - RNA, 19 nt, Streptococcus pneumoniae R6
cauuucuuugucuccaaca

SEQ ID NO: 4109375 - RNA, 12 nt, Streptococcus pneumoniae R6
cauuucuuuucu

SEQ ID NO: 4109376 - RNA, 22 nt, Streptococcus pneumoniae R6
cauuucuuuugcaaucauuuca

SEQ ID NO: 4109377 - RNA, 16 nt, Streptococcus pneumoniae R6
ccaaguaaucugcacc

SEQ ID NO: 4109378 - RNA, 17 nt, Streptococcus pneumoniae R6
ccaagucaacaccuguc

SEQ ID NO: 4109379 - RNA, 20 nt, Streptococcus pneumoniae R6
ccaagucaucaaaaauagaa

SEQ ID NO: 4109380 - RNA, 18 nt, Streptococcus pneumoniae R6
ccaagucggcaggcuggu

SEQ ID NO: 4109381 - RNA, 16 nt, Streptococcus pneumoniae R6
ccaaguggaagucugu

SEQ ID NO: 4109382 - RNA, 18 nt, Streptococcus pneumoniae R6
ccaaguggaauucauuuu

SEQ ID NO: 4109383 - RNA, 13 nt, Streptococcus pneumoniae R6
ccaaguggcauug

SEQ ID NO: 4109384 - RNA, 21 nt, Streptococcus pneumoniae R6
ccaaguggcauugcuucauaa

SEQ ID NO: 4109385 - RNA, 19 nt, Streptococcus pneumoniae R6
ccaaguuaaaaaacuuggu

SEQ ID NO: 4109386 - RNA, 16 nt, Streptococcus pneumoniae R6
ccaaguucauuuuuua

SEQ ID NO: 4109387 - RNA, 13 nt, Streptococcus pneumoniae R6
ccaaguucuuuuc

SEQ ID NO: 4109388 - RNA, 22 nt, Streptococcus pneumoniae R6
ccaaguucuuuucauaaagaga

SEQ ID NO: 4109389 - RNA, 18 nt, Streptococcus pneumoniae R6
ccaaguuuguaucuuccu

SEQ ID NO: 4109390 - RNA, 19 nt, Streptococcus pneumoniae R6
ccaauaauaaaacuuuuaa

SEQ ID NO: 4109391 - RNA, 12 nt, Streptococcus pneumoniae R6
ccaauacaggaa

SEQ ID NO: 4109392 - RNA, 18 nt, Streptococcus pneumoniae R6
ccaauacaggaaaaccag

SEQ ID NO: 4109393 - RNA, 16 nt, Streptococcus pneumoniae R6
ccaauacuacaauaau

SEQ ID NO: 4109394 - RNA, 16 nt, Streptococcus pneumoniae R6
ccaauaucaucgauuu

SEQ ID NO: 4109395 - RNA, 22 nt, Streptococcus pneumoniae R6
ccaauaucaucgauuuuuucac

SEQ ID NO: 4109396 - RNA, 11 nt, Streptococcus pneumoniae R6
ccaaucaaacu

SEQ ID NO: 4109397 - RNA, 12 nt, Streptococcus pneumoniae R6
ccaaucaaacua

SEQ ID NO: 4109398 - RNA, 18 nt, Streptococcus pneumoniae R6
ccaaucaaacuacuauuu

SEQ ID NO: 4109399 - RNA, 13 nt, Streptococcus pneumoniae R6
ccaaucaaaucaa

SEQ ID NO: 4109400 - RNA, 14 nt, Streptococcus pneumoniae R6
ccaaucaaaucaau

SEQ ID NO: 4109401 - RNA, 18 nt, Streptococcus pneumoniae R6
ccaaucaauuuuacagga

SEQ ID NO: 4109402 - RNA, 18 nt, Streptococcus pneumoniae R6
ccaaucacuugaccaaag

SEQ ID NO: 4109403 - RNA, 13 nt, Streptococcus pneumoniae R6
ccaaucaucaucg

SEQ ID NO: 4109404 - RNA, 18 nt, Streptococcus pneumoniae R6
ccaaucauggcugggaug

SEQ ID NO: 4109405 - RNA, 16 nt, Streptococcus pneumoniae R6
ccaaucauuuggaaaa

SEQ ID NO: 4109406 - RNA, 17 nt, Streptococcus pneumoniae R6
ccaauccuaaauccucu

SEQ ID NO: 4109407 - RNA, 18 nt, Streptococcus pneumoniae R6
ccaauccuaaauccucua

SEQ ID NO: 4109408 - RNA, 12 nt, Streptococcus pneumoniae R6
ccaauccuauga

SEQ ID NO: 4109409 - RNA, 21 nt, Streptococcus pneumoniae R6
ccaaucgauuuguucucaucu

SEQ ID NO: 4109410 - RNA, 14 nt, Streptococcus pneumoniae R6
ccaaucguaaacug

SEQ ID NO: 4109411 - RNA, 14 nt, Streptococcus pneumoniae R6
ccaaucucaaaucc

SEQ ID NO: 4109412 - RNA, 17 nt, Streptococcus pneumoniae R6
ccaaucucaaggcacga

SEQ ID NO: 4109413 - RNA, 13 nt, Streptococcus pneumoniae R6
ccaauuaaauaag

SEQ ID NO: 4109414 - RNA, 14 nt, Streptococcus pneumoniae R6
ccaauuaaauaagc

SEQ ID NO: 4109415 - RNA, 12 nt, Streptococcus pneumoniae R6
ccaauugaggaa

SEQ ID NO: 4109416 - RNA, 23 nt, Streptococcus pneumoniae R6
ccaauuucuuuagcauaauagca

SEQ ID NO: 4109417 - RNA, 12 nt, Streptococcus pneumoniae R6
ccaauuuuuccu

SEQ ID NO: 4109418 - RNA, 13 nt, Streptococcus pneumoniae R6
ccaauuuuuccuu

SEQ ID NO: 4109419 - RNA, 14 nt, Streptococcus pneumoniae R6
ccacaacaaaaaag

SEQ ID NO: 4109420 - RNA, 17 nt, Streptococcus pneumoniae R6
ccacaaccucaaaacag

SEQ ID NO: 4109421 - RNA, 17 nt, Streptococcus pneumoniae R6
ccacaaccuuaaaacag

SEQ ID NO: 4109422 - RNA, 13 nt, Streptococcus pneumoniae R6
ccacaacuuuuaa

SEQ ID NO: 4109423 - RNA, 14 nt, Streptococcus pneumoniae R6
ccacaacuuuuaaa

SEQ ID NO: 4109424 - RNA, 15 nt, Streptococcus pneumoniae R6
ccacaccaccugcca

SEQ ID NO: 4109425 - RNA, 16 nt, Streptococcus pneumoniae R6
ccacagaccuguccaa

SEQ ID NO: 4109426 - RNA, 23 nt, Streptococcus pneumoniae R6
ccacagaguugggguuuggaaau

SEQ ID NO: 4109427 - RNA, 15 nt, Streptococcus pneumoniae R6
ccacagcguuucuau

SEQ ID NO: 4109428 - RNA, 20 nt, Streptococcus pneumoniae R6
ccacaguaacccauaccaga

SEQ ID NO: 4109429 - RNA, 16 nt, Streptococcus pneumoniae R6
ccacauagucagaacc

SEQ ID NO: 4109430 - RNA, 17 nt, Streptococcus pneumoniae R6
ccacaucaaaaacagcc

SEQ ID NO: 4109431 - RNA, 13 nt, Streptococcus pneumoniae R6
ccacaucaucaaa

SEQ ID NO: 4109432 - RNA, 17 nt, Streptococcus pneumoniae R6
ccacaucugccauauca

SEQ ID NO: 4109433 - RNA, 15 nt, Streptococcus pneumoniae R6
ccaccaaacaucugg

SEQ ID NO: 4109434 - RNA, 19 nt, Streptococcus pneumoniae R6
ccaccaagucaucaaaaau

SEQ ID NO: 4109435 - RNA, 18 nt, Streptococcus pneumoniae R6
ccaccagacauaucuuua

SEQ ID NO: 4109436 - RNA, 17 nt, Streptococcus pneumoniae R6
ccacccauauuuuuccu

SEQ ID NO: 4109437 - RNA, 22 nt, Streptococcus pneumoniae R6
ccaccgauauggccugcuaggc

SEQ ID NO: 4109438 - RNA, 15 nt, Streptococcus pneumoniae R6
ccaccugcagcaagu

SEQ ID NO: 4109439 - RNA, 12 nt, Streptococcus pneumoniae R6
ccaccuucaaca

SEQ ID NO: 4109440 - RNA, 13 nt, Streptococcus pneumoniae R6
ccaccuucaacaa

SEQ ID NO: 4109441 - RNA, 22 nt, Streptococcus pneumoniae R6
ccaccuucaucucucuauaaua

SEQ ID NO: 4109442 - RNA, 14 nt, Streptococcus pneumoniae R6
ccaccuuuucucaa

SEQ ID NO: 4109443 - RNA, 17 nt, Streptococcus pneumoniae R6
ccacgaagcugacgggc

SEQ ID NO: 4109444 - RNA, 23 nt, Streptococcus pneumoniae R6
ccacgaugaugauuggaaugacg

SEQ ID NO: 4109445 - RNA, 18 nt, Streptococcus pneumoniae R6
ccacgcuccacuucccca

SEQ ID NO: 4109446 - RNA, 20 nt, Streptococcus pneumoniae R6
ccacgcuggcuggaucagcu

SEQ ID NO: 4109447 - RNA, 14 nt, Streptococcus pneumoniae R6
ccacgucacaaaga

SEQ ID NO: 4109448 - RNA, 16 nt, Streptococcus pneumoniae R6
ccacgucagcuuuauc

SEQ ID NO: 4109449 - RNA, 16 nt, Streptococcus pneumoniae R6
ccacguccgucaagaa

SEQ ID NO: 4109450 - RNA, 21 nt, Streptococcus pneumoniae R6
ccacuaaaaauaugcuauuga

SEQ ID NO: 4109451 - RNA, 15 nt, Streptococcus pneumoniae R6
ccacuacaguugaca

SEQ ID NO: 4109452 - RNA, 17 nt, Streptococcus pneumoniae R6
ccacuacaguugacaaa

SEQ ID NO: 4109453 - RNA, 12 nt, Streptococcus pneumoniae R6
ccacucaacauu

SEQ ID NO: 4109454 - RNA, 17 nt, Streptococcus pneumoniae R6
ccacucagacagcugag

SEQ ID NO: 4109455 - RNA, 18 nt, Streptococcus pneumoniae R6
ccacucaguauuacaucc

SEQ ID NO: 4109456 - RNA, 17 nt, Streptococcus pneumoniae R6
ccacugaaucguuggca

SEQ ID NO: 4109457 - RNA, 17 nt, Streptococcus pneumoniae R6
ccacugaguuuuuccca

SEQ ID NO: 4109458 - RNA, 22 nt, Streptococcus pneumoniae R6
ccacugcaucugguucuagcag

SEQ ID NO: 4109459 - RNA, 18 nt, Streptococcus pneumoniae R6
ccacugugauuucuaaaa

SEQ ID NO: 4109460 - RNA, 15 nt, Streptococcus pneumoniae R6
ccacuuccuaccuau

SEQ ID NO: 4109461 - RNA, 14 nt, Streptococcus pneumoniae R6
ccacuuucaagucu

SEQ ID NO: 4109462 - RNA, 23 nt, Streptococcus pneumoniae R6
ccacuuuuuauccgucacgauuu

SEQ ID NO: 4109463 - RNA, 13 nt, Streptococcus pneumoniae R6
ccagaaaaauccc

SEQ ID NO: 4109464 - RNA, 21 nt, Streptococcus pneumoniae R6
ccagaacucccuguuccaaag

SEQ ID NO: 4109465 - RNA, 14 nt, Streptococcus pneumoniae R6
ccagaacuucaaua

SEQ ID NO: 4109466 - RNA, 18 nt, Streptococcus pneumoniae R6
ccagaacuuccacuucca

SEQ ID NO: 4109467 - RNA, 21 nt, Streptococcus pneumoniae R6
ccagaacuuccacuuccagaa

SEQ ID NO: 4109468 - RNA, 18 nt, Streptococcus pneumoniae R6
ccagacccugcacaaaga

SEQ ID NO: 4109469 - RNA, 23 nt, Streptococcus pneumoniae R6
ccagagaagccaccgccagaacu

SEQ ID NO: 4109470 - RNA, 19 nt, Streptococcus pneumoniae R6
ccagagacacuugccuaaa

SEQ ID NO: 4109471 - RNA, 13 nt, Streptococcus pneumoniae R6
ccagagcaccaac

SEQ ID NO: 4109472 - RNA, 16 nt, Streptococcus pneumoniae R6
ccagagcaccaaccaa

SEQ ID NO: 4109473 - RNA, 12 nt, Streptococcus pneumoniae R6
ccagagccuuga

SEQ ID NO: 4109474 - RNA, 18 nt, Streptococcus pneumoniae R6
ccagagccuugaguggau

SEQ ID NO: 4109475 - RNA, 14 nt, Streptococcus pneumoniae R6
ccagauaaagcuga

SEQ ID NO: 4109476 - RNA, 18 nt, Streptococcus pneumoniae R6
ccagauaaagcugauuuu

SEQ ID NO: 4109477 - RNA, 22 nt, Streptococcus pneumoniae R6
ccagauagagcuaacuuuuccu

SEQ ID NO: 4109478 - RNA, 23 nt, Streptococcus pneumoniae R6
ccagauagagcuaacuuuuccuu

SEQ ID NO: 4109479 - RNA, 13 nt, Streptococcus pneumoniae R6
ccagauauaccaa

SEQ ID NO: 4109480 - RNA, 20 nt, Streptococcus pneumoniae R6
cccaaacauagugaccugga

SEQ ID NO: 4109481 - RNA, 15 nt, Streptococcus pneumoniae R6
cccaaacucuucaca

SEQ ID NO: 4109482 - RNA, 14 nt, Streptococcus pneumoniae R6
cccaaagaauccau

SEQ ID NO: 4109483 - RNA, 11 nt, Streptococcus pneumoniae R6
cccaaaucauc

SEQ ID NO: 4109484 - RNA, 13 nt, Streptococcus pneumoniae R6
cccaaauuccugg

SEQ ID NO: 4109485 - RNA, 16 nt, Streptococcus pneumoniae R6
cccaagcuuuaugcuu

SEQ ID NO: 4109486 - RNA, 17 nt, Streptococcus pneumoniae R6
cccaaguaaucugcacc

SEQ ID NO: 4109487 - RNA, 13 nt, Streptococcus pneumoniae R6
cccaaguuaaaaa

SEQ ID NO: 4109488 - RNA, 14 nt, Streptococcus pneumoniae R6
cccaaguuaaaaaa

SEQ ID NO: 4109489 - RNA, 16 nt, Streptococcus pneumoniae R6
cccaccaagucaucaa

SEQ ID NO: 4109490 - RNA, 14 nt, Streptococcus pneumoniae R6
cccacccauauuuu

SEQ ID NO: 4109491 - RNA, 14 nt, Streptococcus pneumoniae R6
cccaccugcuuaau

SEQ ID NO: 4109492 - RNA, 13 nt, Streptococcus pneumoniae R6
cccacuaaaaaua

SEQ ID NO: 4109493 - RNA, 18 nt, Streptococcus pneumoniae R6
cccacuacaguugacaaa

SEQ ID NO: 4109494 - RNA, 20 nt, Streptococcus pneumoniae R6
cccacuacaguugacaaaga

SEQ ID NO: 4109495 - RNA, 12 nt, Streptococcus pneumoniae R6
cccagccuucag

SEQ ID NO: 4109496 - RNA, 15 nt, Streptococcus pneumoniae R6
cccagccuucagccc

SEQ ID NO: 4109497 - RNA, 13 nt, Streptococcus pneumoniae R6
cccagcuucuuuu

SEQ ID NO: 4109498 - RNA, 15 nt, Streptococcus pneumoniae R6
cccaguaaaggacuu

SEQ ID NO: 4109499 - RNA, 22 nt, Streptococcus pneumoniae R6
cccaguacuagacaauuuucau

SEQ ID NO: 4109500 - RNA, 23 nt, Streptococcus pneumoniae R6
cccaguagcuauuaaagauuuuu

SEQ ID NO: 4109501 - RNA, 14 nt, Streptococcus pneumoniae R6
cccauaauaucaua

SEQ ID NO: 4109502 - RNA, 17 nt, Streptococcus pneumoniae R6
cccauacgcccuccauu

SEQ ID NO: 4109503 - RNA, 23 nt, Streptococcus pneumoniae R6
cccauagauuuuuauuauuuccu

SEQ ID NO: 4109504 - RNA, 22 nt, Streptococcus pneumoniae R6
cccauauuuggcauauuuuuag

SEQ ID NO: 4109505 - RNA, 18 nt, Streptococcus pneumoniae R6
cccaucauuccugauaaa

SEQ ID NO: 4109506 - RNA, 17 nt, Streptococcus pneumoniae R6
cccaucauuucuucaac

SEQ ID NO: 4109507 - RNA, 11 nt, Streptococcus pneumoniae R6
cccauccgccc

SEQ ID NO: 4109508 - RNA, 12 nt, Streptococcus pneumoniae R6
cccaugacaauc

SEQ ID NO: 4109509 - RNA, 18 nt, Streptococcus pneumoniae R6
cccauggaacuaagauuu

SEQ ID NO: 4109510 - RNA, 19 nt, Streptococcus pneumoniae R6
cccauuggaucccauggug

SEQ ID NO: 4109511 - RNA, 21 nt, Streptococcus pneumoniae R6
cccauuuauggaaaaaaugaa

SEQ ID NO: 4109512 - RNA, 19 nt, Streptococcus pneumoniae R6
cccauuugcuucaucauuu

SEQ ID NO: 4109513 - RNA, 21 nt, Streptococcus pneumoniae R6
ccccaaaaguuagacagaaaa

SEQ ID NO: 4109514 - RNA, 22 nt, Streptococcus pneumoniae R6
ccccaaaaguuagacagaaaaa

SEQ ID NO: 4109515 - RNA, 23 nt, Streptococcus pneumoniae R6
ccccaaaaguuagauuuuuucug

SEQ ID NO: 4109516 - RNA, 22 nt, Streptococcus pneumoniae R6
ccccacgaaggacaucuucuac

SEQ ID NO: 4109517 - RNA, 18 nt, Streptococcus pneumoniae R6
ccccaguuacuuucuagg

SEQ ID NO: 4109518 - RNA, 17 nt, Streptococcus pneumoniae R6
ccccauuuaccaagcuc

SEQ ID NO: 4109519 - RNA, 23 nt, Streptococcus pneumoniae R6
cccccuacagggaucgaaccugu

SEQ ID NO: 4109520 - RNA, 16 nt, Streptococcus pneumoniae R6
ccccuacucgauuuua

SEQ ID NO: 4109521 - RNA, 21 nt, Streptococcus pneumoniae R6
ccccugauaguuaucgucacg

SEQ ID NO: 4109522 - RNA, 14 nt, Streptococcus pneumoniae R6
ccccugaugagcca

SEQ ID NO: 4109523 - RNA, 22 nt, Streptococcus pneumoniae R6
cccgauggguuaagugcauucg

SEQ ID NO: 4109524 - RNA, 22 nt, Streptococcus pneumoniae R6
cccgcauaaauacuaucaauaa

SEQ ID NO: 4109525 - RNA, 15 nt, Streptococcus pneumoniae R6
cccgcccaucaugcu

SEQ ID NO: 4109526 - RNA, 13 nt, Streptococcus pneumoniae R6
cccuaccucauau

SEQ ID NO: 4109527 - RNA, 21 nt, Streptococcus pneumoniae R6
cccuacucgauuuuaaaucac

SEQ ID NO: 4109528 - RNA, 20 nt, Streptococcus pneumoniae R6
cccuaggcaagcuugaaaca

SEQ ID NO: 4109529 - RNA, 23 nt, Streptococcus pneumoniae R6
cccuaucgauauaauuuuccuua

SEQ ID NO: 4109530 - RNA, 20 nt, Streptococcus pneumoniae R6
cccuaugagagcuuauuuuu

SEQ ID NO: 4109531 - RNA, 22 nt, Streptococcus pneumoniae R6
cccucaaccugaaucuccucag

SEQ ID NO: 4109532 - RNA, 23 nt, Streptococcus pneumoniae R6
cccuccuauagaaaaauccccca

SEQ ID NO: 4109533 - RNA, 21 nt, Streptococcus pneumoniae R6
cccugcaaacuggagcauuuc

SEQ ID NO: 4109534 - RNA, 19 nt, Streptococcus pneumoniae R6
cccugcaugagcuguuuag

SEQ ID NO: 4109535 - RNA, 15 nt, Streptococcus pneumoniae R6
cccuggaggauagca

SEQ ID NO: 4109536 - RNA, 15 nt, Streptococcus pneumoniae R6
cccuggggucggcag

SEQ ID NO: 4109537 - RNA, 16 nt, Streptococcus pneumoniae R6
cccuguuguccgccag

SEQ ID NO: 4109538 - RNA, 13 nt, Streptococcus pneumoniae R6
cccuuaaaaccau

SEQ ID NO: 4109539 - RNA, 16 nt, Streptococcus pneumoniae R6
cccuuauuuccaucuu

SEQ ID NO: 4109540 - RNA, 13 nt, Streptococcus pneumoniae R6
cccuucuuucuca

SEQ ID NO: 4109541 - RNA, 14 nt, Streptococcus pneumoniae R6
cccuugauuuccuu

SEQ ID NO: 4109542 - RNA, 20 nt, Streptococcus pneumoniae R6
cccuugucuacauucuuuuu

SEQ ID NO: 4109543 - RNA, 19 nt, Streptococcus pneumoniae R6
cccuuguuucuaaaacauu

SEQ ID NO: 4109544 - RNA, 23 nt, Streptococcus pneumoniae R6
cccuuguuucuaaaacauuguga

SEQ ID NO: 4109545 - RNA, 11 nt, Streptococcus pneumoniae R6
cccuuuaccau

SEQ ID NO: 4109546 - RNA, 13 nt, Streptococcus pneumoniae R6
cccuuuagaacuu

SEQ ID NO: 4109547 - RNA, 14 nt, Streptococcus pneumoniae R6
cccuuugcugcuuu

SEQ ID NO: 4109548 - RNA, 20 nt, Streptococcus pneumoniae R6
ccgaacuuuugaauuucaug

SEQ ID NO: 4109549 - RNA, 14 nt, Streptococcus pneumoniae R6
ccgaagaaggccaa

SEQ ID NO: 4109550 - RNA, 18 nt, Streptococcus pneumoniae R6
ccgaagaaggccaaauau

SEQ ID NO: 4109551 - RNA, 14 nt, Streptococcus pneumoniae R6
ccgaccuugucucc

SEQ ID NO: 4109552 - RNA, 14 nt, Streptococcus pneumoniae R6
ccgacuauuuuuug

SEQ ID NO: 4109553 - RNA, 22 nt, Streptococcus pneumoniae R6
ccgacuugguaguugagcuggc

SEQ ID NO: 4109554 - RNA, 19 nt, Streptococcus pneumoniae R6
ccgagucaaaauucuuuga

SEQ ID NO: 4109555 - RNA, 13 nt, Streptococcus pneumoniae R6
ccgaguuuuucag

SEQ ID NO: 4109556 - RNA, 13 nt, Streptococcus pneumoniae R6
ccgauaacagccg

SEQ ID NO: 4109557 - RNA, 13 nt, Streptococcus pneumoniae R6
ccgauaucaccaa

SEQ ID NO: 4109558 - RNA, 23 nt, Streptococcus pneumoniae R6
ccgauggaaauauaggccaagau

SEQ ID NO: 4109559 - RNA, 20 nt, Streptococcus pneumoniae R6
ccgccaccuccgccuccaga

SEQ ID NO: 4109560 - RNA, 16 nt, Streptococcus pneumoniae R6
ccgccauacuuucucu

SEQ ID NO: 4109561 - RNA, 14 nt, Streptococcus pneumoniae R6
ccgcccaucaugcu

SEQ ID NO: 4109562 - RNA, 16 nt, Streptococcus pneumoniae R6
ccgcgucagcuuuauc

SEQ ID NO: 4109563 - RNA, 17 nt, Streptococcus pneumoniae R6
ccgcuucagcgauuucu

SEQ ID NO: 4109564 - RNA, 17 nt, Streptococcus pneumoniae R6
ccggaaaauucucuuuu

SEQ ID NO: 4109565 - RNA, 14 nt, Streptococcus pneumoniae R6
ccggaaaccaaagg

SEQ ID NO: 4109566 - RNA, 15 nt, Streptococcus pneumoniae R6
ccggauugcuccgau

SEQ ID NO: 4109567 - RNA, 13 nt, Streptococcus pneumoniae R6
ccggcuuucacaa

SEQ ID NO: 4109568 - RNA, 15 nt, Streptococcus pneumoniae R6
ccguaagauagggcu

SEQ ID NO: 4109569 - RNA, 12 nt, Streptococcus pneumoniae R6
ccguagauagcu

SEQ ID NO: 4109570 - RNA, 21 nt, Streptococcus pneumoniae R6
ccguagguaugguuacugacu

SEQ ID NO: 4109571 - RNA, 14 nt, Streptococcus pneumoniae R6
ccguagguuuucuc

SEQ ID NO: 4109572 - RNA, 16 nt, Streptococcus pneumoniae R6
ccguagguuuucuccu

SEQ ID NO: 4109573 - RNA, 19 nt, Streptococcus pneumoniae R6
ccgucaacgucaagaacuu

SEQ ID NO: 4109574 - RNA, 15 nt, Streptococcus pneumoniae R6
ccgucuuggucuguc

SEQ ID NO: 4109575 - RNA, 19 nt, Streptococcus pneumoniae R6
ccgucuuuagagagaugaa

SEQ ID NO: 4109576 - RNA, 14 nt, Streptococcus pneumoniae R6
ccguugaaaucaau

SEQ ID NO: 4109577 - RNA, 22 nt, Streptococcus pneumoniae R6
ccguugaguuuuuuauuuuccc

SEQ ID NO: 4109578 - RNA, 17 nt, Streptococcus pneumoniae R6
ccguugucuucugcgga

SEQ ID NO: 4109579 - RNA, 17 nt, Streptococcus pneumoniae R6
ccguuuuucuccucuaa

SEQ ID NO: 4109580 - RNA, 16 nt, Streptococcus pneumoniae R6
ccuaaaacaguuacau

SEQ ID NO: 4109581 - RNA, 16 nt, Streptococcus pneumoniae R6
ccuaaaacuagugaag

SEQ ID NO: 4109582 - RNA, 19 nt, Streptococcus pneumoniae R6
ccuaaacacuucacuaauu

SEQ ID NO: 4109583 - RNA, 19 nt, Streptococcus pneumoniae R6
ccugauaguuuaguuauug

SEQ ID NO: 4109584 - RNA, 21 nt, Streptococcus pneumoniae R6
ccugauauuaugcguuuuuca

SEQ ID NO: 4109585 - RNA, 23 nt, Streptococcus pneumoniae R6
ccugauauuaugcguuuuuuuga

SEQ ID NO: 4109586 - RNA, 14 nt, Streptococcus pneumoniae R6
ccugauuaaaauca

SEQ ID NO: 4109587 - RNA, 17 nt, Streptococcus pneumoniae R6
ccugcaaaucuacuggc

SEQ ID NO: 4109588 - RNA, 12 nt, Streptococcus pneumoniae R6
ccugcaguuccc

SEQ ID NO: 4109589 - RNA, 14 nt, Streptococcus pneumoniae R6
ccugcaguucccac

SEQ ID NO: 4109590 - RNA, 14 nt, Streptococcus pneumoniae R6
ccugcauuucuuuu

SEQ ID NO: 4109591 - RNA, 12 nt, Streptococcus pneumoniae R6
ccugccaauggu

SEQ ID NO: 4109592 - RNA, 16 nt, Streptococcus pneumoniae R6
ccugccccugaugagc

SEQ ID NO: 4109593 - RNA, 18 nt, Streptococcus pneumoniae R6
ccugccccugaugagcca

SEQ ID NO: 4109594 - RNA, 10 nt, Streptococcus pneumoniae R6
ccugccugug

SEQ ID NO: 4109595 - RNA, 17 nt, Streptococcus pneumoniae R6
ccugcgacuagcuuucu

SEQ ID NO: 4109596 - RNA, 15 nt, Streptococcus pneumoniae R6
ccugcggcugcagcu

SEQ ID NO: 4109597 - RNA, 15 nt, Streptococcus pneumoniae R6
ccugcuacugcaucc

SEQ ID NO: 4109598 - RNA, 17 nt, Streptococcus pneumoniae R6
ccugcuacugcauccaa

SEQ ID NO: 4109599 - RNA, 21 nt, Streptococcus pneumoniae R6
ccugcuccuccgagagcugau

SEQ ID NO: 4109600 - RNA, 19 nt, Streptococcus pneumoniae R6
ccugcucgccccauuucuu

SEQ ID NO: 4109601 - RNA, 13 nt, Streptococcus pneumoniae R6
ccugcuuuuucaa

SEQ ID NO: 4109602 - RNA, 22 nt, Streptococcus pneumoniae R6
ccugcuuuuucaagcauuuuuu

SEQ ID NO: 4109603 - RNA, 21 nt, Streptococcus pneumoniae R6
ccuggaaucagaacacuucca

SEQ ID NO: 4109604 - RNA, 18 nt, Streptococcus pneumoniae R6
ccuggauagguugcaaag

SEQ ID NO: 4109605 - RNA, 16 nt, Streptococcus pneumoniae R6
ccuggauugacuguug

SEQ ID NO: 4109606 - RNA, 22 nt, Streptococcus pneumoniae R6
ccuggcaauacuucaacaaaug

SEQ ID NO: 4109607 - RNA, 13 nt, Streptococcus pneumoniae R6
ccuggucuuauuu

SEQ ID NO: 4109608 - RNA, 20 nt, Streptococcus pneumoniae R6
ccuggucuuauuucauuuca

SEQ ID NO: 4109609 - RNA, 18 nt, Streptococcus pneumoniae R6
ccuguaaucccucagagu

SEQ ID NO: 4109610 - RNA, 21 nt, Streptococcus pneumoniae R6
ccuguacccaaguaaucugca

SEQ ID NO: 4109611 - RNA, 21 nt, Streptococcus pneumoniae R6
ccuguagggggcauauaaaua

SEQ ID NO: 4109612 - RNA, 20 nt, Streptococcus pneumoniae R6
ccuguaugggcaucaacagc

SEQ ID NO: 4109613 - RNA, 18 nt, Streptococcus pneumoniae R6
ccugucaagaccauggcg

SEQ ID NO: 4109614 - RNA, 19 nt, Streptococcus pneumoniae R6
ccuguccuaggucuagacu

SEQ ID NO: 4109615 - RNA, 14 nt, Streptococcus pneumoniae R6
ccugugauuuucuu

SEQ ID NO: 4109616 - RNA, 13 nt, Streptococcus pneumoniae R6
ccugugcuacgac

SEQ ID NO: 4109617 - RNA, 15 nt, Streptococcus pneumoniae R6
ccugugcuagugaau

SEQ ID NO: 4109618 - RNA, 18 nt, Streptococcus pneumoniae R6
ccuguuguaauuuuaaaa

SEQ ID NO: 4109619 - RNA, 12 nt, Streptococcus pneumoniae R6
ccuguuucaaag

SEQ ID NO: 4109620 - RNA, 17 nt, Streptococcus pneumoniae R6
ccuguuugaaucaauuc

SEQ ID NO: 4109621 - RNA, 17 nt, Streptococcus pneumoniae R6
ccuguuuguguuucugg

SEQ ID NO: 4109622 - RNA, 23 nt, Streptococcus pneumoniae R6
ccuguuuucacuggaguucuuuu

SEQ ID NO: 4109623 - RNA, 14 nt, Streptococcus pneumoniae R6
ccuuaaaacagugu

SEQ ID NO: 4109624 - RNA, 16 nt, Streptococcus pneumoniae R6
ccuuaaaaccauguuu

SEQ ID NO: 4109625 - RNA, 20 nt, Streptococcus pneumoniae R6
ccuuaaaaccauguuuuuca

SEQ ID NO: 4109626 - RNA, 17 nt, Streptococcus pneumoniae R6
ccuuaacuggagcagga

SEQ ID NO: 4109627 - RNA, 12 nt, Streptococcus pneumoniae R6
ccuuaagucugu

SEQ ID NO: 4109628 - RNA, 22 nt, Streptococcus pneumoniae R6
ccuuaccacuagugaauuuggu

SEQ ID NO: 4109629 - RNA, 19 nt, Streptococcus pneumoniae R6
ccuuaccguauauauguua

SEQ ID NO: 4109630 - RNA, 17 nt, Streptococcus pneumoniae R6
ccuuacuagcaaauuua

SEQ ID NO: 4109631 - RNA, 17 nt, Streptococcus pneumoniae R6
ccuuagcagacuucuuu

SEQ ID NO: 4109632 - RNA, 18 nt, Streptococcus pneumoniae R6
ccuuauauggaugauuua

SEQ ID NO: 4109633 - RNA, 16 nt, Streptococcus pneumoniae R6
ccuuauccaauucuuc

SEQ ID NO: 4109634 - RNA, 17 nt, Streptococcus pneumoniae R6
ccuuauccacaucauca

SEQ ID NO: 4109635 - RNA, 16 nt, Streptococcus pneumoniae R6
ccuuauugcucuugac

SEQ ID NO: 4109636 - RNA, 12 nt, Streptococcus pneumoniae R6
ccuuauuuuuua

SEQ ID NO: 4109637 - RNA, 19 nt, Streptococcus pneumoniae R6
ccuucaacggcaccuucua

SEQ ID NO: 4109638 - RNA, 23 nt, Streptococcus pneumoniae R6
ccuucaacggcaccuucuacagc

SEQ ID NO: 4109639 - RNA, 16 nt, Streptococcus pneumoniae R6
ccuucaagggcagaca

SEQ ID NO: 4109640 - RNA, 16 nt, Streptococcus pneumoniae R6
ccuucaccaaucaaau

SEQ ID NO: 4109641 - RNA, 15 nt, Streptococcus pneumoniae R6
ccuucauaaaggaac

SEQ ID NO: 4109642 - RNA, 23 nt, Streptococcus pneumoniae R6
ccuucauacgagccgcaagguga

SEQ ID NO: 4109643 - RNA, 21 nt, Streptococcus pneumoniae R6
ccuucaucaaaugacuaaccu

SEQ ID NO: 4109644 - RNA, 17 nt, Streptococcus pneumoniae R6
ccuucaucauagaaaua

SEQ ID NO: 4109645 - RNA, 19 nt, Streptococcus pneumoniae R6
ccuucaucucucuauaaua

SEQ ID NO: 4109646 - RNA, 16 nt, Streptococcus pneumoniae R6
ccuucauuaagucaua

SEQ ID NO: 4109647 - RNA, 22 nt, Streptococcus pneumoniae R6
ccuuccauauagucuuucaaag

SEQ ID NO: 4109648 - RNA, 17 nt, Streptococcus pneumoniae R6
ccuuccaugauagaugg

SEQ ID NO: 4109649 - RNA, 14 nt, Streptococcus pneumoniae R6
ccuucguaaauaag

SEQ ID NO: 4109650 - RNA, 17 nt, Streptococcus pneumoniae R6
ccuucuccaauugcaag

SEQ ID NO: 4109651 - RNA, 13 nt, Streptococcus pneumoniae R6
ccuucuuuuuaau

SEQ ID NO: 4109652 - RNA, 18 nt, Streptococcus pneumoniae R6
ccuugaagaguugccccu

SEQ ID NO: 4109653 - RNA, 17 nt, Streptococcus pneumoniae R6
ccuugauaaugcguuua

SEQ ID NO: 4109654 - RNA, 15 nt, Streptococcus pneumoniae R6
ccuugaugaucuaaa

SEQ ID NO: 4109655 - RNA, 17 nt, Streptococcus pneumoniae R6
ccuugccaucugcuuca

SEQ ID NO: 4109656 - RNA, 12 nt, Streptococcus pneumoniae R6
ccuuggacuugg

SEQ ID NO: 4109657 - RNA, 18 nt, Streptococcus pneumoniae R6
ccuugguaacaacaccgc

SEQ ID NO: 4109658 - RNA, 20 nt, Streptococcus pneumoniae R6
ccuugguaauuccuucuuga

SEQ ID NO: 4109659 - RNA, 16 nt, Streptococcus pneumoniae R6
ccuuguagaaaagcaa

SEQ ID NO: 4109660 - RNA, 20 nt, Streptococcus pneumoniae R6
ccuuguagaaaagcaaaaug

SEQ ID NO: 4109661 - RNA, 24 nt, Streptococcus pneumoniae R6
ccuugucauccuuacggucaaagu

SEQ ID NO: 4109662 - RNA, 14 nt, Streptococcus pneumoniae R6
ccuugugcacacuc

SEQ ID NO: 4109663 - RNA, 19 nt, Streptococcus pneumoniae R6
ccuuguucaugcaggaagu

SEQ ID NO: 4109664 - RNA, 13 nt, Streptococcus pneumoniae R6
ccuuguuuccaag

SEQ ID NO: 4109665 - RNA, 19 nt, Streptococcus pneumoniae R6
ccuuguuucuaaaacauug

SEQ ID NO: 4109666 - RNA, 14 nt, Streptococcus pneumoniae R6
ccuuuaaaaacaau

SEQ ID NO: 4109667 - RNA, 15 nt, Streptococcus pneumoniae R6
ccuuuaaaaacaauc

SEQ ID NO: 4109668 - RNA, 22 nt, Streptococcus pneumoniae R6
ccuuuaaccugaugaauaguga

SEQ ID NO: 4109669 - RNA, 18 nt, Streptococcus pneumoniae R6
ccuuuagaacuugcucca

SEQ ID NO: 4109670 - RNA, 20 nt, Streptococcus pneumoniae R6
ccuuuagugauaucuugaag

SEQ ID NO: 4109671 - RNA, 14 nt, Streptococcus pneumoniae R6
ccuuuaguuuauuc

SEQ ID NO: 4109672 - RNA, 12 nt, Streptococcus pneumoniae R6
ccuuuauuuuuu

SEQ ID NO: 4109673 - RNA, 13 nt, Streptococcus pneumoniae R6
ccuuuauuuuuuu

SEQ ID NO: 4109674 - RNA, 12 nt, Streptococcus pneumoniae R6
ccuuucaaaaua

SEQ ID NO: 4109675 - RNA, 23 nt, Streptococcus pneumoniae R6
ccuuucaauagcauauuuuuagu

SEQ ID NO: 4109676 - RNA, 18 nt, Streptococcus pneumoniae R6
ccuuuccuaaucgauuug

SEQ ID NO: 4109677 - RNA, 18 nt, Streptococcus pneumoniae R6
ccuuucggcuguuuuuga

SEQ ID NO: 4109678 - RNA, 15 nt, Streptococcus pneumoniae R6
ccuuucuuguaauaa

SEQ ID NO: 4109679 - RNA, 13 nt, Streptococcus pneumoniae R6
ccuuucuuuuuug

SEQ ID NO: 4109680 - RNA, 21 nt, Streptococcus pneumoniae R6
ccuuucuuuuuugauguucag

SEQ ID NO: 4109681 - RNA, 12 nt, Streptococcus pneumoniae R6
ccuuugaguaag

SEQ ID NO: 4109682 - RNA, 12 nt, Streptococcus pneumoniae R6
ccuuugcugcuu

SEQ ID NO: 4109683 - RNA, 14 nt, Streptococcus pneumoniae R6
ccuuuguauggaaa

SEQ ID NO: 4109684 - RNA, 15 nt, Streptococcus pneumoniae R6
ccuuuucgugagcga

SEQ ID NO: 4109685 - RNA, 15 nt, Streptococcus pneumoniae R6
ccuuuucuacugaaa

SEQ ID NO: 4109686 - RNA, 20 nt, Streptococcus pneumoniae R6
cgaugaccguugacuuccuu

SEQ ID NO: 4109687 - RNA, 20 nt, Streptococcus pneumoniae R6
cgaugauauugcaguauauc

SEQ ID NO: 4109688 - RNA, 22 nt, Streptococcus pneumoniae R6
cgaugaugauuggaaugacgaa

SEQ ID NO: 4109689 - RNA, 22 nt, Streptococcus pneumoniae R6
cgaugccaugagcgucuuucuu

SEQ ID NO: 4109690 - RNA, 23 nt, Streptococcus pneumoniae R6
cgauggggggacauaaaaaaauc

SEQ ID NO: 4109691 - RNA, 18 nt, Streptococcus pneumoniae R6
cgauguuugcagcaccag

SEQ ID NO: 4109692 - RNA, 17 nt, Streptococcus pneumoniae R6
cgauuaaaaguaagaga

SEQ ID NO: 4109693 - RNA, 19 nt, Streptococcus pneumoniae R6
cgauuaaaaguaagagaaa

SEQ ID NO: 4109694 - RNA, 19 nt, Streptococcus pneumoniae R6
cgauuaaauaguucuucca

SEQ ID NO: 4109695 - RNA, 21 nt, Streptococcus pneumoniae R6
cgauuaaauaguucuuccaau

SEQ ID NO: 4109696 - RNA, 19 nt, Streptococcus pneumoniae R6
cgauuaggggggcuauucu

SEQ ID NO: 4109697 - RNA, 15 nt, Streptococcus pneumoniae R6
cgauuauuuuuucuc

SEQ ID NO: 4109698 - RNA, 22 nt, Streptococcus pneumoniae R6
cgauucccacaagggauagcac

SEQ ID NO: 4109699 - RNA, 16 nt, Streptococcus pneumoniae R6
cgauugauuuccaaaa

SEQ ID NO: 4109700 - RNA, 21 nt, Streptococcus pneumoniae R6
cgauugauuucggccaauucu

SEQ ID NO: 4109701 - RNA, 18 nt, Streptococcus pneumoniae R6
cgauuggauuugacugga

SEQ ID NO: 4109702 - RNA, 18 nt, Streptococcus pneumoniae R6
cgauuggggucagaaaga

SEQ ID NO: 4109703 - RNA, 14 nt, Streptococcus pneumoniae R6
cgauugguaucuug

SEQ ID NO: 4109704 - RNA, 15 nt, Streptococcus pneumoniae R6
cgauugguucugcuc

SEQ ID NO: 4109705 - RNA, 13 nt, Streptococcus pneumoniae R6
cgauugucaucau

SEQ ID NO: 4109706 - RNA, 16 nt, Streptococcus pneumoniae R6
cgauuuaaugauaugg

SEQ ID NO: 4109707 - RNA, 11 nt, Streptococcus pneumoniae R6
cgauuucucuc

SEQ ID NO: 4109708 - RNA, 20 nt, Streptococcus pneumoniae R6
cgauuuguccuggucuuauu

SEQ ID NO: 4109709 - RNA, 12 nt, Streptococcus pneumoniae R6
cgauuuguucuc

SEQ ID NO: 4109710 - RNA, 20 nt, Streptococcus pneumoniae R6
cgauuuguucuguucuuauu

SEQ ID NO: 4109711 - RNA, 19 nt, Streptococcus pneumoniae R6
cgauuuguuuuugguaaga

SEQ ID NO: 4109712 - RNA, 12 nt, Streptococcus pneumoniae R6
cgauuuucaaaa

SEQ ID NO: 4109713 - RNA, 18 nt, Streptococcus pneumoniae R6
cgauuuucucuuuguccu

SEQ ID NO: 4109714 - RNA, 15 nt, Streptococcus pneumoniae R6
cgauuuuuucaccaa

SEQ ID NO: 4109715 - RNA, 17 nt, Streptococcus pneumoniae R6
cgauuuuuucaccaaaa

SEQ ID NO: 4109716 - RNA, 19 nt, Streptococcus pneumoniae R6
cgauuuuuucuuuguucuu

SEQ ID NO: 4109717 - RNA, 13 nt, Streptococcus pneumoniae R6
cgcaaaagcuacu

SEQ ID NO: 4109718 - RNA, 23 nt, Streptococcus pneumoniae R6
cgcaaacuuggucgcugaguaaa

SEQ ID NO: 4109719 - RNA, 21 nt, Streptococcus pneumoniae R6
cgcaaauccgaaaaucacucc

SEQ ID NO: 4109720 - RNA, 18 nt, Streptococcus pneumoniae R6
cgcaaggaugccagccuu

SEQ ID NO: 4109721 - RNA, 23 nt, Streptococcus pneumoniae R6
cgcaagguuguuagauuauguaa

SEQ ID NO: 4109722 - RNA, 20 nt, Streptococcus pneumoniae R6
cgcaaguccuacccacugug

SEQ ID NO: 4109723 - RNA, 13 nt, Streptococcus pneumoniae R6
cgcaaguuuuucc

SEQ ID NO: 4109724 - RNA, 18 nt, Streptococcus pneumoniae R6
cgcacugucguuccuuuu

SEQ ID NO: 4109725 - RNA, 18 nt, Streptococcus pneumoniae R6
cgcagagguggaaugaua

SEQ ID NO: 4109726 - RNA, 21 nt, Streptococcus pneumoniae R6
cgcauaaauacuaucaauaaa

SEQ ID NO: 4109727 - RNA, 23 nt, Streptococcus pneumoniae R6
cgcauaguaucaagguuuuucug

SEQ ID NO: 4109728 - RNA, 16 nt, Streptococcus pneumoniae R6
cgcauaguaucaaguu

SEQ ID NO: 4109729 - RNA, 17 nt, Streptococcus pneumoniae R6
cgcauaguugcauuaaa

SEQ ID NO: 4109730 - RNA, 23 nt, Streptococcus pneumoniae R6
cgcauaugcaacuuguuuuuccu

SEQ ID NO: 4109731 - RNA, 15 nt, Streptococcus pneumoniae R6
cgcaucgucaucacg

SEQ ID NO: 4109732 - RNA, 19 nt, Streptococcus pneumoniae R6
cgcauuugagcgaaaucaa

SEQ ID NO: 4109733 - RNA, 15 nt, Streptococcus pneumoniae R6
cgccauuuggcccua

SEQ ID NO: 4109734 - RNA, 14 nt, Streptococcus pneumoniae R6
cgccccauuucuuc

SEQ ID NO: 4109735 - RNA, 15 nt, Streptococcus pneumoniae R6
cgcccuccauuauga

SEQ ID NO: 4109736 - RNA, 21 nt, Streptococcus pneumoniae R6
cgccgauggaaauauaggcca

SEQ ID NO: 4109737 - RNA, 23 nt, Streptococcus pneumoniae R6
cgccuggagcuucaucaguucca

SEQ ID NO: 4109738 - RNA, 18 nt, Streptococcus pneumoniae R6
cgccuggauagguugcaa

SEQ ID NO: 4109739 - RNA, 14 nt, Streptococcus pneumoniae R6
cgcgaaacggcagc

SEQ ID NO: 4109740 - RNA, 15 nt, Streptococcus pneumoniae R6
cgcgcaauuaagcag

SEQ ID NO: 4109741 - RNA, 17 nt, Streptococcus pneumoniae R6
cgcggcaaauagcccau

SEQ ID NO: 4109742 - RNA, 16 nt, Streptococcus pneumoniae R6
cgcggguucaauacaa

SEQ ID NO: 4109743 - RNA, 12 nt, Streptococcus pneumoniae R6
cgcuaagagggu

SEQ ID NO: 4109744 - RNA, 19 nt, Streptococcus pneumoniae R6
cgcuaagaggguccaaacc

SEQ ID NO: 4109745 - RNA, 21 nt, Streptococcus pneumoniae R6
cgcuacgacguuuaucaauaa

SEQ ID NO: 4109746 - RNA, 16 nt, Streptococcus pneumoniae R6
cgcuagcaaaaucaua

SEQ ID NO: 4109747 - RNA, 13 nt, Streptococcus pneumoniae R6
cgcuauuuaaacu

SEQ ID NO: 4109748 - RNA, 19 nt, Streptococcus pneumoniae R6
cgcuccuaaucucuggcug

SEQ ID NO: 4109749 - RNA, 13 nt, Streptococcus pneumoniae R6
cgcugaguaaaga

SEQ ID NO: 4109750 - RNA, 16 nt, Streptococcus pneumoniae R6
cgcuggcauuucccau

SEQ ID NO: 4109751 - RNA, 20 nt, Streptococcus pneumoniae R6
cgcuggcauuucccauugca

SEQ ID NO: 4109752 - RNA, 17 nt, Streptococcus pneumoniae R6
cgcuuaaaggcucuaaa

SEQ ID NO: 4109753 - RNA, 15 nt, Streptococcus pneumoniae R6
cgcuuacauaaagua

SEQ ID NO: 4109754 - RNA, 15 nt, Streptococcus pneumoniae R6
cgcuuccaauuuuug

SEQ ID NO: 4109755 - RNA, 13 nt, Streptococcus pneumoniae R6
cgcuugaaacuca

SEQ ID NO: 4109756 - RNA, 15 nt, Streptococcus pneumoniae R6
cgcuugaaugauaaa

SEQ ID NO: 4109757 - RNA, 12 nt, Streptococcus pneumoniae R6
cgcuuucuucau

SEQ ID NO: 4109758 - RNA, 15 nt, Streptococcus pneumoniae R6
cgcuuucuucauuuu

SEQ ID NO: 4109759 - RNA, 16 nt, Streptococcus pneumoniae R6
cggaaagccaaaucaa

SEQ ID NO: 4109760 - RNA, 20 nt, Streptococcus pneumoniae R6
cggaaagccaaaucaauuuc

SEQ ID NO: 4109761 - RNA, 13 nt, Streptococcus pneumoniae R6
cggaaaggcuagg

SEQ ID NO: 4109762 - RNA, 12 nt, Streptococcus pneumoniae R6
cggaaauauuuu

SEQ ID NO: 4109763 - RNA, 18 nt, Streptococcus pneumoniae R6
cggaacucuagcuuuuua

SEQ ID NO: 4109764 - RNA, 17 nt, Streptococcus pneumoniae R6
cggaaguuggucuccca

SEQ ID NO: 4109765 - RNA, 14 nt, Streptococcus pneumoniae R6
cggaauagagcauc

SEQ ID NO: 4109766 - RNA, 16 nt, Streptococcus pneumoniae R6
cggaaugcuugcaaau

SEQ ID NO: 4109767 - RNA, 16 nt, Streptococcus pneumoniae R6
cggacaccucuuucuu

SEQ ID NO: 4109768 - RNA, 23 nt, Streptococcus pneumoniae R6
cggacgauuaaaaguaagagaaa

SEQ ID NO: 4109769 - RNA, 14 nt, Streptococcus pneumoniae R6
cggagcuuggaaug

SEQ ID NO: 4109770 - RNA, 20 nt, Streptococcus pneumoniae R6
cggagggucuuuuguccugu

SEQ ID NO: 4109771 - RNA, 20 nt, Streptococcus pneumoniae R6
cggaguuuuuuugaugagga

SEQ ID NO: 4109772 - RNA, 19 nt, Streptococcus pneumoniae R6
cggauaaaaccuguuugaa

SEQ ID NO: 4109773 - RNA, 22 nt, Streptococcus pneumoniae R6
cggauaaaaccuguuugaauca

SEQ ID NO: 4109774 - RNA, 15 nt, Streptococcus pneumoniae R6
cggauaaaagagaau

SEQ ID NO: 4109775 - RNA, 13 nt, Streptococcus pneumoniae R6
cggauaaaauccg

SEQ ID NO: 4109776 - RNA, 11 nt, Streptococcus pneumoniae R6
cggauaacagu

SEQ ID NO: 4109777 - RNA, 17 nt, Streptococcus pneumoniae R6
cggauucucucagcuac

SEQ ID NO: 4109778 - RNA, 20 nt, Streptococcus pneumoniae R6
cggcaccuucuacagcaccu

SEQ ID NO: 4109779 - RNA, 14 nt, Streptococcus pneumoniae R6
cggcagacagagaa

SEQ ID NO: 4109780 - RNA, 12 nt, Streptococcus pneumoniae R6
cggcauaaaauc

SEQ ID NO: 4109781 - RNA, 22 nt, Streptococcus pneumoniae R6
cggcauugugaugaagauugau

SEQ ID NO: 4109782 - RNA, 20 nt, Streptococcus pneumoniae R6
cggccagcacggugugugua

SEQ ID NO: 4109783 - RNA, 20 nt, Streptococcus pneumoniae R6
cggccuucuuuuuaauuauu

SEQ ID NO: 4109784 - RNA, 20 nt, Streptococcus pneumoniae R6
cggcucaugagauaauacaa

SEQ ID NO: 4109785 - RNA, 13 nt, Streptococcus pneumoniae R6
cggcuguucuuuu

SEQ ID NO: 4109786 - RNA, 16 nt, Streptococcus pneumoniae R6
cggcuucaucuggauu

SEQ ID NO: 4109787 - RNA, 14 nt, Streptococcus pneumoniae R6
cggguucuuccaaa

SEQ ID NO: 4109788 - RNA, 12 nt, Streptococcus pneumoniae R6
cggguuuuaaac

SEQ ID NO: 4109789 - RNA, 19 nt, Streptococcus pneumoniae R6
cguuuuauuguuccuaaaa

SEQ ID NO: 4109790 - RNA, 21 nt, Streptococcus pneumoniae R6
cguuuucaaagcuacuuuuuu

SEQ ID NO: 4109791 - RNA, 11 nt, Streptococcus pneumoniae R6
cguuuuuaaau

SEQ ID NO: 4109792 - RNA, 18 nt, Streptococcus pneumoniae R6
cguuuuuaucauuuugaa

SEQ ID NO: 4109793 - RNA, 19 nt, Streptococcus pneumoniae R6
cguuuuuaucauuuugaaa

SEQ ID NO: 4109794 - RNA, 15 nt, Streptococcus pneumoniae R6
cguuuuucugauuuu

SEQ ID NO: 4109795 - RNA, 19 nt, Streptococcus pneumoniae R6
cguuuuucugauuuugaaa

SEQ ID NO: 4109796 - RNA, 18 nt, Streptococcus pneumoniae R6
cguuuuuucugauuucaa

SEQ ID NO: 4109797 - RNA, 21 nt, Streptococcus pneumoniae R6
cuaaaaacucuucuuuuggca

SEQ ID NO: 4109798 - RNA, 11 nt, Streptococcus pneumoniae R6
cuaaaaauaaa

SEQ ID NO: 4109799 - RNA, 12 nt, Streptococcus pneumoniae R6
cuaaaaauaaaa

SEQ ID NO: 4109800 - RNA, 13 nt, Streptococcus pneumoniae R6
cuaaaaauaaaaa

SEQ ID NO: 4109801 - RNA, 14 nt, Streptococcus pneumoniae R6
cuaaaaauaaaaaa

SEQ ID NO: 4109802 - RNA, 16 nt, Streptococcus pneumoniae R6
cuaaaacauucuuaca

SEQ ID NO: 4109803 - RNA, 19 nt, Streptococcus pneumoniae R6
cuaaaacauucuuagaaau

SEQ ID NO: 4109804 - RNA, 19 nt, Streptococcus pneumoniae R6
cuaaaacauuuauagaaau

SEQ ID NO: 4109805 - RNA, 18 nt, Streptococcus pneumoniae R6
cuaaaacauuucuauaaa

SEQ ID NO: 4109806 - RNA, 13 nt, Streptococcus pneumoniae R6
cuaaaaccaaagg

SEQ ID NO: 4109807 - RNA, 16 nt, Streptococcus pneumoniae R6
cuaaaaccucaaggca

SEQ ID NO: 4109808 - RNA, 22 nt, Streptococcus pneumoniae R6
cuaaaacgucguaaucuuaaag

SEQ ID NO: 4109809 - RNA, 18 nt, Streptococcus pneumoniae R6
cuaaaauaguggaaagag

SEQ ID NO: 4109810 - RNA, 19 nt, Streptococcus pneumoniae R6
cuaaaaucaggucuuauag

SEQ ID NO: 4109811 - RNA, 13 nt, Streptococcus pneumoniae R6
cuaaaauguaguu

SEQ ID NO: 4109812 - RNA, 19 nt, Streptococcus pneumoniae R6
cuaaaauuauguuuuugaa

SEQ ID NO: 4109813 - RNA, 17 nt, Streptococcus pneumoniae R6
cuaaaauugacuuucuu

SEQ ID NO: 4109814 - RNA, 20 nt, Streptococcus pneumoniae R6
cuaaacaagggauuuuucug

SEQ ID NO: 4109815 - RNA, 20 nt, Streptococcus pneumoniae R6
cuaaacaauguucucauauu

SEQ ID NO: 4109816 - RNA, 12 nt, Streptococcus pneumoniae R6
cuaaaccaauaa

SEQ ID NO: 4109817 - RNA, 16 nt, Streptococcus pneumoniae R6
cuaaaccaauaauaaa

SEQ ID NO: 4109818 - RNA, 19 nt, Streptococcus pneumoniae R6
cuaaaccaauaauaaaacu

SEQ ID NO: 4109819 - RNA, 16 nt, Streptococcus pneumoniae R6
cuaaaccuuauuuuuu

SEQ ID NO: 4109820 - RNA, 18 nt, Streptococcus pneumoniae R6
cuaaacgugauaaaguuu

SEQ ID NO: 4109821 - RNA, 19 nt, Streptococcus pneumoniae R6
cuaaacuauuucuuauuuc

SEQ ID NO: 4109822 - RNA, 16 nt, Streptococcus pneumoniae R6
cuaaacuguacaagaa

SEQ ID NO: 4109823 - RNA, 18 nt, Streptococcus pneumoniae R6
cuaaacuguacaagaaca

SEQ ID NO: 4109824 - RNA, 20 nt, Streptococcus pneumoniae R6
cuaaagaauuugaaaaaaau

SEQ ID NO: 4109825 - RNA, 21 nt, Streptococcus pneumoniae R6
cuaaagacgcuggcuuucacg

SEQ ID NO: 4109826 - RNA, 13 nt, Streptococcus pneumoniae R6
cuaaagauugaga

SEQ ID NO: 4109827 - RNA, 15 nt, Streptococcus pneumoniae R6
cuaaagcaauuuuga

SEQ ID NO: 4109828 - RNA, 19 nt, Streptococcus pneumoniae R6
cuaaagcaauuuugaaaga

SEQ ID NO: 4109829 - RNA, 20 nt, Streptococcus pneumoniae R6
cuaaagcaauuuugaaagau

SEQ ID NO: 4109830 - RNA, 16 nt, Streptococcus pneumoniae R6
cuaaaggcuuaauauu

SEQ ID NO: 4109831 - RNA, 18 nt, Streptococcus pneumoniae R6
cuaaaggcuuaauauuac

SEQ ID NO: 4109832 - RNA, 20 nt, Streptococcus pneumoniae R6
cuaaagggauccucauauuc

SEQ ID NO: 4109833 - RNA, 22 nt, Streptococcus pneumoniae R6
cuaaagggauccucauauucuu

SEQ ID NO: 4109834 - RNA, 18 nt, Streptococcus pneumoniae R6
cuaaaguuccuaauuguu

SEQ ID NO: 4109835 - RNA, 9 nt, Streptococcus pneumoniae R6
cuaaauaca

SEQ ID NO: 4109836 - RNA, 16 nt, Streptococcus pneumoniae R6
cuaaauacaaaaacaa

SEQ ID NO: 4109837 - RNA, 20 nt, Streptococcus pneumoniae R6
cuaaauacaaaaacaaagag

SEQ ID NO: 4109838 - RNA, 17 nt, Streptococcus pneumoniae R6
cuaaauauaaucgauuu

SEQ ID NO: 4109839 - RNA, 14 nt, Streptococcus pneumoniae R6
cuaaauccuuuuuu

SEQ ID NO: 4109840 - RNA, 15 nt, Streptococcus pneumoniae R6
cuaaauccuuuuuuc

SEQ ID NO: 4109841 - RNA, 21 nt, Streptococcus pneumoniae R6
cuaaauccuuuuuucuuuacu

SEQ ID NO: 4109842 - RNA, 13 nt, Streptococcus pneumoniae R6
cuaaaucuucuaa

SEQ ID NO: 4109843 - RNA, 14 nt, Streptococcus pneumoniae R6
cuaaaucuugcccu

SEQ ID NO: 4109844 - RNA, 18 nt, Streptococcus pneumoniae R6
cuaaauuacgauucauag

SEQ ID NO: 4109845 - RNA, 21 nt, Streptococcus pneumoniae R6
cuaaauuccaaauuagaaaaa

SEQ ID NO: 4109846 - RNA, 19 nt, Streptococcus pneumoniae R6
cuaaauugaauaaagucaa

SEQ ID NO: 4109847 - RNA, 14 nt, Streptococcus pneumoniae R6
cuaacaaugcuuua

SEQ ID NO: 4109848 - RNA, 15 nt, Streptococcus pneumoniae R6
cuaacaauguuuuag

SEQ ID NO: 4109849 - RNA, 22 nt, Streptococcus pneumoniae R6
cuaacaucuuuugauagaugac

SEQ ID NO: 4109850 - RNA, 16 nt, Streptococcus pneumoniae R6
cuaaccaccugagcua

SEQ ID NO: 4109851 - RNA, 12 nt, Streptococcus pneumoniae R6
cuaacucagcuu

SEQ ID NO: 4109852 - RNA, 16 nt, Streptococcus pneumoniae R6
cuaacucauagcagau

SEQ ID NO: 4109853 - RNA, 15 nt, Streptococcus pneumoniae R6
cuaacugaagcuguu

SEQ ID NO: 4109854 - RNA, 20 nt, Streptococcus pneumoniae R6
cuaacugcuucacuagucau

SEQ ID NO: 4109855 - RNA, 13 nt, Streptococcus pneumoniae R6
cuaacuuaaaagc

SEQ ID NO: 4109856 - RNA, 14 nt, Streptococcus pneumoniae R6
cuaacuuaaaagcu

SEQ ID NO: 4109857 - RNA, 14 nt, Streptococcus pneumoniae R6
cuaacuucaauaga

SEQ ID NO: 4109858 - RNA, 15 nt, Streptococcus pneumoniae R6
cuaacuucuccaucu

SEQ ID NO: 4109859 - RNA, 20 nt, Streptococcus pneumoniae R6
cuaacuucuccaucuuagga

SEQ ID NO: 4109860 - RNA, 13 nt, Streptococcus pneumoniae R6
cuaacuucuuauu

SEQ ID NO: 4109861 - RNA, 13 nt, Streptococcus pneumoniae R6
cuaacuuuuccuu

SEQ ID NO: 4109862 - RNA, 18 nt, Streptococcus pneumoniae R6
cuaagaaaguaagaaucu

SEQ ID NO: 4109863 - RNA, 14 nt, Streptococcus pneumoniae R6
cuaagagagaagcc

SEQ ID NO: 4109864 - RNA, 18 nt, Streptococcus pneumoniae R6
cuaagaguauaaaaccuu

SEQ ID NO: 4109865 - RNA, 18 nt, Streptococcus pneumoniae R6
cuaagauauuauuucaaa

SEQ ID NO: 4109866 - RNA, 19 nt, Streptococcus pneumoniae R6
cuaagauuuguuuuucaaa

SEQ ID NO: 4109867 - RNA, 23 nt, Streptococcus pneumoniae R6
cuaagcauuuaauccaaaguaaa

SEQ ID NO: 4109868 - RNA, 14 nt, Streptococcus pneumoniae R6
cuaagccuuuuucu

SEQ ID NO: 4109869 - RNA, 23 nt, Streptococcus pneumoniae R6
cuaagcucgagaaaggacaaauu

SEQ ID NO: 4109870 - RNA, 17 nt, Streptococcus pneumoniae R6
cuaagcucuuaaaagca

SEQ ID NO: 4109871 - RNA, 18 nt, Streptococcus pneumoniae R6
cuaaggaaagucaaacaa

SEQ ID NO: 4109872 - RNA, 16 nt, Streptococcus pneumoniae R6
cuaaggcuguuucaaa

SEQ ID NO: 4109873 - RNA, 16 nt, Streptococcus pneumoniae R6
cuaagguauauucaaa

SEQ ID NO: 4109874 - RNA, 20 nt, Streptococcus pneumoniae R6
cuaagguauauucaaaauac

SEQ ID NO: 4109875 - RNA, 24 nt, Streptococcus pneumoniae R6
cuaaggucaaacuuuuucucucug

SEQ ID NO: 4109876 - RNA, 14 nt, Streptococcus pneumoniae R6
cuaagguuucaaaa

SEQ ID NO: 4109877 - RNA, 19 nt, Streptococcus pneumoniae R6
cuaagugucuggaaugaua

SEQ ID NO: 4109878 - RNA, 21 nt, Streptococcus pneumoniae R6
cuaagugucuggaaugauaac

SEQ ID NO: 4109879 - RNA, 23 nt, Streptococcus pneumoniae R6
cuaaguuccuguuguaauuuuaa

SEQ ID NO: 4109880 - RNA, 22 nt, Streptococcus pneumoniae R6
cuaaguugggugaaguugaaag

SEQ ID NO: 4109881 - RNA, 18 nt, Streptococcus pneumoniae R6
cuaaguuuaaacucaggu

SEQ ID NO: 4109882 - RNA, 12 nt, Streptococcus pneumoniae R6
cuaauaauucca

SEQ ID NO: 4109883 - RNA, 15 nt, Streptococcus pneumoniae R6
cuaauaauuuuucau

SEQ ID NO: 4109884 - RNA, 13 nt, Streptococcus pneumoniae R6
cuaauacauuuug

SEQ ID NO: 4109885 - RNA, 18 nt, Streptococcus pneumoniae R6
cuaauacauuuuguaaaa

SEQ ID NO: 4109886 - RNA, 20 nt, Streptococcus pneumoniae R6
cuaauacauuuuguaaaaaa

SEQ ID NO: 4109887 - RNA, 22 nt, Streptococcus pneumoniae R6
cuaauacccauuuauggaaaaa

SEQ ID NO: 4109888 - RNA, 16 nt, Streptococcus pneumoniae R6
cuaauagguacaaaaa

SEQ ID NO: 4109889 - RNA, 13 nt, Streptococcus pneumoniae R6
cuaaucauaguga

SEQ ID NO: 4109890 - RNA, 18 nt, Streptococcus pneumoniae R6
cuaauccacucagacagc

SEQ ID NO: 4109891 - RNA, 17 nt, Streptococcus pneumoniae R6
cuaaucuuucugcaucc

SEQ ID NO: 4109892 - RNA, 21 nt, Streptococcus pneumoniae R6
cuagccuccuaguuugcucuu

SEQ ID NO: 4109893 - RNA, 23 nt, Streptococcus pneumoniae R6
cuagcgcaaagcuaaauccuuuu

SEQ ID NO: 4109894 - RNA, 18 nt, Streptococcus pneumoniae R6
cuagcucccuuaguucaa

SEQ ID NO: 4109895 - RNA, 16 nt, Streptococcus pneumoniae R6
cuagcuggugagaaga

SEQ ID NO: 4109896 - RNA, 12 nt, Streptococcus pneumoniae R6
cuagcuuuuucc

SEQ ID NO: 4109897 - RNA, 18 nt, Streptococcus pneumoniae R6
cuaggaaacuagccgcag

SEQ ID NO: 4109898 - RNA, 14 nt, Streptococcus pneumoniae R6
cuaggaauaucaaa

SEQ ID NO: 4109899 - RNA, 19 nt, Streptococcus pneumoniae R6
cuaggagagcuagggauuu

SEQ ID NO: 4109900 - RNA, 18 nt, Streptococcus pneumoniae R6
cuagggacaccuuggcaa

SEQ ID NO: 4109901 - RNA, 19 nt, Streptococcus pneumoniae R6
cuagggugacaguaaaaaa

SEQ ID NO: 4109902 - RNA, 13 nt, Streptococcus pneumoniae R6
cuaggucuagacu

SEQ ID NO: 4109903 - RNA, 22 nt, Streptococcus pneumoniae R6
cuaggugagauuggauuuucug

SEQ ID NO: 4109904 - RNA, 21 nt, Streptococcus pneumoniae R6
cuagguuaaagguuuuaucug

SEQ ID NO: 4109905 - RNA, 20 nt, Streptococcus pneumoniae R6
cuagguuagucaaaaagaag

SEQ ID NO: 4109906 - RNA, 20 nt, Streptococcus pneumoniae R6
cuaguaaauaucauuuccaa

SEQ ID NO: 4109907 - RNA, 21 nt, Streptococcus pneumoniae R6
cuaguaaauaucauuuccaac

SEQ ID NO: 4109908 - RNA, 15 nt, Streptococcus pneumoniae R6
cuaguaaaucgauuu

SEQ ID NO: 4109909 - RNA, 15 nt, Streptococcus pneumoniae R6
cuaguaagaugaguu

SEQ ID NO: 4109910 - RNA, 20 nt, Streptococcus pneumoniae R6
cuaguaaucgguaggaugac

SEQ ID NO: 4109911 - RNA, 23 nt, Streptococcus pneumoniae R6
cuaguaaucgguaggaugacaac

SEQ ID NO: 4109912 - RNA, 13 nt, Streptococcus pneumoniae R6
cuaguacaaagaa

SEQ ID NO: 4109913 - RNA, 16 nt, Streptococcus pneumoniae R6
cuaguacaaagaauaa

SEQ ID NO: 4109914 - RNA, 14 nt, Streptococcus pneumoniae R6
cuaguacauugaaa

SEQ ID NO: 4109915 - RNA, 20 nt, Streptococcus pneumoniae R6
cuaguauucaucuuaucaac

SEQ ID NO: 4109916 - RNA, 17 nt, Streptococcus pneumoniae R6
cuagucgaagcuuccaa

SEQ ID NO: 4109917 - RNA, 17 nt, Streptococcus pneumoniae R6
cuagucuaacuucucca

SEQ ID NO: 4109918 - RNA, 14 nt, Streptococcus pneumoniae R6
cuagucuacaaauu

SEQ ID NO: 4109919 - RNA, 16 nt, Streptococcus pneumoniae R6
cuagucuacuuguuca

SEQ ID NO: 4109920 - RNA, 15 nt, Streptococcus pneumoniae R6
cuagucuggagauuu

SEQ ID NO: 4109921 - RNA, 15 nt, Streptococcus pneumoniae R6
cuagugaaaaauuga

SEQ ID NO: 4109922 - RNA, 21 nt, Streptococcus pneumoniae R6
cuagugaauggauuuaucagu

SEQ ID NO: 4109923 - RNA, 15 nt, Streptococcus pneumoniae R6
cuagugaauuugguu

SEQ ID NO: 4109924 - RNA, 19 nt, Streptococcus pneumoniae R6
cuaguguauggcgcaguuu

SEQ ID NO: 4109925 - RNA, 24 nt, Streptococcus pneumoniae R6
cuagugucauaguccugaaaauca

SEQ ID NO: 4109926 - RNA, 18 nt, Streptococcus pneumoniae R6
cuaguucccuaucuuggu

SEQ ID NO: 4109927 - RNA, 15 nt, Streptococcus pneumoniae R6
cuaguucucaaauuu

SEQ ID NO: 4109928 - RNA, 16 nt, Streptococcus pneumoniae R6
cuaguugcuaguguau

SEQ ID NO: 4109929 - RNA, 16 nt, Streptococcus pneumoniae R6
cuaguuggugacugac

SEQ ID NO: 4109930 - RNA, 14 nt, Streptococcus pneumoniae R6
cuaguuguuuuucg

SEQ ID NO: 4109931 - RNA, 17 nt, Streptococcus pneumoniae R6
cuaguuucaaucuacua

SEQ ID NO: 4109932 - RNA, 13 nt, Streptococcus pneumoniae R6
cuaguuucaauuu

SEQ ID NO: 4109933 - RNA, 13 nt, Streptococcus pneumoniae R6
cuaguuugcucuu

SEQ ID NO: 4109934 - RNA, 18 nt, Streptococcus pneumoniae R6
cuaguuuugguuuuucuu

SEQ ID NO: 4109935 - RNA, 20 nt, Streptococcus pneumoniae R6
cuaguuuugguuuuucuuca

SEQ ID NO: 4109936 - RNA, 11 nt, Streptococcus pneumoniae R6
cuaguuuuuug

SEQ ID NO: 4109937 - RNA, 13 nt, Streptococcus pneumoniae R6
cuauaaaauauag

SEQ ID NO: 4109938 - RNA, 14 nt, Streptococcus pneumoniae R6
cuauaaacaaagga

SEQ ID NO: 4109939 - RNA, 15 nt, Streptococcus pneumoniae R6
cuauaaacaaaggag

SEQ ID NO: 4109940 - RNA, 23 nt, Streptococcus pneumoniae R6
cuauaaacaaaggaguuaaccuc

SEQ ID NO: 4109941 - RNA, 15 nt, Streptococcus pneumoniae R6
cuauaaauucauuug

SEQ ID NO: 4109942 - RNA, 15 nt, Streptococcus pneumoniae R6
cuauaagacuccucu

SEQ ID NO: 4109943 - RNA, 19 nt, Streptococcus pneumoniae R6
cuauaagaugaccuuaucu

SEQ ID NO: 4109944 - RNA, 18 nt, Streptococcus pneumoniae R6
cuauaagcccaaaucauc

SEQ ID NO: 4109945 - RNA, 19 nt, Streptococcus pneumoniae R6
cuauaagugaauaugauuu

SEQ ID NO: 4109946 - RNA, 15 nt, Streptococcus pneumoniae R6
cuauaauauaauaaa

SEQ ID NO: 4109947 - RNA, 17 nt, Streptococcus pneumoniae R6
cuauaauauaauaaacu

SEQ ID NO: 4109948 - RNA, 14 nt, Streptococcus pneumoniae R6
cuauaaucaauaua

SEQ ID NO: 4109949 - RNA, 17 nt, Streptococcus pneumoniae R6
cuauaauggcuuauucc

SEQ ID NO: 4109950 - RNA, 21 nt, Streptococcus pneumoniae R6
cuauaauggcuuguuccaauu

SEQ ID NO: 4109951 - RNA, 22 nt, Streptococcus pneumoniae R6
cuauacauuuagaaagguaaaa

SEQ ID NO: 4109952 - RNA, 18 nt, Streptococcus pneumoniae R6
cuauaccaagcucagcau

SEQ ID NO: 4109953 - RNA, 17 nt, Streptococcus pneumoniae R6
cuauacuagcuuauuau

SEQ ID NO: 4109954 - RNA, 13 nt, Streptococcus pneumoniae R6
cuauacuuacucu

SEQ ID NO: 4109955 - RNA, 12 nt, Streptococcus pneumoniae R6
cuauacuuuuuc

SEQ ID NO: 4109956 - RNA, 20 nt, Streptococcus pneumoniae R6
cuauacuuuuucuuccuuuc

SEQ ID NO: 4109957 - RNA, 19 nt, Streptococcus pneumoniae R6
cuauacuuuuuuaauuuaa

SEQ ID NO: 4109958 - RNA, 20 nt, Streptococcus pneumoniae R6
cuauagauaaggucaucuua

SEQ ID NO: 4109959 - RNA, 19 nt, Streptococcus pneumoniae R6
cuauagcguuuugaaacua

SEQ ID NO: 4109960 - RNA, 18 nt, Streptococcus pneumoniae R6
cuauaguagauugaaacu

SEQ ID NO: 4109961 - RNA, 21 nt, Streptococcus pneumoniae R6
cuauaguauauugaaacuaga

SEQ ID NO: 4109962 - RNA, 16 nt, Streptococcus pneumoniae R6
cuauagucaauugaaa

SEQ ID NO: 4109963 - RNA, 17 nt, Streptococcus pneumoniae R6
cuauaguuugcaaauua

SEQ ID NO: 4109964 - RNA, 13 nt, Streptococcus pneumoniae R6
cuauauaguuuaa

SEQ ID NO: 4109965 - RNA, 22 nt, Streptococcus pneumoniae R6
cuauauaguuuaaucaaaauaa

SEQ ID NO: 4109966 - RNA, 14 nt, Streptococcus pneumoniae R6
cuauauaucaugcu

SEQ ID NO: 4109967 - RNA, 15 nt, Streptococcus pneumoniae R6
cuauauauuaucgga

SEQ ID NO: 4109968 - RNA, 22 nt, Streptococcus pneumoniae R6
cuauaucuaaugacuaauucua

SEQ ID NO: 4109969 - RNA, 23 nt, Streptococcus pneumoniae R6
cuauauuagaggcgagacauuuu

SEQ ID NO: 4109970 - RNA, 22 nt, Streptococcus pneumoniae R6
cuauauuaucagcguaauaguc

SEQ ID NO: 4109971 - RNA, 22 nt, Streptococcus pneumoniae R6
cuauauuucaagaauuaaguga

SEQ ID NO: 4109972 - RNA, 19 nt, Streptococcus pneumoniae R6
cuauauuucuauacuuuuu

SEQ ID NO: 4109973 - RNA, 21 nt, Streptococcus pneumoniae R6
cuauauuucuauacuuuuucu

SEQ ID NO: 4109974 - RNA, 20 nt, Streptococcus pneumoniae R6
cuaucaaacaggauguguaa

SEQ ID NO: 4109975 - RNA, 17 nt, Streptococcus pneumoniae R6
cuaucaauuauaauaaa

SEQ ID NO: 4109976 - RNA, 18 nt, Streptococcus pneumoniae R6
cuaucaauuauaauaaaa

SEQ ID NO: 4109977 - RNA, 21 nt, Streptococcus pneumoniae R6
cuaucacggcggaaaggcuag

SEQ ID NO: 4109978 - RNA, 16 nt, Streptococcus pneumoniae R6
cuaucauauccagcuu

SEQ ID NO: 4109979 - RNA, 16 nt, Streptococcus pneumoniae R6
cuaucaugcgaaucaa

SEQ ID NO: 4109980 - RNA, 19 nt, Streptococcus pneumoniae R6
cuaucaugcgaaucaauuu

SEQ ID NO: 4109981 - RNA, 18 nt, Streptococcus pneumoniae R6
cuaucguagcuuuucuua

SEQ ID NO: 4109982 - RNA, 17 nt, Streptococcus pneumoniae R6
cuaucuaaaauagaagg

SEQ ID NO: 4109983 - RNA, 19 nt, Streptococcus pneumoniae R6
cuaucuaaaauagaaggag

SEQ ID NO: 4109984 - RNA, 20 nt, Streptococcus pneumoniae R6
cuaucuaaaauagaaggagu

SEQ ID NO: 4109985 - RNA, 17 nt, Streptococcus pneumoniae R6
cuaucuaggcugacaau

SEQ ID NO: 4109986 - RNA, 22 nt, Streptococcus pneumoniae R6
cuaucugcaaccucaaaacagu

SEQ ID NO: 4109987 - RNA, 19 nt, Streptococcus pneumoniae R6
cuaucugcuaacugcugga

SEQ ID NO: 4109988 - RNA, 13 nt, Streptococcus pneumoniae R6
cuaucugucacaa

SEQ ID NO: 4109989 - RNA, 19 nt, Streptococcus pneumoniae R6
cuaucuuauugauuuuucu

SEQ ID NO: 4109990 - RNA, 18 nt, Streptococcus pneumoniae R6
cuaucuucuugauacuga

SEQ ID NO: 4109991 - RNA, 18 nt, Streptococcus pneumoniae R6
cuaugaacugguuuuccu

SEQ ID NO: 4109992 - RNA, 11 nt, Streptococcus pneumoniae R6
cuaugauaaaa

SEQ ID NO: 4109993 - RNA, 23 nt, Streptococcus pneumoniae R6
cuaugaugugcuauucuaaauuc

SEQ ID NO: 4109994 - RNA, 19 nt, Streptococcus pneumoniae R6
cucaucgacuuguuuuuug

SEQ ID NO: 4109995 - RNA, 20 nt, Streptococcus pneumoniae R6
cucaucuacgucugcacgga

SEQ ID NO: 4109996 - RNA, 14 nt, Streptococcus pneumoniae R6
cucaucuauuuuua

SEQ ID NO: 4109997 - RNA, 16 nt, Streptococcus pneumoniae R6
cucaucuauuuuuacu

SEQ ID NO: 4109998 - RNA, 13 nt, Streptococcus pneumoniae R6
cucaucugcaaua

SEQ ID NO: 4109999 - RNA, 17 nt, Streptococcus pneumoniae R6
cucaucugcaauaacaa

SEQ ID NO: 4110000 - RNA, 18 nt, Streptococcus pneumoniae R6
cucaucuucacucuucaa

SEQ ID NO: 4110001 - RNA, 18 nt, Streptococcus pneumoniae R6
cucaucuuugauuucuug

SEQ ID NO: 4110002 - RNA, 15 nt, Streptococcus pneumoniae R6
cucauguaaaucauu

SEQ ID NO: 4110003 - RNA, 20 nt, Streptococcus pneumoniae R6
cucauguaaaucauuuucuu

SEQ ID NO: 4110004 - RNA, 21 nt, Streptococcus pneumoniae R6
cucauguaaaucauuuucuug

SEQ ID NO: 4110005 - RNA, 18 nt, Streptococcus pneumoniae R6
cucauugauuuggacuau

SEQ ID NO: 4110006 - RNA, 19 nt, Streptococcus pneumoniae R6
cucauuugcgcgcuugaau

SEQ ID NO: 4110007 - RNA, 20 nt, Streptococcus pneumoniae R6
cuccaaacgcgauacaauaa

SEQ ID NO: 4110008 - RNA, 16 nt, Streptococcus pneumoniae R6
cuccaaagccuucuug

SEQ ID NO: 4110009 - RNA, 20 nt, Streptococcus pneumoniae R6
cuccaaaggagaagauuuca

SEQ ID NO: 4110010 - RNA, 16 nt, Streptococcus pneumoniae R6
cuccaaaguagcuugc

SEQ ID NO: 4110011 - RNA, 15 nt, Streptococcus pneumoniae R6
cuccaaccaucaaaa

SEQ ID NO: 4110012 - RNA, 16 nt, Streptococcus pneumoniae R6
cuccaagaaagagaau

SEQ ID NO: 4110013 - RNA, 16 nt, Streptococcus pneumoniae R6
cuccaccauaguguuu

SEQ ID NO: 4110014 - RNA, 17 nt, Streptococcus pneumoniae R6
cuccacgcuccacuucc

SEQ ID NO: 4110015 - RNA, 18 nt, Streptococcus pneumoniae R6
cuccacgcuccacuuccc

SEQ ID NO: 4110016 - RNA, 14 nt, Streptococcus pneumoniae R6
cuccacuauaaaac

SEQ ID NO: 4110017 - RNA, 17 nt, Streptococcus pneumoniae R6
cuccacuauaaaacauu

SEQ ID NO: 4110018 - RNA, 15 nt, Streptococcus pneumoniae R6
cuccagaaauaauau

SEQ ID NO: 4110019 - RNA, 15 nt, Streptococcus pneumoniae R6
cuccagauuggaggc

SEQ ID NO: 4110020 - RNA, 20 nt, Streptococcus pneumoniae R6
cuccaguaacuuuaccaaaa

SEQ ID NO: 4110021 - RNA, 15 nt, Streptococcus pneumoniae R6
cuccaguuuuaaucu

SEQ ID NO: 4110022 - RNA, 14 nt, Streptococcus pneumoniae R6
cuccaguuuuguuu

SEQ ID NO: 4110023 - RNA, 13 nt, Streptococcus pneumoniae R6
cuccauaaaaaga

SEQ ID NO: 4110024 - RNA, 22 nt, Streptococcus pneumoniae R6
cuccauaaaaucacaucugcua

SEQ ID NO: 4110025 - RNA, 21 nt, Streptococcus pneumoniae R6
cuccauaaacgcaagcaacaa

SEQ ID NO: 4110026 - RNA, 20 nt, Streptococcus pneumoniae R6
cuccauaggccaagucuuuu

SEQ ID NO: 4110027 - RNA, 20 nt, Streptococcus pneumoniae R6
cuccaugcuaccagucggaa

SEQ ID NO: 4110028 - RNA, 12 nt, Streptococcus pneumoniae R6
cuccauuacuug

SEQ ID NO: 4110029 - RNA, 18 nt, Streptococcus pneumoniae R6
cuccauuaugaagaacac

SEQ ID NO: 4110030 - RNA, 17 nt, Streptococcus pneumoniae R6
cucccaagcucugaaug

SEQ ID NO: 4110031 - RNA, 19 nt, Streptococcus pneumoniae R6
cucccacuaucuaaaaaaa

SEQ ID NO: 4110032 - RNA, 20 nt, Streptococcus pneumoniae R6
cucccacuuucaagucuuug

SEQ ID NO: 4110033 - RNA, 15 nt, Streptococcus pneumoniae R6
cucccauauuuggca

SEQ ID NO: 4110034 - RNA, 23 nt, Streptococcus pneumoniae R6
cucccauucuucuuuuccaaaca

SEQ ID NO: 4110035 - RNA, 17 nt, Streptococcus pneumoniae R6
cuccccaugaguuuuca

SEQ ID NO: 4110036 - RNA, 14 nt, Streptococcus pneumoniae R6
cuccccuuuagaac

SEQ ID NO: 4110037 - RNA, 16 nt, Streptococcus pneumoniae R6
cucccuguuccaaaga

SEQ ID NO: 4110038 - RNA, 17 nt, Streptococcus pneumoniae R6
cucccuuaguucaaugg

SEQ ID NO: 4110039 - RNA, 12 nt, Streptococcus pneumoniae R6
cucccuucuuua

SEQ ID NO: 4110040 - RNA, 23 nt, Streptococcus pneumoniae R6
cuccgagaaguaccgccaaaccu

SEQ ID NO: 4110041 - RNA, 17 nt, Streptococcus pneumoniae R6
cuccgauaauuauuuuu

SEQ ID NO: 4110042 - RNA, 24 nt, Streptococcus pneumoniae R6
cuccgccgaggauuucacgcaccu

SEQ ID NO: 4110043 - RNA, 15 nt, Streptococcus pneumoniae R6
cuccgccuccagaga

SEQ ID NO: 4110044 - RNA, 12 nt, Streptococcus pneumoniae R6
cuccgcuuccag

SEQ ID NO: 4110045 - RNA, 18 nt, Streptococcus pneumoniae R6
cuccgcuuuuaucaaaga

SEQ ID NO: 4110046 - RNA, 23 nt, Streptococcus pneumoniae R6
cuccguagauagcugcagcugag

SEQ ID NO: 4110047 - RNA, 21 nt, Streptococcus pneumoniae R6
cuccguuuuggacgucuucac

SEQ ID NO: 4110048 - RNA, 23 nt, Streptococcus pneumoniae R6
cuccuacaaagcccauacgcccu

SEQ ID NO: 4110049 - RNA, 18 nt, Streptococcus pneumoniae R6
cuccuaguuugcucuuug

SEQ ID NO: 4110050 - RNA, 15 nt, Streptococcus pneumoniae R6
cuccuccaaguccaa

SEQ ID NO: 4110051 - RNA, 14 nt, Streptococcus pneumoniae R6
cuccucuguaucaa

SEQ ID NO: 4110052 - RNA, 13 nt, Streptococcus pneumoniae R6
cuccugugcucca

SEQ ID NO: 4110053 - RNA, 20 nt, Streptococcus pneumoniae R6
cuccuuaaauuuuauacaaa

SEQ ID NO: 4110054 - RNA, 13 nt, Streptococcus pneumoniae R6
cuccuuaauagug

SEQ ID NO: 4110055 - RNA, 14 nt, Streptococcus pneumoniae R6
cuccuucauuaagu

SEQ ID NO: 4110056 - RNA, 16 nt, Streptococcus pneumoniae R6
cuccuucuccaauccu

SEQ ID NO: 4110057 - RNA, 11 nt, Streptococcus pneumoniae R6
cuccuucuuuu

SEQ ID NO: 4110058 - RNA, 17 nt, Streptococcus pneumoniae R6
cuccuuuaacauuugag

SEQ ID NO: 4110059 - RNA, 11 nt, Streptococcus pneumoniae R6
cuccuuuagug

SEQ ID NO: 4110060 - RNA, 14 nt, Streptococcus pneumoniae R6
cucgacacuagaug

SEQ ID NO: 4110061 - RNA, 17 nt, Streptococcus pneumoniae R6
cucgacacuagaugcau

SEQ ID NO: 4110062 - RNA, 22 nt, Streptococcus pneumoniae R6
cucgagaaaggggcucuuuguc

SEQ ID NO: 4110063 - RNA, 20 nt, Streptococcus pneumoniae R6
cucgagaaagguaacuccuu

SEQ ID NO: 4110064 - RNA, 20 nt, Streptococcus pneumoniae R6
cucgagcaguuccaucaauc

SEQ ID NO: 4110065 - RNA, 23 nt, Streptococcus pneumoniae R6
cucgagcuuagcuuuucuucaac

SEQ ID NO: 4110066 - RNA, 19 nt, Streptococcus pneumoniae R6
cucgagguuaacuccuuug

SEQ ID NO: 4110067 - RNA, 14 nt, Streptococcus pneumoniae R6
cucgauugaggucg

SEQ ID NO: 4110068 - RNA, 13 nt, Streptococcus pneumoniae R6
cucgcaagagacu

SEQ ID NO: 4110069 - RNA, 12 nt, Streptococcus pneumoniae R6
cucgcuggagau

SEQ ID NO: 4110070 - RNA, 18 nt, Streptococcus pneumoniae R6
cucgcuggagauagguca

SEQ ID NO: 4110071 - RNA, 15 nt, Streptococcus pneumoniae R6
cucguuaauugcauu

SEQ ID NO: 4110072 - RNA, 17 nt, Streptococcus pneumoniae R6
cucguuuguuuuuuccu

SEQ ID NO: 4110073 - RNA, 16 nt, Streptococcus pneumoniae R6
cucuaaaaauaaaaaa

SEQ ID NO: 4110074 - RNA, 13 nt, Streptococcus pneumoniae R6
cucuaaaaucauc

SEQ ID NO: 4110075 - RNA, 18 nt, Streptococcus pneumoniae R6
cucuaaacaaacuccucu

SEQ ID NO: 4110076 - RNA, 19 nt, Streptococcus pneumoniae R6
cucuaaagagacaggucaa

SEQ ID NO: 4110077 - RNA, 12 nt, Streptococcus pneumoniae R6
cucuaaauaaau

SEQ ID NO: 4110078 - RNA, 21 nt, Streptococcus pneumoniae R6
cucuaaccauuauagcauucu

SEQ ID NO: 4110079 - RNA, 13 nt, Streptococcus pneumoniae R6
cucuaacuguauu

SEQ ID NO: 4110080 - RNA, 14 nt, Streptococcus pneumoniae R6
cucuacauucccaa

SEQ ID NO: 4110081 - RNA, 14 nt, Streptococcus pneumoniae R6
cucuaccaagcccu

SEQ ID NO: 4110082 - RNA, 16 nt, Streptococcus pneumoniae R6
cucuaccugccuucca

SEQ ID NO: 4110083 - RNA, 16 nt, Streptococcus pneumoniae R6
cucuacgaacaggaac

SEQ ID NO: 4110084 - RNA, 13 nt, Streptococcus pneumoniae R6
cucuacuaacuca

SEQ ID NO: 4110085 - RNA, 17 nt, Streptococcus pneumoniae R6
cucuagaaaucucuuuu

SEQ ID NO: 4110086 - RNA, 16 nt, Streptococcus pneumoniae R6
cucuagccggauuuau

SEQ ID NO: 4110087 - RNA, 14 nt, Streptococcus pneumoniae R6
cucuaguaaagugu

SEQ ID NO: 4110088 - RNA, 16 nt, Streptococcus pneumoniae R6
cucuauacacauccag

SEQ ID NO: 4110089 - RNA, 18 nt, Streptococcus pneumoniae R6
cucuauacacauccagug

SEQ ID NO: 4110090 - RNA, 15 nt, Streptococcus pneumoniae R6
cucuauacuuacuaa

SEQ ID NO: 4110091 - RNA, 23 nt, Streptococcus pneumoniae R6
cucuaucaggaaagucaaauuaa

SEQ ID NO: 4110092 - RNA, 16 nt, Streptococcus pneumoniae R6
cucuaucuuuuaacua

SEQ ID NO: 4110093 - RNA, 15 nt, Streptococcus pneumoniae R6
cucucaauuccuuau

SEQ ID NO: 4110094 - RNA, 17 nt, Streptococcus pneumoniae R6
cucucagcacuuggcau

SEQ ID NO: 4110095 - RNA, 13 nt, Streptococcus pneumoniae R6
cucuccuuaucaa

SEQ ID NO: 4110096 - RNA, 15 nt, Streptococcus pneumoniae R6
cucucggucuuguuu

SEQ ID NO: 4110097 - RNA, 14 nt, Streptococcus pneumoniae R6
cugauaagauuuuu

SEQ ID NO: 4110098 - RNA, 23 nt, Streptococcus pneumoniae R6
cugauaagucaggcauaccgccu

SEQ ID NO: 4110099 - RNA, 22 nt, Streptococcus pneumoniae R6
cugauagaagagucagcucuuu

SEQ ID NO: 4110100 - RNA, 13 nt, Streptococcus pneumoniae R6
cugauagagauua

SEQ ID NO: 4110101 - RNA, 19 nt, Streptococcus pneumoniae R6
cugauagaguuagagccgc

SEQ ID NO: 4110102 - RNA, 21 nt, Streptococcus pneumoniae R6
cugauagugauguuucaaguc

SEQ ID NO: 4110103 - RNA, 15 nt, Streptococcus pneumoniae R6
cugauagugguguuu

SEQ ID NO: 4110104 - RNA, 21 nt, Streptococcus pneumoniae R6
cugauagugguguuucaaguc

SEQ ID NO: 4110105 - RNA, 23 nt, Streptococcus pneumoniae R6
cugauauauuuucgauuuaauga

SEQ ID NO: 4110106 - RNA, 21 nt, Streptococcus pneumoniae R6
cugaucaaaaaauuucauuuc

SEQ ID NO: 4110107 - RNA, 22 nt, Streptococcus pneumoniae R6
cugaucaaaaaauuucauuucg

SEQ ID NO: 4110108 - RNA, 17 nt, Streptococcus pneumoniae R6
cugauccagccuuguau

SEQ ID NO: 4110109 - RNA, 17 nt, Streptococcus pneumoniae R6
cugaucccuccauuuca

SEQ ID NO: 4110110 - RNA, 14 nt, Streptococcus pneumoniae R6
cugaugaaacuaau

SEQ ID NO: 4110111 - RNA, 22 nt, Streptococcus pneumoniae R6
cugaugaaccuucaucaaauga

SEQ ID NO: 4110112 - RNA, 20 nt, Streptococcus pneumoniae R6
cugaugaacggagauaguac

SEQ ID NO: 4110113 - RNA, 21 nt, Streptococcus pneumoniae R6
cugaugaagggcuuuucuauc

SEQ ID NO: 4110114 - RNA, 16 nt, Streptococcus pneumoniae R6
cugaugaagucaaguc

SEQ ID NO: 4110115 - RNA, 16 nt, Streptococcus pneumoniae R6
cugaugagagaucuag

SEQ ID NO: 4110116 - RNA, 17 nt, Streptococcus pneumoniae R6
cugaugcaacaaguugu

SEQ ID NO: 4110117 - RNA, 14 nt, Streptococcus pneumoniae R6
cugauguaacuguu

SEQ ID NO: 4110118 - RNA, 15 nt, Streptococcus pneumoniae R6
cugauuaaaaucaua

SEQ ID NO: 4110119 - RNA, 16 nt, Streptococcus pneumoniae R6
cugauuauguuuuaaa

SEQ ID NO: 4110120 - RNA, 19 nt, Streptococcus pneumoniae R6
cugauuauguuuuaaauaa

SEQ ID NO: 4110121 - RNA, 20 nt, Streptococcus pneumoniae R6
cugauuauguuuuaaauaaa

SEQ ID NO: 4110122 - RNA, 20 nt, Streptococcus pneumoniae R6
cugauuccuggaaucagaac

SEQ ID NO: 4110123 - RNA, 17 nt, Streptococcus pneumoniae R6
cugauuccuuuuuucua

SEQ ID NO: 4110124 - RNA, 12 nt, Streptococcus pneumoniae R6
cugauuucaaag

SEQ ID NO: 4110125 - RNA, 21 nt, Streptococcus pneumoniae R6
cugauuucaaagaauuuugac

SEQ ID NO: 4110126 - RNA, 16 nt, Streptococcus pneumoniae R6
cugauuucaaggcauu

SEQ ID NO: 4110127 - RNA, 21 nt, Streptococcus pneumoniae R6
cugauuucaaggcauuuuuug

SEQ ID NO: 4110128 - RNA, 14 nt, Streptococcus pneumoniae R6
cugauuucaauuuu

SEQ ID NO: 4110129 - RNA, 21 nt, Streptococcus pneumoniae R6
cugauuuuaugcguuuuucug

SEQ ID NO: 4110130 - RNA, 23 nt, Streptococcus pneumoniae R6
cugauuuuaugcguuuuucugau

SEQ ID NO: 4110131 - RNA, 13 nt, Streptococcus pneumoniae R6
cugauuuugaaaa

SEQ ID NO: 4110132 - RNA, 18 nt, Streptococcus pneumoniae R6
cugauuuugaaaaugaau

SEQ ID NO: 4110133 - RNA, 20 nt, Streptococcus pneumoniae R6
cugauuuugaaaauuuuucc

SEQ ID NO: 4110134 - RNA, 15 nt, Streptococcus pneumoniae R6
cugauuuuuucuauu

SEQ ID NO: 4110135 - RNA, 17 nt, Streptococcus pneumoniae R6
cugcaaaauuuugagca

SEQ ID NO: 4110136 - RNA, 11 nt, Streptococcus pneumoniae R6
cugcaaaccac

SEQ ID NO: 4110137 - RNA, 12 nt, Streptococcus pneumoniae R6
cugcaaagauag

SEQ ID NO: 4110138 - RNA, 14 nt, Streptococcus pneumoniae R6
cugcaaaucuacug

SEQ ID NO: 4110139 - RNA, 18 nt, Streptococcus pneumoniae R6
cugcaaccucaaaacagu

SEQ ID NO: 4110140 - RNA, 19 nt, Streptococcus pneumoniae R6
cugcaaccucaaaacagug

SEQ ID NO: 4110141 - RNA, 18 nt, Streptococcus pneumoniae R6
cugcaaccucuacaauaa

SEQ ID NO: 4110142 - RNA, 19 nt, Streptococcus pneumoniae R6
cugcaaccucuacaauaac

SEQ ID NO: 4110143 - RNA, 18 nt, Streptococcus pneumoniae R6
cugcaaccuuaaaacagu

SEQ ID NO: 4110144 - RNA, 20 nt, Streptococcus pneumoniae R6
cugcaaccuuaaaacagugu

SEQ ID NO: 4110145 - RNA, 16 nt, Streptococcus pneumoniae R6
cugcaaggcaagacug

SEQ ID NO: 4110146 - RNA, 17 nt, Streptococcus pneumoniae R6
cugcaaggcaagacuga

SEQ ID NO: 4110147 - RNA, 12 nt, Streptococcus pneumoniae R6
cugcaauaaucu

SEQ ID NO: 4110148 - RNA, 21 nt, Streptococcus pneumoniae R6
cugcaaucauugcaaaggaga

SEQ ID NO: 4110149 - RNA, 18 nt, Streptococcus pneumoniae R6
cugcaauuaguaugagca

SEQ ID NO: 4110150 - RNA, 21 nt, Streptococcus pneumoniae R6
cugcaauuaguaugagcacua

SEQ ID NO: 4110151 - RNA, 20 nt, Streptococcus pneumoniae R6
cugcacauugguucuuuuua

SEQ ID NO: 4110152 - RNA, 22 nt, Streptococcus pneumoniae R6
cugcacauugguucuuuuuacu

SEQ ID NO: 4110153 - RNA, 14 nt, Streptococcus pneumoniae R6
cugcaccagauucg

SEQ ID NO: 4110154 - RNA, 17 nt, Streptococcus pneumoniae R6
cugcacggacuucugcu

SEQ ID NO: 4110155 - RNA, 12 nt, Streptococcus pneumoniae R6
cugcacucucau

SEQ ID NO: 4110156 - RNA, 16 nt, Streptococcus pneumoniae R6
cugcagcuaguuuccu

SEQ ID NO: 4110157 - RNA, 22 nt, Streptococcus pneumoniae R6
cugcagcugcggcuuuuucuuu

SEQ ID NO: 4110158 - RNA, 23 nt, Streptococcus pneumoniae R6
cugcagcugcggcuuuuucuuuc

SEQ ID NO: 4110159 - RNA, 23 nt, Streptococcus pneumoniae R6
cugcaggcugcucaaaacacugu

SEQ ID NO: 4110160 - RNA, 16 nt, Streptococcus pneumoniae R6
cugcagggggcaguaa

SEQ ID NO: 4110161 - RNA, 17 nt, Streptococcus pneumoniae R6
cugcaguugugucuucg

SEQ ID NO: 4110162 - RNA, 17 nt, Streptococcus pneumoniae R6
cugcaguuucucuacua

SEQ ID NO: 4110163 - RNA, 20 nt, Streptococcus pneumoniae R6
cugcaguuucucuacuaacu

SEQ ID NO: 4110164 - RNA, 23 nt, Streptococcus pneumoniae R6
cugcaucaagaacaauuucacaa

SEQ ID NO: 4110165 - RNA, 18 nt, Streptococcus pneumoniae R6
cugcauccaccuucaucu

SEQ ID NO: 4110166 - RNA, 14 nt, Streptococcus pneumoniae R6
cugcaucguucaau

SEQ ID NO: 4110167 - RNA, 15 nt, Streptococcus pneumoniae R6
cugcaugaaggucuu

SEQ ID NO: 4110168 - RNA, 20 nt, Streptococcus pneumoniae R6
cugcaugaaggucuuuuguc

SEQ ID NO: 4110169 - RNA, 21 nt, Streptococcus pneumoniae R6
cugcaugcgugccuugaccaa

SEQ ID NO: 4110170 - RNA, 14 nt, Streptococcus pneumoniae R6
cugcauuuuuucau

SEQ ID NO: 4110171 - RNA, 19 nt, Streptococcus pneumoniae R6
cugccaauugcucaacuuc

SEQ ID NO: 4110172 - RNA, 14 nt, Streptococcus pneumoniae R6
cugccacaccaccu

SEQ ID NO: 4110173 - RNA, 16 nt, Streptococcus pneumoniae R6
cugccagauuccugaa

SEQ ID NO: 4110174 - RNA, 22 nt, Streptococcus pneumoniae R6
cugccagcugagcuaaggaggc

SEQ ID NO: 4110175 - RNA, 21 nt, Streptococcus pneumoniae R6
cugccauugguguuugguuga

SEQ ID NO: 4110176 - RNA, 21 nt, Streptococcus pneumoniae R6
cugccauuugacgaacaaaaa

SEQ ID NO: 4110177 - RNA, 13 nt, Streptococcus pneumoniae R6
cugcccaaagaca

SEQ ID NO: 4110178 - RNA, 16 nt, Streptococcus pneumoniae R6
cugcccccaaacaguu

SEQ ID NO: 4110179 - RNA, 18 nt, Streptococcus pneumoniae R6
cugccgccauacuuucuc

SEQ ID NO: 4110180 - RNA, 19 nt, Streptococcus pneumoniae R6
cugccuuuuuauccaaaau

SEQ ID NO: 4110181 - RNA, 22 nt, Streptococcus pneumoniae R6
cugcgacaaaauugauaauagu

SEQ ID NO: 4110182 - RNA, 15 nt, Streptococcus pneumoniae R6
cugcgucugucuuga

SEQ ID NO: 4110183 - RNA, 17 nt, Streptococcus pneumoniae R6
cugcguuaacuucaaga

SEQ ID NO: 4110184 - RNA, 19 nt, Streptococcus pneumoniae R6
cugcuaaaacaaaauucuu

SEQ ID NO: 4110185 - RNA, 13 nt, Streptococcus pneumoniae R6
cugcuaaaagauu

SEQ ID NO: 4110186 - RNA, 20 nt, Streptococcus pneumoniae R6
cugcuaaaagauuucuauaa

SEQ ID NO: 4110187 - RNA, 13 nt, Streptococcus pneumoniae R6
cugcuaacugcug

SEQ ID NO: 4110188 - RNA, 18 nt, Streptococcus pneumoniae R6
cugcuaacugcuggauag

SEQ ID NO: 4110189 - RNA, 13 nt, Streptococcus pneumoniae R6
cugcuaauuuuau

SEQ ID NO: 4110190 - RNA, 18 nt, Streptococcus pneumoniae R6
cugcuacagauagaaggu

SEQ ID NO: 4110191 - RNA, 20 nt, Streptococcus pneumoniae R6
cugcuagacuaacuucuuau

SEQ ID NO: 4110192 - RNA, 20 nt, Streptococcus pneumoniae R6
cugcuaggcugauuccugga

SEQ ID NO: 4110193 - RNA, 13 nt, Streptococcus pneumoniae R6
cugcuauagucaa

SEQ ID NO: 4110194 - RNA, 20 nt, Streptococcus pneumoniae R6
cugcuauuaugcuaaagaaa

SEQ ID NO: 4110195 - RNA, 20 nt, Streptococcus pneumoniae R6
cugcucaaucuuaucaauca

SEQ ID NO: 4110196 - RNA, 19 nt, Streptococcus pneumoniae R6
cugcuccauaggcagcuug

SEQ ID NO: 4110197 - RNA, 16 nt, Streptococcus pneumoniae R6
cugcuccuccgagagc

SEQ ID NO: 4110198 - RNA, 13 nt, Streptococcus pneumoniae R6
cugcuccuccgcc

SEQ ID NO: 4110199 - RNA, 19 nt, Streptococcus pneumoniae R6
cuguauaggucuggcuauu

SEQ ID NO: 4110200 - RNA, 22 nt, Streptococcus pneumoniae R6
cuguauaggucuggcuauuuuu

SEQ ID NO: 4110201 - RNA, 15 nt, Streptococcus pneumoniae R6
cuguaucgaccucua

SEQ ID NO: 4110202 - RNA, 18 nt, Streptococcus pneumoniae R6
cuguaucgaccucuacca

SEQ ID NO: 4110203 - RNA, 21 nt, Streptococcus pneumoniae R6
cuguaugagaaacagcuccug

SEQ ID NO: 4110204 - RNA, 22 nt, Streptococcus pneumoniae R6
cuguaugggcaucaacagcucc

SEQ ID NO: 4110205 - RNA, 23 nt, Streptococcus pneumoniae R6
cuguaugggcaucaacagcucca

SEQ ID NO: 4110206 - RNA, 17 nt, Streptococcus pneumoniae R6
cuguauugguaacaaaa

SEQ ID NO: 4110207 - RNA, 22 nt, Streptococcus pneumoniae R6
cuguauuggugccgaaacuuca

SEQ ID NO: 4110208 - RNA, 20 nt, Streptococcus pneumoniae R6
cuguauuugcgacacuagca

SEQ ID NO: 4110209 - RNA, 23 nt, Streptococcus pneumoniae R6
cugucaagucuugcucuucauug

SEQ ID NO: 4110210 - RNA, 16 nt, Streptococcus pneumoniae R6
cugucacccuaggcaa

SEQ ID NO: 4110211 - RNA, 16 nt, Streptococcus pneumoniae R6
cugucagcaauuccuu

SEQ ID NO: 4110212 - RNA, 17 nt, Streptococcus pneumoniae R6
cugucauuuuuuccaau

SEQ ID NO: 4110213 - RNA, 20 nt, Streptococcus pneumoniae R6
cugucauuuuuuccaauucu

SEQ ID NO: 4110214 - RNA, 15 nt, Streptococcus pneumoniae R6
cuguccuaggucuag

SEQ ID NO: 4110215 - RNA, 16 nt, Streptococcus pneumoniae R6
cugucguagucuagga

SEQ ID NO: 4110216 - RNA, 18 nt, Streptococcus pneumoniae R6
cugucucaggucuagcaa

SEQ ID NO: 4110217 - RNA, 15 nt, Streptococcus pneumoniae R6
cugucugcugacuga

SEQ ID NO: 4110218 - RNA, 19 nt, Streptococcus pneumoniae R6
cugucuuagacuuucucac

SEQ ID NO: 4110219 - RNA, 15 nt, Streptococcus pneumoniae R6
cugucuuauccaaac

SEQ ID NO: 4110220 - RNA, 17 nt, Streptococcus pneumoniae R6
cugucuugcugucucca

SEQ ID NO: 4110221 - RNA, 20 nt, Streptococcus pneumoniae R6
cugucuuuucaaaguuaacu

SEQ ID NO: 4110222 - RNA, 21 nt, Streptococcus pneumoniae R6
cugucuuuucaaaguuaacuu

SEQ ID NO: 4110223 - RNA, 10 nt, Streptococcus pneumoniae R6
cugugaaaau

SEQ ID NO: 4110224 - RNA, 21 nt, Streptococcus pneumoniae R6
cugugacccacggauuaagag

SEQ ID NO: 4110225 - RNA, 17 nt, Streptococcus pneumoniae R6
cugugaccggcuuccua

SEQ ID NO: 4110226 - RNA, 20 nt, Streptococcus pneumoniae R6
cugugagauaguaucaaaug

SEQ ID NO: 4110227 - RNA, 21 nt, Streptococcus pneumoniae R6
cugugauuucuaaaacauugu

SEQ ID NO: 4110228 - RNA, 14 nt, Streptococcus pneumoniae R6
cugugauuuucuua

SEQ ID NO: 4110229 - RNA, 19 nt, Streptococcus pneumoniae R6
cugugauuuucuuaucacg

SEQ ID NO: 4110230 - RNA, 19 nt, Streptococcus pneumoniae R6
cugugauuuuuuuugguaa

SEQ ID NO: 4110231 - RNA, 11 nt, Streptococcus pneumoniae R6
cuguggaauau

SEQ ID NO: 4110232 - RNA, 14 nt, Streptococcus pneumoniae R6
cugugguccuugua

SEQ ID NO: 4110233 - RNA, 18 nt, Streptococcus pneumoniae R6
cuguguagcacuuuucca

SEQ ID NO: 4110234 - RNA, 20 nt, Streptococcus pneumoniae R6
cuguguagcacuuuuccauu

SEQ ID NO: 4110235 - RNA, 13 nt, Streptococcus pneumoniae R6
cuguuaauaacuc

SEQ ID NO: 4110236 - RNA, 20 nt, Streptococcus pneumoniae R6
cuguuaauaacucucaucua

SEQ ID NO: 4110237 - RNA, 17 nt, Streptococcus pneumoniae R6
cuguuaccacaggagcu

SEQ ID NO: 4110238 - RNA, 20 nt, Streptococcus pneumoniae R6
cuguuaccacaggagcugga

SEQ ID NO: 4110239 - RNA, 17 nt, Streptococcus pneumoniae R6
cuguuaccacuuccuac

SEQ ID NO: 4110240 - RNA, 15 nt, Streptococcus pneumoniae R6
cuguucauucuucac

SEQ ID NO: 4110241 - RNA, 16 nt, Streptococcus pneumoniae R6
cuguucauucuucaca

SEQ ID NO: 4110242 - RNA, 17 nt, Streptococcus pneumoniae R6
cuguuccaaagaaguag

SEQ ID NO: 4110243 - RNA, 20 nt, Streptococcus pneumoniae R6
cuguucgcaagauagaaccc

SEQ ID NO: 4110244 - RNA, 14 nt, Streptococcus pneumoniae R6
cuguucuauaaaau

SEQ ID NO: 4110245 - RNA, 19 nt, Streptococcus pneumoniae R6
cuguucuuauuucauuuua

SEQ ID NO: 4110246 - RNA, 12 nt, Streptococcus pneumoniae R6
cuguucuuuuuu

SEQ ID NO: 4110247 - RNA, 14 nt, Streptococcus pneumoniae R6
cuguugauauuucc

SEQ ID NO: 4110248 - RNA, 15 nt, Streptococcus pneumoniae R6
cuguugauauuucca

SEQ ID NO: 4110249 - RNA, 17 nt, Streptococcus pneumoniae R6
cuguugaugcaucaagu

SEQ ID NO: 4110250 - RNA, 15 nt, Streptococcus pneumoniae R6
cuguugcuucaucuc

SEQ ID NO: 4110251 - RNA, 16 nt, Streptococcus pneumoniae R6
cuguuguaauuuuaaa

SEQ ID NO: 4110252 - RNA, 22 nt, Streptococcus pneumoniae R6
cuguugucacauagacuccaua

SEQ ID NO: 4110253 - RNA, 23 nt, Streptococcus pneumoniae R6
cuguuuaaauucauuaaacucug

SEQ ID NO: 4110254 - RNA, 14 nt, Streptococcus pneumoniae R6
cuguuuauuuuuua

SEQ ID NO: 4110255 - RNA, 22 nt, Streptococcus pneumoniae R6
cuguuuauuuuuuaauuaauca

SEQ ID NO: 4110256 - RNA, 14 nt, Streptococcus pneumoniae R6
cuguuucaaaugaa

SEQ ID NO: 4110257 - RNA, 19 nt, Streptococcus pneumoniae R6
cuguuucaaaugaaauauu

SEQ ID NO: 4110258 - RNA, 22 nt, Streptococcus pneumoniae R6
cuguuucaggaaguuuuuucuc

SEQ ID NO: 4110259 - RNA, 16 nt, Streptococcus pneumoniae R6
cuguuuccgugugaga

SEQ ID NO: 4110260 - RNA, 15 nt, Streptococcus pneumoniae R6
cuguuucgucuucca

SEQ ID NO: 4110261 - RNA, 23 nt, Streptococcus pneumoniae R6
cuguuucgucuuccauuucuuug

SEQ ID NO: 4110262 - RNA, 23 nt, Streptococcus pneumoniae R6
cuguuucugcaaccucuacaaua

SEQ ID NO: 4110263 - RNA, 17 nt, Streptococcus pneumoniae R6
cuguuugaaucaauucu

SEQ ID NO: 4110264 - RNA, 18 nt, Streptococcus pneumoniae R6
cuguuuggccaagguuca

SEQ ID NO: 4110265 - RNA, 17 nt, Streptococcus pneumoniae R6
cuguuuuagcguuuuug

SEQ ID NO: 4110266 - RNA, 19 nt, Streptococcus pneumoniae R6
cuguuuuagcguuuuugug

SEQ ID NO: 4110267 - RNA, 18 nt, Streptococcus pneumoniae R6
cuguuuucacauuuucaa

SEQ ID NO: 4110268 - RNA, 19 nt, Streptococcus pneumoniae R6
cuguuuuccuuucaauguu

SEQ ID NO: 4110269 - RNA, 19 nt, Streptococcus pneumoniae R6
cuguuuucuuagugaguuu

SEQ ID NO: 4110270 - RNA, 21 nt, Streptococcus pneumoniae R6
cuguuuucuuggucauuugag

SEQ ID NO: 4110271 - RNA, 14 nt, Streptococcus pneumoniae R6
cuguuuuggauaau

SEQ ID NO: 4110272 - RNA, 17 nt, Streptococcus pneumoniae R6
cuguuuuugaagaaaag

SEQ ID NO: 4110273 - RNA, 21 nt, Streptococcus pneumoniae R6
cuguuuuugguugcaccaagu

SEQ ID NO: 4110274 - RNA, 20 nt, Streptococcus pneumoniae R6
cuguuuuuucuuaucuugau

SEQ ID NO: 4110275 - RNA, 14 nt, Streptococcus pneumoniae R6
cuuaaaaaagucca

SEQ ID NO: 4110276 - RNA, 13 nt, Streptococcus pneumoniae R6
cuuaaaaaguuac

SEQ ID NO: 4110277 - RNA, 16 nt, Streptococcus pneumoniae R6
cuuaaaaaucuucaaa

SEQ ID NO: 4110278 - RNA, 19 nt, Streptococcus pneumoniae R6
cuuaaaagcaaaagaacaa

SEQ ID NO: 4110279 - RNA, 17 nt, Streptococcus pneumoniae R6
cuuaaaauaauuuuuuu

SEQ ID NO: 4110280 - RNA, 14 nt, Streptococcus pneumoniae R6
cuuaaaauccaguc

SEQ ID NO: 4110281 - RNA, 19 nt, Streptococcus pneumoniae R6
cuuaaaauugguuuaaaua

SEQ ID NO: 4110282 - RNA, 17 nt, Streptococcus pneumoniae R6
cuuaaaauuguuucaug

SEQ ID NO: 4110283 - RNA, 19 nt, Streptococcus pneumoniae R6
cuuaaacgacuagauaaaa

SEQ ID NO: 4110284 - RNA, 20 nt, Streptococcus pneumoniae R6
cuuaaacgugcuauaucaaa

SEQ ID NO: 4110285 - RNA, 23 nt, Streptococcus pneumoniae R6
cuuaaagugggaacuagagaguu

SEQ ID NO: 4110286 - RNA, 22 nt, Streptococcus pneumoniae R6
cuuaaauaaaauuuuuuucaaa

SEQ ID NO: 4110287 - RNA, 13 nt, Streptococcus pneumoniae R6
cuuaaauccacgu

SEQ ID NO: 4110288 - RNA, 20 nt, Streptococcus pneumoniae R6
cuuaaaugacauuccugucu

SEQ ID NO: 4110289 - RNA, 19 nt, Streptococcus pneumoniae R6
cuuaaauuuuauacaaauu

SEQ ID NO: 4110290 - RNA, 16 nt, Streptococcus pneumoniae R6
cuuaacaaucuuacca

SEQ ID NO: 4110291 - RNA, 22 nt, Streptococcus pneumoniae R6
cuuaacccgcucaaaaucauca

SEQ ID NO: 4110292 - RNA, 15 nt, Streptococcus pneumoniae R6
cuuaacccuuuuuau

SEQ ID NO: 4110293 - RNA, 22 nt, Streptococcus pneumoniae R6
cuuaaccucuugaaguucauuu

SEQ ID NO: 4110294 - RNA, 23 nt, Streptococcus pneumoniae R6
cuuaaguaaguacaugcaaagua

SEQ ID NO: 4110295 - RNA, 22 nt, Streptococcus pneumoniae R6
cuuaauaucagccagagcacca

SEQ ID NO: 4110296 - RNA, 21 nt, Streptococcus pneumoniae R6
cuuaaucaauuaucauuucca

SEQ ID NO: 4110297 - RNA, 12 nt, Streptococcus pneumoniae R6
cuuaaucuguuu

SEQ ID NO: 4110298 - RNA, 14 nt, Streptococcus pneumoniae R6
cuuaaucuuggcaa

SEQ ID NO: 4110299 - RNA, 16 nt, Streptococcus pneumoniae R6
cuuaaucuuuaaaagu

SEQ ID NO: 4110300 - RNA, 17 nt, Streptococcus pneumoniae R6
cuuaaucuuuaaaaguu

SEQ ID NO: 4110301 - RNA, 15 nt, Streptococcus pneumoniae R6
cuuaauucucuuauu

SEQ ID NO: 4110302 - RNA, 17 nt, Streptococcus pneumoniae R6
cuuaauucucuuauugu

SEQ ID NO: 4110303 - RNA, 21 nt, Streptococcus pneumoniae R6
cuuaauucucuuguuguugua

SEQ ID NO: 4110304 - RNA, 17 nt, Streptococcus pneumoniae R6
cuuaauuguagcuuuau

SEQ ID NO: 4110305 - RNA, 19 nt, Streptococcus pneumoniae R6
cuuaauuguagcuuuauua

SEQ ID NO: 4110306 - RNA, 22 nt, Streptococcus pneumoniae R6
cuuaauuguagcuuuauuaagc

SEQ ID NO: 4110307 - RNA, 13 nt, Streptococcus pneumoniae R6
cuuaauuucuauc

SEQ ID NO: 4110308 - RNA, 18 nt, Streptococcus pneumoniae R6
cuuacaaaaaaucaaaaa

SEQ ID NO: 4110309 - RNA, 20 nt, Streptococcus pneumoniae R6
cuuacauaauaaccuuccac

SEQ ID NO: 4110310 - RNA, 17 nt, Streptococcus pneumoniae R6
cuuacaucaaaaacauc

SEQ ID NO: 4110311 - RNA, 20 nt, Streptococcus pneumoniae R6
cuuacauuugaguuucucuu

SEQ ID NO: 4110312 - RNA, 15 nt, Streptococcus pneumoniae R6
cuuaccaaggcuuug

SEQ ID NO: 4110313 - RNA, 12 nt, Streptococcus pneumoniae R6
cuuaccaagucc

SEQ ID NO: 4110314 - RNA, 21 nt, Streptococcus pneumoniae R6
cuuacggaucuagcugagaca

SEQ ID NO: 4110315 - RNA, 18 nt, Streptococcus pneumoniae R6
cuuacggucaaagucaua

SEQ ID NO: 4110316 - RNA, 16 nt, Streptococcus pneumoniae R6
cuuacguucauccaua

SEQ ID NO: 4110317 - RNA, 13 nt, Streptococcus pneumoniae R6
cuuacguuccaag

SEQ ID NO: 4110318 - RNA, 13 nt, Streptococcus pneumoniae R6
cuuacuauacuua

SEQ ID NO: 4110319 - RNA, 17 nt, Streptococcus pneumoniae R6
cuuacuauucacucaaa

SEQ ID NO: 4110320 - RNA, 19 nt, Streptococcus pneumoniae R6
cuuacucuuucgaucaguc

SEQ ID NO: 4110321 - RNA, 19 nt, Streptococcus pneumoniae R6
cuuacuguccuucuuuuac

SEQ ID NO: 4110322 - RNA, 23 nt, Streptococcus pneumoniae R6
cuuacuuaacccuuuuuauacuc

SEQ ID NO: 4110323 - RNA, 14 nt, Streptococcus pneumoniae R6
cuuacuuuuuauua

SEQ ID NO: 4110324 - RNA, 21 nt, Streptococcus pneumoniae R6
cuuacuuuuuauuacaucuau

SEQ ID NO: 4110325 - RNA, 23 nt, Streptococcus pneumoniae R6
cuuacuuuuuauuacaucuaucu

SEQ ID NO: 4110326 - RNA, 18 nt, Streptococcus pneumoniae R6
cuuagaaaaucucuucaa

SEQ ID NO: 4110327 - RNA, 19 nt, Streptococcus pneumoniae R6
cuuagaaaaucucuucaaa

SEQ ID NO: 4110328 - RNA, 20 nt, Streptococcus pneumoniae R6
cuuagauagauaaaggccaa

SEQ ID NO: 4110329 - RNA, 16 nt, Streptococcus pneumoniae R6
cuuagaucuagauuaa

SEQ ID NO: 4110330 - RNA, 18 nt, Streptococcus pneumoniae R6
cuuagcaacuguuuuuuc

SEQ ID NO: 4110331 - RNA, 12 nt, Streptococcus pneumoniae R6
cuuagcagacuu

SEQ ID NO: 4110332 - RNA, 23 nt, Streptococcus pneumoniae R6
cuuagcagacuucuuuuuuacuu

SEQ ID NO: 4110333 - RNA, 24 nt, Streptococcus pneumoniae R6
cuuagccaagucaguuuuccguuc

SEQ ID NO: 4110334 - RNA, 14 nt, Streptococcus pneumoniae R6
cuuagcucugugca

SEQ ID NO: 4110335 - RNA, 17 nt, Streptococcus pneumoniae R6
cuuagcuuuucuucaac

SEQ ID NO: 4110336 - RNA, 16 nt, Streptococcus pneumoniae R6
cuuaggguuagauuau

SEQ ID NO: 4110337 - RNA, 14 nt, Streptococcus pneumoniae R6
cuuaguaaugacuu

SEQ ID NO: 4110338 - RNA, 16 nt, Streptococcus pneumoniae R6
cuuaguacgugacuca

SEQ ID NO: 4110339 - RNA, 21 nt, Streptococcus pneumoniae R6
cuuaguacgugacucagcuuc

SEQ ID NO: 4110340 - RNA, 23 nt, Streptococcus pneumoniae R6
cuuagucucaaaaucaaagacuu

SEQ ID NO: 4110341 - RNA, 21 nt, Streptococcus pneumoniae R6
cuuauaauauagggcuuuuuu

SEQ ID NO: 4110342 - RNA, 21 nt, Streptococcus pneumoniae R6
cuuauaauuaaaaguuucccc

SEQ ID NO: 4110343 - RNA, 15 nt, Streptococcus pneumoniae R6
cuuauagaaacaucu

SEQ ID NO: 4110344 - RNA, 17 nt, Streptococcus pneumoniae R6
cuuauagaaacaucuua

SEQ ID NO: 4110345 - RNA, 22 nt, Streptococcus pneumoniae R6
cuuauaguaacgagucaaaaaa

SEQ ID NO: 4110346 - RNA, 20 nt, Streptococcus pneumoniae R6
cuuauaguacuaaucuuugc

SEQ ID NO: 4110347 - RNA, 23 nt, Streptococcus pneumoniae R6
cuuauaguuugucuuucauuucu

SEQ ID NO: 4110348 - RNA, 20 nt, Streptococcus pneumoniae R6
cuuauauauccauucuuaaa

SEQ ID NO: 4110349 - RNA, 14 nt, Streptococcus pneumoniae R6
cuuauauuaaaaaa

SEQ ID NO: 4110350 - RNA, 19 nt, Streptococcus pneumoniae R6
cuuauauuaaaaaaagggg

SEQ ID NO: 4110351 - RNA, 19 nt, Streptococcus pneumoniae R6
cuuauauuuaguacucugu

SEQ ID NO: 4110352 - RNA, 22 nt, Streptococcus pneumoniae R6
cuuaucacgaauuucuuguuca

SEQ ID NO: 4110353 - RNA, 15 nt, Streptococcus pneumoniae R6
cuuaucagaaaauaa

SEQ ID NO: 4110354 - RNA, 20 nt, Streptococcus pneumoniae R6
cuuaucaggcgugcgcucua

SEQ ID NO: 4110355 - RNA, 18 nt, Streptococcus pneumoniae R6
cuuauccgaacccuguuu

SEQ ID NO: 4110356 - RNA, 12 nt, Streptococcus pneumoniae R6
cuuauccuuguc

SEQ ID NO: 4110357 - RNA, 15 nt, Streptococcus pneumoniae R6
cuuaucuaaaaccuc

SEQ ID NO: 4110358 - RNA, 19 nt, Streptococcus pneumoniae R6
cuuaucuaaaaccucaagg

SEQ ID NO: 4110359 - RNA, 16 nt, Streptococcus pneumoniae R6
cuuaucuaagacugcu

SEQ ID NO: 4110360 - RNA, 18 nt, Streptococcus pneumoniae R6
cuuaucuaagacugcuug

SEQ ID NO: 4110361 - RNA, 21 nt, Streptococcus pneumoniae R6
cuuaucuaagacugcuugcac

SEQ ID NO: 4110362 - RNA, 16 nt, Streptococcus pneumoniae R6
cuuaucuauagcuuuu

SEQ ID NO: 4110363 - RNA, 16 nt, Streptococcus pneumoniae R6
cuuaucugcaaccuca

SEQ ID NO: 4110364 - RNA, 19 nt, Streptococcus pneumoniae R6
cuuaucugcaaccucaaaa

SEQ ID NO: 4110365 - RNA, 21 nt, Streptococcus pneumoniae R6
cuuaucuggguuccagaugaa

SEQ ID NO: 4110366 - RNA, 16 nt, Streptococcus pneumoniae R6
cuuaucuucaguuccc

SEQ ID NO: 4110367 - RNA, 17 nt, Streptococcus pneumoniae R6
cuuaucuucaguucccu

SEQ ID NO: 4110368 - RNA, 13 nt, Streptococcus pneumoniae R6
cuuaucuuuggca

SEQ ID NO: 4110369 - RNA, 13 nt, Streptococcus pneumoniae R6
cuuaugaauacuc

SEQ ID NO: 4110370 - RNA, 14 nt, Streptococcus pneumoniae R6
cuuauuccaauuga

SEQ ID NO: 4110371 - RNA, 20 nt, Streptococcus pneumoniae R6
cuuauugaugauguuuaaaa

SEQ ID NO: 4110372 - RNA, 20 nt, Streptococcus pneumoniae R6
cuuauuguuguaauaaucaa

SEQ ID NO: 4110373 - RNA, 15 nt, Streptococcus pneumoniae R6
cuuauuucaaaaaau

SEQ ID NO: 4110374 - RNA, 16 nt, Streptococcus pneumoniae R6
cuuauuucaaaaaaug

SEQ ID NO: 4110375 - RNA, 20 nt, Streptococcus pneumoniae R6
cuuauuucaauuugaugauu

SEQ ID NO: 4110376 - RNA, 12 nt, Streptococcus pneumoniae R6
cuuauuucacau

SEQ ID NO: 4110377 - RNA, 13 nt, Streptococcus pneumoniae R6
cuuauuucauuug

SEQ ID NO: 4110378 - RNA, 10 nt, Streptococcus pneumoniae R6
cuuauuuccu

SEQ ID NO: 4110379 - RNA, 15 nt, Streptococcus pneumoniae R6
cuuauuuucuacucu

SEQ ID NO: 4110380 - RNA, 19 nt, Streptococcus pneumoniae R6
cuucaaaaucaaagaacaa

SEQ ID NO: 4110381 - RNA, 22 nt, Streptococcus pneumoniae R6
cuucaaaaucgagguauuucuu

SEQ ID NO: 4110382 - RNA, 18 nt, Streptococcus pneumoniae R6
cuucaaaaucucagcuag

SEQ ID NO: 4110383 - RNA, 16 nt, Streptococcus pneumoniae R6
cuucaaaggucaaauc

SEQ ID NO: 4110384 - RNA, 15 nt, Streptococcus pneumoniae R6
cuucaaauccugcau

SEQ ID NO: 4110385 - RNA, 16 nt, Streptococcus pneumoniae R6
cuucaaauccugcauu

SEQ ID NO: 4110386 - RNA, 18 nt, Streptococcus pneumoniae R6
cuucaaauccugcauugu

SEQ ID NO: 4110387 - RNA, 21 nt, Streptococcus pneumoniae R6
cuucaaauccuuuauuuucaa

SEQ ID NO: 4110388 - RNA, 13 nt, Streptococcus pneumoniae R6
cuucaaauuguuu

SEQ ID NO: 4110389 - RNA, 12 nt, Streptococcus pneumoniae R6
cuucaaauuuuu

SEQ ID NO: 4110390 - RNA, 14 nt, Streptococcus pneumoniae R6
cuucaacaaaccuu

SEQ ID NO: 4110391 - RNA, 20 nt, Streptococcus pneumoniae R6
cuucaacauucuccaguaga

SEQ ID NO: 4110392 - RNA, 16 nt, Streptococcus pneumoniae R6
cuucaacccacuacag

SEQ ID NO: 4110393 - RNA, 12 nt, Streptococcus pneumoniae R6
cuucaacucuau

SEQ ID NO: 4110394 - RNA, 13 nt, Streptococcus pneumoniae R6
cuucaacuucuau

SEQ ID NO: 4110395 - RNA, 15 nt, Streptococcus pneumoniae R6
cuucaacuucuauca

SEQ ID NO: 4110396 - RNA, 16 nt, Streptococcus pneumoniae R6
cuucaacuucuaucac

SEQ ID NO: 4110397 - RNA, 12 nt, Streptococcus pneumoniae R6
cuucaagagcuu

SEQ ID NO: 4110398 - RNA, 15 nt, Streptococcus pneumoniae R6
cuucaagguuuuucu

SEQ ID NO: 4110399 - RNA, 21 nt, Streptococcus pneumoniae R6
cuucaaguuuagcguuggaau

SEQ ID NO: 4110400 - RNA, 15 nt, Streptococcus pneumoniae R6
cuucaauaauuucuu

SEQ ID NO: 4110401 - RNA, 18 nt, Streptococcus pneumoniae R6
cuucaauaccaaagaagu

SEQ ID NO: 4110402 - RNA, 18 nt, Streptococcus pneumoniae R6
cuucaauacgaacaccga

SEQ ID NO: 4110403 - RNA, 23 nt, Streptococcus pneumoniae R6
cuucaauagcauugucacaaagg

SEQ ID NO: 4110404 - RNA, 20 nt, Streptococcus pneumoniae R6
cuucugaaucugccucaaga

SEQ ID NO: 4110405 - RNA, 22 nt, Streptococcus pneumoniae R6
cuucugagguuaaaaucuuuua

SEQ ID NO: 4110406 - RNA, 12 nt, Streptococcus pneumoniae R6
cuucugcaauua

SEQ ID NO: 4110407 - RNA, 14 nt, Streptococcus pneumoniae R6
cuucugcggauaaa

SEQ ID NO: 4110408 - RNA, 15 nt, Streptococcus pneumoniae R6
cuucugcucgcugga

SEQ ID NO: 4110409 - RNA, 15 nt, Streptococcus pneumoniae R6
cuucugcuucuaaaa

SEQ ID NO: 4110410 - RNA, 14 nt, Streptococcus pneumoniae R6
cuucuggcacagaa

SEQ ID NO: 4110411 - RNA, 20 nt, Streptococcus pneumoniae R6
cuucuggcacagaaacaccu

SEQ ID NO: 4110412 - RNA, 18 nt, Streptococcus pneumoniae R6
cuucuggcuuaacaaugg

SEQ ID NO: 4110413 - RNA, 23 nt, Streptococcus pneumoniae R6
cuucugggauggucacagaacca

SEQ ID NO: 4110414 - RNA, 14 nt, Streptococcus pneumoniae R6
cuucuggugcugga

SEQ ID NO: 4110415 - RNA, 19 nt, Streptococcus pneumoniae R6
cuucugguuugugcucaau

SEQ ID NO: 4110416 - RNA, 20 nt, Streptococcus pneumoniae R6
cuucuguaagucauuuucuu

SEQ ID NO: 4110417 - RNA, 19 nt, Streptococcus pneumoniae R6
cuucuguucauucuucaca

SEQ ID NO: 4110418 - RNA, 19 nt, Streptococcus pneumoniae R6
cuucuguugguugaauaua

SEQ ID NO: 4110419 - RNA, 16 nt, Streptococcus pneumoniae R6
cuucuuccaucuucuc

SEQ ID NO: 4110420 - RNA, 10 nt, Streptococcus pneumoniae R6
cuucuucccc

SEQ ID NO: 4110421 - RNA, 15 nt, Streptococcus pneumoniae R6
cuucuucgcuuucuu

SEQ ID NO: 4110422 - RNA, 18 nt, Streptococcus pneumoniae R6
cuucuugaccaacuuuaa

SEQ ID NO: 4110423 - RNA, 23 nt, Streptococcus pneumoniae R6
cuucuugaguaguuccagugauu

SEQ ID NO: 4110424 - RNA, 22 nt, Streptococcus pneumoniae R6
cuucuugauacugaucaaaaaa

SEQ ID NO: 4110425 - RNA, 13 nt, Streptococcus pneumoniae R6
cuucuuggaauuc

SEQ ID NO: 4110426 - RNA, 18 nt, Streptococcus pneumoniae R6
cuucuuguccaagcaagg

SEQ ID NO: 4110427 - RNA, 19 nt, Streptococcus pneumoniae R6
cuucuuuacugagauggau

SEQ ID NO: 4110428 - RNA, 21 nt, Streptococcus pneumoniae R6
cuucuuuauguucaucuucuu

SEQ ID NO: 4110429 - RNA, 21 nt, Streptococcus pneumoniae R6
cuucuuucucaaacauuguga

SEQ ID NO: 4110430 - RNA, 22 nt, Streptococcus pneumoniae R6
cuucuuucucaaacauugugag

SEQ ID NO: 4110431 - RNA, 17 nt, Streptococcus pneumoniae R6
cuucuuuguaggcuucu

SEQ ID NO: 4110432 - RNA, 14 nt, Streptococcus pneumoniae R6
cuucuuuucuuuua

SEQ ID NO: 4110433 - RNA, 18 nt, Streptococcus pneumoniae R6
cuucuuuuuauauauaaa

SEQ ID NO: 4110434 - RNA, 12 nt, Streptococcus pneumoniae R6
cuucuuuuucuc

SEQ ID NO: 4110435 - RNA, 18 nt, Streptococcus pneumoniae R6
cuucuuuuuguccuucuu

SEQ ID NO: 4110436 - RNA, 22 nt, Streptococcus pneumoniae R6
cuucuuuuuuauccucaaaauu

SEQ ID NO: 4110437 - RNA, 14 nt, Streptococcus pneumoniae R6
cuucuuuuuugaga

SEQ ID NO: 4110438 - RNA, 17 nt, Streptococcus pneumoniae R6
cuucuuuuuugagauga

SEQ ID NO: 4110439 - RNA, 21 nt, Streptococcus pneumoniae R6
cuugaaaauaccaaguucauu

SEQ ID NO: 4110440 - RNA, 15 nt, Streptococcus pneumoniae R6
cuugaaacaaauaaa

SEQ ID NO: 4110441 - RNA, 22 nt, Streptococcus pneumoniae R6
cuugaaaccaguuccuuugucu

SEQ ID NO: 4110442 - RNA, 12 nt, Streptococcus pneumoniae R6
cuugaaagacca

SEQ ID NO: 4110443 - RNA, 18 nt, Streptococcus pneumoniae R6
cuugaaauaucuggacuu

SEQ ID NO: 4110444 - RNA, 11 nt, Streptococcus pneumoniae R6
cuugaaaucaa

SEQ ID NO: 4110445 - RNA, 15 nt, Streptococcus pneumoniae R6
cuugaaccuuucuuc

SEQ ID NO: 4110446 - RNA, 15 nt, Streptococcus pneumoniae R6
cuugaacgacaugcg

SEQ ID NO: 4110447 - RNA, 14 nt, Streptococcus pneumoniae R6
cuugaacuucuuga

SEQ ID NO: 4110448 - RNA, 18 nt, Streptococcus pneumoniae R6
cuugaaggggcaacucuu

SEQ ID NO: 4110449 - RNA, 19 nt, Streptococcus pneumoniae R6
cuugaaggggcaacucuuc

SEQ ID NO: 4110450 - RNA, 22 nt, Streptococcus pneumoniae R6
cuugaaggggcaacucuucaag

SEQ ID NO: 4110451 - RNA, 13 nt, Streptococcus pneumoniae R6
cuugaaguucauu

SEQ ID NO: 4110452 - RNA, 15 nt, Streptococcus pneumoniae R6
cuugaaguucauuuu

SEQ ID NO: 4110453 - RNA, 17 nt, Streptococcus pneumoniae R6
cuugaaguucauuuucu

SEQ ID NO: 4110454 - RNA, 18 nt, Streptococcus pneumoniae R6
cuugaaguucauuuucuu

SEQ ID NO: 4110455 - RNA, 21 nt, Streptococcus pneumoniae R6
cuugaauagauacaaaaccaa

SEQ ID NO: 4110456 - RNA, 15 nt, Streptococcus pneumoniae R6
cuugaauauuuuucu

SEQ ID NO: 4110457 - RNA, 14 nt, Streptococcus pneumoniae R6
cuugaaugauaaaa

SEQ ID NO: 4110458 - RNA, 19 nt, Streptococcus pneumoniae R6
cuugaaugauaaaacauac

SEQ ID NO: 4110459 - RNA, 13 nt, Streptococcus pneumoniae R6
cuugaauuagaag

SEQ ID NO: 4110460 - RNA, 14 nt, Streptococcus pneumoniae R6
cuugaauucccuua

SEQ ID NO: 4110461 - RNA, 20 nt, Streptococcus pneumoniae R6
cuugaauuuacguccuugga

SEQ ID NO: 4110462 - RNA, 19 nt, Streptococcus pneumoniae R6
cuugacaaagaaaaaacaa

SEQ ID NO: 4110463 - RNA, 22 nt, Streptococcus pneumoniae R6
cuugacaaagagccacucuuua

SEQ ID NO: 4110464 - RNA, 20 nt, Streptococcus pneumoniae R6
cuugacauacaacuuaaaaa

SEQ ID NO: 4110465 - RNA, 20 nt, Streptococcus pneumoniae R6
cuugaccaacuuuaagagcu

SEQ ID NO: 4110466 - RNA, 23 nt, Streptococcus pneumoniae R6
cuugaccaaguccucaauuugaa

SEQ ID NO: 4110467 - RNA, 23 nt, Streptococcus pneumoniae R6
cuugaccagcuacuguacuuccc

SEQ ID NO: 4110468 - RNA, 19 nt, Streptococcus pneumoniae R6
cuugacuauauuucuuaau

SEQ ID NO: 4110469 - RNA, 19 nt, Streptococcus pneumoniae R6
cuugacuccccauuuacca

SEQ ID NO: 4110470 - RNA, 15 nt, Streptococcus pneumoniae R6
cuugagaagagcuuc

SEQ ID NO: 4110471 - RNA, 23 nt, Streptococcus pneumoniae R6
cuugagacgaugaauaugucuag

SEQ ID NO: 4110472 - RNA, 15 nt, Streptococcus pneumoniae R6
cuugagcaaacugaa

SEQ ID NO: 4110473 - RNA, 22 nt, Streptococcus pneumoniae R6
cuugagcuaggguguuuucaau

SEQ ID NO: 4110474 - RNA, 16 nt, Streptococcus pneumoniae R6
cuugagcugcugugau

SEQ ID NO: 4110475 - RNA, 20 nt, Streptococcus pneumoniae R6
cuugaggucccaugcuucca

SEQ ID NO: 4110476 - RNA, 23 nt, Streptococcus pneumoniae R6
cuugagguuuuagauaagacuga

SEQ ID NO: 4110477 - RNA, 22 nt, Streptococcus pneumoniae R6
cuugaguaaauaaaacaaaaaa

SEQ ID NO: 4110478 - RNA, 13 nt, Streptococcus pneumoniae R6
cuugaguaauucu

SEQ ID NO: 4110479 - RNA, 13 nt, Streptococcus pneumoniae R6
cuugaguggaaaa

SEQ ID NO: 4110480 - RNA, 22 nt, Streptococcus pneumoniae R6
cuugauaaggugggaagaguug

SEQ ID NO: 4110481 - RNA, 16 nt, Streptococcus pneumoniae R6
cuugauaaguucuuuu

SEQ ID NO: 4110482 - RNA, 22 nt, Streptococcus pneumoniae R6
cuugauacugaucaaaaaauuu

SEQ ID NO: 4110483 - RNA, 14 nt, Streptococcus pneumoniae R6
cuugauagcagaau

SEQ ID NO: 4110484 - RNA, 18 nt, Streptococcus pneumoniae R6
cuugauagcguccaucuc

SEQ ID NO: 4110485 - RNA, 17 nt, Streptococcus pneumoniae R6
cuugauauaguuaaaaa

SEQ ID NO: 4110486 - RNA, 18 nt, Streptococcus pneumoniae R6
cuugauauaguuaaaaaa

SEQ ID NO: 4110487 - RNA, 20 nt, Streptococcus pneumoniae R6
cuugauauucuuaucaaauc

SEQ ID NO: 4110488 - RNA, 12 nt, Streptococcus pneumoniae R6
cuugaucuucca

SEQ ID NO: 4110489 - RNA, 17 nt, Streptococcus pneumoniae R6
cuugaugaaaaaaaguu

SEQ ID NO: 4110490 - RNA, 12 nt, Streptococcus pneumoniae R6
cuugaugaaaga

SEQ ID NO: 4110491 - RNA, 20 nt, Streptococcus pneumoniae R6
cuugaugaaagauauuuugc

SEQ ID NO: 4110492 - RNA, 18 nt, Streptococcus pneumoniae R6
cuugaugagcaaaggauu

SEQ ID NO: 4110493 - RNA, 17 nt, Streptococcus pneumoniae R6
cuugaugcgauugauuu

SEQ ID NO: 4110494 - RNA, 17 nt, Streptococcus pneumoniae R6
cuugaugucuuggauuu

SEQ ID NO: 4110495 - RNA, 19 nt, Streptococcus pneumoniae R6
cuugauuuucuuuaaaaaa

SEQ ID NO: 4110496 - RNA, 18 nt, Streptococcus pneumoniae R6
cuugauuuuuuuuaaaaa

SEQ ID NO: 4110497 - RNA, 22 nt, Streptococcus pneumoniae R6
cuugauuuuuuuuaaaaaagug

SEQ ID NO: 4110498 - RNA, 15 nt, Streptococcus pneumoniae R6
cuugcaaacuuuuua

SEQ ID NO: 4110499 - RNA, 16 nt, Streptococcus pneumoniae R6
cuugcaggaaauuuuu

SEQ ID NO: 4110500 - RNA, 12 nt, Streptococcus pneumoniae R6
cuugcauuaucc

SEQ ID NO: 4110501 - RNA, 16 nt, Streptococcus pneumoniae R6
cuugcccuucuagagu

SEQ ID NO: 4110502 - RNA, 19 nt, Streptococcus pneumoniae R6
cuugcccuuggcuaguuca

SEQ ID NO: 4110503 - RNA, 22 nt, Streptococcus pneumoniae R6
cuugcgauaaagcuaaagauga

SEQ ID NO: 4110504 - RNA, 15 nt, Streptococcus pneumoniae R6
cuugcgaugaugagg

SEQ ID NO: 4110505 - RNA, 21 nt, Streptococcus pneumoniae R6
cuugcgccaguuacccgaccu

SEQ ID NO: 4110506 - RNA, 12 nt, Streptococcus pneumoniae R6
cuuuagaaaggu

SEQ ID NO: 4110507 - RNA, 17 nt, Streptococcus pneumoniae R6
cuuuagaaagguuuuaa

SEQ ID NO: 4110508 - RNA, 12 nt, Streptococcus pneumoniae R6
cuuuagaacuug

SEQ ID NO: 4110509 - RNA, 23 nt, Streptococcus pneumoniae R6
cuuuagacccuucuggcaauuua

SEQ ID NO: 4110510 - RNA, 20 nt, Streptococcus pneumoniae R6
cuuuagauuguccucaauga

SEQ ID NO: 4110511 - RNA, 14 nt, Streptococcus pneumoniae R6
cuuuagcagaugcu

SEQ ID NO: 4110512 - RNA, 19 nt, Streptococcus pneumoniae R6
cuuuaguaccagcucguuc

SEQ ID NO: 4110513 - RNA, 20 nt, Streptococcus pneumoniae R6
cuuuagucccagcuucuuuu

SEQ ID NO: 4110514 - RNA, 14 nt, Streptococcus pneumoniae R6
cuuuagucuuaucc

SEQ ID NO: 4110515 - RNA, 18 nt, Streptococcus pneumoniae R6
cuuuauaguggguugaag

SEQ ID NO: 4110516 - RNA, 15 nt, Streptococcus pneumoniae R6
cuuuauauaaaaaga

SEQ ID NO: 4110517 - RNA, 11 nt, Streptococcus pneumoniae R6
cuuuaucaagc

SEQ ID NO: 4110518 - RNA, 21 nt, Streptococcus pneumoniae R6
cuuuaucaagcaaaucaaagc

SEQ ID NO: 4110519 - RNA, 12 nt, Streptococcus pneumoniae R6
cuuuaucauuaa

SEQ ID NO: 4110520 - RNA, 17 nt, Streptococcus pneumoniae R6
cuuuaucugcaaccuca

SEQ ID NO: 4110521 - RNA, 13 nt, Streptococcus pneumoniae R6
cuuuauuagcaua

SEQ ID NO: 4110522 - RNA, 18 nt, Streptococcus pneumoniae R6
cuuuauugucucuaaaaa

SEQ ID NO: 4110523 - RNA, 15 nt, Streptococcus pneumoniae R6
cuuuauuuucucauc

SEQ ID NO: 4110524 - RNA, 22 nt, Streptococcus pneumoniae R6
cuuuauuuuuucuguaaaauca

SEQ ID NO: 4110525 - RNA, 19 nt, Streptococcus pneumoniae R6
cuuuauuuuuuuacuuaau

SEQ ID NO: 4110526 - RNA, 23 nt, Streptococcus pneumoniae R6
cuuuauuuuuuuauccauuuuuc

SEQ ID NO: 4110527 - RNA, 17 nt, Streptococcus pneumoniae R6
cuuucaaaccagcacca

SEQ ID NO: 4110528 - RNA, 20 nt, Streptococcus pneumoniae R6
cuuucaaagcgggauuuaaa

SEQ ID NO: 4110529 - RNA, 15 nt, Streptococcus pneumoniae R6
cuuucaacucagcau

SEQ ID NO: 4110530 - RNA, 21 nt, Streptococcus pneumoniae R6
cuuucaacucagcauuuucuu

SEQ ID NO: 4110531 - RNA, 16 nt, Streptococcus pneumoniae R6
cuuucaacuccuuacu

SEQ ID NO: 4110532 - RNA, 22 nt, Streptococcus pneumoniae R6
cuuucaacuucgucacauuccc

SEQ ID NO: 4110533 - RNA, 19 nt, Streptococcus pneumoniae R6
cuuucaauagcauauuuuu

SEQ ID NO: 4110534 - RNA, 14 nt, Streptococcus pneumoniae R6
cuuucaauauguuu

SEQ ID NO: 4110535 - RNA, 19 nt, Streptococcus pneumoniae R6
cuuucaguuucauaaucag

SEQ ID NO: 4110536 - RNA, 12 nt, Streptococcus pneumoniae R6
cuuucauagcaa

SEQ ID NO: 4110537 - RNA, 13 nt, Streptococcus pneumoniae R6
cuuucaucccuuc

SEQ ID NO: 4110538 - RNA, 18 nt, Streptococcus pneumoniae R6
cuuuccauucaaauuuag

SEQ ID NO: 4110539 - RNA, 19 nt, Streptococcus pneumoniae R6
cuuuccuaaucgauuuguu

SEQ ID NO: 4110540 - RNA, 16 nt, Streptococcus pneumoniae R6
cuuuccucgauuuguu

SEQ ID NO: 4110541 - RNA, 16 nt, Streptococcus pneumoniae R6
cuuuccuuaagucugu

SEQ ID NO: 4110542 - RNA, 15 nt, Streptococcus pneumoniae R6
cuuucguuccagacu

SEQ ID NO: 4110543 - RNA, 19 nt, Streptococcus pneumoniae R6
cuuucuaaaauaguggaaa

SEQ ID NO: 4110544 - RNA, 17 nt, Streptococcus pneumoniae R6
cuuucuaauuuuugagc

SEQ ID NO: 4110545 - RNA, 17 nt, Streptococcus pneumoniae R6
cuuucuaguuugcucuu

SEQ ID NO: 4110546 - RNA, 16 nt, Streptococcus pneumoniae R6
cuuucucaaacauugu

SEQ ID NO: 4110547 - RNA, 22 nt, Streptococcus pneumoniae R6
cuuucucacgaauaaccaaaac

SEQ ID NO: 4110548 - RNA, 22 nt, Streptococcus pneumoniae R6
cuuucucacuuaauucuucaua

SEQ ID NO: 4110549 - RNA, 14 nt, Streptococcus pneumoniae R6
cuuucugauagauu

SEQ ID NO: 4110550 - RNA, 21 nt, Streptococcus pneumoniae R6
cuuucugauagauuuauuuuu

SEQ ID NO: 4110551 - RNA, 22 nt, Streptococcus pneumoniae R6
cuuucugauagauuuauuuuug

SEQ ID NO: 4110552 - RNA, 22 nt, Streptococcus pneumoniae R6
cuuucuucauuuuguuagccau

SEQ ID NO: 4110553 - RNA, 16 nt, Streptococcus pneumoniae R6
cuuucuucguuuuuac

SEQ ID NO: 4110554 - RNA, 16 nt, Streptococcus pneumoniae R6
cuuucuuuuuauacuc

SEQ ID NO: 4110555 - RNA, 18 nt, Streptococcus pneumoniae R6
cuuucuuuuuauacucau

SEQ ID NO: 4110556 - RNA, 20 nt, Streptococcus pneumoniae R6
cuuucuuuuuauacucaucu

SEQ ID NO: 4110557 - RNA, 16 nt, Streptococcus pneumoniae R6
cuuucuuuuuuaugga

SEQ ID NO: 4110558 - RNA, 18 nt, Streptococcus pneumoniae R6
cuuucuuuuuuauggaug

SEQ ID NO: 4110559 - RNA, 21 nt, Streptococcus pneumoniae R6
cuuugaaauuuaucaaccacu

SEQ ID NO: 4110560 - RNA, 20 nt, Streptococcus pneumoniae R6
cuuugaaggugauaaucauc

SEQ ID NO: 4110561 - RNA, 21 nt, Streptococcus pneumoniae R6
cuuugaaggugauaaucaucg

SEQ ID NO: 4110562 - RNA, 19 nt, Streptococcus pneumoniae R6
cuuugacaagguuuccugc

SEQ ID NO: 4110563 - RNA, 20 nt, Streptococcus pneumoniae R6
cuuugacauccuuuucugua

SEQ ID NO: 4110564 - RNA, 16 nt, Streptococcus pneumoniae R6
cuuugagauauuucuu

SEQ ID NO: 4110565 - RNA, 19 nt, Streptococcus pneumoniae R6
cuuugagauauuucuucuu

SEQ ID NO: 4110566 - RNA, 21 nt, Streptococcus pneumoniae R6
cuuugagauauuucuucuuuu

SEQ ID NO: 4110567 - RNA, 23 nt, Streptococcus pneumoniae R6
cuuugagauauuucuucuuuuca

SEQ ID NO: 4110568 - RNA, 16 nt, Streptococcus pneumoniae R6
cuuugagaucuuuuuc

SEQ ID NO: 4110569 - RNA, 17 nt, Streptococcus pneumoniae R6
cuuugagaucuuuuucg

SEQ ID NO: 4110570 - RNA, 14 nt, Streptococcus pneumoniae R6
cuuugagcaaccua

SEQ ID NO: 4110571 - RNA, 14 nt, Streptococcus pneumoniae R6
cuuugagcaaccug

SEQ ID NO: 4110572 - RNA, 19 nt, Streptococcus pneumoniae R6
cuuugaggaagguuuuaaa

SEQ ID NO: 4110573 - RNA, 23 nt, Streptococcus pneumoniae R6
cuuugaggaagguuuuaaacaaa

SEQ ID NO: 4110574 - RNA, 17 nt, Streptococcus pneumoniae R6
cuuugauucaucuccaa

SEQ ID NO: 4110575 - RNA, 17 nt, Streptococcus pneumoniae R6
cuuugauuuuaaagaaa

SEQ ID NO: 4110576 - RNA, 22 nt, Streptococcus pneumoniae R6
cuuugauuuuaaugcuaauuua

SEQ ID NO: 4110577 - RNA, 14 nt, Streptococcus pneumoniae R6
cuuugauuuugaga

SEQ ID NO: 4110578 - RNA, 15 nt, Streptococcus pneumoniae R6
cuuugcaacuggaga

SEQ ID NO: 4110579 - RNA, 13 nt, Streptococcus pneumoniae R6
cuuugcauuucau

SEQ ID NO: 4110580 - RNA, 13 nt, Streptococcus pneumoniae R6
cuuugccaguucu

SEQ ID NO: 4110581 - RNA, 18 nt, Streptococcus pneumoniae R6
cuuugccaguucuucaug

SEQ ID NO: 4110582 - RNA, 15 nt, Streptococcus pneumoniae R6
cuuugcgaaguauuc

SEQ ID NO: 4110583 - RNA, 22 nt, Streptococcus pneumoniae R6
cuuugcugacuugccuucaaca

SEQ ID NO: 4110584 - RNA, 17 nt, Streptococcus pneumoniae R6
cuuugcugcuuuccuuc

SEQ ID NO: 4110585 - RNA, 19 nt, Streptococcus pneumoniae R6
cuuuggaaauagcauccac

SEQ ID NO: 4110586 - RNA, 15 nt, Streptococcus pneumoniae R6
cuuuggacauagcca

SEQ ID NO: 4110587 - RNA, 23 nt, Streptococcus pneumoniae R6
cuuuggaggcaauggccuguucu

SEQ ID NO: 4110588 - RNA, 15 nt, Streptococcus pneumoniae R6
cuuuggauauuuuga

SEQ ID NO: 4110589 - RNA, 21 nt, Streptococcus pneumoniae R6
cuuugguugcuacaucuucuc

SEQ ID NO: 4110590 - RNA, 16 nt, Streptococcus pneumoniae R6
cuuuguaaguuucuuc

SEQ ID NO: 4110591 - RNA, 19 nt, Streptococcus pneumoniae R6
cuuuguaaguuucuucuuu

SEQ ID NO: 4110592 - RNA, 20 nt, Streptococcus pneumoniae R6
cuuuguaaguuucuucuuua

SEQ ID NO: 4110593 - RNA, 18 nt, Streptococcus pneumoniae R6
cuuuguaggcuucuucuc

SEQ ID NO: 4110594 - RNA, 13 nt, Streptococcus pneumoniae R6
cuuuguauggaaa

SEQ ID NO: 4110595 - RNA, 18 nt, Streptococcus pneumoniae R6
cuuugucaacuguagugg

SEQ ID NO: 4110596 - RNA, 15 nt, Streptococcus pneumoniae R6
cuuuguccauuauga

SEQ ID NO: 4110597 - RNA, 19 nt, Streptococcus pneumoniae R6
cuuugucuuuagucuuauc

SEQ ID NO: 4110598 - RNA, 14 nt, Streptococcus pneumoniae R6
cuuuguuaaaugaa

SEQ ID NO: 4110599 - RNA, 16 nt, Streptococcus pneumoniae R6
cuuuguucacuuuuug

SEQ ID NO: 4110600 - RNA, 16 nt, Streptococcus pneumoniae R6
cuuuguuccacucgcu

SEQ ID NO: 4110601 - RNA, 21 nt, Streptococcus pneumoniae R6
cuuuguucugaaagugaaaaa

SEQ ID NO: 4110602 - RNA, 19 nt, Streptococcus pneumoniae R6
cuuuuaaaauccauaauua

SEQ ID NO: 4110603 - RNA, 23 nt, Streptococcus pneumoniae R6
cuuuuaaauaguuuaaaacauuu

SEQ ID NO: 4110604 - RNA, 13 nt, Streptococcus pneumoniae R6
cuuuuaaauauuu

SEQ ID NO: 4110605 - RNA, 19 nt, Streptococcus pneumoniae R6
cuuuuaaccagacauagag

SEQ ID NO: 4110606 - RNA, 21 nt, Streptococcus pneumoniae R6
cuuuuaacuucagcuuuuuug

SEQ ID NO: 4110607 - RNA, 15 nt, Streptococcus pneumoniae R6
cuuuuaagaaaucau

SEQ ID NO: 4110608 - RNA, 15 nt, Streptococcus pneumoniae R6
gaaaaagcgaguaga

SEQ ID NO: 4110609 - RNA, 16 nt, Streptococcus pneumoniae R6
gaaaaagucaauaaua

SEQ ID NO: 4110610 - RNA, 17 nt, Streptococcus pneumoniae R6
gaaaaagucaauaauau

SEQ ID NO: 4110611 - RNA, 23 nt, Streptococcus pneumoniae R6
gaaaaaguguuugauaucuauca

SEQ ID NO: 4110612 - RNA, 21 nt, Streptococcus pneumoniae R6
gaaaaaguucucuuucuaaaa

SEQ ID NO: 4110613 - RNA, 23 nt, Streptococcus pneumoniae R6
gaaaaaguucucuuucuaaaaua

SEQ ID NO: 4110614 - RNA, 21 nt, Streptococcus pneumoniae R6
gaaaaauaugcauaauuucca

SEQ ID NO: 4110615 - RNA, 21 nt, Streptococcus pneumoniae R6
gaaaaaucgaggucuaaaucu

SEQ ID NO: 4110616 - RNA, 12 nt, Streptococcus pneumoniae R6
gaaaaaugcaaa

SEQ ID NO: 4110617 - RNA, 19 nt, Streptococcus pneumoniae R6
gaaaaaugcucucaaauac

SEQ ID NO: 4110618 - RNA, 13 nt, Streptococcus pneumoniae R6
gaaaaauuuucaa

SEQ ID NO: 4110619 - RNA, 17 nt, Streptococcus pneumoniae R6
gaaaaauuuucaaaauc

SEQ ID NO: 4110620 - RNA, 16 nt, Streptococcus pneumoniae R6
gaaaacagaaaaaucu

SEQ ID NO: 4110621 - RNA, 15 nt, Streptococcus pneumoniae R6
gaaaacagacaaaac

SEQ ID NO: 4110622 - RNA, 16 nt, Streptococcus pneumoniae R6
gaaaacagacaaaacu

SEQ ID NO: 4110623 - RNA, 22 nt, Streptococcus pneumoniae R6
gaaaacaggaguucuuuuacaa

SEQ ID NO: 4110624 - RNA, 15 nt, Streptococcus pneumoniae R6
gaaaacccaccugaa

SEQ ID NO: 4110625 - RNA, 17 nt, Streptococcus pneumoniae R6
gaaaacccaccugaauu

SEQ ID NO: 4110626 - RNA, 23 nt, Streptococcus pneumoniae R6
gaaaacgauaauagcgauugaau

SEQ ID NO: 4110627 - RNA, 19 nt, Streptococcus pneumoniae R6
gaaaacugaugaagucaag

SEQ ID NO: 4110628 - RNA, 20 nt, Streptococcus pneumoniae R6
gaaaacugaugaagucaagu

SEQ ID NO: 4110629 - RNA, 20 nt, Streptococcus pneumoniae R6
gaaaagaauuaggaaaacau

SEQ ID NO: 4110630 - RNA, 18 nt, Streptococcus pneumoniae R6
gaaaagacuuagucuucu

SEQ ID NO: 4110631 - RNA, 22 nt, Streptococcus pneumoniae R6
gaaaagauggaguguucuaaaa

SEQ ID NO: 4110632 - RNA, 17 nt, Streptococcus pneumoniae R6
gaaaagcaagagcugau

SEQ ID NO: 4110633 - RNA, 18 nt, Streptococcus pneumoniae R6
gaaaagcccuucauaagc

SEQ ID NO: 4110634 - RNA, 18 nt, Streptococcus pneumoniae R6
gaaaagcguucaaagacu

SEQ ID NO: 4110635 - RNA, 15 nt, Streptococcus pneumoniae R6
gaaaagcuaagcucg

SEQ ID NO: 4110636 - RNA, 17 nt, Streptococcus pneumoniae R6
gaaaaggcagauucucu

SEQ ID NO: 4110637 - RNA, 18 nt, Streptococcus pneumoniae R6
gaaaaggcagauucucua

SEQ ID NO: 4110638 - RNA, 20 nt, Streptococcus pneumoniae R6
gaaaaggguggaaucacgaa

SEQ ID NO: 4110639 - RNA, 18 nt, Streptococcus pneumoniae R6
gaaaaguaaugccaggcc

SEQ ID NO: 4110640 - RNA, 15 nt, Streptococcus pneumoniae R6
gaaaaguaggacgau

SEQ ID NO: 4110641 - RNA, 20 nt, Streptococcus pneumoniae R6
gaaaaguaggacgauaaaaa

SEQ ID NO: 4110642 - RNA, 15 nt, Streptococcus pneumoniae R6
gaaaagucuuauaau

SEQ ID NO: 4110643 - RNA, 20 nt, Streptococcus pneumoniae R6
gaaaagucuuauaauauagg

SEQ ID NO: 4110644 - RNA, 20 nt, Streptococcus pneumoniae R6
gaaaauaaaauuccuuuaaa

SEQ ID NO: 4110645 - RNA, 18 nt, Streptococcus pneumoniae R6
gaaaauaaaguaaaaauu

SEQ ID NO: 4110646 - RNA, 13 nt, Streptococcus pneumoniae R6
gaaaauagaaaaa

SEQ ID NO: 4110647 - RNA, 14 nt, Streptococcus pneumoniae R6
gaaaauagaaaaaa

SEQ ID NO: 4110648 - RNA, 15 nt, Streptococcus pneumoniae R6
gaaaauagaaaaaau

SEQ ID NO: 4110649 - RNA, 23 nt, Streptococcus pneumoniae R6
gaaaauaguuuuugcaauauuga

SEQ ID NO: 4110650 - RNA, 22 nt, Streptococcus pneumoniae R6
gaaaauauuucgcuuauaaacu

SEQ ID NO: 4110651 - RNA, 13 nt, Streptococcus pneumoniae R6
gaaaaucaaagag

SEQ ID NO: 4110652 - RNA, 14 nt, Streptococcus pneumoniae R6
gaaaaucaaagagc

SEQ ID NO: 4110653 - RNA, 19 nt, Streptococcus pneumoniae R6
gaaaaucauagagcaaacu

SEQ ID NO: 4110654 - RNA, 18 nt, Streptococcus pneumoniae R6
gaaaaucgcaaguuuuuc

SEQ ID NO: 4110655 - RNA, 22 nt, Streptococcus pneumoniae R6
gaaaaucuccucuaccugccuu

SEQ ID NO: 4110656 - RNA, 13 nt, Streptococcus pneumoniae R6
gaaaaucucuuca

SEQ ID NO: 4110657 - RNA, 17 nt, Streptococcus pneumoniae R6
gaaaaucucuucaaacc

SEQ ID NO: 4110658 - RNA, 19 nt, Streptococcus pneumoniae R6
gaaaaucucuucaaaccau

SEQ ID NO: 4110659 - RNA, 17 nt, Streptococcus pneumoniae R6
gaaaaucucuucaaacu

SEQ ID NO: 4110660 - RNA, 14 nt, Streptococcus pneumoniae R6
gaaaaugaaacccu

SEQ ID NO: 4110661 - RNA, 15 nt, Streptococcus pneumoniae R6
gaaaaugaaagagca

SEQ ID NO: 4110662 - RNA, 11 nt, Streptococcus pneumoniae R6
gaaaaugaauu

SEQ ID NO: 4110663 - RNA, 22 nt, Streptococcus pneumoniae R6
gaaaaugaauuugaaacaauga

SEQ ID NO: 4110664 - RNA, 14 nt, Streptococcus pneumoniae R6
gaaaaugaggaaaa

SEQ ID NO: 4110665 - RNA, 19 nt, Streptococcus pneumoniae R6
gaaaauucucuuuucauac

SEQ ID NO: 4110666 - RNA, 22 nt, Streptococcus pneumoniae R6
gaaaauuuccauuggacagggu

SEQ ID NO: 4110667 - RNA, 17 nt, Streptococcus pneumoniae R6
gaaacaaaauauauaau

SEQ ID NO: 4110668 - RNA, 18 nt, Streptococcus pneumoniae R6
gaaacaaccgauaagaau

SEQ ID NO: 4110669 - RNA, 18 nt, Streptococcus pneumoniae R6
gaaacaauaaaaucaaac

SEQ ID NO: 4110670 - RNA, 21 nt, Streptococcus pneumoniae R6
gaaacagcugcgauaaggaag

SEQ ID NO: 4110671 - RNA, 15 nt, Streptococcus pneumoniae R6
gaaacagugaugaga

SEQ ID NO: 4110672 - RNA, 21 nt, Streptococcus pneumoniae R6
gaaacaugaaguguuguaaag

SEQ ID NO: 4110673 - RNA, 15 nt, Streptococcus pneumoniae R6
gaaacauucaaaucc

SEQ ID NO: 4110674 - RNA, 23 nt, Streptococcus pneumoniae R6
gaaaccaguccacguuuuuccag

SEQ ID NO: 4110675 - RNA, 20 nt, Streptococcus pneumoniae R6
gaaaccuaaucauagugaga

SEQ ID NO: 4110676 - RNA, 20 nt, Streptococcus pneumoniae R6
gaaacggaggauuuuugaau

SEQ ID NO: 4110677 - RNA, 21 nt, Streptococcus pneumoniae R6
gaaacggcauaaaaucugaau

SEQ ID NO: 4110678 - RNA, 21 nt, Streptococcus pneumoniae R6
gaaacguccaaggcugaaauu

SEQ ID NO: 4110679 - RNA, 15 nt, Streptococcus pneumoniae R6
gaaacgugggcugau

SEQ ID NO: 4110680 - RNA, 15 nt, Streptococcus pneumoniae R6
gaaacuacuuucaga

SEQ ID NO: 4110681 - RNA, 16 nt, Streptococcus pneumoniae R6
gaaacuagcauccauc

SEQ ID NO: 4110682 - RNA, 19 nt, Streptococcus pneumoniae R6
gaaacucaaaagaagauug

SEQ ID NO: 4110683 - RNA, 15 nt, Streptococcus pneumoniae R6
gaaacucaggaugua

SEQ ID NO: 4110684 - RNA, 23 nt, Streptococcus pneumoniae R6
gaaacucuaaacaaacuccucuc

SEQ ID NO: 4110685 - RNA, 22 nt, Streptococcus pneumoniae R6
gaaacuguggaaaauagaaaaa

SEQ ID NO: 4110686 - RNA, 14 nt, Streptococcus pneumoniae R6
gaaagaaaaacugc

SEQ ID NO: 4110687 - RNA, 20 nt, Streptococcus pneumoniae R6
gaaagaaccacgguaaaaua

SEQ ID NO: 4110688 - RNA, 14 nt, Streptococcus pneumoniae R6
gaaagaagagggcu

SEQ ID NO: 4110689 - RNA, 22 nt, Streptococcus pneumoniae R6
gaaagaagguauucauaaaaua

SEQ ID NO: 4110690 - RNA, 20 nt, Streptococcus pneumoniae R6
gaaagaauccaauucaaagu

SEQ ID NO: 4110691 - RNA, 17 nt, Streptococcus pneumoniae R6
gaaagacuagggaaaca

SEQ ID NO: 4110692 - RNA, 14 nt, Streptococcus pneumoniae R6
gaaagacuugauuu

SEQ ID NO: 4110693 - RNA, 18 nt, Streptococcus pneumoniae R6
gaaagagcaggaguugau

SEQ ID NO: 4110694 - RNA, 21 nt, Streptococcus pneumoniae R6
gaaagauaacugcuagaaaug

SEQ ID NO: 4110695 - RNA, 13 nt, Streptococcus pneumoniae R6
gaaagauuaccaa

SEQ ID NO: 4110696 - RNA, 15 nt, Streptococcus pneumoniae R6
gaaagcacuugcuuu

SEQ ID NO: 4110697 - RNA, 14 nt, Streptococcus pneumoniae R6
gaaagcaucuccau

SEQ ID NO: 4110698 - RNA, 13 nt, Streptococcus pneumoniae R6
gaaagcucuucua

SEQ ID NO: 4110699 - RNA, 14 nt, Streptococcus pneumoniae R6
gaaaggaaaauuga

SEQ ID NO: 4110700 - RNA, 16 nt, Streptococcus pneumoniae R6
gaaaggaagagagcuc

SEQ ID NO: 4110701 - RNA, 14 nt, Streptococcus pneumoniae R6
gaaaggaaucugcg

SEQ ID NO: 4110702 - RNA, 12 nt, Streptococcus pneumoniae R6
gaaaggagaaaa

SEQ ID NO: 4110703 - RNA, 13 nt, Streptococcus pneumoniae R6
gaaaggagaaaaa

SEQ ID NO: 4110704 - RNA, 14 nt, Streptococcus pneumoniae R6
gaaaggagaaaaaa

SEQ ID NO: 4110705 - RNA, 17 nt, Streptococcus pneumoniae R6
gaaaggagaaaaaauau

SEQ ID NO: 4110706 - RNA, 21 nt, Streptococcus pneumoniae R6
gaaaggauaugaggagaaaga

SEQ ID NO: 4110707 - RNA, 23 nt, Streptococcus pneumoniae R6
gaaaggauaugaggagaaagaag

SEQ ID NO: 4110708 - RNA, 16 nt, Streptococcus pneumoniae R6
gaaagguaaaauauag

SEQ ID NO: 4110709 - RNA, 15 nt, Streptococcus pneumoniae R6
gaaaguaaaauuaau

SEQ ID NO: 4110710 - RNA, 19 nt, Streptococcus pneumoniae R6
gaacucuagcuuuuuaauu

SEQ ID NO: 4110711 - RNA, 17 nt, Streptococcus pneumoniae R6
gaacugacgaagucagc

SEQ ID NO: 4110712 - RNA, 19 nt, Streptococcus pneumoniae R6
gaacugacgaagucagcuc

SEQ ID NO: 4110713 - RNA, 17 nt, Streptococcus pneumoniae R6
gaacugacgaagucagu

SEQ ID NO: 4110714 - RNA, 23 nt, Streptococcus pneumoniae R6
gaacugcuaccaauucaguaacu

SEQ ID NO: 4110715 - RNA, 18 nt, Streptococcus pneumoniae R6
gaacugggugcguacagc

SEQ ID NO: 4110716 - RNA, 21 nt, Streptococcus pneumoniae R6
gaacuugugcaacuuccaugu

SEQ ID NO: 4110717 - RNA, 14 nt, Streptococcus pneumoniae R6
gaacuuucuuuuuu

SEQ ID NO: 4110718 - RNA, 17 nt, Streptococcus pneumoniae R6
gaacuuuuuaaaguauu

SEQ ID NO: 4110719 - RNA, 16 nt, Streptococcus pneumoniae R6
gaagaaaagcuaagcu

SEQ ID NO: 4110720 - RNA, 19 nt, Streptococcus pneumoniae R6
gaagaacaauccaaauaag

SEQ ID NO: 4110721 - RNA, 15 nt, Streptococcus pneumoniae R6
gaagaacauuuggaa

SEQ ID NO: 4110722 - RNA, 17 nt, Streptococcus pneumoniae R6
gaagaagcuguaaaucu

SEQ ID NO: 4110723 - RNA, 12 nt, Streptococcus pneumoniae R6
gaagaaggaaga

SEQ ID NO: 4110724 - RNA, 15 nt, Streptococcus pneumoniae R6
gaagaaggaagaguc

SEQ ID NO: 4110725 - RNA, 12 nt, Streptococcus pneumoniae R6
gaagaaggccaa

SEQ ID NO: 4110726 - RNA, 15 nt, Streptococcus pneumoniae R6
gaagaauguuuucag

SEQ ID NO: 4110727 - RNA, 23 nt, Streptococcus pneumoniae R6
gaagaccacgaugaugauuggaa

SEQ ID NO: 4110728 - RNA, 21 nt, Streptococcus pneumoniae R6
gaagacgccuaguacauugaa

SEQ ID NO: 4110729 - RNA, 21 nt, Streptococcus pneumoniae R6
gaagacuggaguucaccagua

SEQ ID NO: 4110730 - RNA, 16 nt, Streptococcus pneumoniae R6
gaagacuuuaaaaauu

SEQ ID NO: 4110731 - RNA, 20 nt, Streptococcus pneumoniae R6
gaagagagcuccaaauggca

SEQ ID NO: 4110732 - RNA, 21 nt, Streptococcus pneumoniae R6
gaagagauuuucgaagaguau

SEQ ID NO: 4110733 - RNA, 19 nt, Streptococcus pneumoniae R6
gaagagauuuuugaagagu

SEQ ID NO: 4110734 - RNA, 14 nt, Streptococcus pneumoniae R6
gaagagcuuugcuu

SEQ ID NO: 4110735 - RNA, 12 nt, Streptococcus pneumoniae R6
gaagagggcuuc

SEQ ID NO: 4110736 - RNA, 23 nt, Streptococcus pneumoniae R6
gaagagguaucuguagaguuuug

SEQ ID NO: 4110737 - RNA, 19 nt, Streptococcus pneumoniae R6
gaagaguugggucuggaua

SEQ ID NO: 4110738 - RNA, 21 nt, Streptococcus pneumoniae R6
gaagaguugggucuggauacu

SEQ ID NO: 4110739 - RNA, 18 nt, Streptococcus pneumoniae R6
gaagauguaaaaguuuau

SEQ ID NO: 4110740 - RNA, 23 nt, Streptococcus pneumoniae R6
gaagauuuacuucuuuuucuccu

SEQ ID NO: 4110741 - RNA, 15 nt, Streptococcus pneumoniae R6
gaagauuuccuccau

SEQ ID NO: 4110742 - RNA, 16 nt, Streptococcus pneumoniae R6
gaagauuuccugauuu

SEQ ID NO: 4110743 - RNA, 15 nt, Streptococcus pneumoniae R6
gaagauuucuuucau

SEQ ID NO: 4110744 - RNA, 18 nt, Streptococcus pneumoniae R6
gaagcaaaucaacuggca

SEQ ID NO: 4110745 - RNA, 20 nt, Streptococcus pneumoniae R6
gaagcacacaaaucuucugu

SEQ ID NO: 4110746 - RNA, 22 nt, Streptococcus pneumoniae R6
gaagcaucaaauccuucagcuu

SEQ ID NO: 4110747 - RNA, 13 nt, Streptococcus pneumoniae R6
gaagccaaucaaa

SEQ ID NO: 4110748 - RNA, 15 nt, Streptococcus pneumoniae R6
gaagccaaucaaacu

SEQ ID NO: 4110749 - RNA, 23 nt, Streptococcus pneumoniae R6
gaagccauccuugguaacaacac

SEQ ID NO: 4110750 - RNA, 23 nt, Streptococcus pneumoniae R6
gaagcgagucgcaggcuguacuu

SEQ ID NO: 4110751 - RNA, 15 nt, Streptococcus pneumoniae R6
gaagcgaugauaaga

SEQ ID NO: 4110752 - RNA, 19 nt, Streptococcus pneumoniae R6
gaagcguucaaucagauag

SEQ ID NO: 4110753 - RNA, 22 nt, Streptococcus pneumoniae R6
gaagcuauccuggcguaguaaa

SEQ ID NO: 4110754 - RNA, 14 nt, Streptococcus pneumoniae R6
gaagcugagcucuu

SEQ ID NO: 4110755 - RNA, 13 nt, Streptococcus pneumoniae R6
gaagcugcuuuca

SEQ ID NO: 4110756 - RNA, 22 nt, Streptococcus pneumoniae R6
gaagcugucuuuaguagucuaa

SEQ ID NO: 4110757 - RNA, 15 nt, Streptococcus pneumoniae R6
gaagcuuccaauaau

SEQ ID NO: 4110758 - RNA, 23 nt, Streptococcus pneumoniae R6
gaagcuuccaauaauagaaaaca

SEQ ID NO: 4110759 - RNA, 18 nt, Streptococcus pneumoniae R6
gaaggaacuaacucauca

SEQ ID NO: 4110760 - RNA, 16 nt, Streptococcus pneumoniae R6
gaaggagccagcugaa

SEQ ID NO: 4110761 - RNA, 15 nt, Streptococcus pneumoniae R6
gaaggaguuucaccu

SEQ ID NO: 4110762 - RNA, 16 nt, Streptococcus pneumoniae R6
gaaggaguuucaccuu

SEQ ID NO: 4110763 - RNA, 23 nt, Streptococcus pneumoniae R6
gaaggaguuucaccuugccaucu

SEQ ID NO: 4110764 - RNA, 16 nt, Streptococcus pneumoniae R6
gaaggauugagaagcc

SEQ ID NO: 4110765 - RNA, 18 nt, Streptococcus pneumoniae R6
gaaggauuuaguucugua

SEQ ID NO: 4110766 - RNA, 20 nt, Streptococcus pneumoniae R6
gaaggcuuuaccaaaaaugu

SEQ ID NO: 4110767 - RNA, 15 nt, Streptococcus pneumoniae R6
gaaggucaagagaaa

SEQ ID NO: 4110768 - RNA, 16 nt, Streptococcus pneumoniae R6
gaaggucaagagaaaa

SEQ ID NO: 4110769 - RNA, 22 nt, Streptococcus pneumoniae R6
gaaggucuuucaagcgaacauc

SEQ ID NO: 4110770 - RNA, 16 nt, Streptococcus pneumoniae R6
gaaggucuuuugucuu

SEQ ID NO: 4110771 - RNA, 22 nt, Streptococcus pneumoniae R6
gaagguuucauguggugcuucu

SEQ ID NO: 4110772 - RNA, 12 nt, Streptococcus pneumoniae R6
gaaguaaaucuu

SEQ ID NO: 4110773 - RNA, 17 nt, Streptococcus pneumoniae R6
gaaguaaaucuucccau

SEQ ID NO: 4110774 - RNA, 18 nt, Streptococcus pneumoniae R6
gaaguaaaucuucccaua

SEQ ID NO: 4110775 - RNA, 21 nt, Streptococcus pneumoniae R6
gaaguaggccaaacuugaaau

SEQ ID NO: 4110776 - RNA, 23 nt, Streptococcus pneumoniae R6
gaaguaggccaaacuugaaauga

SEQ ID NO: 4110777 - RNA, 13 nt, Streptococcus pneumoniae R6
gaagucaagccuc

SEQ ID NO: 4110778 - RNA, 23 nt, Streptococcus pneumoniae R6
gaagucaccauaaaucuugaugu

SEQ ID NO: 4110779 - RNA, 15 nt, Streptococcus pneumoniae R6
gaagucagcuaagcu

SEQ ID NO: 4110780 - RNA, 17 nt, Streptococcus pneumoniae R6
gaagucagcuaagcucg

SEQ ID NO: 4110781 - RNA, 15 nt, Streptococcus pneumoniae R6
gaagucagcucaaaa

SEQ ID NO: 4110782 - RNA, 16 nt, Streptococcus pneumoniae R6
gaagucagcucaaaac

SEQ ID NO: 4110783 - RNA, 24 nt, Streptococcus pneumoniae R6
gaagucagcucaaaacaguguuuu

SEQ ID NO: 4110784 - RNA, 18 nt, Streptococcus pneumoniae R6
gaagucagucacauauau

SEQ ID NO: 4110785 - RNA, 22 nt, Streptococcus pneumoniae R6
gaagucagucacauauauaauc

SEQ ID NO: 4110786 - RNA, 14 nt, Streptococcus pneumoniae R6
gaagucaucuauca

SEQ ID NO: 4110787 - RNA, 16 nt, Streptococcus pneumoniae R6
gaaguccaagcccagu

SEQ ID NO: 4110788 - RNA, 23 nt, Streptococcus pneumoniae R6
gaaguccauaaugucuucugcuc

SEQ ID NO: 4110789 - RNA, 17 nt, Streptococcus pneumoniae R6
gaagucuauuauauaua

SEQ ID NO: 4110790 - RNA, 23 nt, Streptococcus pneumoniae R6
gaagugaaaggagcgauugaaga

SEQ ID NO: 4110791 - RNA, 23 nt, Streptococcus pneumoniae R6
gaagugccaguguacuagucuaa

SEQ ID NO: 4110792 - RNA, 14 nt, Streptococcus pneumoniae R6
gaaguggauuuucu

SEQ ID NO: 4110793 - RNA, 20 nt, Streptococcus pneumoniae R6
gaaguuaaguuuuuugacuu

SEQ ID NO: 4110794 - RNA, 18 nt, Streptococcus pneumoniae R6
gaaguucaguagauuaaa

SEQ ID NO: 4110795 - RNA, 15 nt, Streptococcus pneumoniae R6
gaaguucauuuucuu

SEQ ID NO: 4110796 - RNA, 20 nt, Streptococcus pneumoniae R6
gaaguucauuuucuuuacuu

SEQ ID NO: 4110797 - RNA, 23 nt, Streptococcus pneumoniae R6
gaaguucauuuucuuuacuucug

SEQ ID NO: 4110798 - RNA, 24 nt, Streptococcus pneumoniae R6
gaaguugauucaugacaucuucca

SEQ ID NO: 4110799 - RNA, 16 nt, Streptococcus pneumoniae R6
gaaguuggaauagucc

SEQ ID NO: 4110800 - RNA, 16 nt, Streptococcus pneumoniae R6
gaaguuggucucccaa

SEQ ID NO: 4110801 - RNA, 15 nt, Streptococcus pneumoniae R6
gaaguuguucuugaa

SEQ ID NO: 4110802 - RNA, 14 nt, Streptococcus pneumoniae R6
gaaguuuucaaagu

SEQ ID NO: 4110803 - RNA, 21 nt, Streptococcus pneumoniae R6
gaauaaagaaacuuggcaaaa

SEQ ID NO: 4110804 - RNA, 17 nt, Streptococcus pneumoniae R6
gaauaacagccaucaga

SEQ ID NO: 4110805 - RNA, 20 nt, Streptococcus pneumoniae R6
gaauaacucaaaagcuuguu

SEQ ID NO: 4110806 - RNA, 13 nt, Streptococcus pneumoniae R6
gaauaaugcccau

SEQ ID NO: 4110807 - RNA, 15 nt, Streptococcus pneumoniae R6
gaauaauuaaaucau

SEQ ID NO: 4110808 - RNA, 16 nt, Streptococcus pneumoniae R6
gaauacaaaaaucuaa

SEQ ID NO: 4110809 - RNA, 17 nt, Streptococcus pneumoniae R6
gaauaccugaaaccauu

SEQ ID NO: 4110810 - RNA, 18 nt, Streptococcus pneumoniae R6
gaauacucuuuacuuugc

SEQ ID NO: 4110811 - RNA, 12 nt, Streptococcus pneumoniae R6
gaauagaaaaau

SEQ ID NO: 4110812 - RNA, 14 nt, Streptococcus pneumoniae R6
gacgagaaucgaac

SEQ ID NO: 4110813 - RNA, 14 nt, Streptococcus pneumoniae R6
gacgagugaagaau

SEQ ID NO: 4110814 - RNA, 21 nt, Streptococcus pneumoniae R6
gacgaguuaaaacaaagaaaa

SEQ ID NO: 4110815 - RNA, 23 nt, Streptococcus pneumoniae R6
gacgaguuaaaacaaagaaaaag

SEQ ID NO: 4110816 - RNA, 21 nt, Streptococcus pneumoniae R6
gacgauuaaaaguaagagaaa

SEQ ID NO: 4110817 - RNA, 13 nt, Streptococcus pneumoniae R6
gacgauuccaaac

SEQ ID NO: 4110818 - RNA, 16 nt, Streptococcus pneumoniae R6
gacgauuuucucuuug

SEQ ID NO: 4110819 - RNA, 18 nt, Streptococcus pneumoniae R6
gacgauuuucucuuuguc

SEQ ID NO: 4110820 - RNA, 21 nt, Streptococcus pneumoniae R6
gacgauuuucucuuuguccuu

SEQ ID NO: 4110821 - RNA, 21 nt, Streptococcus pneumoniae R6
gacgauuuuuucuuuguucuu

SEQ ID NO: 4110822 - RNA, 12 nt, Streptococcus pneumoniae R6
gacggucaugcg

SEQ ID NO: 4110823 - RNA, 16 nt, Streptococcus pneumoniae R6
gacgugguuuaaaaag

SEQ ID NO: 4110824 - RNA, 16 nt, Streptococcus pneumoniae R6
gacgugguuugaagag

SEQ ID NO: 4110825 - RNA, 18 nt, Streptococcus pneumoniae R6
gacguucuucaagagcuu

SEQ ID NO: 4110826 - RNA, 15 nt, Streptococcus pneumoniae R6
gacguucuucugcag

SEQ ID NO: 4110827 - RNA, 17 nt, Streptococcus pneumoniae R6
gacguucuucugcaguu

SEQ ID NO: 4110828 - RNA, 14 nt, Streptococcus pneumoniae R6
gacguuuaucaaua

SEQ ID NO: 4110829 - RNA, 13 nt, Streptococcus pneumoniae R6
gacguuuucagau

SEQ ID NO: 4110830 - RNA, 19 nt, Streptococcus pneumoniae R6
gacguuuucuccuuugagg

SEQ ID NO: 4110831 - RNA, 16 nt, Streptococcus pneumoniae R6
gacuaaauacaaaaac

SEQ ID NO: 4110832 - RNA, 19 nt, Streptococcus pneumoniae R6
gacuaaauacaaaaacaaa

SEQ ID NO: 4110833 - RNA, 20 nt, Streptococcus pneumoniae R6
gacuaacuucuuauuagcaa

SEQ ID NO: 4110834 - RNA, 14 nt, Streptococcus pneumoniae R6
gacuacauuuuuug

SEQ ID NO: 4110835 - RNA, 14 nt, Streptococcus pneumoniae R6
gacuacuaaaacau

SEQ ID NO: 4110836 - RNA, 19 nt, Streptococcus pneumoniae R6
gacuagauaaaagaaugcu

SEQ ID NO: 4110837 - RNA, 12 nt, Streptococcus pneumoniae R6
gacuagcaauca

SEQ ID NO: 4110838 - RNA, 14 nt, Streptococcus pneumoniae R6
gacuagcaaucaaa

SEQ ID NO: 4110839 - RNA, 14 nt, Streptococcus pneumoniae R6
gacuaggcggcugg

SEQ ID NO: 4110840 - RNA, 14 nt, Streptococcus pneumoniae R6
gacuauagcagauu

SEQ ID NO: 4110841 - RNA, 22 nt, Streptococcus pneumoniae R6
gacuauagcguuuugaaacuag

SEQ ID NO: 4110842 - RNA, 20 nt, Streptococcus pneumoniae R6
gacuauuaaccuugucuucu

SEQ ID NO: 4110843 - RNA, 14 nt, Streptococcus pneumoniae R6
gacuauuugaguaa

SEQ ID NO: 4110844 - RNA, 15 nt, Streptococcus pneumoniae R6
gacucagcuucugcu

SEQ ID NO: 4110845 - RNA, 16 nt, Streptococcus pneumoniae R6
gacucaucuguagguu

SEQ ID NO: 4110846 - RNA, 21 nt, Streptococcus pneumoniae R6
gacuccaccauaguguuucuc

SEQ ID NO: 4110847 - RNA, 24 nt, Streptococcus pneumoniae R6
gacuccaccauaguguuucucugu

SEQ ID NO: 4110848 - RNA, 14 nt, Streptococcus pneumoniae R6
gacuccuacaaagc

SEQ ID NO: 4110849 - RNA, 15 nt, Streptococcus pneumoniae R6
gacugaaaauauuuc

SEQ ID NO: 4110850 - RNA, 19 nt, Streptococcus pneumoniae R6
gacugaaaauauuucgcuu

SEQ ID NO: 4110851 - RNA, 20 nt, Streptococcus pneumoniae R6
gacugaaauacggauaacgu

SEQ ID NO: 4110852 - RNA, 23 nt, Streptococcus pneumoniae R6
gacugacgaagucagcucaaaac

SEQ ID NO: 4110853 - RNA, 16 nt, Streptococcus pneumoniae R6
gacugagccaauuaaa

SEQ ID NO: 4110854 - RNA, 22 nt, Streptococcus pneumoniae R6
gacugauuaaauagagccuucu

SEQ ID NO: 4110855 - RNA, 14 nt, Streptococcus pneumoniae R6
gacugauuuacaaa

SEQ ID NO: 4110856 - RNA, 16 nt, Streptococcus pneumoniae R6
gacugccucucuucug

SEQ ID NO: 4110857 - RNA, 17 nt, Streptococcus pneumoniae R6
gacugccuuuauuuuuu

SEQ ID NO: 4110858 - RNA, 18 nt, Streptococcus pneumoniae R6
gacugcgauuggggauug

SEQ ID NO: 4110859 - RNA, 21 nt, Streptococcus pneumoniae R6
gacuggaauucucuaagugau

SEQ ID NO: 4110860 - RNA, 15 nt, Streptococcus pneumoniae R6
gacuggugugauuuu

SEQ ID NO: 4110861 - RNA, 14 nt, Streptococcus pneumoniae R6
gacugguuuccuag

SEQ ID NO: 4110862 - RNA, 15 nt, Streptococcus pneumoniae R6
gacugucaauauaga

SEQ ID NO: 4110863 - RNA, 14 nt, Streptococcus pneumoniae R6
gacuguuucagaga

SEQ ID NO: 4110864 - RNA, 24 nt, Streptococcus pneumoniae R6
gacuguuugagaugauuugcucaa

SEQ ID NO: 4110865 - RNA, 18 nt, Streptococcus pneumoniae R6
gacuuaaauagaaaaaca

SEQ ID NO: 4110866 - RNA, 15 nt, Streptococcus pneumoniae R6
gacuucaacccacua

SEQ ID NO: 4110867 - RNA, 20 nt, Streptococcus pneumoniae R6
gacuucacacuuaaguguug

SEQ ID NO: 4110868 - RNA, 19 nt, Streptococcus pneumoniae R6
gacuucccagccuaccugc

SEQ ID NO: 4110869 - RNA, 15 nt, Streptococcus pneumoniae R6
gacuuccuuuucuua

SEQ ID NO: 4110870 - RNA, 13 nt, Streptococcus pneumoniae R6
gacuucgucaguc

SEQ ID NO: 4110871 - RNA, 13 nt, Streptococcus pneumoniae R6
gacuucgucaguu

SEQ ID NO: 4110872 - RNA, 16 nt, Streptococcus pneumoniae R6
gacuucgucaguucua

SEQ ID NO: 4110873 - RNA, 21 nt, Streptococcus pneumoniae R6
gacuucgucaguucuauccac

SEQ ID NO: 4110874 - RNA, 22 nt, Streptococcus pneumoniae R6
gacuucgucaguucuauccaca

SEQ ID NO: 4110875 - RNA, 17 nt, Streptococcus pneumoniae R6
gacuucgucaguuucau

SEQ ID NO: 4110876 - RNA, 20 nt, Streptococcus pneumoniae R6
gacuucgucaguuucaucua

SEQ ID NO: 4110877 - RNA, 21 nt, Streptococcus pneumoniae R6
gacuucgucguaaccuucuuc

SEQ ID NO: 4110878 - RNA, 18 nt, Streptococcus pneumoniae R6
gacuucugagcuacuaua

SEQ ID NO: 4110879 - RNA, 14 nt, Streptococcus pneumoniae R6
gacuucuuaaucaa

SEQ ID NO: 4110880 - RNA, 20 nt, Streptococcus pneumoniae R6
gacuugaaauacuaaaaaaa

SEQ ID NO: 4110881 - RNA, 15 nt, Streptococcus pneumoniae R6
gacuugcuugccaug

SEQ ID NO: 4110882 - RNA, 16 nt, Streptococcus pneumoniae R6
gacuuggaaccagccu

SEQ ID NO: 4110883 - RNA, 14 nt, Streptococcus pneumoniae R6
gacuuggccaauuc

SEQ ID NO: 4110884 - RNA, 14 nt, Streptococcus pneumoniae R6
gacuugguaaaaug

SEQ ID NO: 4110885 - RNA, 12 nt, Streptococcus pneumoniae R6
gacuuguguuuu

SEQ ID NO: 4110886 - RNA, 19 nt, Streptococcus pneumoniae R6
gacuuguguuuuuccuuug

SEQ ID NO: 4110887 - RNA, 23 nt, Streptococcus pneumoniae R6
gacuuuaucaccuccuucuccaa

SEQ ID NO: 4110888 - RNA, 12 nt, Streptococcus pneumoniae R6
gacuuucaauuc

SEQ ID NO: 4110889 - RNA, 15 nt, Streptococcus pneumoniae R6
gacuuucaauucuuc

SEQ ID NO: 4110890 - RNA, 17 nt, Streptococcus pneumoniae R6
gacuuucaauucuucac

SEQ ID NO: 4110891 - RNA, 14 nt, Streptococcus pneumoniae R6
gacuuuccacaauu

SEQ ID NO: 4110892 - RNA, 15 nt, Streptococcus pneumoniae R6
gacuuucucacgaau

SEQ ID NO: 4110893 - RNA, 21 nt, Streptococcus pneumoniae R6
gacuuucucacgaauaaccaa

SEQ ID NO: 4110894 - RNA, 22 nt, Streptococcus pneumoniae R6
gacuuucuuguuuucuuaucuu

SEQ ID NO: 4110895 - RNA, 12 nt, Streptococcus pneumoniae R6
gacuuuuuucua

SEQ ID NO: 4110896 - RNA, 14 nt, Streptococcus pneumoniae R6
gagaaaaaauaugg

SEQ ID NO: 4110897 - RNA, 17 nt, Streptococcus pneumoniae R6
gagaaaaagccuccaga

SEQ ID NO: 4110898 - RNA, 21 nt, Streptococcus pneumoniae R6
gagaaaauaugggcuuacauc

SEQ ID NO: 4110899 - RNA, 16 nt, Streptococcus pneumoniae R6
gagaaacaagaacucu

SEQ ID NO: 4110900 - RNA, 18 nt, Streptococcus pneumoniae R6
gagaaacaauaaaaucaa

SEQ ID NO: 4110901 - RNA, 17 nt, Streptococcus pneumoniae R6
gagaaacuuagcgaaau

SEQ ID NO: 4110902 - RNA, 16 nt, Streptococcus pneumoniae R6
gagaaagaaaaacugc

SEQ ID NO: 4110903 - RNA, 17 nt, Streptococcus pneumoniae R6
gagaaagaaaaacugcu

SEQ ID NO: 4110904 - RNA, 23 nt, Streptococcus pneumoniae R6
gagaaagaaaaacugcuuagaac

SEQ ID NO: 4110905 - RNA, 16 nt, Streptococcus pneumoniae R6
gagaaagaagagggcu

SEQ ID NO: 4110906 - RNA, 13 nt, Streptococcus pneumoniae R6
gagaaagaucauu

SEQ ID NO: 4110907 - RNA, 18 nt, Streptococcus pneumoniae R6
gagaaagauuuucaaagu

SEQ ID NO: 4110908 - RNA, 11 nt, Streptococcus pneumoniae R6
gagaaaggaca

SEQ ID NO: 4110909 - RNA, 16 nt, Streptococcus pneumoniae R6
gagaaaggacaaauuu

SEQ ID NO: 4110910 - RNA, 12 nt, Streptococcus pneumoniae R6
gagaaagucagc

SEQ ID NO: 4110911 - RNA, 20 nt, Streptococcus pneumoniae R6
gagaaaguuugguuugcgca

SEQ ID NO: 4110912 - RNA, 14 nt, Streptococcus pneumoniae R6
gagaagaaaacaga

SEQ ID NO: 4110913 - RNA, 11 nt, Streptococcus pneumoniae R6
gagaagaaauu

SEQ ID NO: 4110914 - RNA, 15 nt, Streptococcus pneumoniae R6
gagaagaaauuccac

SEQ ID NO: 4110915 - RNA, 16 nt, Streptococcus pneumoniae R6
gaguauaagauacaaa

SEQ ID NO: 4110916 - RNA, 14 nt, Streptococcus pneumoniae R6
gaguaugaaaagag

SEQ ID NO: 4110917 - RNA, 21 nt, Streptococcus pneumoniae R6
gaguauuacaaucauagauuc

SEQ ID NO: 4110918 - RNA, 19 nt, Streptococcus pneumoniae R6
gaguauuuuauaguaauuc

SEQ ID NO: 4110919 - RNA, 13 nt, Streptococcus pneumoniae R6
gagucaaaaaagg

SEQ ID NO: 4110920 - RNA, 22 nt, Streptococcus pneumoniae R6
gagucaaaaaaggaguaacuau

SEQ ID NO: 4110921 - RNA, 19 nt, Streptococcus pneumoniae R6
gagucaaaauucuuugaaa

SEQ ID NO: 4110922 - RNA, 21 nt, Streptococcus pneumoniae R6
gagucaauaauccuaacuuaa

SEQ ID NO: 4110923 - RNA, 13 nt, Streptococcus pneumoniae R6
gagucagcucuuu

SEQ ID NO: 4110924 - RNA, 19 nt, Streptococcus pneumoniae R6
gagucagcucuuuuuugau

SEQ ID NO: 4110925 - RNA, 22 nt, Streptococcus pneumoniae R6
gagucauaguuacucaggauaa

SEQ ID NO: 4110926 - RNA, 15 nt, Streptococcus pneumoniae R6
gaguccaaagaccau

SEQ ID NO: 4110927 - RNA, 16 nt, Streptococcus pneumoniae R6
gagucuccucaaaaac

SEQ ID NO: 4110928 - RNA, 16 nt, Streptococcus pneumoniae R6
gagucuugauggacaa

SEQ ID NO: 4110929 - RNA, 16 nt, Streptococcus pneumoniae R6
gagugaaaaacuagca

SEQ ID NO: 4110930 - RNA, 13 nt, Streptococcus pneumoniae R6
gaguggauguuuc

SEQ ID NO: 4110931 - RNA, 14 nt, Streptococcus pneumoniae R6
gaguuaaaacaaag

SEQ ID NO: 4110932 - RNA, 17 nt, Streptococcus pneumoniae R6
gaguuaaaacaaagaaa

SEQ ID NO: 4110933 - RNA, 23 nt, Streptococcus pneumoniae R6
gaguuacaaacucucauuaaaac

SEQ ID NO: 4110934 - RNA, 15 nt, Streptococcus pneumoniae R6
gaguuaccuaaauua

SEQ ID NO: 4110935 - RNA, 16 nt, Streptococcus pneumoniae R6
gaguuaccuaaauuau

SEQ ID NO: 4110936 - RNA, 20 nt, Streptococcus pneumoniae R6
gaguuacggguuuuaaacua

SEQ ID NO: 4110937 - RNA, 16 nt, Streptococcus pneumoniae R6
gaguuaggagccaagu

SEQ ID NO: 4110938 - RNA, 15 nt, Streptococcus pneumoniae R6
gaguuccuguuucag

SEQ ID NO: 4110939 - RNA, 14 nt, Streptococcus pneumoniae R6
gaguucuuuuacaa

SEQ ID NO: 4110940 - RNA, 11 nt, Streptococcus pneumoniae R6
gaguugaaaau

SEQ ID NO: 4110941 - RNA, 17 nt, Streptococcus pneumoniae R6
gaguugauaugagagau

SEQ ID NO: 4110942 - RNA, 15 nt, Streptococcus pneumoniae R6
gaguugcauagcgaa

SEQ ID NO: 4110943 - RNA, 16 nt, Streptococcus pneumoniae R6
gaguugcuugucaucu

SEQ ID NO: 4110944 - RNA, 19 nt, Streptococcus pneumoniae R6
gaguuugauuucuggauga

SEQ ID NO: 4110945 - RNA, 13 nt, Streptococcus pneumoniae R6
gaguuuguaucgc

SEQ ID NO: 4110946 - RNA, 15 nt, Streptococcus pneumoniae R6
gaguuuuaaucucaa

SEQ ID NO: 4110947 - RNA, 13 nt, Streptococcus pneumoniae R6
gaguuuucaaccu

SEQ ID NO: 4110948 - RNA, 15 nt, Streptococcus pneumoniae R6
gaguuuuuaucuagc

SEQ ID NO: 4110949 - RNA, 12 nt, Streptococcus pneumoniae R6
gaguuuuucagc

SEQ ID NO: 4110950 - RNA, 14 nt, Streptococcus pneumoniae R6
gauaaaaaacaacu

SEQ ID NO: 4110951 - RNA, 14 nt, Streptococcus pneumoniae R6
gauaaaaaucaagc

SEQ ID NO: 4110952 - RNA, 20 nt, Streptococcus pneumoniae R6
gauaaaaccuguuugaauca

SEQ ID NO: 4110953 - RNA, 19 nt, Streptococcus pneumoniae R6
gauaaaagaaugcucagac

SEQ ID NO: 4110954 - RNA, 19 nt, Streptococcus pneumoniae R6
gauaaaagauagcuaugaa

SEQ ID NO: 4110955 - RNA, 21 nt, Streptococcus pneumoniae R6
gauaaaauguaauuguuccau

SEQ ID NO: 4110956 - RNA, 16 nt, Streptococcus pneumoniae R6
gauaaaauugauaaua

SEQ ID NO: 4110957 - RNA, 20 nt, Streptococcus pneumoniae R6
gauaaaauuuaaaaauagau

SEQ ID NO: 4110958 - RNA, 19 nt, Streptococcus pneumoniae R6
gauaaaguuaugaaaaaga

SEQ ID NO: 4110959 - RNA, 23 nt, Streptococcus pneumoniae R6
gauaaauguugaauaguuuagua

SEQ ID NO: 4110960 - RNA, 18 nt, Streptococcus pneumoniae R6
gauaaauugcuggagaau

SEQ ID NO: 4110961 - RNA, 22 nt, Streptococcus pneumoniae R6
gauaaauugcuggagaaucauc

SEQ ID NO: 4110962 - RNA, 21 nt, Streptococcus pneumoniae R6
gauaaauuuuauugucuucau

SEQ ID NO: 4110963 - RNA, 11 nt, Streptococcus pneumoniae R6
gauaacauaac

SEQ ID NO: 4110964 - RNA, 18 nt, Streptococcus pneumoniae R6
gauaaccacagacugagg

SEQ ID NO: 4110965 - RNA, 19 nt, Streptococcus pneumoniae R6
gauaaccuuaaucaaauua

SEQ ID NO: 4110966 - RNA, 15 nt, Streptococcus pneumoniae R6
gauaacgaagagcug

SEQ ID NO: 4110967 - RNA, 15 nt, Streptococcus pneumoniae R6
gauaacgaauccaac

SEQ ID NO: 4110968 - RNA, 19 nt, Streptococcus pneumoniae R6
gauaagaauaucaagauaa

SEQ ID NO: 4110969 - RNA, 23 nt, Streptococcus pneumoniae R6
gauaagaauuggcacaaaagcga

SEQ ID NO: 4110970 - RNA, 21 nt, Streptococcus pneumoniae R6
gauaagacugacgaagucagc

SEQ ID NO: 4110971 - RNA, 22 nt, Streptococcus pneumoniae R6
gauaagacugacgaagucagcu

SEQ ID NO: 4110972 - RNA, 22 nt, Streptococcus pneumoniae R6
gauaagauaaaguggucuuuuu

SEQ ID NO: 4110973 - RNA, 12 nt, Streptococcus pneumoniae R6
gauaagaugaca

SEQ ID NO: 4110974 - RNA, 21 nt, Streptococcus pneumoniae R6
gauaagaugacaucuaaauaa

SEQ ID NO: 4110975 - RNA, 13 nt, Streptococcus pneumoniae R6
gauaagauuuuug

SEQ ID NO: 4110976 - RNA, 21 nt, Streptococcus pneumoniae R6
gauaagcaccuaguacaaaga

SEQ ID NO: 4110977 - RNA, 12 nt, Streptococcus pneumoniae R6
gauaagcuucuu

SEQ ID NO: 4110978 - RNA, 17 nt, Streptococcus pneumoniae R6
gauaaggcgaugcugac

SEQ ID NO: 4110979 - RNA, 18 nt, Streptococcus pneumoniae R6
gauaaggcgaugcugacg

SEQ ID NO: 4110980 - RNA, 18 nt, Streptococcus pneumoniae R6
gauaaggugggaagaguu

SEQ ID NO: 4110981 - RNA, 18 nt, Streptococcus pneumoniae R6
gauaaguggcaaaaauau

SEQ ID NO: 4110982 - RNA, 18 nt, Streptococcus pneumoniae R6
gauaauagcacuuaaaaa

SEQ ID NO: 4110983 - RNA, 18 nt, Streptococcus pneumoniae R6
gauaauauuacuucuaaa

SEQ ID NO: 4110984 - RNA, 16 nt, Streptococcus pneumoniae R6
gauaaucauaaagccu

SEQ ID NO: 4110985 - RNA, 13 nt, Streptococcus pneumoniae R6
gauaaucaucugg

SEQ ID NO: 4110986 - RNA, 14 nt, Streptococcus pneumoniae R6
gauaaucgcaaggu

SEQ ID NO: 4110987 - RNA, 19 nt, Streptococcus pneumoniae R6
gauaaugcuuugaacaaau

SEQ ID NO: 4110988 - RNA, 13 nt, Streptococcus pneumoniae R6
gauaauuucuuua

SEQ ID NO: 4110989 - RNA, 15 nt, Streptococcus pneumoniae R6
gauaauuucuuuaau

SEQ ID NO: 4110990 - RNA, 21 nt, Streptococcus pneumoniae R6
gauacaccaucccuuaucauu

SEQ ID NO: 4110991 - RNA, 11 nt, Streptococcus pneumoniae R6
gauaccaacca

SEQ ID NO: 4110992 - RNA, 15 nt, Streptococcus pneumoniae R6
gauaccaaccaguug

SEQ ID NO: 4110993 - RNA, 17 nt, Streptococcus pneumoniae R6
gauaccucgacuucaaa

SEQ ID NO: 4110994 - RNA, 23 nt, Streptococcus pneumoniae R6
gauaccuucuuuaucauuaaaga

SEQ ID NO: 4110995 - RNA, 22 nt, Streptococcus pneumoniae R6
gauaccuugaucaaucauguua

SEQ ID NO: 4110996 - RNA, 16 nt, Streptococcus pneumoniae R6
gauaccuuuuccuuca

SEQ ID NO: 4110997 - RNA, 17 nt, Streptococcus pneumoniae R6
gauaccuuuuccuucau

SEQ ID NO: 4110998 - RNA, 14 nt, Streptococcus pneumoniae R6
gauacgaucugaaa

SEQ ID NO: 4110999 - RNA, 16 nt, Streptococcus pneumoniae R6
gauacgaugaccaaga

SEQ ID NO: 4111000 - RNA, 23 nt, Streptococcus pneumoniae R6
gauacgauuaggaacaccucugu

SEQ ID NO: 4111001 - RNA, 13 nt, Streptococcus pneumoniae R6
gauacuaacacau

SEQ ID NO: 4111002 - RNA, 17 nt, Streptococcus pneumoniae R6
gauacuaugcguuuuaa

SEQ ID NO: 4111003 - RNA, 15 nt, Streptococcus pneumoniae R6
gauacuccauaaaaa

SEQ ID NO: 4111004 - RNA, 18 nt, Streptococcus pneumoniae R6
gauacugccgccaccucc

SEQ ID NO: 4111005 - RNA, 22 nt, Streptococcus pneumoniae R6
gauagaaaagcccuucaucagu

SEQ ID NO: 4111006 - RNA, 12 nt, Streptococcus pneumoniae R6
gauagaaagcaa

SEQ ID NO: 4111007 - RNA, 13 nt, Streptococcus pneumoniae R6
gauagaacugacg

SEQ ID NO: 4111008 - RNA, 15 nt, Streptococcus pneumoniae R6
gauagaacugacgaa

SEQ ID NO: 4111009 - RNA, 22 nt, Streptococcus pneumoniae R6
gauagaagagucagcucuuuuu

SEQ ID NO: 4111010 - RNA, 19 nt, Streptococcus pneumoniae R6
gauagaaggucaagagaaa

SEQ ID NO: 4111011 - RNA, 17 nt, Streptococcus pneumoniae R6
gauagaaucauggccac

SEQ ID NO: 4111012 - RNA, 14 nt, Streptococcus pneumoniae R6
gauagauccccuau

SEQ ID NO: 4111013 - RNA, 19 nt, Streptococcus pneumoniae R6
gauagauccuucaaauccu

SEQ ID NO: 4111014 - RNA, 17 nt, Streptococcus pneumoniae R6
gauagaucugauagugg

SEQ ID NO: 4111015 - RNA, 21 nt, Streptococcus pneumoniae R6
gauagaugcuacuauauucua

SEQ ID NO: 4111016 - RNA, 15 nt, Streptococcus pneumoniae R6
gauagauuuuucaag

SEQ ID NO: 4111017 - RNA, 15 nt, Streptococcus pneumoniae R6
gauagcacuugaauc

SEQ ID NO: 4111018 - RNA, 14 nt, Streptococcus pneumoniae R6
gaugucauacaagg

SEQ ID NO: 4111019 - RNA, 20 nt, Streptococcus pneumoniae R6
gaugucguaaguguuacuau

SEQ ID NO: 4111020 - RNA, 20 nt, Streptococcus pneumoniae R6
gauguuacagacaaaacugg

SEQ ID NO: 4111021 - RNA, 21 nt, Streptococcus pneumoniae R6
gauguuauuuacuguuuuagc

SEQ ID NO: 4111022 - RNA, 12 nt, Streptococcus pneumoniae R6
gauguucagagc

SEQ ID NO: 4111023 - RNA, 21 nt, Streptococcus pneumoniae R6
gauuaaaccuuccaagagacc

SEQ ID NO: 4111024 - RNA, 19 nt, Streptococcus pneumoniae R6
gauuaaauaguucuuccaa

SEQ ID NO: 4111025 - RNA, 22 nt, Streptococcus pneumoniae R6
gauuacacaaucguuucaaaaa

SEQ ID NO: 4111026 - RNA, 18 nt, Streptococcus pneumoniae R6
gauuaccaacuacuccuc

SEQ ID NO: 4111027 - RNA, 12 nt, Streptococcus pneumoniae R6
gauuagauaaga

SEQ ID NO: 4111028 - RNA, 23 nt, Streptococcus pneumoniae R6
gauuaggaaaggaaaauugauuu

SEQ ID NO: 4111029 - RNA, 19 nt, Streptococcus pneumoniae R6
gauuaggaaauucaaauga

SEQ ID NO: 4111030 - RNA, 18 nt, Streptococcus pneumoniae R6
gauuaggagaaucaacau

SEQ ID NO: 4111031 - RNA, 18 nt, Streptococcus pneumoniae R6
gauuaggggggcuauucu

SEQ ID NO: 4111032 - RNA, 21 nt, Streptococcus pneumoniae R6
gauuauaugcuaaaauguagu

SEQ ID NO: 4111033 - RNA, 12 nt, Streptococcus pneumoniae R6
gauuaucguguu

SEQ ID NO: 4111034 - RNA, 17 nt, Streptococcus pneumoniae R6
gauuaugauuuaaacua

SEQ ID NO: 4111035 - RNA, 16 nt, Streptococcus pneumoniae R6
gauuauugguggcuuc

SEQ ID NO: 4111036 - RNA, 19 nt, Streptococcus pneumoniae R6
gauuauuuuuuaacagauu

SEQ ID NO: 4111037 - RNA, 22 nt, Streptococcus pneumoniae R6
gauucacauggagggucaaaac

SEQ ID NO: 4111038 - RNA, 19 nt, Streptococcus pneumoniae R6
gauucacuagccccagcua

SEQ ID NO: 4111039 - RNA, 17 nt, Streptococcus pneumoniae R6
gauucauaguuacuccu

SEQ ID NO: 4111040 - RNA, 16 nt, Streptococcus pneumoniae R6
gauucaugacaucuuc

SEQ ID NO: 4111041 - RNA, 19 nt, Streptococcus pneumoniae R6
gauucaugacaucuuccaa

SEQ ID NO: 4111042 - RNA, 13 nt, Streptococcus pneumoniae R6
gauucauucugcu

SEQ ID NO: 4111043 - RNA, 16 nt, Streptococcus pneumoniae R6
gauuccaaacaacaau

SEQ ID NO: 4111044 - RNA, 13 nt, Streptococcus pneumoniae R6
gauucccugauuu

SEQ ID NO: 4111045 - RNA, 12 nt, Streptococcus pneumoniae R6
gauuccuccgag

SEQ ID NO: 4111046 - RNA, 13 nt, Streptococcus pneumoniae R6
gauuccugaaaua

SEQ ID NO: 4111047 - RNA, 15 nt, Streptococcus pneumoniae R6
gauuccuuuuugcag

SEQ ID NO: 4111048 - RNA, 14 nt, Streptococcus pneumoniae R6
gauucgccacguuc

SEQ ID NO: 4111049 - RNA, 16 nt, Streptococcus pneumoniae R6
gauucgcuauucuucu

SEQ ID NO: 4111050 - RNA, 16 nt, Streptococcus pneumoniae R6
gauucgcucuucaauc

SEQ ID NO: 4111051 - RNA, 22 nt, Streptococcus pneumoniae R6
gauucggauaaguuuuguuugu

SEQ ID NO: 4111052 - RNA, 12 nt, Streptococcus pneumoniae R6
gauucuacuuuu

SEQ ID NO: 4111053 - RNA, 16 nt, Streptococcus pneumoniae R6
gauucuacuuuuucaa

SEQ ID NO: 4111054 - RNA, 12 nt, Streptococcus pneumoniae R6
gauucugaaaua

SEQ ID NO: 4111055 - RNA, 21 nt, Streptococcus pneumoniae R6
gauucugaaauaacucauaau

SEQ ID NO: 4111056 - RNA, 21 nt, Streptococcus pneumoniae R6
gauucuuauauuaaaaaaagg

SEQ ID NO: 4111057 - RNA, 19 nt, Streptococcus pneumoniae R6
gauucuucugguuuggcaa

SEQ ID NO: 4111058 - RNA, 15 nt, Streptococcus pneumoniae R6
gauucuuucuaauga

SEQ ID NO: 4111059 - RNA, 14 nt, Streptococcus pneumoniae R6
gauugaaacuagaa

SEQ ID NO: 4111060 - RNA, 23 nt, Streptococcus pneumoniae R6
gauugaaauucgcuuuuuuaaau

SEQ ID NO: 4111061 - RNA, 17 nt, Streptococcus pneumoniae R6
gauugagaaacuagaag

SEQ ID NO: 4111062 - RNA, 18 nt, Streptococcus pneumoniae R6
gauugagaaaguuaaaaa

SEQ ID NO: 4111063 - RNA, 21 nt, Streptococcus pneumoniae R6
gauugagaaaguuaaaaaaac

SEQ ID NO: 4111064 - RNA, 13 nt, Streptococcus pneumoniae R6
gauugagaagcca

SEQ ID NO: 4111065 - RNA, 14 nt, Streptococcus pneumoniae R6
gauugagaagccaa

SEQ ID NO: 4111066 - RNA, 13 nt, Streptococcus pneumoniae R6
gauugauaaaauu

SEQ ID NO: 4111067 - RNA, 14 nt, Streptococcus pneumoniae R6
gauugauuauccuu

SEQ ID NO: 4111068 - RNA, 18 nt, Streptococcus pneumoniae R6
gauugauuuucagcaccu

SEQ ID NO: 4111069 - RNA, 22 nt, Streptococcus pneumoniae R6
gauugcaagcccuuauuuccau

SEQ ID NO: 4111070 - RNA, 16 nt, Streptococcus pneumoniae R6
gauugcccaaaaugag

SEQ ID NO: 4111071 - RNA, 13 nt, Streptococcus pneumoniae R6
gauugccuugcuc

SEQ ID NO: 4111072 - RNA, 16 nt, Streptococcus pneumoniae R6
gauugcuacaauccag

SEQ ID NO: 4111073 - RNA, 16 nt, Streptococcus pneumoniae R6
gauuggagcuuaaaau

SEQ ID NO: 4111074 - RNA, 14 nt, Streptococcus pneumoniae R6
gauuggauaaaauc

SEQ ID NO: 4111075 - RNA, 14 nt, Streptococcus pneumoniae R6
gauuggauuugacu

SEQ ID NO: 4111076 - RNA, 22 nt, Streptococcus pneumoniae R6
gauuggcgagauaaugcccaag

SEQ ID NO: 4111077 - RNA, 21 nt, Streptococcus pneumoniae R6
gauuggcucaaucaauugguu

SEQ ID NO: 4111078 - RNA, 19 nt, Streptococcus pneumoniae R6
gauugucacauugagaaag

SEQ ID NO: 4111079 - RNA, 15 nt, Streptococcus pneumoniae R6
gauugugaauaggug

SEQ ID NO: 4111080 - RNA, 19 nt, Streptococcus pneumoniae R6
gauugugaauuauaguaga

SEQ ID NO: 4111081 - RNA, 19 nt, Streptococcus pneumoniae R6
gauugugauagcaguaguu

SEQ ID NO: 4111082 - RNA, 13 nt, Streptococcus pneumoniae R6
gauuguucagagg

SEQ ID NO: 4111083 - RNA, 12 nt, Streptococcus pneumoniae R6
gauuuaaaacug

SEQ ID NO: 4111084 - RNA, 11 nt, Streptococcus pneumoniae R6
gauuuaaaaua

SEQ ID NO: 4111085 - RNA, 23 nt, Streptococcus pneumoniae R6
gauuuaaaaucguagucuuucac

SEQ ID NO: 4111086 - RNA, 13 nt, Streptococcus pneumoniae R6
gauuuaacuuuuu

SEQ ID NO: 4111087 - RNA, 16 nt, Streptococcus pneumoniae R6
gauuuaagaauaaagc

SEQ ID NO: 4111088 - RNA, 18 nt, Streptococcus pneumoniae R6
gauuuaauuagaaaaaaa

SEQ ID NO: 4111089 - RNA, 20 nt, Streptococcus pneumoniae R6
gauuuaccuuccucaacaaa

SEQ ID NO: 4111090 - RNA, 21 nt, Streptococcus pneumoniae R6
gauuuaccuuccucaacaaaa

SEQ ID NO: 4111091 - RNA, 15 nt, Streptococcus pneumoniae R6
gauuuacuuccuuuu

SEQ ID NO: 4111092 - RNA, 12 nt, Streptococcus pneumoniae R6
gauuuagaggcc

SEQ ID NO: 4111093 - RNA, 19 nt, Streptococcus pneumoniae R6
gauuuagcuuugcgcuaga

SEQ ID NO: 4111094 - RNA, 16 nt, Streptococcus pneumoniae R6
gauuuaguagcaucau

SEQ ID NO: 4111095 - RNA, 15 nt, Streptococcus pneumoniae R6
gauuuauaauuucaa

SEQ ID NO: 4111096 - RNA, 23 nt, Streptococcus pneumoniae R6
gauuuaucaguauauugaaauga

SEQ ID NO: 4111097 - RNA, 22 nt, Streptococcus pneumoniae R6
gauuuauuugcuuaauccucaa

SEQ ID NO: 4111098 - RNA, 15 nt, Streptococcus pneumoniae R6
gauuuauuuguuuca

SEQ ID NO: 4111099 - RNA, 23 nt, Streptococcus pneumoniae R6
gauuucaaguaaaaucaggauuu

SEQ ID NO: 4111100 - RNA, 20 nt, Streptococcus pneumoniae R6
gauuucaauuuuaaauuuuu

SEQ ID NO: 4111101 - RNA, 17 nt, Streptococcus pneumoniae R6
gauuucagaaucccaaa

SEQ ID NO: 4111102 - RNA, 14 nt, Streptococcus pneumoniae R6
gauuucagcguuuu

SEQ ID NO: 4111103 - RNA, 17 nt, Streptococcus pneumoniae R6
gauuuccacuaaagguu

SEQ ID NO: 4111104 - RNA, 17 nt, Streptococcus pneumoniae R6
gauuuccauuuuccaug

SEQ ID NO: 4111105 - RNA, 14 nt, Streptococcus pneumoniae R6
gauuuccucugcgc

SEQ ID NO: 4111106 - RNA, 20 nt, Streptococcus pneumoniae R6
gauuuccuucacuacagaau

SEQ ID NO: 4111107 - RNA, 16 nt, Streptococcus pneumoniae R6
gauuucggccaauucu

SEQ ID NO: 4111108 - RNA, 15 nt, Streptococcus pneumoniae R6
gauuucuaaagagua

SEQ ID NO: 4111109 - RNA, 23 nt, Streptococcus pneumoniae R6
gauuucuaacaauauuuuagaag

SEQ ID NO: 4111110 - RNA, 20 nt, Streptococcus pneumoniae R6
gauuucuccuguuucaaagu

SEQ ID NO: 4111111 - RNA, 22 nt, Streptococcus pneumoniae R6
gauuucuucacggcuaauacca

SEQ ID NO: 4111112 - RNA, 14 nt, Streptococcus pneumoniae R6
gauuucuuuaucaa

SEQ ID NO: 4111113 - RNA, 13 nt, Streptococcus pneumoniae R6
gauuugaaaacug

SEQ ID NO: 4111114 - RNA, 12 nt, Streptococcus pneumoniae R6
gauuugaaacua

SEQ ID NO: 4111115 - RNA, 12 nt, Streptococcus pneumoniae R6
gauuugagugaa

SEQ ID NO: 4111116 - RNA, 12 nt, Streptococcus pneumoniae R6
gauuugauaaga

SEQ ID NO: 4111117 - RNA, 19 nt, Streptococcus pneumoniae R6
gauuuggacuauucguuug

SEQ ID NO: 4111118 - RNA, 23 nt, Streptococcus pneumoniae R6
gauuuguccaucuguaauaugaa

SEQ ID NO: 4111119 - RNA, 17 nt, Streptococcus pneumoniae R6
gauuugugaaucaucac

SEQ ID NO: 4111120 - RNA, 19 nt, Streptococcus pneumoniae R6
gauuuguucagguguuucu

SEQ ID NO: 4111121 - RNA, 12 nt, Streptococcus pneumoniae R6
gcaccauuuuca

SEQ ID NO: 4111122 - RNA, 18 nt, Streptococcus pneumoniae R6
gcaccuaguacaaagaau

SEQ ID NO: 4111123 - RNA, 21 nt, Streptococcus pneumoniae R6
gcaccugauuucuccgcuucc

SEQ ID NO: 4111124 - RNA, 18 nt, Streptococcus pneumoniae R6
gcaccuucuacagcaccu

SEQ ID NO: 4111125 - RNA, 16 nt, Streptococcus pneumoniae R6
gcaccuuggcauccag

SEQ ID NO: 4111126 - RNA, 20 nt, Streptococcus pneumoniae R6
gcacgagucaccccuccaug

SEQ ID NO: 4111127 - RNA, 16 nt, Streptococcus pneumoniae R6
gcacguguaaugacag

SEQ ID NO: 4111128 - RNA, 17 nt, Streptococcus pneumoniae R6
gcacguguaauggcugu

SEQ ID NO: 4111129 - RNA, 18 nt, Streptococcus pneumoniae R6
gcacugauuugagguugu

SEQ ID NO: 4111130 - RNA, 18 nt, Streptococcus pneumoniae R6
gcacuugaugaaaaaaag

SEQ ID NO: 4111131 - RNA, 20 nt, Streptococcus pneumoniae R6
gcacuugaugaaaaaaaguu

SEQ ID NO: 4111132 - RNA, 20 nt, Streptococcus pneumoniae R6
gcagaaaaauuucauuuucu

SEQ ID NO: 4111133 - RNA, 19 nt, Streptococcus pneumoniae R6
gcagaaccccgauaacagc

SEQ ID NO: 4111134 - RNA, 13 nt, Streptococcus pneumoniae R6
gcagaaccuuaaa

SEQ ID NO: 4111135 - RNA, 18 nt, Streptococcus pneumoniae R6
gcagaaucgugaguuccu

SEQ ID NO: 4111136 - RNA, 15 nt, Streptococcus pneumoniae R6
gcagacagagaaaau

SEQ ID NO: 4111137 - RNA, 17 nt, Streptococcus pneumoniae R6
gcagacgaaauacaaga

SEQ ID NO: 4111138 - RNA, 18 nt, Streptococcus pneumoniae R6
gcagacgaguuaaaacaa

SEQ ID NO: 4111139 - RNA, 19 nt, Streptococcus pneumoniae R6
gcagacgaguuaaaacaaa

SEQ ID NO: 4111140 - RNA, 20 nt, Streptococcus pneumoniae R6
gcagacgaguuaaaacaaag

SEQ ID NO: 4111141 - RNA, 20 nt, Streptococcus pneumoniae R6
gcagagguguacuauucuag

SEQ ID NO: 4111142 - RNA, 20 nt, Streptococcus pneumoniae R6
gcagauagagacauaaucaa

SEQ ID NO: 4111143 - RNA, 15 nt, Streptococcus pneumoniae R6
gcagauagggcuagg

SEQ ID NO: 4111144 - RNA, 21 nt, Streptococcus pneumoniae R6
gcagauagggcuaggcuaaca

SEQ ID NO: 4111145 - RNA, 13 nt, Streptococcus pneumoniae R6
gcagaugaaagcu

SEQ ID NO: 4111146 - RNA, 16 nt, Streptococcus pneumoniae R6
gcagauugaaauaaga

SEQ ID NO: 4111147 - RNA, 20 nt, Streptococcus pneumoniae R6
gcagauuuaacuauaguaga

SEQ ID NO: 4111148 - RNA, 15 nt, Streptococcus pneumoniae R6
gcagauuugcuuaca

SEQ ID NO: 4111149 - RNA, 22 nt, Streptococcus pneumoniae R6
gcagauuuguugauagaguagu

SEQ ID NO: 4111150 - RNA, 18 nt, Streptococcus pneumoniae R6
gcagccacuuuuuauccg

SEQ ID NO: 4111151 - RNA, 23 nt, Streptococcus pneumoniae R6
gcagcgacauugacugagucacg

SEQ ID NO: 4111152 - RNA, 18 nt, Streptococcus pneumoniae R6
gcagcgauugaaacagcu

SEQ ID NO: 4111153 - RNA, 14 nt, Streptococcus pneumoniae R6
gcagcgguuccauu

SEQ ID NO: 4111154 - RNA, 15 nt, Streptococcus pneumoniae R6
gcagcuaguuuccua

SEQ ID NO: 4111155 - RNA, 23 nt, Streptococcus pneumoniae R6
gcagcuaguuuccuaguuugcuc

SEQ ID NO: 4111156 - RNA, 16 nt, Streptococcus pneumoniae R6
gcagcugaggaaaucc

SEQ ID NO: 4111157 - RNA, 13 nt, Streptococcus pneumoniae R6
gcagcuuguucuu

SEQ ID NO: 4111158 - RNA, 19 nt, Streptococcus pneumoniae R6
gcagcuuguucuucugcug

SEQ ID NO: 4111159 - RNA, 17 nt, Streptococcus pneumoniae R6
gcaggaagaaagaggag

SEQ ID NO: 4111160 - RNA, 13 nt, Streptococcus pneumoniae R6
gcaggaauaucca

SEQ ID NO: 4111161 - RNA, 15 nt, Streptococcus pneumoniae R6
gcaggacuaaaucca

SEQ ID NO: 4111162 - RNA, 17 nt, Streptococcus pneumoniae R6
gcaggauuuuugcuucu

SEQ ID NO: 4111163 - RNA, 17 nt, Streptococcus pneumoniae R6
gcaggcugauuccagcu

SEQ ID NO: 4111164 - RNA, 15 nt, Streptococcus pneumoniae R6
gcaggcugcucaaaa

SEQ ID NO: 4111165 - RNA, 17 nt, Streptococcus pneumoniae R6
gcaggcugcucaaaaca

SEQ ID NO: 4111166 - RNA, 15 nt, Streptococcus pneumoniae R6
gcagguugcucaaag

SEQ ID NO: 4111167 - RNA, 16 nt, Streptococcus pneumoniae R6
gcagguuuucaagccu

SEQ ID NO: 4111168 - RNA, 12 nt, Streptococcus pneumoniae R6
gcaguaaaucuu

SEQ ID NO: 4111169 - RNA, 22 nt, Streptococcus pneumoniae R6
gcaguaacuucugucuauuugc

SEQ ID NO: 4111170 - RNA, 16 nt, Streptococcus pneumoniae R6
gcaguacauucaacac

SEQ ID NO: 4111171 - RNA, 18 nt, Streptococcus pneumoniae R6
gcaguacauucaacaccu

SEQ ID NO: 4111172 - RNA, 12 nt, Streptococcus pneumoniae R6
gcaguacuuuga

SEQ ID NO: 4111173 - RNA, 19 nt, Streptococcus pneumoniae R6
gcaguacuuugagcaaccu

SEQ ID NO: 4111174 - RNA, 22 nt, Streptococcus pneumoniae R6
gcaguacuuugagcaaccugcg

SEQ ID NO: 4111175 - RNA, 16 nt, Streptococcus pneumoniae R6
gcaguccaaggagaac

SEQ ID NO: 4111176 - RNA, 15 nt, Streptococcus pneumoniae R6
gcagucguuccuuuu

SEQ ID NO: 4111177 - RNA, 12 nt, Streptococcus pneumoniae R6
gcagugacuacc

SEQ ID NO: 4111178 - RNA, 16 nt, Streptococcus pneumoniae R6
gcaguuccgauguguu

SEQ ID NO: 4111179 - RNA, 12 nt, Streptococcus pneumoniae R6
gcaguucuucau

SEQ ID NO: 4111180 - RNA, 20 nt, Streptococcus pneumoniae R6
gcaguugugucuucgucugg

SEQ ID NO: 4111181 - RNA, 21 nt, Streptococcus pneumoniae R6
gcaguuucucuacuaacucaa

SEQ ID NO: 4111182 - RNA, 13 nt, Streptococcus pneumoniae R6
gcaguuuuuucuu

SEQ ID NO: 4111183 - RNA, 13 nt, Streptococcus pneumoniae R6
gcauaaaaucagg

SEQ ID NO: 4111184 - RNA, 14 nt, Streptococcus pneumoniae R6
gcauaaaaucugaa

SEQ ID NO: 4111185 - RNA, 17 nt, Streptococcus pneumoniae R6
gcauaaaaucugaauca

SEQ ID NO: 4111186 - RNA, 22 nt, Streptococcus pneumoniae R6
gcauaaaucaaaucgauaaaga

SEQ ID NO: 4111187 - RNA, 16 nt, Streptococcus pneumoniae R6
gcauaagccggcuugu

SEQ ID NO: 4111188 - RNA, 12 nt, Streptococcus pneumoniae R6
gcauaaugaggu

SEQ ID NO: 4111189 - RNA, 20 nt, Streptococcus pneumoniae R6
gcauaaugauuucaagacca

SEQ ID NO: 4111190 - RNA, 16 nt, Streptococcus pneumoniae R6
gcauaauuuccauacc

SEQ ID NO: 4111191 - RNA, 15 nt, Streptococcus pneumoniae R6
gcauacguucaaauu

SEQ ID NO: 4111192 - RNA, 17 nt, Streptococcus pneumoniae R6
gcauacguucaaauucg

SEQ ID NO: 4111193 - RNA, 17 nt, Streptococcus pneumoniae R6
gcauacugaauuuagaa

SEQ ID NO: 4111194 - RNA, 19 nt, Streptococcus pneumoniae R6
gcauacugcccugaaaucc

SEQ ID NO: 4111195 - RNA, 16 nt, Streptococcus pneumoniae R6
gcauagaugacaaagu

SEQ ID NO: 4111196 - RNA, 22 nt, Streptococcus pneumoniae R6
gcauaguauaucacuuuauagu

SEQ ID NO: 4111197 - RNA, 20 nt, Streptococcus pneumoniae R6
gcauaguaucaagguuuuuc

SEQ ID NO: 4111198 - RNA, 16 nt, Streptococcus pneumoniae R6
gcauaguugcauuaaa

SEQ ID NO: 4111199 - RNA, 19 nt, Streptococcus pneumoniae R6
gcauaguugcauuaaaauc

SEQ ID NO: 4111200 - RNA, 20 nt, Streptococcus pneumoniae R6
gcauaugcaacuuguuuuuc

SEQ ID NO: 4111201 - RNA, 20 nt, Streptococcus pneumoniae R6
gcaucaaauccuucagcuuu

SEQ ID NO: 4111202 - RNA, 16 nt, Streptococcus pneumoniae R6
gcaucaacagcuccau

SEQ ID NO: 4111203 - RNA, 21 nt, Streptococcus pneumoniae R6
gcaucaacuauucuuuuucua

SEQ ID NO: 4111204 - RNA, 16 nt, Streptococcus pneumoniae R6
gcaucacgaaaauauu

SEQ ID NO: 4111205 - RNA, 16 nt, Streptococcus pneumoniae R6
gcauccaguaaaaacu

SEQ ID NO: 4111206 - RNA, 19 nt, Streptococcus pneumoniae R6
gcauccaucccauuuauau

SEQ ID NO: 4111207 - RNA, 21 nt, Streptococcus pneumoniae R6
gcaucgguaagaaagcaacua

SEQ ID NO: 4111208 - RNA, 19 nt, Streptococcus pneumoniae R6
gcaucuaaaugauccaagu

SEQ ID NO: 4111209 - RNA, 22 nt, Streptococcus pneumoniae R6
gcaucuaagcauuuaauccaaa

SEQ ID NO: 4111210 - RNA, 11 nt, Streptococcus pneumoniae R6
gcaucuagguc

SEQ ID NO: 4111211 - RNA, 16 nt, Streptococcus pneumoniae R6
gcaucuuaacauucuc

SEQ ID NO: 4111212 - RNA, 20 nt, Streptococcus pneumoniae R6
gcaucuuaucagaaaauaaa

SEQ ID NO: 4111213 - RNA, 14 nt, Streptococcus pneumoniae R6
gcaucuugucaaag

SEQ ID NO: 4111214 - RNA, 14 nt, Streptococcus pneumoniae R6
gcaucuuguguuuu

SEQ ID NO: 4111215 - RNA, 14 nt, Streptococcus pneumoniae R6
gcaugaaggucuuu

SEQ ID NO: 4111216 - RNA, 20 nt, Streptococcus pneumoniae R6
gcaugacuccacucaacauu

SEQ ID NO: 4111217 - RNA, 13 nt, Streptococcus pneumoniae R6
gcaugauaucaaa

SEQ ID NO: 4111218 - RNA, 13 nt, Streptococcus pneumoniae R6
gcauggaaagcau

SEQ ID NO: 4111219 - RNA, 17 nt, Streptococcus pneumoniae R6
gcauggaaagcaucucc

SEQ ID NO: 4111220 - RNA, 16 nt, Streptococcus pneumoniae R6
gcaugggccccagcuu

SEQ ID NO: 4111221 - RNA, 17 nt, Streptococcus pneumoniae R6
gcauguaucacaguaag

SEQ ID NO: 4111222 - RNA, 22 nt, Streptococcus pneumoniae R6
gcauguucgggcacuucuuuuu

SEQ ID NO: 4111223 - RNA, 18 nt, Streptococcus pneumoniae R6
gcauuccagacagcuuca

SEQ ID NO: 4111224 - RNA, 23 nt, Streptococcus pneumoniae R6
gccuguaguuucauguggccuug

SEQ ID NO: 4111225 - RNA, 15 nt, Streptococcus pneumoniae R6
gccuucaucauagaa

SEQ ID NO: 4111226 - RNA, 15 nt, Streptococcus pneumoniae R6
gccuucauccuugag

SEQ ID NO: 4111227 - RNA, 17 nt, Streptococcus pneumoniae R6
gccuucauccuugaguu

SEQ ID NO: 4111228 - RNA, 17 nt, Streptococcus pneumoniae R6
gccuucauuuuacaucu

SEQ ID NO: 4111229 - RNA, 21 nt, Streptococcus pneumoniae R6
gccuucuacuuccugcucaaa

SEQ ID NO: 4111230 - RNA, 14 nt, Streptococcus pneumoniae R6
gccuucuggucuga

SEQ ID NO: 4111231 - RNA, 16 nt, Streptococcus pneumoniae R6
gccuucuguugguuga

SEQ ID NO: 4111232 - RNA, 11 nt, Streptococcus pneumoniae R6
gccuucuucca

SEQ ID NO: 4111233 - RNA, 12 nt, Streptococcus pneumoniae R6
gccuucuuccau

SEQ ID NO: 4111234 - RNA, 12 nt, Streptococcus pneumoniae R6
gccuugaccaau

SEQ ID NO: 4111235 - RNA, 22 nt, Streptococcus pneumoniae R6
gccuuguauccaaucucuugaa

SEQ ID NO: 4111236 - RNA, 19 nt, Streptococcus pneumoniae R6
gccuugucccaucauuccu

SEQ ID NO: 4111237 - RNA, 19 nt, Streptococcus pneumoniae R6
gccuuugauaaccacagac

SEQ ID NO: 4111238 - RNA, 13 nt, Streptococcus pneumoniae R6
gccuuuuucuucu

SEQ ID NO: 4111239 - RNA, 14 nt, Streptococcus pneumoniae R6
gccuuuuugaacug

SEQ ID NO: 4111240 - RNA, 18 nt, Streptococcus pneumoniae R6
gcgaaaagcuacaaucug

SEQ ID NO: 4111241 - RNA, 14 nt, Streptococcus pneumoniae R6
gcgaaacggcagcu

SEQ ID NO: 4111242 - RNA, 19 nt, Streptococcus pneumoniae R6
gcgaaaggagaaaaaauau

SEQ ID NO: 4111243 - RNA, 18 nt, Streptococcus pneumoniae R6
gcgaaaggagaaaaauau

SEQ ID NO: 4111244 - RNA, 22 nt, Streptococcus pneumoniae R6
gcgaacaaaucaauuagaaaau

SEQ ID NO: 4111245 - RNA, 15 nt, Streptococcus pneumoniae R6
gcgaacaucuccaac

SEQ ID NO: 4111246 - RNA, 17 nt, Streptococcus pneumoniae R6
gcgaagggcuucuuuga

SEQ ID NO: 4111247 - RNA, 23 nt, Streptococcus pneumoniae R6
gcgaaguagcgugugauaucaau

SEQ ID NO: 4111248 - RNA, 17 nt, Streptococcus pneumoniae R6
gcgaauuugaugcugca

SEQ ID NO: 4111249 - RNA, 15 nt, Streptococcus pneumoniae R6
gcgacauugacugag

SEQ ID NO: 4111250 - RNA, 17 nt, Streptococcus pneumoniae R6
gcgaccaagagcaaaaa

SEQ ID NO: 4111251 - RNA, 17 nt, Streptococcus pneumoniae R6
gcgauagauguuuucaa

SEQ ID NO: 4111252 - RNA, 19 nt, Streptococcus pneumoniae R6
gcgauagcuccaucuccaa

SEQ ID NO: 4111253 - RNA, 23 nt, Streptococcus pneumoniae R6
gcgauagcuccaucuccaacugc

SEQ ID NO: 4111254 - RNA, 21 nt, Streptococcus pneumoniae R6
gcgauugauuucggccaauuc

SEQ ID NO: 4111255 - RNA, 14 nt, Streptococcus pneumoniae R6
gcgauuuuaggaua

SEQ ID NO: 4111256 - RNA, 14 nt, Streptococcus pneumoniae R6
gcgauuuucccuuu

SEQ ID NO: 4111257 - RNA, 13 nt, Streptococcus pneumoniae R6
gcgauuuugccaa

SEQ ID NO: 4111258 - RNA, 21 nt, Streptococcus pneumoniae R6
gcgauuuuuguguuuuuucuu

SEQ ID NO: 4111259 - RNA, 15 nt, Streptococcus pneumoniae R6
gcgcccuugagagaa

SEQ ID NO: 4111260 - RNA, 15 nt, Streptococcus pneumoniae R6
gcgcgugguccagau

SEQ ID NO: 4111261 - RNA, 15 nt, Streptococcus pneumoniae R6
gcgcucuaaccaccu

SEQ ID NO: 4111262 - RNA, 19 nt, Streptococcus pneumoniae R6
gcgcuucuacuccaagcaa

SEQ ID NO: 4111263 - RNA, 16 nt, Streptococcus pneumoniae R6
gcgcuugaaacucauc

SEQ ID NO: 4111264 - RNA, 22 nt, Streptococcus pneumoniae R6
gcgcuugauaaccuuaaucaaa

SEQ ID NO: 4111265 - RNA, 20 nt, Streptococcus pneumoniae R6
gcggaaguuggucucccaag

SEQ ID NO: 4111266 - RNA, 13 nt, Streptococcus pneumoniae R6
gcggauaaaagag

SEQ ID NO: 4111267 - RNA, 15 nt, Streptococcus pneumoniae R6
gcggcauucaagaga

SEQ ID NO: 4111268 - RNA, 18 nt, Streptococcus pneumoniae R6
gcggcuagcgucuaacaa

SEQ ID NO: 4111269 - RNA, 17 nt, Streptococcus pneumoniae R6
gcggcuuuuucuuucaa

SEQ ID NO: 4111270 - RNA, 21 nt, Streptococcus pneumoniae R6
gcgucaccguagguuggguga

SEQ ID NO: 4111271 - RNA, 21 nt, Streptococcus pneumoniae R6
gcgucaggagcacuugaugaa

SEQ ID NO: 4111272 - RNA, 21 nt, Streptococcus pneumoniae R6
gcguccagcagcuaagaccuu

SEQ ID NO: 4111273 - RNA, 21 nt, Streptococcus pneumoniae R6
gcgugagauuugugaaucauc

SEQ ID NO: 4111274 - RNA, 13 nt, Streptococcus pneumoniae R6
gcguuaaauccua

SEQ ID NO: 4111275 - RNA, 19 nt, Streptococcus pneumoniae R6
gcguuauuugaaaaauaua

SEQ ID NO: 4111276 - RNA, 20 nt, Streptococcus pneumoniae R6
gcguucagccaucuuguaac

SEQ ID NO: 4111277 - RNA, 17 nt, Streptococcus pneumoniae R6
gcguugacaaucuuuuc

SEQ ID NO: 4111278 - RNA, 23 nt, Streptococcus pneumoniae R6
gcguugauuccgaauggccagau

SEQ ID NO: 4111279 - RNA, 17 nt, Streptococcus pneumoniae R6
gcguuuagcaucuucuu

SEQ ID NO: 4111280 - RNA, 20 nt, Streptococcus pneumoniae R6
gcguuuauauaguagccaaa

SEQ ID NO: 4111281 - RNA, 22 nt, Streptococcus pneumoniae R6
gcguuugacaaguaaguagcau

SEQ ID NO: 4111282 - RNA, 22 nt, Streptococcus pneumoniae R6
gcguuuuaucauagaaauauuu

SEQ ID NO: 4111283 - RNA, 12 nt, Streptococcus pneumoniae R6
gcuaaaaagcua

SEQ ID NO: 4111284 - RNA, 17 nt, Streptococcus pneumoniae R6
gcuaaaagauuucuaua

SEQ ID NO: 4111285 - RNA, 16 nt, Streptococcus pneumoniae R6
gcuaaaaucaggucuu

SEQ ID NO: 4111286 - RNA, 18 nt, Streptococcus pneumoniae R6
gcuaaagcaccugaauca

SEQ ID NO: 4111287 - RNA, 19 nt, Streptococcus pneumoniae R6
gcuaacggaauuaauagcu

SEQ ID NO: 4111288 - RNA, 15 nt, Streptococcus pneumoniae R6
gcuaacuuuuccuua

SEQ ID NO: 4111289 - RNA, 24 nt, Streptococcus pneumoniae R6
gcuaagaaaguaagaaucugcaug

SEQ ID NO: 4111290 - RNA, 22 nt, Streptococcus pneumoniae R6
gcuaagauaauagcgaugaaga

SEQ ID NO: 4111291 - RNA, 20 nt, Streptococcus pneumoniae R6
gcuaagcucgagaaaggaca

SEQ ID NO: 4111292 - RNA, 20 nt, Streptococcus pneumoniae R6
gcuaauagagcugaggaaau

SEQ ID NO: 4111293 - RNA, 13 nt, Streptococcus pneumoniae R6
gcuaauaguggug

SEQ ID NO: 4111294 - RNA, 15 nt, Streptococcus pneumoniae R6
gcuaaucaaaacgca

SEQ ID NO: 4111295 - RNA, 22 nt, Streptococcus pneumoniae R6
gcuaaucaaaacgcaguuucag

SEQ ID NO: 4111296 - RNA, 12 nt, Streptococcus pneumoniae R6
gcuaauucuuug

SEQ ID NO: 4111297 - RNA, 16 nt, Streptococcus pneumoniae R6
gcuaauuucaagaagu

SEQ ID NO: 4111298 - RNA, 14 nt, Streptococcus pneumoniae R6
gcuaauuuugccag

SEQ ID NO: 4111299 - RNA, 18 nt, Streptococcus pneumoniae R6
gcuacaccguaauuuccu

SEQ ID NO: 4111300 - RNA, 13 nt, Streptococcus pneumoniae R6
gcuacaggcaugg

SEQ ID NO: 4111301 - RNA, 16 nt, Streptococcus pneumoniae R6
gcuaccaaguaaaucu

SEQ ID NO: 4111302 - RNA, 15 nt, Streptococcus pneumoniae R6
gcuaccagaccaagu

SEQ ID NO: 4111303 - RNA, 18 nt, Streptococcus pneumoniae R6
gcuaccguugaaaucaau

SEQ ID NO: 4111304 - RNA, 19 nt, Streptococcus pneumoniae R6
gcuaccguugaaaucaaua

SEQ ID NO: 4111305 - RNA, 14 nt, Streptococcus pneumoniae R6
gcuacuauaaaaga

SEQ ID NO: 4111306 - RNA, 23 nt, Streptococcus pneumoniae R6
gcuacucccaucgcgaccaagag

SEQ ID NO: 4111307 - RNA, 23 nt, Streptococcus pneumoniae R6
gcuagaaacguuguuaaaucaac

SEQ ID NO: 4111308 - RNA, 17 nt, Streptococcus pneumoniae R6
gcuagaaauggcagcgu

SEQ ID NO: 4111309 - RNA, 18 nt, Streptococcus pneumoniae R6
gcuagaacuuccguauug

SEQ ID NO: 4111310 - RNA, 13 nt, Streptococcus pneumoniae R6
gcuagaagcaucg

SEQ ID NO: 4111311 - RNA, 13 nt, Streptococcus pneumoniae R6
gcuagaauguagu

SEQ ID NO: 4111312 - RNA, 19 nt, Streptococcus pneumoniae R6
gcuagacuaacuucuuauu

SEQ ID NO: 4111313 - RNA, 14 nt, Streptococcus pneumoniae R6
gcuagauauuucca

SEQ ID NO: 4111314 - RNA, 13 nt, Streptococcus pneumoniae R6
gcuagcaucaucg

SEQ ID NO: 4111315 - RNA, 21 nt, Streptococcus pneumoniae R6
gcuagcgucuaacaauuagga

SEQ ID NO: 4111316 - RNA, 19 nt, Streptococcus pneumoniae R6
gcuagcuagaguuucaauu

SEQ ID NO: 4111317 - RNA, 22 nt, Streptococcus pneumoniae R6
gcuagcuugcgaaauggcucca

SEQ ID NO: 4111318 - RNA, 13 nt, Streptococcus pneumoniae R6
gcuaggagacucu

SEQ ID NO: 4111319 - RNA, 15 nt, Streptococcus pneumoniae R6
gcuagggauuuggcc

SEQ ID NO: 4111320 - RNA, 16 nt, Streptococcus pneumoniae R6
gcuagucgugaaagag

SEQ ID NO: 4111321 - RNA, 20 nt, Streptococcus pneumoniae R6
gcuauaagaugaccuuaucu

SEQ ID NO: 4111322 - RNA, 13 nt, Streptococcus pneumoniae R6
gcuauaagcccaa

SEQ ID NO: 4111323 - RNA, 15 nt, Streptococcus pneumoniae R6
gcuauaauaguaaga

SEQ ID NO: 4111324 - RNA, 13 nt, Streptococcus pneumoniae R6
gcuauagucaaag

SEQ ID NO: 4111325 - RNA, 18 nt, Streptococcus pneumoniae R6
gcuauauaguuuaaucaa

SEQ ID NO: 4111326 - RNA, 14 nt, Streptococcus pneumoniae R6
gcuaucaaugguuu

SEQ ID NO: 4111327 - RNA, 15 nt, Streptococcus pneumoniae R6
gcuguuuauuuuuua

SEQ ID NO: 4111328 - RNA, 16 nt, Streptococcus pneumoniae R6
gcuguuuauuuuuuaa

SEQ ID NO: 4111329 - RNA, 17 nt, Streptococcus pneumoniae R6
gcuuaaaauaauuuuuu

SEQ ID NO: 4111330 - RNA, 20 nt, Streptococcus pneumoniae R6
gcuuacaucaaaaacaucuc

SEQ ID NO: 4111331 - RNA, 19 nt, Streptococcus pneumoniae R6
gcuuauauacccaaaacac

SEQ ID NO: 4111332 - RNA, 19 nt, Streptococcus pneumoniae R6
gcuuauuucacauuuucaa

SEQ ID NO: 4111333 - RNA, 10 nt, Streptococcus pneumoniae R6
gcuucaucaa

SEQ ID NO: 4111334 - RNA, 20 nt, Streptococcus pneumoniae R6
gcuucaucaacccccauacc

SEQ ID NO: 4111335 - RNA, 14 nt, Streptococcus pneumoniae R6
gcuucaucuuucau

SEQ ID NO: 4111336 - RNA, 20 nt, Streptococcus pneumoniae R6
gcuuccaauaauagaaaaca

SEQ ID NO: 4111337 - RNA, 10 nt, Streptococcus pneumoniae R6
gcuuccaguu

SEQ ID NO: 4111338 - RNA, 20 nt, Streptococcus pneumoniae R6
gcuuccaucugcagccucaa

SEQ ID NO: 4111339 - RNA, 19 nt, Streptococcus pneumoniae R6
gcuucguaaucauaagcaa

SEQ ID NO: 4111340 - RNA, 17 nt, Streptococcus pneumoniae R6
gcuucguagucgccauc

SEQ ID NO: 4111341 - RNA, 16 nt, Streptococcus pneumoniae R6
gcuucuaagaucuggu

SEQ ID NO: 4111342 - RNA, 19 nt, Streptococcus pneumoniae R6
gcuucucggacuuuuucca

SEQ ID NO: 4111343 - RNA, 14 nt, Streptococcus pneumoniae R6
gcuucuuuccuuag

SEQ ID NO: 4111344 - RNA, 19 nt, Streptococcus pneumoniae R6
gcuucuuuuggauuuucaa

SEQ ID NO: 4111345 - RNA, 19 nt, Streptococcus pneumoniae R6
gcuucuuuuuauauauaaa

SEQ ID NO: 4111346 - RNA, 22 nt, Streptococcus pneumoniae R6
gcuucuuuuuuuacuaaaauaa

SEQ ID NO: 4111347 - RNA, 15 nt, Streptococcus pneumoniae R6
gcuugaaacaaauaa

SEQ ID NO: 4111348 - RNA, 20 nt, Streptococcus pneumoniae R6
gcuugaaacaaauaaaucau

SEQ ID NO: 4111349 - RNA, 14 nt, Streptococcus pneumoniae R6
gcuugaaacucauc

SEQ ID NO: 4111350 - RNA, 21 nt, Streptococcus pneumoniae R6
gcuugaaugauaaaacauacu

SEQ ID NO: 4111351 - RNA, 13 nt, Streptococcus pneumoniae R6
gcuugagcaaucc

SEQ ID NO: 4111352 - RNA, 18 nt, Streptococcus pneumoniae R6
gcuugaguggaaaaaccu

SEQ ID NO: 4111353 - RNA, 19 nt, Streptococcus pneumoniae R6
gcuugauaaccuuaaucaa

SEQ ID NO: 4111354 - RNA, 13 nt, Streptococcus pneumoniae R6
gcuugcauuuuuu

SEQ ID NO: 4111355 - RNA, 19 nt, Streptococcus pneumoniae R6
gcuugcguuuuugccucaa

SEQ ID NO: 4111356 - RNA, 19 nt, Streptococcus pneumoniae R6
gcuuggaaaucuucugugu

SEQ ID NO: 4111357 - RNA, 20 nt, Streptococcus pneumoniae R6
gcuuggaaaucuucuguguu

SEQ ID NO: 4111358 - RNA, 21 nt, Streptococcus pneumoniae R6
gcuuggaaugauuugggcaag

SEQ ID NO: 4111359 - RNA, 14 nt, Streptococcus pneumoniae R6
gcuuggauuuucaa

SEQ ID NO: 4111360 - RNA, 23 nt, Streptococcus pneumoniae R6
gcuuggcguuuugaguuaacuau

SEQ ID NO: 4111361 - RNA, 14 nt, Streptococcus pneumoniae R6
gcuugggaaaccaa

SEQ ID NO: 4111362 - RNA, 14 nt, Streptococcus pneumoniae R6
gcuugguaauagau

SEQ ID NO: 4111363 - RNA, 21 nt, Streptococcus pneumoniae R6
gcuuggucaguaagauacaga

SEQ ID NO: 4111364 - RNA, 15 nt, Streptococcus pneumoniae R6
gcuugucaucuucca

SEQ ID NO: 4111365 - RNA, 17 nt, Streptococcus pneumoniae R6
gcuugucaucuuccaag

SEQ ID NO: 4111366 - RNA, 22 nt, Streptococcus pneumoniae R6
gcuugucaucuuccaagaccug

SEQ ID NO: 4111367 - RNA, 16 nt, Streptococcus pneumoniae R6
gcuugugaaagcucuu

SEQ ID NO: 4111368 - RNA, 18 nt, Streptococcus pneumoniae R6
gcuuuaaaacuaaagcuu

SEQ ID NO: 4111369 - RNA, 13 nt, Streptococcus pneumoniae R6
gcuuuaaaugcug

SEQ ID NO: 4111370 - RNA, 18 nt, Streptococcus pneumoniae R6
gcuuuacuaguucucaaa

SEQ ID NO: 4111371 - RNA, 18 nt, Streptococcus pneumoniae R6
gcuuuaucaagcaaauca

SEQ ID NO: 4111372 - RNA, 18 nt, Streptococcus pneumoniae R6
gcuuuaucugcaaccuca

SEQ ID NO: 4111373 - RNA, 19 nt, Streptococcus pneumoniae R6
gcuuuauucuuaaauccac

SEQ ID NO: 4111374 - RNA, 19 nt, Streptococcus pneumoniae R6
gcuuuauugucucuaaaaa

SEQ ID NO: 4111375 - RNA, 19 nt, Streptococcus pneumoniae R6
gcuuucaauuguuuauaaa

SEQ ID NO: 4111376 - RNA, 20 nt, Streptococcus pneumoniae R6
gcuuucacaaauuugaaaau

SEQ ID NO: 4111377 - RNA, 20 nt, Streptococcus pneumoniae R6
gcuuucagcagcuucuucaa

SEQ ID NO: 4111378 - RNA, 11 nt, Streptococcus pneumoniae R6
gcuuuccuuuc

SEQ ID NO: 4111379 - RNA, 20 nt, Streptococcus pneumoniae R6
gcuuucuguaaucuuaccag

SEQ ID NO: 4111380 - RNA, 13 nt, Streptococcus pneumoniae R6
gcuuugaacaaau

SEQ ID NO: 4111381 - RNA, 17 nt, Streptococcus pneumoniae R6
gcuuugagauauuucuu

SEQ ID NO: 4111382 - RNA, 16 nt, Streptococcus pneumoniae R6
gcuuugagaucuuuuu

SEQ ID NO: 4111383 - RNA, 14 nt, Streptococcus pneumoniae R6
gcuuugagcaaccu

SEQ ID NO: 4111384 - RNA, 15 nt, Streptococcus pneumoniae R6
gcuuuggcaacugcu

SEQ ID NO: 4111385 - RNA, 16 nt, Streptococcus pneumoniae R6
gcuuugguuucagcua

SEQ ID NO: 4111386 - RNA, 17 nt, Streptococcus pneumoniae R6
gcuuuguggucuugcuu

SEQ ID NO: 4111387 - RNA, 15 nt, Streptococcus pneumoniae R6
gcuuuuauucagcca

SEQ ID NO: 4111388 - RNA, 14 nt, Streptococcus pneumoniae R6
gcuuuuauuucuug

SEQ ID NO: 4111389 - RNA, 13 nt, Streptococcus pneumoniae R6
gcuuuugauuuga

SEQ ID NO: 4111390 - RNA, 12 nt, Streptococcus pneumoniae R6
gcuuuuucuguu

SEQ ID NO: 4111391 - RNA, 13 nt, Streptococcus pneumoniae R6
gcuuuuucuuuuu

SEQ ID NO: 4111392 - RNA, 14 nt, Streptococcus pneumoniae R6
gcuuuuugauauga

SEQ ID NO: 4111393 - RNA, 15 nt, Streptococcus pneumoniae R6
gcuuuuuguuuucua

SEQ ID NO: 4111394 - RNA, 16 nt, Streptococcus pneumoniae R6
gcuuuuuuaaaugcug

SEQ ID NO: 4111395 - RNA, 17 nt, Streptococcus pneumoniae R6
gcuuuuuuaucuuuccu

SEQ ID NO: 4111396 - RNA, 19 nt, Streptococcus pneumoniae R6
gcuuuuuuaucuuuccuuc

SEQ ID NO: 4111397 - RNA, 14 nt, Streptococcus pneumoniae R6
gcuuuuuucuuuua

SEQ ID NO: 4111398 - RNA, 18 nt, Streptococcus pneumoniae R6
gcuuuuuuggcagauuua

SEQ ID NO: 4111399 - RNA, 11 nt, Streptococcus pneumoniae R6
ggaaaaauuuu

SEQ ID NO: 4111400 - RNA, 15 nt, Streptococcus pneumoniae R6
ggaaaacuuccaagc

SEQ ID NO: 4111401 - RNA, 21 nt, Streptococcus pneumoniae R6
ggaaaaguaaugccaggccag

SEQ ID NO: 4111402 - RNA, 16 nt, Streptococcus pneumoniae R6
ggaaacauugauaaua

SEQ ID NO: 4111403 - RNA, 20 nt, Streptococcus pneumoniae R6
ggaaaccaaucucaaauccu

SEQ ID NO: 4111404 - RNA, 23 nt, Streptococcus pneumoniae R6
ggaaaccagcugcguaguagauu

SEQ ID NO: 4111405 - RNA, 14 nt, Streptococcus pneumoniae R6
ggaaagcaucucca

SEQ ID NO: 4111406 - RNA, 14 nt, Streptococcus pneumoniae R6
ggaaagccaaauca

SEQ ID NO: 4111407 - RNA, 16 nt, Streptococcus pneumoniae R6
ggaaagccaaaucaau

SEQ ID NO: 4111408 - RNA, 23 nt, Streptococcus pneumoniae R6
ggaaaggaaaauugauuuauaga

SEQ ID NO: 4111409 - RNA, 17 nt, Streptococcus pneumoniae R6
ggaaaguaguaacuuuu

SEQ ID NO: 4111410 - RNA, 13 nt, Streptococcus pneumoniae R6
ggaaagucaaauu

SEQ ID NO: 4111411 - RNA, 15 nt, Streptococcus pneumoniae R6
ggaaagucaaauuaa

SEQ ID NO: 4111412 - RNA, 14 nt, Streptococcus pneumoniae R6
ggaaaguucuuccc

SEQ ID NO: 4111413 - RNA, 11 nt, Streptococcus pneumoniae R6
ggaaauaagaa

SEQ ID NO: 4111414 - RNA, 19 nt, Streptococcus pneumoniae R6
ggaaauauaggccaagaua

SEQ ID NO: 4111415 - RNA, 18 nt, Streptococcus pneumoniae R6
ggaaaucauaaauauccu

SEQ ID NO: 4111416 - RNA, 22 nt, Streptococcus pneumoniae R6
ggaaauucaagaaugacacgua

SEQ ID NO: 4111417 - RNA, 18 nt, Streptococcus pneumoniae R6
ggaaccugaaaaaauaaa

SEQ ID NO: 4111418 - RNA, 22 nt, Streptococcus pneumoniae R6
ggaacucacuucccugagacuu

SEQ ID NO: 4111419 - RNA, 18 nt, Streptococcus pneumoniae R6
ggaacucuagcuuuuuaa

SEQ ID NO: 4111420 - RNA, 23 nt, Streptococcus pneumoniae R6
ggaacugacgaagucagcucaaa

SEQ ID NO: 4111421 - RNA, 14 nt, Streptococcus pneumoniae R6
ggaagaaagaggag

SEQ ID NO: 4111422 - RNA, 18 nt, Streptococcus pneumoniae R6
ggaagaaagaggaguagg

SEQ ID NO: 4111423 - RNA, 19 nt, Streptococcus pneumoniae R6
ggaagagucagacuuggaa

SEQ ID NO: 4111424 - RNA, 16 nt, Streptococcus pneumoniae R6
ggaagaugaagacauu

SEQ ID NO: 4111425 - RNA, 17 nt, Streptococcus pneumoniae R6
ggaagguauggccgaua

SEQ ID NO: 4111426 - RNA, 18 nt, Streptococcus pneumoniae R6
ggaaguaccaaggaagaa

SEQ ID NO: 4111427 - RNA, 14 nt, Streptococcus pneumoniae R6
ggaagugaaaaagc

SEQ ID NO: 4111428 - RNA, 18 nt, Streptococcus pneumoniae R6
ggaaguugagcggauauu

SEQ ID NO: 4111429 - RNA, 23 nt, Streptococcus pneumoniae R6
ggaauaaggcagcuuaagugcgu

SEQ ID NO: 4111430 - RNA, 14 nt, Streptococcus pneumoniae R6
ggcgauuuuaggau

SEQ ID NO: 4111431 - RNA, 21 nt, Streptococcus pneumoniae R6
ggcgauuuuuuugauuucugg

SEQ ID NO: 4111432 - RNA, 11 nt, Streptococcus pneumoniae R6
ggcgccugcug

SEQ ID NO: 4111433 - RNA, 14 nt, Streptococcus pneumoniae R6
ggcguaguaaauca

SEQ ID NO: 4111434 - RNA, 11 nt, Streptococcus pneumoniae R6
ggcguccucua

SEQ ID NO: 4111435 - RNA, 11 nt, Streptococcus pneumoniae R6
ggcgugcuccc

SEQ ID NO: 4111436 - RNA, 19 nt, Streptococcus pneumoniae R6
ggcgugggucaucaagcuu

SEQ ID NO: 4111437 - RNA, 21 nt, Streptococcus pneumoniae R6
ggcguguuugucaaacaucau

SEQ ID NO: 4111438 - RNA, 16 nt, Streptococcus pneumoniae R6
ggcguuaccuccaccu

SEQ ID NO: 4111439 - RNA, 18 nt, Streptococcus pneumoniae R6
ggcuaauuguaaacugug

SEQ ID NO: 4111440 - RNA, 17 nt, Streptococcus pneumoniae R6
ggcuacaccguaauuuc

SEQ ID NO: 4111441 - RNA, 21 nt, Streptococcus pneumoniae R6
ggcuacagaugcugcauuuug

SEQ ID NO: 4111442 - RNA, 16 nt, Streptococcus pneumoniae R6
ggcuagcacuaguaau

SEQ ID NO: 4111443 - RNA, 22 nt, Streptococcus pneumoniae R6
ggcuagcuuucuaguuugcucu

SEQ ID NO: 4111444 - RNA, 23 nt, Streptococcus pneumoniae R6
ggcuagucccugguaaaagagca

SEQ ID NO: 4111445 - RNA, 17 nt, Streptococcus pneumoniae R6
ggcuauugaagaagacu

SEQ ID NO: 4111446 - RNA, 16 nt, Streptococcus pneumoniae R6
ggcucauaaauggagc

SEQ ID NO: 4111447 - RNA, 19 nt, Streptococcus pneumoniae R6
ggcucaucuggcuuucugu

SEQ ID NO: 4111448 - RNA, 15 nt, Streptococcus pneumoniae R6
ggcucauguaaauca

SEQ ID NO: 4111449 - RNA, 16 nt, Streptococcus pneumoniae R6
ggcucauguaaaucau

SEQ ID NO: 4111450 - RNA, 20 nt, Streptococcus pneumoniae R6
ggcuccguuuuggacgucuu

SEQ ID NO: 4111451 - RNA, 20 nt, Streptococcus pneumoniae R6
ggcugaaacugcguuuugau

SEQ ID NO: 4111452 - RNA, 22 nt, Streptococcus pneumoniae R6
ggcugaaggaaugccaaagaca

SEQ ID NO: 4111453 - RNA, 19 nt, Streptococcus pneumoniae R6
ggcugaauauauucuccag

SEQ ID NO: 4111454 - RNA, 19 nt, Streptococcus pneumoniae R6
ggcugacaauaaagauaag

SEQ ID NO: 4111455 - RNA, 21 nt, Streptococcus pneumoniae R6
ggcugauuuugaaaaugaauu

SEQ ID NO: 4111456 - RNA, 17 nt, Streptococcus pneumoniae R6
ggcuggggcgaccacua

SEQ ID NO: 4111457 - RNA, 15 nt, Streptococcus pneumoniae R6
ggcuguaguuuuacc

SEQ ID NO: 4111458 - RNA, 20 nt, Streptococcus pneumoniae R6
ggcugugauauacuaauaua

SEQ ID NO: 4111459 - RNA, 16 nt, Streptococcus pneumoniae R6
ggcuguguagaugaga

SEQ ID NO: 4111460 - RNA, 17 nt, Streptococcus pneumoniae R6
ggcuguuucaaaugaaa

SEQ ID NO: 4111461 - RNA, 16 nt, Streptococcus pneumoniae R6
ggcuguuuuggcaacg

SEQ ID NO: 4111462 - RNA, 18 nt, Streptococcus pneumoniae R6
ggcuuacaucaaaaacau

SEQ ID NO: 4111463 - RNA, 22 nt, Streptococcus pneumoniae R6
ggcuuaucugacuagcaucuug

SEQ ID NO: 4111464 - RNA, 13 nt, Streptococcus pneumoniae R6
ggcuucaguaaua

SEQ ID NO: 4111465 - RNA, 20 nt, Streptococcus pneumoniae R6
ggcuucauuaugaguggcag

SEQ ID NO: 4111466 - RNA, 12 nt, Streptococcus pneumoniae R6
ggcuuccugugc

SEQ ID NO: 4111467 - RNA, 17 nt, Streptococcus pneumoniae R6
ggcuugguucuucacua

SEQ ID NO: 4111468 - RNA, 24 nt, Streptococcus pneumoniae R6
ggcuuguaauucgccuaguaagau

SEQ ID NO: 4111469 - RNA, 12 nt, Streptococcus pneumoniae R6
ggcuuguuuaaa

SEQ ID NO: 4111470 - RNA, 14 nt, Streptococcus pneumoniae R6
ggcuuuauucuuaa

SEQ ID NO: 4111471 - RNA, 21 nt, Streptococcus pneumoniae R6
ggcuuucaacugcuuuuucaa

SEQ ID NO: 4111472 - RNA, 13 nt, Streptococcus pneumoniae R6
ggcuuucccagac

SEQ ID NO: 4111473 - RNA, 12 nt, Streptococcus pneumoniae R6
ggcuuucuucac

SEQ ID NO: 4111474 - RNA, 12 nt, Streptococcus pneumoniae R6
ggcuuuuccaag

SEQ ID NO: 4111475 - RNA, 13 nt, Streptococcus pneumoniae R6
ggcuuuucuauca

SEQ ID NO: 4111476 - RNA, 16 nt, Streptococcus pneumoniae R6
ggcuuuugauuugauu

SEQ ID NO: 4111477 - RNA, 15 nt, Streptococcus pneumoniae R6
ggcuuuuucucaucu

SEQ ID NO: 4111478 - RNA, 22 nt, Streptococcus pneumoniae R6
gggaaaaauuuucaaaaucaga

SEQ ID NO: 4111479 - RNA, 22 nt, Streptococcus pneumoniae R6
gggaaaugaaagaaacucuaaa

SEQ ID NO: 4111480 - RNA, 15 nt, Streptococcus pneumoniae R6
gggaacacuuguaaa

SEQ ID NO: 4111481 - RNA, 20 nt, Streptococcus pneumoniae R6
gggaaggugagggcugagaa

SEQ ID NO: 4111482 - RNA, 12 nt, Streptococcus pneumoniae R6
gggaaugaugac

SEQ ID NO: 4111483 - RNA, 15 nt, Streptococcus pneumoniae R6
gggagaaaagucacu

SEQ ID NO: 4111484 - RNA, 16 nt, Streptococcus pneumoniae R6
gggagaaaugagagau

SEQ ID NO: 4111485 - RNA, 15 nt, Streptococcus pneumoniae R6
gggagcuaacucaag

SEQ ID NO: 4111486 - RNA, 13 nt, Streptococcus pneumoniae R6
gggagguaaagau

SEQ ID NO: 4111487 - RNA, 18 nt, Streptococcus pneumoniae R6
gggauccucauauucuuu

SEQ ID NO: 4111488 - RNA, 20 nt, Streptococcus pneumoniae R6
gggauuuucauauaauaaau

SEQ ID NO: 4111489 - RNA, 19 nt, Streptococcus pneumoniae R6
gggauuuuuuagcuucuuu

SEQ ID NO: 4111490 - RNA, 14 nt, Streptococcus pneumoniae R6
gggcaagcugucaa

SEQ ID NO: 4111491 - RNA, 21 nt, Streptococcus pneumoniae R6
gggcaagggcaccaaacuuag

SEQ ID NO: 4111492 - RNA, 13 nt, Streptococcus pneumoniae R6
gggcaccaaacuu

SEQ ID NO: 4111493 - RNA, 19 nt, Streptococcus pneumoniae R6
gggcacgacgggcuuggaa

SEQ ID NO: 4111494 - RNA, 20 nt, Streptococcus pneumoniae R6
gggcacgacgggcuuggaaa

SEQ ID NO: 4111495 - RNA, 13 nt, Streptococcus pneumoniae R6
gggcacggagggc

SEQ ID NO: 4111496 - RNA, 12 nt, Streptococcus pneumoniae R6
gggcacuucuuu

SEQ ID NO: 4111497 - RNA, 16 nt, Streptococcus pneumoniae R6
gggcagacgaguuaaa

SEQ ID NO: 4111498 - RNA, 17 nt, Streptococcus pneumoniae R6
gggcagacgaguuaaaa

SEQ ID NO: 4111499 - RNA, 18 nt, Streptococcus pneumoniae R6
gggcaucaacagcuccau

SEQ ID NO: 4111500 - RNA, 20 nt, Streptococcus pneumoniae R6
gggcaugucguauaucugag

SEQ ID NO: 4111501 - RNA, 22 nt, Streptococcus pneumoniae R6
gggcugcguugaggacagguau

SEQ ID NO: 4111502 - RNA, 17 nt, Streptococcus pneumoniae R6
gggcuuuucuaucacuc

SEQ ID NO: 4111503 - RNA, 13 nt, Streptococcus pneumoniae R6
ggggucggcagaa

SEQ ID NO: 4111504 - RNA, 14 nt, Streptococcus pneumoniae R6
gggucaacuuguaa

SEQ ID NO: 4111505 - RNA, 22 nt, Streptococcus pneumoniae R6
gggucaugccuuuuucaaucaa

SEQ ID NO: 4111506 - RNA, 19 nt, Streptococcus pneumoniae R6
gggugucaaaucaaaauca

SEQ ID NO: 4111507 - RNA, 22 nt, Streptococcus pneumoniae R6
ggguuaguugguuaucuuuaaa

SEQ ID NO: 4111508 - RNA, 12 nt, Streptococcus pneumoniae R6
ggguucaucucu

SEQ ID NO: 4111509 - RNA, 20 nt, Streptococcus pneumoniae R6
ggguucuucgaaagucaauu

SEQ ID NO: 4111510 - RNA, 12 nt, Streptococcus pneumoniae R6
ggguucuuugcc

SEQ ID NO: 4111511 - RNA, 14 nt, Streptococcus pneumoniae R6
ggguugaaguaacu

SEQ ID NO: 4111512 - RNA, 20 nt, Streptococcus pneumoniae R6
ggguugagaagugggagaaa

SEQ ID NO: 4111513 - RNA, 14 nt, Streptococcus pneumoniae R6
ggguuucuucuagc

SEQ ID NO: 4111514 - RNA, 21 nt, Streptococcus pneumoniae R6
ggguuuuaaagccgacccagg

SEQ ID NO: 4111515 - RNA, 15 nt, Streptococcus pneumoniae R6
gguaaaagagcaaga

SEQ ID NO: 4111516 - RNA, 18 nt, Streptococcus pneumoniae R6
gguaaaagagcaagaacu

SEQ ID NO: 4111517 - RNA, 14 nt, Streptococcus pneumoniae R6
gguaacaaaacuaa

SEQ ID NO: 4111518 - RNA, 14 nt, Streptococcus pneumoniae R6
gguaagagaacuuc

SEQ ID NO: 4111519 - RNA, 15 nt, Streptococcus pneumoniae R6
gguaauuaugaaauu

SEQ ID NO: 4111520 - RNA, 20 nt, Streptococcus pneumoniae R6
gguacaguugggauuccaua

SEQ ID NO: 4111521 - RNA, 23 nt, Streptococcus pneumoniae R6
gguaccgcugaaagcaaggcuug

SEQ ID NO: 4111522 - RNA, 14 nt, Streptococcus pneumoniae R6
gguagauaccucgu

SEQ ID NO: 4111523 - RNA, 13 nt, Streptococcus pneumoniae R6
gguaggaguuuga

SEQ ID NO: 4111524 - RNA, 20 nt, Streptococcus pneumoniae R6
gguaggcauaaacaggcucg

SEQ ID NO: 4111525 - RNA, 19 nt, Streptococcus pneumoniae R6
gguaguuguuaguucuuga

SEQ ID NO: 4111526 - RNA, 17 nt, Streptococcus pneumoniae R6
gguaugaucuauuccua

SEQ ID NO: 4111527 - RNA, 15 nt, Streptococcus pneumoniae R6
gguauuuguaaaauu

SEQ ID NO: 4111528 - RNA, 12 nt, Streptococcus pneumoniae R6
ggucaagaagcg

SEQ ID NO: 4111529 - RNA, 17 nt, Streptococcus pneumoniae R6
ggucaagauauucuuga

SEQ ID NO: 4111530 - RNA, 22 nt, Streptococcus pneumoniae R6
ggucaaucuugucuaaaaauag

SEQ ID NO: 4111531 - RNA, 14 nt, Streptococcus pneumoniae R6
ggucaauggcaaaa

SEQ ID NO: 4111532 - RNA, 17 nt, Streptococcus pneumoniae R6
ggucacauugaaaaugu

SEQ ID NO: 4111533 - RNA, 14 nt, Streptococcus pneumoniae R6
guaugaaggaguuu

SEQ ID NO: 4111534 - RNA, 17 nt, Streptococcus pneumoniae R6
guaugaaggaguuucac

SEQ ID NO: 4111535 - RNA, 21 nt, Streptococcus pneumoniae R6
guaugaaggaguuucaccuug

SEQ ID NO: 4111536 - RNA, 19 nt, Streptococcus pneumoniae R6
guaugacaucuuggaguug

SEQ ID NO: 4111537 - RNA, 20 nt, Streptococcus pneumoniae R6
guaugagcacuauuguuauu

SEQ ID NO: 4111538 - RNA, 17 nt, Streptococcus pneumoniae R6
guaugcaaggcaaugau

SEQ ID NO: 4111539 - RNA, 13 nt, Streptococcus pneumoniae R6
guauggagcuuuu

SEQ ID NO: 4111540 - RNA, 16 nt, Streptococcus pneumoniae R6
guauggaggaauaaau

SEQ ID NO: 4111541 - RNA, 21 nt, Streptococcus pneumoniae R6
guauguuuaaagucucugucc

SEQ ID NO: 4111542 - RNA, 12 nt, Streptococcus pneumoniae R6
guauuaaaauaa

SEQ ID NO: 4111543 - RNA, 22 nt, Streptococcus pneumoniae R6
guauuaaaauaaguucaacaaa

SEQ ID NO: 4111544 - RNA, 22 nt, Streptococcus pneumoniae R6
guauuaagaacucuuuccaacu

SEQ ID NO: 4111545 - RNA, 13 nt, Streptococcus pneumoniae R6
guauuacauccac

SEQ ID NO: 4111546 - RNA, 18 nt, Streptococcus pneumoniae R6
guauuauucuaguuucaa

SEQ ID NO: 4111547 - RNA, 17 nt, Streptococcus pneumoniae R6
guauucagucaucucug

SEQ ID NO: 4111548 - RNA, 15 nt, Streptococcus pneumoniae R6
guauucauaaaauac

SEQ ID NO: 4111549 - RNA, 20 nt, Streptococcus pneumoniae R6
guauucaucuuaucaacgcu

SEQ ID NO: 4111550 - RNA, 19 nt, Streptococcus pneumoniae R6
guauuccaagaguaaauca

SEQ ID NO: 4111551 - RNA, 15 nt, Streptococcus pneumoniae R6
guauugaaaaaacuu

SEQ ID NO: 4111552 - RNA, 12 nt, Streptococcus pneumoniae R6
guauugaacccg

SEQ ID NO: 4111553 - RNA, 14 nt, Streptococcus pneumoniae R6
guauugacugccca

SEQ ID NO: 4111554 - RNA, 19 nt, Streptococcus pneumoniae R6
guauugggaugacuuucca

SEQ ID NO: 4111555 - RNA, 12 nt, Streptococcus pneumoniae R6
guauuuauaaac

SEQ ID NO: 4111556 - RNA, 18 nt, Streptococcus pneumoniae R6
guauuuaugugcuuaaca

SEQ ID NO: 4111557 - RNA, 17 nt, Streptococcus pneumoniae R6
guauuucuucuucugaa

SEQ ID NO: 4111558 - RNA, 12 nt, Streptococcus pneumoniae R6
guauuuguaaaa

SEQ ID NO: 4111559 - RNA, 22 nt, Streptococcus pneumoniae R6
guauuuuaaauuauguaaauaa

SEQ ID NO: 4111560 - RNA, 15 nt, Streptococcus pneumoniae R6
guauuuuuucuuccc

SEQ ID NO: 4111561 - RNA, 14 nt, Streptococcus pneumoniae R6
gucaaaaagaagga

SEQ ID NO: 4111562 - RNA, 21 nt, Streptococcus pneumoniae R6
gucaaaauauuuggagcaagu

SEQ ID NO: 4111563 - RNA, 12 nt, Streptococcus pneumoniae R6
gucaaacaucau

SEQ ID NO: 4111564 - RNA, 21 nt, Streptococcus pneumoniae R6
gucaaacuuuuucucucugaa

SEQ ID NO: 4111565 - RNA, 13 nt, Streptococcus pneumoniae R6
gucaaagaaggcu

SEQ ID NO: 4111566 - RNA, 20 nt, Streptococcus pneumoniae R6
gucaaauaagaaagaccaua

SEQ ID NO: 4111567 - RNA, 19 nt, Streptococcus pneumoniae R6
gucaaaucgauuucuaaaa

SEQ ID NO: 4111568 - RNA, 22 nt, Streptococcus pneumoniae R6
gucaaauuaauuuauagaaaaa

SEQ ID NO: 4111569 - RNA, 14 nt, Streptococcus pneumoniae R6
gucaacgucaucuu

SEQ ID NO: 4111570 - RNA, 11 nt, Streptococcus pneumoniae R6
gucaacuguag

SEQ ID NO: 4111571 - RNA, 18 nt, Streptococcus pneumoniae R6
gucaacuguaguggguug

SEQ ID NO: 4111572 - RNA, 20 nt, Streptococcus pneumoniae R6
gucaacuguaguggguugaa

SEQ ID NO: 4111573 - RNA, 22 nt, Streptococcus pneumoniae R6
gucaagaauccgccguuaucca

SEQ ID NO: 4111574 - RNA, 15 nt, Streptococcus pneumoniae R6
gucaagaccauggcg

SEQ ID NO: 4111575 - RNA, 14 nt, Streptococcus pneumoniae R6
gucaagagaaaacc

SEQ ID NO: 4111576 - RNA, 22 nt, Streptococcus pneumoniae R6
gucaagaguugguagguauauu

SEQ ID NO: 4111577 - RNA, 23 nt, Streptococcus pneumoniae R6
gucaaggauuucuuugaaaucuu

SEQ ID NO: 4111578 - RNA, 19 nt, Streptococcus pneumoniae R6
gucaagggguuaagacacc

SEQ ID NO: 4111579 - RNA, 19 nt, Streptococcus pneumoniae R6
gucaauaauauaggucaga

SEQ ID NO: 4111580 - RNA, 22 nt, Streptococcus pneumoniae R6
gucaauaccagguaauccagaa

SEQ ID NO: 4111581 - RNA, 14 nt, Streptococcus pneumoniae R6
gucaauugaaacaa

SEQ ID NO: 4111582 - RNA, 19 nt, Streptococcus pneumoniae R6
gucaauuuccauuuacaga

SEQ ID NO: 4111583 - RNA, 11 nt, Streptococcus pneumoniae R6
gucacacaaaa

SEQ ID NO: 4111584 - RNA, 18 nt, Streptococcus pneumoniae R6
gucacagaaccaucuuca

SEQ ID NO: 4111585 - RNA, 20 nt, Streptococcus pneumoniae R6
gucacagaaccaucuucauu

SEQ ID NO: 4111586 - RNA, 17 nt, Streptococcus pneumoniae R6
gucacauucgaaugaua

SEQ ID NO: 4111587 - RNA, 18 nt, Streptococcus pneumoniae R6
gucaccaaauuucauauu

SEQ ID NO: 4111588 - RNA, 22 nt, Streptococcus pneumoniae R6
gucaccaucuaagguauauuca

SEQ ID NO: 4111589 - RNA, 14 nt, Streptococcus pneumoniae R6
gucaccgacaacuu

SEQ ID NO: 4111590 - RNA, 22 nt, Streptococcus pneumoniae R6
gucaccgauagcggcaacuagg

SEQ ID NO: 4111591 - RNA, 15 nt, Streptococcus pneumoniae R6
gucacgaaccacacu

SEQ ID NO: 4111592 - RNA, 16 nt, Streptococcus pneumoniae R6
gucacggaguuucuug

SEQ ID NO: 4111593 - RNA, 17 nt, Streptococcus pneumoniae R6
gucacggaguuucuugg

SEQ ID NO: 4111594 - RNA, 16 nt, Streptococcus pneumoniae R6
gucacuacuuccaucu

SEQ ID NO: 4111595 - RNA, 20 nt, Streptococcus pneumoniae R6
gucacuacuuccaucuacac

SEQ ID NO: 4111596 - RNA, 22 nt, Streptococcus pneumoniae R6
gucacuguauuggucguauuuu

SEQ ID NO: 4111597 - RNA, 21 nt, Streptococcus pneumoniae R6
gucacuugaccuguuuucaca

SEQ ID NO: 4111598 - RNA, 23 nt, Streptococcus pneumoniae R6
gucacuugccucuuuaagagacu

SEQ ID NO: 4111599 - RNA, 16 nt, Streptococcus pneumoniae R6
gucagaaagaaguuua

SEQ ID NO: 4111600 - RNA, 17 nt, Streptococcus pneumoniae R6
gucagaggggugcugag

SEQ ID NO: 4111601 - RNA, 14 nt, Streptococcus pneumoniae R6
gucagauaggauug

SEQ ID NO: 4111602 - RNA, 21 nt, Streptococcus pneumoniae R6
gucagcccuauccgcaaccuc

SEQ ID NO: 4111603 - RNA, 22 nt, Streptococcus pneumoniae R6
gucagcccuauccgcaaccuca

SEQ ID NO: 4111604 - RNA, 16 nt, Streptococcus pneumoniae R6
gucagcucaaaacacu

SEQ ID NO: 4111605 - RNA, 17 nt, Streptococcus pneumoniae R6
gucagcugucuuuucaa

SEQ ID NO: 4111606 - RNA, 17 nt, Streptococcus pneumoniae R6
gucagcuuccaucugca

SEQ ID NO: 4111607 - RNA, 18 nt, Streptococcus pneumoniae R6
gucagcuuccaucugcag

SEQ ID NO: 4111608 - RNA, 15 nt, Streptococcus pneumoniae R6
gucagcuuuaucugc

SEQ ID NO: 4111609 - RNA, 22 nt, Streptococcus pneumoniae R6
gucagcuuuaucugcaaccuca

SEQ ID NO: 4111610 - RNA, 17 nt, Streptococcus pneumoniae R6
gucagggaaaaaacucg

SEQ ID NO: 4111611 - RNA, 21 nt, Streptococcus pneumoniae R6
gucagucuuaucuaaaaccuc

SEQ ID NO: 4111612 - RNA, 22 nt, Streptococcus pneumoniae R6
gucagucuuaucuaaaaccuca

SEQ ID NO: 4111613 - RNA, 18 nt, Streptococcus pneumoniae R6
gucagugguucacuggca

SEQ ID NO: 4111614 - RNA, 14 nt, Streptococcus pneumoniae R6
gucaguucuaucca

SEQ ID NO: 4111615 - RNA, 16 nt, Streptococcus pneumoniae R6
gucaguucuauccaca

SEQ ID NO: 4111616 - RNA, 22 nt, Streptococcus pneumoniae R6
gucaguucuauccacaaccuca

SEQ ID NO: 4111617 - RNA, 22 nt, Streptococcus pneumoniae R6
gucaguucuaucuacaaccuca

SEQ ID NO: 4111618 - RNA, 17 nt, Streptococcus pneumoniae R6
gucaguucuaucugcaa

SEQ ID NO: 4111619 - RNA, 21 nt, Streptococcus pneumoniae R6
gucaguucuaucugcaaccuc

SEQ ID NO: 4111620 - RNA, 22 nt, Streptococcus pneumoniae R6
gucaguucuaucugcaaccuca

SEQ ID NO: 4111621 - RNA, 22 nt, Streptococcus pneumoniae R6
gucaguucuaucugcaaccuua

SEQ ID NO: 4111622 - RNA, 22 nt, Streptococcus pneumoniae R6
gucaguuucauccacaaccuca

SEQ ID NO: 4111623 - RNA, 23 nt, Streptococcus pneumoniae R6
gucaguuucauccacaaccucaa

SEQ ID NO: 4111624 - RNA, 22 nt, Streptococcus pneumoniae R6
gucaguuucaucuacaaccuca

SEQ ID NO: 4111625 - RNA, 23 nt, Streptococcus pneumoniae R6
gucaguuucaucuacaaccucaa

SEQ ID NO: 4111626 - RNA, 14 nt, Streptococcus pneumoniae R6
gucauaaacaucug

SEQ ID NO: 4111627 - RNA, 16 nt, Streptococcus pneumoniae R6
gucauaaacaucuguc

SEQ ID NO: 4111628 - RNA, 13 nt, Streptococcus pneumoniae R6
gucauaacauucu

SEQ ID NO: 4111629 - RNA, 12 nt, Streptococcus pneumoniae R6
gucauauuucuu

SEQ ID NO: 4111630 - RNA, 19 nt, Streptococcus pneumoniae R6
gucaucaaaaauagaaaua

SEQ ID NO: 4111631 - RNA, 21 nt, Streptococcus pneumoniae R6
gucaucaaaauccguuuuuua

SEQ ID NO: 4111632 - RNA, 19 nt, Streptococcus pneumoniae R6
gucaucagcagagaaagaa

SEQ ID NO: 4111633 - RNA, 17 nt, Streptococcus pneumoniae R6
gucauccauuuuuccau

SEQ ID NO: 4111634 - RNA, 14 nt, Streptococcus pneumoniae R6
gucaucguuccagu

SEQ ID NO: 4111635 - RNA, 18 nt, Streptococcus pneumoniae R6
gucuugugaauagcucaa

SEQ ID NO: 4111636 - RNA, 13 nt, Streptococcus pneumoniae R6
gucuuuaaaauua

SEQ ID NO: 4111637 - RNA, 20 nt, Streptococcus pneumoniae R6
gucuuuacguccaccacaaa

SEQ ID NO: 4111638 - RNA, 14 nt, Streptococcus pneumoniae R6
gucuuucauuucug

SEQ ID NO: 4111639 - RNA, 20 nt, Streptococcus pneumoniae R6
gucuuugauuuugagacuaa

SEQ ID NO: 4111640 - RNA, 19 nt, Streptococcus pneumoniae R6
gucuuuugccuuagcaacu

SEQ ID NO: 4111641 - RNA, 14 nt, Streptococcus pneumoniae R6
gucuuuuguccugu

SEQ ID NO: 4111642 - RNA, 13 nt, Streptococcus pneumoniae R6
gucuuuuugcuca

SEQ ID NO: 4111643 - RNA, 23 nt, Streptococcus pneumoniae R6
gugaaaaucauagagcaaacuag

SEQ ID NO: 4111644 - RNA, 18 nt, Streptococcus pneumoniae R6
gugaaacuaaugagccuu

SEQ ID NO: 4111645 - RNA, 20 nt, Streptococcus pneumoniae R6
gugaaaguuagccucucuaa

SEQ ID NO: 4111646 - RNA, 21 nt, Streptococcus pneumoniae R6
gugaaaucauacugccaagau

SEQ ID NO: 4111647 - RNA, 17 nt, Streptococcus pneumoniae R6
gugaacaaugguaacag

SEQ ID NO: 4111648 - RNA, 21 nt, Streptococcus pneumoniae R6
gugaacaaugguaacagucuu

SEQ ID NO: 4111649 - RNA, 22 nt, Streptococcus pneumoniae R6
gugaacaaugguaacagucuua

SEQ ID NO: 4111650 - RNA, 14 nt, Streptococcus pneumoniae R6
gugaauagcucaaa

SEQ ID NO: 4111651 - RNA, 13 nt, Streptococcus pneumoniae R6
gugaaucuaguaa

SEQ ID NO: 4111652 - RNA, 12 nt, Streptococcus pneumoniae R6
gugaauuuucaa

SEQ ID NO: 4111653 - RNA, 13 nt, Streptococcus pneumoniae R6
gugacaguaaaaa

SEQ ID NO: 4111654 - RNA, 21 nt, Streptococcus pneumoniae R6
gugacauggacacauaguagu

SEQ ID NO: 4111655 - RNA, 19 nt, Streptococcus pneumoniae R6
gugaccuggacggauuucu

SEQ ID NO: 4111656 - RNA, 14 nt, Streptococcus pneumoniae R6
gugacgagacagau

SEQ ID NO: 4111657 - RNA, 13 nt, Streptococcus pneumoniae R6
gugagaggggcua

SEQ ID NO: 4111658 - RNA, 12 nt, Streptococcus pneumoniae R6
gugagcaucagg

SEQ ID NO: 4111659 - RNA, 14 nt, Streptococcus pneumoniae R6
gugauaaaguuucu

SEQ ID NO: 4111660 - RNA, 16 nt, Streptococcus pneumoniae R6
gugauauaauaaaaag

SEQ ID NO: 4111661 - RNA, 15 nt, Streptococcus pneumoniae R6
gugauaucaaugguu

SEQ ID NO: 4111662 - RNA, 16 nt, Streptococcus pneumoniae R6
gugauguaauuucuga

SEQ ID NO: 4111663 - RNA, 14 nt, Streptococcus pneumoniae R6
gugauuaaaacugc

SEQ ID NO: 4111664 - RNA, 15 nt, Streptococcus pneumoniae R6
gugauuaaaacugcc

SEQ ID NO: 4111665 - RNA, 16 nt, Streptococcus pneumoniae R6
gugauugugaauaggu

SEQ ID NO: 4111666 - RNA, 17 nt, Streptococcus pneumoniae R6
gugauuucuaaaacauu

SEQ ID NO: 4111667 - RNA, 17 nt, Streptococcus pneumoniae R6
gugauuucuguaaaaau

SEQ ID NO: 4111668 - RNA, 18 nt, Streptococcus pneumoniae R6
gugauuucuguaaaaaua

SEQ ID NO: 4111669 - RNA, 15 nt, Streptococcus pneumoniae R6
gugauuuuaaauuua

SEQ ID NO: 4111670 - RNA, 18 nt, Streptococcus pneumoniae R6
gugauuuuauauaaaaua

SEQ ID NO: 4111671 - RNA, 17 nt, Streptococcus pneumoniae R6
gugcaaacuaggaagcu

SEQ ID NO: 4111672 - RNA, 22 nt, Streptococcus pneumoniae R6
gugcaaagacagggccuuagca

SEQ ID NO: 4111673 - RNA, 14 nt, Streptococcus pneumoniae R6
gugcagucuuuuug

SEQ ID NO: 4111674 - RNA, 17 nt, Streptococcus pneumoniae R6
gugcauuucauccccau

SEQ ID NO: 4111675 - RNA, 13 nt, Streptococcus pneumoniae R6
gugccacaauacc

SEQ ID NO: 4111676 - RNA, 17 nt, Streptococcus pneumoniae R6
gugcgagacaaaaaaaa

SEQ ID NO: 4111677 - RNA, 16 nt, Streptococcus pneumoniae R6
gugcgagccucuuuuu

SEQ ID NO: 4111678 - RNA, 16 nt, Streptococcus pneumoniae R6
gugcuaaguccuugau

SEQ ID NO: 4111679 - RNA, 12 nt, Streptococcus pneumoniae R6
gugcuagcuugc

SEQ ID NO: 4111680 - RNA, 14 nt, Streptococcus pneumoniae R6
gugcuagggcaagg

SEQ ID NO: 4111681 - RNA, 13 nt, Streptococcus pneumoniae R6
gugcucacagagu

SEQ ID NO: 4111682 - RNA, 15 nt, Streptococcus pneumoniae R6
gugcuccauuuuuua

SEQ ID NO: 4111683 - RNA, 15 nt, Streptococcus pneumoniae R6
gugcugcgucugcuc

SEQ ID NO: 4111684 - RNA, 17 nt, Streptococcus pneumoniae R6
gugcuguagagagauaa

SEQ ID NO: 4111685 - RNA, 12 nt, Streptococcus pneumoniae R6
gugcuucuggga

SEQ ID NO: 4111686 - RNA, 17 nt, Streptococcus pneumoniae R6
guggaaaauagaaaaaa

SEQ ID NO: 4111687 - RNA, 15 nt, Streptococcus pneumoniae R6
guggaaugauaacau

SEQ ID NO: 4111688 - RNA, 18 nt, Streptococcus pneumoniae R6
guggacaugaguccugcg

SEQ ID NO: 4111689 - RNA, 17 nt, Streptococcus pneumoniae R6
guggacucgaaccaccg

SEQ ID NO: 4111690 - RNA, 11 nt, Streptococcus pneumoniae R6
guggagaaagu

SEQ ID NO: 4111691 - RNA, 15 nt, Streptococcus pneumoniae R6
guggaugaaacugac

SEQ ID NO: 4111692 - RNA, 19 nt, Streptococcus pneumoniae R6
gugggaauauguauuucau

SEQ ID NO: 4111693 - RNA, 13 nt, Streptococcus pneumoniae R6
gugggaauguuug

SEQ ID NO: 4111694 - RNA, 13 nt, Streptococcus pneumoniae R6
gugggcugauuuu

SEQ ID NO: 4111695 - RNA, 18 nt, Streptococcus pneumoniae R6
gugggcuuuuuucuaucc

SEQ ID NO: 4111696 - RNA, 21 nt, Streptococcus pneumoniae R6
gugguaaugcuuuccauuaau

SEQ ID NO: 4111697 - RNA, 15 nt, Streptococcus pneumoniae R6
gugguauacuauuuu

SEQ ID NO: 4111698 - RNA, 16 nt, Streptococcus pneumoniae R6
guggugucauauaauc

SEQ ID NO: 4111699 - RNA, 13 nt, Streptococcus pneumoniae R6
gugguugaugaga

SEQ ID NO: 4111700 - RNA, 17 nt, Streptococcus pneumoniae R6
guguacuacucuaacuu

SEQ ID NO: 4111701 - RNA, 19 nt, Streptococcus pneumoniae R6
guguacucaacagaagaau

SEQ ID NO: 4111702 - RNA, 20 nt, Streptococcus pneumoniae R6
guguauuauucuaguuucaa

SEQ ID NO: 4111703 - RNA, 19 nt, Streptococcus pneumoniae R6
guguauucguccauccaag

SEQ ID NO: 4111704 - RNA, 14 nt, Streptococcus pneumoniae R6
gugucaaaaaggaa

SEQ ID NO: 4111705 - RNA, 17 nt, Streptococcus pneumoniae R6
gugucauaaucuguuua

SEQ ID NO: 4111706 - RNA, 11 nt, Streptococcus pneumoniae R6
gugucucuggu

SEQ ID NO: 4111707 - RNA, 15 nt, Streptococcus pneumoniae R6
gugugaaaacuugau

SEQ ID NO: 4111708 - RNA, 16 nt, Streptococcus pneumoniae R6
gugugaaauuugugau

SEQ ID NO: 4111709 - RNA, 14 nt, Streptococcus pneumoniae R6
guguggcgcugcuu

SEQ ID NO: 4111710 - RNA, 12 nt, Streptococcus pneumoniae R6
guguuaaaucau

SEQ ID NO: 4111711 - RNA, 12 nt, Streptococcus pneumoniae R6
guguucaaaaac

SEQ ID NO: 4111712 - RNA, 17 nt, Streptococcus pneumoniae R6
guguugaauguugaaac

SEQ ID NO: 4111713 - RNA, 11 nt, Streptococcus pneumoniae R6
guguugacaag

SEQ ID NO: 4111714 - RNA, 15 nt, Streptococcus pneumoniae R6
guguuucuugagaag

SEQ ID NO: 4111715 - RNA, 13 nt, Streptococcus pneumoniae R6
guguuuuuccuuu

SEQ ID NO: 4111716 - RNA, 19 nt, Streptococcus pneumoniae R6
guguuuuucguuagauacu

SEQ ID NO: 4111717 - RNA, 21 nt, Streptococcus pneumoniae R6
guguuuuuucuugcuuguaau

SEQ ID NO: 4111718 - RNA, 11 nt, Streptococcus pneumoniae R6
guuaaaaaaac

SEQ ID NO: 4111719 - RNA, 22 nt, Streptococcus pneumoniae R6
guuaaaaaagauuugaaacuaa

SEQ ID NO: 4111720 - RNA, 12 nt, Streptococcus pneumoniae R6
guuaaaaacuca

SEQ ID NO: 4111721 - RNA, 21 nt, Streptococcus pneumoniae R6
guuaaaaauugauuugacuuc

SEQ ID NO: 4111722 - RNA, 18 nt, Streptococcus pneumoniae R6
guuaaaagcaaaaacgca

SEQ ID NO: 4111723 - RNA, 20 nt, Streptococcus pneumoniae R6
guuaaaaguuguggaaagga

SEQ ID NO: 4111724 - RNA, 21 nt, Streptococcus pneumoniae R6
guuaaaaucaguucuuuaaag

SEQ ID NO: 4111725 - RNA, 16 nt, Streptococcus pneumoniae R6
guuaaaaucuuuuacu

SEQ ID NO: 4111726 - RNA, 14 nt, Streptococcus pneumoniae R6
guuaaauuauuaaa

SEQ ID NO: 4111727 - RNA, 13 nt, Streptococcus pneumoniae R6
guuaaauucuucu

SEQ ID NO: 4111728 - RNA, 12 nt, Streptococcus pneumoniae R6
guuaacuucaag

SEQ ID NO: 4111729 - RNA, 14 nt, Streptococcus pneumoniae R6
guuaacuuuuccag

SEQ ID NO: 4111730 - RNA, 21 nt, Streptococcus pneumoniae R6
guuaauaacucucaucuaucu

SEQ ID NO: 4111731 - RNA, 19 nt, Streptococcus pneumoniae R6
guuaaucuacgcuuuaaaa

SEQ ID NO: 4111732 - RNA, 15 nt, Streptococcus pneumoniae R6
guuaaucucuccuua

SEQ ID NO: 4111733 - RNA, 20 nt, Streptococcus pneumoniae R6
guuaaucucuccuuaucaaa

SEQ ID NO: 4111734 - RNA, 17 nt, Streptococcus pneumoniae R6
guuaauugaauuucaag

SEQ ID NO: 4111735 - RNA, 22 nt, Streptococcus pneumoniae R6
guuacagacaaaacuggcaaaa

SEQ ID NO: 4111736 - RNA, 21 nt, Streptococcus pneumoniae R6
guuacauaucuagguaaaaau

SEQ ID NO: 4111737 - RNA, 21 nt, Streptococcus pneumoniae R6
guuaccaauacaggaaaacca

SEQ ID NO: 4111738 - RNA, 24 nt, Streptococcus pneumoniae R6
guuacucuauuguagaguggcuuu

SEQ ID NO: 4111739 - RNA, 21 nt, Streptococcus pneumoniae R6
guugaaaaccuuguuuuaaaa

SEQ ID NO: 4111740 - RNA, 16 nt, Streptococcus pneumoniae R6
guugaacuuuagaaac

SEQ ID NO: 4111741 - RNA, 15 nt, Streptococcus pneumoniae R6
guugaagaaaagcua

SEQ ID NO: 4111742 - RNA, 16 nt, Streptococcus pneumoniae R6
guugaagaaaagcuaa

SEQ ID NO: 4111743 - RNA, 17 nt, Streptococcus pneumoniae R6
guugaaucauuuuguuu

SEQ ID NO: 4111744 - RNA, 14 nt, Streptococcus pneumoniae R6
guugacaaagagcc

SEQ ID NO: 4111745 - RNA, 19 nt, Streptococcus pneumoniae R6
guugacaaagagccaaaaa

SEQ ID NO: 4111746 - RNA, 22 nt, Streptococcus pneumoniae R6
guugacaaagagccaaaaaaga

SEQ ID NO: 4111747 - RNA, 21 nt, Streptococcus pneumoniae R6
guugacaaagagccagaaaaa

SEQ ID NO: 4111748 - RNA, 22 nt, Streptococcus pneumoniae R6
guugacaaagagccagaaaaau

SEQ ID NO: 4111749 - RNA, 16 nt, Streptococcus pneumoniae R6
guugacaaagagccau

SEQ ID NO: 4111750 - RNA, 23 nt, Streptococcus pneumoniae R6
guugacaaagagccgaaaaaaua

SEQ ID NO: 4111751 - RNA, 14 nt, Streptococcus pneumoniae R6
guugaccauuucaa

SEQ ID NO: 4111752 - RNA, 17 nt, Streptococcus pneumoniae R6
guugacuuguacucaau

SEQ ID NO: 4111753 - RNA, 22 nt, Streptococcus pneumoniae R6
guugagcauguagucaaucaaa

SEQ ID NO: 4111754 - RNA, 19 nt, Streptococcus pneumoniae R6
guugagcgaaaucugucua

SEQ ID NO: 4111755 - RNA, 17 nt, Streptococcus pneumoniae R6
guugauaaucuuaucuc

SEQ ID NO: 4111756 - RNA, 20 nt, Streptococcus pneumoniae R6
guugcauagcgaagaacaau

SEQ ID NO: 4111757 - RNA, 21 nt, Streptococcus pneumoniae R6
guugcauuuuuuauugcaauu

SEQ ID NO: 4111758 - RNA, 14 nt, Streptococcus pneumoniae R6
guugccuuuuugaa

SEQ ID NO: 4111759 - RNA, 13 nt, Streptococcus pneumoniae R6
guugcucuuaucu

SEQ ID NO: 4111760 - RNA, 16 nt, Streptococcus pneumoniae R6
guuggaaguagugaaa

SEQ ID NO: 4111761 - RNA, 17 nt, Streptococcus pneumoniae R6
guugguaagagaaauuu

SEQ ID NO: 4111762 - RNA, 15 nt, Streptococcus pneumoniae R6
guugguuaaaaguug

SEQ ID NO: 4111763 - RNA, 14 nt, Streptococcus pneumoniae R6
guuguaagcuagca

SEQ ID NO: 4111764 - RNA, 16 nt, Streptococcus pneumoniae R6
guuguaagcuagcaac

SEQ ID NO: 4111765 - RNA, 17 nt, Streptococcus pneumoniae R6
guuguaagcuagcaaca

SEQ ID NO: 4111766 - RNA, 23 nt, Streptococcus pneumoniae R6
guuguagauagaacugacgaagu

SEQ ID NO: 4111767 - RNA, 14 nt, Streptococcus pneumoniae R6
guuguagaugaaac

SEQ ID NO: 4111768 - RNA, 23 nt, Streptococcus pneumoniae R6
guuguagaugaaacugacgaagu

SEQ ID NO: 4111769 - RNA, 21 nt, Streptococcus pneumoniae R6
guuguaugguugacuggacca

SEQ ID NO: 4111770 - RNA, 13 nt, Streptococcus pneumoniae R6
guugugaauuuca

SEQ ID NO: 4111771 - RNA, 23 nt, Streptococcus pneumoniae R6
guuguggauggaacugacgaagu

SEQ ID NO: 4111772 - RNA, 17 nt, Streptococcus pneumoniae R6
guuguguuugaccacuc

SEQ ID NO: 4111773 - RNA, 18 nt, Streptococcus pneumoniae R6
guuguuaguucuugaaau

SEQ ID NO: 4111774 - RNA, 13 nt, Streptococcus pneumoniae R6
guuuaaaccuugc

SEQ ID NO: 4111775 - RNA, 17 nt, Streptococcus pneumoniae R6
guuuaaauucauuaaac

SEQ ID NO: 4111776 - RNA, 13 nt, Streptococcus pneumoniae R6
guuuaacuaaaaa

SEQ ID NO: 4111777 - RNA, 15 nt, Streptococcus pneumoniae R6
guuuaacuguuccuu

SEQ ID NO: 4111778 - RNA, 18 nt, Streptococcus pneumoniae R6
guuuaagucuugcuucca

SEQ ID NO: 4111779 - RNA, 14 nt, Streptococcus pneumoniae R6
guuuaaucaaaaua

SEQ ID NO: 4111780 - RNA, 15 nt, Streptococcus pneumoniae R6
guuuaaucaaaauaa

SEQ ID NO: 4111781 - RNA, 23 nt, Streptococcus pneumoniae R6
guuuaauccauggaauaccaaua

SEQ ID NO: 4111782 - RNA, 19 nt, Streptococcus pneumoniae R6
guuuaccaauuuuuccuuu

SEQ ID NO: 4111783 - RNA, 15 nt, Streptococcus pneumoniae R6
guuuaccccaaauuc

SEQ ID NO: 4111784 - RNA, 18 nt, Streptococcus pneumoniae R6
guuuacucuuugauuuuc

SEQ ID NO: 4111785 - RNA, 15 nt, Streptococcus pneumoniae R6
guuuagacauuauag

SEQ ID NO: 4111786 - RNA, 20 nt, Streptococcus pneumoniae R6
guuuagcaucuaaaugaucc

SEQ ID NO: 4111787 - RNA, 13 nt, Streptococcus pneumoniae R6
guuuauaaacuuu

SEQ ID NO: 4111788 - RNA, 17 nt, Streptococcus pneumoniae R6
guuuauacccaaacucu

SEQ ID NO: 4111789 - RNA, 19 nt, Streptococcus pneumoniae R6
guuuaucacucaguuucug

SEQ ID NO: 4111790 - RNA, 17 nt, Streptococcus pneumoniae R6
guuuaucccagagcuau

SEQ ID NO: 4111791 - RNA, 18 nt, Streptococcus pneumoniae R6
guuuaucuagaauuucuu

SEQ ID NO: 4111792 - RNA, 13 nt, Streptococcus pneumoniae R6
guuuaucucccau

SEQ ID NO: 4111793 - RNA, 14 nt, Streptococcus pneumoniae R6
guuuaucucccaua

SEQ ID NO: 4111794 - RNA, 19 nt, Streptococcus pneumoniae R6
guuuauuaccuuucuugua

SEQ ID NO: 4111795 - RNA, 20 nt, Streptococcus pneumoniae R6
guuuauugaguuuuuugacu

SEQ ID NO: 4111796 - RNA, 24 nt, Streptococcus pneumoniae R6
guuuauugaguuuuuugacuucaa

SEQ ID NO: 4111797 - RNA, 14 nt, Streptococcus pneumoniae R6
guuucaaaguaaug

SEQ ID NO: 4111798 - RNA, 14 nt, Streptococcus pneumoniae R6
guuucaaaugaaau

SEQ ID NO: 4111799 - RNA, 18 nt, Streptococcus pneumoniae R6
guuucaaaugaaauauuu

SEQ ID NO: 4111800 - RNA, 19 nt, Streptococcus pneumoniae R6
guuucaaucguuucuggca

SEQ ID NO: 4111801 - RNA, 17 nt, Streptococcus pneumoniae R6
guuucagcauauuuccc

SEQ ID NO: 4111802 - RNA, 17 nt, Streptococcus pneumoniae R6
guuucagucaauaccag

SEQ ID NO: 4111803 - RNA, 16 nt, Streptococcus pneumoniae R6
guuucauccacaaccu

SEQ ID NO: 4111804 - RNA, 21 nt, Streptococcus pneumoniae R6
guuucauccacaaccucaaaa

SEQ ID NO: 4111805 - RNA, 21 nt, Streptococcus pneumoniae R6
guuucaucuacaaccucaaaa

SEQ ID NO: 4111806 - RNA, 24 nt, Streptococcus pneumoniae R6
guuucauggacuguuucauggcaa

SEQ ID NO: 4111807 - RNA, 22 nt, Streptococcus pneumoniae R6
guuucauguaagaguucuuccc

SEQ ID NO: 4111808 - RNA, 22 nt, Streptococcus pneumoniae R6
guuucauguggugcuucuggca

SEQ ID NO: 4111809 - RNA, 15 nt, Streptococcus pneumoniae R6
guuuccaccuucuuu

SEQ ID NO: 4111810 - RNA, 22 nt, Streptococcus pneumoniae R6
guuucccuaauaauacaaaaaa

SEQ ID NO: 4111811 - RNA, 13 nt, Streptococcus pneumoniae R6
guuuccuucuacu

SEQ ID NO: 4111812 - RNA, 17 nt, Streptococcus pneumoniae R6
guuucgaaguuucaauc

SEQ ID NO: 4111813 - RNA, 15 nt, Streptococcus pneumoniae R6
guuucgcuaucucua

SEQ ID NO: 4111814 - RNA, 23 nt, Streptococcus pneumoniae R6
guuucggcuguucuuuuuuguuu

SEQ ID NO: 4111815 - RNA, 21 nt, Streptococcus pneumoniae R6
guuucguguggguucauccag

SEQ ID NO: 4111816 - RNA, 12 nt, Streptococcus pneumoniae R6
guuucuaauaau

SEQ ID NO: 4111817 - RNA, 22 nt, Streptococcus pneumoniae R6
guuucuagccccucggauuuua

SEQ ID NO: 4111818 - RNA, 15 nt, Streptococcus pneumoniae R6
guuucuauauuuaua

SEQ ID NO: 4111819 - RNA, 22 nt, Streptococcus pneumoniae R6
guuucuggucuagcuauuucuu

SEQ ID NO: 4111820 - RNA, 21 nt, Streptococcus pneumoniae R6
guuucuuaaucuguuuggcaa

SEQ ID NO: 4111821 - RNA, 19 nt, Streptococcus pneumoniae R6
guuucuugaugaaagauau

SEQ ID NO: 4111822 - RNA, 24 nt, Streptococcus pneumoniae R6
guuucuuuaaaucgcuauaaauaa

SEQ ID NO: 4111823 - RNA, 18 nt, Streptococcus pneumoniae R6
guuugaaaaggcuguaua

SEQ ID NO: 4111824 - RNA, 23 nt, Streptococcus pneumoniae R6
guuugaacagcuugagauuucac

SEQ ID NO: 4111825 - RNA, 13 nt, Streptococcus pneumoniae R6
guuugaagcugcu

SEQ ID NO: 4111826 - RNA, 15 nt, Streptococcus pneumoniae R6
guuugagacaauccu

SEQ ID NO: 4111827 - RNA, 21 nt, Streptococcus pneumoniae R6
guuugaucaauugucugaagu

SEQ ID NO: 4111828 - RNA, 14 nt, Streptococcus pneumoniae R6
guuugaucuuugcu

SEQ ID NO: 4111829 - RNA, 16 nt, Streptococcus pneumoniae R6
guuugaugacuucagc

SEQ ID NO: 4111830 - RNA, 15 nt, Streptococcus pneumoniae R6
guuugauuaguccau

SEQ ID NO: 4111831 - RNA, 19 nt, Streptococcus pneumoniae R6
guuugcgcaggacuaaauc

SEQ ID NO: 4111832 - RNA, 14 nt, Streptococcus pneumoniae R6
guuugcuuagaaac

SEQ ID NO: 4111833 - RNA, 17 nt, Streptococcus pneumoniae R6
guuugcuucauuuuuuc

SEQ ID NO: 4111834 - RNA, 13 nt, Streptococcus pneumoniae R6
guuuggcaaauag

SEQ ID NO: 4111835 - RNA, 20 nt, Streptococcus pneumoniae R6
guuuggcuucaguaauaucu

SEQ ID NO: 4111836 - RNA, 13 nt, Streptococcus pneumoniae R6
guuuguaucuucc

SEQ ID NO: 4111837 - RNA, 19 nt, Streptococcus pneumoniae R6
guuuuaaacaaagucugaa

SEQ ID NO: 4111838 - RNA, 14 nt, Streptococcus pneumoniae R6
guuuuaagcugacu

SEQ ID NO: 4111839 - RNA, 16 nt, Streptococcus pneumoniae R6
guuuuaagcugacuuc

SEQ ID NO: 4111840 - RNA, 20 nt, Streptococcus pneumoniae R6
guuuuaccuuaauucguuug

SEQ ID NO: 4111841 - RNA, 10 nt, Streptococcus pneumoniae R6
uaaaacauug

SEQ ID NO: 4111842 - RNA, 13 nt, Streptococcus pneumoniae R6
uaaaacauuguga

SEQ ID NO: 4111843 - RNA, 14 nt, Streptococcus pneumoniae R6
uaaaacauugugag

SEQ ID NO: 4111844 - RNA, 23 nt, Streptococcus pneumoniae R6
uaaaacauugugagaaauugguu

SEQ ID NO: 4111845 - RNA, 22 nt, Streptococcus pneumoniae R6
uaaaacauuguuaaaaaucgau

SEQ ID NO: 4111846 - RNA, 17 nt, Streptococcus pneumoniae R6
uaaaacauuguuagaaa

SEQ ID NO: 4111847 - RNA, 23 nt, Streptococcus pneumoniae R6
uaaaacauuguuagaauucgauu

SEQ ID NO: 4111848 - RNA, 16 nt, Streptococcus pneumoniae R6
ucaguucuaucugcaa

SEQ ID NO: 4111849 - RNA, 19 nt, Streptococcus pneumoniae R6
ucaguucuaucugcaaccu

SEQ ID NO: 4111850 - RNA, 13 nt, Streptococcus pneumoniae R6
ucaguugcauaaa

SEQ ID NO: 4111851 - RNA, 15 nt, Streptococcus pneumoniae R6
ucaguugcgccacuu

SEQ ID NO: 4111852 - RNA, 20 nt, Streptococcus pneumoniae R6
ucaguuucauccacaaccuc

SEQ ID NO: 4111853 - RNA, 19 nt, Streptococcus pneumoniae R6
ucaguuucaucuacaaccu

SEQ ID NO: 4111854 - RNA, 20 nt, Streptococcus pneumoniae R6
ucaguuucaucuacaaccuc

SEQ ID NO: 4111855 - RNA, 23 nt, Streptococcus pneumoniae R6
ucaguuucgccuggagcuucauc

SEQ ID NO: 4111856 - RNA, 12 nt, Streptococcus pneumoniae R6
ucaguuucuauu

SEQ ID NO: 4111857 - RNA, 17 nt, Streptococcus pneumoniae R6
ucaguuuuaucaguaau

SEQ ID NO: 4111858 - RNA, 13 nt, Streptococcus pneumoniae R6
ucaguuuuuucac

SEQ ID NO: 4111859 - RNA, 19 nt, Streptococcus pneumoniae R6
ucaguuuuuucacaaauuc

SEQ ID NO: 4111860 - RNA, 15 nt, Streptococcus pneumoniae R6
ucauaaaaauaaaga

SEQ ID NO: 4111861 - RNA, 19 nt, Streptococcus pneumoniae R6
ucauaaacaagagcaagga

SEQ ID NO: 4111862 - RNA, 20 nt, Streptococcus pneumoniae R6
ucauaaacaucugucgcaag

SEQ ID NO: 4111863 - RNA, 14 nt, Streptococcus pneumoniae R6
ucauaaacuaucca

SEQ ID NO: 4111864 - RNA, 20 nt, Streptococcus pneumoniae R6
ucauaaacuauccagagcau

SEQ ID NO: 4111865 - RNA, 15 nt, Streptococcus pneumoniae R6
ucauaaagagaagga

SEQ ID NO: 4111866 - RNA, 15 nt, Streptococcus pneumoniae R6
ucauaaagucuuuaa

SEQ ID NO: 4111867 - RNA, 18 nt, Streptococcus pneumoniae R6
ucauaaaguuuucugagu

SEQ ID NO: 4111868 - RNA, 18 nt, Streptococcus pneumoniae R6
ucauaaauauccugcccc

SEQ ID NO: 4111869 - RNA, 16 nt, Streptococcus pneumoniae R6
ucauaaaucaauuuuu

SEQ ID NO: 4111870 - RNA, 15 nt, Streptococcus pneumoniae R6
ucauaacacuauuaa

SEQ ID NO: 4111871 - RNA, 16 nt, Streptococcus pneumoniae R6
ucauaacauucuacau

SEQ ID NO: 4111872 - RNA, 13 nt, Streptococcus pneumoniae R6
ucauaacuacagu

SEQ ID NO: 4111873 - RNA, 19 nt, Streptococcus pneumoniae R6
ucauaacuacaguauagca

SEQ ID NO: 4111874 - RNA, 18 nt, Streptococcus pneumoniae R6
ucauaagauuaauuucag

SEQ ID NO: 4111875 - RNA, 19 nt, Streptococcus pneumoniae R6
ucauaagauuaauuucaga

SEQ ID NO: 4111876 - RNA, 17 nt, Streptococcus pneumoniae R6
ucauaauaaccaagcua

SEQ ID NO: 4111877 - RNA, 22 nt, Streptococcus pneumoniae R6
ucauaaucaggccagaugacuu

SEQ ID NO: 4111878 - RNA, 21 nt, Streptococcus pneumoniae R6
ucauaauccaacaccaauuuu

SEQ ID NO: 4111879 - RNA, 16 nt, Streptococcus pneumoniae R6
ucauaauuuuuuucau

SEQ ID NO: 4111880 - RNA, 21 nt, Streptococcus pneumoniae R6
ucauacacauguuaacaaauu

SEQ ID NO: 4111881 - RNA, 22 nt, Streptococcus pneumoniae R6
ucauaccagagguagcuuagaa

SEQ ID NO: 4111882 - RNA, 15 nt, Streptococcus pneumoniae R6
ucauacgauaaaaau

SEQ ID NO: 4111883 - RNA, 16 nt, Streptococcus pneumoniae R6
ucauacgauaaaaauc

SEQ ID NO: 4111884 - RNA, 14 nt, Streptococcus pneumoniae R6
ucauagaaauauuu

SEQ ID NO: 4111885 - RNA, 18 nt, Streptococcus pneumoniae R6
ucauagaaauauuuacuu

SEQ ID NO: 4111886 - RNA, 18 nt, Streptococcus pneumoniae R6
ucauagaaauuuuuacuu

SEQ ID NO: 4111887 - RNA, 21 nt, Streptococcus pneumoniae R6
ucauagagccuaguugcuagu

SEQ ID NO: 4111888 - RNA, 12 nt, Streptococcus pneumoniae R6
ucauagcagcaa

SEQ ID NO: 4111889 - RNA, 20 nt, Streptococcus pneumoniae R6
ucauagcauagaugacaaag

SEQ ID NO: 4111890 - RNA, 15 nt, Streptococcus pneumoniae R6
ucauagccauaaaac

SEQ ID NO: 4111891 - RNA, 17 nt, Streptococcus pneumoniae R6
ucauagccauaaaacau

SEQ ID NO: 4111892 - RNA, 17 nt, Streptococcus pneumoniae R6
ucauagccgaugaccuu

SEQ ID NO: 4111893 - RNA, 16 nt, Streptococcus pneumoniae R6
ucauaggcauaguacc

SEQ ID NO: 4111894 - RNA, 15 nt, Streptococcus pneumoniae R6
ucauaggcuuuagua

SEQ ID NO: 4111895 - RNA, 18 nt, Streptococcus pneumoniae R6
ucauaguacaauaccuuu

SEQ ID NO: 4111896 - RNA, 12 nt, Streptococcus pyogenes M1 GAS
aaaaaaagcaau

SEQ ID NO: 4111897 - RNA, 15 nt, Streptococcus pyogenes M1 GAS
aaaaaacuucacauu

SEQ ID NO: 4111898 - RNA, 22 nt, Streptococcus pyogenes M1 GAS
aaaaaagaagcaaaauuauuau

SEQ ID NO: 4111899 - RNA, 14 nt, Streptococcus pyogenes M1 GAS
aaaaaauuaagaag

SEQ ID NO: 4111900 - RNA, 18 nt, Streptococcus pyogenes M1 GAS
aaaaaauuuaauaguuuu

SEQ ID NO: 4111901 - RNA, 15 nt, Streptococcus pyogenes M1 GAS
aaaaacaaauuguag

SEQ ID NO: 4111902 - RNA, 20 nt, Streptococcus pyogenes M1 GAS
aaaaacaaauuguagggauu

SEQ ID NO: 4111903 - RNA, 17 nt, Streptococcus pyogenes M1 GAS
aaaaaccuuuagagaau

SEQ ID NO: 4111904 - RNA, 21 nt, Streptococcus pyogenes M1 GAS
aaaaacgccacgcucaacugg

SEQ ID NO: 4111905 - RNA, 18 nt, Streptococcus pyogenes M1 GAS
aaaaacucaaaaaauaca

SEQ ID NO: 4111906 - RNA, 19 nt, Streptococcus pyogenes M1 GAS
aaaaacuuggguugggaua

SEQ ID NO: 4111907 - RNA, 10 nt, Streptococcus pyogenes M1 GAS
aaaaagauaa

SEQ ID NO: 4111908 - RNA, 13 nt, Streptococcus pyogenes M1 GAS
aaaaagauaaaca

SEQ ID NO: 4111909 - RNA, 15 nt, Streptococcus pyogenes M1 GAS
aaaaagcaaauugaa

SEQ ID NO: 4111910 - RNA, 21 nt, Streptococcus pyogenes M1 GAS
aaaaagcaaauugaaaaaauc

SEQ ID NO: 4111911 - RNA, 15 nt, Streptococcus pyogenes M1 GAS
aaaaagccagagcag

SEQ ID NO: 4111912 - RNA, 17 nt, Streptococcus pyogenes M1 GAS
aaaaagccagagcaguu

SEQ ID NO: 4111913 - RNA, 23 nt, Streptococcus pyogenes M1 GAS
aaaaagccuauuuaauaggcuuu

SEQ ID NO: 4111914 - RNA, 12 nt, Streptococcus pyogenes M1 GAS
aaaaaguaaaaa

SEQ ID NO: 4111915 - RNA, 15 nt, Streptococcus pyogenes M1 GAS
aaaaaguaaaaagca

SEQ ID NO: 4111916 - RNA, 21 nt, Streptococcus pyogenes M1 GAS
aaaaaguuucugaguugauuu

SEQ ID NO: 4111917 - RNA, 22 nt, Streptococcus pyogenes M1 GAS
aaaggacauggaguccuuuuuu

SEQ ID NO: 4111918 - RNA, 19 nt, Streptococcus pyogenes M1 GAS
aaaggagucggaaauugac

SEQ ID NO: 4111919 - RNA, 13 nt, Streptococcus pyogenes M1 GAS
aaaggauaugagg

SEQ ID NO: 4111920 - RNA, 23 nt, Streptococcus pyogenes M1 GAS
aaaggauuuaguuuuguauugua

SEQ ID NO: 4111921 - RNA, 15 nt, Streptococcus pyogenes M1 GAS
aaaggcuucaucaau

SEQ ID NO: 4111922 - RNA, 16 nt, Streptococcus pyogenes M1 GAS
aaaggcuucaucaaug

SEQ ID NO: 4111923 - RNA, 13 nt, Streptococcus pyogenes M1 GAS
aaagggaagaaga

SEQ ID NO: 4111924 - RNA, 14 nt, Streptococcus pyogenes M1 GAS
aaaguaaaaagcaa

SEQ ID NO: 4111925 - RNA, 22 nt, Streptococcus pyogenes M1 GAS
aaaguaaaaagcaaauugaaaa

SEQ ID NO: 4111926 - RNA, 12 nt, Streptococcus pyogenes M1 GAS
aaaguaaaaaua

SEQ ID NO: 4111927 - RNA, 19 nt, Streptococcus pyogenes M1 GAS
aaaguaaaaucuuauuuuu

SEQ ID NO: 4111928 - RNA, 20 nt, Streptococcus pyogenes M1 GAS
aaaguaaggguuaacaauga

SEQ ID NO: 4111929 - RNA, 22 nt, Streptococcus pyogenes M1 GAS
aaaguaauaaguagcguacaug

SEQ ID NO: 4111930 - RNA, 15 nt, Streptococcus pyogenes M1 GAS
aaagucacgaguguu

SEQ ID NO: 4111931 - RNA, 15 nt, Streptococcus pyogenes M1 GAS
aaaguuauaaagaaa

SEQ ID NO: 4111932 - RNA, 22 nt, Streptococcus pyogenes M1 GAS
aaaguuggcuacucuauuugaa

SEQ ID NO: 4111933 - RNA, 14 nt, Streptococcus pyogenes M1 GAS
aaauaaaauauuuu

SEQ ID NO: 4111934 - RNA, 13 nt, Streptococcus pyogenes M1 GAS
aaauaaaaucguu

SEQ ID NO: 4111935 - RNA, 12 nt, Streptococcus pyogenes M1 GAS
aaauaaaccaag

SEQ ID NO: 4111936 - RNA, 17 nt, Streptococcus pyogenes M1 GAS
aaauaaaccaagcuaaa

SEQ ID NO: 4111937 - RNA, 13 nt, Streptococcus pyogenes M1 GAS
aaauaaacuuuca

SEQ ID NO: 4111938 - RNA, 16 nt, Streptococcus pyogenes M1 GAS
aaauacuagaaaaagc

SEQ ID NO: 4111939 - RNA, 17 nt, Streptococcus pyogenes M1 GAS
aaauacuagaaaaagca

SEQ ID NO: 4111940 - RNA, 18 nt, Streptococcus pyogenes M1 GAS
aaauacuagaaaaagcaa

SEQ ID NO: 4111941 - RNA, 20 nt, Streptococcus pyogenes M1 GAS
aaauacuagaaaaagcaaug

SEQ ID NO: 4111942 - RNA, 21 nt, Streptococcus pyogenes M1 GAS
aaauauaaagucagacuuaau

SEQ ID NO: 4111943 - RNA, 13 nt, Streptococcus pyogenes M1 GAS
aaauauaaauuau

SEQ ID NO: 4111944 - RNA, 17 nt, Streptococcus pyogenes M1 GAS
aaauauaaauuauuaac

SEQ ID NO: 4111945 - RNA, 14 nt, Streptococcus pyogenes M1 GAS
aaauauauucuaau

SEQ ID NO: 4111946 - RNA, 15 nt, Streptococcus pyogenes M1 GAS
aaauaucuuaccauu

SEQ ID NO: 4111947 - RNA, 18 nt, Streptococcus pyogenes M1 GAS
aaauaucuuuuuuacuuu

SEQ ID NO: 4111948 - RNA, 23 nt, Streptococcus pyogenes M1 GAS
aaauaucuuuuuuacuuuuaaaa

SEQ ID NO: 4111949 - RNA, 12 nt, Streptococcus pyogenes M1 GAS
aaaucaaaaagc

SEQ ID NO: 4111950 - RNA, 21 nt, Streptococcus pyogenes M1 GAS
aaaucaaaaagcuaacaccau

SEQ ID NO: 4111951 - RNA, 19 nt, Streptococcus pyogenes M1 GAS
aaaucaguagugaugagua

SEQ ID NO: 4111952 - RNA, 21 nt, Streptococcus pyogenes M1 GAS
aaauccuugcguagacagcaa

SEQ ID NO: 4111953 - RNA, 18 nt, Streptococcus pyogenes M1 GAS
aaauccuuuugaaaaauu

SEQ ID NO: 4111954 - RNA, 14 nt, Streptococcus pyogenes M1 GAS
aaauccuuuugcuu

SEQ ID NO: 4111955 - RNA, 22 nt, Streptococcus pyogenes M1 GAS
aaauccuuuugcuucuagcucu

SEQ ID NO: 4111956 - RNA, 23 nt, Streptococcus pyogenes M1 GAS
aaaucuaaucagaacucgucuuu

SEQ ID NO: 4111957 - RNA, 18 nt, Streptococcus pyogenes M1 GAS
aaaucucagaagcuuuau

SEQ ID NO: 4111958 - RNA, 22 nt, Streptococcus pyogenes M1 GAS
aaaucuggcuuagcagcaccag

SEQ ID NO: 4111959 - RNA, 17 nt, Streptococcus pyogenes M1 GAS
aaaucuuacuaacuagc

SEQ ID NO: 4111960 - RNA, 22 nt, Streptococcus pyogenes M1 GAS
aaaucuuacuaacuagcaagug

SEQ ID NO: 4111961 - RNA, 20 nt, Streptococcus pyogenes M1 GAS
aaaucuucugcauuaucauc

SEQ ID NO: 4111962 - RNA, 19 nt, Streptococcus pyogenes M1 GAS
aaaugaagcaaaauaaacu

SEQ ID NO: 4111963 - RNA, 15 nt, Streptococcus pyogenes M1 GAS
aaaugacaugaaagu

SEQ ID NO: 4111964 - RNA, 17 nt, Streptococcus pyogenes M1 GAS
aaaugacuucaaaauca

SEQ ID NO: 4111965 - RNA, 19 nt, Streptococcus pyogenes M1 GAS
aaaugaugagauuaacuga

SEQ ID NO: 4111966 - RNA, 14 nt, Streptococcus pyogenes M1 GAS
aaaugcauuacauu

SEQ ID NO: 4111967 - RNA, 17 nt, Streptococcus pyogenes M1 GAS
aaaugccaaucuuugug

SEQ ID NO: 4111968 - RNA, 20 nt, Streptococcus pyogenes M1 GAS
aaaugccuccgacaaucgaa

SEQ ID NO: 4111969 - RNA, 18 nt, Streptococcus pyogenes M1 GAS
aaauguaugauuuuaacg

SEQ ID NO: 4111970 - RNA, 18 nt, Streptococcus pyogenes M1 GAS
aaauguccgaaaaaaacu

SEQ ID NO: 4111971 - RNA, 20 nt, Streptococcus pyogenes M1 GAS
aaauguccgaaaaaaacuug

SEQ ID NO: 4111972 - RNA, 15 nt, Streptococcus pyogenes M1 GAS
aaauuaagaaggaac

SEQ ID NO: 4111973 - RNA, 22 nt, Streptococcus pyogenes M1 GAS
aaauuacgauggacacuacuau

SEQ ID NO: 4111974 - RNA, 17 nt, Streptococcus pyogenes M1 GAS
aaauuauuauuuugcuu

SEQ ID NO: 4111975 - RNA, 13 nt, Streptococcus pyogenes M1 GAS
aaauucaaauacu

SEQ ID NO: 4111976 - RNA, 14 nt, Streptococcus pyogenes M1 GAS
aaauuccccacaaa

SEQ ID NO: 4111977 - RNA, 20 nt, Streptococcus pyogenes M1 GAS
aaauuccccacaaaagacaa

SEQ ID NO: 4111978 - RNA, 23 nt, Streptococcus pyogenes M1 GAS
aaauucguauugucaucgcuuug

SEQ ID NO: 4111979 - RNA, 14 nt, Streptococcus pyogenes M1 GAS
aaauucuuuuugaa

SEQ ID NO: 4111980 - RNA, 14 nt, Streptococcus pyogenes M1 GAS
aaauugauuauucu

SEQ ID NO: 4111981 - RNA, 20 nt, Streptococcus pyogenes M1 GAS
aaauugauuauucuuuauuu

SEQ ID NO: 4111982 - RNA, 22 nt, Streptococcus pyogenes M1 GAS
aaauugguccucugaaaaguug

SEQ ID NO: 4111983 - RNA, 22 nt, Streptococcus pyogenes M1 GAS
aaauuguagggauuuuuuaacu

SEQ ID NO: 4111984 - RNA, 21 nt, Streptococcus pyogenes M1 GAS
aaauuuaauaguuuuccauaa

SEQ ID NO: 4111985 - RNA, 21 nt, Streptococcus pyogenes M1 GAS
aaauuuuagguaaaguuagga

SEQ ID NO: 4111986 - RNA, 22 nt, Streptococcus pyogenes M1 GAS
aaauuuuuuucaggauguuuau

SEQ ID NO: 4111987 - RNA, 12 nt, Streptococcus pyogenes M1 GAS
aacaaaaucaca

SEQ ID NO: 4111988 - RNA, 14 nt, Streptococcus pyogenes M1 GAS
aacaaauaauuccu

SEQ ID NO: 4111989 - RNA, 13 nt, Streptococcus pyogenes M1 GAS
aacaagagcucaa

SEQ ID NO: 4111990 - RNA, 20 nt, Streptococcus pyogenes M1 GAS
aacaagagcucaaccucuga

SEQ ID NO: 4111991 - RNA, 18 nt, Streptococcus pyogenes M1 GAS
aacaauaacacagaagcc

SEQ ID NO: 4111992 - RNA, 18 nt, Streptococcus pyogenes M1 GAS
aacaaugagaucuucuuu

SEQ ID NO: 4111993 - RNA, 18 nt, Streptococcus pyogenes M1 GAS
aacacaaugcuuuuugua

SEQ ID NO: 4111994 - RNA, 17 nt, Streptococcus pyogenes M1 GAS
aacacaauucaagauag

SEQ ID NO: 4111995 - RNA, 20 nt, Streptococcus pyogenes M1 GAS
aacaccaccaauaaugagca

SEQ ID NO: 4111996 - RNA, 18 nt, Streptococcus pyogenes M1 GAS
aacaccccccgcuuuuaa

SEQ ID NO: 4111997 - RNA, 22 nt, Streptococcus pyogenes M1 GAS
aacaccguucauauaagcaauc

SEQ ID NO: 4111998 - RNA, 13 nt, Streptococcus pyogenes M1 GAS
aacacucaucaua

SEQ ID NO: 4111999 - RNA, 18 nt, Streptococcus pyogenes M1 GAS
aacacucaucauauuguu

SEQ ID NO: 4112000 - RNA, 15 nt, Streptococcus pyogenes M1 GAS
aacagauaagugcca

SEQ ID NO: 4112001 - RNA, 22 nt, Streptococcus pyogenes M1 GAS
aacagauaagugccaucaggcu

SEQ ID NO: 4112002 - RNA, 20 nt, Streptococcus pyogenes M1 GAS
aacagcauuuucaucaucaa

SEQ ID NO: 4112003 - RNA, 22 nt, Streptococcus pyogenes M1 GAS
aacagcugcuugaaaagaugca

SEQ ID NO: 4112004 - RNA, 12 nt, Streptococcus pyogenes M1 GAS
aacaguuccagu

SEQ ID NO: 4112005 - RNA, 17 nt, Streptococcus pyogenes M1 GAS
aacaguuccaguucugu

SEQ ID NO: 4112006 - RNA, 12 nt, Streptococcus pyogenes M1 GAS
aacauaacaauc

SEQ ID NO: 4112007 - RNA, 17 nt, Streptococcus pyogenes M1 GAS
aacauaaggauuauuag

SEQ ID NO: 4112008 - RNA, 15 nt, Streptococcus pyogenes M1 GAS
aacaucaaaaagagg

SEQ ID NO: 4112009 - RNA, 23 nt, Streptococcus pyogenes M1 GAS
aacauccauaccaucaaugacuu

SEQ ID NO: 4112010 - RNA, 17 nt, Streptococcus pyogenes M1 GAS
aacaucuugauuguaag

SEQ ID NO: 4112011 - RNA, 12 nt, Streptococcus pyogenes M1 GAS
aaccaagugcca

SEQ ID NO: 4112012 - RNA, 22 nt, Streptococcus pyogenes M1 GAS
aaccaagugccaguaaggaaau

SEQ ID NO: 4112013 - RNA, 16 nt, Streptococcus pyogenes M1 GAS
aaccauaucacaaaac

SEQ ID NO: 4112014 - RNA, 20 nt, Streptococcus pyogenes M1 GAS
aaccauaucacaaaacccuu

SEQ ID NO: 4112015 - RNA, 17 nt, Streptococcus pyogenes M1 GAS
aaccauuauaaaagagu

SEQ ID NO: 4112016 - RNA, 18 nt, Streptococcus pyogenes M1 GAS
aaccauuauaaaagagug

SEQ ID NO: 4112017 - RNA, 15 nt, Streptococcus pyogenes M1 GAS
aagcugagcaaaaca

SEQ ID NO: 4112018 - RNA, 17 nt, Streptococcus pyogenes M1 GAS
aagcugagcaaaacaau

SEQ ID NO: 4112019 - RNA, 20 nt, Streptococcus pyogenes M1 GAS
aagcuugcuaagagaauaac

SEQ ID NO: 4112020 - RNA, 22 nt, Streptococcus pyogenes M1 GAS
aagcuuggauugccgccaugcu

SEQ ID NO: 4112021 - RNA, 15 nt, Streptococcus pyogenes M1 GAS
aagcuuuaagcuuug

SEQ ID NO: 4112022 - RNA, 21 nt, Streptococcus pyogenes M1 GAS
aaggaauugcagcuaaaaaca

SEQ ID NO: 4112023 - RNA, 18 nt, Streptococcus pyogenes M1 GAS
aaggaccaagauucauga

SEQ ID NO: 4112024 - RNA, 18 nt, Streptococcus pyogenes M1 GAS
aaggagauaggaaacuca

SEQ ID NO: 4112025 - RNA, 15 nt, Streptococcus pyogenes M1 GAS
aaggaugaaaugauu

SEQ ID NO: 4112026 - RNA, 18 nt, Streptococcus pyogenes M1 GAS
aaggcaauccaaaucaac

SEQ ID NO: 4112027 - RNA, 19 nt, Streptococcus pyogenes M1 GAS
aaggcacagaaaaaagaua

SEQ ID NO: 4112028 - RNA, 20 nt, Streptococcus pyogenes M1 GAS
aaggcacagaaaaaagauaa

SEQ ID NO: 4112029 - RNA, 16 nt, Streptococcus pyogenes M1 GAS
aaggcaccugaggcaa

SEQ ID NO: 4112030 - RNA, 15 nt, Streptococcus pyogenes M1 GAS
aaggcaguugcagag

SEQ ID NO: 4112031 - RNA, 21 nt, Streptococcus pyogenes M1 GAS
aaggcaguugcagaguacaag

SEQ ID NO: 4112032 - RNA, 16 nt, Streptococcus pyogenes M1 GAS
aaggcugcgaugauuu

SEQ ID NO: 4112033 - RNA, 13 nt, Streptococcus pyogenes M1 GAS
aaggcuucaucaa

SEQ ID NO: 4112034 - RNA, 22 nt, Streptococcus pyogenes M1 GAS
aaggcuuguucuuuauuuugau

SEQ ID NO: 4112035 - RNA, 17 nt, Streptococcus pyogenes M1 GAS
aaggcuuuuuguuuuau

SEQ ID NO: 4112036 - RNA, 14 nt, Streptococcus pyogenes M1 GAS
aagggaagaagauc

SEQ ID NO: 4112037 - RNA, 22 nt, Streptococcus pyogenes M1 GAS
aagguacacgugauaaaugccg

SEQ ID NO: 4112038 - RNA, 16 nt, Streptococcus pyogenes M1 GAS
aagguaucuaagcuau

SEQ ID NO: 4112039 - RNA, 15 nt, Streptococcus pyogenes M1 GAS
aaggucucaaauuuu

SEQ ID NO: 4112040 - RNA, 16 nt, Streptococcus pyogenes M1 GAS
aaggugccuguuuuug

SEQ ID NO: 4112041 - RNA, 21 nt, Streptococcus pyogenes M1 GAS
aagguuacccuugacgaugcu

SEQ ID NO: 4112042 - RNA, 18 nt, Streptococcus pyogenes M1 GAS
aagguuguggcugauaaa

SEQ ID NO: 4112043 - RNA, 11 nt, Streptococcus pyogenes M1 GAS
aaguaaaaagc

SEQ ID NO: 4112044 - RNA, 13 nt, Streptococcus pyogenes M1 GAS
aaguaaaaagcaa

SEQ ID NO: 4112045 - RNA, 21 nt, Streptococcus pyogenes M1 GAS
aaguaaaagggauaauaaagu

SEQ ID NO: 4112046 - RNA, 13 nt, Streptococcus pyogenes M1 GAS
aaguaaggguuaa

SEQ ID NO: 4112047 - RNA, 24 nt, Streptococcus pyogenes M1 GAS
aaguaauaaguagcguacauggau

SEQ ID NO: 4112048 - RNA, 14 nt, Streptococcus pyogenes M1 GAS
aaguagauacuuug

SEQ ID NO: 4112049 - RNA, 17 nt, Streptococcus pyogenes M1 GAS
aaguauagcauaaaaua

SEQ ID NO: 4112050 - RNA, 16 nt, Streptococcus pyogenes M1 GAS
aaguauaguuauguua

SEQ ID NO: 4112051 - RNA, 18 nt, Streptococcus pyogenes M1 GAS
aaguauuuuaugacaaau

SEQ ID NO: 4112052 - RNA, 15 nt, Streptococcus pyogenes M1 GAS
aagucuaucugcaga

SEQ ID NO: 4112053 - RNA, 18 nt, Streptococcus pyogenes M1 GAS
aagucuaucugcagauuu

SEQ ID NO: 4112054 - RNA, 14 nt, Streptococcus pyogenes M1 GAS
aagucucuugcaag

SEQ ID NO: 4112055 - RNA, 14 nt, Streptococcus pyogenes M1 GAS
aagugauauacuga

SEQ ID NO: 4112056 - RNA, 18 nt, Streptococcus pyogenes M1 GAS
aagugauguuuuuacauu

SEQ ID NO: 4112057 - RNA, 18 nt, Streptococcus pyogenes M1 GAS
aagugccaguaaggaaau

SEQ ID NO: 4112058 - RNA, 14 nt, Streptococcus pyogenes M1 GAS
aagugucuugauau

SEQ ID NO: 4112059 - RNA, 21 nt, Streptococcus pyogenes M1 GAS
aagugugacuaguuuauuaca

SEQ ID NO: 4112060 - RNA, 23 nt, Streptococcus pyogenes M1 GAS
aagugugacuaguuuauuacaaa

SEQ ID NO: 4112061 - RNA, 12 nt, Streptococcus pyogenes M1 GAS
aaguuaccaauu

SEQ ID NO: 4112062 - RNA, 16 nt, Streptococcus pyogenes M1 GAS
aaguuauaaagaaaca

SEQ ID NO: 4112063 - RNA, 19 nt, Streptococcus pyogenes M1 GAS
aaguucuaaacuuaugauu

SEQ ID NO: 4112064 - RNA, 11 nt, Streptococcus pyogenes M1 GAS
aaguucuuugc

SEQ ID NO: 4112065 - RNA, 13 nt, Streptococcus pyogenes M1 GAS
aaguugaaugagu

SEQ ID NO: 4112066 - RNA, 20 nt, Streptococcus pyogenes M1 GAS
aaguugccuuaucucaguuu

SEQ ID NO: 4112067 - RNA, 16 nt, Streptococcus pyogenes M1 GAS
aaguuggcuacucuau

SEQ ID NO: 4112068 - RNA, 17 nt, Streptococcus pyogenes M1 GAS
aaguuggcuacucuauu

SEQ ID NO: 4112069 - RNA, 19 nt, Streptococcus pyogenes M1 GAS
aaguuggcuacucuauuuu

SEQ ID NO: 4112070 - RNA, 21 nt, Streptococcus pyogenes M1 GAS
aaguuuucucagagacaauaa

SEQ ID NO: 4112071 - RNA, 14 nt, Streptococcus pyogenes M1 GAS
aaguuuuuuuguaa

SEQ ID NO: 4112072 - RNA, 15 nt, Streptococcus pyogenes M1 GAS
aauaaaauagcaccu

SEQ ID NO: 4112073 - RNA, 16 nt, Streptococcus pyogenes M1 GAS
aauaaaauagcaccua

SEQ ID NO: 4112074 - RNA, 22 nt, Streptococcus pyogenes M1 GAS
aauaaagcguugacaguuaaaa

SEQ ID NO: 4112075 - RNA, 18 nt, Streptococcus pyogenes M1 GAS
aauaacagaaauuaauaa

SEQ ID NO: 4112076 - RNA, 13 nt, Streptococcus pyogenes M1 GAS
aauaacaucaaag

SEQ ID NO: 4112077 - RNA, 24 nt, Streptococcus pyogenes M1 GAS
aauaacccgucuuacaauuaauag

SEQ ID NO: 4112078 - RNA, 14 nt, Streptococcus pyogenes M1 GAS
aauaacgccagcua

SEQ ID NO: 4112079 - RNA, 19 nt, Streptococcus pyogenes M1 GAS
aauaagauucaauaugaaa

SEQ ID NO: 4112080 - RNA, 19 nt, Streptococcus pyogenes M1 GAS
aauaagcccuuaaucuaaa

SEQ ID NO: 4112081 - RNA, 18 nt, Streptococcus pyogenes M1 GAS
aauaaggcucgacaaagg

SEQ ID NO: 4112082 - RNA, 22 nt, Streptococcus pyogenes M1 GAS
aauaaggcucgacaaaggcugc

SEQ ID NO: 4112083 - RNA, 23 nt, Streptococcus pyogenes M1 GAS
aauaaguauagcauaaaauaguu

SEQ ID NO: 4112084 - RNA, 19 nt, Streptococcus pyogenes M1 GAS
aauaaugccaucaaaaaaa

SEQ ID NO: 4112085 - RNA, 22 nt, Streptococcus pyogenes M1 GAS
aauaaugccaucaaaaaaagac

SEQ ID NO: 4112086 - RNA, 23 nt, Streptococcus pyogenes M1 GAS
aauaaugccaucaaaaaaagaca

SEQ ID NO: 4112087 - RNA, 20 nt, Streptococcus pyogenes M1 GAS
aauacagccguucuuaaaag

SEQ ID NO: 4112088 - RNA, 15 nt, Streptococcus pyogenes M1 GAS
aauacauuguuuuuc

SEQ ID NO: 4112089 - RNA, 13 nt, Streptococcus pyogenes M1 GAS
aauaccauuuuua

SEQ ID NO: 4112090 - RNA, 14 nt, Streptococcus pyogenes M1 GAS
aauaccauuuuuau

SEQ ID NO: 4112091 - RNA, 17 nt, Streptococcus pyogenes M1 GAS
aauacgcuucuaugugg

SEQ ID NO: 4112092 - RNA, 17 nt, Streptococcus pyogenes M1 GAS
aauacuagaaaaagcaa

SEQ ID NO: 4112093 - RNA, 20 nt, Streptococcus pyogenes M1 GAS
aauacuagaaaaagcaauga

SEQ ID NO: 4112094 - RNA, 21 nt, Streptococcus pyogenes M1 GAS
aauacuagaaaaagcaaugau

SEQ ID NO: 4112095 - RNA, 13 nt, Streptococcus pyogenes M1 GAS
aauagcgccagca

SEQ ID NO: 4112096 - RNA, 14 nt, Streptococcus pyogenes M1 GAS
aauagcgccagcaa

SEQ ID NO: 4112097 - RNA, 21 nt, Streptococcus pyogenes M1 GAS
aauagcguaaagcaagggaaa

SEQ ID NO: 4112098 - RNA, 19 nt, Streptococcus pyogenes M1 GAS
aauagcugcugcuaaagca

SEQ ID NO: 4112099 - RNA, 23 nt, Streptococcus pyogenes M1 GAS
aauagguaaagauuuuaaauauc

SEQ ID NO: 4112100 - RNA, 13 nt, Streptococcus pyogenes M1 GAS
aauauaauaaaaa

SEQ ID NO: 4112101 - RNA, 14 nt, Streptococcus pyogenes M1 GAS
aauauagucugcau

SEQ ID NO: 4112102 - RNA, 21 nt, Streptococcus pyogenes M1 GAS
aauaucagcuacacuugauuu

SEQ ID NO: 4112103 - RNA, 24 nt, Streptococcus pyogenes M1 GAS
aauaucagcuacacuugauuucau

SEQ ID NO: 4112104 - RNA, 14 nt, Streptococcus pyogenes M1 GAS
aauaucaggcaaaa

SEQ ID NO: 4112105 - RNA, 17 nt, Streptococcus pyogenes M1 GAS
aauaucaggcaaaacaa

SEQ ID NO: 4112106 - RNA, 14 nt, Streptococcus pyogenes M1 GAS
aauaucaugaagua

SEQ ID NO: 4112107 - RNA, 23 nt, Streptococcus pyogenes M1 GAS
aauaucaugaaguauaguuaugu

SEQ ID NO: 4112108 - RNA, 18 nt, Streptococcus pyogenes M1 GAS
aauaucgccaauaaaaaa

SEQ ID NO: 4112109 - RNA, 20 nt, Streptococcus pyogenes M1 GAS
aauaucgccaauaaaaaaga

SEQ ID NO: 4112110 - RNA, 13 nt, Streptococcus pyogenes M1 GAS
aauaucuuaccau

SEQ ID NO: 4112111 - RNA, 23 nt, Streptococcus pyogenes M1 GAS
aauaucuuaccauuguagaguuu

SEQ ID NO: 4112112 - RNA, 21 nt, Streptococcus pyogenes M1 GAS
aauaucuuuuuuacuuuuaaa

SEQ ID NO: 4112113 - RNA, 24 nt, Streptococcus pyogenes M1 GAS
aauaugaaaacguguauucuuaaa

SEQ ID NO: 4112114 - RNA, 12 nt, Streptococcus pyogenes M1 GAS
aauaugauauaa

SEQ ID NO: 4112115 - RNA, 15 nt, Streptococcus pyogenes M1 GAS
aauaugauauaaaaa

SEQ ID NO: 4112116 - RNA, 13 nt, Streptococcus pyogenes M1 GAS
aauaugugauuau

SEQ ID NO: 4112117 - RNA, 23 nt, Streptococcus pyogenes M1 GAS
acaccguuuuuuguuguaaaaag

SEQ ID NO: 4112118 - RNA, 21 nt, Streptococcus pyogenes M1 GAS
acaccuaauaaaauagcaccu

SEQ ID NO: 4112119 - RNA, 14 nt, Streptococcus pyogenes M1 GAS
acaccuacuaacaa

SEQ ID NO: 4112120 - RNA, 16 nt, Streptococcus pyogenes M1 GAS
acaccuacuaacaaca

SEQ ID NO: 4112121 - RNA, 15 nt, Streptococcus pyogenes M1 GAS
acacguaagcuccaa

SEQ ID NO: 4112122 - RNA, 17 nt, Streptococcus pyogenes M1 GAS
acacgugauaaaugccg

SEQ ID NO: 4112123 - RNA, 22 nt, Streptococcus pyogenes M1 GAS
acacguuccaugauugauuuua

SEQ ID NO: 4112124 - RNA, 13 nt, Streptococcus pyogenes M1 GAS
acagaaaaaagau

SEQ ID NO: 4112125 - RNA, 12 nt, Streptococcus pyogenes M1 GAS
acagaaagcgga

SEQ ID NO: 4112126 - RNA, 13 nt, Streptococcus pyogenes M1 GAS
acagaaagcggaa

SEQ ID NO: 4112127 - RNA, 18 nt, Streptococcus pyogenes M1 GAS
acagaaagcggaagaaca

SEQ ID NO: 4112128 - RNA, 11 nt, Streptococcus pyogenes M1 GAS
acagagucuua

SEQ ID NO: 4112129 - RNA, 18 nt, Streptococcus pyogenes M1 GAS
acagauaagugccaucag

SEQ ID NO: 4112130 - RNA, 15 nt, Streptococcus pyogenes M1 GAS
acagauugaagacaa

SEQ ID NO: 4112131 - RNA, 18 nt, Streptococcus pyogenes M1 GAS
acagcaacaucaaaaaga

SEQ ID NO: 4112132 - RNA, 19 nt, Streptococcus pyogenes M1 GAS
acagcauuuucaucaucaa

SEQ ID NO: 4112133 - RNA, 19 nt, Streptococcus pyogenes M1 GAS
acagccguucuuaaaagaa

SEQ ID NO: 4112134 - RNA, 18 nt, Streptococcus pyogenes M1 GAS
acagcguaagccaaaucu

SEQ ID NO: 4112135 - RNA, 16 nt, Streptococcus pyogenes M1 GAS
acaguauacaucaacu

SEQ ID NO: 4112136 - RNA, 16 nt, Streptococcus pyogenes M1 GAS
acaguauguaaauaua

SEQ ID NO: 4112137 - RNA, 22 nt, Streptococcus pyogenes M1 GAS
acagucuuuuuuauaauuauuu

SEQ ID NO: 4112138 - RNA, 14 nt, Streptococcus pyogenes M1 GAS
acaguuaaaaauaa

SEQ ID NO: 4112139 - RNA, 16 nt, Streptococcus pyogenes M1 GAS
acaguugugugacugu

SEQ ID NO: 4112140 - RNA, 18 nt, Streptococcus pyogenes M1 GAS
acaguuuauguuuaaugg

SEQ ID NO: 4112141 - RNA, 21 nt, Streptococcus pyogenes M1 GAS
acauacuuuauuaaucaaaaa

SEQ ID NO: 4112142 - RNA, 13 nt, Streptococcus pyogenes M1 GAS
acauaguguuuug

SEQ ID NO: 4112143 - RNA, 13 nt, Streptococcus pyogenes M1 GAS
acaucaaaaaaag

SEQ ID NO: 4112144 - RNA, 14 nt, Streptococcus pyogenes M1 GAS
acaucaaaaaaagc

SEQ ID NO: 4112145 - RNA, 15 nt, Streptococcus pyogenes M1 GAS
acaucaaaaaaagca

SEQ ID NO: 4112146 - RNA, 18 nt, Streptococcus pyogenes M1 GAS
acaucaaaaaaagcaaug

SEQ ID NO: 4112147 - RNA, 19 nt, Streptococcus pyogenes M1 GAS
acaucaaaaaaagcaauga

SEQ ID NO: 4112148 - RNA, 20 nt, Streptococcus pyogenes M1 GAS
acaucaaaaaaagcaaugac

SEQ ID NO: 4112149 - RNA, 13 nt, Streptococcus pyogenes M1 GAS
acaucaaaaagag

SEQ ID NO: 4112150 - RNA, 15 nt, Streptococcus pyogenes M1 GAS
acaucaaaaagagga

SEQ ID NO: 4112151 - RNA, 21 nt, Streptococcus pyogenes M1 GAS
acaucaaaggcuuuuuguuuu

SEQ ID NO: 4112152 - RNA, 18 nt, Streptococcus pyogenes M1 GAS
acaucaacuaucaaguau

SEQ ID NO: 4112153 - RNA, 15 nt, Streptococcus pyogenes M1 GAS
acauuaguccaaaau

SEQ ID NO: 4112154 - RNA, 22 nt, Streptococcus pyogenes M1 GAS
acauuaguccaaaauacauccu

SEQ ID NO: 4112155 - RNA, 15 nt, Streptococcus pyogenes M1 GAS
acauugaauaaagug

SEQ ID NO: 4112156 - RNA, 16 nt, Streptococcus pyogenes M1 GAS
acauugaauaaaguga

SEQ ID NO: 4112157 - RNA, 17 nt, Streptococcus pyogenes M1 GAS
acauugacugacagagu

SEQ ID NO: 4112158 - RNA, 23 nt, Streptococcus pyogenes M1 GAS
acauuguauuagcaaagugauau

SEQ ID NO: 4112159 - RNA, 19 nt, Streptococcus pyogenes M1 GAS
acauuucgugucuaaaaua

SEQ ID NO: 4112160 - RNA, 16 nt, Streptococcus pyogenes M1 GAS
acauuuuauuugaaga

SEQ ID NO: 4112161 - RNA, 12 nt, Streptococcus pyogenes M1 GAS
accaaaaaaagc

SEQ ID NO: 4112162 - RNA, 15 nt, Streptococcus pyogenes M1 GAS
accaaaaccaagugc

SEQ ID NO: 4112163 - RNA, 18 nt, Streptococcus pyogenes M1 GAS
accaacuuggacgaaggc

SEQ ID NO: 4112164 - RNA, 12 nt, Streptococcus pyogenes M1 GAS
accaagauucau

SEQ ID NO: 4112165 - RNA, 18 nt, Streptococcus pyogenes M1 GAS
accaauaaugagcaaggc

SEQ ID NO: 4112166 - RNA, 20 nt, Streptococcus pyogenes M1 GAS
accaauaaugagcaaggcaa

SEQ ID NO: 4112167 - RNA, 16 nt, Streptococcus pyogenes M1 GAS
accaauauagcaaucu

SEQ ID NO: 4112168 - RNA, 15 nt, Streptococcus pyogenes M1 GAS
accacaccuaauaaa

SEQ ID NO: 4112169 - RNA, 20 nt, Streptococcus pyogenes M1 GAS
accacacgauuaaccguucc

SEQ ID NO: 4112170 - RNA, 13 nt, Streptococcus pyogenes M1 GAS
accagcaccuucu

SEQ ID NO: 4112171 - RNA, 21 nt, Streptococcus pyogenes M1 GAS
accaucaaugacuugaccaaa

SEQ ID NO: 4112172 - RNA, 12 nt, Streptococcus pyogenes M1 GAS
accauugccauu

SEQ ID NO: 4112173 - RNA, 13 nt, Streptococcus pyogenes M1 GAS
accauugccauua

SEQ ID NO: 4112174 - RNA, 15 nt, Streptococcus pyogenes M1 GAS
accauuguagaguuu

SEQ ID NO: 4112175 - RNA, 21 nt, Streptococcus pyogenes M1 GAS
accauuuaugaggccaauaau

SEQ ID NO: 4112176 - RNA, 15 nt, Streptococcus pyogenes M1 GAS
acccgucuuacaauu

SEQ ID NO: 4112177 - RNA, 19 nt, Streptococcus pyogenes M1 GAS
acccgucuuacaauuaaua

SEQ ID NO: 4112178 - RNA, 16 nt, Streptococcus pyogenes M1 GAS
acccuugauuaauagc

SEQ ID NO: 4112179 - RNA, 17 nt, Streptococcus pyogenes M1 GAS
accgcuaggauuuuucc

SEQ ID NO: 4112180 - RNA, 15 nt, Streptococcus pyogenes M1 GAS
accguaacuugcuuu

SEQ ID NO: 4112181 - RNA, 18 nt, Streptococcus pyogenes M1 GAS
accguuccugucgcagau

SEQ ID NO: 4112182 - RNA, 13 nt, Streptococcus pyogenes M1 GAS
accuaauaaaaua

SEQ ID NO: 4112183 - RNA, 19 nt, Streptococcus pyogenes M1 GAS
accuaauugugagaaacua

SEQ ID NO: 4112184 - RNA, 16 nt, Streptococcus pyogenes M1 GAS
accuacgauaaaacaa

SEQ ID NO: 4112185 - RNA, 15 nt, Streptococcus pyogenes M1 GAS
accuacuagcacaaa

SEQ ID NO: 4112186 - RNA, 21 nt, Streptococcus pyogenes M1 GAS
accuacuagcacaaaaucauu

SEQ ID NO: 4112187 - RNA, 19 nt, Streptococcus pyogenes M1 GAS
accuccaccggucgauggg

SEQ ID NO: 4112188 - RNA, 15 nt, Streptococcus pyogenes M1 GAS
accuccagcugacag

SEQ ID NO: 4112189 - RNA, 19 nt, Streptococcus pyogenes M1 GAS
accucucaugggcaaauaa

SEQ ID NO: 4112190 - RNA, 20 nt, Streptococcus pyogenes M1 GAS
accugaauugcuggugacua

SEQ ID NO: 4112191 - RNA, 18 nt, Streptococcus pyogenes M1 GAS
accugagccuccaacaua

SEQ ID NO: 4112192 - RNA, 16 nt, Streptococcus pyogenes M1 GAS
accugaggcaauggcu

SEQ ID NO: 4112193 - RNA, 15 nt, Streptococcus pyogenes M1 GAS
accugcugcuccuau

SEQ ID NO: 4112194 - RNA, 22 nt, Streptococcus pyogenes M1 GAS
accuguagcccuuuuugccuuu

SEQ ID NO: 4112195 - RNA, 18 nt, Streptococcus pyogenes M1 GAS
accuguggucaaaagucc

SEQ ID NO: 4112196 - RNA, 21 nt, Streptococcus pyogenes M1 GAS
accuuaggcagacaauuauuu

SEQ ID NO: 4112197 - RNA, 22 nt, Streptococcus pyogenes M1 GAS
accuuaggcagacaauuauuuu

SEQ ID NO: 4112198 - RNA, 18 nt, Streptococcus pyogenes M1 GAS
accuuagugguuugcaaa

SEQ ID NO: 4112199 - RNA, 20 nt, Streptococcus pyogenes M1 GAS
accuuaugcagguguuuaaa

SEQ ID NO: 4112200 - RNA, 14 nt, Streptococcus pyogenes M1 GAS
accuucaaaaaagg

SEQ ID NO: 4112201 - RNA, 23 nt, Streptococcus pyogenes M1 GAS
accuucaaaaaagggaagaagau

SEQ ID NO: 4112202 - RNA, 20 nt, Streptococcus pyogenes M1 GAS
accuugcuuguagauaccua

SEQ ID NO: 4112203 - RNA, 15 nt, Streptococcus pyogenes M1 GAS
accuuucaagacaag

SEQ ID NO: 4112204 - RNA, 23 nt, Streptococcus pyogenes M1 GAS
accuuugauaagauauuguuaau

SEQ ID NO: 4112205 - RNA, 12 nt, Streptococcus pyogenes M1 GAS
accuuugccauu

SEQ ID NO: 4112206 - RNA, 23 nt, Streptococcus pyogenes M1 GAS
accuuugccauuuccuacaaaau

SEQ ID NO: 4112207 - RNA, 22 nt, Streptococcus pyogenes M1 GAS
acgcuuuacauuuuauuugaag

SEQ ID NO: 4112208 - RNA, 15 nt, Streptococcus pyogenes M1 GAS
acggaguauuuuuua

SEQ ID NO: 4112209 - RNA, 18 nt, Streptococcus pyogenes M1 GAS
acggcuaauaagagugug

SEQ ID NO: 4112210 - RNA, 18 nt, Streptococcus pyogenes M1 GAS
acggcuucuacacaaaag

SEQ ID NO: 4112211 - RNA, 23 nt, Streptococcus pyogenes M1 GAS
acgguguaauccccucguuuaaa

SEQ ID NO: 4112212 - RNA, 15 nt, Streptococcus pyogenes M1 GAS
acguaaaaagagaag

SEQ ID NO: 4112213 - RNA, 19 nt, Streptococcus pyogenes M1 GAS
acguaaaaagagaagauga

SEQ ID NO: 4112214 - RNA, 16 nt, Streptococcus pyogenes M1 GAS
acguaaccaauuguug

SEQ ID NO: 4112215 - RNA, 15 nt, Streptococcus pyogenes M1 GAS
acgucaaaaaaaagg

SEQ ID NO: 4112216 - RNA, 16 nt, Streptococcus pyogenes M1 GAS
acgugcuuuaaucuca

SEQ ID NO: 4112217 - RNA, 23 nt, Streptococcus pyogenes M1 GAS
agaaucaaagggauuacgauuaa

SEQ ID NO: 4112218 - RNA, 16 nt, Streptococcus pyogenes M1 GAS
agaauuauacuaacua

SEQ ID NO: 4112219 - RNA, 17 nt, Streptococcus pyogenes M1 GAS
agaauuauacuaacuau

SEQ ID NO: 4112220 - RNA, 22 nt, Streptococcus pyogenes M1 GAS
agaauuauacuaacuauuuuua

SEQ ID NO: 4112221 - RNA, 14 nt, Streptococcus pyogenes M1 GAS
agaauugaaaaacu

SEQ ID NO: 4112222 - RNA, 20 nt, Streptococcus pyogenes M1 GAS
agaauuucaaguucucuacu

SEQ ID NO: 4112223 - RNA, 13 nt, Streptococcus pyogenes M1 GAS
agaauuuuuauaa

SEQ ID NO: 4112224 - RNA, 12 nt, Streptococcus pyogenes M1 GAS
agacaaaaaacu

SEQ ID NO: 4112225 - RNA, 14 nt, Streptococcus pyogenes M1 GAS
agacaaacaucgau

SEQ ID NO: 4112226 - RNA, 21 nt, Streptococcus pyogenes M1 GAS
agacaauaaggucaucagaau

SEQ ID NO: 4112227 - RNA, 14 nt, Streptococcus pyogenes M1 GAS
agacaccaaaaaaa

SEQ ID NO: 4112228 - RNA, 15 nt, Streptococcus pyogenes M1 GAS
agacaccaaaaaaag

SEQ ID NO: 4112229 - RNA, 18 nt, Streptococcus pyogenes M1 GAS
agacaguuagcaaauugu

SEQ ID NO: 4112230 - RNA, 14 nt, Streptococcus pyogenes M1 GAS
agacauucguucua

SEQ ID NO: 4112231 - RNA, 16 nt, Streptococcus pyogenes M1 GAS
agaccauaaaaaaccu

SEQ ID NO: 4112232 - RNA, 20 nt, Streptococcus pyogenes M1 GAS
agaccucucaugggcaaaua

SEQ ID NO: 4112233 - RNA, 15 nt, Streptococcus pyogenes M1 GAS
agaccuucaaaaaag

SEQ ID NO: 4112234 - RNA, 13 nt, Streptococcus pyogenes M1 GAS
agacggcuaauaa

SEQ ID NO: 4112235 - RNA, 21 nt, Streptococcus pyogenes M1 GAS
agacuauaaaagucaacugau

SEQ ID NO: 4112236 - RNA, 20 nt, Streptococcus pyogenes M1 GAS
agacuaugguggguuucguu

SEQ ID NO: 4112237 - RNA, 20 nt, Streptococcus pyogenes M1 GAS
agacuuggccagcgucugau

SEQ ID NO: 4112238 - RNA, 19 nt, Streptococcus pyogenes M1 GAS
agagaaugauaguaaacga

SEQ ID NO: 4112239 - RNA, 21 nt, Streptococcus pyogenes M1 GAS
agagagaaugauaguaaacga

SEQ ID NO: 4112240 - RNA, 17 nt, Streptococcus pyogenes M1 GAS
agagagguugguaaaaa

SEQ ID NO: 4112241 - RNA, 18 nt, Streptococcus pyogenes M1 GAS
agagauuucguugacaaa

SEQ ID NO: 4112242 - RNA, 17 nt, Streptococcus pyogenes M1 GAS
agagcaguucagcagca

SEQ ID NO: 4112243 - RNA, 19 nt, Streptococcus pyogenes M1 GAS
agagcaguucagcagcacu

SEQ ID NO: 4112244 - RNA, 23 nt, Streptococcus pyogenes M1 GAS
agaguacuucugcagucuuuuuc

SEQ ID NO: 4112245 - RNA, 15 nt, Streptococcus pyogenes M1 GAS
agagucauuugacua

SEQ ID NO: 4112246 - RNA, 12 nt, Streptococcus pyogenes M1 GAS
agauaaaaaugg

SEQ ID NO: 4112247 - RNA, 16 nt, Streptococcus pyogenes M1 GAS
agauaaacuacaccau

SEQ ID NO: 4112248 - RNA, 18 nt, Streptococcus pyogenes M1 GAS
agauaagugccaucaggc

SEQ ID NO: 4112249 - RNA, 17 nt, Streptococcus pyogenes M1 GAS
agauaguaaagaagaau

SEQ ID NO: 4112250 - RNA, 18 nt, Streptococcus pyogenes M1 GAS
agauauucuuuggcaaga

SEQ ID NO: 4112251 - RNA, 21 nt, Streptococcus pyogenes M1 GAS
agauauucuuuggcaagauaa

SEQ ID NO: 4112252 - RNA, 17 nt, Streptococcus pyogenes M1 GAS
agaucauuaaauugauu

SEQ ID NO: 4112253 - RNA, 14 nt, Streptococcus pyogenes M1 GAS
agauccuacaagag

SEQ ID NO: 4112254 - RNA, 13 nt, Streptococcus pyogenes M1 GAS
agaucuucuuuug

SEQ ID NO: 4112255 - RNA, 15 nt, Streptococcus pyogenes M1 GAS
agaugacgguaaaua

SEQ ID NO: 4112256 - RNA, 18 nt, Streptococcus pyogenes M1 GAS
agaugacgguaaauaaag

SEQ ID NO: 4112257 - RNA, 20 nt, Streptococcus pyogenes M1 GAS
agaugcuugcucaauuuuug

SEQ ID NO: 4112258 - RNA, 17 nt, Streptococcus pyogenes M1 GAS
agauggguuagcucugu

SEQ ID NO: 4112259 - RNA, 19 nt, Streptococcus pyogenes M1 GAS
agaugucauggauauuaca

SEQ ID NO: 4112260 - RNA, 21 nt, Streptococcus pyogenes M1 GAS
agauguggcuaguaaguuuuu

SEQ ID NO: 4112261 - RNA, 18 nt, Streptococcus pyogenes M1 GAS
agauguuuacgcuuuaca

SEQ ID NO: 4112262 - RNA, 16 nt, Streptococcus pyogenes M1 GAS
agauuaaacuuacaaa

SEQ ID NO: 4112263 - RNA, 14 nt, Streptococcus pyogenes M1 GAS
agauuaacugacaa

SEQ ID NO: 4112264 - RNA, 16 nt, Streptococcus pyogenes M1 GAS
agauuggauuucgacu

SEQ ID NO: 4112265 - RNA, 14 nt, Streptococcus pyogenes M1 GAS
agauuucguugaca

SEQ ID NO: 4112266 - RNA, 13 nt, Streptococcus pyogenes M1 GAS
agauuuuaaaaaa

SEQ ID NO: 4112267 - RNA, 21 nt, Streptococcus pyogenes M1 GAS
agauuuuaagacaacauacuu

SEQ ID NO: 4112268 - RNA, 20 nt, Streptococcus pyogenes M1 GAS
agcaaaacaauaacacagaa

SEQ ID NO: 4112269 - RNA, 22 nt, Streptococcus pyogenes M1 GAS
agcaaaacaauaacacagaagc

SEQ ID NO: 4112270 - RNA, 16 nt, Streptococcus pyogenes M1 GAS
agcaaaaugcuguuug

SEQ ID NO: 4112271 - RNA, 20 nt, Streptococcus pyogenes M1 GAS
agcaaaggcgauuagcccaa

SEQ ID NO: 4112272 - RNA, 19 nt, Streptococcus pyogenes M1 GAS
agcaaaggcuucaucaaug

SEQ ID NO: 4112273 - RNA, 21 nt, Streptococcus pyogenes M1 GAS
agcaaagugauauacugaaaa

SEQ ID NO: 4112274 - RNA, 13 nt, Streptococcus pyogenes M1 GAS
agcaaauugaaaa

SEQ ID NO: 4112275 - RNA, 16 nt, Streptococcus pyogenes M1 GAS
agcaaauugaaaaaau

SEQ ID NO: 4112276 - RNA, 16 nt, Streptococcus pyogenes M1 GAS
agcaacaucaaaaaga

SEQ ID NO: 4112277 - RNA, 15 nt, Streptococcus pyogenes M1 GAS
agcaagcaucagcuc

SEQ ID NO: 4112278 - RNA, 15 nt, Streptococcus pyogenes M1 GAS
agcaaggcaccugag

SEQ ID NO: 4112279 - RNA, 21 nt, Streptococcus pyogenes M1 GAS
agcaagugugacuaguuuauu

SEQ ID NO: 4112280 - RNA, 14 nt, Streptococcus pyogenes M1 GAS
agcaauaacaucuu

SEQ ID NO: 4112281 - RNA, 18 nt, Streptococcus pyogenes M1 GAS
agcaccuacgauaaaaca

SEQ ID NO: 4112282 - RNA, 23 nt, Streptococcus pyogenes M1 GAS
agcagacaaaagggaagagagaa

SEQ ID NO: 4112283 - RNA, 19 nt, Streptococcus pyogenes M1 GAS
agcagcacuggcuuuuuug

SEQ ID NO: 4112284 - RNA, 11 nt, Streptococcus pyogenes M1 GAS
agcagcagaag

SEQ ID NO: 4112285 - RNA, 16 nt, Streptococcus pyogenes M1 GAS
agcagcagaagcaaau

SEQ ID NO: 4112286 - RNA, 20 nt, Streptococcus pyogenes M1 GAS
agcagcagaagcaaauucuu

SEQ ID NO: 4112287 - RNA, 12 nt, Streptococcus pyogenes M1 GAS
agcagcaucacg

SEQ ID NO: 4112288 - RNA, 22 nt, Streptococcus pyogenes M1 GAS
agcagcaucacguacagaaaug

SEQ ID NO: 4112289 - RNA, 17 nt, Streptococcus pyogenes M1 GAS
agcaguucagcagcacu

SEQ ID NO: 4112290 - RNA, 14 nt, Streptococcus pyogenes M1 GAS
agcauauugccacu

SEQ ID NO: 4112291 - RNA, 14 nt, Streptococcus pyogenes M1 GAS
agcauauuuugauu

SEQ ID NO: 4112292 - RNA, 19 nt, Streptococcus pyogenes M1 GAS
agcaucacguacagaaaug

SEQ ID NO: 4112293 - RNA, 15 nt, Streptococcus pyogenes M1 GAS
agcaucugaaaaaau

SEQ ID NO: 4112294 - RNA, 18 nt, Streptococcus pyogenes M1 GAS
agcaugauuuaguuuuua

SEQ ID NO: 4112295 - RNA, 15 nt, Streptococcus pyogenes M1 GAS
agcauuaaggauuau

SEQ ID NO: 4112296 - RNA, 16 nt, Streptococcus pyogenes M1 GAS
agcauuugccauggca

SEQ ID NO: 4112297 - RNA, 19 nt, Streptococcus pyogenes M1 GAS
agcauuuguuuugauaaaa

SEQ ID NO: 4112298 - RNA, 13 nt, Streptococcus pyogenes M1 GAS
agcauuuucauca

SEQ ID NO: 4112299 - RNA, 19 nt, Streptococcus pyogenes M1 GAS
agcauuuucaucaucaaga

SEQ ID NO: 4112300 - RNA, 14 nt, Streptococcus pyogenes M1 GAS
agccaaauccaccu

SEQ ID NO: 4112301 - RNA, 20 nt, Streptococcus pyogenes M1 GAS
agccaauaacgccagcuaca

SEQ ID NO: 4112302 - RNA, 12 nt, Streptococcus pyogenes M1 GAS
agccaauuacuu

SEQ ID NO: 4112303 - RNA, 15 nt, Streptococcus pyogenes M1 GAS
agccagagcaguuca

SEQ ID NO: 4112304 - RNA, 23 nt, Streptococcus pyogenes M1 GAS
agccagauggugcuacugaugua

SEQ ID NO: 4112305 - RNA, 22 nt, Streptococcus pyogenes M1 GAS
agccauuagcguagcccucgcu

SEQ ID NO: 4112306 - RNA, 13 nt, Streptococcus pyogenes M1 GAS
agccgaauaaggc

SEQ ID NO: 4112307 - RNA, 21 nt, Streptococcus pyogenes M1 GAS
agccgcucuaauuuagucauu

SEQ ID NO: 4112308 - RNA, 16 nt, Streptococcus pyogenes M1 GAS
agccuauuuaauaggc

SEQ ID NO: 4112309 - RNA, 17 nt, Streptococcus pyogenes M1 GAS
agccucuuggaaacaag

SEQ ID NO: 4112310 - RNA, 19 nt, Streptococcus pyogenes M1 GAS
agccucuuggaaacaagag

SEQ ID NO: 4112311 - RNA, 13 nt, Streptococcus pyogenes M1 GAS
agccuuauccauu

SEQ ID NO: 4112312 - RNA, 22 nt, Streptococcus pyogenes M1 GAS
agcggcacguuauucucugcua

SEQ ID NO: 4112313 - RNA, 21 nt, Streptococcus pyogenes M1 GAS
agcgggaacacucaucauauu

SEQ ID NO: 4112314 - RNA, 16 nt, Streptococcus pyogenes M1 GAS
agcgguuuugucuuau

SEQ ID NO: 4112315 - RNA, 17 nt, Streptococcus pyogenes M1 GAS
agcguaagccaaaucuu

SEQ ID NO: 4112316 - RNA, 23 nt, Streptococcus pyogenes M1 GAS
agcguagcccucgcuaucaaagc

SEQ ID NO: 4112317 - RNA, 15 nt, Streptococcus pyogenes M1 GAS
aguuccucgguuuuu

SEQ ID NO: 4112318 - RNA, 17 nt, Streptococcus pyogenes M1 GAS
aguuccucgguuuuuuu

SEQ ID NO: 4112319 - RNA, 19 nt, Streptococcus pyogenes M1 GAS
aguuccugcauguaacaag

SEQ ID NO: 4112320 - RNA, 20 nt, Streptococcus pyogenes M1 GAS
aguuuaggauauaagaaggu

SEQ ID NO: 4112321 - RNA, 16 nt, Streptococcus pyogenes M1 GAS
aguuuauguaugcugu

SEQ ID NO: 4112322 - RNA, 16 nt, Streptococcus pyogenes M1 GAS
aguuugacuucaaaaa

SEQ ID NO: 4112323 - RNA, 23 nt, Streptococcus pyogenes M1 GAS
aguuuucucagagacaauaaggu

SEQ ID NO: 4112324 - RNA, 23 nt, Streptococcus pyogenes M1 GAS
aguuuuuagcagcagaagcaaau

SEQ ID NO: 4112325 - RNA, 18 nt, Streptococcus pyogenes M1 GAS
aguuuuuucuaaaagaga

SEQ ID NO: 4112326 - RNA, 22 nt, Streptococcus pyogenes M1 GAS
auaaaaaaccuuaucaaaccaa

SEQ ID NO: 4112327 - RNA, 18 nt, Streptococcus pyogenes M1 GAS
auaaaaaagaagcaaaau

SEQ ID NO: 4112328 - RNA, 22 nt, Streptococcus pyogenes M1 GAS
auaaaaauauucccaaugcccc

SEQ ID NO: 4112329 - RNA, 14 nt, Streptococcus pyogenes M1 GAS
auaaaaauggcugu

SEQ ID NO: 4112330 - RNA, 15 nt, Streptococcus pyogenes M1 GAS
auaaaacaaauaauu

SEQ ID NO: 4112331 - RNA, 20 nt, Streptococcus pyogenes M1 GAS
auaaaacucaaaaagcauuu

SEQ ID NO: 4112332 - RNA, 14 nt, Streptococcus pyogenes M1 GAS
auaaaagauauuuu

SEQ ID NO: 4112333 - RNA, 18 nt, Streptococcus pyogenes M1 GAS
auaaaagauauuuuaaaa

SEQ ID NO: 4112334 - RNA, 16 nt, Streptococcus pyogenes M1 GAS
auaaaauauuuuucca

SEQ ID NO: 4112335 - RNA, 18 nt, Streptococcus pyogenes M1 GAS
auaaaaucguuauuaauu

SEQ ID NO: 4112336 - RNA, 22 nt, Streptococcus pyogenes M1 GAS
auaaaaucguuauuaauuguuu

SEQ ID NO: 4112337 - RNA, 12 nt, Streptococcus pyogenes M1 GAS
auaaaaugccuc

SEQ ID NO: 4112338 - RNA, 20 nt, Streptococcus pyogenes M1 GAS
auaaaauuccccacaaaaga

SEQ ID NO: 4112339 - RNA, 11 nt, Streptococcus pyogenes M1 GAS
auaaacaaagc

SEQ ID NO: 4112340 - RNA, 15 nt, Streptococcus pyogenes M1 GAS
auaaacaaagccagu

SEQ ID NO: 4112341 - RNA, 13 nt, Streptococcus pyogenes M1 GAS
auaaaccaagcua

SEQ ID NO: 4112342 - RNA, 13 nt, Streptococcus pyogenes M1 GAS
auaaacuacacca

SEQ ID NO: 4112343 - RNA, 19 nt, Streptococcus pyogenes M1 GAS
auaaacuguauacaaaaag

SEQ ID NO: 4112344 - RNA, 14 nt, Streptococcus pyogenes M1 GAS
auaaacuugaauau

SEQ ID NO: 4112345 - RNA, 13 nt, Streptococcus pyogenes M1 GAS
auaaagaaaaagu

SEQ ID NO: 4112346 - RNA, 18 nt, Streptococcus pyogenes M1 GAS
auaaagaaacaaaaauga

SEQ ID NO: 4112347 - RNA, 14 nt, Streptococcus pyogenes M1 GAS
auaaagucagacuu

SEQ ID NO: 4112348 - RNA, 21 nt, Streptococcus pyogenes M1 GAS
auaaagucagacuuaauugaa

SEQ ID NO: 4112349 - RNA, 15 nt, Streptococcus pyogenes M1 GAS
auaaagugauaguga

SEQ ID NO: 4112350 - RNA, 16 nt, Streptococcus pyogenes M1 GAS
auaaaucuuacuaacu

SEQ ID NO: 4112351 - RNA, 15 nt, Streptococcus pyogenes M1 GAS
auaaauucuaacucu

SEQ ID NO: 4112352 - RNA, 15 nt, Streptococcus pyogenes M1 GAS
auaacaaauuuaucc

SEQ ID NO: 4112353 - RNA, 15 nt, Streptococcus pyogenes M1 GAS
auaaccgccaucuaa

SEQ ID NO: 4112354 - RNA, 16 nt, Streptococcus pyogenes M1 GAS
auaacuguuuuucuua

SEQ ID NO: 4112355 - RNA, 17 nt, Streptococcus pyogenes M1 GAS
auaacuuuuagcuaaga

SEQ ID NO: 4112356 - RNA, 20 nt, Streptococcus pyogenes M1 GAS
auaagaaggucucaaauuuu

SEQ ID NO: 4112357 - RNA, 15 nt, Streptococcus pyogenes M1 GAS
auaagaccuucaaaa

SEQ ID NO: 4112358 - RNA, 20 nt, Streptococcus pyogenes M1 GAS
auaagaccuucaaaaaaggg

SEQ ID NO: 4112359 - RNA, 23 nt, Streptococcus pyogenes M1 GAS
auaagagaagugauguuuuuaca

SEQ ID NO: 4112360 - RNA, 13 nt, Streptococcus pyogenes M1 GAS
auaagauacugcc

SEQ ID NO: 4112361 - RNA, 16 nt, Streptococcus pyogenes M1 GAS
auaagauucaauauga

SEQ ID NO: 4112362 - RNA, 20 nt, Streptococcus pyogenes M1 GAS
auaaggcugcgaugauuuug

SEQ ID NO: 4112363 - RNA, 12 nt, Streptococcus pyogenes M1 GAS
auaagguuuuuu

SEQ ID NO: 4112364 - RNA, 21 nt, Streptococcus pyogenes M1 GAS
auaaguagcguacauggaugc

SEQ ID NO: 4112365 - RNA, 19 nt, Streptococcus pyogenes M1 GAS
auaaguauucuaaaauccu

SEQ ID NO: 4112366 - RNA, 12 nt, Streptococcus pyogenes M1 GAS
auaauaaaaagc

SEQ ID NO: 4112367 - RNA, 18 nt, Streptococcus pyogenes M1 GAS
auaaucgaugauaauagu

SEQ ID NO: 4112368 - RNA, 15 nt, Streptococcus pyogenes M1 GAS
auaaucguaacuggu

SEQ ID NO: 4112369 - RNA, 17 nt, Streptococcus pyogenes M1 GAS
auaaucguaacuggucc

SEQ ID NO: 4112370 - RNA, 15 nt, Streptococcus pyogenes M1 GAS
auaaucugagcgguu

SEQ ID NO: 4112371 - RNA, 20 nt, Streptococcus pyogenes M1 GAS
auaaucuucaauuuuugcca

SEQ ID NO: 4112372 - RNA, 16 nt, Streptococcus pyogenes M1 GAS
auaaugagcaaggcaa

SEQ ID NO: 4112373 - RNA, 16 nt, Streptococcus pyogenes M1 GAS
auaaugccaucaaaaa

SEQ ID NO: 4112374 - RNA, 18 nt, Streptococcus pyogenes M1 GAS
auaaugccaucaaaaaaa

SEQ ID NO: 4112375 - RNA, 19 nt, Streptococcus pyogenes M1 GAS
auaaugccaucaaaaaaag

SEQ ID NO: 4112376 - RNA, 21 nt, Streptococcus pyogenes M1 GAS
auaauuaguauauuguaauaa

SEQ ID NO: 4112377 - RNA, 21 nt, Streptococcus pyogenes M1 GAS
auaauuccugugacaacccaa

SEQ ID NO: 4112378 - RNA, 22 nt, Streptococcus pyogenes M1 GAS
auacaacugacuagccaaaucu

SEQ ID NO: 4112379 - RNA, 23 nt, Streptococcus pyogenes M1 GAS
auacaguccaaacucaaaccaaa

SEQ ID NO: 4112380 - RNA, 21 nt, Streptococcus pyogenes M1 GAS
auacauugagaauuuuuauaa

SEQ ID NO: 4112381 - RNA, 15 nt, Streptococcus pyogenes M1 GAS
auaccaaaucaaaaa

SEQ ID NO: 4112382 - RNA, 17 nt, Streptococcus pyogenes M1 GAS
auaccaaaucaaaaagc

SEQ ID NO: 4112383 - RNA, 18 nt, Streptococcus pyogenes M1 GAS
auaccaaaucaaaaagcu

SEQ ID NO: 4112384 - RNA, 20 nt, Streptococcus pyogenes M1 GAS
auaccaaaucaaaaagcuaa

SEQ ID NO: 4112385 - RNA, 15 nt, Streptococcus pyogenes M1 GAS
auaccauuucuuugc

SEQ ID NO: 4112386 - RNA, 21 nt, Streptococcus pyogenes M1 GAS
auaccauuucuuugcaaaaga

SEQ ID NO: 4112387 - RNA, 23 nt, Streptococcus pyogenes M1 GAS
auaccguagaaaguagcaccuuu

SEQ ID NO: 4112388 - RNA, 14 nt, Streptococcus pyogenes M1 GAS
auacgguaaaaacu

SEQ ID NO: 4112389 - RNA, 13 nt, Streptococcus pyogenes M1 GAS
auacguaaaaaga

SEQ ID NO: 4112390 - RNA, 18 nt, Streptococcus pyogenes M1 GAS
auacguaaaaagagaaga

SEQ ID NO: 4112391 - RNA, 23 nt, Streptococcus pyogenes M1 GAS
auacguuuauuuaguuauuuuug

SEQ ID NO: 4112392 - RNA, 16 nt, Streptococcus pyogenes M1 GAS
auacuaacuauuuuua

SEQ ID NO: 4112393 - RNA, 17 nt, Streptococcus pyogenes M1 GAS
auacuaacuauuuuuac

SEQ ID NO: 4112394 - RNA, 14 nt, Streptococcus pyogenes M1 GAS
auacuagaaaaagc

SEQ ID NO: 4112395 - RNA, 18 nt, Streptococcus pyogenes M1 GAS
auacucaauauaauaaaa

SEQ ID NO: 4112396 - RNA, 22 nt, Streptococcus pyogenes M1 GAS
auacuggucaauggaaauuuua

SEQ ID NO: 4112397 - RNA, 16 nt, Streptococcus pyogenes M1 GAS
auacuuugguauucuu

SEQ ID NO: 4112398 - RNA, 22 nt, Streptococcus pyogenes M1 GAS
auacuuugguauucuuuuuccg

SEQ ID NO: 4112399 - RNA, 18 nt, Streptococcus pyogenes M1 GAS
auagaaacuuuuuauaag

SEQ ID NO: 4112400 - RNA, 20 nt, Streptococcus pyogenes M1 GAS
auagaaacuuuuuauaagca

SEQ ID NO: 4112401 - RNA, 19 nt, Streptococcus pyogenes M1 GAS
auagaagacggaguauuuu

SEQ ID NO: 4112402 - RNA, 21 nt, Streptococcus pyogenes M1 GAS
auagaagacggaguauuuuuu

SEQ ID NO: 4112403 - RNA, 23 nt, Streptococcus pyogenes M1 GAS
auagaagacggaguauuuuuuag

SEQ ID NO: 4112404 - RNA, 14 nt, Streptococcus pyogenes M1 GAS
auagacaaacagaa

SEQ ID NO: 4112405 - RNA, 20 nt, Streptococcus pyogenes M1 GAS
auagagccaagauuuuaagg

SEQ ID NO: 4112406 - RNA, 19 nt, Streptococcus pyogenes M1 GAS
auagauaauguuguuuuug

SEQ ID NO: 4112407 - RNA, 19 nt, Streptococcus pyogenes M1 GAS
auagcaauggcuaaaaaga

SEQ ID NO: 4112408 - RNA, 21 nt, Streptococcus pyogenes M1 GAS
auagcaccuacgauaaaacaa

SEQ ID NO: 4112409 - RNA, 19 nt, Streptococcus pyogenes M1 GAS
auagcacguuggaaaagga

SEQ ID NO: 4112410 - RNA, 13 nt, Streptococcus pyogenes M1 GAS
auagcauaaaaua

SEQ ID NO: 4112411 - RNA, 16 nt, Streptococcus pyogenes M1 GAS
auagcauaaaauaguu

SEQ ID NO: 4112412 - RNA, 14 nt, Streptococcus pyogenes M1 GAS
auagcauuaaggau

SEQ ID NO: 4112413 - RNA, 20 nt, Streptococcus pyogenes M1 GAS
auagcguaaagcaagggaaa

SEQ ID NO: 4112414 - RNA, 14 nt, Streptococcus pyogenes M1 GAS
auagcucaucccua

SEQ ID NO: 4112415 - RNA, 17 nt, Streptococcus pyogenes M1 GAS
auaggaauaguuuagug

SEQ ID NO: 4112416 - RNA, 12 nt, Streptococcus pyogenes M1 GAS
auaggcuuuuuu

SEQ ID NO: 4112417 - RNA, 13 nt, Streptococcus pyogenes M1 GAS
aucuuauuuuaag

SEQ ID NO: 4112418 - RNA, 19 nt, Streptococcus pyogenes M1 GAS
aucuucaauuuuugccaaa

SEQ ID NO: 4112419 - RNA, 15 nt, Streptococcus pyogenes M1 GAS
aucuuuaucagucug

SEQ ID NO: 4112420 - RNA, 12 nt, Streptococcus pyogenes M1 GAS
aucuuucauuag

SEQ ID NO: 4112421 - RNA, 13 nt, Streptococcus pyogenes M1 GAS
aucuuugacaaug

SEQ ID NO: 4112422 - RNA, 14 nt, Streptococcus pyogenes M1 GAS
aucuuugacaaugu

SEQ ID NO: 4112423 - RNA, 13 nt, Streptococcus pyogenes M1 GAS
augaaaaagaagu

SEQ ID NO: 4112424 - RNA, 14 nt, Streptococcus pyogenes M1 GAS
augaaaacguguau

SEQ ID NO: 4112425 - RNA, 23 nt, Streptococcus pyogenes M1 GAS
augaaaacguguauucuuaaaaa

SEQ ID NO: 4112426 - RNA, 14 nt, Streptococcus pyogenes M1 GAS
augaaagguaucua

SEQ ID NO: 4112427 - RNA, 20 nt, Streptococcus pyogenes M1 GAS
augacaacuaucgcucagaa

SEQ ID NO: 4112428 - RNA, 16 nt, Streptococcus pyogenes M1 GAS
augacauugacugaca

SEQ ID NO: 4112429 - RNA, 20 nt, Streptococcus pyogenes M1 GAS
augaccuuugauaagauauu

SEQ ID NO: 4112430 - RNA, 18 nt, Streptococcus pyogenes M1 GAS
augacgccuccaaauacu

SEQ ID NO: 4112431 - RNA, 18 nt, Streptococcus pyogenes M1 GAS
augacuauagaaaguaaa

SEQ ID NO: 4112432 - RNA, 14 nt, Streptococcus pyogenes M1 GAS
augacuguauguau

SEQ ID NO: 4112433 - RNA, 17 nt, Streptococcus pyogenes M1 GAS
augacuucaaaaucacc

SEQ ID NO: 4112434 - RNA, 22 nt, Streptococcus pyogenes M1 GAS
augacuuguaaaaugauacuuu

SEQ ID NO: 4112435 - RNA, 13 nt, Streptococcus pyogenes M1 GAS
augagaaagccaa

SEQ ID NO: 4112436 - RNA, 13 nt, Streptococcus pyogenes M1 GAS
augagcaaggcaa

SEQ ID NO: 4112437 - RNA, 14 nt, Streptococcus pyogenes M1 GAS
augagcaaggcaag

SEQ ID NO: 4112438 - RNA, 18 nt, Streptococcus pyogenes M1 GAS
augaguaagaaauuacuu

SEQ ID NO: 4112439 - RNA, 24 nt, Streptococcus pyogenes M1 GAS
augauaaaggccuguauuucuuua

SEQ ID NO: 4112440 - RNA, 21 nt, Streptococcus pyogenes M1 GAS
augauaauaguagguagaacg

SEQ ID NO: 4112441 - RNA, 13 nt, Streptococcus pyogenes M1 GAS
augauauaaaaau

SEQ ID NO: 4112442 - RNA, 16 nt, Streptococcus pyogenes M1 GAS
augaucuguuuaaaaa

SEQ ID NO: 4112443 - RNA, 17 nt, Streptococcus pyogenes M1 GAS
augaucuguuuaaaaac

SEQ ID NO: 4112444 - RNA, 21 nt, Streptococcus pyogenes M1 GAS
augaucuguuuaaaaacaaau

SEQ ID NO: 4112445 - RNA, 22 nt, Streptococcus pyogenes M1 GAS
augaugccauuuaaaagggcaa

SEQ ID NO: 4112446 - RNA, 18 nt, Streptococcus pyogenes M1 GAS
augauuacauuaggauau

SEQ ID NO: 4112447 - RNA, 20 nt, Streptococcus pyogenes M1 GAS
augauugaguaagcagcauc

SEQ ID NO: 4112448 - RNA, 21 nt, Streptococcus pyogenes M1 GAS
augauugaguaagcagcauca

SEQ ID NO: 4112449 - RNA, 17 nt, Streptococcus pyogenes M1 GAS
augauuugucaaaaagu

SEQ ID NO: 4112450 - RNA, 20 nt, Streptococcus pyogenes M1 GAS
augauuugucaaaaaguaaa

SEQ ID NO: 4112451 - RNA, 23 nt, Streptococcus pyogenes M1 GAS
augauuugucaaaaaguaaaaag

SEQ ID NO: 4112452 - RNA, 16 nt, Streptococcus pyogenes M1 GAS
augauuuuaacguuuu

SEQ ID NO: 4112453 - RNA, 15 nt, Streptococcus pyogenes M1 GAS
augcacacaaaucuu

SEQ ID NO: 4112454 - RNA, 20 nt, Streptococcus pyogenes M1 GAS
augcauuacauuuaaaggag

SEQ ID NO: 4112455 - RNA, 23 nt, Streptococcus pyogenes M1 GAS
augccaagauaccggguuguuuu

SEQ ID NO: 4112456 - RNA, 15 nt, Streptococcus pyogenes M1 GAS
augccaaucuuugug

SEQ ID NO: 4112457 - RNA, 19 nt, Streptococcus pyogenes M1 GAS
augccauuuaaaagggcaa

SEQ ID NO: 4112458 - RNA, 22 nt, Streptococcus pyogenes M1 GAS
augcccauugaugaguuuaugu

SEQ ID NO: 4112459 - RNA, 19 nt, Streptococcus pyogenes M1 GAS
augccccaaaguaauccaa

SEQ ID NO: 4112460 - RNA, 15 nt, Streptococcus pyogenes M1 GAS
augcgaggcuuuuuu

SEQ ID NO: 4112461 - RNA, 17 nt, Streptococcus pyogenes M1 GAS
augcucauaggcagaga

SEQ ID NO: 4112462 - RNA, 22 nt, Streptococcus pyogenes M1 GAS
augcuccuccaccaaaaccaag

SEQ ID NO: 4112463 - RNA, 15 nt, Streptococcus pyogenes M1 GAS
augcugaguucuuuu

SEQ ID NO: 4112464 - RNA, 16 nt, Streptococcus pyogenes M1 GAS
augcugaguucuuuuu

SEQ ID NO: 4112465 - RNA, 14 nt, Streptococcus pyogenes M1 GAS
augcuguccaugau

SEQ ID NO: 4112466 - RNA, 20 nt, Streptococcus pyogenes M1 GAS
augcuguccaugauuuucau

SEQ ID NO: 4112467 - RNA, 16 nt, Streptococcus pyogenes M1 GAS
augcuuuuaauuuuau

SEQ ID NO: 4112468 - RNA, 20 nt, Streptococcus pyogenes M1 GAS
auggaaauuuuaaaugacau

SEQ ID NO: 4112469 - RNA, 21 nt, Streptococcus pyogenes M1 GAS
auggacgucuucuuuuuauua

SEQ ID NO: 4112470 - RNA, 16 nt, Streptococcus pyogenes M1 GAS
auggagucaaugaaaa

SEQ ID NO: 4112471 - RNA, 22 nt, Streptococcus pyogenes M1 GAS
auggaugcuccuccaccaaaac

SEQ ID NO: 4112472 - RNA, 15 nt, Streptococcus pyogenes M1 GAS
auggcuaaaaagaga

SEQ ID NO: 4112473 - RNA, 20 nt, Streptococcus pyogenes M1 GAS
auggcuaaaaagagagcuua

SEQ ID NO: 4112474 - RNA, 13 nt, Streptococcus pyogenes M1 GAS
auggucuugcucu

SEQ ID NO: 4112475 - RNA, 22 nt, Streptococcus pyogenes M1 GAS
auguaaauauaaagucagacuu

SEQ ID NO: 4112476 - RNA, 23 nt, Streptococcus pyogenes M1 GAS
auguaccaauuuaagguauuguu

SEQ ID NO: 4112477 - RNA, 22 nt, Streptococcus pyogenes M1 GAS
auguaugcuguccaugauuuuc

SEQ ID NO: 4112478 - RNA, 18 nt, Streptococcus pyogenes M1 GAS
augucauggauauuacaa

SEQ ID NO: 4112479 - RNA, 17 nt, Streptococcus pyogenes M1 GAS
auguccgaaaaaaacuu

SEQ ID NO: 4112480 - RNA, 15 nt, Streptococcus pyogenes M1 GAS
augucuugcuaaaau

SEQ ID NO: 4112481 - RNA, 16 nt, Streptococcus pyogenes M1 GAS
auguuauuaaauaaua

SEQ ID NO: 4112482 - RNA, 17 nt, Streptococcus pyogenes M1 GAS
auguuuacgcuuuacau

SEQ ID NO: 4112483 - RNA, 22 nt, Streptococcus pyogenes M1 GAS
auguuuugcucgacagugcgca

SEQ ID NO: 4112484 - RNA, 23 nt, Streptococcus pyogenes M1 GAS
auuaaauaauacagcauacauca

SEQ ID NO: 4112485 - RNA, 18 nt, Streptococcus pyogenes M1 GAS
auuaacguuaacaaaaau

SEQ ID NO: 4112486 - RNA, 17 nt, Streptococcus pyogenes M1 GAS
auuaagauuaauuuacu

SEQ ID NO: 4112487 - RNA, 23 nt, Streptococcus pyogenes M1 GAS
auuaagauuugaccacaccuaau

SEQ ID NO: 4112488 - RNA, 14 nt, Streptococcus pyogenes M1 GAS
auuaaggauuauga

SEQ ID NO: 4112489 - RNA, 19 nt, Streptococcus pyogenes M1 GAS
auuaaggauuaugaaaaag

SEQ ID NO: 4112490 - RNA, 14 nt, Streptococcus pyogenes M1 GAS
auuaauaaauuuuu

SEQ ID NO: 4112491 - RNA, 16 nt, Streptococcus pyogenes M1 GAS
auuaauaaguauucua

SEQ ID NO: 4112492 - RNA, 14 nt, Streptococcus pyogenes M1 GAS
auuaauaauauuaa

SEQ ID NO: 4112493 - RNA, 20 nt, Streptococcus pyogenes M1 GAS
auuaauagcgccagcaauuu

SEQ ID NO: 4112494 - RNA, 22 nt, Streptococcus pyogenes M1 GAS
auuaaucaaaaaacugagacaa

SEQ ID NO: 4112495 - RNA, 18 nt, Streptococcus pyogenes M1 GAS
auuaauuuacuaauccuu

SEQ ID NO: 4112496 - RNA, 20 nt, Streptococcus pyogenes M1 GAS
auuacaagcauuuugcaagu

SEQ ID NO: 4112497 - RNA, 13 nt, Streptococcus pyogenes M1 GAS
auuacauuaggau

SEQ ID NO: 4112498 - RNA, 14 nt, Streptococcus pyogenes M1 GAS
auuacauuaggaua

SEQ ID NO: 4112499 - RNA, 17 nt, Streptococcus pyogenes M1 GAS
auuacauuaggauauag

SEQ ID NO: 4112500 - RNA, 23 nt, Streptococcus pyogenes M1 GAS
auuaccuauugagucuuuuccua

SEQ ID NO: 4112501 - RNA, 14 nt, Streptococcus pyogenes M1 GAS
auuacgauuaaaag

SEQ ID NO: 4112502 - RNA, 14 nt, Streptococcus pyogenes M1 GAS
auuagcaaagugau

SEQ ID NO: 4112503 - RNA, 14 nt, Streptococcus pyogenes M1 GAS
auuaguaaccauag

SEQ ID NO: 4112504 - RNA, 19 nt, Streptococcus pyogenes M1 GAS
auuaguccaaaauacaucc

SEQ ID NO: 4112505 - RNA, 21 nt, Streptococcus pyogenes M1 GAS
auuaguccaaaauacauccua

SEQ ID NO: 4112506 - RNA, 19 nt, Streptococcus pyogenes M1 GAS
auuagucuuuaaaaaacgc

SEQ ID NO: 4112507 - RNA, 19 nt, Streptococcus pyogenes M1 GAS
auuauaccaaauuucagau

SEQ ID NO: 4112508 - RNA, 18 nt, Streptococcus pyogenes M1 GAS
auuauacuaacuauuuuu

SEQ ID NO: 4112509 - RNA, 23 nt, Streptococcus pyogenes M1 GAS
auuauacuaacuauuuuuaccuu

SEQ ID NO: 4112510 - RNA, 23 nt, Streptococcus pyogenes M1 GAS
auuauaguaaccauugccauuaa

SEQ ID NO: 4112511 - RNA, 17 nt, Streptococcus pyogenes M1 GAS
auuaucaauaacagaaa

SEQ ID NO: 4112512 - RNA, 13 nt, Streptococcus pyogenes M1 GAS
auuaugaaaaaga

SEQ ID NO: 4112513 - RNA, 17 nt, Streptococcus pyogenes M1 GAS
auuaugaggugaacacc

SEQ ID NO: 4112514 - RNA, 21 nt, Streptococcus pyogenes M1 GAS
auuauuaguaaccauagaagc

SEQ ID NO: 4112515 - RNA, 15 nt, Streptococcus pyogenes M1 GAS
auuauuuuaauuuuu

SEQ ID NO: 4112516 - RNA, 22 nt, Streptococcus pyogenes M1 GAS
caaaaaacaagucuaucugcag

SEQ ID NO: 4112517 - RNA, 16 nt, Streptococcus pyogenes M1 GAS
caaaaaacuagaaacu

SEQ ID NO: 4112518 - RNA, 20 nt, Streptococcus pyogenes M1 GAS
caaaaaauuaagaaggaacu

SEQ ID NO: 4112519 - RNA, 16 nt, Streptococcus pyogenes M1 GAS
caaaaagagaccgaag

SEQ ID NO: 4112520 - RNA, 18 nt, Streptococcus pyogenes M1 GAS
caaaaagccuauuuaaua

SEQ ID NO: 4112521 - RNA, 17 nt, Streptococcus pyogenes M1 GAS
caaaaaggcuaagaugg

SEQ ID NO: 4112522 - RNA, 16 nt, Streptococcus pyogenes M1 GAS
caaaaaguaaaaagca

SEQ ID NO: 4112523 - RNA, 17 nt, Streptococcus pyogenes M1 GAS
caaaaaguaaaaagcaa

SEQ ID NO: 4112524 - RNA, 17 nt, Streptococcus pyogenes M1 GAS
caaaaauaaguauagca

SEQ ID NO: 4112525 - RNA, 15 nt, Streptococcus pyogenes M1 GAS
caaaaaucuuuuucu

SEQ ID NO: 4112526 - RNA, 15 nt, Streptococcus pyogenes M1 GAS
caaaacccuuucgua

SEQ ID NO: 4112527 - RNA, 16 nt, Streptococcus pyogenes M1 GAS
caaaacuucaaauuuc

SEQ ID NO: 4112528 - RNA, 17 nt, Streptococcus pyogenes M1 GAS
caaaagaauugaaaaac

SEQ ID NO: 4112529 - RNA, 18 nt, Streptococcus pyogenes M1 GAS
caaaagaccauaaaaaac

SEQ ID NO: 4112530 - RNA, 21 nt, Streptococcus pyogenes M1 GAS
caaaaguuggcuacucuauuu

SEQ ID NO: 4112531 - RNA, 11 nt, Streptococcus pyogenes M1 GAS
caaaauuauua

SEQ ID NO: 4112532 - RNA, 19 nt, Streptococcus pyogenes M1 GAS
caaaauuauuauuuugcuu

SEQ ID NO: 4112533 - RNA, 21 nt, Streptococcus pyogenes M1 GAS
caaacaagcgggucucuuugg

SEQ ID NO: 4112534 - RNA, 15 nt, Streptococcus pyogenes M1 GAS
caaacagaaauacuc

SEQ ID NO: 4112535 - RNA, 16 nt, Streptococcus pyogenes M1 GAS
caaacauccaaucacc

SEQ ID NO: 4112536 - RNA, 15 nt, Streptococcus pyogenes M1 GAS
caaacggaguuccuc

SEQ ID NO: 4112537 - RNA, 14 nt, Streptococcus pyogenes M1 GAS
caaacggaguucuc

SEQ ID NO: 4112538 - RNA, 21 nt, Streptococcus pyogenes M1 GAS
caaacuaggccaauccuaaca

SEQ ID NO: 4112539 - RNA, 14 nt, Streptococcus pyogenes M1 GAS
caaacuauauuguu

SEQ ID NO: 4112540 - RNA, 15 nt, Streptococcus pyogenes M1 GAS
caaacuauauuguua

SEQ ID NO: 4112541 - RNA, 23 nt, Streptococcus pyogenes M1 GAS
caaagcaucaggauugccaucaa

SEQ ID NO: 4112542 - RNA, 17 nt, Streptococcus pyogenes M1 GAS
caaaggauaugaggguc

SEQ ID NO: 4112543 - RNA, 21 nt, Streptococcus pyogenes M1 GAS
caaaggcuucaucaaugauag

SEQ ID NO: 4112544 - RNA, 23 nt, Streptococcus pyogenes M1 GAS
caaagggauuacgauuaaaagau

SEQ ID NO: 4112545 - RNA, 13 nt, Streptococcus pyogenes M1 GAS
caaaguaauccaa

SEQ ID NO: 4112546 - RNA, 19 nt, Streptococcus pyogenes M1 GAS
caaauaguagcaaauaaca

SEQ ID NO: 4112547 - RNA, 14 nt, Streptococcus pyogenes M1 GAS
caaauccuuuugcu

SEQ ID NO: 4112548 - RNA, 14 nt, Streptococcus pyogenes M1 GAS
caaauugaaaaaau

SEQ ID NO: 4112549 - RNA, 14 nt, Streptococcus pyogenes M1 GAS
caaauuguuugauu

SEQ ID NO: 4112550 - RNA, 23 nt, Streptococcus pyogenes M1 GAS
caaauuguuugauugauuugucu

SEQ ID NO: 4112551 - RNA, 14 nt, Streptococcus pyogenes M1 GAS
caaauuuauccuga

SEQ ID NO: 4112552 - RNA, 15 nt, Streptococcus pyogenes M1 GAS
caaauuuauccugau

SEQ ID NO: 4112553 - RNA, 15 nt, Streptococcus pyogenes M1 GAS
caaauuucagauaag

SEQ ID NO: 4112554 - RNA, 17 nt, Streptococcus pyogenes M1 GAS
caaauuucagauaagac

SEQ ID NO: 4112555 - RNA, 14 nt, Streptococcus pyogenes M1 GAS
caaauuuuuuucag

SEQ ID NO: 4112556 - RNA, 17 nt, Streptococcus pyogenes M1 GAS
caacacaauucaagaua

SEQ ID NO: 4112557 - RNA, 23 nt, Streptococcus pyogenes M1 GAS
caacaguugcuugcuuuuuucua

SEQ ID NO: 4112558 - RNA, 11 nt, Streptococcus pyogenes M1 GAS
caacaucaagg

SEQ ID NO: 4112559 - RNA, 15 nt, Streptococcus pyogenes M1 GAS
caaccgcuuccuuug

SEQ ID NO: 4112560 - RNA, 13 nt, Streptococcus pyogenes M1 GAS
caaccugaaaagu

SEQ ID NO: 4112561 - RNA, 14 nt, Streptococcus pyogenes M1 GAS
caacuccugauaau

SEQ ID NO: 4112562 - RNA, 17 nt, Streptococcus pyogenes M1 GAS
caacuuaccagcaccuu

SEQ ID NO: 4112563 - RNA, 16 nt, Streptococcus pyogenes M1 GAS
caacuucuauaugugu

SEQ ID NO: 4112564 - RNA, 16 nt, Streptococcus pyogenes M1 GAS
caagaacuccuggauu

SEQ ID NO: 4112565 - RNA, 21 nt, Streptococcus pyogenes M1 GAS
caagacacccccugcuguccc

SEQ ID NO: 4112566 - RNA, 15 nt, Streptococcus pyogenes M1 GAS
caagagcuuaaaagu

SEQ ID NO: 4112567 - RNA, 22 nt, Streptococcus pyogenes M1 GAS
caagaggaggcaacuguggguu

SEQ ID NO: 4112568 - RNA, 15 nt, Streptococcus pyogenes M1 GAS
caagaggaguugaac

SEQ ID NO: 4112569 - RNA, 13 nt, Streptococcus pyogenes M1 GAS
caagauaauauug

SEQ ID NO: 4112570 - RNA, 21 nt, Streptococcus pyogenes M1 GAS
caagauaccggguuguuuuuu

SEQ ID NO: 4112571 - RNA, 17 nt, Streptococcus pyogenes M1 GAS
caagaucugcacacacu

SEQ ID NO: 4112572 - RNA, 18 nt, Streptococcus pyogenes M1 GAS
caagcaacacgcuaucaa

SEQ ID NO: 4112573 - RNA, 20 nt, Streptococcus pyogenes M1 GAS
caagcaggcuacacaguuag

SEQ ID NO: 4112574 - RNA, 13 nt, Streptococcus pyogenes M1 GAS
caagcaucagcuc

SEQ ID NO: 4112575 - RNA, 14 nt, Streptococcus pyogenes M1 GAS
caaggcaagaggag

SEQ ID NO: 4112576 - RNA, 22 nt, Streptococcus pyogenes M1 GAS
caaggcaccugaggcaauggcu

SEQ ID NO: 4112577 - RNA, 16 nt, Streptococcus pyogenes M1 GAS
caaggcugucgugcuc

SEQ ID NO: 4112578 - RNA, 16 nt, Streptococcus pyogenes M1 GAS
caaguaugcuuuuaau

SEQ ID NO: 4112579 - RNA, 20 nt, Streptococcus pyogenes M1 GAS
caagucaggaauuguugacu

SEQ ID NO: 4112580 - RNA, 20 nt, Streptococcus pyogenes M1 GAS
caaguccugcuuuugaugca

SEQ ID NO: 4112581 - RNA, 22 nt, Streptococcus pyogenes M1 GAS
caagugacaaccuuaaagaccc

SEQ ID NO: 4112582 - RNA, 17 nt, Streptococcus pyogenes M1 GAS
caagugauacuugguau

SEQ ID NO: 4112583 - RNA, 18 nt, Streptococcus pyogenes M1 GAS
caagugccaguaaggaaa

SEQ ID NO: 4112584 - RNA, 23 nt, Streptococcus pyogenes M1 GAS
caagugccaguaaggaaaucaau

SEQ ID NO: 4112585 - RNA, 17 nt, Streptococcus pyogenes M1 GAS
caauaaaaaagaagcaa

SEQ ID NO: 4112586 - RNA, 15 nt, Streptococcus pyogenes M1 GAS
caauaacacagaagc

SEQ ID NO: 4112587 - RNA, 23 nt, Streptococcus pyogenes M1 GAS
caauaacacagaagccucuucug

SEQ ID NO: 4112588 - RNA, 17 nt, Streptococcus pyogenes M1 GAS
caauaacagaaauuaau

SEQ ID NO: 4112589 - RNA, 20 nt, Streptococcus pyogenes M1 GAS
caauaaugccaucaaaaaaa

SEQ ID NO: 4112590 - RNA, 16 nt, Streptococcus pyogenes M1 GAS
caauacucccuucucu

SEQ ID NO: 4112591 - RNA, 19 nt, Streptococcus pyogenes M1 GAS
caauacucccuucucuagu

SEQ ID NO: 4112592 - RNA, 15 nt, Streptococcus pyogenes M1 GAS
caauagcugcugcua

SEQ ID NO: 4112593 - RNA, 20 nt, Streptococcus pyogenes M1 GAS
caauagcugcugcuaaagca

SEQ ID NO: 4112594 - RNA, 17 nt, Streptococcus pyogenes M1 GAS
caauauaacuuuuagcu

SEQ ID NO: 4112595 - RNA, 18 nt, Streptococcus pyogenes M1 GAS
caauauaauaaaaagcag

SEQ ID NO: 4112596 - RNA, 21 nt, Streptococcus pyogenes M1 GAS
caauaugugauuauuauucua

SEQ ID NO: 4112597 - RNA, 16 nt, Streptococcus pyogenes M1 GAS
caaucaucaggguugc

SEQ ID NO: 4112598 - RNA, 15 nt, Streptococcus pyogenes M1 GAS
caaucgguuuuagcu

SEQ ID NO: 4112599 - RNA, 14 nt, Streptococcus pyogenes M1 GAS
caaugaaaaguuau

SEQ ID NO: 4112600 - RNA, 13 nt, Streptococcus pyogenes M1 GAS
caaugccaucugc

SEQ ID NO: 4112601 - RNA, 14 nt, Streptococcus pyogenes M1 GAS
caaugcuuuuugua

SEQ ID NO: 4112602 - RNA, 15 nt, Streptococcus pyogenes M1 GAS
caauggaaauuuuaa

SEQ ID NO: 4112603 - RNA, 21 nt, Streptococcus pyogenes M1 GAS
caauggaaauuuuaaaugaca

SEQ ID NO: 4112604 - RNA, 13 nt, Streptococcus pyogenes M1 GAS
caauguaugacaa

SEQ ID NO: 4112605 - RNA, 19 nt, Streptococcus pyogenes M1 GAS
caaugugacaauuggugau

SEQ ID NO: 4112606 - RNA, 20 nt, Streptococcus pyogenes M1 GAS
caauuauuucgucuaaaaag

SEQ ID NO: 4112607 - RNA, 16 nt, Streptococcus pyogenes M1 GAS
caauucaagauaguga

SEQ ID NO: 4112608 - RNA, 23 nt, Streptococcus pyogenes M1 GAS
caauuccauacgcuccaacgaua

SEQ ID NO: 4112609 - RNA, 17 nt, Streptococcus pyogenes M1 GAS
caauuccaucacuucca

SEQ ID NO: 4112610 - RNA, 23 nt, Streptococcus pyogenes M1 GAS
caauugauuugcagaggcuugca

SEQ ID NO: 4112611 - RNA, 21 nt, Streptococcus pyogenes M1 GAS
caauuguuuuuucaacaaauc

SEQ ID NO: 4112612 - RNA, 18 nt, Streptococcus pyogenes M1 GAS
caauuuuugccaaaaucu

SEQ ID NO: 4112613 - RNA, 18 nt, Streptococcus pyogenes M1 GAS
cacaaacugcccuugaaa

SEQ ID NO: 4112614 - RNA, 13 nt, Streptococcus pyogenes M1 GAS
cacacaaaucuuc

SEQ ID NO: 4112615 - RNA, 21 nt, Streptococcus pyogenes M1 GAS
cacagaaaaaagauaaacauc

SEQ ID NO: 4112616 - RNA, 22 nt, Streptococcus pyogenes M1 GAS
caugccuaaagcccauaaagga

SEQ ID NO: 4112617 - RNA, 18 nt, Streptococcus pyogenes M1 GAS
cauggagucaaugaaaag

SEQ ID NO: 4112618 - RNA, 15 nt, Streptococcus pyogenes M1 GAS
cauggaguccuuuuu

SEQ ID NO: 4112619 - RNA, 23 nt, Streptococcus pyogenes M1 GAS
cauggcaagagcaccgcgaauau

SEQ ID NO: 4112620 - RNA, 21 nt, Streptococcus pyogenes M1 GAS
cauggcuaaugauaaggcugc

SEQ ID NO: 4112621 - RNA, 16 nt, Streptococcus pyogenes M1 GAS
cauggguaaaaugacu

SEQ ID NO: 4112622 - RNA, 17 nt, Streptococcus pyogenes M1 GAS
cauguguuguuagggua

SEQ ID NO: 4112623 - RNA, 18 nt, Streptococcus pyogenes M1 GAS
cauguguuguuaggguag

SEQ ID NO: 4112624 - RNA, 16 nt, Streptococcus pyogenes M1 GAS
cauguugacuauuuuu

SEQ ID NO: 4112625 - RNA, 16 nt, Streptococcus pyogenes M1 GAS
cauuaaaaaaaccagc

SEQ ID NO: 4112626 - RNA, 15 nt, Streptococcus pyogenes M1 GAS
cauuaaagcuaucau

SEQ ID NO: 4112627 - RNA, 23 nt, Streptococcus pyogenes M1 GAS
cauuaaggauuaugaaaaagaag

SEQ ID NO: 4112628 - RNA, 15 nt, Streptococcus pyogenes M1 GAS
cauuaagguuuuuuu

SEQ ID NO: 4112629 - RNA, 14 nt, Streptococcus pyogenes M1 GAS
cauuaauaaaagau

SEQ ID NO: 4112630 - RNA, 15 nt, Streptococcus pyogenes M1 GAS
cauuacauuuaaagg

SEQ ID NO: 4112631 - RNA, 13 nt, Streptococcus pyogenes M1 GAS
cauuagcuuuuuu

SEQ ID NO: 4112632 - RNA, 19 nt, Streptococcus pyogenes M1 GAS
cauuaguccaaaauacauc

SEQ ID NO: 4112633 - RNA, 13 nt, Streptococcus pyogenes M1 GAS
cauuauaaaagag

SEQ ID NO: 4112634 - RNA, 14 nt, Streptococcus pyogenes M1 GAS
cauuauaaaagagu

SEQ ID NO: 4112635 - RNA, 16 nt, Streptococcus pyogenes M1 GAS
cauuaucaucuggucc

SEQ ID NO: 4112636 - RNA, 21 nt, Streptococcus pyogenes M1 GAS
cauuauugacaaauccaauga

SEQ ID NO: 4112637 - RNA, 22 nt, Streptococcus pyogenes M1 GAS
cauucguucuaguuuaggauau

SEQ ID NO: 4112638 - RNA, 14 nt, Streptococcus pyogenes M1 GAS
cauucuugcagaau

SEQ ID NO: 4112639 - RNA, 13 nt, Streptococcus pyogenes M1 GAS
cauugaauaaagu

SEQ ID NO: 4112640 - RNA, 17 nt, Streptococcus pyogenes M1 GAS
cauugaugagacuaacc

SEQ ID NO: 4112641 - RNA, 22 nt, Streptococcus pyogenes M1 GAS
cauugccaucgacgaugugacu

SEQ ID NO: 4112642 - RNA, 15 nt, Streptococcus pyogenes M1 GAS
cauugccauuaauaa

SEQ ID NO: 4112643 - RNA, 22 nt, Streptococcus pyogenes M1 GAS
cauugcuuuuuaugauuuguca

SEQ ID NO: 4112644 - RNA, 14 nt, Streptococcus pyogenes M1 GAS
cauugucaaauaaa

SEQ ID NO: 4112645 - RNA, 15 nt, Streptococcus pyogenes M1 GAS
cauugucaaauaaaa

SEQ ID NO: 4112646 - RNA, 17 nt, Streptococcus pyogenes M1 GAS
cauugucaaauaaaauc

SEQ ID NO: 4112647 - RNA, 19 nt, Streptococcus pyogenes M1 GAS
cauuuaugcugauuuugga

SEQ ID NO: 4112648 - RNA, 16 nt, Streptococcus pyogenes M1 GAS
cauuuccuacaaaaua

SEQ ID NO: 4112649 - RNA, 19 nt, Streptococcus pyogenes M1 GAS
cauuucggacuguuuuuua

SEQ ID NO: 4112650 - RNA, 11 nt, Streptococcus pyogenes M1 GAS
cauuucuucag

SEQ ID NO: 4112651 - RNA, 17 nt, Streptococcus pyogenes M1 GAS
cauuucuucagguuucu

SEQ ID NO: 4112652 - RNA, 19 nt, Streptococcus pyogenes M1 GAS
cauuucuucagguuucuuu

SEQ ID NO: 4112653 - RNA, 22 nt, Streptococcus pyogenes M1 GAS
cauuucuugaggugauucuuuu

SEQ ID NO: 4112654 - RNA, 15 nt, Streptococcus pyogenes M1 GAS
cauuucuuugcaaaa

SEQ ID NO: 4112655 - RNA, 21 nt, Streptococcus pyogenes M1 GAS
cauuugacuacuagcaugucc

SEQ ID NO: 4112656 - RNA, 18 nt, Streptococcus pyogenes M1 GAS
cauuuguuuugauaaaaa

SEQ ID NO: 4112657 - RNA, 23 nt, Streptococcus pyogenes M1 GAS
cauuuuacuauggcuucuaaaaa

SEQ ID NO: 4112658 - RNA, 16 nt, Streptococcus pyogenes M1 GAS
cauuuucaucaucaag

SEQ ID NO: 4112659 - RNA, 16 nt, Streptococcus pyogenes M1 GAS
cauuuucuuugugaca

SEQ ID NO: 4112660 - RNA, 19 nt, Streptococcus pyogenes M1 GAS
cauuuucuuugugacauga

SEQ ID NO: 4112661 - RNA, 21 nt, Streptococcus pyogenes M1 GAS
cauuuugcaagucucuugcaa

SEQ ID NO: 4112662 - RNA, 22 nt, Streptococcus pyogenes M1 GAS
cauuuugcaagucucuugcaag

SEQ ID NO: 4112663 - RNA, 22 nt, Streptococcus pyogenes M1 GAS
cauuuuggagagauuuuaaaaa

SEQ ID NO: 4112664 - RNA, 21 nt, Streptococcus pyogenes M1 GAS
cauuuuuuauaaugguuuuuu

SEQ ID NO: 4112665 - RNA, 11 nt, Streptococcus pyogenes M1 GAS
ccaaaaagaaa

SEQ ID NO: 4112666 - RNA, 13 nt, Streptococcus pyogenes M1 GAS
ccaaaaagaaagg

SEQ ID NO: 4112667 - RNA, 18 nt, Streptococcus pyogenes M1 GAS
ccaaaaguuggcuacucu

SEQ ID NO: 4112668 - RNA, 16 nt, Streptococcus pyogenes M1 GAS
ccaaaauacauccuaa

SEQ ID NO: 4112669 - RNA, 15 nt, Streptococcus pyogenes M1 GAS
ccaaacucaaaccaa

SEQ ID NO: 4112670 - RNA, 16 nt, Streptococcus pyogenes M1 GAS
ccaaagaaggccagca

SEQ ID NO: 4112671 - RNA, 20 nt, Streptococcus pyogenes M1 GAS
ccaagggcaauaauuuucaa

SEQ ID NO: 4112672 - RNA, 22 nt, Streptococcus pyogenes M1 GAS
ccaaggucugcgcgacuaaaau

SEQ ID NO: 4112673 - RNA, 20 nt, Streptococcus pyogenes M1 GAS
ccaagugccaguaaggaaau

SEQ ID NO: 4112674 - RNA, 13 nt, Streptococcus pyogenes M1 GAS
ccaauaaaaaaga

SEQ ID NO: 4112675 - RNA, 20 nt, Streptococcus pyogenes M1 GAS
ccaauccuaacaauuuuuca

SEQ ID NO: 4112676 - RNA, 12 nt, Streptococcus pyogenes M1 GAS
ccaaucuuugug

SEQ ID NO: 4112677 - RNA, 15 nt, Streptococcus pyogenes M1 GAS
ccaauuguugaauaa

SEQ ID NO: 4112678 - RNA, 22 nt, Streptococcus pyogenes M1 GAS
ccacaaaagacaacgacgcuua

SEQ ID NO: 4112679 - RNA, 15 nt, Streptococcus pyogenes M1 GAS
ccacaccuaauaaaa

SEQ ID NO: 4112680 - RNA, 14 nt, Streptococcus pyogenes M1 GAS
ccacucgugcugcc

SEQ ID NO: 4112681 - RNA, 15 nt, Streptococcus pyogenes M1 GAS
ccagcaccuucuuuu

SEQ ID NO: 4112682 - RNA, 15 nt, Streptococcus pyogenes M1 GAS
ccagcauuugccaug

SEQ ID NO: 4112683 - RNA, 22 nt, Streptococcus pyogenes M1 GAS
ccagcgucugauauugaucucu

SEQ ID NO: 4112684 - RNA, 12 nt, Streptococcus pyogenes M1 GAS
ccagcuuacagc

SEQ ID NO: 4112685 - RNA, 18 nt, Streptococcus pyogenes M1 GAS
ccauaauaucagcuacac

SEQ ID NO: 4112686 - RNA, 15 nt, Streptococcus pyogenes M1 GAS
ccauacgcuccaacg

SEQ ID NO: 4112687 - RNA, 15 nt, Streptococcus pyogenes M1 GAS
ccauagaagccaauu

SEQ ID NO: 4112688 - RNA, 19 nt, Streptococcus pyogenes M1 GAS
ccaucaagacacccccugc

SEQ ID NO: 4112689 - RNA, 16 nt, Streptococcus pyogenes M1 GAS
ccaucaucgaguggau

SEQ ID NO: 4112690 - RNA, 22 nt, Streptococcus pyogenes M1 GAS
ccaugauugauuuuagcggcac

SEQ ID NO: 4112691 - RNA, 11 nt, Streptococcus pyogenes M1 GAS
ccaugauuuuc

SEQ ID NO: 4112692 - RNA, 15 nt, Streptococcus pyogenes M1 GAS
ccaugcucauaggca

SEQ ID NO: 4112693 - RNA, 15 nt, Streptococcus pyogenes M1 GAS
ccauuauaaaucuua

SEQ ID NO: 4112694 - RNA, 12 nt, Streptococcus pyogenes M1 GAS
ccauucuugcag

SEQ ID NO: 4112695 - RNA, 17 nt, Streptococcus pyogenes M1 GAS
ccauuuccuacaaaaua

SEQ ID NO: 4112696 - RNA, 17 nt, Streptococcus pyogenes M1 GAS
ccauuucggacuguuuu

SEQ ID NO: 4112697 - RNA, 14 nt, Streptococcus pyogenes M1 GAS
cccaucaagacacc

SEQ ID NO: 4112698 - RNA, 13 nt, Streptococcus pyogenes M1 GAS
cccauggcgugca

SEQ ID NO: 4112699 - RNA, 18 nt, Streptococcus pyogenes M1 GAS
cccuugaaauacgcuucu

SEQ ID NO: 4112700 - RNA, 14 nt, Streptococcus pyogenes M1 GAS
ccgaauaaggcucg

SEQ ID NO: 4112701 - RNA, 21 nt, Streptococcus pyogenes M1 GAS
ccgaauaaggcucgacaaagg

SEQ ID NO: 4112702 - RNA, 13 nt, Streptococcus pyogenes M1 GAS
ccgaguuuugcug

SEQ ID NO: 4112703 - RNA, 20 nt, Streptococcus pyogenes M1 GAS
ccgcccagaauaaucugagc

SEQ ID NO: 4112704 - RNA, 20 nt, Streptococcus pyogenes M1 GAS
ccgcgaauaugauauaaaaa

SEQ ID NO: 4112705 - RNA, 19 nt, Streptococcus pyogenes M1 GAS
ccggcucuaaaauauauug

SEQ ID NO: 4112706 - RNA, 22 nt, Streptococcus pyogenes M1 GAS
ccgguuucuugccuuuauauuu

SEQ ID NO: 4112707 - RNA, 15 nt, Streptococcus pyogenes M1 GAS
ccguaacuugcuuug

SEQ ID NO: 4112708 - RNA, 12 nt, Streptococcus pyogenes M1 GAS
ccgugaggacuu

SEQ ID NO: 4112709 - RNA, 18 nt, Streptococcus pyogenes M1 GAS
ccgugaggacuuauuuuu

SEQ ID NO: 4112710 - RNA, 16 nt, Streptococcus pyogenes M1 GAS
ccguuagucugcugcu

SEQ ID NO: 4112711 - RNA, 22 nt, Streptococcus pyogenes M1 GAS
ccguuuuuuguuguaaaaaggu

SEQ ID NO: 4112712 - RNA, 13 nt, Streptococcus pyogenes M1 GAS
ccuaaagcccaua

SEQ ID NO: 4112713 - RNA, 13 nt, Streptococcus pyogenes M1 GAS
ccuaacaaaauca

SEQ ID NO: 4112714 - RNA, 21 nt, Streptococcus pyogenes M1 GAS
ccuaacaauuuuucaaaaaaa

SEQ ID NO: 4112715 - RNA, 19 nt, Streptococcus pyogenes M1 GAS
ccuaauaaaauagcaccua

SEQ ID NO: 4112716 - RNA, 20 nt, Streptococcus pyogenes M1 GAS
cuaaucagaacucgucuuua

SEQ ID NO: 4112717 - RNA, 23 nt, Streptococcus pyogenes M1 GAS
cuaaucagaacucgucuuuaucc

SEQ ID NO: 4112718 - RNA, 14 nt, Streptococcus pyogenes M1 GAS
cuaauccaauaaua

SEQ ID NO: 4112719 - RNA, 16 nt, Streptococcus pyogenes M1 GAS
cuaauccuuuuucaca

SEQ ID NO: 4112720 - RNA, 15 nt, Streptococcus pyogenes M1 GAS
cuaaucuaggacuaa

SEQ ID NO: 4112721 - RNA, 12 nt, Streptococcus pyogenes M1 GAS
cuacaaaauaac

SEQ ID NO: 4112722 - RNA, 19 nt, Streptococcus pyogenes M1 GAS
cuacacuugauuucauuuu

SEQ ID NO: 4112723 - RNA, 18 nt, Streptococcus pyogenes M1 GAS
cuacgguuauuaccuauu

SEQ ID NO: 4112724 - RNA, 17 nt, Streptococcus pyogenes M1 GAS
cuacucuauuuuaagua

SEQ ID NO: 4112725 - RNA, 16 nt, Streptococcus pyogenes M1 GAS
cuagaaaaagcaauga

SEQ ID NO: 4112726 - RNA, 20 nt, Streptococcus pyogenes M1 GAS
cuagacucuagcauaaaaga

SEQ ID NO: 4112727 - RNA, 12 nt, Streptococcus pyogenes M1 GAS
cuagcacaaaau

SEQ ID NO: 4112728 - RNA, 14 nt, Streptococcus pyogenes M1 GAS
cuagcgggaacacu

SEQ ID NO: 4112729 - RNA, 22 nt, Streptococcus pyogenes M1 GAS
cuagcucuuuaucaccugucaa

SEQ ID NO: 4112730 - RNA, 14 nt, Streptococcus pyogenes M1 GAS
cuaggaauaaaaug

SEQ ID NO: 4112731 - RNA, 21 nt, Streptococcus pyogenes M1 GAS
cuaggagggacugucaaaaaa

SEQ ID NO: 4112732 - RNA, 22 nt, Streptococcus pyogenes M1 GAS
cuaggcuuucauuauagacuau

SEQ ID NO: 4112733 - RNA, 22 nt, Streptococcus pyogenes M1 GAS
cuagguaguuacgcauaccuga

SEQ ID NO: 4112734 - RNA, 15 nt, Streptococcus pyogenes M1 GAS
cuagguuaaaauaga

SEQ ID NO: 4112735 - RNA, 22 nt, Streptococcus pyogenes M1 GAS
cuagucgaaauugguccucuga

SEQ ID NO: 4112736 - RNA, 13 nt, Streptococcus pyogenes M1 GAS
cuagucuuuuuau

SEQ ID NO: 4112737 - RNA, 21 nt, Streptococcus pyogenes M1 GAS
cuaguguguugucaaacauaa

SEQ ID NO: 4112738 - RNA, 13 nt, Streptococcus pyogenes M1 GAS
cuaguuaagcuug

SEQ ID NO: 4112739 - RNA, 23 nt, Streptococcus pyogenes M1 GAS
cuaguuaagcuugcuaagagaau

SEQ ID NO: 4112740 - RNA, 14 nt, Streptococcus pyogenes M1 GAS
cuauaccuaaaaaa

SEQ ID NO: 4112741 - RNA, 15 nt, Streptococcus pyogenes M1 GAS
cuauaccuaaaaaau

SEQ ID NO: 4112742 - RNA, 18 nt, Streptococcus pyogenes M1 GAS
cuauagaaaguaaaaaua

SEQ ID NO: 4112743 - RNA, 20 nt, Streptococcus pyogenes M1 GAS
cuauagaaaguaaaaauacu

SEQ ID NO: 4112744 - RNA, 21 nt, Streptococcus pyogenes M1 GAS
cuauagaaaguuauaaagaaa

SEQ ID NO: 4112745 - RNA, 22 nt, Streptococcus pyogenes M1 GAS
cuaucauaggguucacuuuguu

SEQ ID NO: 4112746 - RNA, 20 nt, Streptococcus pyogenes M1 GAS
cuaucauggagucaaugaaa

SEQ ID NO: 4112747 - RNA, 14 nt, Streptococcus pyogenes M1 GAS
cuauccauuaucgc

SEQ ID NO: 4112748 - RNA, 16 nt, Streptococcus pyogenes M1 GAS
cuaucgcuaacauuua

SEQ ID NO: 4112749 - RNA, 22 nt, Streptococcus pyogenes M1 GAS
cuaucugcagauuuuaagacaa

SEQ ID NO: 4112750 - RNA, 21 nt, Streptococcus pyogenes M1 GAS
cuaugaaaaaagaacaaagau

SEQ ID NO: 4112751 - RNA, 19 nt, Streptococcus pyogenes M1 GAS
cuaugauacauugaauaaa

SEQ ID NO: 4112752 - RNA, 16 nt, Streptococcus pyogenes M1 GAS
cuaugaucuguuuaaa

SEQ ID NO: 4112753 - RNA, 15 nt, Streptococcus pyogenes M1 GAS
cuauggcuucuaaaa

SEQ ID NO: 4112754 - RNA, 19 nt, Streptococcus pyogenes M1 GAS
cuauguggagcuuuuuuug

SEQ ID NO: 4112755 - RNA, 20 nt, Streptococcus pyogenes M1 GAS
cuauguugcuuaaugaccuu

SEQ ID NO: 4112756 - RNA, 16 nt, Streptococcus pyogenes M1 GAS
cuauuaccuauagaaa

SEQ ID NO: 4112757 - RNA, 19 nt, Streptococcus pyogenes M1 GAS
cuauucaauauuuuauuaa

SEQ ID NO: 4112758 - RNA, 20 nt, Streptococcus pyogenes M1 GAS
cuauucaauauuuuauuaau

SEQ ID NO: 4112759 - RNA, 18 nt, Streptococcus pyogenes M1 GAS
cuauugaaucuuguuuaa

SEQ ID NO: 4112760 - RNA, 17 nt, Streptococcus pyogenes M1 GAS
cuauuucacuuaucauu

SEQ ID NO: 4112761 - RNA, 12 nt, Streptococcus pyogenes M1 GAS
cuauuuuaagua

SEQ ID NO: 4112762 - RNA, 20 nt, Streptococcus pyogenes M1 GAS
cuauuuuaaguaaaggauuu

SEQ ID NO: 4112763 - RNA, 20 nt, Streptococcus pyogenes M1 GAS
cucaaaccaaacaagcgggu

SEQ ID NO: 4112764 - RNA, 15 nt, Streptococcus pyogenes M1 GAS
cucaaauuuuuuuca

SEQ ID NO: 4112765 - RNA, 22 nt, Streptococcus pyogenes M1 GAS
cucaaccucugaaggcacagcc

SEQ ID NO: 4112766 - RNA, 19 nt, Streptococcus pyogenes M1 GAS
cucaauuuuugauuuuaau

SEQ ID NO: 4112767 - RNA, 24 nt, Streptococcus pyogenes M1 GAS
cucacuaggccuagcuuuuuacau

SEQ ID NO: 4112768 - RNA, 15 nt, Streptococcus pyogenes M1 GAS
cucagaauaaagaaa

SEQ ID NO: 4112769 - RNA, 21 nt, Streptococcus pyogenes M1 GAS
cucagaauaaagaaaaagucu

SEQ ID NO: 4112770 - RNA, 14 nt, Streptococcus pyogenes M1 GAS
cucagagacaauaa

SEQ ID NO: 4112771 - RNA, 13 nt, Streptococcus pyogenes M1 GAS
cucaguaaucuaa

SEQ ID NO: 4112772 - RNA, 16 nt, Streptococcus pyogenes M1 GAS
cucauaacaaauuuau

SEQ ID NO: 4112773 - RNA, 17 nt, Streptococcus pyogenes M1 GAS
cucaugggcaaauaaac

SEQ ID NO: 4112774 - RNA, 15 nt, Streptococcus pyogenes M1 GAS
cuccaacgaccucca

SEQ ID NO: 4112775 - RNA, 18 nt, Streptococcus pyogenes M1 GAS
cuccaacgaccuccagcu

SEQ ID NO: 4112776 - RNA, 15 nt, Streptococcus pyogenes M1 GAS
cuccagcugacagcc

SEQ ID NO: 4112777 - RNA, 22 nt, Streptococcus pyogenes M1 GAS
cuccuaaggaguaguugcuggu

SEQ ID NO: 4112778 - RNA, 18 nt, Streptococcus pyogenes M1 GAS
cuccuggauuaaaugccc

SEQ ID NO: 4112779 - RNA, 20 nt, Streptococcus pyogenes M1 GAS
cuccuugcaauagagccaag

SEQ ID NO: 4112780 - RNA, 20 nt, Streptococcus pyogenes M1 GAS
cucgagcuuucuacuaaaaa

SEQ ID NO: 4112781 - RNA, 14 nt, Streptococcus pyogenes M1 GAS
cucgcuaucaaagc

SEQ ID NO: 4112782 - RNA, 17 nt, Streptococcus pyogenes M1 GAS
cucgguuuuuuuaagua

SEQ ID NO: 4112783 - RNA, 18 nt, Streptococcus pyogenes M1 GAS
cucgugcugccaucggaa

SEQ ID NO: 4112784 - RNA, 21 nt, Streptococcus pyogenes M1 GAS
cucgugguugucaaccucuau

SEQ ID NO: 4112785 - RNA, 16 nt, Streptococcus pyogenes M1 GAS
cucuaauuuagucauu

SEQ ID NO: 4112786 - RNA, 21 nt, Streptococcus pyogenes M1 GAS
cucuaauuuagucauuucuuc

SEQ ID NO: 4112787 - RNA, 15 nt, Streptococcus pyogenes M1 GAS
cucuagcauaaaaga

SEQ ID NO: 4112788 - RNA, 14 nt, Streptococcus pyogenes M1 GAS
cucugcaacaucaa

SEQ ID NO: 4112789 - RNA, 16 nt, Streptococcus pyogenes M1 GAS
cucugcaacaucaagg

SEQ ID NO: 4112790 - RNA, 23 nt, Streptococcus pyogenes M1 GAS
cucuucgguacugaacuuguccu

SEQ ID NO: 4112791 - RNA, 22 nt, Streptococcus pyogenes M1 GAS
cucuuguccacgccgaagaugu

SEQ ID NO: 4112792 - RNA, 13 nt, Streptococcus pyogenes M1 GAS
cucuuuuuuuuau

SEQ ID NO: 4112793 - RNA, 12 nt, Streptococcus pyogenes M1 GAS
cugaaaauaaaa

SEQ ID NO: 4112794 - RNA, 14 nt, Streptococcus pyogenes M1 GAS
cugaaaauaaaaua

SEQ ID NO: 4112795 - RNA, 20 nt, Streptococcus pyogenes M1 GAS
cugaaaauaaaauauuuuuc

SEQ ID NO: 4112796 - RNA, 13 nt, Streptococcus pyogenes M1 GAS
cugaaacaccugc

SEQ ID NO: 4112797 - RNA, 15 nt, Streptococcus pyogenes M1 GAS
cugaaauauaaccuc

SEQ ID NO: 4112798 - RNA, 15 nt, Streptococcus pyogenes M1 GAS
cugaacucuuuauuc

SEQ ID NO: 4112799 - RNA, 19 nt, Streptococcus pyogenes M1 GAS
cugacaaaaaaagcaagca

SEQ ID NO: 4112800 - RNA, 23 nt, Streptococcus pyogenes M1 GAS
cugacaaaacuucaaauuucaug

SEQ ID NO: 4112801 - RNA, 15 nt, Streptococcus pyogenes M1 GAS
cugagauauucauuu

SEQ ID NO: 4112802 - RNA, 16 nt, Streptococcus pyogenes M1 GAS
cugagauauucauuuu

SEQ ID NO: 4112803 - RNA, 20 nt, Streptococcus pyogenes M1 GAS
cugagauauucauuuucuuc

SEQ ID NO: 4112804 - RNA, 19 nt, Streptococcus pyogenes M1 GAS
cugagccaauaacgccagc

SEQ ID NO: 4112805 - RNA, 20 nt, Streptococcus pyogenes M1 GAS
cugagccuccaacauagcua

SEQ ID NO: 4112806 - RNA, 22 nt, Streptococcus pyogenes M1 GAS
cugagcgguuuugucuuaucuc

SEQ ID NO: 4112807 - RNA, 14 nt, Streptococcus pyogenes M1 GAS
cugaguucuuuuuc

SEQ ID NO: 4112808 - RNA, 15 nt, Streptococcus pyogenes M1 GAS
cugaguucuuuuucg

SEQ ID NO: 4112809 - RNA, 20 nt, Streptococcus pyogenes M1 GAS
cugauaaaacucaaaaagca

SEQ ID NO: 4112810 - RNA, 19 nt, Streptococcus pyogenes M1 GAS
cugauaagguuuuuuuaag

SEQ ID NO: 4112811 - RNA, 17 nt, Streptococcus pyogenes M1 GAS
cugauaaugauuuauua

SEQ ID NO: 4112812 - RNA, 16 nt, Streptococcus pyogenes M1 GAS
cugaucccuucauuuu

SEQ ID NO: 4112813 - RNA, 23 nt, Streptococcus pyogenes M1 GAS
cugaugcgauucccaucuuuauc

SEQ ID NO: 4112814 - RNA, 14 nt, Streptococcus pyogenes M1 GAS
cugauuuuggauga

SEQ ID NO: 4112815 - RNA, 11 nt, Streptococcus pyogenes M1 GAS
cuuuaaaaagu

SEQ ID NO: 4112816 - RNA, 20 nt, Streptococcus pyogenes M1 GAS
cuuuaaaaaguuucugaguu

SEQ ID NO: 4112817 - RNA, 22 nt, Streptococcus pyogenes M1 GAS
cuuuaaaaaguuucugaguuga

SEQ ID NO: 4112818 - RNA, 19 nt, Streptococcus pyogenes M1 GAS
cuuuaacaaugagaucuuc

SEQ ID NO: 4112819 - RNA, 15 nt, Streptococcus pyogenes M1 GAS
cuuuaacaugaugua

SEQ ID NO: 4112820 - RNA, 21 nt, Streptococcus pyogenes M1 GAS
cuuuacaucaaaggcuuuuug

SEQ ID NO: 4112821 - RNA, 11 nt, Streptococcus pyogenes M1 GAS
cuuuacauuuu

SEQ ID NO: 4112822 - RNA, 12 nt, Streptococcus pyogenes M1 GAS
cuuuacauuuua

SEQ ID NO: 4112823 - RNA, 13 nt, Streptococcus pyogenes M1 GAS
cuuuagagaauca

SEQ ID NO: 4112824 - RNA, 17 nt, Streptococcus pyogenes M1 GAS
cuuuagagaaucaaagg

SEQ ID NO: 4112825 - RNA, 22 nt, Streptococcus pyogenes M1 GAS
cuuuagagaaucaaagggauua

SEQ ID NO: 4112826 - RNA, 18 nt, Streptococcus pyogenes M1 GAS
cuuuaguugcuucuuuua

SEQ ID NO: 4112827 - RNA, 22 nt, Streptococcus pyogenes M1 GAS
cuuuauaaugguuuuuugucuu

SEQ ID NO: 4112828 - RNA, 18 nt, Streptococcus pyogenes M1 GAS
cuuuaucuuauuuuaaga

SEQ ID NO: 4112829 - RNA, 19 nt, Streptococcus pyogenes M1 GAS
cuuuaucuuauuuuaagaa

SEQ ID NO: 4112830 - RNA, 13 nt, Streptococcus pyogenes M1 GAS
cuuuauugaugau

SEQ ID NO: 4112831 - RNA, 12 nt, Streptococcus pyogenes M1 GAS
cuuuauuuugau

SEQ ID NO: 4112832 - RNA, 19 nt, Streptococcus pyogenes M1 GAS
cuuucaaacggaguuccuc

SEQ ID NO: 4112833 - RNA, 15 nt, Streptococcus pyogenes M1 GAS
cuuucaguuaucuga

SEQ ID NO: 4112834 - RNA, 17 nt, Streptococcus pyogenes M1 GAS
cuuucauuauagacuau

SEQ ID NO: 4112835 - RNA, 14 nt, Streptococcus pyogenes M1 GAS
cuuuccauucuugc

SEQ ID NO: 4112836 - RNA, 14 nt, Streptococcus pyogenes M1 GAS
cuuucuacuaaaaa

SEQ ID NO: 4112837 - RNA, 15 nt, Streptococcus pyogenes M1 GAS
cuuucuacuaaaaaa

SEQ ID NO: 4112838 - RNA, 12 nt, Streptococcus pyogenes M1 GAS
cuuucuuuugcc

SEQ ID NO: 4112839 - RNA, 14 nt, Streptococcus pyogenes M1 GAS
cuuugauuuuucuu

SEQ ID NO: 4112840 - RNA, 14 nt, Streptococcus pyogenes M1 GAS
cuuugcaaaagaau

SEQ ID NO: 4112841 - RNA, 20 nt, Streptococcus pyogenes M1 GAS
cuuuuaagcugagcaaaaca

SEQ ID NO: 4112842 - RNA, 21 nt, Streptococcus pyogenes M1 GAS
cuuuuaagcugagcaaaacaa

SEQ ID NO: 4112843 - RNA, 22 nt, Streptococcus pyogenes M1 GAS
cuuuuaagcugagcaaaacaau

SEQ ID NO: 4112844 - RNA, 14 nt, Streptococcus pyogenes M1 GAS
cuuuuaauuuggag

SEQ ID NO: 4112845 - RNA, 19 nt, Streptococcus pyogenes M1 GAS
cuuuuaauuuuauuuuuua

SEQ ID NO: 4112846 - RNA, 20 nt, Streptococcus pyogenes M1 GAS
cuuuuaauuuuauuuuuuaa

SEQ ID NO: 4112847 - RNA, 21 nt, Streptococcus pyogenes M1 GAS
cuuuuaauuuuauuuuuuaaa

SEQ ID NO: 4112848 - RNA, 15 nt, Streptococcus pyogenes M1 GAS
cuuuuagcuaagaau

SEQ ID NO: 4112849 - RNA, 14 nt, Streptococcus pyogenes M1 GAS
cuuuuaguuuuauu

SEQ ID NO: 4112850 - RNA, 12 nt, Streptococcus pyogenes M1 GAS
cuuuuaucacua

SEQ ID NO: 4112851 - RNA, 17 nt, Streptococcus pyogenes M1 GAS
cuuuucagagaugcuuc

SEQ ID NO: 4112852 - RNA, 19 nt, Streptococcus pyogenes M1 GAS
cuuuucguuuuauuuugau

SEQ ID NO: 4112853 - RNA, 13 nt, Streptococcus pyogenes M1 GAS
cuuuugaaaaauu

SEQ ID NO: 4112854 - RNA, 17 nt, Streptococcus pyogenes M1 GAS
cuuuugaaaaauuauga

SEQ ID NO: 4112855 - RNA, 11 nt, Streptococcus pyogenes M1 GAS
cuuuugccacg

SEQ ID NO: 4112856 - RNA, 23 nt, Streptococcus pyogenes M1 GAS
cuuuugcuucuagcucuuuauca

SEQ ID NO: 4112857 - RNA, 21 nt, Streptococcus pyogenes M1 GAS
cuuuuucguauacuuuaaaca

SEQ ID NO: 4112858 - RNA, 17 nt, Streptococcus pyogenes M1 GAS
cuuuuuggugucagcau

SEQ ID NO: 4112859 - RNA, 20 nt, Streptococcus pyogenes M1 GAS
cuuuuuuacuuuuaaaaucu

SEQ ID NO: 4112860 - RNA, 14 nt, Streptococcus pyogenes M1 GAS
cuuuuuucuaaccu

SEQ ID NO: 4112861 - RNA, 14 nt, Streptococcus pyogenes M1 GAS
cuuuuuugacacag

SEQ ID NO: 4112862 - RNA, 16 nt, Streptococcus pyogenes M1 GAS
cuuuuuugacacagau

SEQ ID NO: 4112863 - RNA, 14 nt, Streptococcus pyogenes M1 GAS
gaaaaaaacuugca

SEQ ID NO: 4112864 - RNA, 23 nt, Streptococcus pyogenes M1 GAS
gaaaaacuuggguugggauauua

SEQ ID NO: 4112865 - RNA, 16 nt, Streptococcus pyogenes M1 GAS
gaaaaagucucuagaa

SEQ ID NO: 4112866 - RNA, 17 nt, Streptococcus pyogenes M1 GAS
gaaaacguguauucuua

SEQ ID NO: 4112867 - RNA, 21 nt, Streptococcus pyogenes M1 GAS
gaaaacguguauucuuaaaaa

SEQ ID NO: 4112868 - RNA, 13 nt, Streptococcus pyogenes M1 GAS
gaaaagcuaagua

SEQ ID NO: 4112869 - RNA, 13 nt, Streptococcus pyogenes M1 GAS
gaaaauaaaauau

SEQ ID NO: 4112870 - RNA, 15 nt, Streptococcus pyogenes M1 GAS
gaaaaugcauuacau

SEQ ID NO: 4112871 - RNA, 18 nt, Streptococcus pyogenes M1 GAS
gaaaaugcauuacauuua

SEQ ID NO: 4112872 - RNA, 14 nt, Streptococcus pyogenes M1 GAS
gaaacaccugcugc

SEQ ID NO: 4112873 - RNA, 20 nt, Streptococcus pyogenes M1 GAS
gaaacguuauuaaagacaaa

SEQ ID NO: 4112874 - RNA, 19 nt, Streptococcus pyogenes M1 GAS
gaaacuaaaggcaauagca

SEQ ID NO: 4112875 - RNA, 18 nt, Streptococcus pyogenes M1 GAS
gaaagaggugcaacugcu

SEQ ID NO: 4112876 - RNA, 15 nt, Streptococcus pyogenes M1 GAS
gaaagcggaagaaca

SEQ ID NO: 4112877 - RNA, 18 nt, Streptococcus pyogenes M1 GAS
gaaaguaaggguuaacaa

SEQ ID NO: 4112878 - RNA, 13 nt, Streptococcus pyogenes M1 GAS
gaaaguagcaccu

SEQ ID NO: 4112879 - RNA, 19 nt, Streptococcus pyogenes M1 GAS
gaaauacuccguuucuagu

SEQ ID NO: 4112880 - RNA, 24 nt, Streptococcus pyogenes M1 GAS
gaaauacuccguuucuaguuucau

SEQ ID NO: 4112881 - RNA, 23 nt, Streptococcus pyogenes M1 GAS
gaaauaucuuucaguuguuuuaa

SEQ ID NO: 4112882 - RNA, 15 nt, Streptococcus pyogenes M1 GAS
gaaaugauagcaccu

SEQ ID NO: 4112883 - RNA, 16 nt, Streptococcus pyogenes M1 GAS
gaaauuuuaaaugaca

SEQ ID NO: 4112884 - RNA, 14 nt, Streptococcus pyogenes M1 GAS
gaacacucaucaua

SEQ ID NO: 4112885 - RNA, 14 nt, Streptococcus pyogenes M1 GAS
gaacagauugaaga

SEQ ID NO: 4112886 - RNA, 19 nt, Streptococcus pyogenes M1 GAS
gaacagauugaagacaaac

SEQ ID NO: 4112887 - RNA, 19 nt, Streptococcus pyogenes M1 GAS
gaaccaacuuggacgaagg

SEQ ID NO: 4112888 - RNA, 17 nt, Streptococcus pyogenes M1 GAS
gaacuccuaaaacaugu

SEQ ID NO: 4112889 - RNA, 12 nt, Streptococcus pyogenes M1 GAS
gaacuuguccug

SEQ ID NO: 4112890 - RNA, 19 nt, Streptococcus pyogenes M1 GAS
gaagaaggucaugaugcca

SEQ ID NO: 4112891 - RNA, 15 nt, Streptococcus pyogenes M1 GAS
gaagagagaagcugu

SEQ ID NO: 4112892 - RNA, 14 nt, Streptococcus pyogenes M1 GAS
gaagcaaaauaaac

SEQ ID NO: 4112893 - RNA, 22 nt, Streptococcus pyogenes M1 GAS
gaagccgugaggacuuauuuuu

SEQ ID NO: 4112894 - RNA, 15 nt, Streptococcus pyogenes M1 GAS
gaaggcacagaaaaa

SEQ ID NO: 4112895 - RNA, 16 nt, Streptococcus pyogenes M1 GAS
gaaggcucuuaucuuu

SEQ ID NO: 4112896 - RNA, 16 nt, Streptococcus pyogenes M1 GAS
gaaggcuuguucuuua

SEQ ID NO: 4112897 - RNA, 17 nt, Streptococcus pyogenes M1 GAS
gaaggcuuguucuuuau

SEQ ID NO: 4112898 - RNA, 23 nt, Streptococcus pyogenes M1 GAS
gaauaaaaagacuagagucucua

SEQ ID NO: 4112899 - RNA, 16 nt, Streptococcus pyogenes M1 GAS
gaauaaagaaaaaguc

SEQ ID NO: 4112900 - RNA, 20 nt, Streptococcus pyogenes M1 GAS
gaauaaggcucgacaaaggc

SEQ ID NO: 4112901 - RNA, 22 nt, Streptococcus pyogenes M1 GAS
gaaucauuuuggagagauuuua

SEQ ID NO: 4112902 - RNA, 23 nt, Streptococcus pyogenes M1 GAS
gaaucgcuuuaggaauaucauga

SEQ ID NO: 4112903 - RNA, 17 nt, Streptococcus pyogenes M1 GAS
gaauuauuaguaaccau

SEQ ID NO: 4112904 - RNA, 13 nt, Streptococcus pyogenes M1 GAS
gaauucuaaaaua

SEQ ID NO: 4112905 - RNA, 15 nt, Streptococcus pyogenes M1 GAS
gaauugcagcuaaaa

SEQ ID NO: 4112906 - RNA, 21 nt, Streptococcus pyogenes M1 GAS
gaauugcuggugacuaucauu

SEQ ID NO: 4112907 - RNA, 21 nt, Streptococcus pyogenes M1 GAS
gaauuuuuauaacaauuacaa

SEQ ID NO: 4112908 - RNA, 22 nt, Streptococcus pyogenes M1 GAS
gacaaauccaaugacuaaggua

SEQ ID NO: 4112909 - RNA, 19 nt, Streptococcus pyogenes M1 GAS
gacaacaauaucgagcuga

SEQ ID NO: 4112910 - RNA, 20 nt, Streptococcus pyogenes M1 GAS
gacaacauccauaccaucaa

SEQ ID NO: 4112911 - RNA, 23 nt, Streptococcus pyogenes M1 GAS
gacaaucgaaaugauagcaccua

SEQ ID NO: 4112912 - RNA, 22 nt, Streptococcus pyogenes M1 GAS
gacacagaugcgcaccuccacc

SEQ ID NO: 4112913 - RNA, 21 nt, Streptococcus pyogenes M1 GAS
gacacccccugcugucccagc

SEQ ID NO: 4112914 - RNA, 21 nt, Streptococcus pyogenes M1 GAS
gacacuaaaaccauuauaaaa

SEQ ID NO: 4112915 - RNA, 17 nt, Streptococcus pyogenes M1 GAS
gauuuccucuaacaugu

SEQ ID NO: 4112916 - RNA, 22 nt, Streptococcus pyogenes M1 GAS
gauuuccucuaacauguccaaa

SEQ ID NO: 4112917 - RNA, 20 nt, Streptococcus pyogenes M1 GAS
gauuucggaccaugccuaaa

SEQ ID NO: 4112918 - RNA, 21 nt, Streptococcus pyogenes M1 GAS
gauuugaccacaccuaauaaa

SEQ ID NO: 4112919 - RNA, 22 nt, Streptococcus pyogenes M1 GAS
gauuugaccacaccuaauaaaa

SEQ ID NO: 4112920 - RNA, 20 nt, Streptococcus pyogenes M1 GAS
gauuugcugagcuaaagcca

SEQ ID NO: 4112921 - RNA, 20 nt, Streptococcus pyogenes M1 GAS
gauuuuaaauaucuuaccau

SEQ ID NO: 4112922 - RNA, 14 nt, Streptococcus pyogenes M1 GAS
gcaaaagaauugaa

SEQ ID NO: 4112923 - RNA, 17 nt, Streptococcus pyogenes M1 GAS
gcaaaaugcuguuuguc

SEQ ID NO: 4112924 - RNA, 12 nt, Streptococcus pyogenes M1 GAS
gcaaaggcuuca

SEQ ID NO: 4112925 - RNA, 15 nt, Streptococcus pyogenes M1 GAS
gcaaaggcuucauca

SEQ ID NO: 4112926 - RNA, 21 nt, Streptococcus pyogenes M1 GAS
gcaaaggcuucaucaaugaua

SEQ ID NO: 4112927 - RNA, 15 nt, Streptococcus pyogenes M1 GAS
gcaaauugaaaaaau

SEQ ID NO: 4112928 - RNA, 15 nt, Streptococcus pyogenes M1 GAS
gcaacacgcuaucaa

SEQ ID NO: 4112929 - RNA, 19 nt, Streptococcus pyogenes M1 GAS
gcaauaaucgaugauaaua

SEQ ID NO: 4112930 - RNA, 15 nt, Streptococcus pyogenes M1 GAS
gcaauagagccaaga

SEQ ID NO: 4112931 - RNA, 14 nt, Streptococcus pyogenes M1 GAS
gcaauccaaaucaa

SEQ ID NO: 4112932 - RNA, 16 nt, Streptococcus pyogenes M1 GAS
gcaauggcuaaaaaga

SEQ ID NO: 4112933 - RNA, 22 nt, Streptococcus pyogenes M1 GAS
gcaauggcuaaaaagagagcuu

SEQ ID NO: 4112934 - RNA, 16 nt, Streptococcus pyogenes M1 GAS
gcaauuaaguaauugg

SEQ ID NO: 4112935 - RNA, 19 nt, Streptococcus pyogenes M1 GAS
gcaauuguuuuuucaacaa

SEQ ID NO: 4112936 - RNA, 22 nt, Streptococcus pyogenes M1 GAS
gcacaaacucugccaauuguuc

SEQ ID NO: 4112937 - RNA, 16 nt, Streptococcus pyogenes M1 GAS
gcacagaaaaaagaua

SEQ ID NO: 4112938 - RNA, 13 nt, Streptococcus pyogenes M1 GAS
gcaccuucuuuua

SEQ ID NO: 4112939 - RNA, 15 nt, Streptococcus pyogenes M1 GAS
gcaccuuuuuuauug

SEQ ID NO: 4112940 - RNA, 12 nt, Streptococcus pyogenes M1 GAS
gcacguuuucug

SEQ ID NO: 4112941 - RNA, 11 nt, Streptococcus pyogenes M1 GAS
gcacuuguaau

SEQ ID NO: 4112942 - RNA, 20 nt, Streptococcus pyogenes M1 GAS
gcagauggggugucagggga

SEQ ID NO: 4112943 - RNA, 22 nt, Streptococcus pyogenes M1 GAS
gcagauggggugucaggggaau

SEQ ID NO: 4112944 - RNA, 14 nt, Streptococcus pyogenes M1 GAS
gcagcaaaggcgau

SEQ ID NO: 4112945 - RNA, 14 nt, Streptococcus pyogenes M1 GAS
gcagcaccaguaaa

SEQ ID NO: 4112946 - RNA, 14 nt, Streptococcus pyogenes M1 GAS
gcagcagaagcaaa

SEQ ID NO: 4112947 - RNA, 17 nt, Streptococcus pyogenes M1 GAS
gcagcuaaaaacaaugc

SEQ ID NO: 4112948 - RNA, 17 nt, Streptococcus pyogenes M1 GAS
gcaggguaucugcucag

SEQ ID NO: 4112949 - RNA, 19 nt, Streptococcus pyogenes M1 GAS
gcaguuauaauuaguauau

SEQ ID NO: 4112950 - RNA, 22 nt, Streptococcus pyogenes M1 GAS
gcauaaaagauauuuuaaaaua

SEQ ID NO: 4112951 - RNA, 17 nt, Streptococcus pyogenes M1 GAS
gcaucgcaaacagaugc

SEQ ID NO: 4112952 - RNA, 16 nt, Streptococcus pyogenes M1 GAS
gcaucuacagcaccuu

SEQ ID NO: 4112953 - RNA, 14 nt, Streptococcus pyogenes M1 GAS
gcauguaacaagcc

SEQ ID NO: 4112954 - RNA, 15 nt, Streptococcus pyogenes M1 GAS
gcauugucaaauaaa

SEQ ID NO: 4112955 - RNA, 13 nt, Streptococcus pyogenes M1 GAS
gcauuuguuuuga

SEQ ID NO: 4112956 - RNA, 15 nt, Streptococcus pyogenes M1 GAS
gcauuuucaucauca

SEQ ID NO: 4112957 - RNA, 15 nt, Streptococcus pyogenes M1 GAS
gccaaagaaggccag

SEQ ID NO: 4112958 - RNA, 21 nt, Streptococcus pyogenes M1 GAS
gccaaaucuucugcauuauca

SEQ ID NO: 4112959 - RNA, 19 nt, Streptococcus pyogenes M1 GAS
gccaauuguucauuaaagc

SEQ ID NO: 4112960 - RNA, 21 nt, Streptococcus pyogenes M1 GAS
gccagagcaguucagcagcac

SEQ ID NO: 4112961 - RNA, 22 nt, Streptococcus pyogenes M1 GAS
gccagcuacauugggccccaug

SEQ ID NO: 4112962 - RNA, 18 nt, Streptococcus pyogenes M1 GAS
gcccccucuuuaccauuu

SEQ ID NO: 4112963 - RNA, 14 nt, Streptococcus pyogenes M1 GAS
gccccuuuuuugac

SEQ ID NO: 4112964 - RNA, 14 nt, Streptococcus pyogenes M1 GAS
gcccuggagcuguu

SEQ ID NO: 4112965 - RNA, 18 nt, Streptococcus pyogenes M1 GAS
gccgaagcggaaaaggaa

SEQ ID NO: 4112966 - RNA, 14 nt, Streptococcus pyogenes M1 GAS
gccguccuuaaaag

SEQ ID NO: 4112967 - RNA, 19 nt, Streptococcus pyogenes M1 GAS
gccguccuuaaaagaaaau

SEQ ID NO: 4112968 - RNA, 15 nt, Streptococcus pyogenes M1 GAS
gccuccaacauagcu

SEQ ID NO: 4112969 - RNA, 14 nt, Streptococcus pyogenes M1 GAS
gccuuaaugagaaa

SEQ ID NO: 4112970 - RNA, 16 nt, Streptococcus pyogenes M1 GAS
gcgaggcuuuuuugag

SEQ ID NO: 4112971 - RNA, 22 nt, Streptococcus pyogenes M1 GAS
gcgcauguugacuauuuuucgc

SEQ ID NO: 4112972 - RNA, 20 nt, Streptococcus pyogenes M1 GAS
gcgccguuuuucaaggcugu

SEQ ID NO: 4112973 - RNA, 19 nt, Streptococcus pyogenes M1 GAS
gcggaagaacagcauuuuc

SEQ ID NO: 4112974 - RNA, 16 nt, Streptococcus pyogenes M1 GAS
gcggcacguuauucuc

SEQ ID NO: 4112975 - RNA, 21 nt, Streptococcus pyogenes M1 GAS
gcguauaggugaguuuuuucu

SEQ ID NO: 4112976 - RNA, 16 nt, Streptococcus pyogenes M1 GAS
gcgucuggcaauaagu

SEQ ID NO: 4112977 - RNA, 12 nt, Streptococcus pyogenes M1 GAS
gcguuagcuuuu

SEQ ID NO: 4112978 - RNA, 15 nt, Streptococcus pyogenes M1 GAS
gcguuucgaaaaagg

SEQ ID NO: 4112979 - RNA, 13 nt, Streptococcus pyogenes M1 GAS
gcuaaaaagagag

SEQ ID NO: 4112980 - RNA, 16 nt, Streptococcus pyogenes M1 GAS
gcuaaaagcauaaaaa

SEQ ID NO: 4112981 - RNA, 18 nt, Streptococcus pyogenes M1 GAS
gcuaacugauaaaacuca

SEQ ID NO: 4112982 - RNA, 14 nt, Streptococcus pyogenes M1 GAS
gcuaaucuaggacu

SEQ ID NO: 4112983 - RNA, 13 nt, Streptococcus pyogenes M1 GAS
gcuaaugucuugg

SEQ ID NO: 4112984 - RNA, 21 nt, Streptococcus pyogenes M1 GAS
gcuacauugggccccauggcg

SEQ ID NO: 4112985 - RNA, 14 nt, Streptococcus pyogenes M1 GAS
gcuagacuauaaaa

SEQ ID NO: 4112986 - RNA, 14 nt, Streptococcus pyogenes M1 GAS
gcuagauugcuucc

SEQ ID NO: 4112987 - RNA, 18 nt, Streptococcus pyogenes M1 GAS
gcuagggcaacugcaaua

SEQ ID NO: 4112988 - RNA, 23 nt, Streptococcus pyogenes M1 GAS
gcuaguaaguuuuuuuguaauug

SEQ ID NO: 4112989 - RNA, 18 nt, Streptococcus pyogenes M1 GAS
gcuaucaaagcugacagu

SEQ ID NO: 4112990 - RNA, 18 nt, Streptococcus pyogenes M1 GAS
gcuaugcgaggcuuuuuu

SEQ ID NO: 4112991 - RNA, 23 nt, Streptococcus pyogenes M1 GAS
gcuauuauccaacuuuuaucacu

SEQ ID NO: 4112992 - RNA, 20 nt, Streptococcus pyogenes M1 GAS
gcucaacuggcacaaacucu

SEQ ID NO: 4112993 - RNA, 16 nt, Streptococcus pyogenes M1 GAS
gcuccaacgaccucca

SEQ ID NO: 4112994 - RNA, 17 nt, Streptococcus pyogenes M1 GAS
gcucggugcugacuggu

SEQ ID NO: 4112995 - RNA, 17 nt, Streptococcus pyogenes M1 GAS
gcucuaauuuagucauu

SEQ ID NO: 4112996 - RNA, 20 nt, Streptococcus pyogenes M1 GAS
gcucuaauuuagucauuucu

SEQ ID NO: 4112997 - RNA, 13 nt, Streptococcus pyogenes M1 GAS
gcucuuuaucacc

SEQ ID NO: 4112998 - RNA, 15 nt, Streptococcus pyogenes M1 GAS
gcucuuuaucaccug

SEQ ID NO: 4112999 - RNA, 23 nt, Streptococcus pyogenes M1 GAS
gcugaugacuuguaaaaugauac

SEQ ID NO: 4113000 - RNA, 16 nt, Streptococcus pyogenes M1 GAS
gcugcuaaagcaauca

SEQ ID NO: 4113001 - RNA, 13 nt, Streptococcus pyogenes M1 GAS
gcuguuggauaca

SEQ ID NO: 4113002 - RNA, 14 nt, Streptococcus pyogenes M1 GAS
gcuuccaacuccug

SEQ ID NO: 4113003 - RNA, 13 nt, Streptococcus pyogenes M1 GAS
gcuucuuucaaac

SEQ ID NO: 4113004 - RNA, 18 nt, Streptococcus pyogenes M1 GAS
gcuugaucuuacaaagga

SEQ ID NO: 4113005 - RNA, 15 nt, Streptococcus pyogenes M1 GAS
gcuugcuaagagaau

SEQ ID NO: 4113006 - RNA, 16 nt, Streptococcus pyogenes M1 GAS
gcuugcucaauuuuug

SEQ ID NO: 4113007 - RNA, 21 nt, Streptococcus pyogenes M1 GAS
gcuugcuuuuuucuaaccucu

SEQ ID NO: 4113008 - RNA, 18 nt, Streptococcus pyogenes M1 GAS
gcuuggauuuccucuaac

SEQ ID NO: 4113009 - RNA, 17 nt, Streptococcus pyogenes M1 GAS
gcuuguagauaccuaca

SEQ ID NO: 4113010 - RNA, 22 nt, Streptococcus pyogenes M1 GAS
gcuugucuuuuuuuggccucaa

SEQ ID NO: 4113011 - RNA, 18 nt, Streptococcus pyogenes M1 GAS
gcuuucuacuaaaaaagg

SEQ ID NO: 4113012 - RNA, 22 nt, Streptococcus pyogenes M1 GAS
gcuuugacaaagcagugcuuua

SEQ ID NO: 4113013 - RNA, 18 nt, Streptococcus pyogenes M1 GAS
gcuuugauuuuucuuguu

SEQ ID NO: 4113014 - RNA, 14 nt, Streptococcus pyogenes M1 GAS
gcuuuuaagcugag

SEQ ID NO: 4113015 - RNA, 13 nt, Streptococcus pyogenes M1 GAS
guauuuuuuucua

SEQ ID NO: 4113016 - RNA, 19 nt, Streptococcus pyogenes M1 GAS
gucaaaaaguaaaaagcaa

SEQ ID NO: 4113017 - RNA, 20 nt, Streptococcus pyogenes M1 GAS
gucaauuuagccguccuuaa

SEQ ID NO: 4113018 - RNA, 19 nt, Streptococcus pyogenes M1 GAS
gucacgaucaagaaacuca

SEQ ID NO: 4113019 - RNA, 22 nt, Streptococcus pyogenes M1 GAS
gucagacuuaauugaaagaggu

SEQ ID NO: 4113020 - RNA, 23 nt, Streptococcus pyogenes M1 GAS
gucaggggaauuuccuaauguaa

SEQ ID NO: 4113021 - RNA, 20 nt, Streptococcus pyogenes M1 GAS
gucauacucaauagcugcug

SEQ ID NO: 4113022 - RNA, 22 nt, Streptococcus pyogenes M1 GAS
gucaucaaaagaccauaaaaaa

SEQ ID NO: 4113023 - RNA, 21 nt, Streptococcus pyogenes M1 GAS
gucaugugcuaucauggaguc

SEQ ID NO: 4113024 - RNA, 21 nt, Streptococcus pyogenes M1 GAS
gucauuucuucagguuucuuu

SEQ ID NO: 4113025 - RNA, 17 nt, Streptococcus pyogenes M1 GAS
guccaucauugaugaga

SEQ ID NO: 4113026 - RNA, 19 nt, Streptococcus pyogenes M1 GAS
gucccagcagcaaaggcga

SEQ ID NO: 4113027 - RNA, 13 nt, Streptococcus pyogenes M1 GAS
guccgaaaaaaac

SEQ ID NO: 4113028 - RNA, 21 nt, Streptococcus pyogenes M1 GAS
guccgagaaagauucuugcuu

SEQ ID NO: 4113029 - RNA, 17 nt, Streptococcus pyogenes M1 GAS
guccuaaccuuuuggcu

SEQ ID NO: 4113030 - RNA, 17 nt, Streptococcus pyogenes M1 GAS
guccuuaaaagaaaauc

SEQ ID NO: 4113031 - RNA, 18 nt, Streptococcus pyogenes M1 GAS
guccuuaaaagaaaaucu

SEQ ID NO: 4113032 - RNA, 21 nt, Streptococcus pyogenes M1 GAS
gucggcaauacagugaauaau

SEQ ID NO: 4113033 - RNA, 21 nt, Streptococcus pyogenes M1 GAS
gucguuuuuugcuuuugauac

SEQ ID NO: 4113034 - RNA, 14 nt, Streptococcus pyogenes M1 GAS
gucuaccgcuagga

SEQ ID NO: 4113035 - RNA, 18 nt, Streptococcus pyogenes M1 GAS
gucuaucugcagauuuua

SEQ ID NO: 4113036 - RNA, 12 nt, Streptococcus pyogenes M1 GAS
gucucuuuugug

SEQ ID NO: 4113037 - RNA, 23 nt, Streptococcus pyogenes M1 GAS
gucugauauugaucucugcaaca

SEQ ID NO: 4113038 - RNA, 17 nt, Streptococcus pyogenes M1 GAS
gucugcaaguucuuugc

SEQ ID NO: 4113039 - RNA, 17 nt, Streptococcus pyogenes M1 GAS
gucugcaugaagugguu

SEQ ID NO: 4113040 - RNA, 18 nt, Streptococcus pyogenes M1 GAS
gucugcgcgacuaaaauc

SEQ ID NO: 4113041 - RNA, 11 nt, Streptococcus pyogenes M1 GAS
gucugcugcua

SEQ ID NO: 4113042 - RNA, 21 nt, Streptococcus pyogenes M1 GAS
gucuuaguuuugcacugcuau

SEQ ID NO: 4113043 - RNA, 13 nt, Streptococcus pyogenes M1 GAS
gucuucuuuuuau

SEQ ID NO: 4113044 - RNA, 16 nt, Streptococcus pyogenes M1 GAS
gucuugauaacaauau

SEQ ID NO: 4113045 - RNA, 18 nt, Streptococcus pyogenes M1 GAS
gucuugcuaaaauuucug

SEQ ID NO: 4113046 - RNA, 21 nt, Streptococcus pyogenes M1 GAS
gucuugcucuuguuuucucaa

SEQ ID NO: 4113047 - RNA, 16 nt, Streptococcus pyogenes M1 GAS
gucuuuauccauucuu

SEQ ID NO: 4113048 - RNA, 18 nt, Streptococcus pyogenes M1 GAS
gucuuuucuuuuuggcug

SEQ ID NO: 4113049 - RNA, 21 nt, Streptococcus pyogenes M1 GAS
gugaacaccccccgcuuuuaa

SEQ ID NO: 4113050 - RNA, 18 nt, Streptococcus pyogenes M1 GAS
gugacuagauucccagag

SEQ ID NO: 4113051 - RNA, 18 nt, Streptococcus pyogenes M1 GAS
gugagaaacuaaaggcaa

SEQ ID NO: 4113052 - RNA, 17 nt, Streptococcus pyogenes M1 GAS
gugaggacuuauuuuuu

SEQ ID NO: 4113053 - RNA, 21 nt, Streptococcus pyogenes M1 GAS
gugaggacuuauuuuuuuaag

SEQ ID NO: 4113054 - RNA, 17 nt, Streptococcus pyogenes M1 GAS
gugauggucuugcucuu

SEQ ID NO: 4113055 - RNA, 14 nt, Streptococcus pyogenes M1 GAS
gugcaaggcuaaga

SEQ ID NO: 4113056 - RNA, 16 nt, Streptococcus pyogenes M1 GAS
gugcaccgacauacaa

SEQ ID NO: 4113057 - RNA, 18 nt, Streptococcus pyogenes M1 GAS
gugcagugggcuuuuuug

SEQ ID NO: 4113058 - RNA, 20 nt, Streptococcus pyogenes M1 GAS
gugccaguaaggaaaucaau

SEQ ID NO: 4113059 - RNA, 21 nt, Streptococcus pyogenes M1 GAS
guggauacaagguuaaguaaa

SEQ ID NO: 4113060 - RNA, 16 nt, Streptococcus pyogenes M1 GAS
gugggauauuuagaug

SEQ ID NO: 4113061 - RNA, 18 nt, Streptococcus pyogenes M1 GAS
gugggcuuuuuuguguuc

SEQ ID NO: 4113062 - RNA, 20 nt, Streptococcus pyogenes M1 GAS
guggguuucguugacaacaa

SEQ ID NO: 4113063 - RNA, 18 nt, Streptococcus pyogenes M1 GAS
guguacucaucuaaaaaa

SEQ ID NO: 4113064 - RNA, 17 nt, Streptococcus pyogenes M1 GAS
gugucuuuucuuuuugg

SEQ ID NO: 4113065 - RNA, 21 nt, Streptococcus pyogenes M1 GAS
gugucuuuucuuuuuggcuga

SEQ ID NO: 4113066 - RNA, 16 nt, Streptococcus pyogenes M1 GAS
guguugucaaacauaa

SEQ ID NO: 4113067 - RNA, 14 nt, Streptococcus pyogenes M1 GAS
guuaaaauagaaga

SEQ ID NO: 4113068 - RNA, 17 nt, Streptococcus pyogenes M1 GAS
guuaacugguaaaguau

SEQ ID NO: 4113069 - RNA, 15 nt, Streptococcus pyogenes M1 GAS
guuaagcuugcuaag

SEQ ID NO: 4113070 - RNA, 17 nt, Streptococcus pyogenes M1 GAS
guuaagcuugcuaagag

SEQ ID NO: 4113071 - RNA, 15 nt, Streptococcus pyogenes M1 GAS
guuaaguaaaaggga

SEQ ID NO: 4113072 - RNA, 22 nt, Streptococcus pyogenes M1 GAS
guuaauauagucugcaugaagu

SEQ ID NO: 4113073 - RNA, 13 nt, Streptococcus pyogenes M1 GAS
guuaccagauaaa

SEQ ID NO: 4113074 - RNA, 22 nt, Streptococcus pyogenes M1 GAS
guuaguuuuauccccuauucaa

SEQ ID NO: 4113075 - RNA, 17 nt, Streptococcus pyogenes M1 GAS
guuauagcuccuaaaac

SEQ ID NO: 4113076 - RNA, 14 nt, Streptococcus pyogenes M1 GAS
guuauuaaagacaa

SEQ ID NO: 4113077 - RNA, 16 nt, Streptococcus pyogenes M1 GAS
guucaauacucccuuc

SEQ ID NO: 4113078 - RNA, 19 nt, Streptococcus pyogenes M1 GAS
guucaauggauauaacaac

SEQ ID NO: 4113079 - RNA, 17 nt, Streptococcus pyogenes M1 GAS
guucacuuuguuaccag

SEQ ID NO: 4113080 - RNA, 16 nt, Streptococcus pyogenes M1 GAS
guucagauauucuuug

SEQ ID NO: 4113081 - RNA, 17 nt, Streptococcus pyogenes M1 GAS
guucagcagcacuggcu

SEQ ID NO: 4113082 - RNA, 16 nt, Streptococcus pyogenes M1 GAS
guucauauaagcaauc

SEQ ID NO: 4113083 - RNA, 19 nt, Streptococcus pyogenes M1 GAS
guucauuuagugguauaga

SEQ ID NO: 4113084 - RNA, 21 nt, Streptococcus pyogenes M1 GAS
guucuaguuuaggauauaaga

SEQ ID NO: 4113085 - RNA, 14 nt, Streptococcus pyogenes M1 GAS
guucugaaaauaaa

SEQ ID NO: 4113086 - RNA, 21 nt, Streptococcus pyogenes M1 GAS
guucugaaaauaaaauauuuu

SEQ ID NO: 4113087 - RNA, 23 nt, Streptococcus pyogenes M1 GAS
guucuguuucuaagcaaauagca

SEQ ID NO: 4113088 - RNA, 18 nt, Streptococcus pyogenes M1 GAS
guucuuaaaagaaaaucu

SEQ ID NO: 4113089 - RNA, 13 nt, Streptococcus pyogenes M1 GAS
guugaaugaguua

SEQ ID NO: 4113090 - RNA, 14 nt, Streptococcus pyogenes M1 GAS
guugacaacaauau

SEQ ID NO: 4113091 - RNA, 18 nt, Streptococcus pyogenes M1 GAS
guugacaguuaaaaauaa

SEQ ID NO: 4113092 - RNA, 16 nt, Streptococcus pyogenes M1 GAS
guugacuuugcaaaag

SEQ ID NO: 4113093 - RNA, 13 nt, Streptococcus pyogenes M1 GAS
guugcaauaaucg

SEQ ID NO: 4113094 - RNA, 17 nt, Streptococcus pyogenes M1 GAS
guugcagaguacaaggc

SEQ ID NO: 4113095 - RNA, 23 nt, Streptococcus pyogenes M1 GAS
guuggaggucugugaugaaucau

SEQ ID NO: 4113096 - RNA, 13 nt, Streptococcus pyogenes M1 GAS
guuguaaaaaggu

SEQ ID NO: 4113097 - RNA, 20 nt, Streptococcus pyogenes M1 GAS
guuuaggaaucacaacuucu

SEQ ID NO: 4113098 - RNA, 18 nt, Streptococcus pyogenes M1 GAS
guuuauguaugcugucca

SEQ ID NO: 4113099 - RNA, 12 nt, Streptococcus pyogenes M1 GAS
guuuauuuaguu

SEQ ID NO: 4113100 - RNA, 20 nt, Streptococcus pyogenes M1 GAS
guuuauuuauaauuucuuuc

SEQ ID NO: 4113101 - RNA, 23 nt, Streptococcus pyogenes M1 GAS
guuuauuuguugaagugucuuga

SEQ ID NO: 4113102 - RNA, 16 nt, Streptococcus pyogenes M1 GAS
guuucauagaagacgg

SEQ ID NO: 4113103 - RNA, 16 nt, Streptococcus pyogenes M1 GAS
guuucccauguuuuau

SEQ ID NO: 4113104 - RNA, 13 nt, Streptococcus pyogenes M1 GAS
guuucgaaaaagg

SEQ ID NO: 4113105 - RNA, 20 nt, Streptococcus pyogenes M1 GAS
guuucggaaaacuuuugacu

SEQ ID NO: 4113106 - RNA, 16 nt, Streptococcus pyogenes M1 GAS
guuugauugauuuguc

SEQ ID NO: 4113107 - RNA, 22 nt, Streptococcus pyogenes M1 GAS
guuuuagcgucugcauguccua

SEQ ID NO: 4113108 - RNA, 18 nt, Streptococcus pyogenes M1 GAS
guuuucucaacaguauaa

SEQ ID NO: 4113109 - RNA, 18 nt, Streptococcus pyogenes M1 GAS
guuuucucagagacaaua

SEQ ID NO: 4113110 - RNA, 11 nt, Streptococcus pyogenes M1 GAS
guuuucuuuag

SEQ ID NO: 4113111 - RNA, 14 nt, Streptococcus pyogenes M1 GAS
guuuugauaaaaaa

SEQ ID NO: 4113112 - RNA, 13 nt, Streptococcus pyogenes M1 GAS
guuuugcaauuaa

SEQ ID NO: 4113113 - RNA, 13 nt, Streptococcus pyogenes M1 GAS
guuuugguugaua

SEQ ID NO: 4113114 - RNA, 15 nt, Streptococcus pyogenes M1 GAS
guuuuuugucuucuu

SEQ ID NO: 4113115 - RNA, 13 nt, Streptococcus pyogenes M1 GAS
uaaggauuuagcu

SEQ ID NO: 4113116 - RNA, 17 nt, Streptococcus pyogenes M1 GAS
uaaggcucgacaaaggc

SEQ ID NO: 4113117 - RNA, 14 nt, Streptococcus pyogenes M1 GAS
uaaggguuaacaau

SEQ ID NO: 4113118 - RNA, 14 nt, Streptococcus pyogenes M1 GAS
uaaguaauguguug

SEQ ID NO: 4113119 - RNA, 18 nt, Streptococcus pyogenes M1 GAS
uaaguaauguguuguaua

SEQ ID NO: 4113120 - RNA, 17 nt, Streptococcus pyogenes M1 GAS
uaaguauucuaaaaucc

SEQ ID NO: 4113121 - RNA, 18 nt, Streptococcus pyogenes M1 GAS
uaaguccuuuuaguuuua

SEQ ID NO: 4113122 - RNA, 18 nt, Streptococcus pyogenes M1 GAS
uaaguccuuuucguuuua

SEQ ID NO: 4113123 - RNA, 20 nt, Streptococcus pyogenes M1 GAS
uaaguugaaugaguuagucu

SEQ ID NO: 4113124 - RNA, 17 nt, Streptococcus pyogenes M1 GAS
uaaguuuuuaucauauu

SEQ ID NO: 4113125 - RNA, 15 nt, Streptococcus pyogenes M1 GAS
uaauaacaaaaugaa

SEQ ID NO: 4113126 - RNA, 12 nt, Streptococcus pyogenes M1 GAS
uaauaagauuca

SEQ ID NO: 4113127 - RNA, 19 nt, Streptococcus pyogenes M1 GAS
uaauaagauucaauaugaa

SEQ ID NO: 4113128 - RNA, 20 nt, Streptococcus pyogenes M1 GAS
uaauaagauucaauaugaaa

SEQ ID NO: 4113129 - RNA, 20 nt, Streptococcus pyogenes M1 GAS
uaauaaguauucuaaaaucc

SEQ ID NO: 4113130 - RNA, 19 nt, Streptococcus pyogenes M1 GAS
uaauacguuuauuuaguua

SEQ ID NO: 4113131 - RNA, 13 nt, Streptococcus pyogenes M1 GAS
uaauagaauaaaa

SEQ ID NO: 4113132 - RNA, 16 nt, Streptococcus pyogenes M1 GAS
uaauauguaacgcuug

SEQ ID NO: 4113133 - RNA, 13 nt, Streptococcus pyogenes M1 GAS
uaaucaaaaaacu

SEQ ID NO: 4113134 - RNA, 14 nt, Streptococcus pyogenes M1 GAS
uaaucaaaaaacug

SEQ ID NO: 4113135 - RNA, 20 nt, Streptococcus pyogenes M1 GAS
uaaucaaaaaacugagacaa

SEQ ID NO: 4113136 - RNA, 18 nt, Streptococcus pyogenes M1 GAS
uaaucgagagauuauucu

SEQ ID NO: 4113137 - RNA, 15 nt, Streptococcus pyogenes M1 GAS
uaaucuaaagcauca

SEQ ID NO: 4113138 - RNA, 23 nt, Streptococcus pyogenes M1 GAS
uaaucuucagagcacguuuucug

SEQ ID NO: 4113139 - RNA, 18 nt, Streptococcus pyogenes M1 GAS
uaaucuuugacaauguca

SEQ ID NO: 4113140 - RNA, 15 nt, Streptococcus pyogenes M1 GAS
uaaugauaaggcugc

SEQ ID NO: 4113141 - RNA, 15 nt, Streptococcus pyogenes M1 GAS
uaaugccaucaaaaa

SEQ ID NO: 4113142 - RNA, 17 nt, Streptococcus pyogenes M1 GAS
uaaugccaucaaaaaaa

SEQ ID NO: 4113143 - RNA, 22 nt, Streptococcus pyogenes M1 GAS
uaauggugucgcuuuuuuuauu

SEQ ID NO: 4113144 - RNA, 22 nt, Streptococcus pyogenes M1 GAS
uaaugguuuuuuugucuucuuc

SEQ ID NO: 4113145 - RNA, 24 nt, Streptococcus pyogenes M1 GAS
uaauguuguuuuuggaucgcugug

SEQ ID NO: 4113146 - RNA, 11 nt, Streptococcus pyogenes M1 GAS
uaauuagcaua

SEQ ID NO: 4113147 - RNA, 17 nt, Streptococcus pyogenes M1 GAS
uaauuaucugaauuauu

SEQ ID NO: 4113148 - RNA, 19 nt, Streptococcus pyogenes M1 GAS
uaauuauuuuaauuuuucc

SEQ ID NO: 4113149 - RNA, 23 nt, Streptococcus pyogenes M1 GAS
uaauuauuuuaauuuuuccuuaa

SEQ ID NO: 4113150 - RNA, 22 nt, Streptococcus pyogenes M1 GAS
uaauuguugcaaccugaaaagu

SEQ ID NO: 4113151 - RNA, 19 nt, Streptococcus pyogenes M1 GAS
uaauuuagucauuucuuca

SEQ ID NO: 4113152 - RNA, 16 nt, Streptococcus pyogenes M1 GAS
uaauuuuauuuuuuaa

SEQ ID NO: 4113153 - RNA, 11 nt, Streptococcus pyogenes M1 GAS
uacaaaaaaca

SEQ ID NO: 4113154 - RNA, 12 nt, Streptococcus pyogenes M1 GAS
uacaaaaaacaa

SEQ ID NO: 4113155 - RNA, 13 nt, Streptococcus pyogenes M1 GAS
uacaaaauaaccc

SEQ ID NO: 4113156 - RNA, 19 nt, Streptococcus pyogenes M1 GAS
uacaaaggauaugaggguc

SEQ ID NO: 4113157 - RNA, 18 nt, Streptococcus pyogenes M1 GAS
uacaacugacuagccaaa

SEQ ID NO: 4113158 - RNA, 17 nt, Streptococcus pyogenes M1 GAS
uacaagcguuguagccu

SEQ ID NO: 4113159 - RNA, 21 nt, Streptococcus pyogenes M1 GAS
uacaagguuaaguaaaaggga

SEQ ID NO: 4113160 - RNA, 17 nt, Streptococcus pyogenes M1 GAS
uacacuugauuucauuu

SEQ ID NO: 4113161 - RNA, 16 nt, Streptococcus pyogenes M1 GAS
uacagaaaugaaaaga

SEQ ID NO: 4113162 - RNA, 22 nt, Streptococcus pyogenes M1 GAS
uacagcugguuuuuuaauuauu

SEQ ID NO: 4113163 - RNA, 16 nt, Streptococcus pyogenes M1 GAS
uacaguugacaauaag

SEQ ID NO: 4113164 - RNA, 19 nt, Streptococcus pyogenes M1 GAS
uacauaaaaugacuucaaa

SEQ ID NO: 4113165 - RNA, 14 nt, Streptococcus pyogenes M1 GAS
uacaucaaaaaaag

SEQ ID NO: 4113166 - RNA, 15 nt, Streptococcus pyogenes M1 GAS
uacaucaaaaaaagc

SEQ ID NO: 4113167 - RNA, 19 nt, Streptococcus pyogenes M1 GAS
uacaucaaaaaaagcaaug

SEQ ID NO: 4113168 - RNA, 22 nt, Streptococcus pyogenes M1 GAS
uacaugaccuuccccaucaaga

SEQ ID NO: 4113169 - RNA, 19 nt, Streptococcus pyogenes M1 GAS
uacauugaauaaagugaua

SEQ ID NO: 4113170 - RNA, 21 nt, Streptococcus pyogenes M1 GAS
uacauugagaauuuuuauaac

SEQ ID NO: 4113171 - RNA, 15 nt, Streptococcus pyogenes M1 GAS
uaccaaaucaaaaag

SEQ ID NO: 4113172 - RNA, 16 nt, Streptococcus pyogenes M1 GAS
uaccaaaucaaaaagc

SEQ ID NO: 4113173 - RNA, 17 nt, Streptococcus pyogenes M1 GAS
uaccaaaucaaaaagcu

SEQ ID NO: 4113174 - RNA, 15 nt, Streptococcus pyogenes M1 GAS
uaccagauaaauagu

SEQ ID NO: 4113175 - RNA, 14 nt, Streptococcus pyogenes M1 GAS
uaccagcaccuucu

SEQ ID NO: 4113176 - RNA, 17 nt, Streptococcus pyogenes M1 GAS
uaccagcaccuucuuuu

SEQ ID NO: 4113177 - RNA, 14 nt, Streptococcus pyogenes M1 GAS
uaccauuucuuugc

SEQ ID NO: 4113178 - RNA, 20 nt, Streptococcus pyogenes M1 GAS
uaccauuucuuugcaaaaga

SEQ ID NO: 4113179 - RNA, 17 nt, Streptococcus pyogenes M1 GAS
uaccauuuuuaucugua

SEQ ID NO: 4113180 - RNA, 21 nt, Streptococcus pyogenes M1 GAS
uaccguuaguauuagcaccag

SEQ ID NO: 4113181 - RNA, 21 nt, Streptococcus pyogenes M1 GAS
uaccuauagaaaguuauaaag

SEQ ID NO: 4113182 - RNA, 19 nt, Streptococcus pyogenes M1 GAS
uacggcuucuacacaaaag

SEQ ID NO: 4113183 - RNA, 23 nt, Streptococcus pyogenes M1 GAS
uacgguaaaaacucaaaaaauac

SEQ ID NO: 4113184 - RNA, 13 nt, Streptococcus pyogenes M1 GAS
uacuaacaacaac

SEQ ID NO: 4113185 - RNA, 10 nt, Streptococcus pyogenes M1 GAS
uacuaacuau

SEQ ID NO: 4113186 - RNA, 19 nt, Streptococcus pyogenes M1 GAS
uacuaacuauuuuuaccuu

SEQ ID NO: 4113187 - RNA, 20 nt, Streptococcus pyogenes M1 GAS
uacuaacuauuuuuaccuuu

SEQ ID NO: 4113188 - RNA, 14 nt, Streptococcus pyogenes M1 GAS
uacuagaaaaagca

SEQ ID NO: 4113189 - RNA, 16 nt, Streptococcus pyogenes M1 GAS
uacuagaaaaagcaau

SEQ ID NO: 4113190 - RNA, 19 nt, Streptococcus pyogenes M1 GAS
uacuagaaaaagcaaugau

SEQ ID NO: 4113191 - RNA, 18 nt, Streptococcus pyogenes M1 GAS
uacuagcacaaaaucauu

SEQ ID NO: 4113192 - RNA, 13 nt, Streptococcus pyogenes M1 GAS
uacuaugaaaaaa

SEQ ID NO: 4113193 - RNA, 15 nt, Streptococcus pyogenes M1 GAS
uacuaugaaaaaaga

SEQ ID NO: 4113194 - RNA, 17 nt, Streptococcus pyogenes M1 GAS
uacucaauauaauaaaa

SEQ ID NO: 4113195 - RNA, 20 nt, Streptococcus pyogenes M1 GAS
uacucaauauaauaaaaagc

SEQ ID NO: 4113196 - RNA, 17 nt, Streptococcus pyogenes M1 GAS
uacuccguuucuaguuu

SEQ ID NO: 4113197 - RNA, 13 nt, Streptococcus pyogenes M1 GAS
uacugauaaacuu

SEQ ID NO: 4113198 - RNA, 15 nt, Streptococcus pyogenes M1 GAS
uacugauaaacuuga

SEQ ID NO: 4113199 - RNA, 20 nt, Streptococcus pyogenes M1 GAS
uacugggucaacuccaaucu

SEQ ID NO: 4113200 - RNA, 20 nt, Streptococcus pyogenes M1 GAS
uacuguaauauuuccuuuua

SEQ ID NO: 4113201 - RNA, 22 nt, Streptococcus pyogenes M1 GAS
uacuucaaggaaggcuuguucu

SEQ ID NO: 4113202 - RNA, 19 nt, Streptococcus pyogenes M1 GAS
uacuuuauuaaucaaaaaa

SEQ ID NO: 4113203 - RNA, 21 nt, Streptococcus pyogenes M1 GAS
uacuuugguauucuuuuuccg

SEQ ID NO: 4113204 - RNA, 12 nt, Streptococcus pyogenes M1 GAS
uacuuuuaaaau

SEQ ID NO: 4113205 - RNA, 15 nt, Streptococcus pyogenes M1 GAS
uagaaaaagcaauga

SEQ ID NO: 4113206 - RNA, 18 nt, Streptococcus pyogenes M1 GAS
uagaaacuuuuuauaagc

SEQ ID NO: 4113207 - RNA, 15 nt, Streptococcus pyogenes M1 GAS
uagaaaguuauaaag

SEQ ID NO: 4113208 - RNA, 21 nt, Streptococcus pyogenes M1 GAS
uagaagacaaggugaguauaa

SEQ ID NO: 4113209 - RNA, 14 nt, Streptococcus pyogenes M1 GAS
uagaauaaaaagac

SEQ ID NO: 4113210 - RNA, 15 nt, Streptococcus pyogenes M1 GAS
uagaauaaaaagacu

SEQ ID NO: 4113211 - RNA, 23 nt, Streptococcus pyogenes M1 GAS
uagaauucuuagguggagcuuua

SEQ ID NO: 4113212 - RNA, 14 nt, Streptococcus pyogenes M1 GAS
uagacuauaaaagu

SEQ ID NO: 4113213 - RNA, 20 nt, Streptococcus pyogenes M1 GAS
uagagaacagauaagugcca

SEQ ID NO: 4113214 - RNA, 16 nt, Streptococcus pyogenes M1 GAS
uagagauagaucaauu

SEQ ID NO: 4113215 - RNA, 18 nt, Streptococcus pyogenes M1 GAS
uauggcuucuaaaaaagu

SEQ ID NO: 4113216 - RNA, 16 nt, Streptococcus pyogenes M1 GAS
uauguaaauauaaagu

SEQ ID NO: 4113217 - RNA, 17 nt, Streptococcus pyogenes M1 GAS
uaugucuugcuaaaauu

SEQ ID NO: 4113218 - RNA, 12 nt, Streptococcus pyogenes M1 GAS
uauuaaagacaa

SEQ ID NO: 4113219 - RNA, 22 nt, Streptococcus pyogenes M1 GAS
uauuaaccggcucuaaaauaua

SEQ ID NO: 4113220 - RNA, 21 nt, Streptococcus pyogenes M1 GAS
uauuaagauaccaaaucaaaa

SEQ ID NO: 4113221 - RNA, 16 nt, Streptococcus pyogenes M1 GAS
uauuacaaaacugucu

SEQ ID NO: 4113222 - RNA, 15 nt, Streptococcus pyogenes M1 GAS
uauuagcaaaaugcu

SEQ ID NO: 4113223 - RNA, 18 nt, Streptococcus pyogenes M1 GAS
uauuagucuuuaaaaaac

SEQ ID NO: 4113224 - RNA, 19 nt, Streptococcus pyogenes M1 GAS
uauuagucuuuaaaaaacg

SEQ ID NO: 4113225 - RNA, 22 nt, Streptococcus pyogenes M1 GAS
uauuauacucaauauaauaaaa

SEQ ID NO: 4113226 - RNA, 13 nt, Streptococcus pyogenes M1 GAS
uauucauuuucuu

SEQ ID NO: 4113227 - RNA, 11 nt, Streptococcus pyogenes M1 GAS
uauucucugcu

SEQ ID NO: 4113228 - RNA, 16 nt, Streptococcus pyogenes M1 GAS
uauucuuaaaaaaauc

SEQ ID NO: 4113229 - RNA, 22 nt, Streptococcus pyogenes M1 GAS
uauuggccuucuuggaaaacag

SEQ ID NO: 4113230 - RNA, 14 nt, Streptococcus pyogenes M1 GAS
uauugugcuauuca

SEQ ID NO: 4113231 - RNA, 22 nt, Streptococcus pyogenes M1 GAS
uauuguggcgggccuucuauca

SEQ ID NO: 4113232 - RNA, 12 nt, Streptococcus pyogenes M1 GAS
uauuuaauagca

SEQ ID NO: 4113233 - RNA, 15 nt, Streptococcus pyogenes M1 GAS
uauuuacugggucaa

SEQ ID NO: 4113234 - RNA, 22 nt, Streptococcus pyogenes M1 GAS
uauuuacugggucaacuccaau

SEQ ID NO: 4113235 - RNA, 15 nt, Streptococcus pyogenes M1 GAS
uauuuauaauuucuu

SEQ ID NO: 4113236 - RNA, 23 nt, Streptococcus pyogenes M1 GAS
uauuucacuagacauucguucua

SEQ ID NO: 4113237 - RNA, 21 nt, Streptococcus pyogenes M1 GAS
uauuuccuuuuaaagacauca

SEQ ID NO: 4113238 - RNA, 15 nt, Streptococcus pyogenes M1 GAS
uauuucgucuaaaaa

SEQ ID NO: 4113239 - RNA, 17 nt, Streptococcus pyogenes M1 GAS
uauuucgucuaaaaagc

SEQ ID NO: 4113240 - RNA, 18 nt, Streptococcus pyogenes M1 GAS
uauuucgucuaaaaagcc

SEQ ID NO: 4113241 - RNA, 17 nt, Streptococcus pyogenes M1 GAS
uauuugaaguaaaggau

SEQ ID NO: 4113242 - RNA, 23 nt, Streptococcus pyogenes M1 GAS
uauuugacuuguuacaaaaaaca

SEQ ID NO: 4113243 - RNA, 13 nt, Streptococcus pyogenes M1 GAS
uauuuuaaaauag

SEQ ID NO: 4113244 - RNA, 17 nt, Streptococcus pyogenes M1 GAS
uauuuuaaguaaaggau

SEQ ID NO: 4113245 - RNA, 15 nt, Streptococcus pyogenes M1 GAS
uauuuugauauuuuu

SEQ ID NO: 4113246 - RNA, 13 nt, Streptococcus pyogenes M1 GAS
uauuuugcuucua

SEQ ID NO: 4113247 - RNA, 16 nt, Streptococcus pyogenes M1 GAS
uauuuuuuaaagcuac

SEQ ID NO: 4113248 - RNA, 11 nt, Streptococcus pyogenes M1 GAS
uauuuuuuagu

SEQ ID NO: 4113249 - RNA, 21 nt, Streptococcus pyogenes M1 GAS
uauuuuuucucaaaaauauau

SEQ ID NO: 4113250 - RNA, 12 nt, Streptococcus pyogenes M1 GAS
uauuuuuuucua

SEQ ID NO: 4113251 - RNA, 16 nt, Streptococcus pyogenes M1 GAS
ucaaaaaaacuucaca

SEQ ID NO: 4113252 - RNA, 17 nt, Streptococcus pyogenes M1 GAS
ucaaaaaaagacacaca

SEQ ID NO: 4113253 - RNA, 13 nt, Streptococcus pyogenes M1 GAS
ucaaaaaagggaa

SEQ ID NO: 4113254 - RNA, 19 nt, Streptococcus pyogenes M1 GAS
ucaaaaaauuaagaaggaa

SEQ ID NO: 4113255 - RNA, 23 nt, Streptococcus pyogenes M1 GAS
ucaaaaagaggauuuauggaacu

SEQ ID NO: 4113256 - RNA, 15 nt, Streptococcus pyogenes M1 GAS
ucaaaaauauauucu

SEQ ID NO: 4113257 - RNA, 20 nt, Streptococcus pyogenes M1 GAS
ucaaaagaccauaaaaaacc

SEQ ID NO: 4113258 - RNA, 22 nt, Streptococcus pyogenes M1 GAS
ucaaauaaaaucguuauuaauu

SEQ ID NO: 4113259 - RNA, 15 nt, Streptococcus pyogenes M1 GAS
ucaacaaauccuuuu

SEQ ID NO: 4113260 - RNA, 23 nt, Streptococcus pyogenes M1 GAS
ucaacaguauaacuguuuuucuu

SEQ ID NO: 4113261 - RNA, 21 nt, Streptococcus pyogenes M1 GAS
ucaacaguugcuugcuuuuuu

SEQ ID NO: 4113262 - RNA, 17 nt, Streptococcus pyogenes M1 GAS
ucaaccgcuuccuuugc

SEQ ID NO: 4113263 - RNA, 18 nt, Streptococcus pyogenes M1 GAS
ucaacuggcacaaacucu

SEQ ID NO: 4113264 - RNA, 12 nt, Streptococcus pyogenes M1 GAS
ucaagaaacuca

SEQ ID NO: 4113265 - RNA, 23 nt, Streptococcus pyogenes M1 GAS
ucaagaaacucaucuggguagag

SEQ ID NO: 4113266 - RNA, 19 nt, Streptococcus pyogenes M1 GAS
ucaagagucauuugacuac

SEQ ID NO: 4113267 - RNA, 23 nt, Streptococcus pyogenes M1 GAS
ucaaggaauugcagcuaaaaaca

SEQ ID NO: 4113268 - RNA, 15 nt, Streptococcus pyogenes M1 GAS
ucaagguugcaagug

SEQ ID NO: 4113269 - RNA, 20 nt, Streptococcus pyogenes M1 GAS
ucaauaacagaaauuaauaa

SEQ ID NO: 4113270 - RNA, 13 nt, Streptococcus pyogenes M1 GAS
ucaauagcugcug

SEQ ID NO: 4113271 - RNA, 17 nt, Streptococcus pyogenes M1 GAS
ucaauauaauaaaaagc

SEQ ID NO: 4113272 - RNA, 21 nt, Streptococcus pyogenes M1 GAS
ucaauauuuuauuaauaagua

SEQ ID NO: 4113273 - RNA, 22 nt, Streptococcus pyogenes M1 GAS
ucaauauuuuauuaauaaguau

SEQ ID NO: 4113274 - RNA, 14 nt, Streptococcus pyogenes M1 GAS
ucaaugaaaaguua

SEQ ID NO: 4113275 - RNA, 20 nt, Streptococcus pyogenes M1 GAS
ucaaugauagcuuucaauug

SEQ ID NO: 4113276 - RNA, 20 nt, Streptococcus pyogenes M1 GAS
ucaauggaaauuuuaaauga

SEQ ID NO: 4113277 - RNA, 16 nt, Streptococcus pyogenes M1 GAS
ucaauguuuugcucga

SEQ ID NO: 4113278 - RNA, 20 nt, Streptococcus pyogenes M1 GAS
ucaauuauuucgucuaaaaa

SEQ ID NO: 4113279 - RNA, 19 nt, Streptococcus pyogenes M1 GAS
ucaauuuagccguccuuaa

SEQ ID NO: 4113280 - RNA, 18 nt, Streptococcus pyogenes M1 GAS
ucaauuuuguugaguguu

SEQ ID NO: 4113281 - RNA, 14 nt, Streptococcus pyogenes M1 GAS
ucaauuuuugauuu

SEQ ID NO: 4113282 - RNA, 20 nt, Streptococcus pyogenes M1 GAS
ucaauuuuugauuuuaauuu

SEQ ID NO: 4113283 - RNA, 14 nt, Streptococcus pyogenes M1 GAS
ucacaacuucuaua

SEQ ID NO: 4113284 - RNA, 16 nt, Streptococcus pyogenes M1 GAS
ucacauuguauuagca

SEQ ID NO: 4113285 - RNA, 19 nt, Streptococcus pyogenes M1 GAS
ucaccuuaggcagacaauu

SEQ ID NO: 4113286 - RNA, 21 nt, Streptococcus pyogenes M1 GAS
ucaccuuaggcagacaauuau

SEQ ID NO: 4113287 - RNA, 17 nt, Streptococcus pyogenes M1 GAS
ucaccuucucuuuugcu

SEQ ID NO: 4113288 - RNA, 21 nt, Streptococcus pyogenes M1 GAS
ucaccuugcuuguagauaccu

SEQ ID NO: 4113289 - RNA, 18 nt, Streptococcus pyogenes M1 GAS
ucaccuuucuauauaacu

SEQ ID NO: 4113290 - RNA, 14 nt, Streptococcus pyogenes M1 GAS
ucacgauaagaagc

SEQ ID NO: 4113291 - RNA, 17 nt, Streptococcus pyogenes M1 GAS
ucacguacagaaaugaa

SEQ ID NO: 4113292 - RNA, 15 nt, Streptococcus pyogenes M1 GAS
ucacuauaauuucaa

SEQ ID NO: 4113293 - RNA, 19 nt, Streptococcus pyogenes M1 GAS
ucacuauaauuucaauaau

SEQ ID NO: 4113294 - RNA, 15 nt, Streptococcus pyogenes M1 GAS
ucacucguaaaaaga

SEQ ID NO: 4113295 - RNA, 16 nt, Streptococcus pyogenes M1 GAS
ucacucguaaaaagau

SEQ ID NO: 4113296 - RNA, 17 nt, Streptococcus pyogenes M1 GAS
ucacuuuguuaccagau

SEQ ID NO: 4113297 - RNA, 14 nt, Streptococcus pyogenes M1 GAS
ucagaaagaagaaa

SEQ ID NO: 4113298 - RNA, 20 nt, Streptococcus pyogenes M1 GAS
ucagaagcuuuaucauacuc

SEQ ID NO: 4113299 - RNA, 15 nt, Streptococcus pyogenes M1 GAS
ucagaauaaagaaaa

SEQ ID NO: 4113300 - RNA, 17 nt, Streptococcus pyogenes M1 GAS
ucagaauaaagaaaaag

SEQ ID NO: 4113301 - RNA, 15 nt, Streptococcus pyogenes M1 GAS
ucagaauaagaaaac

SEQ ID NO: 4113302 - RNA, 16 nt, Streptococcus pyogenes M1 GAS
ucagacuuaauugaaa

SEQ ID NO: 4113303 - RNA, 19 nt, Streptococcus pyogenes M1 GAS
ucagagaugcuucuuucaa

SEQ ID NO: 4113304 - RNA, 13 nt, Streptococcus pyogenes M1 GAS
ucagagcuuuuuu

SEQ ID NO: 4113305 - RNA, 19 nt, Streptococcus pyogenes M1 GAS
ucagauaagaccuucaaaa

SEQ ID NO: 4113306 - RNA, 19 nt, Streptococcus pyogenes M1 GAS
ucagaucauuaaauugauu

SEQ ID NO: 4113307 - RNA, 14 nt, Streptococcus pyogenes M1 GAS
ucagcaucugaaaa

SEQ ID NO: 4113308 - RNA, 20 nt, Streptococcus pyogenes M1 GAS
ucagcccccucuuuaccauu

SEQ ID NO: 4113309 - RNA, 21 nt, Streptococcus pyogenes M1 GAS
ucagcucuugcuugucuuuuu

SEQ ID NO: 4113310 - RNA, 14 nt, Streptococcus pyogenes M1 GAS
ucaggcaaaacaaa

SEQ ID NO: 4113311 - RNA, 17 nt, Streptococcus pyogenes M1 GAS
ucaguccuccucuuuag

SEQ ID NO: 4113312 - RNA, 18 nt, Streptococcus pyogenes M1 GAS
ucaguuuuuuugauuuuc

SEQ ID NO: 4113313 - RNA, 21 nt, Streptococcus pyogenes M1 GAS
ucauaaacaaugagucaccug

SEQ ID NO: 4113314 - RNA, 18 nt, Streptococcus pyogenes M1 GAS
ucauaaauucuaacucuu

SEQ ID NO: 4113315 - RNA, 17 nt, Streptococcus pyogenes M1 GAS
ucugauaagguuuuuuu

SEQ ID NO: 4113316 - RNA, 14 nt, Streptococcus pyogenes M1 GAS
ucugauauuucauc

SEQ ID NO: 4113317 - RNA, 20 nt, Streptococcus pyogenes M1 GAS
ucugaugcguuuauaaaguu

SEQ ID NO: 4113318 - RNA, 22 nt, Streptococcus pyogenes M1 GAS
ucugaugcguuuauaaaguuuu

SEQ ID NO: 4113319 - RNA, 13 nt, Streptococcus pyogenes M1 GAS
ucugcaacaucaa

SEQ ID NO: 4113320 - RNA, 15 nt, Streptococcus pyogenes M1 GAS
ucugcauuaucaucu

SEQ ID NO: 4113321 - RNA, 21 nt, Streptococcus pyogenes M1 GAS
ucugcuagacggcuaauaaga

SEQ ID NO: 4113322 - RNA, 20 nt, Streptococcus pyogenes M1 GAS
ucugcuucuuacuaugaaaa

SEQ ID NO: 4113323 - RNA, 15 nt, Streptococcus pyogenes M1 GAS
ucuggagaugagaaa

SEQ ID NO: 4113324 - RNA, 15 nt, Streptococcus pyogenes M1 GAS
ucuggucccacaccu

SEQ ID NO: 4113325 - RNA, 14 nt, Streptococcus pyogenes M1 GAS
ucugguuuaucauu

SEQ ID NO: 4113326 - RNA, 16 nt, Streptococcus pyogenes M1 GAS
ucugguuuuaauauug

SEQ ID NO: 4113327 - RNA, 16 nt, Streptococcus pyogenes M1 GAS
ucuguccaauaccuag

SEQ ID NO: 4113328 - RNA, 16 nt, Streptococcus pyogenes M1 GAS
ucuguuucuaagcaaa

SEQ ID NO: 4113329 - RNA, 21 nt, Streptococcus pyogenes M1 GAS
ucuguuucuaagcaaauagca

SEQ ID NO: 4113330 - RNA, 20 nt, Streptococcus pyogenes M1 GAS
ucuuauagcacguuggaaaa

SEQ ID NO: 4113331 - RNA, 19 nt, Streptococcus pyogenes M1 GAS
ucuucaauuuuugccaaaa

SEQ ID NO: 4113332 - RNA, 14 nt, Streptococcus pyogenes M1 GAS
ucuucagguuucuu

SEQ ID NO: 4113333 - RNA, 12 nt, Streptococcus pyogenes M1 GAS
ucuucaucuguu

SEQ ID NO: 4113334 - RNA, 18 nt, Streptococcus pyogenes M1 GAS
ucuucuaaaaugaugaga

SEQ ID NO: 4113335 - RNA, 14 nt, Streptococcus pyogenes M1 GAS
ucuucuaaacguuu

SEQ ID NO: 4113336 - RNA, 22 nt, Streptococcus pyogenes M1 GAS
ucuucugaugcguuuauaaagu

SEQ ID NO: 4113337 - RNA, 12 nt, Streptococcus pyogenes M1 GAS
ucuucuucuuuu

SEQ ID NO: 4113338 - RNA, 23 nt, Streptococcus pyogenes M1 GAS
ucuucuuuuuauuauacucaaua

SEQ ID NO: 4113339 - RNA, 18 nt, Streptococcus pyogenes M1 GAS
ucuugaggugauucuuuu

SEQ ID NO: 4113340 - RNA, 16 nt, Streptococcus pyogenes M1 GAS
ucuugcagaauagaaa

SEQ ID NO: 4113341 - RNA, 13 nt, Streptococcus pyogenes M1 GAS
ucuugcauuaccu

SEQ ID NO: 4113342 - RNA, 14 nt, Streptococcus pyogenes M1 GAS
ucuugcauuaccuu

SEQ ID NO: 4113343 - RNA, 16 nt, Streptococcus pyogenes M1 GAS
ucuuguagaauuucaa

SEQ ID NO: 4113344 - RNA, 18 nt, Streptococcus pyogenes M1 GAS
ucuuguagaauuucaagu

SEQ ID NO: 4113345 - RNA, 22 nt, Streptococcus pyogenes M1 GAS
ucuuguccgaucuuuuggacca

SEQ ID NO: 4113346 - RNA, 19 nt, Streptococcus pyogenes M1 GAS
ucuugucgcugaauaaaca

SEQ ID NO: 4113347 - RNA, 13 nt, Streptococcus pyogenes M1 GAS
ucuuuauccauuc

SEQ ID NO: 4113348 - RNA, 22 nt, Streptococcus pyogenes M1 GAS
ucuuuauccauucuuuauaaug

SEQ ID NO: 4113349 - RNA, 20 nt, Streptococcus pyogenes M1 GAS
ucuuucauuagcuuuuuuua

SEQ ID NO: 4113350 - RNA, 15 nt, Streptococcus pyogenes M1 GAS
ucuuugacaauguca

SEQ ID NO: 4113351 - RNA, 18 nt, Streptococcus pyogenes M1 GAS
ucuuuggagaaauucaaa

SEQ ID NO: 4113352 - RNA, 21 nt, Streptococcus pyogenes M1 GAS
ucuuugguuugaugaaccuca

SEQ ID NO: 4113353 - RNA, 19 nt, Streptococcus pyogenes M1 GAS
ucuuuguccauuuuuuaua

SEQ ID NO: 4113354 - RNA, 13 nt, Streptococcus pyogenes M1 GAS
ucuuuuaguucag

SEQ ID NO: 4113355 - RNA, 16 nt, Streptococcus pyogenes M1 GAS
ucuuuuggaccacucg

SEQ ID NO: 4113356 - RNA, 13 nt, Streptococcus pyogenes M1 GAS
ucuuuuuuaccuu

SEQ ID NO: 4113357 - RNA, 17 nt, Streptococcus pyogenes M1 GAS
ucuuuuuuacuuuuaaa

SEQ ID NO: 4113358 - RNA, 12 nt, Streptococcus pyogenes M1 GAS
ugaaaaaagaac

SEQ ID NO: 4113359 - RNA, 16 nt, Streptococcus pyogenes M1 GAS
ugaaaaagccuuuaca

SEQ ID NO: 4113360 - RNA, 17 nt, Streptococcus pyogenes M1 GAS
ugaaaacguguauucuu

SEQ ID NO: 4113361 - RNA, 14 nt, Streptococcus pyogenes M1 GAS
ugaaaauaucuuuu

SEQ ID NO: 4113362 - RNA, 17 nt, Streptococcus pyogenes M1 GAS
ugaaacaccugcugcuc

SEQ ID NO: 4113363 - RNA, 18 nt, Streptococcus pyogenes M1 GAS
ugaaacaccugcugcucc

SEQ ID NO: 4113364 - RNA, 16 nt, Streptococcus pyogenes M1 GAS
ugaaaguuccuuagca

SEQ ID NO: 4113365 - RNA, 20 nt, Streptococcus pyogenes M1 GAS
ugaaggacagguagauguug

SEQ ID NO: 4113366 - RNA, 19 nt, Streptococcus pyogenes M1 GAS
ugaauacguaaaaagagaa

SEQ ID NO: 4113367 - RNA, 20 nt, Streptococcus pyogenes M1 GAS
ugaauacguaaaaagagaag

SEQ ID NO: 4113368 - RNA, 14 nt, Streptococcus pyogenes M1 GAS
ugaaucauuuugga

SEQ ID NO: 4113369 - RNA, 15 nt, Streptococcus pyogenes M1 GAS
ugacaaauucuuuuu

SEQ ID NO: 4113370 - RNA, 22 nt, Streptococcus pyogenes M1 GAS
ugacaacaauaugugauuauua

SEQ ID NO: 4113371 - RNA, 23 nt, Streptococcus pyogenes M1 GAS
ugacaagucaggaauuguugacu

SEQ ID NO: 4113372 - RNA, 19 nt, Streptococcus pyogenes M1 GAS
ugacagacaccaaaaaaag

SEQ ID NO: 4113373 - RNA, 20 nt, Streptococcus pyogenes M1 GAS
ugacagacaccaaaaaaagc

SEQ ID NO: 4113374 - RNA, 16 nt, Streptococcus pyogenes M1 GAS
ugacaguuaaaaauaa

SEQ ID NO: 4113375 - RNA, 17 nt, Streptococcus pyogenes M1 GAS
ugacaguuaaaaauaac

SEQ ID NO: 4113376 - RNA, 18 nt, Streptococcus pyogenes M1 GAS
ugacaugaguauaaauuu

SEQ ID NO: 4113377 - RNA, 23 nt, Streptococcus pyogenes M1 GAS
ugacauuucgugucuaaaauaau

SEQ ID NO: 4113378 - RNA, 21 nt, Streptococcus pyogenes M1 GAS
ugaccaaaagaauuauacuaa

SEQ ID NO: 4113379 - RNA, 19 nt, Streptococcus pyogenes M1 GAS
ugaccaauauagcaaucuu

SEQ ID NO: 4113380 - RNA, 20 nt, Streptococcus pyogenes M1 GAS
ugaccacaccuaauaaaaua

SEQ ID NO: 4113381 - RNA, 15 nt, Streptococcus pyogenes M1 GAS
ugaccccaaaaguug

SEQ ID NO: 4113382 - RNA, 15 nt, Streptococcus pyogenes M1 GAS
ugacuagccaaaucu

SEQ ID NO: 4113383 - RNA, 16 nt, Streptococcus pyogenes M1 GAS
ugacuagccaaaucug

SEQ ID NO: 4113384 - RNA, 23 nt, Streptococcus pyogenes M1 GAS
ugacuaucauuggggaaacuagc

SEQ ID NO: 4113385 - RNA, 20 nt, Streptococcus pyogenes M1 GAS
ugacucugauccgaguuuug

SEQ ID NO: 4113386 - RNA, 22 nt, Streptococcus pyogenes M1 GAS
ugacucugauccgaguuuugcu

SEQ ID NO: 4113387 - RNA, 21 nt, Streptococcus pyogenes M1 GAS
ugacuugguucugaaaauaaa

SEQ ID NO: 4113388 - RNA, 16 nt, Streptococcus pyogenes M1 GAS
ugacuuguuacaaaaa

SEQ ID NO: 4113389 - RNA, 19 nt, Streptococcus pyogenes M1 GAS
ugacuuguuacaaaaaaca

SEQ ID NO: 4113390 - RNA, 14 nt, Streptococcus pyogenes M1 GAS
ugagaauuuuuaua

SEQ ID NO: 4113391 - RNA, 21 nt, Streptococcus pyogenes M1 GAS
ugagaauuuuuauaacaauua

SEQ ID NO: 4113392 - RNA, 15 nt, Streptococcus pyogenes M1 GAS
ugagacaaguugccu

SEQ ID NO: 4113393 - RNA, 12 nt, Streptococcus pyogenes M1 GAS
ugagacuaaccu

SEQ ID NO: 4113394 - RNA, 17 nt, Streptococcus pyogenes M1 GAS
ugagauauucauuuucu

SEQ ID NO: 4113395 - RNA, 14 nt, Streptococcus pyogenes M1 GAS
ugagaucuucuuuu

SEQ ID NO: 4113396 - RNA, 15 nt, Streptococcus pyogenes M1 GAS
ugagaucuucuuuug

SEQ ID NO: 4113397 - RNA, 14 nt, Streptococcus pyogenes M1 GAS
ugagauuaacugac

SEQ ID NO: 4113398 - RNA, 17 nt, Streptococcus pyogenes M1 GAS
ugagauuaacugacaaa

SEQ ID NO: 4113399 - RNA, 21 nt, Streptococcus pyogenes M1 GAS
ugagauuaacugacaaaaaaa

SEQ ID NO: 4113400 - RNA, 14 nt, Streptococcus pyogenes M1 GAS
ugagcaaaacaaua

SEQ ID NO: 4113401 - RNA, 16 nt, Streptococcus pyogenes M1 GAS
ugagcaaaacaauaac

SEQ ID NO: 4113402 - RNA, 21 nt, Streptococcus pyogenes M1 GAS
ugagcaaaacaauaacacaga

SEQ ID NO: 4113403 - RNA, 19 nt, Streptococcus pyogenes M1 GAS
ugagccuccaacauagcua

SEQ ID NO: 4113404 - RNA, 13 nt, Streptococcus pyogenes M1 GAS
ugaguauaaauuu

SEQ ID NO: 4113405 - RNA, 14 nt, Streptococcus pyogenes M1 GAS
ugaguauaaugcug

SEQ ID NO: 4113406 - RNA, 17 nt, Streptococcus pyogenes M1 GAS
ugaguccgagaaagauu

SEQ ID NO: 4113407 - RNA, 14 nt, Streptococcus pyogenes M1 GAS
ugagucuuuuccua

SEQ ID NO: 4113408 - RNA, 13 nt, Streptococcus pyogenes M1 GAS
ugaguugauuuau

SEQ ID NO: 4113409 - RNA, 15 nt, Streptococcus pyogenes M1 GAS
ugaguuuauguaugc

SEQ ID NO: 4113410 - RNA, 11 nt, Streptococcus pyogenes M1 GAS
ugauaaaaaga

SEQ ID NO: 4113411 - RNA, 13 nt, Streptococcus pyogenes M1 GAS
ugauaaaacucaa

SEQ ID NO: 4113412 - RNA, 20 nt, Streptococcus pyogenes M1 GAS
ugauaaaggccuguauuucu

SEQ ID NO: 4113413 - RNA, 19 nt, Streptococcus pyogenes M1 GAS
ugauaaaugccguuguaag

SEQ ID NO: 4113414 - RNA, 16 nt, Streptococcus pyogenes M1 GAS
ugauaacaauauaacu

SEQ ID NO: 4113415 - RNA, 21 nt, Streptococcus pyogenes M1 GAS
uggcuuuuuugcuuuuuaauu

SEQ ID NO: 4113416 - RNA, 15 nt, Streptococcus pyogenes M1 GAS
ugggcaguaguuuua

SEQ ID NO: 4113417 - RNA, 19 nt, Streptococcus pyogenes M1 GAS
ugggcuuuuuuguguucag

SEQ ID NO: 4113418 - RNA, 14 nt, Streptococcus pyogenes M1 GAS
uggguaaaaugacu

SEQ ID NO: 4113419 - RNA, 15 nt, Streptococcus pyogenes M1 GAS
ugguauucuuuuucc

SEQ ID NO: 4113420 - RNA, 19 nt, Streptococcus pyogenes M1 GAS
ugguccaucauugaugaga

SEQ ID NO: 4113421 - RNA, 21 nt, Streptococcus pyogenes M1 GAS
uggucccacaccuacuaacaa

SEQ ID NO: 4113422 - RNA, 16 nt, Streptococcus pyogenes M1 GAS
uggugcuacugaugua

SEQ ID NO: 4113423 - RNA, 18 nt, Streptococcus pyogenes M1 GAS
ugguuacagacuuuuaau

SEQ ID NO: 4113424 - RNA, 22 nt, Streptococcus pyogenes M1 GAS
ugguucaucuugccaucagcau

SEQ ID NO: 4113425 - RNA, 13 nt, Streptococcus pyogenes M1 GAS
ugguuuuuuaauu

SEQ ID NO: 4113426 - RNA, 21 nt, Streptococcus pyogenes M1 GAS
uguaacuguagcguuuguguu

SEQ ID NO: 4113427 - RNA, 19 nt, Streptococcus pyogenes M1 GAS
uguaauacgagcuagggca

SEQ ID NO: 4113428 - RNA, 12 nt, Streptococcus pyogenes M1 GAS
uguaauccccuc

SEQ ID NO: 4113429 - RNA, 13 nt, Streptococcus pyogenes M1 GAS
uguacaagagcuu

SEQ ID NO: 4113430 - RNA, 14 nt, Streptococcus pyogenes M1 GAS
uguagccugugcag

SEQ ID NO: 4113431 - RNA, 15 nt, Streptococcus pyogenes M1 GAS
uguaggacacuuuga

SEQ ID NO: 4113432 - RNA, 21 nt, Streptococcus pyogenes M1 GAS
uguauauuuaauagcauuguc

SEQ ID NO: 4113433 - RNA, 21 nt, Streptococcus pyogenes M1 GAS
uguaucaagagucauuugacu

SEQ ID NO: 4113434 - RNA, 20 nt, Streptococcus pyogenes M1 GAS
uguaucucauaacaaauuua

SEQ ID NO: 4113435 - RNA, 14 nt, Streptococcus pyogenes M1 GAS
uguauucuuaaaaa

SEQ ID NO: 4113436 - RNA, 15 nt, Streptococcus pyogenes M1 GAS
uguauucuuaaaaaa

SEQ ID NO: 4113437 - RNA, 19 nt, Streptococcus pyogenes M1 GAS
uguauuuuuuucuaguucg

SEQ ID NO: 4113438 - RNA, 15 nt, Streptococcus pyogenes M1 GAS
ugucaaaaaguaaaa

SEQ ID NO: 4113439 - RNA, 20 nt, Streptococcus pyogenes M1 GAS
ugucaaacauaacaauccua

SEQ ID NO: 4113440 - RNA, 14 nt, Streptococcus pyogenes M1 GAS
ugucaaauaaaauc

SEQ ID NO: 4113441 - RNA, 20 nt, Streptococcus pyogenes M1 GAS
ugucaacucgauaaaaacga

SEQ ID NO: 4113442 - RNA, 23 nt, Streptococcus pyogenes M1 GAS
ugucaagccauagccagauggug

SEQ ID NO: 4113443 - RNA, 18 nt, Streptococcus pyogenes M1 GAS
ugucagcauaaaggguaa

SEQ ID NO: 4113444 - RNA, 16 nt, Streptococcus pyogenes M1 GAS
ugucaugaugguuuca

SEQ ID NO: 4113445 - RNA, 14 nt, Streptococcus pyogenes M1 GAS
ugucauuucuugag

SEQ ID NO: 4113446 - RNA, 23 nt, Streptococcus pyogenes M1 GAS
ugucguugaugcaaauaguucag

SEQ ID NO: 4113447 - RNA, 16 nt, Streptococcus pyogenes M1 GAS
ugucguuuuuugcuuu

SEQ ID NO: 4113448 - RNA, 21 nt, Streptococcus pyogenes M1 GAS
ugucguuuuuugcuuuugaua

SEQ ID NO: 4113449 - RNA, 23 nt, Streptococcus pyogenes M1 GAS
ugucuggaaacuggucaaaagcu

SEQ ID NO: 4113450 - RNA, 19 nt, Streptococcus pyogenes M1 GAS
ugucuucuccgacugcagu

SEQ ID NO: 4113451 - RNA, 14 nt, Streptococcus pyogenes M1 GAS
ugucuucuucuuuu

SEQ ID NO: 4113452 - RNA, 15 nt, Streptococcus pyogenes M1 GAS
ugucuucuucuuuuc

SEQ ID NO: 4113453 - RNA, 18 nt, Streptococcus pyogenes M1 GAS
ugucuugcuaaaauuucu

SEQ ID NO: 4113454 - RNA, 21 nt, Streptococcus pyogenes M1 GAS
ugugacggaagauguggcuag

SEQ ID NO: 4113455 - RNA, 22 nt, Streptococcus pyogenes M1 GAS
ugugacuaguuuauuacaaaac

SEQ ID NO: 4113456 - RNA, 18 nt, Streptococcus pyogenes M1 GAS
ugugaggccgucacaaac

SEQ ID NO: 4113457 - RNA, 21 nt, Streptococcus pyogenes M1 GAS
ugugaugaaucauuuuggaga

SEQ ID NO: 4113458 - RNA, 15 nt, Streptococcus pyogenes M1 GAS
ugugauuaguuuuua

SEQ ID NO: 4113459 - RNA, 21 nt, Streptococcus pyogenes M1 GAS
ugugauuaguuuuuagcagca

SEQ ID NO: 4113460 - RNA, 22 nt, Streptococcus pyogenes M1 GAS
uguggagcuuuuuuugguccug

SEQ ID NO: 4113461 - RNA, 23 nt, Streptococcus pyogenes M1 GAS
uguguaauuucuugugcuaaucu

SEQ ID NO: 4113462 - RNA, 18 nt, Streptococcus pyogenes M1 GAS
ugugugacuguaaauaga

SEQ ID NO: 4113463 - RNA, 22 nt, Streptococcus pyogenes M1 GAS
uguguuguauagguagaugauu

SEQ ID NO: 4113464 - RNA, 24 nt, Streptococcus pyogenes M1 GAS
uguucauuuagugguauagacaaa

SEQ ID NO: 4113465 - RNA, 18 nt, Streptococcus pyogenes M1 GAS
uguucugguuuaucauuu

SEQ ID NO: 4113466 - RNA, 16 nt, Streptococcus pyogenes M1 GAS
uguucuuuauuuugau

SEQ ID NO: 4113467 - RNA, 17 nt, Streptococcus pyogenes M1 GAS
uguucuuuauuuugaua

SEQ ID NO: 4113468 - RNA, 12 nt, Streptococcus pyogenes M1 GAS
uguuggaggucu

SEQ ID NO: 4113469 - RNA, 19 nt, Streptococcus pyogenes M1 GAS
uguuuacaguugugugacu

SEQ ID NO: 4113470 - RNA, 21 nt, Streptococcus pyogenes M1 GAS
uguuuacgcuuuacauuuuau

SEQ ID NO: 4113471 - RNA, 23 nt, Streptococcus pyogenes M1 GAS
uguuuacgcuuuacauuuuauuu

SEQ ID NO: 4113472 - RNA, 13 nt, Streptococcus pyogenes M1 GAS
uguuuauuccaaa

SEQ ID NO: 4113473 - RNA, 20 nt, Streptococcus pyogenes M1 GAS
uguuuuaguaaagccuuauc

SEQ ID NO: 4113474 - RNA, 16 nt, Streptococcus pyogenes M1 GAS
uguuuugauaaaaaac

SEQ ID NO: 4113475 - RNA, 19 nt, Streptococcus pyogenes M1 GAS
uguuuuuagauaaaaaugg

SEQ ID NO: 4113476 - RNA, 13 nt, Streptococcus pyogenes M1 GAS
uguuuuucuuaua

SEQ ID NO: 4113477 - RNA, 20 nt, Streptococcus pyogenes M1 GAS
uguuuuuucaacaaauccuu

SEQ ID NO: 4113478 - RNA, 13 nt, Streptococcus pyogenes M1 GAS
uuaaaaauaacuu

SEQ ID NO: 4113479 - RNA, 18 nt, Streptococcus pyogenes M1 GAS
uuaaaagggucaguuugu

SEQ ID NO: 4113480 - RNA, 15 nt, Streptococcus pyogenes M1 GAS
uuaaagacaaaaaac

SEQ ID NO: 4113481 - RNA, 20 nt, Streptococcus pyogenes M1 GAS
uuaacaggugacauaguguu

SEQ ID NO: 4113482 - RNA, 18 nt, Streptococcus pyogenes M1 GAS
uuaacguuccaaaaagaa

SEQ ID NO: 4113483 - RNA, 22 nt, Streptococcus pyogenes M1 GAS
uuaacuauuucacuuaucauuu

SEQ ID NO: 4113484 - RNA, 16 nt, Streptococcus pyogenes M1 GAS
uuaacucucauaaaau

SEQ ID NO: 4113485 - RNA, 15 nt, Streptococcus pyogenes M1 GAS
uuaacugguaaagua

SEQ ID NO: 4113486 - RNA, 18 nt, Streptococcus pyogenes M1 GAS
uuaacuguuagccaugug

SEQ ID NO: 4113487 - RNA, 23 nt, Streptococcus pyogenes M1 GAS
uuaagacaacauacuuuauuaau

SEQ ID NO: 4113488 - RNA, 19 nt, Streptococcus pyogenes M1 GAS
uuaagacuauguugcuuaa

SEQ ID NO: 4113489 - RNA, 18 nt, Streptococcus pyogenes M1 GAS
uuaagagggccaaggucu

SEQ ID NO: 4113490 - RNA, 22 nt, Streptococcus pyogenes M1 GAS
uuaagauggugacucuguuccu

SEQ ID NO: 4113491 - RNA, 21 nt, Streptococcus pyogenes M1 GAS
uuaagauuaaacuuacaaaaa

SEQ ID NO: 4113492 - RNA, 17 nt, Streptococcus pyogenes M1 GAS
uuaagcuugcuaagaga

SEQ ID NO: 4113493 - RNA, 19 nt, Streptococcus pyogenes M1 GAS
uuaagcuugcuaagagaau

SEQ ID NO: 4113494 - RNA, 17 nt, Streptococcus pyogenes M1 GAS
uuaagcuuuguugcauu

SEQ ID NO: 4113495 - RNA, 20 nt, Streptococcus pyogenes M1 GAS
uuaaggauuaugaaaaagaa

SEQ ID NO: 4113496 - RNA, 15 nt, Streptococcus pyogenes M1 GAS
uuaaggauuuagcug

SEQ ID NO: 4113497 - RNA, 22 nt, Streptococcus pyogenes M1 GAS
uuaagggcaaugccaucugcuu

SEQ ID NO: 4113498 - RNA, 13 nt, Streptococcus pyogenes M1 GAS
uuaauaaaagauu

SEQ ID NO: 4113499 - RNA, 20 nt, Streptococcus pyogenes M1 GAS
uuaauaaacuguauacaaaa

SEQ ID NO: 4113500 - RNA, 14 nt, Streptococcus pyogenes M1 GAS
uuaauaauauuaac

SEQ ID NO: 4113501 - RNA, 18 nt, Streptococcus pyogenes M1 GAS
uuaauagagaacagauaa

SEQ ID NO: 4113502 - RNA, 15 nt, Streptococcus pyogenes M1 GAS
uuaauagcgccagca

SEQ ID NO: 4113503 - RNA, 22 nt, Streptococcus pyogenes M1 GAS
uuaauaggcuuuuuuuguaucu

SEQ ID NO: 4113504 - RNA, 18 nt, Streptococcus pyogenes M1 GAS
uuaauaguuuuccauaau

SEQ ID NO: 4113505 - RNA, 17 nt, Streptococcus pyogenes M1 GAS
uuaauauagucugcaug

SEQ ID NO: 4113506 - RNA, 12 nt, Streptococcus pyogenes M1 GAS
uuaaucaaaaaa

SEQ ID NO: 4113507 - RNA, 15 nt, Streptococcus pyogenes M1 GAS
uuaaucaaaaaacug

SEQ ID NO: 4113508 - RNA, 12 nt, Streptococcus pyogenes M1 GAS
uuaauuuuauuu

SEQ ID NO: 4113509 - RNA, 14 nt, Streptococcus pyogenes M1 GAS
uuaauuuuucuucu

SEQ ID NO: 4113510 - RNA, 12 nt, Streptococcus pyogenes M1 GAS
uuacaaaaaaca

SEQ ID NO: 4113511 - RNA, 14 nt, Streptococcus pyogenes M1 GAS
uuacagcugguuuu

SEQ ID NO: 4113512 - RNA, 14 nt, Streptococcus pyogenes M1 GAS
uuacaucaaaaaaa

SEQ ID NO: 4113513 - RNA, 17 nt, Streptococcus pyogenes M1 GAS
uuacaucaaaaaaagca

SEQ ID NO: 4113514 - RNA, 17 nt, Streptococcus pyogenes M1 GAS
uucuugacgcaucuccu

SEQ ID NO: 4113515 - RNA, 19 nt, Streptococcus pyogenes M1 GAS
uucuugugcuaaucuaucu

SEQ ID NO: 4113516 - RNA, 21 nt, Streptococcus pyogenes M1 GAS
uucuuucaaacggaguuccuc

SEQ ID NO: 4113517 - RNA, 20 nt, Streptococcus pyogenes M1 GAS
uucuuugcagagaugcuucu

SEQ ID NO: 4113518 - RNA, 22 nt, Streptococcus pyogenes M1 GAS
uucuuuggcaagauaauauuga

SEQ ID NO: 4113519 - RNA, 14 nt, Streptococcus pyogenes M1 GAS
uucuuugguuugau

SEQ ID NO: 4113520 - RNA, 20 nt, Streptococcus pyogenes M1 GAS
uucuuuuaggccaccagaug

SEQ ID NO: 4113521 - RNA, 20 nt, Streptococcus pyogenes M1 GAS
uucuuuucagagaugcuucu

SEQ ID NO: 4113522 - RNA, 19 nt, Streptococcus pyogenes M1 GAS
uugaaaagaugcacacaaa

SEQ ID NO: 4113523 - RNA, 20 nt, Streptococcus pyogenes M1 GAS
uugaaccaacuuggacgaag

SEQ ID NO: 4113524 - RNA, 22 nt, Streptococcus pyogenes M1 GAS
uugaaggacagguagauguugu

SEQ ID NO: 4113525 - RNA, 17 nt, Streptococcus pyogenes M1 GAS
uugaauacguaaaaaga

SEQ ID NO: 4113526 - RNA, 21 nt, Streptococcus pyogenes M1 GAS
uugaauaucgccaauaaaaaa

SEQ ID NO: 4113527 - RNA, 21 nt, Streptococcus pyogenes M1 GAS
uugaaugaguuagucugaauu

SEQ ID NO: 4113528 - RNA, 17 nt, Streptococcus pyogenes M1 GAS
uugaauugaaaaaagac

SEQ ID NO: 4113529 - RNA, 15 nt, Streptococcus pyogenes M1 GAS
uugaccacaccuaau

SEQ ID NO: 4113530 - RNA, 24 nt, Streptococcus pyogenes M1 GAS
uugaccacaccuaauaaaauagca

SEQ ID NO: 4113531 - RNA, 20 nt, Streptococcus pyogenes M1 GAS
uugaccuacuagcacaaaau

SEQ ID NO: 4113532 - RNA, 21 nt, Streptococcus pyogenes M1 GAS
uugacuugguucugaaaauaa

SEQ ID NO: 4113533 - RNA, 22 nt, Streptococcus pyogenes M1 GAS
uugagacuaaaggucugcuucu

SEQ ID NO: 4113534 - RNA, 13 nt, Streptococcus pyogenes M1 GAS
uugauacguuuau

SEQ ID NO: 4113535 - RNA, 23 nt, Streptococcus pyogenes M1 GAS
uugauaugguggguaaaaccaac

SEQ ID NO: 4113536 - RNA, 15 nt, Streptococcus pyogenes M1 GAS
uugauauuuuuucuc

SEQ ID NO: 4113537 - RNA, 22 nt, Streptococcus pyogenes M1 GAS
uugauauuuuuucucaaaaaua

SEQ ID NO: 4113538 - RNA, 14 nt, Streptococcus pyogenes M1 GAS
uugaugaaccucag

SEQ ID NO: 4113539 - RNA, 15 nt, Streptococcus pyogenes M1 GAS
uugaugauugaguaa

SEQ ID NO: 4113540 - RNA, 13 nt, Streptococcus pyogenes M1 GAS
uugauuugccgcu

SEQ ID NO: 4113541 - RNA, 17 nt, Streptococcus pyogenes M1 GAS
uugcaaaagaauugaaa

SEQ ID NO: 4113542 - RNA, 14 nt, Streptococcus pyogenes M1 GAS
uugcaagucucuug

SEQ ID NO: 4113543 - RNA, 22 nt, Streptococcus pyogenes M1 GAS
uugcacugcuauuucagcuaga

SEQ ID NO: 4113544 - RNA, 16 nt, Streptococcus pyogenes M1 GAS
uugcaucgcaaacaga

SEQ ID NO: 4113545 - RNA, 17 nt, Streptococcus pyogenes M1 GAS
uugcauuuuuuguaauu

SEQ ID NO: 4113546 - RNA, 20 nt, Streptococcus pyogenes M1 GAS
uugccaucagcaucugaaaa

SEQ ID NO: 4113547 - RNA, 17 nt, Streptococcus pyogenes M1 GAS
uugccauuaauaauauu

SEQ ID NO: 4113548 - RNA, 22 nt, Streptococcus pyogenes M1 GAS
uugccauuaauaauauuaaccg

SEQ ID NO: 4113549 - RNA, 18 nt, Streptococcus pyogenes M1 GAS
uugccugaaauauaaccu

SEQ ID NO: 4113550 - RNA, 15 nt, Streptococcus pyogenes M1 GAS
uugcuaagagaauaa

SEQ ID NO: 4113551 - RNA, 18 nt, Streptococcus pyogenes M1 GAS
uugcugagcuaaagccaa

SEQ ID NO: 4113552 - RNA, 15 nt, Streptococcus pyogenes M1 GAS
uugcuuaaugaccuu

SEQ ID NO: 4113553 - RNA, 18 nt, Streptococcus pyogenes M1 GAS
uugcuuccaacuccugau

SEQ ID NO: 4113554 - RNA, 12 nt, Streptococcus pyogenes M1 GAS
uugcuucuuuua

SEQ ID NO: 4113555 - RNA, 14 nt, Streptococcus pyogenes M1 GAS
uugcuuuugauacc

SEQ ID NO: 4113556 - RNA, 18 nt, Streptococcus pyogenes M1 GAS
uuggaacaccguuuuuug

SEQ ID NO: 4113557 - RNA, 21 nt, Streptococcus pyogenes M1 GAS
uuggaacaccguuuuuuguug

SEQ ID NO: 4113558 - RNA, 23 nt, Streptococcus pyogenes M1 GAS
uuggaacaccguuuuuuguugua

SEQ ID NO: 4113559 - RNA, 16 nt, Streptococcus pyogenes M1 GAS
uuggaagaucuccaag

SEQ ID NO: 4113560 - RNA, 19 nt, Streptococcus pyogenes M1 GAS
uuggagagauaaaaaguaa

SEQ ID NO: 4113561 - RNA, 12 nt, Streptococcus pyogenes M1 GAS
uuggauccuuua

SEQ ID NO: 4113562 - RNA, 17 nt, Streptococcus pyogenes M1 GAS
uuggccccuuuuuugac

SEQ ID NO: 4113563 - RNA, 23 nt, Streptococcus pyogenes M1 GAS
uuggcuaccguuaguauuagcac

SEQ ID NO: 4113564 - RNA, 23 nt, Streptococcus pyogenes M1 GAS
uugggacuuuucagucuucugua

SEQ ID NO: 4113565 - RNA, 15 nt, Streptococcus pyogenes M1 GAS
uugggagaguuccug

SEQ ID NO: 4113566 - RNA, 22 nt, Streptococcus pyogenes M1 GAS
uugggguuauccucuuuuaguu

SEQ ID NO: 4113567 - RNA, 14 nt, Streptococcus pyogenes M1 GAS
uugguaaaaaggca

SEQ ID NO: 4113568 - RNA, 15 nt, Streptococcus pyogenes M1 GAS
uuggugauuaacgcu

SEQ ID NO: 4113569 - RNA, 13 nt, Streptococcus pyogenes M1 GAS
uuggugucagcau

SEQ ID NO: 4113570 - RNA, 21 nt, Streptococcus pyogenes M1 GAS
uugguuuaauacguuuauuua

SEQ ID NO: 4113571 - RNA, 19 nt, Streptococcus pyogenes M1 GAS
uuguagggauuuuuuaacu

SEQ ID NO: 4113572 - RNA, 12 nt, Streptococcus pyogenes M1 GAS
uuguauagguag

SEQ ID NO: 4113573 - RNA, 12 nt, Streptococcus pyogenes M1 GAS
uuguauuagcaa

SEQ ID NO: 4113574 - RNA, 20 nt, Streptococcus pyogenes M1 GAS
uugucacugaaaaagccuuu

SEQ ID NO: 4113575 - RNA, 15 nt, Streptococcus pyogenes M1 GAS
uuguccauuuuuuau

SEQ ID NO: 4113576 - RNA, 13 nt, Streptococcus pyogenes M1 GAS
uugucguuuuuug

SEQ ID NO: 4113577 - RNA, 22 nt, Streptococcus pyogenes M1 GAS
uugugacaugaguauaaauuug

SEQ ID NO: 4113578 - RNA, 14 nt, Streptococcus pyogenes M1 GAS
uugugauauaaaau

SEQ ID NO: 4113579 - RNA, 22 nt, Streptococcus pyogenes M1 GAS
uugugcuaaucuaucucguaau

SEQ ID NO: 4113580 - RNA, 22 nt, Streptococcus pyogenes M1 GAS
uugugguuacagacuuuuaaug

SEQ ID NO: 4113581 - RNA, 16 nt, Streptococcus pyogenes M1 GAS
uuguguugaagaaggu

SEQ ID NO: 4113582 - RNA, 22 nt, Streptococcus pyogenes M1 GAS
uuguuaggguagcugguuugau

SEQ ID NO: 4113583 - RNA, 19 nt, Streptococcus pyogenes M1 GAS
uuguuaguuuuauccccua

SEQ ID NO: 4113584 - RNA, 21 nt, Streptococcus pyogenes M1 GAS
uuguucaaccgucacuauuga

SEQ ID NO: 4113585 - RNA, 17 nt, Streptococcus pyogenes M1 GAS
uuguucuaaguuuuuau

SEQ ID NO: 4113586 - RNA, 23 nt, Streptococcus pyogenes M1 GAS
uuguuguauuaugaggugaacac

SEQ ID NO: 4113587 - RNA, 19 nt, Streptococcus pyogenes M1 GAS
uuguuuuaguaaagccuua

SEQ ID NO: 4113588 - RNA, 22 nt, Streptococcus pyogenes M1 GAS
uuguuuuggccaauaaaauauc

SEQ ID NO: 4113589 - RNA, 16 nt, Streptococcus pyogenes M1 GAS
uuuaaaaacaaauugu

SEQ ID NO: 4113590 - RNA, 17 nt, Streptococcus pyogenes M1 GAS
uuuaaaagggcugaccu

SEQ ID NO: 4113591 - RNA, 13 nt, Streptococcus pyogenes M1 GAS
uuuaaagacauca

SEQ ID NO: 4113592 - RNA, 15 nt, Streptococcus pyogenes M1 GAS
uuuaacaugauguac

SEQ ID NO: 4113593 - RNA, 20 nt, Streptococcus pyogenes M1 GAS
uuuaacguaauaaaauaaca

SEQ ID NO: 4113594 - RNA, 14 nt, Streptococcus pyogenes M1 GAS
uuuaagacaacaua

SEQ ID NO: 4113595 - RNA, 21 nt, Streptococcus pyogenes M1 GAS
uuuaagauuaaacuuacaaaa

SEQ ID NO: 4113596 - RNA, 16 nt, Streptococcus pyogenes M1 GAS
uuuaauacguuuauuu

SEQ ID NO: 4113597 - RNA, 22 nt, Streptococcus pyogenes M1 GAS
uuuaauagcauugucaaauaaa

SEQ ID NO: 4113598 - RNA, 19 nt, Streptococcus pyogenes M1 GAS
uuuaauaguuuuccauaau

SEQ ID NO: 4113599 - RNA, 14 nt, Streptococcus pyogenes M1 GAS
uuuaauuuuuccuu

SEQ ID NO: 4113600 - RNA, 18 nt, Streptococcus pyogenes M1 GAS
uuuacaucaaaaaaagca

SEQ ID NO: 4113601 - RNA, 22 nt, Streptococcus pyogenes M1 GAS
uuuacaucaaaaaaagcaauga

SEQ ID NO: 4113602 - RNA, 14 nt, Streptococcus pyogenes M1 GAS
uuuacauuuuauuu

SEQ ID NO: 4113603 - RNA, 17 nt, Streptococcus pyogenes M1 GAS
uuuacgcuuuacauuuu

SEQ ID NO: 4113604 - RNA, 20 nt, Streptococcus pyogenes M1 GAS
uuuacuauggcuucuaaaaa

SEQ ID NO: 4113605 - RNA, 16 nt, Streptococcus pyogenes M1 GAS
uuuagcgguaucccuu

SEQ ID NO: 4113606 - RNA, 14 nt, Streptococcus pyogenes M1 GAS
uuuagcuucuaaau

SEQ ID NO: 4113607 - RNA, 17 nt, Streptococcus pyogenes M1 GAS
uuuagguacucguaagc

SEQ ID NO: 4113608 - RNA, 13 nt, Streptococcus pyogenes M1 GAS
uuuaggucuaauu

SEQ ID NO: 4113609 - RNA, 15 nt, Streptococcus pyogenes M1 GAS
uuuaguugcuucuuu

SEQ ID NO: 4113610 - RNA, 18 nt, Streptococcus pyogenes M1 GAS
uuuauacgguaaaaacuc

SEQ ID NO: 4113611 - RNA, 14 nt, Streptococcus pyogenes M1 GAS
uuuaugaaagguau

SEQ ID NO: 4113612 - RNA, 22 nt, Streptococcus pyogenes M1 GAS
uuuaugucgucgugacaaugug

SEQ ID NO: 4113613 - RNA, 17 nt, Streptococcus pyogenes M1 GAS
uuuuuggugucagcaua

SEQ ID NO: 4113614 - RNA, 18 nt, Streptococcus pyogenes M1 GAS
uuuuuggugucagcauaa

SEQ ID NO: 4113615 - RNA, 15 nt, Streptococcus pyogenes M1 GAS
uuuuugucuucuucu

SEQ ID NO: 4113616 - RNA, 13 nt, Streptococcus pyogenes M1 GAS
uuuuuguguucag

SEQ ID NO: 4113617 - RNA, 22 nt, Streptococcus pyogenes M1 GAS
uuuuuuaagacuauguugcuua

SEQ ID NO: 4113618 - RNA, 12 nt, Streptococcus pyogenes M1 GAS
uuuuuuguaauu

SEQ ID NO: 4113619 - RNA, 13 nt, Streptococcus pyogenes M1 GAS
uuuuuuuaaagcu

SEQ ID NO: 4113620 - RNA, 12 nt, Streptococcus pyogenes M1 GAS
aaacaaaaagag

SEQ ID NO: 4113621 - RNA, 18 nt, Streptococcus pyogenes M1 GAS
aaacaagucuaucugcag

SEQ ID NO: 4113622 - RNA, 20 nt, Streptococcus pyogenes M1 GAS
aaacaccaccaauaaugagc

SEQ ID NO: 4113623 - RNA, 13 nt, Streptococcus pyogenes M1 GAS
aaacaccugcugc

SEQ ID NO: 4113624 - RNA, 21 nt, Streptococcus pyogenes M1 GAS
aaacacuaccuuaaauguaug

SEQ ID NO: 4113625 - RNA, 12 nt, Streptococcus pyogenes M1 GAS
aaacagaaauac

SEQ ID NO: 4113626 - RNA, 20 nt, Streptococcus pyogenes M1 GAS
aaacagaugcucaaacuaua

SEQ ID NO: 4113627 - RNA, 13 nt, Streptococcus pyogenes M1 GAS
aaacauauuauag

SEQ ID NO: 4113628 - RNA, 16 nt, Streptococcus pyogenes M1 GAS
aaacaucgauuuggug

SEQ ID NO: 4113629 - RNA, 17 nt, Streptococcus pyogenes M1 GAS
aaaccauuauaaaagag

SEQ ID NO: 4113630 - RNA, 15 nt, Streptococcus pyogenes M1 GAS
aaaccuauaaggaga

SEQ ID NO: 4113631 - RNA, 16 nt, Streptococcus pyogenes M1 GAS
aaacgccacgcucaac

SEQ ID NO: 4113632 - RNA, 20 nt, Streptococcus pyogenes M1 GAS
aaacgcuauaccuaaaaaau

SEQ ID NO: 4113633 - RNA, 20 nt, Streptococcus pyogenes M1 GAS
aaacguguauucuuaaaaaa

SEQ ID NO: 4113634 - RNA, 22 nt, Streptococcus pyogenes M1 GAS
aaacguguauucuuaaaaaaau

SEQ ID NO: 4113635 - RNA, 22 nt, Streptococcus pyogenes M1 GAS
aaacguuauuaaagacaaaaaa

SEQ ID NO: 4113636 - RNA, 23 nt, Streptococcus pyogenes M1 GAS
aaacguuauuaaagacaaaaaac

SEQ ID NO: 4113637 - RNA, 15 nt, Streptococcus pyogenes M1 GAS
aaacuacaccauuua

SEQ ID NO: 4113638 - RNA, 18 nt, Streptococcus pyogenes M1 GAS
aaacuaggccaauccuaa

SEQ ID NO: 4113639 - RNA, 21 nt, Streptococcus pyogenes M1 GAS
aaacuaggccaauccuaacaa

SEQ ID NO: 4113640 - RNA, 13 nt, Streptococcus pyogenes M1 GAS
aaacuauauuguu

SEQ ID NO: 4113641 - RNA, 18 nt, Streptococcus pyogenes M1 GAS
aaacucaaaaaauacaau

SEQ ID NO: 4113642 - RNA, 15 nt, Streptococcus pyogenes M1 GAS
aaacucaaaaagcau

SEQ ID NO: 4113643 - RNA, 14 nt, Streptococcus pyogenes M1 GAS
aaacugagacaagu

SEQ ID NO: 4113644 - RNA, 16 nt, Streptococcus pyogenes M1 GAS
aaacuggucaaaagcu

SEQ ID NO: 4113645 - RNA, 14 nt, Streptococcus pyogenes M1 GAS
aaacuuacaaaaag

SEQ ID NO: 4113646 - RNA, 21 nt, Streptococcus pyogenes M1 GAS
aaacuuaugauuauccucuua

SEQ ID NO: 4113647 - RNA, 24 nt, Streptococcus pyogenes M1 GAS
aaacuucacauuguauuagcaaag

SEQ ID NO: 4113648 - RNA, 13 nt, Streptococcus pyogenes M1 GAS
aaacuuuugacuu

SEQ ID NO: 4113649 - RNA, 15 nt, Streptococcus pyogenes M1 GAS
aaagaaaaagucucu

SEQ ID NO: 4113650 - RNA, 16 nt, Streptococcus pyogenes M1 GAS
aaagaaaggaauugaa

SEQ ID NO: 4113651 - RNA, 15 nt, Streptococcus pyogenes M1 GAS
aaagaauuauacuaa

SEQ ID NO: 4113652 - RNA, 14 nt, Streptococcus pyogenes M1 GAS
aaagacaaaaaacu

SEQ ID NO: 4113653 - RNA, 22 nt, Streptococcus pyogenes M1 GAS
aaagauaguaaagaagaauuaa

SEQ ID NO: 4113654 - RNA, 16 nt, Streptococcus pyogenes M1 GAS
aaagauauuuuaaaau

SEQ ID NO: 4113655 - RNA, 16 nt, Streptococcus pyogenes M1 GAS
aaagaucuuucuuuug

SEQ ID NO: 4113656 - RNA, 14 nt, Streptococcus pyogenes M1 GAS
aaagcaaauugaaa

SEQ ID NO: 4113657 - RNA, 18 nt, Streptococcus pyogenes M1 GAS
aaagcaaauugaaaaaau

SEQ ID NO: 4113658 - RNA, 23 nt, Streptococcus pyogenes M1 GAS
aaagcaagcaacacgcuaucaac

SEQ ID NO: 4113659 - RNA, 20 nt, Streptococcus pyogenes M1 GAS
aaagcaauguaugacaacua

SEQ ID NO: 4113660 - RNA, 16 nt, Streptococcus pyogenes M1 GAS
aaagcauaaaaauauu

SEQ ID NO: 4113661 - RNA, 13 nt, Streptococcus pyogenes M1 GAS
aaagcauuuguuu

SEQ ID NO: 4113662 - RNA, 16 nt, Streptococcus pyogenes M1 GAS
aaagccaagcuuuaaa

SEQ ID NO: 4113663 - RNA, 15 nt, Streptococcus pyogenes M1 GAS
aaagccagagcaguu

SEQ ID NO: 4113664 - RNA, 21 nt, Streptococcus pyogenes M1 GAS
aaagccuuauccauucuuaac

SEQ ID NO: 4113665 - RNA, 20 nt, Streptococcus pyogenes M1 GAS
aaagcggaagaacagcauuu

SEQ ID NO: 4113666 - RNA, 15 nt, Streptococcus pyogenes M1 GAS
aaagcuaaacuaggc

SEQ ID NO: 4113667 - RNA, 13 nt, Streptococcus pyogenes M1 GAS
aaagcuaaguaag

SEQ ID NO: 4113668 - RNA, 19 nt, Streptococcus pyogenes M1 GAS
aaagcuaucauacaacuga

SEQ ID NO: 4113669 - RNA, 16 nt, Streptococcus pyogenes M1 GAS
aaaggauuuaguuuug

SEQ ID NO: 4113670 - RNA, 16 nt, Streptococcus pyogenes M1 GAS
aaaggcaguugcagag

SEQ ID NO: 4113671 - RNA, 13 nt, Streptococcus pyogenes M1 GAS
aaaggcugccuug

SEQ ID NO: 4113672 - RNA, 15 nt, Streptococcus pyogenes M1 GAS
aaaguaaaaagcaaa

SEQ ID NO: 4113673 - RNA, 23 nt, Streptococcus pyogenes M1 GAS
aaaguaaaaauacuagaaaaagc

SEQ ID NO: 4113674 - RNA, 12 nt, Streptococcus pyogenes M1 GAS
aaaguaaaaucu

SEQ ID NO: 4113675 - RNA, 17 nt, Streptococcus pyogenes M1 GAS
aaaguaaaaucuuauuu

SEQ ID NO: 4113676 - RNA, 18 nt, Streptococcus pyogenes M1 GAS
aaaguaaggguuaacaau

SEQ ID NO: 4113677 - RNA, 21 nt, Streptococcus pyogenes M1 GAS
aaaguagcaccuuuuuuauug

SEQ ID NO: 4113678 - RNA, 20 nt, Streptococcus pyogenes M1 GAS
aaagugauauacugaaaaug

SEQ ID NO: 4113679 - RNA, 17 nt, Streptococcus pyogenes M1 GAS
aaagugcgcuuccagaa

SEQ ID NO: 4113680 - RNA, 22 nt, Streptococcus pyogenes M1 GAS
aaaguuggcuacucuauuuuaa

SEQ ID NO: 4113681 - RNA, 11 nt, Streptococcus pyogenes M1 GAS
aaaguuuucuc

SEQ ID NO: 4113682 - RNA, 16 nt, Streptococcus pyogenes M1 GAS
aaaguuuucucagaga

SEQ ID NO: 4113683 - RNA, 23 nt, Streptococcus pyogenes M1 GAS
aaaguuuucucagagacaauaag

SEQ ID NO: 4113684 - RNA, 15 nt, Streptococcus pyogenes M1 GAS
aaauaaaccaagcua

SEQ ID NO: 4113685 - RNA, 20 nt, Streptococcus pyogenes M1 GAS
aaauaacaucaaaggguguu

SEQ ID NO: 4113686 - RNA, 14 nt, Streptococcus pyogenes M1 GAS
aaauaacuuuaaaa

SEQ ID NO: 4113687 - RNA, 15 nt, Streptococcus pyogenes M1 GAS
aaauaacuuuaaaag

SEQ ID NO: 4113688 - RNA, 19 nt, Streptococcus pyogenes M1 GAS
aaauacuagaaaaagcaau

SEQ ID NO: 4113689 - RNA, 21 nt, Streptococcus pyogenes M1 GAS
aaauaguucagauauucuuug

SEQ ID NO: 4113690 - RNA, 18 nt, Streptococcus pyogenes M1 GAS
aaauauaaccucuagcuu

SEQ ID NO: 4113691 - RNA, 21 nt, Streptococcus pyogenes M1 GAS
aaauauauucuaauuugugaa

SEQ ID NO: 4113692 - RNA, 12 nt, Streptococcus pyogenes M1 GAS
aaauaucuagaa

SEQ ID NO: 4113693 - RNA, 21 nt, Streptococcus pyogenes M1 GAS
aaauaucuuuuuuacuuuuaa

SEQ ID NO: 4113694 - RNA, 21 nt, Streptococcus pyogenes M1 GAS
aaaucaugggaaaagcuaagu

SEQ ID NO: 4113695 - RNA, 20 nt, Streptococcus pyogenes M1 GAS
aaauccuuuugaaaaauuau

SEQ ID NO: 4113696 - RNA, 18 nt, Streptococcus pyogenes M1 GAS
aaaucuggcuuagcagca

SEQ ID NO: 4113697 - RNA, 13 nt, Streptococcus pyogenes M1 GAS
aaaucuucuagaa

SEQ ID NO: 4113698 - RNA, 15 nt, Streptococcus pyogenes M1 GAS
aaaucuucuagaauc

SEQ ID NO: 4113699 - RNA, 13 nt, Streptococcus pyogenes M1 GAS
aaaucuucuauug

SEQ ID NO: 4113700 - RNA, 14 nt, Streptococcus pyogenes M1 GAS
aaaugacuucaaaa

SEQ ID NO: 4113701 - RNA, 13 nt, Streptococcus pyogenes M1 GAS
aaaugauacuuuc

SEQ ID NO: 4113702 - RNA, 13 nt, Streptococcus pyogenes M1 GAS
aaaugauagcacc

SEQ ID NO: 4113703 - RNA, 16 nt, Streptococcus pyogenes M1 GAS
aaaugcauuacauuua

SEQ ID NO: 4113704 - RNA, 16 nt, Streptococcus pyogenes M1 GAS
aaaugccaaucuuugu

SEQ ID NO: 4113705 - RNA, 17 nt, Streptococcus pyogenes M1 GAS
aaauguaugauuuuaac

SEQ ID NO: 4113706 - RNA, 16 nt, Streptococcus pyogenes M1 GAS
aaauuaauaaauuuuu

SEQ ID NO: 4113707 - RNA, 21 nt, Streptococcus pyogenes M1 GAS
aaauuauuaacguuaacaaaa

SEQ ID NO: 4113708 - RNA, 17 nt, Streptococcus pyogenes M1 GAS
aaauuccccacaaaaga

SEQ ID NO: 4113709 - RNA, 18 nt, Streptococcus pyogenes M1 GAS
aaauuccccacaaaagac

SEQ ID NO: 4113710 - RNA, 19 nt, Streptococcus pyogenes M1 GAS
aaauuccccacaaaagaca

SEQ ID NO: 4113711 - RNA, 23 nt, Streptococcus pyogenes M1 GAS
aaauucuuuuugaauugaaaaaa

SEQ ID NO: 4113712 - RNA, 16 nt, Streptococcus pyogenes M1 GAS
aaauugaaaaaaucgc

SEQ ID NO: 4113713 - RNA, 17 nt, Streptococcus pyogenes M1 GAS
aaauugaccaaaagaau

SEQ ID NO: 4113714 - RNA, 17 nt, Streptococcus pyogenes M1 GAS
aaauugauuauucuuua

SEQ ID NO: 4113715 - RNA, 23 nt, Streptococcus pyogenes M1 GAS
aaauuguagggauuuuuuaacua

SEQ ID NO: 4113716 - RNA, 14 nt, Streptococcus pyogenes M1 GAS
aaauuguuugauug

SEQ ID NO: 4113717 - RNA, 23 nt, Streptococcus pyogenes M1 GAS
aaauuucaugauguuauuaaaua

SEQ ID NO: 4113718 - RNA, 21 nt, Streptococcus pyogenes M1 GAS
aaauuugggcaguaguuuuag

SEQ ID NO: 4113719 - RNA, 12 nt, Streptococcus pyogenes M1 GAS
aaauuuuaaaug

SEQ ID NO: 4113720 - RNA, 17 nt, Streptococcus pyogenes M1 GAS
aagcuaucauacaacug

SEQ ID NO: 4113721 - RNA, 20 nt, Streptococcus pyogenes M1 GAS
aagcuccaacgaccuccagc

SEQ ID NO: 4113722 - RNA, 18 nt, Streptococcus pyogenes M1 GAS
aagcuugaucuuacaaag

SEQ ID NO: 4113723 - RNA, 13 nt, Streptococcus pyogenes M1 GAS
aagcuugcuaaga

SEQ ID NO: 4113724 - RNA, 17 nt, Streptococcus pyogenes M1 GAS
aagcuugcuaagagaau

SEQ ID NO: 4113725 - RNA, 19 nt, Streptococcus pyogenes M1 GAS
aagcuugcuaagagaauaa

SEQ ID NO: 4113726 - RNA, 21 nt, Streptococcus pyogenes M1 GAS
aaggaaggcuuguucuuuauu

SEQ ID NO: 4113727 - RNA, 23 nt, Streptococcus pyogenes M1 GAS
aaggaauugcagcuaaaaacaau

SEQ ID NO: 4113728 - RNA, 17 nt, Streptococcus pyogenes M1 GAS
aaggagcuagauugcuu

SEQ ID NO: 4113729 - RNA, 13 nt, Streptococcus pyogenes M1 GAS
aaggaguuuuaua

SEQ ID NO: 4113730 - RNA, 18 nt, Streptococcus pyogenes M1 GAS
aaggaguuuuauagcuga

SEQ ID NO: 4113731 - RNA, 16 nt, Streptococcus pyogenes M1 GAS
aaggauuaugaaaaag

SEQ ID NO: 4113732 - RNA, 17 nt, Streptococcus pyogenes M1 GAS
aaggauuaugaaaaaga

SEQ ID NO: 4113733 - RNA, 18 nt, Streptococcus pyogenes M1 GAS
aaggauuauuagguucuu

SEQ ID NO: 4113734 - RNA, 15 nt, Streptococcus pyogenes M1 GAS
aaggauuuagcuguu

SEQ ID NO: 4113735 - RNA, 21 nt, Streptococcus pyogenes M1 GAS
aaggcaauccaaaucaacaug

SEQ ID NO: 4113736 - RNA, 15 nt, Streptococcus pyogenes M1 GAS
aaggcacagaaaaaa

SEQ ID NO: 4113737 - RNA, 22 nt, Streptococcus pyogenes M1 GAS
aaggcgauuagcccaagggcaa

SEQ ID NO: 4113738 - RNA, 15 nt, Streptococcus pyogenes M1 GAS
aaggcugucgugcuc

SEQ ID NO: 4113739 - RNA, 23 nt, Streptococcus pyogenes M1 GAS
aagggaagaagauccuacaagag

SEQ ID NO: 4113740 - RNA, 19 nt, Streptococcus pyogenes M1 GAS
aagggauaauaaagugcgc

SEQ ID NO: 4113741 - RNA, 21 nt, Streptococcus pyogenes M1 GAS
aagggugaaucguuacuccuu

SEQ ID NO: 4113742 - RNA, 14 nt, Streptococcus pyogenes M1 GAS
aagguauuguucaa

SEQ ID NO: 4113743 - RNA, 17 nt, Streptococcus pyogenes M1 GAS
aaggucaucagaauaag

SEQ ID NO: 4113744 - RNA, 19 nt, Streptococcus pyogenes M1 GAS
aagguuuuuuuaagcauga

SEQ ID NO: 4113745 - RNA, 22 nt, Streptococcus pyogenes M1 GAS
aagguuuuuuuaagcaugauuu

SEQ ID NO: 4113746 - RNA, 20 nt, Streptococcus pyogenes M1 GAS
aaguaaaaagcaaauugaaa

SEQ ID NO: 4113747 - RNA, 14 nt, Streptococcus pyogenes M1 GAS
aaguaaaggauuua

SEQ ID NO: 4113748 - RNA, 19 nt, Streptococcus pyogenes M1 GAS
aaguagcguacauggaugc

SEQ ID NO: 4113749 - RNA, 23 nt, Streptococcus pyogenes M1 GAS
aaguauucuaaaauccucuuuua

SEQ ID NO: 4113750 - RNA, 20 nt, Streptococcus pyogenes M1 GAS
aagucagacuuaauugaaag

SEQ ID NO: 4113751 - RNA, 22 nt, Streptococcus pyogenes M1 GAS
aagucagacuuaauugaaagag

SEQ ID NO: 4113752 - RNA, 22 nt, Streptococcus pyogenes M1 GAS
aagucaguuuuuucugccauau

SEQ ID NO: 4113753 - RNA, 19 nt, Streptococcus pyogenes M1 GAS
aaguccuuuuaguuuuauu

SEQ ID NO: 4113754 - RNA, 22 nt, Streptococcus pyogenes M1 GAS
aagucuaucugcagauuuuaag

SEQ ID NO: 4113755 - RNA, 22 nt, Streptococcus pyogenes M1 GAS
aagucucuagaacagauugaag

SEQ ID NO: 4113756 - RNA, 13 nt, Streptococcus pyogenes M1 GAS
aagucucuugcaa

SEQ ID NO: 4113757 - RNA, 16 nt, Streptococcus pyogenes M1 GAS
aagugauacuugguau

SEQ ID NO: 4113758 - RNA, 22 nt, Streptococcus pyogenes M1 GAS
aagugccaguaaggaaaucaau

SEQ ID NO: 4113759 - RNA, 15 nt, Streptococcus pyogenes M1 GAS
aaguuaggaaagaua

SEQ ID NO: 4113760 - RNA, 16 nt, Streptococcus pyogenes M1 GAS
aaguuaggaaagauag

SEQ ID NO: 4113761 - RNA, 20 nt, Streptococcus pyogenes M1 GAS
aaguuauaaagaaacaaaaa

SEQ ID NO: 4113762 - RNA, 20 nt, Streptococcus pyogenes M1 GAS
aaguuaucacuaaggcugau

SEQ ID NO: 4113763 - RNA, 18 nt, Streptococcus pyogenes M1 GAS
aaguuccuuagcaguuau

SEQ ID NO: 4113764 - RNA, 12 nt, Streptococcus pyogenes M1 GAS
aaguucuuugcc

SEQ ID NO: 4113765 - RNA, 15 nt, Streptococcus pyogenes M1 GAS
aaguucuuugccuuu

SEQ ID NO: 4113766 - RNA, 14 nt, Streptococcus pyogenes M1 GAS
aaguugaaugaguu

SEQ ID NO: 4113767 - RNA, 18 nt, Streptococcus pyogenes M1 GAS
aaguugccuuaucucagu

SEQ ID NO: 4113768 - RNA, 21 nt, Streptococcus pyogenes M1 GAS
aaguuugcggcucggugcuga

SEQ ID NO: 4113769 - RNA, 19 nt, Streptococcus pyogenes M1 GAS
aaguuuuuaucauauucca

SEQ ID NO: 4113770 - RNA, 14 nt, Streptococcus pyogenes M1 GAS
aauaaaauagcacc

SEQ ID NO: 4113771 - RNA, 19 nt, Streptococcus pyogenes M1 GAS
aauaaaaucguuauuaauu

SEQ ID NO: 4113772 - RNA, 15 nt, Streptococcus pyogenes M1 GAS
aauaaagaaaaaguc

SEQ ID NO: 4113773 - RNA, 16 nt, Streptococcus pyogenes M1 GAS
aauaaagaaaaagucu

SEQ ID NO: 4113774 - RNA, 17 nt, Streptococcus pyogenes M1 GAS
aauaaagugcgcuucca

SEQ ID NO: 4113775 - RNA, 22 nt, Streptococcus pyogenes M1 GAS
aauaacagaaauuaauaaauuu

SEQ ID NO: 4113776 - RNA, 12 nt, Streptococcus pyogenes M1 GAS
aauaacaucaaa

SEQ ID NO: 4113777 - RNA, 14 nt, Streptococcus pyogenes M1 GAS
aauaacaucuugau

SEQ ID NO: 4113778 - RNA, 20 nt, Streptococcus pyogenes M1 GAS
aauaacaucuugauuguaag

SEQ ID NO: 4113779 - RNA, 13 nt, Streptococcus pyogenes M1 GAS
aauaacuuuaaaa

SEQ ID NO: 4113780 - RNA, 15 nt, Streptococcus pyogenes M1 GAS
aauaacuuuaaaagg

SEQ ID NO: 4113781 - RNA, 13 nt, Streptococcus pyogenes M1 GAS
aauaagaaaaccu

SEQ ID NO: 4113782 - RNA, 11 nt, Streptococcus pyogenes M1 GAS
aauaagauuca

SEQ ID NO: 4113783 - RNA, 16 nt, Streptococcus pyogenes M1 GAS
aauaaggucaucagaa

SEQ ID NO: 4113784 - RNA, 21 nt, Streptococcus pyogenes M1 GAS
aauaaguauagcauaaaauag

SEQ ID NO: 4113785 - RNA, 15 nt, Streptococcus pyogenes M1 GAS
aauaaguauucuaaa

SEQ ID NO: 4113786 - RNA, 16 nt, Streptococcus pyogenes M1 GAS
aauaaguauucuaaaa

SEQ ID NO: 4113787 - RNA, 19 nt, Streptococcus pyogenes M1 GAS
aauaauacagcauacauca

SEQ ID NO: 4113788 - RNA, 16 nt, Streptococcus pyogenes M1 GAS
aauaaugccaucaaaa

SEQ ID NO: 4113789 - RNA, 19 nt, Streptococcus pyogenes M1 GAS
aauaccguagaaaguagca

SEQ ID NO: 4113790 - RNA, 15 nt, Streptococcus pyogenes M1 GAS
aauacguaaaaagag

SEQ ID NO: 4113791 - RNA, 16 nt, Streptococcus pyogenes M1 GAS
aauacguaaaaagaga

SEQ ID NO: 4113792 - RNA, 18 nt, Streptococcus pyogenes M1 GAS
aauacguaaaaagagaag

SEQ ID NO: 4113793 - RNA, 19 nt, Streptococcus pyogenes M1 GAS
aauacuagaaaaagcaaug

SEQ ID NO: 4113794 - RNA, 22 nt, Streptococcus pyogenes M1 GAS
aauacuccguuucuaguuucau

SEQ ID NO: 4113795 - RNA, 17 nt, Streptococcus pyogenes M1 GAS
aauagaagacaagguga

SEQ ID NO: 4113796 - RNA, 21 nt, Streptococcus pyogenes M1 GAS
aauagcaauggcuaaaaagag

SEQ ID NO: 4113797 - RNA, 21 nt, Streptococcus pyogenes M1 GAS
aauagcauugucaaauaaaau

SEQ ID NO: 4113798 - RNA, 22 nt, Streptococcus pyogenes M1 GAS
aauagcauugucaaauaaaauc

SEQ ID NO: 4113799 - RNA, 24 nt, Streptococcus pyogenes M1 GAS
aauagcgccagcaauuuucccauc

SEQ ID NO: 4113800 - RNA, 16 nt, Streptococcus pyogenes M1 GAS
aauagcugcugcuaaa

SEQ ID NO: 4113801 - RNA, 18 nt, Streptococcus pyogenes M1 GAS
aauagguaaagauuuuaa

SEQ ID NO: 4113802 - RNA, 18 nt, Streptococcus pyogenes M1 GAS
aauaguagcaaauaacau

SEQ ID NO: 4113803 - RNA, 20 nt, Streptococcus pyogenes M1 GAS
aauaguucccuuaauaaacu

SEQ ID NO: 4113804 - RNA, 14 nt, Streptococcus pyogenes M1 GAS
aauaguuuaucacu

SEQ ID NO: 4113805 - RNA, 15 nt, Streptococcus pyogenes M1 GAS
aauauaauaaaaagc

SEQ ID NO: 4113806 - RNA, 16 nt, Streptococcus pyogenes M1 GAS
aauauaauaaaaagca

SEQ ID NO: 4113807 - RNA, 16 nt, Streptococcus pyogenes M1 GAS
aauauagcaaucuuca

SEQ ID NO: 4113808 - RNA, 20 nt, Streptococcus pyogenes M1 GAS
aauaucagcuacacuugauu

SEQ ID NO: 4113809 - RNA, 17 nt, Streptococcus pyogenes M1 GAS
aauaucgccaauaaaaa

SEQ ID NO: 4113810 - RNA, 17 nt, Streptococcus pyogenes M1 GAS
aauaugauauaaaaaug

SEQ ID NO: 4113811 - RNA, 21 nt, Streptococcus pyogenes M1 GAS
aauaugugauuauuauucuaa

SEQ ID NO: 4113812 - RNA, 22 nt, Streptococcus pyogenes M1 GAS
aauaugugauuauuauucuaaa

SEQ ID NO: 4113813 - RNA, 12 nt, Streptococcus pyogenes M1 GAS
aauauuuccuuu

SEQ ID NO: 4113814 - RNA, 14 nt, Streptococcus pyogenes M1 GAS
aauauuuuauuaau

SEQ ID NO: 4113815 - RNA, 12 nt, Streptococcus pyogenes M1 GAS
aaucaaaaaacu

SEQ ID NO: 4113816 - RNA, 22 nt, Streptococcus pyogenes M1 GAS
aaucaaaaagcuaacaccauaa

SEQ ID NO: 4113817 - RNA, 19 nt, Streptococcus pyogenes M1 GAS
aaucaccguaacuugcuuu

SEQ ID NO: 4113818 - RNA, 14 nt, Streptococcus pyogenes M1 GAS
aaucagaaagaaga

SEQ ID NO: 4113819 - RNA, 17 nt, Streptococcus pyogenes M1 GAS
acagauagucaaaaaga

SEQ ID NO: 4113820 - RNA, 20 nt, Streptococcus pyogenes M1 GAS
acagaugcucaaacuauauu

SEQ ID NO: 4113821 - RNA, 18 nt, Streptococcus pyogenes M1 GAS
acagcaccuucaaccgcu

SEQ ID NO: 4113822 - RNA, 22 nt, Streptococcus pyogenes M1 GAS
acagccgaauaaggcucgacaa

SEQ ID NO: 4113823 - RNA, 23 nt, Streptococcus pyogenes M1 GAS
acagccucuuggaaacaagagcu

SEQ ID NO: 4113824 - RNA, 15 nt, Streptococcus pyogenes M1 GAS
acagcguaagccaaa

SEQ ID NO: 4113825 - RNA, 19 nt, Streptococcus pyogenes M1 GAS
acagcguaagccaaaucuu

SEQ ID NO: 4113826 - RNA, 18 nt, Streptococcus pyogenes M1 GAS
acagcugaaacaccugcu

SEQ ID NO: 4113827 - RNA, 19 nt, Streptococcus pyogenes M1 GAS
acagcugaaacaccugcug

SEQ ID NO: 4113828 - RNA, 21 nt, Streptococcus pyogenes M1 GAS
acagcugaaacaccugcugcu

SEQ ID NO: 4113829 - RNA, 16 nt, Streptococcus pyogenes M1 GAS
acagguagauguuguu

SEQ ID NO: 4113830 - RNA, 13 nt, Streptococcus pyogenes M1 GAS
acaguauacauca

SEQ ID NO: 4113831 - RNA, 15 nt, Streptococcus pyogenes M1 GAS
acaguuaaaaauaac

SEQ ID NO: 4113832 - RNA, 19 nt, Streptococcus pyogenes M1 GAS
acauacuuuauuaaucaaa

SEQ ID NO: 4113833 - RNA, 16 nt, Streptococcus pyogenes M1 GAS
acaucaaaaaaagcaa

SEQ ID NO: 4113834 - RNA, 14 nt, Streptococcus pyogenes M1 GAS
acaucaaaaagagg

SEQ ID NO: 4113835 - RNA, 15 nt, Streptococcus pyogenes M1 GAS
acaucacguaaccaa

SEQ ID NO: 4113836 - RNA, 13 nt, Streptococcus pyogenes M1 GAS
acaucuccuaggc

SEQ ID NO: 4113837 - RNA, 16 nt, Streptococcus pyogenes M1 GAS
acaugaccuuccccau

SEQ ID NO: 4113838 - RNA, 17 nt, Streptococcus pyogenes M1 GAS
acaugaguauaaauuug

SEQ ID NO: 4113839 - RNA, 19 nt, Streptococcus pyogenes M1 GAS
acaugcauaggaucagugc

SEQ ID NO: 4113840 - RNA, 16 nt, Streptococcus pyogenes M1 GAS
acauucguucuaguuu

SEQ ID NO: 4113841 - RNA, 18 nt, Streptococcus pyogenes M1 GAS
acauuguauuagcaaagu

SEQ ID NO: 4113842 - RNA, 21 nt, Streptococcus pyogenes M1 GAS
acauuguauuagcaaagugau

SEQ ID NO: 4113843 - RNA, 18 nt, Streptococcus pyogenes M1 GAS
acauuguuuuucuuuguc

SEQ ID NO: 4113844 - RNA, 22 nt, Streptococcus pyogenes M1 GAS
acauuucgugucuaaaauaauc

SEQ ID NO: 4113845 - RNA, 13 nt, Streptococcus pyogenes M1 GAS
accaaaaaaagca

SEQ ID NO: 4113846 - RNA, 19 nt, Streptococcus pyogenes M1 GAS
accaaaagaauuauacuaa

SEQ ID NO: 4113847 - RNA, 21 nt, Streptococcus pyogenes M1 GAS
accaaaagaauuauacuaacu

SEQ ID NO: 4113848 - RNA, 16 nt, Streptococcus pyogenes M1 GAS
accaaaucaaaaagcu

SEQ ID NO: 4113849 - RNA, 18 nt, Streptococcus pyogenes M1 GAS
accaaaucaaaaagcuaa

SEQ ID NO: 4113850 - RNA, 22 nt, Streptococcus pyogenes M1 GAS
accaaauuucagauaagaccuu

SEQ ID NO: 4113851 - RNA, 18 nt, Streptococcus pyogenes M1 GAS
accaauauagcaaucuuc

SEQ ID NO: 4113852 - RNA, 16 nt, Streptococcus pyogenes M1 GAS
accaauuguugaauaa

SEQ ID NO: 4113853 - RNA, 19 nt, Streptococcus pyogenes M1 GAS
accaauuguugaauaagug

SEQ ID NO: 4113854 - RNA, 17 nt, Streptococcus pyogenes M1 GAS
accaauuuaagguauug

SEQ ID NO: 4113855 - RNA, 18 nt, Streptococcus pyogenes M1 GAS
accacaccuaauaaaaua

SEQ ID NO: 4113856 - RNA, 15 nt, Streptococcus pyogenes M1 GAS
accagaugcuugcuc

SEQ ID NO: 4113857 - RNA, 19 nt, Streptococcus pyogenes M1 GAS
accagcauuugccauggca

SEQ ID NO: 4113858 - RNA, 14 nt, Streptococcus pyogenes M1 GAS
accagccacuacaa

SEQ ID NO: 4113859 - RNA, 16 nt, Streptococcus pyogenes M1 GAS
accauaucgacauuua

SEQ ID NO: 4113860 - RNA, 17 nt, Streptococcus pyogenes M1 GAS
accauuauaaaagagug

SEQ ID NO: 4113861 - RNA, 22 nt, Streptococcus pyogenes M1 GAS
accauugccauuaauaauauua

SEQ ID NO: 4113862 - RNA, 20 nt, Streptococcus pyogenes M1 GAS
accccaaaggcugaugcgau

SEQ ID NO: 4113863 - RNA, 21 nt, Streptococcus pyogenes M1 GAS
accgaaacguaacguaauaga

SEQ ID NO: 4113864 - RNA, 16 nt, Streptococcus pyogenes M1 GAS
accgaagucucuuuug

SEQ ID NO: 4113865 - RNA, 15 nt, Streptococcus pyogenes M1 GAS
accgcgaauaugaua

SEQ ID NO: 4113866 - RNA, 20 nt, Streptococcus pyogenes M1 GAS
accguucauauaagcaauca

SEQ ID NO: 4113867 - RNA, 22 nt, Streptococcus pyogenes M1 GAS
accuacgauaaaacaaauaauu

SEQ ID NO: 4113868 - RNA, 20 nt, Streptococcus pyogenes M1 GAS
accuacuagcacaaaaucau

SEQ ID NO: 4113869 - RNA, 23 nt, Streptococcus pyogenes M1 GAS
accuacugccauggguaaaauga

SEQ ID NO: 4113870 - RNA, 21 nt, Streptococcus pyogenes M1 GAS
accuauagaaaguuauaaaga

SEQ ID NO: 4113871 - RNA, 17 nt, Streptococcus pyogenes M1 GAS
accuaucacgccaguaa

SEQ ID NO: 4113872 - RNA, 16 nt, Streptococcus pyogenes M1 GAS
accuauugagucuuuu

SEQ ID NO: 4113873 - RNA, 13 nt, Streptococcus pyogenes M1 GAS
accuccagcugac

SEQ ID NO: 4113874 - RNA, 13 nt, Streptococcus pyogenes M1 GAS
accucuaucccuu

SEQ ID NO: 4113875 - RNA, 15 nt, Streptococcus pyogenes M1 GAS
accucuaucccuuca

SEQ ID NO: 4113876 - RNA, 16 nt, Streptococcus pyogenes M1 GAS
accucugaaggcacag

SEQ ID NO: 4113877 - RNA, 21 nt, Streptococcus pyogenes M1 GAS
accucugaaggcacagccgaa

SEQ ID NO: 4113878 - RNA, 14 nt, Streptococcus pyogenes M1 GAS
accugaauugcugg

SEQ ID NO: 4113879 - RNA, 19 nt, Streptococcus pyogenes M1 GAS
accugagccuccaacauag

SEQ ID NO: 4113880 - RNA, 20 nt, Streptococcus pyogenes M1 GAS
accuucaaccgcuuccuuug

SEQ ID NO: 4113881 - RNA, 22 nt, Streptococcus pyogenes M1 GAS
accuucaggcugcuaaggacaa

SEQ ID NO: 4113882 - RNA, 16 nt, Streptococcus pyogenes M1 GAS
accuuccccaucaaga

SEQ ID NO: 4113883 - RNA, 16 nt, Streptococcus pyogenes M1 GAS
accuuuauuugcuuuu

SEQ ID NO: 4113884 - RNA, 13 nt, Streptococcus pyogenes M1 GAS
accuuugccauuu

SEQ ID NO: 4113885 - RNA, 18 nt, Streptococcus pyogenes M1 GAS
acgauaagaagcuaaugu

SEQ ID NO: 4113886 - RNA, 16 nt, Streptococcus pyogenes M1 GAS
acgcauuucuuuuuug

SEQ ID NO: 4113887 - RNA, 14 nt, Streptococcus pyogenes M1 GAS
acgcuuaccgcaua

SEQ ID NO: 4113888 - RNA, 21 nt, Streptococcus pyogenes M1 GAS
acgguaucacucguaaaaaga

SEQ ID NO: 4113889 - RNA, 22 nt, Streptococcus pyogenes M1 GAS
acggucauuaauaaaagauuuc

SEQ ID NO: 4113890 - RNA, 13 nt, Streptococcus pyogenes M1 GAS
acgguuuucuguc

SEQ ID NO: 4113891 - RNA, 12 nt, Streptococcus pyogenes M1 GAS
acguacagaaau

SEQ ID NO: 4113892 - RNA, 21 nt, Streptococcus pyogenes M1 GAS
acguuauuaaagacaaaaaac

SEQ ID NO: 4113893 - RNA, 15 nt, Streptococcus pyogenes M1 GAS
acguuccaaaaagaa

SEQ ID NO: 4113894 - RNA, 16 nt, Streptococcus pyogenes M1 GAS
acguuccaaaaagaaa

SEQ ID NO: 4113895 - RNA, 18 nt, Streptococcus pyogenes M1 GAS
acguuccaugauugauuu

SEQ ID NO: 4113896 - RNA, 15 nt, Streptococcus pyogenes M1 GAS
acuaacuauuuuuac

SEQ ID NO: 4113897 - RNA, 16 nt, Streptococcus pyogenes M1 GAS
acuaagguacggucau

SEQ ID NO: 4113898 - RNA, 15 nt, Streptococcus pyogenes M1 GAS
acuaagguuacccuu

SEQ ID NO: 4113899 - RNA, 14 nt, Streptococcus pyogenes M1 GAS
acuagaaaaagcaa

SEQ ID NO: 4113900 - RNA, 15 nt, Streptococcus pyogenes M1 GAS
acuagaaaaagcaau

SEQ ID NO: 4113901 - RNA, 16 nt, Streptococcus pyogenes M1 GAS
acuagaaaaagcaaug

SEQ ID NO: 4113902 - RNA, 17 nt, Streptococcus pyogenes M1 GAS
acuagaaaaagcaauga

SEQ ID NO: 4113903 - RNA, 19 nt, Streptococcus pyogenes M1 GAS
acuagaaaaagcaaugauu

SEQ ID NO: 4113904 - RNA, 17 nt, Streptococcus pyogenes M1 GAS
acuagcacaaaaucauu

SEQ ID NO: 4113905 - RNA, 19 nt, Streptococcus pyogenes M1 GAS
acuaggaaucgcuuuagga

SEQ ID NO: 4113906 - RNA, 21 nt, Streptococcus pyogenes M1 GAS
acuaggcuuucauuauagacu

SEQ ID NO: 4113907 - RNA, 22 nt, Streptococcus pyogenes M1 GAS
acuauauuguuaguuuuauccc

SEQ ID NO: 4113908 - RNA, 19 nt, Streptococcus pyogenes M1 GAS
acuaucauuggggaaacua

SEQ ID NO: 4113909 - RNA, 12 nt, Streptococcus pyogenes M1 GAS
acuaugaaaaaa

SEQ ID NO: 4113910 - RNA, 16 nt, Streptococcus pyogenes M1 GAS
acuaugaaaaaagaac

SEQ ID NO: 4113911 - RNA, 19 nt, Streptococcus pyogenes M1 GAS
acuauggcuucuaaaaaag

SEQ ID NO: 4113912 - RNA, 20 nt, Streptococcus pyogenes M1 GAS
acuauggcuucuaaaaaagu

SEQ ID NO: 4113913 - RNA, 23 nt, Streptococcus pyogenes M1 GAS
acuauggcuucuaaaaaaguuau

SEQ ID NO: 4113914 - RNA, 14 nt, Streptococcus pyogenes M1 GAS
acucaaaaaauaca

SEQ ID NO: 4113915 - RNA, 17 nt, Streptococcus pyogenes M1 GAS
acucaauagcugcugcu

SEQ ID NO: 4113916 - RNA, 20 nt, Streptococcus pyogenes M1 GAS
acucaauauaauaaaaagca

SEQ ID NO: 4113917 - RNA, 14 nt, Streptococcus pyogenes M1 GAS
acucaucuaaaaaa

SEQ ID NO: 4113918 - RNA, 15 nt, Streptococcus pyogenes M1 GAS
acucaucuaaaaaag

SEQ ID NO: 4113919 - RNA, 15 nt, Streptococcus pyogenes M1 GAS
agagguugguaaaaa

SEQ ID NO: 4113920 - RNA, 19 nt, Streptococcus pyogenes M1 GAS
agagguugguaaaaaggca

SEQ ID NO: 4113921 - RNA, 21 nt, Streptococcus pyogenes M1 GAS
agagguugguaaaaaggcagu

SEQ ID NO: 4113922 - RNA, 14 nt, Streptococcus pyogenes M1 GAS
agaguacaaggcaa

SEQ ID NO: 4113923 - RNA, 15 nt, Streptococcus pyogenes M1 GAS
agaguacaaggcaau

SEQ ID NO: 4113924 - RNA, 16 nt, Streptococcus pyogenes M1 GAS
agaguacaaggcaauc

SEQ ID NO: 4113925 - RNA, 19 nt, Streptococcus pyogenes M1 GAS
agaguacaaggcaauccaa

SEQ ID NO: 4113926 - RNA, 21 nt, Streptococcus pyogenes M1 GAS
agagucuuaguuuaggaauca

SEQ ID NO: 4113927 - RNA, 19 nt, Streptococcus pyogenes M1 GAS
agaguuugaggugauguuc

SEQ ID NO: 4113928 - RNA, 20 nt, Streptococcus pyogenes M1 GAS
agauaagaccuucaaaaaag

SEQ ID NO: 4113929 - RNA, 17 nt, Streptococcus pyogenes M1 GAS
agauaccaaaucaaaaa

SEQ ID NO: 4113930 - RNA, 19 nt, Streptococcus pyogenes M1 GAS
agauaccaaaucaaaaagc

SEQ ID NO: 4113931 - RNA, 20 nt, Streptococcus pyogenes M1 GAS
agauaccaaaucaaaaagcu

SEQ ID NO: 4113932 - RNA, 15 nt, Streptococcus pyogenes M1 GAS
agauaccuacaaccu

SEQ ID NO: 4113933 - RNA, 21 nt, Streptococcus pyogenes M1 GAS
agauacuuugguauucuuuuu

SEQ ID NO: 4113934 - RNA, 23 nt, Streptococcus pyogenes M1 GAS
agauacuuugguauucuuuuucc

SEQ ID NO: 4113935 - RNA, 15 nt, Streptococcus pyogenes M1 GAS
agauaguaaagaaga

SEQ ID NO: 4113936 - RNA, 16 nt, Streptococcus pyogenes M1 GAS
agauagucaaaaagac

SEQ ID NO: 4113937 - RNA, 18 nt, Streptococcus pyogenes M1 GAS
agauagucaaaaagacuu

SEQ ID NO: 4113938 - RNA, 15 nt, Streptococcus pyogenes M1 GAS
agauauucuuuggca

SEQ ID NO: 4113939 - RNA, 20 nt, Streptococcus pyogenes M1 GAS
agauauuguuaauauagucu

SEQ ID NO: 4113940 - RNA, 19 nt, Streptococcus pyogenes M1 GAS
agaucaauuccaucacuuc

SEQ ID NO: 4113941 - RNA, 15 nt, Streptococcus pyogenes M1 GAS
agaucugcacacacu

SEQ ID NO: 4113942 - RNA, 23 nt, Streptococcus pyogenes M1 GAS
agaugagaaagccaagcuuuaaa

SEQ ID NO: 4113943 - RNA, 23 nt, Streptococcus pyogenes M1 GAS
agaugagcgucaccuucucuuuu

SEQ ID NO: 4113944 - RNA, 23 nt, Streptococcus pyogenes M1 GAS
agaugauuacauuaggauauaga

SEQ ID NO: 4113945 - RNA, 23 nt, Streptococcus pyogenes M1 GAS
agaugcuugcucaauuuuugauu

SEQ ID NO: 4113946 - RNA, 16 nt, Streptococcus pyogenes M1 GAS
agaugucgcaaaggcu

SEQ ID NO: 4113947 - RNA, 17 nt, Streptococcus pyogenes M1 GAS
agauuaaacuuacaaaa

SEQ ID NO: 4113948 - RNA, 18 nt, Streptococcus pyogenes M1 GAS
agauuaaacuuacaaaaa

SEQ ID NO: 4113949 - RNA, 19 nt, Streptococcus pyogenes M1 GAS
agauuaaacuuacaaaaag

SEQ ID NO: 4113950 - RNA, 17 nt, Streptococcus pyogenes M1 GAS
agauuaacugacaaaaa

SEQ ID NO: 4113951 - RNA, 16 nt, Streptococcus pyogenes M1 GAS
agauucaauaugaaaa

SEQ ID NO: 4113952 - RNA, 22 nt, Streptococcus pyogenes M1 GAS
agauuggauuucgacucaugau

SEQ ID NO: 4113953 - RNA, 15 nt, Streptococcus pyogenes M1 GAS
agauuuuaaaaaacc

SEQ ID NO: 4113954 - RNA, 13 nt, Streptococcus pyogenes M1 GAS
agauuuuaaauau

SEQ ID NO: 4113955 - RNA, 14 nt, Streptococcus pyogenes M1 GAS
agauuuuaagacaa

SEQ ID NO: 4113956 - RNA, 20 nt, Streptococcus pyogenes M1 GAS
agcaaacuaggccaauccua

SEQ ID NO: 4113957 - RNA, 19 nt, Streptococcus pyogenes M1 GAS
agcaaagugauauacugaa

SEQ ID NO: 4113958 - RNA, 16 nt, Streptococcus pyogenes M1 GAS
agcaaauuguuugauu

SEQ ID NO: 4113959 - RNA, 19 nt, Streptococcus pyogenes M1 GAS
agcaacacgcuaucaacag

SEQ ID NO: 4113960 - RNA, 16 nt, Streptococcus pyogenes M1 GAS
agcaaccucaguucug

SEQ ID NO: 4113961 - RNA, 17 nt, Streptococcus pyogenes M1 GAS
agcaaggaugaaaugau

SEQ ID NO: 4113962 - RNA, 22 nt, Streptococcus pyogenes M1 GAS
agcaaucauacccgcguuaucu

SEQ ID NO: 4113963 - RNA, 15 nt, Streptococcus pyogenes M1 GAS
agcaaucuaagaauu

SEQ ID NO: 4113964 - RNA, 14 nt, Streptococcus pyogenes M1 GAS
agcaaucuucaaca

SEQ ID NO: 4113965 - RNA, 21 nt, Streptococcus pyogenes M1 GAS
agcaaucuucaacaccuucgu

SEQ ID NO: 4113966 - RNA, 23 nt, Streptococcus pyogenes M1 GAS
agcaaugacuauagaaaguaaaa

SEQ ID NO: 4113967 - RNA, 18 nt, Streptococcus pyogenes M1 GAS
agcaauggcuaaaaagag

SEQ ID NO: 4113968 - RNA, 23 nt, Streptococcus pyogenes M1 GAS
agcaauggcuaaaaagagagcuu

SEQ ID NO: 4113969 - RNA, 16 nt, Streptococcus pyogenes M1 GAS
agcaauuguuuuuuca

SEQ ID NO: 4113970 - RNA, 19 nt, Streptococcus pyogenes M1 GAS
agcaauuguuuuuucaaca

SEQ ID NO: 4113971 - RNA, 13 nt, Streptococcus pyogenes M1 GAS
agcaccuucaacc

SEQ ID NO: 4113972 - RNA, 22 nt, Streptococcus pyogenes M1 GAS
agcaccuucaaccgcuuccuuu

SEQ ID NO: 4113973 - RNA, 22 nt, Streptococcus pyogenes M1 GAS
agcacuggcuuuuuugcuuuuu

SEQ ID NO: 4113974 - RNA, 22 nt, Streptococcus pyogenes M1 GAS
agcagcaccaguaaaggcagga

SEQ ID NO: 4113975 - RNA, 18 nt, Streptococcus pyogenes M1 GAS
agcagcagaagcaaauuc

SEQ ID NO: 4113976 - RNA, 20 nt, Streptococcus pyogenes M1 GAS
agcagcaucacguacagaaa

SEQ ID NO: 4113977 - RNA, 15 nt, Streptococcus pyogenes M1 GAS
agcaggcguuuuguu

SEQ ID NO: 4113978 - RNA, 15 nt, Streptococcus pyogenes M1 GAS
agcaguucagcagca

SEQ ID NO: 4113979 - RNA, 18 nt, Streptococcus pyogenes M1 GAS
agcaguucagcagcacug

SEQ ID NO: 4113980 - RNA, 23 nt, Streptococcus pyogenes M1 GAS
agcauaaaagauauuuuaaaaua

SEQ ID NO: 4113981 - RNA, 18 nt, Streptococcus pyogenes M1 GAS
agcauaaccuuugccauu

SEQ ID NO: 4113982 - RNA, 15 nt, Streptococcus pyogenes M1 GAS
agcauauuuugauua

SEQ ID NO: 4113983 - RNA, 17 nt, Streptococcus pyogenes M1 GAS
agcaucacguacagaaa

SEQ ID NO: 4113984 - RNA, 18 nt, Streptococcus pyogenes M1 GAS
agcaucacguacagaaau

SEQ ID NO: 4113985 - RNA, 20 nt, Streptococcus pyogenes M1 GAS
agcaucaggauugccaucaa

SEQ ID NO: 4113986 - RNA, 23 nt, Streptococcus pyogenes M1 GAS
agcaucaggauugccaucaaugu

SEQ ID NO: 4113987 - RNA, 15 nt, Streptococcus pyogenes M1 GAS
agcaucguuaagugg

SEQ ID NO: 4113988 - RNA, 16 nt, Streptococcus pyogenes M1 GAS
agcaucguuaagugga

SEQ ID NO: 4113989 - RNA, 20 nt, Streptococcus pyogenes M1 GAS
agcaugacuguauguaucaa

SEQ ID NO: 4113990 - RNA, 22 nt, Streptococcus pyogenes M1 GAS
agcauuaaggauuaugaaaaag

SEQ ID NO: 4113991 - RNA, 21 nt, Streptococcus pyogenes M1 GAS
agcauuuguuuugauaaaaaa

SEQ ID NO: 4113992 - RNA, 23 nt, Streptococcus pyogenes M1 GAS
agcauuuguuuugauaaaaaaca

SEQ ID NO: 4113993 - RNA, 15 nt, Streptococcus pyogenes M1 GAS
agcauuuucaucauc

SEQ ID NO: 4113994 - RNA, 17 nt, Streptococcus pyogenes M1 GAS
agcauuuugagaacgaa

SEQ ID NO: 4113995 - RNA, 19 nt, Streptococcus pyogenes M1 GAS
agccaaagaaggccagcaa

SEQ ID NO: 4113996 - RNA, 22 nt, Streptococcus pyogenes M1 GAS
agccaaaucuggcuuagcagca

SEQ ID NO: 4113997 - RNA, 12 nt, Streptococcus pyogenes M1 GAS
agccaagcaauc

SEQ ID NO: 4113998 - RNA, 15 nt, Streptococcus pyogenes M1 GAS
agccaagcuuuaaaa

SEQ ID NO: 4113999 - RNA, 22 nt, Streptococcus pyogenes M1 GAS
agcccucgcuaucaaagcugac

SEQ ID NO: 4114000 - RNA, 20 nt, Streptococcus pyogenes M1 GAS
agcccuuaaucuaaaagcac

SEQ ID NO: 4114001 - RNA, 18 nt, Streptococcus pyogenes M1 GAS
agccgcucuaauuuaguc

SEQ ID NO: 4114002 - RNA, 21 nt, Streptococcus pyogenes M1 GAS
agccguccuuaaaagaaaauc

SEQ ID NO: 4114003 - RNA, 13 nt, Streptococcus pyogenes M1 GAS
agccuuuuuugau

SEQ ID NO: 4114004 - RNA, 20 nt, Streptococcus pyogenes M1 GAS
agcgccagcaauuuucccau

SEQ ID NO: 4114005 - RNA, 23 nt, Streptococcus pyogenes M1 GAS
agcgccagcaauuuucccaucaa

SEQ ID NO: 4114006 - RNA, 12 nt, Streptococcus pyogenes M1 GAS
agcgucugcaug

SEQ ID NO: 4114007 - RNA, 15 nt, Streptococcus pyogenes M1 GAS
agcguguaccaagcu

SEQ ID NO: 4114008 - RNA, 18 nt, Streptococcus pyogenes M1 GAS
agcguugacaguuaaaaa

SEQ ID NO: 4114009 - RNA, 22 nt, Streptococcus pyogenes M1 GAS
agcguugacaguuaaaaauaac

SEQ ID NO: 4114010 - RNA, 17 nt, Streptococcus pyogenes M1 GAS
agcuaaaagcauaaaaa

SEQ ID NO: 4114011 - RNA, 16 nt, Streptococcus pyogenes M1 GAS
agcuacacuugauuuc

SEQ ID NO: 4114012 - RNA, 20 nt, Streptococcus pyogenes M1 GAS
agcuacacuugauuucauuu

SEQ ID NO: 4114013 - RNA, 21 nt, Streptococcus pyogenes M1 GAS
agcuacauugggccccauggc

SEQ ID NO: 4114014 - RNA, 16 nt, Streptococcus pyogenes M1 GAS
agcuagggcaacugca

SEQ ID NO: 4114015 - RNA, 18 nt, Streptococcus pyogenes M1 GAS
agcucaaccucugaaggc

SEQ ID NO: 4114016 - RNA, 18 nt, Streptococcus pyogenes M1 GAS
agcuccaacgaccuccag

SEQ ID NO: 4114017 - RNA, 20 nt, Streptococcus pyogenes M1 GAS
agcuccaacgaccuccagcu

SEQ ID NO: 4114018 - RNA, 14 nt, Streptococcus pyogenes M1 GAS
agucggaaauugac

SEQ ID NO: 4114019 - RNA, 19 nt, Streptococcus pyogenes M1 GAS
agucuaggcguauagguga

SEQ ID NO: 4114020 - RNA, 14 nt, Streptococcus pyogenes M1 GAS
agucuugauaacaa

SEQ ID NO: 4114021 - RNA, 14 nt, Streptococcus pyogenes M1 GAS
agucuuuaaaaaac

SEQ ID NO: 4114022 - RNA, 15 nt, Streptococcus pyogenes M1 GAS
agucuuuaaaaaacg

SEQ ID NO: 4114023 - RNA, 18 nt, Streptococcus pyogenes M1 GAS
agucuuuuucauuuuuau

SEQ ID NO: 4114024 - RNA, 23 nt, Streptococcus pyogenes M1 GAS
agugaauucuaaaauaaaccaag

SEQ ID NO: 4114025 - RNA, 21 nt, Streptococcus pyogenes M1 GAS
agugagguuaaucgaccaaaa

SEQ ID NO: 4114026 - RNA, 15 nt, Streptococcus pyogenes M1 GAS
agugcgcuuccagaa

SEQ ID NO: 4114027 - RNA, 16 nt, Streptococcus pyogenes M1 GAS
agugguuugcaaauag

SEQ ID NO: 4114028 - RNA, 15 nt, Streptococcus pyogenes M1 GAS
aguguacucaucuaa

SEQ ID NO: 4114029 - RNA, 19 nt, Streptococcus pyogenes M1 GAS
aguguacucaucuaaaaaa

SEQ ID NO: 4114030 - RNA, 16 nt, Streptococcus pyogenes M1 GAS
aguguagauaaacugg

SEQ ID NO: 4114031 - RNA, 19 nt, Streptococcus pyogenes M1 GAS
agugucugacaagucagga

SEQ ID NO: 4114032 - RNA, 23 nt, Streptococcus pyogenes M1 GAS
aguguguugucaaacauaacaau

SEQ ID NO: 4114033 - RNA, 13 nt, Streptococcus pyogenes M1 GAS
aguguuuugaaug

SEQ ID NO: 4114034 - RNA, 21 nt, Streptococcus pyogenes M1 GAS
aguuaagcuugcuaagagaau

SEQ ID NO: 4114035 - RNA, 15 nt, Streptococcus pyogenes M1 GAS
aguuaggaaagauag

SEQ ID NO: 4114036 - RNA, 19 nt, Streptococcus pyogenes M1 GAS
aguuauaaagaaacaaaaa

SEQ ID NO: 4114037 - RNA, 20 nt, Streptococcus pyogenes M1 GAS
aguuauaaagaaacaaaaau

SEQ ID NO: 4114038 - RNA, 23 nt, Streptococcus pyogenes M1 GAS
aguuauaaagaaacaaaaaugaa

SEQ ID NO: 4114039 - RNA, 17 nt, Streptococcus pyogenes M1 GAS
aguuaucacuaaggcug

SEQ ID NO: 4114040 - RNA, 14 nt, Streptococcus pyogenes M1 GAS
aguuauucccauau

SEQ ID NO: 4114041 - RNA, 12 nt, Streptococcus pyogenes M1 GAS
aguuauuuuuga

SEQ ID NO: 4114042 - RNA, 16 nt, Streptococcus pyogenes M1 GAS
aguucaauggauauaa

SEQ ID NO: 4114043 - RNA, 21 nt, Streptococcus pyogenes M1 GAS
aguucccuuaauaaacuguau

SEQ ID NO: 4114044 - RNA, 16 nt, Streptococcus pyogenes M1 GAS
aguuccucgguuuuuu

SEQ ID NO: 4114045 - RNA, 23 nt, Streptococcus pyogenes M1 GAS
aguuccucgguuuuuuuaaguaa

SEQ ID NO: 4114046 - RNA, 20 nt, Streptococcus pyogenes M1 GAS
aguucugagauauucauuuu

SEQ ID NO: 4114047 - RNA, 14 nt, Streptococcus pyogenes M1 GAS
aguucuucuaaacg

SEQ ID NO: 4114048 - RNA, 18 nt, Streptococcus pyogenes M1 GAS
aguugaaccgcuauaaca

SEQ ID NO: 4114049 - RNA, 18 nt, Streptococcus pyogenes M1 GAS
aguugagacuaaaggucu

SEQ ID NO: 4114050 - RNA, 14 nt, Streptococcus pyogenes M1 GAS
aguugcuucuuuua

SEQ ID NO: 4114051 - RNA, 18 nt, Streptococcus pyogenes M1 GAS
aguugguacuugauaauc

SEQ ID NO: 4114052 - RNA, 16 nt, Streptococcus pyogenes M1 GAS
aguugguauauagcuc

SEQ ID NO: 4114053 - RNA, 17 nt, Streptococcus pyogenes M1 GAS
aguugugauauaaaaug

SEQ ID NO: 4114054 - RNA, 13 nt, Streptococcus pyogenes M1 GAS
aguugugucuuuu

SEQ ID NO: 4114055 - RNA, 16 nt, Streptococcus pyogenes M1 GAS
aguugugucuuuucuu

SEQ ID NO: 4114056 - RNA, 18 nt, Streptococcus pyogenes M1 GAS
aguugugucuuuucuuuu

SEQ ID NO: 4114057 - RNA, 23 nt, Streptococcus pyogenes M1 GAS
aguugugucuuuucuuuuuggcu

SEQ ID NO: 4114058 - RNA, 20 nt, Streptococcus pyogenes M1 GAS
aguuuaacguaauaaaauaa

SEQ ID NO: 4114059 - RNA, 17 nt, Streptococcus pyogenes M1 GAS
aguuuaggauauaagaa

SEQ ID NO: 4114060 - RNA, 16 nt, Streptococcus pyogenes M1 GAS
aguuuagugcugcuuu

SEQ ID NO: 4114061 - RNA, 14 nt, Streptococcus pyogenes M1 GAS
aguuuuauuuugau

SEQ ID NO: 4114062 - RNA, 16 nt, Streptococcus pyogenes M1 GAS
aguuuucucagagaca

SEQ ID NO: 4114063 - RNA, 15 nt, Streptococcus pyogenes M1 GAS
aguuuuuuuguaauu

SEQ ID NO: 4114064 - RNA, 11 nt, Streptococcus pyogenes M1 GAS
auaaaaaacaa

SEQ ID NO: 4114065 - RNA, 23 nt, Streptococcus pyogenes M1 GAS
auaaaaacgaucaaaaaucuuuu

SEQ ID NO: 4114066 - RNA, 14 nt, Streptococcus pyogenes M1 GAS
auaaaacaaauaau

SEQ ID NO: 4114067 - RNA, 20 nt, Streptococcus pyogenes M1 GAS
auaaaagauauuuuaaaaua

SEQ ID NO: 4114068 - RNA, 23 nt, Streptococcus pyogenes M1 GAS
auaaaaucguuauuaauuguuuu

SEQ ID NO: 4114069 - RNA, 17 nt, Streptococcus pyogenes M1 GAS
auaaaauuccccacaaa

SEQ ID NO: 4114070 - RNA, 23 nt, Streptococcus pyogenes M1 GAS
auaaaauuccccacaaaagacaa

SEQ ID NO: 4114071 - RNA, 12 nt, Streptococcus pyogenes M1 GAS
auaaagaaaaag

SEQ ID NO: 4114072 - RNA, 22 nt, Streptococcus pyogenes M1 GAS
auaaagcguugacaguuaaaaa

SEQ ID NO: 4114073 - RNA, 23 nt, Streptococcus pyogenes M1 GAS
auaaagcguugacaguuaaaaau

SEQ ID NO: 4114074 - RNA, 21 nt, Streptococcus pyogenes M1 GAS
auaaaggccuguauuucuuua

SEQ ID NO: 4114075 - RNA, 22 nt, Streptococcus pyogenes M1 GAS
auaaauucuaacucuuguagaa

SEQ ID NO: 4114076 - RNA, 20 nt, Streptococcus pyogenes M1 GAS
auaaauuugggcaguaguuu

SEQ ID NO: 4114077 - RNA, 20 nt, Streptococcus pyogenes M1 GAS
auaacuguucauuuaguggu

SEQ ID NO: 4114078 - RNA, 15 nt, Streptococcus pyogenes M1 GAS
auaacuguuuuucuu

SEQ ID NO: 4114079 - RNA, 17 nt, Streptococcus pyogenes M1 GAS
auaacuguuuuucuuau

SEQ ID NO: 4114080 - RNA, 22 nt, Streptococcus pyogenes M1 GAS
auaacuuuuagcuaagaauaac

SEQ ID NO: 4114081 - RNA, 17 nt, Streptococcus pyogenes M1 GAS
auaagaagcuaaugucu

SEQ ID NO: 4114082 - RNA, 18 nt, Streptococcus pyogenes M1 GAS
auaagaagcuaaugucuu

SEQ ID NO: 4114083 - RNA, 13 nt, Streptococcus pyogenes M1 GAS
auaagguuuuuuu

SEQ ID NO: 4114084 - RNA, 21 nt, Streptococcus pyogenes M1 GAS
auaaguauagcauaaaauagu

SEQ ID NO: 4114085 - RNA, 15 nt, Streptococcus pyogenes M1 GAS
auaaguauucuaaaa

SEQ ID NO: 4114086 - RNA, 13 nt, Streptococcus pyogenes M1 GAS
auaauaaagugcg

SEQ ID NO: 4114087 - RNA, 18 nt, Streptococcus pyogenes M1 GAS
auaauaucagcuacacuu

SEQ ID NO: 4114088 - RNA, 22 nt, Streptococcus pyogenes M1 GAS
auaauaucagcuacacuugauu

SEQ ID NO: 4114089 - RNA, 18 nt, Streptococcus pyogenes M1 GAS
auaauauugauauuccua

SEQ ID NO: 4114090 - RNA, 18 nt, Streptococcus pyogenes M1 GAS
auaaucccuugcuuugau

SEQ ID NO: 4114091 - RNA, 13 nt, Streptococcus pyogenes M1 GAS
auaaugguuuuuu

SEQ ID NO: 4114092 - RNA, 19 nt, Streptococcus pyogenes M1 GAS
auaaugguuuuuuugucuu

SEQ ID NO: 4114093 - RNA, 13 nt, Streptococcus pyogenes M1 GAS
auaauuucaauaa

SEQ ID NO: 4114094 - RNA, 15 nt, Streptococcus pyogenes M1 GAS
auaauuucaauaaua

SEQ ID NO: 4114095 - RNA, 21 nt, Streptococcus pyogenes M1 GAS
auaauuuucagugguaauggu

SEQ ID NO: 4114096 - RNA, 23 nt, Streptococcus pyogenes M1 GAS
auacaaagcaucaggauugccau

SEQ ID NO: 4114097 - RNA, 14 nt, Streptococcus pyogenes M1 GAS
auacaacugacuag

SEQ ID NO: 4114098 - RNA, 23 nt, Streptococcus pyogenes M1 GAS
auacaacugacuagccaaaucug

SEQ ID NO: 4114099 - RNA, 19 nt, Streptococcus pyogenes M1 GAS
auacaagguuaaguaaaag

SEQ ID NO: 4114100 - RNA, 14 nt, Streptococcus pyogenes M1 GAS
auacagcauacauc

SEQ ID NO: 4114101 - RNA, 20 nt, Streptococcus pyogenes M1 GAS
auacauuguuuuucuuuguc

SEQ ID NO: 4114102 - RNA, 19 nt, Streptococcus pyogenes M1 GAS
auaccaaaucaaaaagcua

SEQ ID NO: 4114103 - RNA, 16 nt, Streptococcus pyogenes M1 GAS
auaccaucaaugacuu

SEQ ID NO: 4114104 - RNA, 12 nt, Streptococcus pyogenes M1 GAS
auaccauuucuu

SEQ ID NO: 4114105 - RNA, 16 nt, Streptococcus pyogenes M1 GAS
auaccauuucuuugca

SEQ ID NO: 4114106 - RNA, 20 nt, Streptococcus pyogenes M1 GAS
auaccauuucuuugcaaaag

SEQ ID NO: 4114107 - RNA, 14 nt, Streptococcus pyogenes M1 GAS
auaccuaaaaaaua

SEQ ID NO: 4114108 - RNA, 17 nt, Streptococcus pyogenes M1 GAS
auaccugagccuccaac

SEQ ID NO: 4114109 - RNA, 12 nt, Streptococcus pyogenes M1 GAS
auacgguaaaaa

SEQ ID NO: 4114110 - RNA, 22 nt, Streptococcus pyogenes M1 GAS
auacguuuauuguugcaauaau

SEQ ID NO: 4114111 - RNA, 22 nt, Streptococcus pyogenes M1 GAS
auacguuuauuuaguuauuuuu

SEQ ID NO: 4114112 - RNA, 21 nt, Streptococcus pyogenes M1 GAS
auacuaccuuuaggaucauua

SEQ ID NO: 4114113 - RNA, 16 nt, Streptococcus pyogenes M1 GAS
auacuagaaaaagcaa

SEQ ID NO: 4114114 - RNA, 21 nt, Streptococcus pyogenes M1 GAS
auacucaauauaauaaaaagc

SEQ ID NO: 4114115 - RNA, 23 nt, Streptococcus pyogenes M1 GAS
auacugguacguugauugccauu

SEQ ID NO: 4114116 - RNA, 21 nt, Streptococcus pyogenes M1 GAS
auacuuuaaacacuaccuuaa

SEQ ID NO: 4114117 - RNA, 15 nt, Streptococcus pyogenes M1 GAS
aucuccuaggcgcaa

SEQ ID NO: 4114118 - RNA, 13 nt, Streptococcus pyogenes M1 GAS
aucugaauuauua

SEQ ID NO: 4114119 - RNA, 14 nt, Streptococcus pyogenes M1 GAS
aucugcagauuuua

SEQ ID NO: 4114120 - RNA, 16 nt, Streptococcus pyogenes M1 GAS
aucuguuuaaaaacaa

SEQ ID NO: 4114121 - RNA, 14 nt, Streptococcus pyogenes M1 GAS
aucuuaaauaugac

SEQ ID NO: 4114122 - RNA, 13 nt, Streptococcus pyogenes M1 GAS
aucuuauuuuuua

SEQ ID NO: 4114123 - RNA, 15 nt, Streptococcus pyogenes M1 GAS
aucuucaacaccuuc

SEQ ID NO: 4114124 - RNA, 16 nt, Streptococcus pyogenes M1 GAS
aucuucuaaaaugaug

SEQ ID NO: 4114125 - RNA, 20 nt, Streptococcus pyogenes M1 GAS
aucuuuaucagucuguccaa

SEQ ID NO: 4114126 - RNA, 14 nt, Streptococcus pyogenes M1 GAS
augaaaaaagaaca

SEQ ID NO: 4114127 - RNA, 18 nt, Streptococcus pyogenes M1 GAS
augaaaaaagaacaaaga

SEQ ID NO: 4114128 - RNA, 18 nt, Streptococcus pyogenes M1 GAS
augaaaacguguauucuu

SEQ ID NO: 4114129 - RNA, 20 nt, Streptococcus pyogenes M1 GAS
augaaacguuauuaaagaca

SEQ ID NO: 4114130 - RNA, 21 nt, Streptococcus pyogenes M1 GAS
augaaacguuauuaaagacaa

SEQ ID NO: 4114131 - RNA, 12 nt, Streptococcus pyogenes M1 GAS
augaaucauuuu

SEQ ID NO: 4114132 - RNA, 17 nt, Streptococcus pyogenes M1 GAS
augacaguauacaucaa

SEQ ID NO: 4114133 - RNA, 22 nt, Streptococcus pyogenes M1 GAS
augacgccuccaaauacuggua

SEQ ID NO: 4114134 - RNA, 16 nt, Streptococcus pyogenes M1 GAS
augacgguaaauaaag

SEQ ID NO: 4114135 - RNA, 19 nt, Streptococcus pyogenes M1 GAS
augacuauagaaaguaaaa

SEQ ID NO: 4114136 - RNA, 22 nt, Streptococcus pyogenes M1 GAS
augacuauagaaaguaaaaaua

SEQ ID NO: 4114137 - RNA, 23 nt, Streptococcus pyogenes M1 GAS
augacuauagaaaguaaaaauac

SEQ ID NO: 4114138 - RNA, 18 nt, Streptococcus pyogenes M1 GAS
augacugacaaaacuuca

SEQ ID NO: 4114139 - RNA, 14 nt, Streptococcus pyogenes M1 GAS
augacuugaccaaa

SEQ ID NO: 4114140 - RNA, 12 nt, Streptococcus pyogenes M1 GAS
augagaaagcca

SEQ ID NO: 4114141 - RNA, 20 nt, Streptococcus pyogenes M1 GAS
augagauuaacugacaaaaa

SEQ ID NO: 4114142 - RNA, 16 nt, Streptococcus pyogenes M1 GAS
augagggucaaacuga

SEQ ID NO: 4114143 - RNA, 14 nt, Streptococcus pyogenes M1 GAS
augaguauaaauuu

SEQ ID NO: 4114144 - RNA, 14 nt, Streptococcus pyogenes M1 GAS
augauauaaaaaug

SEQ ID NO: 4114145 - RNA, 19 nt, Streptococcus pyogenes M1 GAS
augauaucccaucuuuguu

SEQ ID NO: 4114146 - RNA, 13 nt, Streptococcus pyogenes M1 GAS
augaugguuucac

SEQ ID NO: 4114147 - RNA, 16 nt, Streptococcus pyogenes M1 GAS
augauuuaguuuuuaa

SEQ ID NO: 4114148 - RNA, 17 nt, Streptococcus pyogenes M1 GAS
augauuuaguuuuuaaa

SEQ ID NO: 4114149 - RNA, 13 nt, Streptococcus pyogenes M1 GAS
augauuuguauuu

SEQ ID NO: 4114150 - RNA, 14 nt, Streptococcus pyogenes M1 GAS
augauuuguauuuu

SEQ ID NO: 4114151 - RNA, 15 nt, Streptococcus pyogenes M1 GAS
augauuugucaaaaa

SEQ ID NO: 4114152 - RNA, 21 nt, Streptococcus pyogenes M1 GAS
augauuugucaaaaaguaaaa

SEQ ID NO: 4114153 - RNA, 23 nt, Streptococcus pyogenes M1 GAS
augcacacaaaucuucuagaauc

SEQ ID NO: 4114154 - RNA, 12 nt, Streptococcus pyogenes M1 GAS
augccucuuguc

SEQ ID NO: 4114155 - RNA, 13 nt, Streptococcus pyogenes M1 GAS
augccucuugucc

SEQ ID NO: 4114156 - RNA, 18 nt, Streptococcus pyogenes M1 GAS
augcgaggcuuuuuugag

SEQ ID NO: 4114157 - RNA, 16 nt, Streptococcus pyogenes M1 GAS
augcuaacugauaaaa

SEQ ID NO: 4114158 - RNA, 14 nt, Streptococcus pyogenes M1 GAS
augcugguguugag

SEQ ID NO: 4114159 - RNA, 16 nt, Streptococcus pyogenes M1 GAS
augcuucuuucaaacg

SEQ ID NO: 4114160 - RNA, 19 nt, Streptococcus pyogenes M1 GAS
augcuugcucaauuuuuga

SEQ ID NO: 4114161 - RNA, 17 nt, Streptococcus pyogenes M1 GAS
auggacggucguguuaa

SEQ ID NO: 4114162 - RNA, 17 nt, Streptococcus pyogenes M1 GAS
auggcuaaaaagagagc

SEQ ID NO: 4114163 - RNA, 20 nt, Streptococcus pyogenes M1 GAS
augggcuaaguagauacuuu

SEQ ID NO: 4114164 - RNA, 17 nt, Streptococcus pyogenes M1 GAS
auggggugucaggggaa

SEQ ID NO: 4114165 - RNA, 16 nt, Streptococcus pyogenes M1 GAS
auggguaaaaugacug

SEQ ID NO: 4114166 - RNA, 17 nt, Streptococcus pyogenes M1 GAS
auguauuggaaaauaca

SEQ ID NO: 4114167 - RNA, 22 nt, Streptococcus pyogenes M1 GAS
augucacgaucaagaaacucau

SEQ ID NO: 4114168 - RNA, 21 nt, Streptococcus pyogenes M1 GAS
auguccuacacguuccaugau

SEQ ID NO: 4114169 - RNA, 16 nt, Streptococcus pyogenes M1 GAS
augucuugcuaaaauu

SEQ ID NO: 4114170 - RNA, 19 nt, Streptococcus pyogenes M1 GAS
augucuuggauagacuggu

SEQ ID NO: 4114171 - RNA, 19 nt, Streptococcus pyogenes M1 GAS
auguucucauaaacaauga

SEQ ID NO: 4114172 - RNA, 17 nt, Streptococcus pyogenes M1 GAS
auguuuauuccaaacau

SEQ ID NO: 4114173 - RNA, 13 nt, Streptococcus pyogenes M1 GAS
auguuuuauuacc

SEQ ID NO: 4114174 - RNA, 17 nt, Streptococcus pyogenes M1 GAS
auguuuuuacauuuuua

SEQ ID NO: 4114175 - RNA, 22 nt, Streptococcus pyogenes M1 GAS
auuaaaagaugucgcaaaggcu

SEQ ID NO: 4114176 - RNA, 17 nt, Streptococcus pyogenes M1 GAS
auuaaacuuacaaaaag

SEQ ID NO: 4114177 - RNA, 16 nt, Streptococcus pyogenes M1 GAS
auuaaccguuccuguc

SEQ ID NO: 4114178 - RNA, 18 nt, Streptococcus pyogenes M1 GAS
auuaacguuccaaaaaga

SEQ ID NO: 4114179 - RNA, 23 nt, Streptococcus pyogenes M1 GAS
auuaaggauuaugaaaaagaagu

SEQ ID NO: 4114180 - RNA, 14 nt, Streptococcus pyogenes M1 GAS
auuaagguuuuuuu

SEQ ID NO: 4114181 - RNA, 12 nt, Streptococcus pyogenes M1 GAS
auuaauaaauuu

SEQ ID NO: 4114182 - RNA, 15 nt, Streptococcus pyogenes M1 GAS
auuaauaaauuuuug

SEQ ID NO: 4114183 - RNA, 13 nt, Streptococcus pyogenes M1 GAS
auuaaucaaaaaa

SEQ ID NO: 4114184 - RNA, 14 nt, Streptococcus pyogenes M1 GAS
auuaauuguuuuag

SEQ ID NO: 4114185 - RNA, 17 nt, Streptococcus pyogenes M1 GAS
auuacaagcauuuugca

SEQ ID NO: 4114186 - RNA, 20 nt, Streptococcus pyogenes M1 GAS
auuaccuauugagucuuuuc

SEQ ID NO: 4114187 - RNA, 15 nt, Streptococcus pyogenes M1 GAS
auuacgauuaaaaga

SEQ ID NO: 4114188 - RNA, 22 nt, Streptococcus pyogenes M1 GAS
auuagaauccuccucuuuuuuu

SEQ ID NO: 4114189 - RNA, 15 nt, Streptococcus pyogenes M1 GAS
auuagcaaaaugcug

SEQ ID NO: 4114190 - RNA, 17 nt, Streptococcus pyogenes M1 GAS
auuagcaccagcauuug

SEQ ID NO: 4114191 - RNA, 17 nt, Streptococcus pyogenes M1 GAS
auuagguucuuugguuu

SEQ ID NO: 4114192 - RNA, 16 nt, Streptococcus pyogenes M1 GAS
auuaguccaaaauaca

SEQ ID NO: 4114193 - RNA, 17 nt, Streptococcus pyogenes M1 GAS
auuaguuuuuagcagca

SEQ ID NO: 4114194 - RNA, 18 nt, Streptococcus pyogenes M1 GAS
auuaguuuuuagcagcag

SEQ ID NO: 4114195 - RNA, 13 nt, Streptococcus pyogenes M1 GAS
auuauaaaagagu

SEQ ID NO: 4114196 - RNA, 19 nt, Streptococcus pyogenes M1 GAS
auuauacucaauauaauaa

SEQ ID NO: 4114197 - RNA, 13 nt, Streptococcus pyogenes M1 GAS
auuaucaauaaca

SEQ ID NO: 4114198 - RNA, 14 nt, Streptococcus pyogenes M1 GAS
auuauccaacuuuu

SEQ ID NO: 4114199 - RNA, 15 nt, Streptococcus pyogenes M1 GAS
auuaucucaacuggu

SEQ ID NO: 4114200 - RNA, 21 nt, Streptococcus pyogenes M1 GAS
auuaucucaacuggugggacu

SEQ ID NO: 4114201 - RNA, 17 nt, Streptococcus pyogenes M1 GAS
auuaucugaauuauuag

SEQ ID NO: 4114202 - RNA, 19 nt, Streptococcus pyogenes M1 GAS
auuaucugaauuauuagua

SEQ ID NO: 4114203 - RNA, 23 nt, Streptococcus pyogenes M1 GAS
auuaucugaauuauuaguaacca

SEQ ID NO: 4114204 - RNA, 15 nt, Streptococcus pyogenes M1 GAS
auuaucugauaaggu

SEQ ID NO: 4114205 - RNA, 14 nt, Streptococcus pyogenes M1 GAS
auuaugaaaaagaa

SEQ ID NO: 4114206 - RNA, 15 nt, Streptococcus pyogenes M1 GAS
auuaugaaaaagaag

SEQ ID NO: 4114207 - RNA, 20 nt, Streptococcus pyogenes M1 GAS
auuaugaaggugauugacuu

SEQ ID NO: 4114208 - RNA, 13 nt, Streptococcus pyogenes M1 GAS
auuaugaggugaa

SEQ ID NO: 4114209 - RNA, 21 nt, Streptococcus pyogenes M1 GAS
auuauuaacguuaacaaaaau

SEQ ID NO: 4114210 - RNA, 16 nt, Streptococcus pyogenes M1 GAS
auuauucuaaaugaca

SEQ ID NO: 4114211 - RNA, 13 nt, Streptococcus pyogenes M1 GAS
auuauucuuuauu

SEQ ID NO: 4114212 - RNA, 14 nt, Streptococcus pyogenes M1 GAS
auuauugucacuga

SEQ ID NO: 4114213 - RNA, 18 nt, Streptococcus pyogenes M1 GAS
auuauugucacugaaaaa

SEQ ID NO: 4114214 - RNA, 17 nt, Streptococcus pyogenes M1 GAS
auuauuuuaauuuuucc

SEQ ID NO: 4114215 - RNA, 18 nt, Streptococcus pyogenes M1 GAS
auuauuuuaauuuuuccu

SEQ ID NO: 4114216 - RNA, 19 nt, Streptococcus pyogenes M1 GAS
auuauuuuaauuuuuccuu

SEQ ID NO: 4114217 - RNA, 13 nt, Streptococcus pyogenes M1 GAS
auuauuuugcuuc

SEQ ID NO: 4114218 - RNA, 14 nt, Streptococcus pyogenes M1 GAS
caaaggcuuuuugu

SEQ ID NO: 4114219 - RNA, 18 nt, Streptococcus pyogenes M1 GAS
caaauaguagcaaauaac

SEQ ID NO: 4114220 - RNA, 14 nt, Streptococcus pyogenes M1 GAS
caaaucaacauggc

SEQ ID NO: 4114221 - RNA, 24 nt, Streptococcus pyogenes M1 GAS
caaaucaacauggcuaaugauaag

SEQ ID NO: 4114222 - RNA, 16 nt, Streptococcus pyogenes M1 GAS
caaaucguacugucug

SEQ ID NO: 4114223 - RNA, 14 nt, Streptococcus pyogenes M1 GAS
caaaucuucuagaa

SEQ ID NO: 4114224 - RNA, 17 nt, Streptococcus pyogenes M1 GAS
caaaucuucugcauuau

SEQ ID NO: 4114225 - RNA, 14 nt, Streptococcus pyogenes M1 GAS
caaauucuuccuua

SEQ ID NO: 4114226 - RNA, 20 nt, Streptococcus pyogenes M1 GAS
caaauucuuccuuagcaaag

SEQ ID NO: 4114227 - RNA, 13 nt, Streptococcus pyogenes M1 GAS
caaauucuuuuug

SEQ ID NO: 4114228 - RNA, 14 nt, Streptococcus pyogenes M1 GAS
caaauucuuuuuga

SEQ ID NO: 4114229 - RNA, 16 nt, Streptococcus pyogenes M1 GAS
caaauugaaaaaaucg

SEQ ID NO: 4114230 - RNA, 20 nt, Streptococcus pyogenes M1 GAS
caaauuucagauaagaccuu

SEQ ID NO: 4114231 - RNA, 15 nt, Streptococcus pyogenes M1 GAS
caacaacccuugauu

SEQ ID NO: 4114232 - RNA, 14 nt, Streptococcus pyogenes M1 GAS
caacauacuuuauu

SEQ ID NO: 4114233 - RNA, 18 nt, Streptococcus pyogenes M1 GAS
caacauccauaccaucaa

SEQ ID NO: 4114234 - RNA, 17 nt, Streptococcus pyogenes M1 GAS
caacauggcuaaugaua

SEQ ID NO: 4114235 - RNA, 18 nt, Streptococcus pyogenes M1 GAS
caacccuugauuaauagc

SEQ ID NO: 4114236 - RNA, 22 nt, Streptococcus pyogenes M1 GAS
caaccucgcuggcuagacuugg

SEQ ID NO: 4114237 - RNA, 17 nt, Streptococcus pyogenes M1 GAS
caaccucugaaggcaca

SEQ ID NO: 4114238 - RNA, 10 nt, Streptococcus pyogenes M1 GAS
caaccugaaa

SEQ ID NO: 4114239 - RNA, 21 nt, Streptococcus pyogenes M1 GAS
caacgaccuccagcugacagc

SEQ ID NO: 4114240 - RNA, 21 nt, Streptococcus pyogenes M1 GAS
caacgcauuucuuuuuugguu

SEQ ID NO: 4114241 - RNA, 23 nt, Streptococcus pyogenes M1 GAS
caacuaucaaguaugcuuuuaau

SEQ ID NO: 4114242 - RNA, 22 nt, Streptococcus pyogenes M1 GAS
caacuaucgcucagaauaaaga

SEQ ID NO: 4114243 - RNA, 16 nt, Streptococcus pyogenes M1 GAS
caacucgauaaaaacg

SEQ ID NO: 4114244 - RNA, 13 nt, Streptococcus pyogenes M1 GAS
caacugacuagcc

SEQ ID NO: 4114245 - RNA, 22 nt, Streptococcus pyogenes M1 GAS
caacugcaauaccguagaaagu

SEQ ID NO: 4114246 - RNA, 14 nt, Streptococcus pyogenes M1 GAS
caacuggcacaaac

SEQ ID NO: 4114247 - RNA, 20 nt, Streptococcus pyogenes M1 GAS
caacuguggguuaagagagg

SEQ ID NO: 4114248 - RNA, 19 nt, Streptococcus pyogenes M1 GAS
caacuucuauauguguaau

SEQ ID NO: 4114249 - RNA, 19 nt, Streptococcus pyogenes M1 GAS
caacuugggagaguuccug

SEQ ID NO: 4114250 - RNA, 17 nt, Streptococcus pyogenes M1 GAS
caagaauagcuuuugua

SEQ ID NO: 4114251 - RNA, 20 nt, Streptococcus pyogenes M1 GAS
caagaauagcuuuuguaaua

SEQ ID NO: 4114252 - RNA, 20 nt, Streptococcus pyogenes M1 GAS
caagagcaccgcgaauauga

SEQ ID NO: 4114253 - RNA, 21 nt, Streptococcus pyogenes M1 GAS
caagagcucaaccucugaagg

SEQ ID NO: 4114254 - RNA, 13 nt, Streptococcus pyogenes M1 GAS
caagagcuuaaaa

SEQ ID NO: 4114255 - RNA, 19 nt, Streptococcus pyogenes M1 GAS
caagagcuuaaaaguuagc

SEQ ID NO: 4114256 - RNA, 23 nt, Streptococcus pyogenes M1 GAS
caagaggaggcaacuguggguua

SEQ ID NO: 4114257 - RNA, 14 nt, Streptococcus pyogenes M1 GAS
caagaggaguugaa

SEQ ID NO: 4114258 - RNA, 14 nt, Streptococcus pyogenes M1 GAS
caagcaucagcucu

SEQ ID NO: 4114259 - RNA, 13 nt, Streptococcus pyogenes M1 GAS
caagcauuuugca

SEQ ID NO: 4114260 - RNA, 23 nt, Streptococcus pyogenes M1 GAS
caagcauuuugcaagucucuugc

SEQ ID NO: 4114261 - RNA, 21 nt, Streptococcus pyogenes M1 GAS
caagcuaucgcuaacauuuau

SEQ ID NO: 4114262 - RNA, 21 nt, Streptococcus pyogenes M1 GAS
caagcuugaucuuacaaagga

SEQ ID NO: 4114263 - RNA, 21 nt, Streptococcus pyogenes M1 GAS
caaggaauugcagcuaaaaac

SEQ ID NO: 4114264 - RNA, 22 nt, Streptococcus pyogenes M1 GAS
caaggaauugcagcuaaaaaca

SEQ ID NO: 4114265 - RNA, 19 nt, Streptococcus pyogenes M1 GAS
caaggugcuuuuuuugucg

SEQ ID NO: 4114266 - RNA, 19 nt, Streptococcus pyogenes M1 GAS
caagguuaaguaaaaggga

SEQ ID NO: 4114267 - RNA, 19 nt, Streptococcus pyogenes M1 GAS
caagguuguggcugauaaa

SEQ ID NO: 4114268 - RNA, 19 nt, Streptococcus pyogenes M1 GAS
caagugauacuugguauug

SEQ ID NO: 4114269 - RNA, 23 nt, Streptococcus pyogenes M1 GAS
caauaaaauaucuagaacagcug

SEQ ID NO: 4114270 - RNA, 22 nt, Streptococcus pyogenes M1 GAS
caauaacgccagcuacauuggg

SEQ ID NO: 4114271 - RNA, 16 nt, Streptococcus pyogenes M1 GAS
caauaaggucaucaga

SEQ ID NO: 4114272 - RNA, 21 nt, Streptococcus pyogenes M1 GAS
caauaaggucaucagaauaag

SEQ ID NO: 4114273 - RNA, 17 nt, Streptococcus pyogenes M1 GAS
caauaauaccauuuuua

SEQ ID NO: 4114274 - RNA, 19 nt, Streptococcus pyogenes M1 GAS
caauaaugccaucaaaaaa

SEQ ID NO: 4114275 - RNA, 22 nt, Streptococcus pyogenes M1 GAS
caauacaaaaaaccuuccugua

SEQ ID NO: 4114276 - RNA, 13 nt, Streptococcus pyogenes M1 GAS
caauacaguugac

SEQ ID NO: 4114277 - RNA, 23 nt, Streptococcus pyogenes M1 GAS
caauagcaaguccugcuuuugau

SEQ ID NO: 4114278 - RNA, 20 nt, Streptococcus pyogenes M1 GAS
caauauaauaaaaagcaguu

SEQ ID NO: 4114279 - RNA, 15 nt, Streptococcus pyogenes M1 GAS
caaucaccuuucuau

SEQ ID NO: 4114280 - RNA, 14 nt, Streptococcus pyogenes M1 GAS
caaucaggacaguc

SEQ ID NO: 4114281 - RNA, 21 nt, Streptococcus pyogenes M1 GAS
caaucauacccgcguuaucuc

SEQ ID NO: 4114282 - RNA, 22 nt, Streptococcus pyogenes M1 GAS
caaucaucauuuagcugauaau

SEQ ID NO: 4114283 - RNA, 13 nt, Streptococcus pyogenes M1 GAS
caaucgaaaugau

SEQ ID NO: 4114284 - RNA, 17 nt, Streptococcus pyogenes M1 GAS
caaucgaaaugauagca

SEQ ID NO: 4114285 - RNA, 20 nt, Streptococcus pyogenes M1 GAS
caaucgaaaugauagcaccu

SEQ ID NO: 4114286 - RNA, 20 nt, Streptococcus pyogenes M1 GAS
caaugaaaaguuauucccau

SEQ ID NO: 4114287 - RNA, 20 nt, Streptococcus pyogenes M1 GAS
caaugacuugaccaaauaca

SEQ ID NO: 4114288 - RNA, 17 nt, Streptococcus pyogenes M1 GAS
caaugagaucuucuuuu

SEQ ID NO: 4114289 - RNA, 13 nt, Streptococcus pyogenes M1 GAS
caauggaaauuuu

SEQ ID NO: 4114290 - RNA, 16 nt, Streptococcus pyogenes M1 GAS
caauggcuaaaaagag

SEQ ID NO: 4114291 - RNA, 13 nt, Streptococcus pyogenes M1 GAS
cacaauuagccaa

SEQ ID NO: 4114292 - RNA, 19 nt, Streptococcus pyogenes M1 GAS
cacaauuagccaaagaagg

SEQ ID NO: 4114293 - RNA, 17 nt, Streptococcus pyogenes M1 GAS
cacacaaaucuucuaga

SEQ ID NO: 4114294 - RNA, 15 nt, Streptococcus pyogenes M1 GAS
cacaccuacuaacaa

SEQ ID NO: 4114295 - RNA, 13 nt, Streptococcus pyogenes M1 GAS
cacagaaaaaaga

SEQ ID NO: 4114296 - RNA, 18 nt, Streptococcus pyogenes M1 GAS
cacagccgaauaaggcuc

SEQ ID NO: 4114297 - RNA, 19 nt, Streptococcus pyogenes M1 GAS
cacagcguaagccaaaucu

SEQ ID NO: 4114298 - RNA, 15 nt, Streptococcus pyogenes M1 GAS
cacaguuagugaggu

SEQ ID NO: 4114299 - RNA, 21 nt, Streptococcus pyogenes M1 GAS
cacauacuggucaauggaaau

SEQ ID NO: 4114300 - RNA, 14 nt, Streptococcus pyogenes M1 GAS
caccaaaaaaagca

SEQ ID NO: 4114301 - RNA, 22 nt, Streptococcus pyogenes M1 GAS
caccaauaaugagcaaggcaag

SEQ ID NO: 4114302 - RNA, 21 nt, Streptococcus pyogenes M1 GAS
caccauuaaaaaaaccagcuu

SEQ ID NO: 4114303 - RNA, 17 nt, Streptococcus pyogenes M1 GAS
caccgacauacaaagca

SEQ ID NO: 4114304 - RNA, 23 nt, Streptococcus pyogenes M1 GAS
caccuacgauaaaacaaauaauu

SEQ ID NO: 4114305 - RNA, 20 nt, Streptococcus pyogenes M1 GAS
caccuuagugguuugcaaau

SEQ ID NO: 4114306 - RNA, 22 nt, Streptococcus pyogenes M1 GAS
caccuucguauuggccuucuug

SEQ ID NO: 4114307 - RNA, 16 nt, Streptococcus pyogenes M1 GAS
cacgaucaagaaacuc

SEQ ID NO: 4114308 - RNA, 19 nt, Streptococcus pyogenes M1 GAS
cacgcucaacuggcacaaa

SEQ ID NO: 4114309 - RNA, 16 nt, Streptococcus pyogenes M1 GAS
cacguaagcuccaacg

SEQ ID NO: 4114310 - RNA, 13 nt, Streptococcus pyogenes M1 GAS
cacuaaaaccauu

SEQ ID NO: 4114311 - RNA, 20 nt, Streptococcus pyogenes M1 GAS
cacuacaagcaucuuugcag

SEQ ID NO: 4114312 - RNA, 16 nt, Streptococcus pyogenes M1 GAS
cacuacucguuacaua

SEQ ID NO: 4114313 - RNA, 22 nt, Streptococcus pyogenes M1 GAS
cacuacucguuacauaaaauga

SEQ ID NO: 4114314 - RNA, 14 nt, Streptococcus pyogenes M1 GAS
cacucguaaaaaga

SEQ ID NO: 4114315 - RNA, 13 nt, Streptococcus pyogenes M1 GAS
cacucgugcugcc

SEQ ID NO: 4114316 - RNA, 14 nt, Streptococcus pyogenes M1 GAS
cagaaaaaagauaa

SEQ ID NO: 4114317 - RNA, 12 nt, Streptococcus pyogenes M1 GAS
cauggguaugcc

SEQ ID NO: 4114318 - RNA, 20 nt, Streptococcus pyogenes M1 GAS
cauguuuacaguugugugac

SEQ ID NO: 4114319 - RNA, 23 nt, Streptococcus pyogenes M1 GAS
cauuaaagcuaucauacaacuga

SEQ ID NO: 4114320 - RNA, 19 nt, Streptococcus pyogenes M1 GAS
cauuaaauugauuauucuu

SEQ ID NO: 4114321 - RNA, 18 nt, Streptococcus pyogenes M1 GAS
cauuaaggauuaugaaaa

SEQ ID NO: 4114322 - RNA, 19 nt, Streptococcus pyogenes M1 GAS
cauuaaggauuaugaaaaa

SEQ ID NO: 4114323 - RNA, 15 nt, Streptococcus pyogenes M1 GAS
cauuaauaauauuaa

SEQ ID NO: 4114324 - RNA, 17 nt, Streptococcus pyogenes M1 GAS
cauuaccuuauuuucua

SEQ ID NO: 4114325 - RNA, 17 nt, Streptococcus pyogenes M1 GAS
cauuagcuuuuuuuaaa

SEQ ID NO: 4114326 - RNA, 14 nt, Streptococcus pyogenes M1 GAS
cauuauugacaaau

SEQ ID NO: 4114327 - RNA, 12 nt, Streptococcus pyogenes M1 GAS
cauucuugcaga

SEQ ID NO: 4114328 - RNA, 18 nt, Streptococcus pyogenes M1 GAS
cauucuugcagaauagaa

SEQ ID NO: 4114329 - RNA, 17 nt, Streptococcus pyogenes M1 GAS
cauugaauaaagugaua

SEQ ID NO: 4114330 - RNA, 18 nt, Streptococcus pyogenes M1 GAS
cauugagaauuuuuauaa

SEQ ID NO: 4114331 - RNA, 21 nt, Streptococcus pyogenes M1 GAS
cauugaugagacuaaccugca

SEQ ID NO: 4114332 - RNA, 21 nt, Streptococcus pyogenes M1 GAS
cauugccauuaauaauauuaa

SEQ ID NO: 4114333 - RNA, 13 nt, Streptococcus pyogenes M1 GAS
cauugcuuuuuau

SEQ ID NO: 4114334 - RNA, 21 nt, Streptococcus pyogenes M1 GAS
cauuguuuuucuuugucaugu

SEQ ID NO: 4114335 - RNA, 18 nt, Streptococcus pyogenes M1 GAS
cauuuagcgguaucccuu

SEQ ID NO: 4114336 - RNA, 18 nt, Streptococcus pyogenes M1 GAS
cauuuagcugauaaucuu

SEQ ID NO: 4114337 - RNA, 15 nt, Streptococcus pyogenes M1 GAS
cauuuccuacaaaau

SEQ ID NO: 4114338 - RNA, 20 nt, Streptococcus pyogenes M1 GAS
cauuucgugucuaaaauaau

SEQ ID NO: 4114339 - RNA, 16 nt, Streptococcus pyogenes M1 GAS
cauuucuucagguuuc

SEQ ID NO: 4114340 - RNA, 13 nt, Streptococcus pyogenes M1 GAS
cauuucuugaggu

SEQ ID NO: 4114341 - RNA, 23 nt, Streptococcus pyogenes M1 GAS
cauuucuugaggugauucuuuuu

SEQ ID NO: 4114342 - RNA, 18 nt, Streptococcus pyogenes M1 GAS
cauuucuuugcaaaagaa

SEQ ID NO: 4114343 - RNA, 14 nt, Streptococcus pyogenes M1 GAS
cauuugccauggca

SEQ ID NO: 4114344 - RNA, 15 nt, Streptococcus pyogenes M1 GAS
cauuuuauuugaaga

SEQ ID NO: 4114345 - RNA, 20 nt, Streptococcus pyogenes M1 GAS
cauuuuggagagauuuuaaa

SEQ ID NO: 4114346 - RNA, 17 nt, Streptococcus pyogenes M1 GAS
cauuuuuacaauacgau

SEQ ID NO: 4114347 - RNA, 17 nt, Streptococcus pyogenes M1 GAS
cauuuuuaucuguauau

SEQ ID NO: 4114348 - RNA, 12 nt, Streptococcus pyogenes M1 GAS
cauuuuuuguaa

SEQ ID NO: 4114349 - RNA, 20 nt, Streptococcus pyogenes M1 GAS
cauuuuuuguaauucagcau

SEQ ID NO: 4114350 - RNA, 19 nt, Streptococcus pyogenes M1 GAS
ccaaauuucagauaagacc

SEQ ID NO: 4114351 - RNA, 21 nt, Streptococcus pyogenes M1 GAS
ccaagcuugaucuuacaaagg

SEQ ID NO: 4114352 - RNA, 20 nt, Streptococcus pyogenes M1 GAS
ccaaggucugcgcgacuaaa

SEQ ID NO: 4114353 - RNA, 16 nt, Streptococcus pyogenes M1 GAS
ccaagugccaguaagg

SEQ ID NO: 4114354 - RNA, 16 nt, Streptococcus pyogenes M1 GAS
ccaauaaugagcaagg

SEQ ID NO: 4114355 - RNA, 20 nt, Streptococcus pyogenes M1 GAS
ccaauaaugccaucaaaaaa

SEQ ID NO: 4114356 - RNA, 21 nt, Streptococcus pyogenes M1 GAS
ccaauaaugccaucaaaaaaa

SEQ ID NO: 4114357 - RNA, 22 nt, Streptococcus pyogenes M1 GAS
ccaauaaugccaucaaaaaaag

SEQ ID NO: 4114358 - RNA, 21 nt, Streptococcus pyogenes M1 GAS
ccaauauagcaaucuucaaca

SEQ ID NO: 4114359 - RNA, 22 nt, Streptococcus pyogenes M1 GAS
ccaaucaccuuucuauauaacu

SEQ ID NO: 4114360 - RNA, 12 nt, Streptococcus pyogenes M1 GAS
ccaauccuaaca

SEQ ID NO: 4114361 - RNA, 13 nt, Streptococcus pyogenes M1 GAS
ccaaugacuaagg

SEQ ID NO: 4114362 - RNA, 19 nt, Streptococcus pyogenes M1 GAS
ccacaccuacuaacaacaa

SEQ ID NO: 4114363 - RNA, 23 nt, Streptococcus pyogenes M1 GAS
ccaccuucaggcugcuaaggaca

SEQ ID NO: 4114364 - RNA, 16 nt, Streptococcus pyogenes M1 GAS
ccagaugcuugcucaa

SEQ ID NO: 4114365 - RNA, 23 nt, Streptococcus pyogenes M1 GAS
ccagaugcuugcucaauuuuuga

SEQ ID NO: 4114366 - RNA, 13 nt, Streptococcus pyogenes M1 GAS
ccagcaaggcacc

SEQ ID NO: 4114367 - RNA, 16 nt, Streptococcus pyogenes M1 GAS
ccagccacuacaagca

SEQ ID NO: 4114368 - RNA, 15 nt, Streptococcus pyogenes M1 GAS
ccagcugacagccuc

SEQ ID NO: 4114369 - RNA, 17 nt, Streptococcus pyogenes M1 GAS
ccagcugacagccucuu

SEQ ID NO: 4114370 - RNA, 18 nt, Streptococcus pyogenes M1 GAS
ccagcugacagccucuug

SEQ ID NO: 4114371 - RNA, 11 nt, Streptococcus pyogenes M1 GAS
ccauagaagcc

SEQ ID NO: 4114372 - RNA, 13 nt, Streptococcus pyogenes M1 GAS
ccaucaaaaaaag

SEQ ID NO: 4114373 - RNA, 22 nt, Streptococcus pyogenes M1 GAS
ccaucaagacacccccugcugu

SEQ ID NO: 4114374 - RNA, 19 nt, Streptococcus pyogenes M1 GAS
ccaucaggcuuaaacauau

SEQ ID NO: 4114375 - RNA, 23 nt, Streptococcus pyogenes M1 GAS
ccaucggaacagcugaaacaccu

SEQ ID NO: 4114376 - RNA, 18 nt, Streptococcus pyogenes M1 GAS
ccaugauugauuuuagcg

SEQ ID NO: 4114377 - RNA, 23 nt, Streptococcus pyogenes M1 GAS
ccaugauuuucaucgugacaaca

SEQ ID NO: 4114378 - RNA, 19 nt, Streptococcus pyogenes M1 GAS
ccauggguaaaaugacuga

SEQ ID NO: 4114379 - RNA, 15 nt, Streptococcus pyogenes M1 GAS
ccauuaauaauauua

SEQ ID NO: 4114380 - RNA, 13 nt, Streptococcus pyogenes M1 GAS
ccauuauaaaaga

SEQ ID NO: 4114381 - RNA, 16 nt, Streptococcus pyogenes M1 GAS
ccauuauaaaucuuac

SEQ ID NO: 4114382 - RNA, 16 nt, Streptococcus pyogenes M1 GAS
ccauuuccuacaaaau

SEQ ID NO: 4114383 - RNA, 22 nt, Streptococcus pyogenes M1 GAS
ccauuucuuugcaaaagaaaac

SEQ ID NO: 4114384 - RNA, 17 nt, Streptococcus pyogenes M1 GAS
cccagcagcaaaggcga

SEQ ID NO: 4114385 - RNA, 15 nt, Streptococcus pyogenes M1 GAS
cccaucaagacaccc

SEQ ID NO: 4114386 - RNA, 11 nt, Streptococcus pyogenes M1 GAS
ccccacaaaag

SEQ ID NO: 4114387 - RNA, 18 nt, Streptococcus pyogenes M1 GAS
ccccuauucaauauuuua

SEQ ID NO: 4114388 - RNA, 18 nt, Streptococcus pyogenes M1 GAS
cccgucuuacaauuaaua

SEQ ID NO: 4114389 - RNA, 17 nt, Streptococcus pyogenes M1 GAS
cccguuagucugcugcu

SEQ ID NO: 4114390 - RNA, 16 nt, Streptococcus pyogenes M1 GAS
cccuaaacuaauaaga

SEQ ID NO: 4114391 - RNA, 21 nt, Streptococcus pyogenes M1 GAS
cccuaaacuaauaagauucaa

SEQ ID NO: 4114392 - RNA, 14 nt, Streptococcus pyogenes M1 GAS
cccuaucacaugca

SEQ ID NO: 4114393 - RNA, 15 nt, Streptococcus pyogenes M1 GAS
cccuaucacaugcau

SEQ ID NO: 4114394 - RNA, 18 nt, Streptococcus pyogenes M1 GAS
cccuuuuuugacacagau

SEQ ID NO: 4114395 - RNA, 21 nt, Streptococcus pyogenes M1 GAS
cccuuuuuugacacagaugcg

SEQ ID NO: 4114396 - RNA, 13 nt, Streptococcus pyogenes M1 GAS
ccgaaaaaaacuu

SEQ ID NO: 4114397 - RNA, 17 nt, Streptococcus pyogenes M1 GAS
ccgcuauaacaguucca

SEQ ID NO: 4114398 - RNA, 15 nt, Streptococcus pyogenes M1 GAS
ccggcucuaaaauau

SEQ ID NO: 4114399 - RNA, 18 nt, Streptococcus pyogenes M1 GAS
ccgguucguuauaaacaa

SEQ ID NO: 4114400 - RNA, 15 nt, Streptococcus pyogenes M1 GAS
ccguacaaucaggac

SEQ ID NO: 4114401 - RNA, 16 nt, Streptococcus pyogenes M1 GAS
ccgucuggaaggcaca

SEQ ID NO: 4114402 - RNA, 21 nt, Streptococcus pyogenes M1 GAS
ccguuugagauaacucuucgg

SEQ ID NO: 4114403 - RNA, 14 nt, Streptococcus pyogenes M1 GAS
ccuaaaaaauaacu

SEQ ID NO: 4114404 - RNA, 22 nt, Streptococcus pyogenes M1 GAS
ccuaaauccuuuugaaaaauua

SEQ ID NO: 4114405 - RNA, 11 nt, Streptococcus pyogenes M1 GAS
ccuaacaaaau

SEQ ID NO: 4114406 - RNA, 14 nt, Streptococcus pyogenes M1 GAS
ccuaacaauuuuuc

SEQ ID NO: 4114407 - RNA, 16 nt, Streptococcus pyogenes M1 GAS
ccuaacaauuuuucaa

SEQ ID NO: 4114408 - RNA, 11 nt, Streptococcus pyogenes M1 GAS
ccuaauguaac

SEQ ID NO: 4114409 - RNA, 18 nt, Streptococcus pyogenes M1 GAS
ccuaauuuaauuuacccc

SEQ ID NO: 4114410 - RNA, 19 nt, Streptococcus pyogenes M1 GAS
ccuacgauaaaacaaauaa

SEQ ID NO: 4114411 - RNA, 13 nt, Streptococcus pyogenes M1 GAS
ccuauagaaaguu

SEQ ID NO: 4114412 - RNA, 21 nt, Streptococcus pyogenes M1 GAS
ccuauagaaaguuauaaagaa

SEQ ID NO: 4114413 - RNA, 19 nt, Streptococcus pyogenes M1 GAS
ccuaucauaggguucacuu

SEQ ID NO: 4114414 - RNA, 16 nt, Streptococcus pyogenes M1 GAS
ccuaugaucuguuuaa

SEQ ID NO: 4114415 - RNA, 19 nt, Streptococcus pyogenes M1 GAS
ccuaugcuaacugauaaaa

SEQ ID NO: 4114416 - RNA, 19 nt, Streptococcus pyogenes M1 GAS
ccuauugagucuuuuccua

SEQ ID NO: 4114417 - RNA, 22 nt, Streptococcus pyogenes M1 GAS
cuaaucuaggacuaaccccuaa

SEQ ID NO: 4114418 - RNA, 17 nt, Streptococcus pyogenes M1 GAS
cuaauggugucgcuuuu

SEQ ID NO: 4114419 - RNA, 18 nt, Streptococcus pyogenes M1 GAS
cuaauuagcauauuuuga

SEQ ID NO: 4114420 - RNA, 16 nt, Streptococcus pyogenes M1 GAS
cuaauugugagaaacu

SEQ ID NO: 4114421 - RNA, 17 nt, Streptococcus pyogenes M1 GAS
cuaauuuagucauuucu

SEQ ID NO: 4114422 - RNA, 18 nt, Streptococcus pyogenes M1 GAS
cuaauuuagucauuucuu

SEQ ID NO: 4114423 - RNA, 14 nt, Streptococcus pyogenes M1 GAS
cuacacaaaagcuu

SEQ ID NO: 4114424 - RNA, 21 nt, Streptococcus pyogenes M1 GAS
cuacacguuccaugauugauu

SEQ ID NO: 4114425 - RNA, 17 nt, Streptococcus pyogenes M1 GAS
cuacacuugauuucauu

SEQ ID NO: 4114426 - RNA, 16 nt, Streptococcus pyogenes M1 GAS
cuacagacaagucuug

SEQ ID NO: 4114427 - RNA, 14 nt, Streptococcus pyogenes M1 GAS
cuacagcaccuuca

SEQ ID NO: 4114428 - RNA, 20 nt, Streptococcus pyogenes M1 GAS
cuacauugggccccauggcg

SEQ ID NO: 4114429 - RNA, 13 nt, Streptococcus pyogenes M1 GAS
cuacuaaaaaagg

SEQ ID NO: 4114430 - RNA, 15 nt, Streptococcus pyogenes M1 GAS
cuacuaggcuuucau

SEQ ID NO: 4114431 - RNA, 23 nt, Streptococcus pyogenes M1 GAS
cuacuugucaugaugguuucacg

SEQ ID NO: 4114432 - RNA, 12 nt, Streptococcus pyogenes M1 GAS
cuagaaaaagca

SEQ ID NO: 4114433 - RNA, 13 nt, Streptococcus pyogenes M1 GAS
cuagaaaaagcaa

SEQ ID NO: 4114434 - RNA, 14 nt, Streptococcus pyogenes M1 GAS
cuagaaaaagcaau

SEQ ID NO: 4114435 - RNA, 14 nt, Streptococcus pyogenes M1 GAS
cuagaacagauuga

SEQ ID NO: 4114436 - RNA, 13 nt, Streptococcus pyogenes M1 GAS
cuagcgggaacac

SEQ ID NO: 4114437 - RNA, 21 nt, Streptococcus pyogenes M1 GAS
cuagcucuuuaucaccuguca

SEQ ID NO: 4114438 - RNA, 18 nt, Streptococcus pyogenes M1 GAS
cuagcuuugucaacucga

SEQ ID NO: 4114439 - RNA, 21 nt, Streptococcus pyogenes M1 GAS
cuagcuuuuuacaucaaaaaa

SEQ ID NO: 4114440 - RNA, 22 nt, Streptococcus pyogenes M1 GAS
cuaggacuaaccccuaaucaga

SEQ ID NO: 4114441 - RNA, 20 nt, Streptococcus pyogenes M1 GAS
cuaggcguauaggugaguuu

SEQ ID NO: 4114442 - RNA, 19 nt, Streptococcus pyogenes M1 GAS
cuagggauccugcuaguau

SEQ ID NO: 4114443 - RNA, 17 nt, Streptococcus pyogenes M1 GAS
cuagguuaaaauagaag

SEQ ID NO: 4114444 - RNA, 16 nt, Streptococcus pyogenes M1 GAS
cuaguaaguuuuuuug

SEQ ID NO: 4114445 - RNA, 17 nt, Streptococcus pyogenes M1 GAS
cuaguacaguauguaaa

SEQ ID NO: 4114446 - RNA, 23 nt, Streptococcus pyogenes M1 GAS
cuaguacaguauguaaauauaaa

SEQ ID NO: 4114447 - RNA, 21 nt, Streptococcus pyogenes M1 GAS
cuaguuaagcuugcuaagaga

SEQ ID NO: 4114448 - RNA, 14 nt, Streptococcus pyogenes M1 GAS
cuaguuuaggauau

SEQ ID NO: 4114449 - RNA, 14 nt, Streptococcus pyogenes M1 GAS
cuauaacaguucca

SEQ ID NO: 4114450 - RNA, 22 nt, Streptococcus pyogenes M1 GAS
cuauaaggagauaggaaacuca

SEQ ID NO: 4114451 - RNA, 15 nt, Streptococcus pyogenes M1 GAS
cuauaauuucaauaa

SEQ ID NO: 4114452 - RNA, 16 nt, Streptococcus pyogenes M1 GAS
cuauagaaaguaaaaa

SEQ ID NO: 4114453 - RNA, 18 nt, Streptococcus pyogenes M1 GAS
cuauagcauuaaggauua

SEQ ID NO: 4114454 - RNA, 13 nt, Streptococcus pyogenes M1 GAS
cuauauuguuagu

SEQ ID NO: 4114455 - RNA, 13 nt, Streptococcus pyogenes M1 GAS
cuaucaaagcuga

SEQ ID NO: 4114456 - RNA, 17 nt, Streptococcus pyogenes M1 GAS
cuaucaaguaugcuuuu

SEQ ID NO: 4114457 - RNA, 16 nt, Streptococcus pyogenes M1 GAS
cuaucacgccaguaaa

SEQ ID NO: 4114458 - RNA, 22 nt, Streptococcus pyogenes M1 GAS
cuaucauggagucaaugaaaag

SEQ ID NO: 4114459 - RNA, 21 nt, Streptococcus pyogenes M1 GAS
cuaucgcucagaauaaagaaa

SEQ ID NO: 4114460 - RNA, 19 nt, Streptococcus pyogenes M1 GAS
cuaucucguaauccuugau

SEQ ID NO: 4114461 - RNA, 15 nt, Streptococcus pyogenes M1 GAS
cuaugaaaaaagaac

SEQ ID NO: 4114462 - RNA, 20 nt, Streptococcus pyogenes M1 GAS
cuaugaucuguuuaaaaaca

SEQ ID NO: 4114463 - RNA, 22 nt, Streptococcus pyogenes M1 GAS
cuaugcuaacugauaaaacuca

SEQ ID NO: 4114464 - RNA, 17 nt, Streptococcus pyogenes M1 GAS
cuauggcuucuaaaaaa

SEQ ID NO: 4114465 - RNA, 16 nt, Streptococcus pyogenes M1 GAS
cuauugacuugguucu

SEQ ID NO: 4114466 - RNA, 21 nt, Streptococcus pyogenes M1 GAS
cuauuuaauaggcuuuuuuug

SEQ ID NO: 4114467 - RNA, 16 nt, Streptococcus pyogenes M1 GAS
cuauuucacuuaucau

SEQ ID NO: 4114468 - RNA, 22 nt, Streptococcus pyogenes M1 GAS
cuauuucagcuagacuauaaaa

SEQ ID NO: 4114469 - RNA, 15 nt, Streptococcus pyogenes M1 GAS
cuauuuuuccuuggc

SEQ ID NO: 4114470 - RNA, 12 nt, Streptococcus pyogenes M1 GAS
cucaaaaaauac

SEQ ID NO: 4114471 - RNA, 20 nt, Streptococcus pyogenes M1 GAS
cucaaaaauauauucuaauu

SEQ ID NO: 4114472 - RNA, 22 nt, Streptococcus pyogenes M1 GAS
cucaacaguauaacuguuuuuc

SEQ ID NO: 4114473 - RNA, 14 nt, Streptococcus pyogenes M1 GAS
cucaauagcugcug

SEQ ID NO: 4114474 - RNA, 13 nt, Streptococcus pyogenes M1 GAS
cucaauauaauaa

SEQ ID NO: 4114475 - RNA, 16 nt, Streptococcus pyogenes M1 GAS
cucaaucaucaggguu

SEQ ID NO: 4114476 - RNA, 16 nt, Streptococcus pyogenes M1 GAS
cucaauuuuugauuuu

SEQ ID NO: 4114477 - RNA, 20 nt, Streptococcus pyogenes M1 GAS
cucacuaggccuagcuuuuu

SEQ ID NO: 4114478 - RNA, 23 nt, Streptococcus pyogenes M1 GAS
cucacuaggccuagcuuuuuaca

SEQ ID NO: 4114479 - RNA, 17 nt, Streptococcus pyogenes M1 GAS
cucagaauaaagaaaaa

SEQ ID NO: 4114480 - RNA, 22 nt, Streptococcus pyogenes M1 GAS
cucagagcuuuuuuuguuuugg

SEQ ID NO: 4114481 - RNA, 20 nt, Streptococcus pyogenes M1 GAS
cucagcaaguugaaggacag

SEQ ID NO: 4114482 - RNA, 18 nt, Streptococcus pyogenes M1 GAS
cucaguucugagauauuc

SEQ ID NO: 4114483 - RNA, 16 nt, Streptococcus pyogenes M1 GAS
cucauaaaacugugcu

SEQ ID NO: 4114484 - RNA, 23 nt, Streptococcus pyogenes M1 GAS
cucauaaaauuccccacaaaaga

SEQ ID NO: 4114485 - RNA, 15 nt, Streptococcus pyogenes M1 GAS
cucauaacaaauuua

SEQ ID NO: 4114486 - RNA, 19 nt, Streptococcus pyogenes M1 GAS
cucauaacaaauuuauccu

SEQ ID NO: 4114487 - RNA, 13 nt, Streptococcus pyogenes M1 GAS
cucaucuaaaaaa

SEQ ID NO: 4114488 - RNA, 14 nt, Streptococcus pyogenes M1 GAS
cucaucuaaaaaag

SEQ ID NO: 4114489 - RNA, 19 nt, Streptococcus pyogenes M1 GAS
cucaucuggguagagauag

SEQ ID NO: 4114490 - RNA, 16 nt, Streptococcus pyogenes M1 GAS
cuccaaaguucuucua

SEQ ID NO: 4114491 - RNA, 20 nt, Streptococcus pyogenes M1 GAS
cuccgacaaucgaaaugaua

SEQ ID NO: 4114492 - RNA, 17 nt, Streptococcus pyogenes M1 GAS
cuccguuucuaguuuca

SEQ ID NO: 4114493 - RNA, 14 nt, Streptococcus pyogenes M1 GAS
cuccuaaaacaugu

SEQ ID NO: 4114494 - RNA, 20 nt, Streptococcus pyogenes M1 GAS
cuccuagacugugaaaguau

SEQ ID NO: 4114495 - RNA, 13 nt, Streptococcus pyogenes M1 GAS
cuccuccaccaaa

SEQ ID NO: 4114496 - RNA, 13 nt, Streptococcus pyogenes M1 GAS
cucgacaaaggcu

SEQ ID NO: 4114497 - RNA, 15 nt, Streptococcus pyogenes M1 GAS
cucgguuuuuuuaag

SEQ ID NO: 4114498 - RNA, 17 nt, Streptococcus pyogenes M1 GAS
cucuaacauguccaaau

SEQ ID NO: 4114499 - RNA, 21 nt, Streptococcus pyogenes M1 GAS
cucuaacauguccaaaucgua

SEQ ID NO: 4114500 - RNA, 15 nt, Streptococcus pyogenes M1 GAS
cucuauccauuaucg

SEQ ID NO: 4114501 - RNA, 22 nt, Streptococcus pyogenes M1 GAS
cucuauuugaaguaaaggauuu

SEQ ID NO: 4114502 - RNA, 17 nt, Streptococcus pyogenes M1 GAS
cucucaugggcaaauaa

SEQ ID NO: 4114503 - RNA, 14 nt, Streptococcus pyogenes M1 GAS
cucuccaaaguucu

SEQ ID NO: 4114504 - RNA, 22 nt, Streptococcus pyogenes M1 GAS
cucuugcaaggugcuuuuuuug

SEQ ID NO: 4114505 - RNA, 14 nt, Streptococcus pyogenes M1 GAS
cucuuuaccauuua

SEQ ID NO: 4114506 - RNA, 13 nt, Streptococcus pyogenes M1 GAS
cucuuuugugauu

SEQ ID NO: 4114507 - RNA, 16 nt, Streptococcus pyogenes M1 GAS
cugaaaaugcauuaca

SEQ ID NO: 4114508 - RNA, 21 nt, Streptococcus pyogenes M1 GAS
cugaaaaugcauuacauuuaa

SEQ ID NO: 4114509 - RNA, 17 nt, Streptococcus pyogenes M1 GAS
cugaaacaccugcugcu

SEQ ID NO: 4114510 - RNA, 19 nt, Streptococcus pyogenes M1 GAS
cugaaacaccugcugcucc

SEQ ID NO: 4114511 - RNA, 15 nt, Streptococcus pyogenes M1 GAS
cugacaaaaaaagca

SEQ ID NO: 4114512 - RNA, 20 nt, Streptococcus pyogenes M1 GAS
cugacaaaacuucaaauuuc

SEQ ID NO: 4114513 - RNA, 22 nt, Streptococcus pyogenes M1 GAS
cugacgauaagucaguuuuuuc

SEQ ID NO: 4114514 - RNA, 12 nt, Streptococcus pyogenes M1 GAS
cugacuuaaauu

SEQ ID NO: 4114515 - RNA, 17 nt, Streptococcus pyogenes M1 GAS
cugacuuaaauuuggag

SEQ ID NO: 4114516 - RNA, 17 nt, Streptococcus pyogenes M1 GAS
cugagauauucauuuuc

SEQ ID NO: 4114517 - RNA, 20 nt, Streptococcus pyogenes M1 GAS
cuugccuuuauauuuaugga

SEQ ID NO: 4114518 - RNA, 19 nt, Streptococcus pyogenes M1 GAS
cuugcguagacagcaagga

SEQ ID NO: 4114519 - RNA, 17 nt, Streptococcus pyogenes M1 GAS
cuugcuaaaauuucuga

SEQ ID NO: 4114520 - RNA, 15 nt, Streptococcus pyogenes M1 GAS
cuugcucuuguuuuc

SEQ ID NO: 4114521 - RNA, 20 nt, Streptococcus pyogenes M1 GAS
cuugcucuuguuuucucaac

SEQ ID NO: 4114522 - RNA, 13 nt, Streptococcus pyogenes M1 GAS
cuuggaaaacaga

SEQ ID NO: 4114523 - RNA, 21 nt, Streptococcus pyogenes M1 GAS
cuuggacgaaggcucuuaucu

SEQ ID NO: 4114524 - RNA, 21 nt, Streptococcus pyogenes M1 GAS
cuugguucugaaaauaaaaua

SEQ ID NO: 4114525 - RNA, 22 nt, Streptococcus pyogenes M1 GAS
cuuguccacgccgaagauguca

SEQ ID NO: 4114526 - RNA, 14 nt, Streptococcus pyogenes M1 GAS
cuugucuuuuuuug

SEQ ID NO: 4114527 - RNA, 19 nt, Streptococcus pyogenes M1 GAS
cuugucuuuuuuuggccuc

SEQ ID NO: 4114528 - RNA, 14 nt, Streptococcus pyogenes M1 GAS
cuuguuacaaaaaa

SEQ ID NO: 4114529 - RNA, 23 nt, Streptococcus pyogenes M1 GAS
cuuuaacaaugagaucuucuuuu

SEQ ID NO: 4114530 - RNA, 17 nt, Streptococcus pyogenes M1 GAS
cuuuacuguaauauuuc

SEQ ID NO: 4114531 - RNA, 16 nt, Streptococcus pyogenes M1 GAS
cuuuagcaauuguuuu

SEQ ID NO: 4114532 - RNA, 19 nt, Streptococcus pyogenes M1 GAS
cuuuagcaauuguuuuuuc

SEQ ID NO: 4114533 - RNA, 16 nt, Streptococcus pyogenes M1 GAS
cuuuaggaucauuauc

SEQ ID NO: 4114534 - RNA, 15 nt, Streptococcus pyogenes M1 GAS
cuuuaguugcuucuu

SEQ ID NO: 4114535 - RNA, 17 nt, Streptococcus pyogenes M1 GAS
cuuuaguugcuucuuuu

SEQ ID NO: 4114536 - RNA, 16 nt, Streptococcus pyogenes M1 GAS
cuuuauccauucuuua

SEQ ID NO: 4114537 - RNA, 17 nt, Streptococcus pyogenes M1 GAS
cuuuauccauucuuuau

SEQ ID NO: 4114538 - RNA, 17 nt, Streptococcus pyogenes M1 GAS
cuuuauuaaucaaaaaa

SEQ ID NO: 4114539 - RNA, 11 nt, Streptococcus pyogenes M1 GAS
cuuuauugaug

SEQ ID NO: 4114540 - RNA, 18 nt, Streptococcus pyogenes M1 GAS
cuuuauuuugauauuuuu

SEQ ID NO: 4114541 - RNA, 20 nt, Streptococcus pyogenes M1 GAS
cuuuauuuugauauuuuuuc

SEQ ID NO: 4114542 - RNA, 20 nt, Streptococcus pyogenes M1 GAS
cuuucaauugauuugcagag

SEQ ID NO: 4114543 - RNA, 14 nt, Streptococcus pyogenes M1 GAS
cuuucaguuguuuu

SEQ ID NO: 4114544 - RNA, 17 nt, Streptococcus pyogenes M1 GAS
cuuucauuagcuuuuuu

SEQ ID NO: 4114545 - RNA, 18 nt, Streptococcus pyogenes M1 GAS
cuuucauuagcuuuuuuu

SEQ ID NO: 4114546 - RNA, 22 nt, Streptococcus pyogenes M1 GAS
cuuucguaaggguuauuauuua

SEQ ID NO: 4114547 - RNA, 19 nt, Streptococcus pyogenes M1 GAS
cuuugacaaugucaauuga

SEQ ID NO: 4114548 - RNA, 21 nt, Streptococcus pyogenes M1 GAS
cuuugacagacaccaaaaaaa

SEQ ID NO: 4114549 - RNA, 18 nt, Streptococcus pyogenes M1 GAS
cuuugauuuuucuuguuu

SEQ ID NO: 4114550 - RNA, 19 nt, Streptococcus pyogenes M1 GAS
cuuugcaggguaucugcuc

SEQ ID NO: 4114551 - RNA, 14 nt, Streptococcus pyogenes M1 GAS
cuuugccuuuagca

SEQ ID NO: 4114552 - RNA, 17 nt, Streptococcus pyogenes M1 GAS
cuuuggagaaauucaaa

SEQ ID NO: 4114553 - RNA, 15 nt, Streptococcus pyogenes M1 GAS
cuuugguauucuuuu

SEQ ID NO: 4114554 - RNA, 15 nt, Streptococcus pyogenes M1 GAS
cuuuguccauuuuuu

SEQ ID NO: 4114555 - RNA, 13 nt, Streptococcus pyogenes M1 GAS
cuuuguugcauug

SEQ ID NO: 4114556 - RNA, 12 nt, Streptococcus pyogenes M1 GAS
cuuuuaaaaucu

SEQ ID NO: 4114557 - RNA, 13 nt, Streptococcus pyogenes M1 GAS
cuuuuaaaaucug

SEQ ID NO: 4114558 - RNA, 19 nt, Streptococcus pyogenes M1 GAS
cuuuugaccuacuagcaca

SEQ ID NO: 4114559 - RNA, 22 nt, Streptococcus pyogenes M1 GAS
cuuuugaccuacuagcacaaaa

SEQ ID NO: 4114560 - RNA, 17 nt, Streptococcus pyogenes M1 GAS
cuuuugacuugguuuaa

SEQ ID NO: 4114561 - RNA, 22 nt, Streptococcus pyogenes M1 GAS
cuuuuggaccacucgugcugcc

SEQ ID NO: 4114562 - RNA, 22 nt, Streptococcus pyogenes M1 GAS
cuuuuuaaagagccucaggaca

SEQ ID NO: 4114563 - RNA, 22 nt, Streptococcus pyogenes M1 GAS
cuuuuuacaucaaaaaaagcaa

SEQ ID NO: 4114564 - RNA, 17 nt, Streptococcus pyogenes M1 GAS
cuuuuuccguuugagau

SEQ ID NO: 4114565 - RNA, 13 nt, Streptococcus pyogenes M1 GAS
cuuuuucuuuucu

SEQ ID NO: 4114566 - RNA, 20 nt, Streptococcus pyogenes M1 GAS
cuuuuugaauugaaaaaaga

SEQ ID NO: 4114567 - RNA, 18 nt, Streptococcus pyogenes M1 GAS
cuuuuugccuuuaacaug

SEQ ID NO: 4114568 - RNA, 17 nt, Streptococcus pyogenes M1 GAS
cuuuuuuacuuuuaaaa

SEQ ID NO: 4114569 - RNA, 19 nt, Streptococcus pyogenes M1 GAS
cuuuuuuauaauuauuuug

SEQ ID NO: 4114570 - RNA, 16 nt, Streptococcus pyogenes M1 GAS
cuuuuuugagcaucag

SEQ ID NO: 4114571 - RNA, 19 nt, Streptococcus pyogenes M1 GAS
cuuuuuuugucguuuuuug

SEQ ID NO: 4114572 - RNA, 20 nt, Streptococcus pyogenes M1 GAS
cuuuuuuugucugacuuaaa

SEQ ID NO: 4114573 - RNA, 14 nt, Streptococcus pyogenes M1 GAS
gaaaaaagaacaaa

SEQ ID NO: 4114574 - RNA, 14 nt, Streptococcus pyogenes M1 GAS
gaaaaagcaaugau

SEQ ID NO: 4114575 - RNA, 15 nt, Streptococcus pyogenes M1 GAS
gaaaaauucugauuc

SEQ ID NO: 4114576 - RNA, 11 nt, Streptococcus pyogenes M1 GAS
gaaaacagaaa

SEQ ID NO: 4114577 - RNA, 20 nt, Streptococcus pyogenes M1 GAS
gaaaagaugcacacaaaucu

SEQ ID NO: 4114578 - RNA, 16 nt, Streptococcus pyogenes M1 GAS
gaaaaggaauaucagg

SEQ ID NO: 4114579 - RNA, 16 nt, Streptococcus pyogenes M1 GAS
gaaaaguugauauccc

SEQ ID NO: 4114580 - RNA, 18 nt, Streptococcus pyogenes M1 GAS
gaaaauacauuguuuuuc

SEQ ID NO: 4114581 - RNA, 12 nt, Streptococcus pyogenes M1 GAS
gaaaauuaguuu

SEQ ID NO: 4114582 - RNA, 13 nt, Streptococcus pyogenes M1 GAS
gaaacaccaccaa

SEQ ID NO: 4114583 - RNA, 19 nt, Streptococcus pyogenes M1 GAS
gaaacaccaccaauaauga

SEQ ID NO: 4114584 - RNA, 22 nt, Streptococcus pyogenes M1 GAS
gaaacaccugcugcuccuauca

SEQ ID NO: 4114585 - RNA, 13 nt, Streptococcus pyogenes M1 GAS
gaaacuaaaggca

SEQ ID NO: 4114586 - RNA, 16 nt, Streptococcus pyogenes M1 GAS
gaaacugcacugagcc

SEQ ID NO: 4114587 - RNA, 17 nt, Streptococcus pyogenes M1 GAS
gaaacuggucaaaagcu

SEQ ID NO: 4114588 - RNA, 16 nt, Streptococcus pyogenes M1 GAS
gaaagauaguaaagaa

SEQ ID NO: 4114589 - RNA, 20 nt, Streptococcus pyogenes M1 GAS
gaaagccaagcuuuaaaauu

SEQ ID NO: 4114590 - RNA, 14 nt, Streptococcus pyogenes M1 GAS
gaaaguaaaaauac

SEQ ID NO: 4114591 - RNA, 23 nt, Streptococcus pyogenes M1 GAS
gaaaguuauagcuccuaaaacca

SEQ ID NO: 4114592 - RNA, 21 nt, Streptococcus pyogenes M1 GAS
gaaauacuccguuucuaguuu

SEQ ID NO: 4114593 - RNA, 16 nt, Streptococcus pyogenes M1 GAS
gaaaugauagcaccua

SEQ ID NO: 4114594 - RNA, 15 nt, Streptococcus pyogenes M1 GAS
gaaauuaauaaauuu

SEQ ID NO: 4114595 - RNA, 16 nt, Streptococcus pyogenes M1 GAS
gaaauucaaauacuuc

SEQ ID NO: 4114596 - RNA, 20 nt, Streptococcus pyogenes M1 GAS
gaaauugaccaaaagaauua

SEQ ID NO: 4114597 - RNA, 15 nt, Streptococcus pyogenes M1 GAS
gaacaccguuuuuug

SEQ ID NO: 4114598 - RNA, 23 nt, Streptococcus pyogenes M1 GAS
gaacaccguuuuuuguuguaaaa

SEQ ID NO: 4114599 - RNA, 18 nt, Streptococcus pyogenes M1 GAS
gaacagauugaagacaaa

SEQ ID NO: 4114600 - RNA, 20 nt, Streptococcus pyogenes M1 GAS
gaacagcugaaacaccugcu

SEQ ID NO: 4114601 - RNA, 12 nt, Streptococcus pyogenes M1 GAS
gaacagcugcuu

SEQ ID NO: 4114602 - RNA, 21 nt, Streptococcus pyogenes M1 GAS
gaaccaacuuggacgaaggcu

SEQ ID NO: 4114603 - RNA, 17 nt, Streptococcus pyogenes M1 GAS
gaacuccuggauuaaau

SEQ ID NO: 4114604 - RNA, 19 nt, Streptococcus pyogenes M1 GAS
gaacuccuggauuaaaugc

SEQ ID NO: 4114605 - RNA, 13 nt, Streptococcus pyogenes M1 GAS
gaacucgucuuua

SEQ ID NO: 4114606 - RNA, 14 nt, Streptococcus pyogenes M1 GAS
gaacucgucuuuau

SEQ ID NO: 4114607 - RNA, 23 nt, Streptococcus pyogenes M1 GAS
gaagaacagcauuuucaucauca

SEQ ID NO: 4114608 - RNA, 19 nt, Streptococcus pyogenes M1 GAS
gaagaugucauggauauua

SEQ ID NO: 4114609 - RNA, 15 nt, Streptococcus pyogenes M1 GAS
gaagcaaauucuucc

SEQ ID NO: 4114610 - RNA, 22 nt, Streptococcus pyogenes M1 GAS
gaagccgcucuaauuuagucau

SEQ ID NO: 4114611 - RNA, 18 nt, Streptococcus pyogenes M1 GAS
gaagccgugaggacuuau

SEQ ID NO: 4114612 - RNA, 15 nt, Streptococcus pyogenes M1 GAS
gaagcuguucucuuu

SEQ ID NO: 4114613 - RNA, 22 nt, Streptococcus pyogenes M1 GAS
gaaggaacucuccaaaguucuu

SEQ ID NO: 4114614 - RNA, 15 nt, Streptococcus pyogenes M1 GAS
gaaggcuuguucuuu

SEQ ID NO: 4114615 - RNA, 13 nt, Streptococcus pyogenes M1 GAS
gaagucucuuuug

SEQ ID NO: 4114616 - RNA, 15 nt, Streptococcus pyogenes M1 GAS
gaagucucuuuugug

SEQ ID NO: 4114617 - RNA, 16 nt, Streptococcus pyogenes M1 GAS
gaugccauuuaaaagg

SEQ ID NO: 4114618 - RNA, 15 nt, Streptococcus pyogenes M1 GAS
gaugcguuuauaaag

SEQ ID NO: 4114619 - RNA, 14 nt, Streptococcus pyogenes M1 GAS
gaugcuucuuucaa

SEQ ID NO: 4114620 - RNA, 19 nt, Streptococcus pyogenes M1 GAS
gauggacgucuucuuuuua

SEQ ID NO: 4114621 - RNA, 14 nt, Streptococcus pyogenes M1 GAS
gauguuuauuccaa

SEQ ID NO: 4114622 - RNA, 19 nt, Streptococcus pyogenes M1 GAS
gauguuuauuccaaacauc

SEQ ID NO: 4114623 - RNA, 20 nt, Streptococcus pyogenes M1 GAS
gauuaaacuuacaaaaagcc

SEQ ID NO: 4114624 - RNA, 15 nt, Streptococcus pyogenes M1 GAS
gauuacgauuaaaag

SEQ ID NO: 4114625 - RNA, 21 nt, Streptococcus pyogenes M1 GAS
gauuagaauccuccucuuuuu

SEQ ID NO: 4114626 - RNA, 15 nt, Streptococcus pyogenes M1 GAS
gauuauuauucuaaa

SEQ ID NO: 4114627 - RNA, 17 nt, Streptococcus pyogenes M1 GAS
gauuauucuuuauuuuu

SEQ ID NO: 4114628 - RNA, 13 nt, Streptococcus pyogenes M1 GAS
gauucaauaugaa

SEQ ID NO: 4114629 - RNA, 19 nt, Streptococcus pyogenes M1 GAS
gauugccauuuaauuggua

SEQ ID NO: 4114630 - RNA, 14 nt, Streptococcus pyogenes M1 GAS
gauugcuuccaacu

SEQ ID NO: 4114631 - RNA, 18 nt, Streptococcus pyogenes M1 GAS
gauuugccgcuacaccac

SEQ ID NO: 4114632 - RNA, 13 nt, Streptococcus pyogenes M1 GAS
gauuuguauuuuu

SEQ ID NO: 4114633 - RNA, 14 nt, Streptococcus pyogenes M1 GAS
gauuuguauuuuuu

SEQ ID NO: 4114634 - RNA, 15 nt, Streptococcus pyogenes M1 GAS
gauuugucaaaaagu

SEQ ID NO: 4114635 - RNA, 16 nt, Streptococcus pyogenes M1 GAS
gauuugucaaaaagua

SEQ ID NO: 4114636 - RNA, 15 nt, Streptococcus pyogenes M1 GAS
gauuuuaaauaucuu

SEQ ID NO: 4114637 - RNA, 15 nt, Streptococcus pyogenes M1 GAS
gauuuuggaugaaag

SEQ ID NO: 4114638 - RNA, 17 nt, Streptococcus pyogenes M1 GAS
gauuuuggaugaaagua

SEQ ID NO: 4114639 - RNA, 23 nt, Streptococcus pyogenes M1 GAS
gauuuuuccuagcgggaacacuc

SEQ ID NO: 4114640 - RNA, 13 nt, Streptococcus pyogenes M1 GAS
gcaaaacaauaac

SEQ ID NO: 4114641 - RNA, 18 nt, Streptococcus pyogenes M1 GAS
gcaaaauuauuauuuugc

SEQ ID NO: 4114642 - RNA, 20 nt, Streptococcus pyogenes M1 GAS
gcaaaggcgauuagcccaag

SEQ ID NO: 4114643 - RNA, 20 nt, Streptococcus pyogenes M1 GAS
gcaaauagcaauggcuaaaa

SEQ ID NO: 4114644 - RNA, 17 nt, Streptococcus pyogenes M1 GAS
gcaaauaguagcaaaua

SEQ ID NO: 4114645 - RNA, 19 nt, Streptococcus pyogenes M1 GAS
gcaaauaguucagauauuc

SEQ ID NO: 4114646 - RNA, 16 nt, Streptococcus pyogenes M1 GAS
gcaaauucuuccuuag

SEQ ID NO: 4114647 - RNA, 18 nt, Streptococcus pyogenes M1 GAS
gcaaauucuuccuuagca

SEQ ID NO: 4114648 - RNA, 17 nt, Streptococcus pyogenes M1 GAS
gcaacaucaaaaagagg

SEQ ID NO: 4114649 - RNA, 20 nt, Streptococcus pyogenes M1 GAS
gcaacaucaaaaagaggauu

SEQ ID NO: 4114650 - RNA, 13 nt, Streptococcus pyogenes M1 GAS
gcaagauaauauu

SEQ ID NO: 4114651 - RNA, 17 nt, Streptococcus pyogenes M1 GAS
gcaauaacaucuugauu

SEQ ID NO: 4114652 - RNA, 20 nt, Streptococcus pyogenes M1 GAS
gcaauaacaucuugauugua

SEQ ID NO: 4114653 - RNA, 15 nt, Streptococcus pyogenes M1 GAS
gcaauccaaaucaac

SEQ ID NO: 4114654 - RNA, 14 nt, Streptococcus pyogenes M1 GAS
gcaaucuucaacac

SEQ ID NO: 4114655 - RNA, 17 nt, Streptococcus pyogenes M1 GAS
gcaauggcuaaaaagag

SEQ ID NO: 4114656 - RNA, 18 nt, Streptococcus pyogenes M1 GAS
gcaauggcuaaaaagaga

SEQ ID NO: 4114657 - RNA, 20 nt, Streptococcus pyogenes M1 GAS
gcaauggcuaaaaagagagc

SEQ ID NO: 4114658 - RNA, 19 nt, Streptococcus pyogenes M1 GAS
gcacagcguaagccaaauc

SEQ ID NO: 4114659 - RNA, 20 nt, Streptococcus pyogenes M1 GAS
gcaccgacauacaaagcauc

SEQ ID NO: 4114660 - RNA, 15 nt, Streptococcus pyogenes M1 GAS
gcaccugaggcaaug

SEQ ID NO: 4114661 - RNA, 13 nt, Streptococcus pyogenes M1 GAS
gcaccuucaaccg

SEQ ID NO: 4114662 - RNA, 14 nt, Streptococcus pyogenes M1 GAS
gcaccuucuuuuag

SEQ ID NO: 4114663 - RNA, 17 nt, Streptococcus pyogenes M1 GAS
gcacuuuauuauaccaa

SEQ ID NO: 4114664 - RNA, 15 nt, Streptococcus pyogenes M1 GAS
gcagaauagaaauag

SEQ ID NO: 4114665 - RNA, 14 nt, Streptococcus pyogenes M1 GAS
gcagcuaaaagcau

SEQ ID NO: 4114666 - RNA, 13 nt, Streptococcus pyogenes M1 GAS
gcaggcguuuugu

SEQ ID NO: 4114667 - RNA, 15 nt, Streptococcus pyogenes M1 GAS
gcaggguaucugcuc

SEQ ID NO: 4114668 - RNA, 20 nt, Streptococcus pyogenes M1 GAS
gcagguaauuaucugaauua

SEQ ID NO: 4114669 - RNA, 20 nt, Streptococcus pyogenes M1 GAS
gcaguuauaauuaguauauu

SEQ ID NO: 4114670 - RNA, 17 nt, Streptococcus pyogenes M1 GAS
gcauaccugagccucca

SEQ ID NO: 4114671 - RNA, 20 nt, Streptococcus pyogenes M1 GAS
gcauaccugagccuccaaca

SEQ ID NO: 4114672 - RNA, 15 nt, Streptococcus pyogenes M1 GAS
gcauaggaucagugc

SEQ ID NO: 4114673 - RNA, 17 nt, Streptococcus pyogenes M1 GAS
gcaucacguacagaaau

SEQ ID NO: 4114674 - RNA, 15 nt, Streptococcus pyogenes M1 GAS
gcaucuacagcaccu

SEQ ID NO: 4114675 - RNA, 17 nt, Streptococcus pyogenes M1 GAS
gcaucuacagcaccuuc

SEQ ID NO: 4114676 - RNA, 21 nt, Streptococcus pyogenes M1 GAS
gcaucuacagcaccuucaacc

SEQ ID NO: 4114677 - RNA, 15 nt, Streptococcus pyogenes M1 GAS
gcaucuuugcagggu

SEQ ID NO: 4114678 - RNA, 23 nt, Streptococcus pyogenes M1 GAS
gcaucuuugcaggguaucugcuc

SEQ ID NO: 4114679 - RNA, 16 nt, Streptococcus pyogenes M1 GAS
gcauuaucaucugguc

SEQ ID NO: 4114680 - RNA, 16 nt, Streptococcus pyogenes M1 GAS
gcauugucaaauaaaa

SEQ ID NO: 4114681 - RNA, 16 nt, Streptococcus pyogenes M1 GAS
gcauuuucaucaucaa

SEQ ID NO: 4114682 - RNA, 17 nt, Streptococcus pyogenes M1 GAS
gcauuuugcaagucucu

SEQ ID NO: 4114683 - RNA, 14 nt, Streptococcus pyogenes M1 GAS
gccaaaucuggcuu

SEQ ID NO: 4114684 - RNA, 15 nt, Streptococcus pyogenes M1 GAS
gccaaaucuggcuua

SEQ ID NO: 4114685 - RNA, 23 nt, Streptococcus pyogenes M1 GAS
gccaauaacgccagcuacauugg

SEQ ID NO: 4114686 - RNA, 17 nt, Streptococcus pyogenes M1 GAS
gccaauuguucauuaaa

SEQ ID NO: 4114687 - RNA, 17 nt, Streptococcus pyogenes M1 GAS
gccaguaaggaaaucaa

SEQ ID NO: 4114688 - RNA, 14 nt, Streptococcus pyogenes M1 GAS
gccaucaaaaaaag

SEQ ID NO: 4114689 - RNA, 21 nt, Streptococcus pyogenes M1 GAS
gccaucaaaaaaagacacaca

SEQ ID NO: 4114690 - RNA, 16 nt, Streptococcus pyogenes M1 GAS
gccaucagcaucugaa

SEQ ID NO: 4114691 - RNA, 20 nt, Streptococcus pyogenes M1 GAS
gccaucugcuuggauuuccu

SEQ ID NO: 4114692 - RNA, 14 nt, Streptococcus pyogenes M1 GAS
gccauuuaaaaggg

SEQ ID NO: 4114693 - RNA, 14 nt, Streptococcus pyogenes M1 GAS
gccccauggcgugc

SEQ ID NO: 4114694 - RNA, 20 nt, Streptococcus pyogenes M1 GAS
gccccuuuuuugacacagau

SEQ ID NO: 4114695 - RNA, 23 nt, Streptococcus pyogenes M1 GAS
gccccuuuuuugacacagaugcg

SEQ ID NO: 4114696 - RNA, 19 nt, Streptococcus pyogenes M1 GAS
gcccucgcuaucaaagcug

SEQ ID NO: 4114697 - RNA, 23 nt, Streptococcus pyogenes M1 GAS
gccucuucugaugcguuuauaaa

SEQ ID NO: 4114698 - RNA, 17 nt, Streptococcus pyogenes M1 GAS
gccucuuggaaacaaga

SEQ ID NO: 4114699 - RNA, 23 nt, Streptococcus pyogenes M1 GAS
gccucuuggaaacaagagcucaa

SEQ ID NO: 4114700 - RNA, 15 nt, Streptococcus pyogenes M1 GAS
gccuucuaucaaaac

SEQ ID NO: 4114701 - RNA, 20 nt, Streptococcus pyogenes M1 GAS
gccuuuaacaugauguacca

SEQ ID NO: 4114702 - RNA, 21 nt, Streptococcus pyogenes M1 GAS
gcgaggcuuuuuugagcauca

SEQ ID NO: 4114703 - RNA, 20 nt, Streptococcus pyogenes M1 GAS
gcgcgacuaaaaucauggga

SEQ ID NO: 4114704 - RNA, 15 nt, Streptococcus pyogenes M1 GAS
gcguaagccaaaucu

SEQ ID NO: 4114705 - RNA, 23 nt, Streptococcus pyogenes M1 GAS
gcguagacagcaaggaugaaaug

SEQ ID NO: 4114706 - RNA, 20 nt, Streptococcus pyogenes M1 GAS
gcguuaucuccacagagucu

SEQ ID NO: 4114707 - RNA, 18 nt, Streptococcus pyogenes M1 GAS
gcuaaaaacaaugcucuu

SEQ ID NO: 4114708 - RNA, 14 nt, Streptococcus pyogenes M1 GAS
gcuaacugauaaaa

SEQ ID NO: 4114709 - RNA, 21 nt, Streptococcus pyogenes M1 GAS
gcuaagaauaacuaacagcaa

SEQ ID NO: 4114710 - RNA, 12 nt, Streptococcus pyogenes M1 GAS
gcuaagagaaua

SEQ ID NO: 4114711 - RNA, 18 nt, Streptococcus pyogenes M1 GAS
gcuaaguagauacuuugg

SEQ ID NO: 4114712 - RNA, 17 nt, Streptococcus pyogenes M1 GAS
gcuagaccucugcucac

SEQ ID NO: 4114713 - RNA, 24 nt, Streptococcus pyogenes M1 GAS
gcuagauugcuuccaacuccugau

SEQ ID NO: 4114714 - RNA, 17 nt, Streptococcus pyogenes M1 GAS
gcuagggcaacugcaau

SEQ ID NO: 4114715 - RNA, 15 nt, Streptococcus pyogenes M1 GAS
gcuauaacaguucca

SEQ ID NO: 4114716 - RNA, 18 nt, Streptococcus pyogenes M1 GAS
gcuauaacaguuccaguu

SEQ ID NO: 4114717 - RNA, 16 nt, Streptococcus pyogenes M1 GAS
guaauucagcaucguu

SEQ ID NO: 4114718 - RNA, 20 nt, Streptococcus pyogenes M1 GAS
guacaguauguaaauauaaa

SEQ ID NO: 4114719 - RNA, 19 nt, Streptococcus pyogenes M1 GAS
guacaugaccuuccccauc

SEQ ID NO: 4114720 - RNA, 17 nt, Streptococcus pyogenes M1 GAS
guacggucauuaauaaa

SEQ ID NO: 4114721 - RNA, 19 nt, Streptococcus pyogenes M1 GAS
guacucaucuaaaaaagca

SEQ ID NO: 4114722 - RNA, 15 nt, Streptococcus pyogenes M1 GAS
guagauguuguucua

SEQ ID NO: 4114723 - RNA, 21 nt, Streptococcus pyogenes M1 GAS
guauagacaaacagaaauacu

SEQ ID NO: 4114724 - RNA, 15 nt, Streptococcus pyogenes M1 GAS
guauagcauaaaaua

SEQ ID NO: 4114725 - RNA, 17 nt, Streptococcus pyogenes M1 GAS
guaucuaagcuauagaa

SEQ ID NO: 4114726 - RNA, 20 nt, Streptococcus pyogenes M1 GAS
guaucuaagcuauagaaacu

SEQ ID NO: 4114727 - RNA, 13 nt, Streptococcus pyogenes M1 GAS
guauguaaauaua

SEQ ID NO: 4114728 - RNA, 16 nt, Streptococcus pyogenes M1 GAS
guauuagcaccagcau

SEQ ID NO: 4114729 - RNA, 22 nt, Streptococcus pyogenes M1 GAS
guauucuaaaauccucuuuuaa

SEQ ID NO: 4114730 - RNA, 19 nt, Streptococcus pyogenes M1 GAS
gucaaaaaauuaagaagga

SEQ ID NO: 4114731 - RNA, 22 nt, Streptococcus pyogenes M1 GAS
gucaaaaaauuaagaaggaacu

SEQ ID NO: 4114732 - RNA, 18 nt, Streptococcus pyogenes M1 GAS
gucaaaaaguaaaaagca

SEQ ID NO: 4114733 - RNA, 17 nt, Streptococcus pyogenes M1 GAS
gucaaaagcuaaacuag

SEQ ID NO: 4114734 - RNA, 13 nt, Streptococcus pyogenes M1 GAS
gucaacuccaauc

SEQ ID NO: 4114735 - RNA, 19 nt, Streptococcus pyogenes M1 GAS
gucaacuuaccagcaccuu

SEQ ID NO: 4114736 - RNA, 20 nt, Streptococcus pyogenes M1 GAS
gucaacuuaccagcaccuuc

SEQ ID NO: 4114737 - RNA, 19 nt, Streptococcus pyogenes M1 GAS
gucaauacagccguucuua

SEQ ID NO: 4114738 - RNA, 19 nt, Streptococcus pyogenes M1 GAS
gucacugaaaaagccuuua

SEQ ID NO: 4114739 - RNA, 22 nt, Streptococcus pyogenes M1 GAS
gucaugaugccauuuaaaaggg

SEQ ID NO: 4114740 - RNA, 20 nt, Streptococcus pyogenes M1 GAS
gucauggcgccguuuuucaa

SEQ ID NO: 4114741 - RNA, 23 nt, Streptococcus pyogenes M1 GAS
gucauuucuucagguuucuuuug

SEQ ID NO: 4114742 - RNA, 18 nt, Streptococcus pyogenes M1 GAS
guccaucauugaugagac

SEQ ID NO: 4114743 - RNA, 13 nt, Streptococcus pyogenes M1 GAS
guccaugauuuuc

SEQ ID NO: 4114744 - RNA, 19 nt, Streptococcus pyogenes M1 GAS
gucccacaccuacuaacaa

SEQ ID NO: 4114745 - RNA, 18 nt, Streptococcus pyogenes M1 GAS
guccuaaccuuuuggcug

SEQ ID NO: 4114746 - RNA, 19 nt, Streptococcus pyogenes M1 GAS
guccuaaccuuuuggcugu

SEQ ID NO: 4114747 - RNA, 21 nt, Streptococcus pyogenes M1 GAS
guccuaaccuuuuggcuguau

SEQ ID NO: 4114748 - RNA, 14 nt, Streptococcus pyogenes M1 GAS
guccuccucuuuag

SEQ ID NO: 4114749 - RNA, 20 nt, Streptococcus pyogenes M1 GAS
gucgaaauugguccucugaa

SEQ ID NO: 4114750 - RNA, 21 nt, Streptococcus pyogenes M1 GAS
gucgcuuuuuuuauuucacua

SEQ ID NO: 4114751 - RNA, 13 nt, Streptococcus pyogenes M1 GAS
gucguuuuuugcu

SEQ ID NO: 4114752 - RNA, 14 nt, Streptococcus pyogenes M1 GAS
gucguuuuuugcuu

SEQ ID NO: 4114753 - RNA, 17 nt, Streptococcus pyogenes M1 GAS
gucuggaaacuggucaa

SEQ ID NO: 4114754 - RNA, 13 nt, Streptococcus pyogenes M1 GAS
gucugugaugaau

SEQ ID NO: 4114755 - RNA, 18 nt, Streptococcus pyogenes M1 GAS
gucuucuccgacugcagu

SEQ ID NO: 4114756 - RNA, 16 nt, Streptococcus pyogenes M1 GAS
gucuucuucuuuucag

SEQ ID NO: 4114757 - RNA, 12 nt, Streptococcus pyogenes M1 GAS
gucuuuaaaaaa

SEQ ID NO: 4114758 - RNA, 21 nt, Streptococcus pyogenes M1 GAS
gucuuuucuuuuuggcugaug

SEQ ID NO: 4114759 - RNA, 22 nt, Streptococcus pyogenes M1 GAS
gugaaaguaucuaggagggacu

SEQ ID NO: 4114760 - RNA, 14 nt, Streptococcus pyogenes M1 GAS
gugaauaaucuuca

SEQ ID NO: 4114761 - RNA, 14 nt, Streptococcus pyogenes M1 GAS
gugacaaugugaca

SEQ ID NO: 4114762 - RNA, 12 nt, Streptococcus pyogenes M1 GAS
gugaguauaaug

SEQ ID NO: 4114763 - RNA, 21 nt, Streptococcus pyogenes M1 GAS
gugaugaguaggcgaacuuua

SEQ ID NO: 4114764 - RNA, 21 nt, Streptococcus pyogenes M1 GAS
gugauguagggcuguaaaaug

SEQ ID NO: 4114765 - RNA, 24 nt, Streptococcus pyogenes M1 GAS
gugauguagggcuguaaaauguua

SEQ ID NO: 4114766 - RNA, 20 nt, Streptococcus pyogenes M1 GAS
gugauguucucauaaacaau

SEQ ID NO: 4114767 - RNA, 17 nt, Streptococcus pyogenes M1 GAS
gugauuaguuuuuagca

SEQ ID NO: 4114768 - RNA, 15 nt, Streptococcus pyogenes M1 GAS
gugcaccgacauaca

SEQ ID NO: 4114769 - RNA, 20 nt, Streptococcus pyogenes M1 GAS
gugcaccgacauacaaagca

SEQ ID NO: 4114770 - RNA, 14 nt, Streptococcus pyogenes M1 GAS
gugcuacugaugua

SEQ ID NO: 4114771 - RNA, 20 nt, Streptococcus pyogenes M1 GAS
gugcucauaaaacugugcuu

SEQ ID NO: 4114772 - RNA, 16 nt, Streptococcus pyogenes M1 GAS
guggcuaguaaguuuu

SEQ ID NO: 4114773 - RNA, 21 nt, Streptococcus pyogenes M1 GAS
guguaauccccucguuuaaau

SEQ ID NO: 4114774 - RNA, 18 nt, Streptococcus pyogenes M1 GAS
guguauucuuaaaaaaau

SEQ ID NO: 4114775 - RNA, 17 nt, Streptococcus pyogenes M1 GAS
guguucuagcuuuguca

SEQ ID NO: 4114776 - RNA, 20 nt, Streptococcus pyogenes M1 GAS
guguuggaggucugugauga

SEQ ID NO: 4114777 - RNA, 20 nt, Streptococcus pyogenes M1 GAS
guguuuaaagaccucucaug

SEQ ID NO: 4114778 - RNA, 13 nt, Streptococcus pyogenes M1 GAS
guuaaaauagaag

SEQ ID NO: 4114779 - RNA, 18 nt, Streptococcus pyogenes M1 GAS
guuaacaaaaauaaguau

SEQ ID NO: 4114780 - RNA, 20 nt, Streptococcus pyogenes M1 GAS
guuaacaaaaauaaguauag

SEQ ID NO: 4114781 - RNA, 12 nt, Streptococcus pyogenes M1 GAS
guuaacagguga

SEQ ID NO: 4114782 - RNA, 20 nt, Streptococcus pyogenes M1 GAS
guuaagcuugcuaagagaau

SEQ ID NO: 4114783 - RNA, 14 nt, Streptococcus pyogenes M1 GAS
guuacaaaaaacaa

SEQ ID NO: 4114784 - RNA, 15 nt, Streptococcus pyogenes M1 GAS
guuacccuugacgau

SEQ ID NO: 4114785 - RNA, 14 nt, Streptococcus pyogenes M1 GAS
guuagucugaauug

SEQ ID NO: 4114786 - RNA, 19 nt, Streptococcus pyogenes M1 GAS
guuauccucuuuuaguuca

SEQ ID NO: 4114787 - RNA, 16 nt, Streptococcus pyogenes M1 GAS
guuaucugauauuuca

SEQ ID NO: 4114788 - RNA, 14 nt, Streptococcus pyogenes M1 GAS
guuauguuauaaga

SEQ ID NO: 4114789 - RNA, 19 nt, Streptococcus pyogenes M1 GAS
guuauuaaagacaaaaaac

SEQ ID NO: 4114790 - RNA, 20 nt, Streptococcus pyogenes M1 GAS
guuauuuaugucuugcuaaa

SEQ ID NO: 4114791 - RNA, 12 nt, Streptococcus pyogenes M1 GAS
guuauuuuugag

SEQ ID NO: 4114792 - RNA, 20 nt, Streptococcus pyogenes M1 GAS
guucaggggguaaaaaaggg

SEQ ID NO: 4114793 - RNA, 12 nt, Streptococcus pyogenes M1 GAS
guucauuuagug

SEQ ID NO: 4114794 - RNA, 18 nt, Streptococcus pyogenes M1 GAS
guuccaugauugauuuua

SEQ ID NO: 4114795 - RNA, 21 nt, Streptococcus pyogenes M1 GAS
guuccuaugcuaacugauaaa

SEQ ID NO: 4114796 - RNA, 21 nt, Streptococcus pyogenes M1 GAS
guuccuuagcaguuauaauua

SEQ ID NO: 4114797 - RNA, 13 nt, Streptococcus pyogenes M1 GAS
guucguuauaaac

SEQ ID NO: 4114798 - RNA, 20 nt, Streptococcus pyogenes M1 GAS
guucuaguuuaggauauaag

SEQ ID NO: 4114799 - RNA, 18 nt, Streptococcus pyogenes M1 GAS
guucucuacuugucauga

SEQ ID NO: 4114800 - RNA, 15 nt, Streptococcus pyogenes M1 GAS
guucugaaaauaaaa

SEQ ID NO: 4114801 - RNA, 22 nt, Streptococcus pyogenes M1 GAS
guucugagauauucauuuucuu

SEQ ID NO: 4114802 - RNA, 20 nt, Streptococcus pyogenes M1 GAS
guucuuuauuuugauauuuu

SEQ ID NO: 4114803 - RNA, 19 nt, Streptococcus pyogenes M1 GAS
guugacuuugcaaaagaau

SEQ ID NO: 4114804 - RNA, 14 nt, Streptococcus pyogenes M1 GAS
guugauauaaaauu

SEQ ID NO: 4114805 - RNA, 16 nt, Streptococcus pyogenes M1 GAS
guugaugcaaauaguu

SEQ ID NO: 4114806 - RNA, 21 nt, Streptococcus pyogenes M1 GAS
guugcaagugacaaccuuaaa

SEQ ID NO: 4114807 - RNA, 19 nt, Streptococcus pyogenes M1 GAS
guugcuacaauuuuuucaa

SEQ ID NO: 4114808 - RNA, 13 nt, Streptococcus pyogenes M1 GAS
guugguaaaaagg

SEQ ID NO: 4114809 - RNA, 15 nt, Streptococcus pyogenes M1 GAS
guuguauuaugaggu

SEQ ID NO: 4114810 - RNA, 21 nt, Streptococcus pyogenes M1 GAS
guuuaaauguccgaaaaaaac

SEQ ID NO: 4114811 - RNA, 16 nt, Streptococcus pyogenes M1 GAS
guuuaacguaauaaaa

SEQ ID NO: 4114812 - RNA, 16 nt, Streptococcus pyogenes M1 GAS
guuuaggauauaagaa

SEQ ID NO: 4114813 - RNA, 20 nt, Streptococcus pyogenes M1 GAS
guuucacgauaagaagcuaa

SEQ ID NO: 4114814 - RNA, 14 nt, Streptococcus pyogenes M1 GAS
guuucgaaaaaggg

SEQ ID NO: 4114815 - RNA, 18 nt, Streptococcus pyogenes M1 GAS
guuucuaguuucauagaa

SEQ ID NO: 4114816 - RNA, 21 nt, Streptococcus pyogenes M1 GAS
guuucuugccuuuauauuuau

SEQ ID NO: 4114817 - RNA, 20 nt, Streptococcus pyogenes M1 GAS
uaacuuuaaaagggcugacc

SEQ ID NO: 4114818 - RNA, 16 nt, Streptococcus pyogenes M1 GAS
uaagaaauuacuugga

SEQ ID NO: 4114819 - RNA, 16 nt, Streptococcus pyogenes M1 GAS
uaagaagcuaaugucu

SEQ ID NO: 4114820 - RNA, 20 nt, Streptococcus pyogenes M1 GAS
uaagaaggaacucuccaaag

SEQ ID NO: 4114821 - RNA, 14 nt, Streptococcus pyogenes M1 GAS
uaagaccuucaaaa

SEQ ID NO: 4114822 - RNA, 23 nt, Streptococcus pyogenes M1 GAS
uaagagagguugguaaaaaggca

SEQ ID NO: 4114823 - RNA, 21 nt, Streptococcus pyogenes M1 GAS
uaagagcguuagcuuuuuaaa

SEQ ID NO: 4114824 - RNA, 16 nt, Streptococcus pyogenes M1 GAS
uaagauggugcuuuaa

SEQ ID NO: 4114825 - RNA, 22 nt, Streptococcus pyogenes M1 GAS
uaagauguuuacgcuuuacauu

SEQ ID NO: 4114826 - RNA, 20 nt, Streptococcus pyogenes M1 GAS
uaagauuaaacuuacaaaaa

SEQ ID NO: 4114827 - RNA, 20 nt, Streptococcus pyogenes M1 GAS
uaagauuugaccacaccuaa

SEQ ID NO: 4114828 - RNA, 15 nt, Streptococcus pyogenes M1 GAS
uaagcaaucaucauu

SEQ ID NO: 4114829 - RNA, 23 nt, Streptococcus pyogenes M1 GAS
uaagcagcaucacguacagaaau

SEQ ID NO: 4114830 - RNA, 15 nt, Streptococcus pyogenes M1 GAS
uaagcccuuaaucua

SEQ ID NO: 4114831 - RNA, 21 nt, Streptococcus pyogenes M1 GAS
uaagcuauagaaacuuuuuau

SEQ ID NO: 4114832 - RNA, 18 nt, Streptococcus pyogenes M1 GAS
uaagcugacgauaaguca

SEQ ID NO: 4114833 - RNA, 15 nt, Streptococcus pyogenes M1 GAS
uaaggaccaagauuc

SEQ ID NO: 4114834 - RNA, 17 nt, Streptococcus pyogenes M1 GAS
uaaggcugcgaugauuu

SEQ ID NO: 4114835 - RNA, 21 nt, Streptococcus pyogenes M1 GAS
uaagguacacgugauaaaugc

SEQ ID NO: 4114836 - RNA, 13 nt, Streptococcus pyogenes M1 GAS
uaaguaaaaggga

SEQ ID NO: 4114837 - RNA, 18 nt, Streptococcus pyogenes M1 GAS
uaaguaaaggauuuaguu

SEQ ID NO: 4114838 - RNA, 14 nt, Streptococcus pyogenes M1 GAS
uaaguaagauggug

SEQ ID NO: 4114839 - RNA, 15 nt, Streptococcus pyogenes M1 GAS
uaaguauucuaaaau

SEQ ID NO: 4114840 - RNA, 15 nt, Streptococcus pyogenes M1 GAS
uaagucaguuuuuuc

SEQ ID NO: 4114841 - RNA, 17 nt, Streptococcus pyogenes M1 GAS
uaagugagcgcccuaaa

SEQ ID NO: 4114842 - RNA, 15 nt, Streptococcus pyogenes M1 GAS
uaaguuuuuaucaua

SEQ ID NO: 4114843 - RNA, 15 nt, Streptococcus pyogenes M1 GAS
uaauaaacuguauac

SEQ ID NO: 4114844 - RNA, 19 nt, Streptococcus pyogenes M1 GAS
uaauaaacuguauacaaaa

SEQ ID NO: 4114845 - RNA, 15 nt, Streptococcus pyogenes M1 GAS
uaauaagauucaaua

SEQ ID NO: 4114846 - RNA, 18 nt, Streptococcus pyogenes M1 GAS
uaauaagauucaauauga

SEQ ID NO: 4114847 - RNA, 22 nt, Streptococcus pyogenes M1 GAS
uaauaagauucaauaugaaaac

SEQ ID NO: 4114848 - RNA, 17 nt, Streptococcus pyogenes M1 GAS
uaauaaguauucuaaaa

SEQ ID NO: 4114849 - RNA, 21 nt, Streptococcus pyogenes M1 GAS
uaauaaguauucuaaaauccu

SEQ ID NO: 4114850 - RNA, 16 nt, Streptococcus pyogenes M1 GAS
uaauacgagcuagggc

SEQ ID NO: 4114851 - RNA, 11 nt, Streptococcus pyogenes M1 GAS
uaauaguuuuc

SEQ ID NO: 4114852 - RNA, 21 nt, Streptococcus pyogenes M1 GAS
uaauaguuuuccauaauauca

SEQ ID NO: 4114853 - RNA, 23 nt, Streptococcus pyogenes M1 GAS
uaaucagaaagaagaaaauuagu

SEQ ID NO: 4114854 - RNA, 16 nt, Streptococcus pyogenes M1 GAS
uaauccaacaacgcua

SEQ ID NO: 4114855 - RNA, 14 nt, Streptococcus pyogenes M1 GAS
uaaucgaugauaau

SEQ ID NO: 4114856 - RNA, 15 nt, Streptococcus pyogenes M1 GAS
uaaucguaaugucuu

SEQ ID NO: 4114857 - RNA, 18 nt, Streptococcus pyogenes M1 GAS
uaaucguaaugucuuguu

SEQ ID NO: 4114858 - RNA, 20 nt, Streptococcus pyogenes M1 GAS
uaaucguaaugucuuguucu

SEQ ID NO: 4114859 - RNA, 15 nt, Streptococcus pyogenes M1 GAS
uaaugaccuuugaua

SEQ ID NO: 4114860 - RNA, 20 nt, Streptococcus pyogenes M1 GAS
uaaugagcaaggcaagagga

SEQ ID NO: 4114861 - RNA, 19 nt, Streptococcus pyogenes M1 GAS
uaaugccaucaaaaaaaga

SEQ ID NO: 4114862 - RNA, 18 nt, Streptococcus pyogenes M1 GAS
uaauguauuggaaaauac

SEQ ID NO: 4114863 - RNA, 20 nt, Streptococcus pyogenes M1 GAS
uaaugucuugggcgcugucu

SEQ ID NO: 4114864 - RNA, 15 nt, Streptococcus pyogenes M1 GAS
uaauuagcauauuuu

SEQ ID NO: 4114865 - RNA, 19 nt, Streptococcus pyogenes M1 GAS
uaauuagcauauuuugauu

SEQ ID NO: 4114866 - RNA, 15 nt, Streptococcus pyogenes M1 GAS
uaauuaguauauugu

SEQ ID NO: 4114867 - RNA, 11 nt, Streptococcus pyogenes M1 GAS
uaauuaucuga

SEQ ID NO: 4114868 - RNA, 13 nt, Streptococcus pyogenes M1 GAS
uaauuaucugaau

SEQ ID NO: 4114869 - RNA, 21 nt, Streptococcus pyogenes M1 GAS
uaauuauuuuaauuuuuccuu

SEQ ID NO: 4114870 - RNA, 19 nt, Streptococcus pyogenes M1 GAS
uaauuccugugacaaccca

SEQ ID NO: 4114871 - RNA, 10 nt, Streptococcus pyogenes M1 GAS
uaauuuacua

SEQ ID NO: 4114872 - RNA, 20 nt, Streptococcus pyogenes M1 GAS
uaauuucaauaauaccauuu

SEQ ID NO: 4114873 - RNA, 14 nt, Streptococcus pyogenes M1 GAS
uaauuucuugugcu

SEQ ID NO: 4114874 - RNA, 22 nt, Streptococcus pyogenes M1 GAS
uaauuuggaggugaaaauaucu

SEQ ID NO: 4114875 - RNA, 12 nt, Streptococcus pyogenes M1 GAS
uaauuuuuccuu

SEQ ID NO: 4114876 - RNA, 19 nt, Streptococcus pyogenes M1 GAS
uacaaaaaaccuuccugua

SEQ ID NO: 4114877 - RNA, 21 nt, Streptococcus pyogenes M1 GAS
uacaaaacugucuggaaacug

SEQ ID NO: 4114878 - RNA, 14 nt, Streptococcus pyogenes M1 GAS
uacaacccacauac

SEQ ID NO: 4114879 - RNA, 15 nt, Streptococcus pyogenes M1 GAS
uacaagagcuuaaaa

SEQ ID NO: 4114880 - RNA, 16 nt, Streptococcus pyogenes M1 GAS
uacaagagcuuaaaag

SEQ ID NO: 4114881 - RNA, 18 nt, Streptococcus pyogenes M1 GAS
uacaagagcuuaaaaguu

SEQ ID NO: 4114882 - RNA, 15 nt, Streptococcus pyogenes M1 GAS
uacaagcauuuugca

SEQ ID NO: 4114883 - RNA, 14 nt, Streptococcus pyogenes M1 GAS
uacaaggcaagcag

SEQ ID NO: 4114884 - RNA, 22 nt, Streptococcus pyogenes M1 GAS
uacaaucaggacagucuuuuuu

SEQ ID NO: 4114885 - RNA, 17 nt, Streptococcus pyogenes M1 GAS
uacaaucgguuuuagcu

SEQ ID NO: 4114886 - RNA, 16 nt, Streptococcus pyogenes M1 GAS
uacaccauuuauuaag

SEQ ID NO: 4114887 - RNA, 18 nt, Streptococcus pyogenes M1 GAS
uacacgugauaaaugccg

SEQ ID NO: 4114888 - RNA, 13 nt, Streptococcus pyogenes M1 GAS
uacacuugauuuc

SEQ ID NO: 4114889 - RNA, 16 nt, Streptococcus pyogenes M1 GAS
uacagcugguuuuuua

SEQ ID NO: 4114890 - RNA, 16 nt, Streptococcus pyogenes M1 GAS
uacaguauguaaauau

SEQ ID NO: 4114891 - RNA, 20 nt, Streptococcus pyogenes M1 GAS
uacaguugacaauaagcccu

SEQ ID NO: 4114892 - RNA, 13 nt, Streptococcus pyogenes M1 GAS
uacaucaaaaaaa

SEQ ID NO: 4114893 - RNA, 16 nt, Streptococcus pyogenes M1 GAS
uacaucaaaaaaagca

SEQ ID NO: 4114894 - RNA, 20 nt, Streptococcus pyogenes M1 GAS
uacaucaaaaaaagcaauga

SEQ ID NO: 4114895 - RNA, 21 nt, Streptococcus pyogenes M1 GAS
uacaucaaaaaaagcaaugac

SEQ ID NO: 4114896 - RNA, 12 nt, Streptococcus pyogenes M1 GAS
uacaucaacuau

SEQ ID NO: 4114897 - RNA, 14 nt, Streptococcus pyogenes M1 GAS
uacauugaauaaag

SEQ ID NO: 4114898 - RNA, 17 nt, Streptococcus pyogenes M1 GAS
uacauugaauaaaguga

SEQ ID NO: 4114899 - RNA, 23 nt, Streptococcus pyogenes M1 GAS
uaccauuuaugaggccaauaaug

SEQ ID NO: 4114900 - RNA, 16 nt, Streptococcus pyogenes M1 GAS
uaccauuucuuugcaa

SEQ ID NO: 4114901 - RNA, 13 nt, Streptococcus pyogenes M1 GAS
uaccccaaaggcu

SEQ ID NO: 4114902 - RNA, 18 nt, Streptococcus pyogenes M1 GAS
uaccccaaaggcugaugc

SEQ ID NO: 4114903 - RNA, 17 nt, Streptococcus pyogenes M1 GAS
uaccuaaaaaauaacuu

SEQ ID NO: 4114904 - RNA, 18 nt, Streptococcus pyogenes M1 GAS
uaccuauugagucuuuuc

SEQ ID NO: 4114905 - RNA, 17 nt, Streptococcus pyogenes M1 GAS
uaccuuauuuucuaggu

SEQ ID NO: 4114906 - RNA, 16 nt, Streptococcus pyogenes M1 GAS
uacgggauuuaguucu

SEQ ID NO: 4114907 - RNA, 16 nt, Streptococcus pyogenes M1 GAS
uacgguaaaaacucaa

SEQ ID NO: 4114908 - RNA, 20 nt, Streptococcus pyogenes M1 GAS
uacgguaaaaacucaaaaaa

SEQ ID NO: 4114909 - RNA, 14 nt, Streptococcus pyogenes M1 GAS
uacguaaaaagaga

SEQ ID NO: 4114910 - RNA, 14 nt, Streptococcus pyogenes M1 GAS
uacguuuauuuagu

SEQ ID NO: 4114911 - RNA, 15 nt, Streptococcus pyogenes M1 GAS
uacuaaaaaaggagc

SEQ ID NO: 4114912 - RNA, 13 nt, Streptococcus pyogenes M1 GAS
uacuagaaaaagc

SEQ ID NO: 4114913 - RNA, 17 nt, Streptococcus pyogenes M1 GAS
uacuagaaaaagcaaug

SEQ ID NO: 4114914 - RNA, 21 nt, Streptococcus pyogenes M1 GAS
uacuaggcuuucauuauagac

SEQ ID NO: 4114915 - RNA, 24 nt, Streptococcus pyogenes M1 GAS
uacuaguguguugucaaacauaac

SEQ ID NO: 4114916 - RNA, 18 nt, Streptococcus pyogenes M1 GAS
uacuauggcuucuaaaaa

SEQ ID NO: 4114917 - RNA, 20 nt, Streptococcus pyogenes M1 GAS
uauagguagaugauuacauu

SEQ ID NO: 4114918 - RNA, 23 nt, Streptococcus pyogenes M1 GAS
uauaguaaccauugccauuaaua

SEQ ID NO: 4114919 - RNA, 13 nt, Streptococcus pyogenes M1 GAS
uauaguuauguua

SEQ ID NO: 4114920 - RNA, 13 nt, Streptococcus pyogenes M1 GAS
uauaucuaugauu

SEQ ID NO: 4114921 - RNA, 16 nt, Streptococcus pyogenes M1 GAS
uauauguguaauuucu

SEQ ID NO: 4114922 - RNA, 17 nt, Streptococcus pyogenes M1 GAS
uauauugugcuauucaa

SEQ ID NO: 4114923 - RNA, 20 nt, Streptococcus pyogenes M1 GAS
uauauuuauggaguucuuga

SEQ ID NO: 4114924 - RNA, 20 nt, Streptococcus pyogenes M1 GAS
uaucaauaacagaaauuaau

SEQ ID NO: 4114925 - RNA, 18 nt, Streptococcus pyogenes M1 GAS
uaucaggcaaaacaaaaa

SEQ ID NO: 4114926 - RNA, 21 nt, Streptococcus pyogenes M1 GAS
uaucagucuguccaauaccua

SEQ ID NO: 4114927 - RNA, 18 nt, Streptococcus pyogenes M1 GAS
uaucauggagucaaugaa

SEQ ID NO: 4114928 - RNA, 18 nt, Streptococcus pyogenes M1 GAS
uauccaaugaaaacucca

SEQ ID NO: 4114929 - RNA, 14 nt, Streptococcus pyogenes M1 GAS
uaucccauaucucu

SEQ ID NO: 4114930 - RNA, 19 nt, Streptococcus pyogenes M1 GAS
uauccuccuaaauauaaau

SEQ ID NO: 4114931 - RNA, 13 nt, Streptococcus pyogenes M1 GAS
uauccucuuuuag

SEQ ID NO: 4114932 - RNA, 16 nt, Streptococcus pyogenes M1 GAS
uaucgccaauaaaaaa

SEQ ID NO: 4114933 - RNA, 18 nt, Streptococcus pyogenes M1 GAS
uaucgccaauaaaaaaga

SEQ ID NO: 4114934 - RNA, 17 nt, Streptococcus pyogenes M1 GAS
uaucuaagcuauagaaa

SEQ ID NO: 4114935 - RNA, 14 nt, Streptococcus pyogenes M1 GAS
uaucuagaacagcu

SEQ ID NO: 4114936 - RNA, 17 nt, Streptococcus pyogenes M1 GAS
uaucuaugauuuguauu

SEQ ID NO: 4114937 - RNA, 18 nt, Streptococcus pyogenes M1 GAS
uaucucauaacaaauuua

SEQ ID NO: 4114938 - RNA, 18 nt, Streptococcus pyogenes M1 GAS
uaucugauaagguuuuuu

SEQ ID NO: 4114939 - RNA, 23 nt, Streptococcus pyogenes M1 GAS
uaucugcagauuuuaagacaaca

SEQ ID NO: 4114940 - RNA, 18 nt, Streptococcus pyogenes M1 GAS
uaucuuuuuuacuuuuaa

SEQ ID NO: 4114941 - RNA, 16 nt, Streptococcus pyogenes M1 GAS
uaugacaaauucuuuu

SEQ ID NO: 4114942 - RNA, 17 nt, Streptococcus pyogenes M1 GAS
uaugacauugacugaca

SEQ ID NO: 4114943 - RNA, 17 nt, Streptococcus pyogenes M1 GAS
uaugauacauugaauaa

SEQ ID NO: 4114944 - RNA, 13 nt, Streptococcus pyogenes M1 GAS
uaugauauaaaaa

SEQ ID NO: 4114945 - RNA, 14 nt, Streptococcus pyogenes M1 GAS
uaugauauaaaaau

SEQ ID NO: 4114946 - RNA, 14 nt, Streptococcus pyogenes M1 GAS
uaugcuguccauga

SEQ ID NO: 4114947 - RNA, 12 nt, Streptococcus pyogenes M1 GAS
uauggacuaucu

SEQ ID NO: 4114948 - RNA, 17 nt, Streptococcus pyogenes M1 GAS
uauggguguuggagguc

SEQ ID NO: 4114949 - RNA, 19 nt, Streptococcus pyogenes M1 GAS
uauguaacgcuuguuuaug

SEQ ID NO: 4114950 - RNA, 22 nt, Streptococcus pyogenes M1 GAS
uauguaacgcuuguuuaugaaa

SEQ ID NO: 4114951 - RNA, 16 nt, Streptococcus pyogenes M1 GAS
uaugucgucgugacaa

SEQ ID NO: 4114952 - RNA, 16 nt, Streptococcus pyogenes M1 GAS
uaugucuugcuaaaau

SEQ ID NO: 4114953 - RNA, 15 nt, Streptococcus pyogenes M1 GAS
uaugugauuauuauu

SEQ ID NO: 4114954 - RNA, 18 nt, Streptococcus pyogenes M1 GAS
uaugugauuauuauucua

SEQ ID NO: 4114955 - RNA, 16 nt, Streptococcus pyogenes M1 GAS
uauguuauaagagaag

SEQ ID NO: 4114956 - RNA, 15 nt, Streptococcus pyogenes M1 GAS
uauuaaauaauacag

SEQ ID NO: 4114957 - RNA, 20 nt, Streptococcus pyogenes M1 GAS
uauuaaccggcucuaaaaua

SEQ ID NO: 4114958 - RNA, 20 nt, Streptococcus pyogenes M1 GAS
uauuaacguuaacaaaaaua

SEQ ID NO: 4114959 - RNA, 19 nt, Streptococcus pyogenes M1 GAS
uauuaagauaccaaaucaa

SEQ ID NO: 4114960 - RNA, 23 nt, Streptococcus pyogenes M1 GAS
uauuaagauaccaaaucaaaaag

SEQ ID NO: 4114961 - RNA, 15 nt, Streptococcus pyogenes M1 GAS
uauuaaucaaaaaac

SEQ ID NO: 4114962 - RNA, 12 nt, Streptococcus pyogenes M1 GAS
uauuauuuugcu

SEQ ID NO: 4114963 - RNA, 16 nt, Streptococcus pyogenes M1 GAS
uauucauuuucuucuu

SEQ ID NO: 4114964 - RNA, 21 nt, Streptococcus pyogenes M1 GAS
uauucuaaaauccucuuuuaa

SEQ ID NO: 4114965 - RNA, 22 nt, Streptococcus pyogenes M1 GAS
uauucuaaaauccucuuuuaau

SEQ ID NO: 4114966 - RNA, 16 nt, Streptococcus pyogenes M1 GAS
uauugagucuuuuccu

SEQ ID NO: 4114967 - RNA, 21 nt, Streptococcus pyogenes M1 GAS
uauugguugccugaaauauaa

SEQ ID NO: 4114968 - RNA, 15 nt, Streptococcus pyogenes M1 GAS
uauuguuaauauagu

SEQ ID NO: 4114969 - RNA, 14 nt, Streptococcus pyogenes M1 GAS
uauuuaauagcauu

SEQ ID NO: 4114970 - RNA, 23 nt, Streptococcus pyogenes M1 GAS
uauuuaauagcauugucaaauaa

SEQ ID NO: 4114971 - RNA, 16 nt, Streptococcus pyogenes M1 GAS
uauuuauaauuucuuu

SEQ ID NO: 4114972 - RNA, 14 nt, Streptococcus pyogenes M1 GAS
uauuucacuagaca

SEQ ID NO: 4114973 - RNA, 15 nt, Streptococcus pyogenes M1 GAS
uauuuuauuaauaag

SEQ ID NO: 4114974 - RNA, 21 nt, Streptococcus pyogenes M1 GAS
uauuuucuagguuaaaauaga

SEQ ID NO: 4114975 - RNA, 19 nt, Streptococcus pyogenes M1 GAS
uauuuugauauuuuuucuc

SEQ ID NO: 4114976 - RNA, 14 nt, Streptococcus pyogenes M1 GAS
uauuuuucgcacag

SEQ ID NO: 4114977 - RNA, 17 nt, Streptococcus pyogenes M1 GAS
uauuuuuucucaaaaau

SEQ ID NO: 4114978 - RNA, 23 nt, Streptococcus pyogenes M1 GAS
uauuuuuucucaaaaauauauuc

SEQ ID NO: 4114979 - RNA, 15 nt, Streptococcus pyogenes M1 GAS
ucaaaaaaaaggaca

SEQ ID NO: 4114980 - RNA, 12 nt, Streptococcus pyogenes M1 GAS
ucaaaaaaagac

SEQ ID NO: 4114981 - RNA, 13 nt, Streptococcus pyogenes M1 GAS
ucaaaaaaagaca

SEQ ID NO: 4114982 - RNA, 16 nt, Streptococcus pyogenes M1 GAS
ucaaaaaauuaagaag

SEQ ID NO: 4114983 - RNA, 17 nt, Streptococcus pyogenes M1 GAS
ucaaaaaauuaagaagg

SEQ ID NO: 4114984 - RNA, 18 nt, Streptococcus pyogenes M1 GAS
ucaaaaaauuaagaagga

SEQ ID NO: 4114985 - RNA, 14 nt, Streptococcus pyogenes M1 GAS
ucaaaaaguaaaaa

SEQ ID NO: 4114986 - RNA, 17 nt, Streptococcus pyogenes M1 GAS
ucaaaaaguaaaaagca

SEQ ID NO: 4114987 - RNA, 15 nt, Streptococcus pyogenes M1 GAS
ucaaaaaucuuuuuc

SEQ ID NO: 4114988 - RNA, 18 nt, Streptococcus pyogenes M1 GAS
ucaaaagaccauaaaaaa

SEQ ID NO: 4114989 - RNA, 14 nt, Streptococcus pyogenes M1 GAS
ucaaaagcuaaacu

SEQ ID NO: 4114990 - RNA, 23 nt, Streptococcus pyogenes M1 GAS
ucaaaaucaccguaacuugcuuu

SEQ ID NO: 4114991 - RNA, 20 nt, Streptococcus pyogenes M1 GAS
ucaaacuauauuguuaguuu

SEQ ID NO: 4114992 - RNA, 13 nt, Streptococcus pyogenes M1 GAS
ucaaagggauuac

SEQ ID NO: 4114993 - RNA, 21 nt, Streptococcus pyogenes M1 GAS
ucaaagggauuacgauuaaaa

SEQ ID NO: 4114994 - RNA, 21 nt, Streptococcus pyogenes M1 GAS
ucaaaggguguuuuuuauaug

SEQ ID NO: 4114995 - RNA, 19 nt, Streptococcus pyogenes M1 GAS
ucaacaaauccuuuugcuu

SEQ ID NO: 4114996 - RNA, 21 nt, Streptococcus pyogenes M1 GAS
ucaacagauagucaaaaagac

SEQ ID NO: 4114997 - RNA, 16 nt, Streptococcus pyogenes M1 GAS
ucaacaguauaacugu

SEQ ID NO: 4114998 - RNA, 21 nt, Streptococcus pyogenes M1 GAS
ucaacaguauaacuguuuuuc

SEQ ID NO: 4114999 - RNA, 15 nt, Streptococcus pyogenes M1 GAS
ucaacaguugcuugc

SEQ ID NO: 4115000 - RNA, 18 nt, Streptococcus pyogenes M1 GAS
ucaacaguugcuugcuuu

SEQ ID NO: 4115001 - RNA, 21 nt, Streptococcus pyogenes M1 GAS
ucaacuaucaaguaugcuuuu

SEQ ID NO: 4115002 - RNA, 22 nt, Streptococcus pyogenes M1 GAS
ucaacuaucaaguaugcuuuua

SEQ ID NO: 4115003 - RNA, 17 nt, Streptococcus pyogenes M1 GAS
ucaacuuaccagcaccu

SEQ ID NO: 4115004 - RNA, 20 nt, Streptococcus pyogenes M1 GAS
ucaagcuaucgcuaacauuu

SEQ ID NO: 4115005 - RNA, 23 nt, Streptococcus pyogenes M1 GAS
ucaaggaaggcuuguucuuuauu

SEQ ID NO: 4115006 - RNA, 17 nt, Streptococcus pyogenes M1 GAS
ucaauaacagaaauuaa

SEQ ID NO: 4115007 - RNA, 19 nt, Streptococcus pyogenes M1 GAS
ucaauaacagaaauuaaua

SEQ ID NO: 4115008 - RNA, 14 nt, Streptococcus pyogenes M1 GAS
ucaauauaauaaaa

SEQ ID NO: 4115009 - RNA, 18 nt, Streptococcus pyogenes M1 GAS
ucaauauaauaaaaagca

SEQ ID NO: 4115010 - RNA, 20 nt, Streptococcus pyogenes M1 GAS
ucaaugaaaaguuauuccca

SEQ ID NO: 4115011 - RNA, 22 nt, Streptococcus pyogenes M1 GAS
ucaaugacuugaccaaauacag

SEQ ID NO: 4115012 - RNA, 13 nt, Streptococcus pyogenes M1 GAS
ucaauguuuugcu

SEQ ID NO: 4115013 - RNA, 13 nt, Streptococcus pyogenes M1 GAS
ucaauuccaucac

SEQ ID NO: 4115014 - RNA, 20 nt, Streptococcus pyogenes M1 GAS
ucaauuccaucacuuccaua

SEQ ID NO: 4115015 - RNA, 18 nt, Streptococcus pyogenes M1 GAS
ucaauuuuugccaaaauc

SEQ ID NO: 4115016 - RNA, 22 nt, Streptococcus pyogenes M1 GAS
ucaccuugcuuguagauaccua

SEQ ID NO: 4115017 - RNA, 17 nt, Streptococcus pyogenes M1 GAS
ugaacuauucuagacuc

SEQ ID NO: 4115018 - RNA, 15 nt, Streptococcus pyogenes M1 GAS
ugaagacaaacaucg

SEQ ID NO: 4115019 - RNA, 14 nt, Streptococcus pyogenes M1 GAS
ugaagcaaaauaaa

SEQ ID NO: 4115020 - RNA, 21 nt, Streptococcus pyogenes M1 GAS
ugaagugucuugauaucauaa

SEQ ID NO: 4115021 - RNA, 17 nt, Streptococcus pyogenes M1 GAS
ugaauacguaaaaagag

SEQ ID NO: 4115022 - RNA, 13 nt, Streptococcus pyogenes M1 GAS
ugaauuauuagua

SEQ ID NO: 4115023 - RNA, 17 nt, Streptococcus pyogenes M1 GAS
ugaauuauuaguaacca

SEQ ID NO: 4115024 - RNA, 14 nt, Streptococcus pyogenes M1 GAS
ugaauucuaaaaua

SEQ ID NO: 4115025 - RNA, 15 nt, Streptococcus pyogenes M1 GAS
ugaauugaaaaaaga

SEQ ID NO: 4115026 - RNA, 17 nt, Streptococcus pyogenes M1 GAS
ugacaaccuuaaagacc

SEQ ID NO: 4115027 - RNA, 11 nt, Streptococcus pyogenes M1 GAS
ugacaauguga

SEQ ID NO: 4115028 - RNA, 17 nt, Streptococcus pyogenes M1 GAS
ugacaauuggugauuaa

SEQ ID NO: 4115029 - RNA, 17 nt, Streptococcus pyogenes M1 GAS
ugacagccaccuucagg

SEQ ID NO: 4115030 - RNA, 15 nt, Streptococcus pyogenes M1 GAS
ugacaguuaaaaaua

SEQ ID NO: 4115031 - RNA, 13 nt, Streptococcus pyogenes M1 GAS
ugacauaguguuu

SEQ ID NO: 4115032 - RNA, 19 nt, Streptococcus pyogenes M1 GAS
ugacauuaguccaaaauac

SEQ ID NO: 4115033 - RNA, 17 nt, Streptococcus pyogenes M1 GAS
ugaccauuuuuacugua

SEQ ID NO: 4115034 - RNA, 14 nt, Streptococcus pyogenes M1 GAS
ugacuagccaaauc

SEQ ID NO: 4115035 - RNA, 14 nt, Streptococcus pyogenes M1 GAS
ugacuaguuuauua

SEQ ID NO: 4115036 - RNA, 15 nt, Streptococcus pyogenes M1 GAS
ugacuguaaauagau

SEQ ID NO: 4115037 - RNA, 12 nt, Streptococcus pyogenes M1 GAS
ugacuucaaaaa

SEQ ID NO: 4115038 - RNA, 13 nt, Streptococcus pyogenes M1 GAS
ugacuucaaaaau

SEQ ID NO: 4115039 - RNA, 23 nt, Streptococcus pyogenes M1 GAS
ugacuucaaaaauacuaccuuua

SEQ ID NO: 4115040 - RNA, 15 nt, Streptococcus pyogenes M1 GAS
ugacuugguuuaaua

SEQ ID NO: 4115041 - RNA, 16 nt, Streptococcus pyogenes M1 GAS
ugacuuguaaaaugau

SEQ ID NO: 4115042 - RNA, 16 nt, Streptococcus pyogenes M1 GAS
ugacuuugcaaaagaa

SEQ ID NO: 4115043 - RNA, 16 nt, Streptococcus pyogenes M1 GAS
ugagauuaacugacaa

SEQ ID NO: 4115044 - RNA, 16 nt, Streptococcus pyogenes M1 GAS
ugagcaaggcaagagg

SEQ ID NO: 4115045 - RNA, 24 nt, Streptococcus pyogenes M1 GAS
ugagccaauaacgccagcuacauu

SEQ ID NO: 4115046 - RNA, 16 nt, Streptococcus pyogenes M1 GAS
ugagccccaaaaguug

SEQ ID NO: 4115047 - RNA, 16 nt, Streptococcus pyogenes M1 GAS
ugagccuccaacauag

SEQ ID NO: 4115048 - RNA, 23 nt, Streptococcus pyogenes M1 GAS
ugagccuccaacauagcuaaucc

SEQ ID NO: 4115049 - RNA, 22 nt, Streptococcus pyogenes M1 GAS
ugagguaaucguaaugucuugu

SEQ ID NO: 4115050 - RNA, 13 nt, Streptococcus pyogenes M1 GAS
ugaggugaacacc

SEQ ID NO: 4115051 - RNA, 16 nt, Streptococcus pyogenes M1 GAS
ugaggugauucuuuuu

SEQ ID NO: 4115052 - RNA, 17 nt, Streptococcus pyogenes M1 GAS
ugaguaagcagcaucac

SEQ ID NO: 4115053 - RNA, 18 nt, Streptococcus pyogenes M1 GAS
ugaguuuuuucuaaaaga

SEQ ID NO: 4115054 - RNA, 20 nt, Streptococcus pyogenes M1 GAS
ugaguuuuuucuaaaagaga

SEQ ID NO: 4115055 - RNA, 12 nt, Streptococcus pyogenes M1 GAS
ugauaaaaaaca

SEQ ID NO: 4115056 - RNA, 23 nt, Streptococcus pyogenes M1 GAS
ugauaaaggccuguauuucuuua

SEQ ID NO: 4115057 - RNA, 23 nt, Streptococcus pyogenes M1 GAS
ugauaagauauuguuaauauagu

SEQ ID NO: 4115058 - RNA, 18 nt, Streptococcus pyogenes M1 GAS
ugauaggaaaaagccaga

SEQ ID NO: 4115059 - RNA, 18 nt, Streptococcus pyogenes M1 GAS
ugauagugaaguuaacaa

SEQ ID NO: 4115060 - RNA, 13 nt, Streptococcus pyogenes M1 GAS
ugauauaaaaaug

SEQ ID NO: 4115061 - RNA, 14 nt, Streptococcus pyogenes M1 GAS
ugauauaaaauugg

SEQ ID NO: 4115062 - RNA, 23 nt, Streptococcus pyogenes M1 GAS
ugauauugaucucugcaacauca

SEQ ID NO: 4115063 - RNA, 13 nt, Streptococcus pyogenes M1 GAS
ugauauuucaucu

SEQ ID NO: 4115064 - RNA, 16 nt, Streptococcus pyogenes M1 GAS
ugaucuguuuaaaaac

SEQ ID NO: 4115065 - RNA, 23 nt, Streptococcus pyogenes M1 GAS
ugaugaaucauuuuggagagauu

SEQ ID NO: 4115066 - RNA, 15 nt, Streptococcus pyogenes M1 GAS
ugaugagacuaaccu

SEQ ID NO: 4115067 - RNA, 20 nt, Streptococcus pyogenes M1 GAS
ugaugaguaggcgaacuuua

SEQ ID NO: 4115068 - RNA, 21 nt, Streptococcus pyogenes M1 GAS
ugaugaguaggcgaacuuuau

SEQ ID NO: 4115069 - RNA, 21 nt, Streptococcus pyogenes M1 GAS
ugaugauaaaggccuguauuu

SEQ ID NO: 4115070 - RNA, 23 nt, Streptococcus pyogenes M1 GAS
ugaugauugaguaagcagcauca

SEQ ID NO: 4115071 - RNA, 20 nt, Streptococcus pyogenes M1 GAS
ugauguacuuuguccuugag

SEQ ID NO: 4115072 - RNA, 22 nt, Streptococcus pyogenes M1 GAS
ugauguagggcuguaaaauguu

SEQ ID NO: 4115073 - RNA, 15 nt, Streptococcus pyogenes M1 GAS
ugauguuauuaaaua

SEQ ID NO: 4115074 - RNA, 14 nt, Streptococcus pyogenes M1 GAS
ugauguuuuuacau

SEQ ID NO: 4115075 - RNA, 14 nt, Streptococcus pyogenes M1 GAS
ugauuacauuagga

SEQ ID NO: 4115076 - RNA, 14 nt, Streptococcus pyogenes M1 GAS
ugauuaccuguggu

SEQ ID NO: 4115077 - RNA, 23 nt, Streptococcus pyogenes M1 GAS
ugauuaccuguggucaaaagucc

SEQ ID NO: 4115078 - RNA, 12 nt, Streptococcus pyogenes M1 GAS
ugauuacugaua

SEQ ID NO: 4115079 - RNA, 21 nt, Streptococcus pyogenes M1 GAS
ugauuagaauccuccucuuuu

SEQ ID NO: 4115080 - RNA, 19 nt, Streptococcus pyogenes M1 GAS
ugauuauccucuuauagca

SEQ ID NO: 4115081 - RNA, 12 nt, Streptococcus pyogenes M1 GAS
ugauuauuauuc

SEQ ID NO: 4115082 - RNA, 15 nt, Streptococcus pyogenes M1 GAS
ugauuauucuuuauu

SEQ ID NO: 4115083 - RNA, 12 nt, Streptococcus pyogenes M1 GAS
ugauucuuuuuu

SEQ ID NO: 4115084 - RNA, 18 nt, Streptococcus pyogenes M1 GAS
ugauugaguaagcagcau

SEQ ID NO: 4115085 - RNA, 17 nt, Streptococcus pyogenes M1 GAS
ugauugauuugucuucu

SEQ ID NO: 4115086 - RNA, 13 nt, Streptococcus pyogenes M1 GAS
ugauugccauuua

SEQ ID NO: 4115087 - RNA, 15 nt, Streptococcus pyogenes M1 GAS
ugauuugucaaaaag

SEQ ID NO: 4115088 - RNA, 16 nt, Streptococcus pyogenes M1 GAS
ugauuuguuuucuuua

SEQ ID NO: 4115089 - RNA, 20 nt, Streptococcus pyogenes M1 GAS
ugauuuuaacguuuugaacu

SEQ ID NO: 4115090 - RNA, 15 nt, Streptococcus pyogenes M1 GAS
ugcaaaagaauugaa

SEQ ID NO: 4115091 - RNA, 19 nt, Streptococcus pyogenes M1 GAS
ugcaaauaguagcaaauaa

SEQ ID NO: 4115092 - RNA, 19 nt, Streptococcus pyogenes M1 GAS
ugcaacaucaaggguaaag

SEQ ID NO: 4115093 - RNA, 14 nt, Streptococcus pyogenes M1 GAS
ugcaaguucuuugc

SEQ ID NO: 4115094 - RNA, 17 nt, Streptococcus pyogenes M1 GAS
ugcaaguucuuugccuu

SEQ ID NO: 4115095 - RNA, 20 nt, Streptococcus pyogenes M1 GAS
ugcacacaaaucuucuagaa

SEQ ID NO: 4115096 - RNA, 18 nt, Streptococcus pyogenes M1 GAS
ugcagagaugcuucuuuc

SEQ ID NO: 4115097 - RNA, 20 nt, Streptococcus pyogenes M1 GAS
ugcagagaugcuucuuucaa

SEQ ID NO: 4115098 - RNA, 17 nt, Streptococcus pyogenes M1 GAS
ugcaggguaucugcuca

SEQ ID NO: 4115099 - RNA, 13 nt, Streptococcus pyogenes M1 GAS
ugcagucuuuuuc

SEQ ID NO: 4115100 - RNA, 14 nt, Streptococcus pyogenes M1 GAS
ugcagucuuuuuca

SEQ ID NO: 4115101 - RNA, 21 nt, Streptococcus pyogenes M1 GAS
ugcaguguacucaucuaaaaa

SEQ ID NO: 4115102 - RNA, 20 nt, Streptococcus pyogenes M1 GAS
ugcaucgucugcaaguucuu

SEQ ID NO: 4115103 - RNA, 14 nt, Streptococcus pyogenes M1 GAS
ugcaugaagugguu

SEQ ID NO: 4115104 - RNA, 13 nt, Streptococcus pyogenes M1 GAS
ugcauuacauuua

SEQ ID NO: 4115105 - RNA, 13 nt, Streptococcus pyogenes M1 GAS
ugcauuaucaucu

SEQ ID NO: 4115106 - RNA, 14 nt, Streptococcus pyogenes M1 GAS
ugcauuuuuuguaa

SEQ ID NO: 4115107 - RNA, 17 nt, Streptococcus pyogenes M1 GAS
ugccaauuguucauuaa

SEQ ID NO: 4115108 - RNA, 15 nt, Streptococcus pyogenes M1 GAS
ugccaguaaggaaau

SEQ ID NO: 4115109 - RNA, 22 nt, Streptococcus pyogenes M1 GAS
ugccaucaggcuuaaacauauu

SEQ ID NO: 4115110 - RNA, 23 nt, Streptococcus pyogenes M1 GAS
ugccaucgacgaugugacuagau

SEQ ID NO: 4115111 - RNA, 19 nt, Streptococcus pyogenes M1 GAS
ugccauggguaaaaugacu

SEQ ID NO: 4115112 - RNA, 12 nt, Streptococcus pyogenes M1 GAS
ugccauuaauaa

SEQ ID NO: 4115113 - RNA, 16 nt, Streptococcus pyogenes M1 GAS
ugccauuaauaauauu

SEQ ID NO: 4115114 - RNA, 16 nt, Streptococcus pyogenes M1 GAS
ugccauuuaaaagggc

SEQ ID NO: 4115115 - RNA, 20 nt, Streptococcus pyogenes M1 GAS
ugccuguuuuugcugucucu

SEQ ID NO: 4115116 - RNA, 21 nt, Streptococcus pyogenes M1 GAS
ugcgacacagauaagauacug

SEQ ID NO: 4115117 - RNA, 12 nt, Streptococcus pyogenes M1 GAS
uuaaaagaaaau

SEQ ID NO: 4115118 - RNA, 18 nt, Streptococcus pyogenes M1 GAS
uuaaaagaaaaucuaauc

SEQ ID NO: 4115119 - RNA, 23 nt, Streptococcus pyogenes M1 GAS
uuaaaagaaaaucuaaucagaac

SEQ ID NO: 4115120 - RNA, 15 nt, Streptococcus pyogenes M1 GAS
uuaaaagaugucgca

SEQ ID NO: 4115121 - RNA, 19 nt, Streptococcus pyogenes M1 GAS
uuaaaagaugucgcaaagg

SEQ ID NO: 4115122 - RNA, 15 nt, Streptococcus pyogenes M1 GAS
uuaaaauagaagaca

SEQ ID NO: 4115123 - RNA, 13 nt, Streptococcus pyogenes M1 GAS
uuaaacauauuau

SEQ ID NO: 4115124 - RNA, 14 nt, Streptococcus pyogenes M1 GAS
uuaaagacaaaaaa

SEQ ID NO: 4115125 - RNA, 18 nt, Streptococcus pyogenes M1 GAS
uuaaagacaaaaaacuag

SEQ ID NO: 4115126 - RNA, 16 nt, Streptococcus pyogenes M1 GAS
uuaaagcgauaaucuu

SEQ ID NO: 4115127 - RNA, 22 nt, Streptococcus pyogenes M1 GAS
uuaaagcuaaguugaaugaguu

SEQ ID NO: 4115128 - RNA, 21 nt, Streptococcus pyogenes M1 GAS
uuaaagcuaucauacaacuga

SEQ ID NO: 4115129 - RNA, 19 nt, Streptococcus pyogenes M1 GAS
uuaaauguccgaaaaaaac

SEQ ID NO: 4115130 - RNA, 21 nt, Streptococcus pyogenes M1 GAS
uuaaauuuggagagauaaaaa

SEQ ID NO: 4115131 - RNA, 24 nt, Streptococcus pyogenes M1 GAS
uuaaauuuggagagauaaaaagua

SEQ ID NO: 4115132 - RNA, 13 nt, Streptococcus pyogenes M1 GAS
uuaacaaaaauaa

SEQ ID NO: 4115133 - RNA, 19 nt, Streptococcus pyogenes M1 GAS
uuaacaauagugaguauaa

SEQ ID NO: 4115134 - RNA, 17 nt, Streptococcus pyogenes M1 GAS
uuaacaaugaaacguua

SEQ ID NO: 4115135 - RNA, 16 nt, Streptococcus pyogenes M1 GAS
uuaacaggugacauag

SEQ ID NO: 4115136 - RNA, 16 nt, Streptococcus pyogenes M1 GAS
uuaaccauaucacaaa

SEQ ID NO: 4115137 - RNA, 18 nt, Streptococcus pyogenes M1 GAS
uuaaccauaucacaaaac

SEQ ID NO: 4115138 - RNA, 18 nt, Streptococcus pyogenes M1 GAS
uuaaccggcucuaaaaua

SEQ ID NO: 4115139 - RNA, 18 nt, Streptococcus pyogenes M1 GAS
uuaacguuaacaaaaaua

SEQ ID NO: 4115140 - RNA, 14 nt, Streptococcus pyogenes M1 GAS
uuaacucucauaaa

SEQ ID NO: 4115141 - RNA, 15 nt, Streptococcus pyogenes M1 GAS
uuaacugacaaaaaa

SEQ ID NO: 4115142 - RNA, 17 nt, Streptococcus pyogenes M1 GAS
uuaacugguaaaguauu

SEQ ID NO: 4115143 - RNA, 20 nt, Streptococcus pyogenes M1 GAS
uuaagaaggaacucuccaaa

SEQ ID NO: 4115144 - RNA, 20 nt, Streptococcus pyogenes M1 GAS
uuaagauaccaaaucaaaaa

SEQ ID NO: 4115145 - RNA, 23 nt, Streptococcus pyogenes M1 GAS
uuaagauaccaaaucaaaaagcu

SEQ ID NO: 4115146 - RNA, 20 nt, Streptococcus pyogenes M1 GAS
uuaaguaaaggauuuaguuu

SEQ ID NO: 4115147 - RNA, 15 nt, Streptococcus pyogenes M1 GAS
uuaaguggaauguuu

SEQ ID NO: 4115148 - RNA, 12 nt, Streptococcus pyogenes M1 GAS
uuaauaaauuuu

SEQ ID NO: 4115149 - RNA, 20 nt, Streptococcus pyogenes M1 GAS
uuaauagcauugucaaauaa

SEQ ID NO: 4115150 - RNA, 21 nt, Streptococcus pyogenes M1 GAS
uuaauagcauugucaaauaaa

SEQ ID NO: 4115151 - RNA, 23 nt, Streptococcus pyogenes M1 GAS
uuaauagcauugucaaauaaaau

SEQ ID NO: 4115152 - RNA, 16 nt, Streptococcus pyogenes M1 GAS
uuaauaguuuuccaua

SEQ ID NO: 4115153 - RNA, 19 nt, Streptococcus pyogenes M1 GAS
uuaauauagucugcaugaa

SEQ ID NO: 4115154 - RNA, 21 nt, Streptococcus pyogenes M1 GAS
uuaauauagucugcaugaagu

SEQ ID NO: 4115155 - RNA, 14 nt, Streptococcus pyogenes M1 GAS
uuaaucgaccaaaa

SEQ ID NO: 4115156 - RNA, 23 nt, Streptococcus pyogenes M1 GAS
uuaaugaccuuugauaagauauu

SEQ ID NO: 4115157 - RNA, 23 nt, Streptococcus pyogenes M1 GAS
uuaaugagaaaccuauaaggaga

SEQ ID NO: 4115158 - RNA, 19 nt, Streptococcus pyogenes M1 GAS
uuaauguauuggaaaauac

SEQ ID NO: 4115159 - RNA, 16 nt, Streptococcus pyogenes M1 GAS
uuaauuauuuuaauuu

SEQ ID NO: 4115160 - RNA, 23 nt, Streptococcus pyogenes M1 GAS
uuacaguugugugacuguaaaua

SEQ ID NO: 4115161 - RNA, 12 nt, Streptococcus pyogenes M1 GAS
uuacaucaaaaa

SEQ ID NO: 4115162 - RNA, 19 nt, Streptococcus pyogenes M1 GAS
uuaccagauaaauaguaca

SEQ ID NO: 4115163 - RNA, 14 nt, Streptococcus pyogenes M1 GAS
uuaccagcaccuuc

SEQ ID NO: 4115164 - RNA, 17 nt, Streptococcus pyogenes M1 GAS
uuacgauuaaaagaugu

SEQ ID NO: 4115165 - RNA, 17 nt, Streptococcus pyogenes M1 GAS
uuacgcuuuacauuuua

SEQ ID NO: 4115166 - RNA, 22 nt, Streptococcus pyogenes M1 GAS
uuacgcuuuacauuuuauuuga

SEQ ID NO: 4115167 - RNA, 17 nt, Streptococcus pyogenes M1 GAS
uuacuaugaaaaaagaa

SEQ ID NO: 4115168 - RNA, 19 nt, Streptococcus pyogenes M1 GAS
uuacuguauaaacuuguug

SEQ ID NO: 4115169 - RNA, 14 nt, Streptococcus pyogenes M1 GAS
uuacuuaucaucau

SEQ ID NO: 4115170 - RNA, 18 nt, Streptococcus pyogenes M1 GAS
uuagacuaugauacauug

SEQ ID NO: 4115171 - RNA, 23 nt, Streptococcus pyogenes M1 GAS
uuagacuaugauacauugaauaa

SEQ ID NO: 4115172 - RNA, 19 nt, Streptococcus pyogenes M1 GAS
uuagcaaaggcuucaucaa

SEQ ID NO: 4115173 - RNA, 20 nt, Streptococcus pyogenes M1 GAS
uuagcaaaggcuucaucaau

SEQ ID NO: 4115174 - RNA, 21 nt, Streptococcus pyogenes M1 GAS
uuagcaaaggcuucaucaaug

SEQ ID NO: 4115175 - RNA, 20 nt, Streptococcus pyogenes M1 GAS
uuagcaaagugauauacuga

SEQ ID NO: 4115176 - RNA, 13 nt, Streptococcus pyogenes M1 GAS
uuagcaauuguuu

SEQ ID NO: 4115177 - RNA, 15 nt, Streptococcus pyogenes M1 GAS
uuagcaauuguuuuu

SEQ ID NO: 4115178 - RNA, 15 nt, Streptococcus pyogenes M1 GAS
uuagcaguuauaauu

SEQ ID NO: 4115179 - RNA, 14 nt, Streptococcus pyogenes M1 GAS
uuagccaaagaagg

SEQ ID NO: 4115180 - RNA, 12 nt, Streptococcus pyogenes M1 GAS
uuagccuuuuuu

SEQ ID NO: 4115181 - RNA, 19 nt, Streptococcus pyogenes M1 GAS
uuagcugauaaucuucaau

SEQ ID NO: 4115182 - RNA, 15 nt, Streptococcus pyogenes M1 GAS
uuagcuuuuuaaaga

SEQ ID NO: 4115183 - RNA, 21 nt, Streptococcus pyogenes M1 GAS
uuaguaaagccuuauccauuc

SEQ ID NO: 4115184 - RNA, 21 nt, Streptococcus pyogenes M1 GAS
uuaguaccguuagcagacaaa

SEQ ID NO: 4115185 - RNA, 12 nt, Streptococcus pyogenes M1 GAS
uuaguagagacg

SEQ ID NO: 4115186 - RNA, 22 nt, Streptococcus pyogenes M1 GAS
uuaguccaaaauacauccuaau

SEQ ID NO: 4115187 - RNA, 17 nt, Streptococcus pyogenes M1 GAS
uuagucuuuaaaaaacg

SEQ ID NO: 4115188 - RNA, 18 nt, Streptococcus pyogenes M1 GAS
uuagugguauagacaaac

SEQ ID NO: 4115189 - RNA, 19 nt, Streptococcus pyogenes M1 GAS
uuaguuuaggaaucacaac

SEQ ID NO: 4115190 - RNA, 15 nt, Streptococcus pyogenes M1 GAS
uuaguuuuauuuuga

SEQ ID NO: 4115191 - RNA, 12 nt, Streptococcus pyogenes M1 GAS
uuaguuuuuaaa

SEQ ID NO: 4115192 - RNA, 18 nt, Streptococcus pyogenes M1 GAS
uuauaaagaaacaaaaau

SEQ ID NO: 4115193 - RNA, 23 nt, Streptococcus pyogenes M1 GAS
uuauaaaguuuucucagagacaa

SEQ ID NO: 4115194 - RNA, 22 nt, Streptococcus pyogenes M1 GAS
uuauaccaaauuucagauaaga

SEQ ID NO: 4115195 - RNA, 22 nt, Streptococcus pyogenes M1 GAS
uuauagcacguuggaaaaggaa

SEQ ID NO: 4115196 - RNA, 14 nt, Streptococcus pyogenes M1 GAS
uuauagcuccuaaa

SEQ ID NO: 4115197 - RNA, 22 nt, Streptococcus pyogenes M1 GAS
uuauaguuugacuucaaaaaua

SEQ ID NO: 4115198 - RNA, 16 nt, Streptococcus pyogenes M1 GAS
uuauauugugcuauuc

SEQ ID NO: 4115199 - RNA, 15 nt, Streptococcus pyogenes M1 GAS
uuaucaaaccaaggu

SEQ ID NO: 4115200 - RNA, 20 nt, Streptococcus pyogenes M1 GAS
uuaucagucuguccaauacc

SEQ ID NO: 4115201 - RNA, 13 nt, Streptococcus pyogenes M1 GAS
uuauccauucuua

SEQ ID NO: 4115202 - RNA, 18 nt, Streptococcus pyogenes M1 GAS
uuauccccuauucaauau

SEQ ID NO: 4115203 - RNA, 14 nt, Streptococcus pyogenes M1 GAS
uuaugagauuagca

SEQ ID NO: 4115204 - RNA, 14 nt, Streptococcus pyogenes M1 GAS
uuaugauuugucaa

SEQ ID NO: 4115205 - RNA, 21 nt, Streptococcus pyogenes M1 GAS
uuaugauuugucaaaaaguaa

SEQ ID NO: 4115206 - RNA, 13 nt, Streptococcus pyogenes M1 GAS
uuaugcugauuuu

SEQ ID NO: 4115207 - RNA, 15 nt, Streptococcus pyogenes M1 GAS
uuauggaguucuuga

SEQ ID NO: 4115208 - RNA, 16 nt, Streptococcus pyogenes M1 GAS
uuauguuauaagagaa

SEQ ID NO: 4115209 - RNA, 18 nt, Streptococcus pyogenes M1 GAS
uuauuaacguuaacaaaa

SEQ ID NO: 4115210 - RNA, 17 nt, Streptococcus pyogenes M1 GAS
uuauuaagauaccaaau

SEQ ID NO: 4115211 - RNA, 19 nt, Streptococcus pyogenes M1 GAS
uuauuaauaaguauucuaa

SEQ ID NO: 4115212 - RNA, 19 nt, Streptococcus pyogenes M1 GAS
uuauuagucuuuaaaaaac

SEQ ID NO: 4115213 - RNA, 23 nt, Streptococcus pyogenes M1 GAS
uuauuccacggacacuaaaacca

SEQ ID NO: 4115214 - RNA, 15 nt, Streptococcus pyogenes M1 GAS
uuauucuuuauuuuu

SEQ ID NO: 4115215 - RNA, 14 nt, Streptococcus pyogenes M1 GAS
uuauuggaaaguaa

SEQ ID NO: 4115216 - RNA, 21 nt, Streptococcus pyogenes M1 GAS
uuauuuugcagguaauuaucu

SEQ ID NO: 4115217 - RNA, 16 nt, Streptococcus pyogenes M1 GAS
uuauuuuugagacagu

SEQ ID NO: 4115218 - RNA, 18 nt, Streptococcus pyogenes M1 GAS
uucaaagggagauucuua

SEQ ID NO: 4115219 - RNA, 22 nt, Streptococcus pyogenes M1 GAS
uucaacuugggagaguuccugc

SEQ ID NO: 4115220 - RNA, 22 nt, Streptococcus pyogenes M1 GAS
uucaagaacuccuggauuaaau

SEQ ID NO: 4115221 - RNA, 19 nt, Streptococcus pyogenes M1 GAS
uucaauaauaccauuuuua

SEQ ID NO: 4115222 - RNA, 18 nt, Streptococcus pyogenes M1 GAS
uucaauaugaaaacgugu

SEQ ID NO: 4115223 - RNA, 19 nt, Streptococcus pyogenes M1 GAS
uucaauauuuuauuaauaa

SEQ ID NO: 4115224 - RNA, 21 nt, Streptococcus pyogenes M1 GAS
uucaauauuuuauuaauaagu

SEQ ID NO: 4115225 - RNA, 20 nt, Streptococcus pyogenes M1 GAS
uucaauuauuucgucuaaaa

SEQ ID NO: 4115226 - RNA, 21 nt, Streptococcus pyogenes M1 GAS
uucaauuauuucgucuaaaaa

SEQ ID NO: 4115227 - RNA, 17 nt, Streptococcus pyogenes M1 GAS
uucacgauaagaagcua

SEQ ID NO: 4115228 - RNA, 21 nt, Streptococcus pyogenes M1 GAS
uucacuauaauuucaauaaua

SEQ ID NO: 4115229 - RNA, 15 nt, Streptococcus pyogenes M1 GAS
uucacuuuguuacca

SEQ ID NO: 4115230 - RNA, 20 nt, Streptococcus pyogenes M1 GAS
uucacuuuguuaccagauaa

SEQ ID NO: 4115231 - RNA, 23 nt, Streptococcus pyogenes M1 GAS
uucagauaagaccuucaaaaaag

SEQ ID NO: 4115232 - RNA, 21 nt, Streptococcus pyogenes M1 GAS
uucagcagcacuggcuuuuuu

SEQ ID NO: 4115233 - RNA, 21 nt, Streptococcus pyogenes M1 GAS
uucagcaucguuaaguggaau

SEQ ID NO: 4115234 - RNA, 13 nt, Streptococcus pyogenes M1 GAS
uucagcuagacua

SEQ ID NO: 4115235 - RNA, 15 nt, Streptococcus pyogenes M1 GAS
uucauagaagacgga

SEQ ID NO: 4115236 - RNA, 19 nt, Streptococcus pyogenes M1 GAS
uucauauaagcaaucauca

SEQ ID NO: 4115237 - RNA, 18 nt, Streptococcus pyogenes M1 GAS
uucaucaaugauagcuuu

SEQ ID NO: 4115238 - RNA, 21 nt, Streptococcus pyogenes M1 GAS
uucaucaucaagaauagcuuu

SEQ ID NO: 4115239 - RNA, 15 nt, Streptococcus pyogenes M1 GAS
uucaucgugacaaca

SEQ ID NO: 4115240 - RNA, 15 nt, Streptococcus pyogenes M1 GAS
uucaucuugcauuac

SEQ ID NO: 4115241 - RNA, 12 nt, Streptococcus pyogenes M1 GAS
uucaucuugcca

SEQ ID NO: 4115242 - RNA, 13 nt, Streptococcus pyogenes M1 GAS
uucauuuucuucu

SEQ ID NO: 4115243 - RNA, 13 nt, Streptococcus pyogenes M1 GAS
uucauuuuuauuu

SEQ ID NO: 4115244 - RNA, 13 nt, Streptococcus pyogenes M1 GAS
uuccaaaaagaaa

SEQ ID NO: 4115245 - RNA, 15 nt, Streptococcus pyogenes M1 GAS
uuccaaaaagaaagg

SEQ ID NO: 4115246 - RNA, 16 nt, Streptococcus pyogenes M1 GAS
uuccagaacaugggag

SEQ ID NO: 4115247 - RNA, 21 nt, Streptococcus pyogenes M1 GAS
uuccagaacaugggagcgcac

SEQ ID NO: 4115248 - RNA, 14 nt, Streptococcus pyogenes M1 GAS
uuccauacgcucca

SEQ ID NO: 4115249 - RNA, 19 nt, Streptococcus pyogenes M1 GAS
uucccaaugccccaaagua

SEQ ID NO: 4115250 - RNA, 17 nt, Streptococcus pyogenes M1 GAS
uuccccacaaaagacaa

SEQ ID NO: 4115251 - RNA, 13 nt, Streptococcus pyogenes M1 GAS
uuccuacaaaaua

SEQ ID NO: 4115252 - RNA, 17 nt, Streptococcus pyogenes M1 GAS
uuccuaugcuaacugau

SEQ ID NO: 4115253 - RNA, 22 nt, Streptococcus pyogenes M1 GAS
uuccuaugcuaacugauaaaac

SEQ ID NO: 4115254 - RNA, 24 nt, Streptococcus pyogenes M1 GAS
uuccuuaacggcaucuacagcacc

SEQ ID NO: 4115255 - RNA, 23 nt, Streptococcus pyogenes M1 GAS
uuccuuagcaaaggcuucaucaa

SEQ ID NO: 4115256 - RNA, 20 nt, Streptococcus pyogenes M1 GAS
uucgcacagcguaagccaaa

SEQ ID NO: 4115257 - RNA, 18 nt, Streptococcus pyogenes M1 GAS
uucgccuaggaauaaaau

SEQ ID NO: 4115258 - RNA, 20 nt, Streptococcus pyogenes M1 GAS
uucgccuaggaauaaaaugc

SEQ ID NO: 4115259 - RNA, 19 nt, Streptococcus pyogenes M1 GAS
uucguauugucaucgcuuu

SEQ ID NO: 4115260 - RNA, 14 nt, Streptococcus pyogenes M1 GAS
uucgucuaaaaagc

SEQ ID NO: 4115261 - RNA, 18 nt, Streptococcus pyogenes M1 GAS
uucguugacaaagccauu

SEQ ID NO: 4115262 - RNA, 21 nt, Streptococcus pyogenes M1 GAS
uucguugacaacaauauguga

SEQ ID NO: 4115263 - RNA, 16 nt, Streptococcus pyogenes M1 GAS
uucuaaaaugaugaga

SEQ ID NO: 4115264 - RNA, 19 nt, Streptococcus pyogenes M1 GAS
uucuaaaugacaguauaca

SEQ ID NO: 4115265 - RNA, 22 nt, Streptococcus pyogenes M1 GAS
uucuaaaugacaguauacauca

SEQ ID NO: 4115266 - RNA, 19 nt, Streptococcus pyogenes M1 GAS
uucuaacauggauaccauu

SEQ ID NO: 4115267 - RNA, 13 nt, Streptococcus pyogenes M1 GAS
uucuaaguuuuua

SEQ ID NO: 4115268 - RNA, 14 nt, Streptococcus pyogenes M1 GAS
uucuacuaaaaaag

SEQ ID NO: 4115269 - RNA, 23 nt, Streptococcus pyogenes M1 GAS
uucuagacucuagcauaaaagau

SEQ ID NO: 4115270 - RNA, 19 nt, Streptococcus pyogenes M1 GAS
uucuagguuaaaauagaag

SEQ ID NO: 4115271 - RNA, 18 nt, Streptococcus pyogenes M1 GAS
uucuaguucguucauaaa

SEQ ID NO: 4115272 - RNA, 18 nt, Streptococcus pyogenes M1 GAS
uucuaguuucauagaaga

SEQ ID NO: 4115273 - RNA, 19 nt, Streptococcus pyogenes M1 GAS
uucuaguuucauagaagac

SEQ ID NO: 4115274 - RNA, 17 nt, Streptococcus pyogenes M1 GAS
uucuaucaaaacguuau

SEQ ID NO: 4115275 - RNA, 18 nt, Streptococcus pyogenes M1 GAS
uucuauugucguugaugc

SEQ ID NO: 4115276 - RNA, 12 nt, Streptococcus pyogenes M1 GAS
uucucaaaaaua

SEQ ID NO: 4115277 - RNA, 16 nt, Streptococcus pyogenes M1 GAS
uucucuacuugucaug

SEQ ID NO: 4115278 - RNA, 16 nt, Streptococcus pyogenes M1 GAS
uucugaaaauaaaaua

SEQ ID NO: 4115279 - RNA, 23 nt, Streptococcus pyogenes M1 GAS
uucugaaaauaaaauauuuuucc

SEQ ID NO: 4115280 - RNA, 22 nt, Streptococcus pyogenes M1 GAS
uucugagauauucauuuucuuc

SEQ ID NO: 4115281 - RNA, 24 nt, Streptococcus pyogenes M1 GAS
uucugauuccauaggugauguagg

SEQ ID NO: 4115282 - RNA, 18 nt, Streptococcus pyogenes M1 GAS
uucugucuacuuauuuga

SEQ ID NO: 4115283 - RNA, 22 nt, Streptococcus pyogenes M1 GAS
uucuuaacgaucuauugacuug

SEQ ID NO: 4115284 - RNA, 16 nt, Streptococcus pyogenes M1 GAS
uucuuacuaugaaaaa

SEQ ID NO: 4115285 - RNA, 18 nt, Streptococcus pyogenes M1 GAS
uucuuacuaugaaaaaag

SEQ ID NO: 4115286 - RNA, 16 nt, Streptococcus pyogenes M1 GAS
uucuugaggugauucu

SEQ ID NO: 4115287 - RNA, 18 nt, Streptococcus pyogenes M1 GAS
uucuugaggugauucuuu

SEQ ID NO: 4115288 - RNA, 20 nt, Streptococcus pyogenes M1 GAS
uucuugaggugauucuuuuu

SEQ ID NO: 4115289 - RNA, 17 nt, Streptococcus pyogenes M1 GAS
uucuuggaaaacagaaa

SEQ ID NO: 4115290 - RNA, 23 nt, Streptococcus pyogenes M1 GAS
uucuuuauuuugauauuuuuucu

SEQ ID NO: 4115291 - RNA, 17 nt, Streptococcus pyogenes M1 GAS
uucuuugccuuuagcaa

SEQ ID NO: 4115292 - RNA, 19 nt, Streptococcus pyogenes M1 GAS
uucuuugguuugaugaacc

SEQ ID NO: 4115293 - RNA, 21 nt, Streptococcus pyogenes M1 GAS
uucuuuuaaccauaucacaaa

SEQ ID NO: 4115294 - RNA, 13 nt, Streptococcus pyogenes M1 GAS
uucuuuuuccguu

SEQ ID NO: 4115295 - RNA, 12 nt, Streptococcus pyogenes M1 GAS
uucuuuuuuacc

SEQ ID NO: 4115296 - RNA, 18 nt, Streptococcus pyogenes M1 GAS
uugaaagaggugcaacug

SEQ ID NO: 4115297 - RNA, 24 nt, Streptococcus pyogenes M1 GAS
uugaaaguuccuuagcaguuauaa

SEQ ID NO: 4115298 - RNA, 14 nt, Streptococcus pyogenes M1 GAS
uugaauguuguauu

SEQ ID NO: 4115299 - RNA, 13 nt, Streptococcus pyogenes M1 GAS
uugacaaagccau

SEQ ID NO: 4115300 - RNA, 18 nt, Streptococcus pyogenes M1 GAS
uugacagacaccaaaaaa

SEQ ID NO: 4115301 - RNA, 22 nt, Streptococcus pyogenes M1 GAS
uugacagacaccaaaaaaagca

SEQ ID NO: 4115302 - RNA, 16 nt, Streptococcus pyogenes M1 GAS
uugacaguuaaaaaua

SEQ ID NO: 4115303 - RNA, 15 nt, Streptococcus pyogenes M1 GAS
uugaccaauauagca

SEQ ID NO: 4115304 - RNA, 13 nt, Streptococcus pyogenes M1 GAS
uugaccacaccua

SEQ ID NO: 4115305 - RNA, 15 nt, Streptococcus pyogenes M1 GAS
uugacgcaucuccuu

SEQ ID NO: 4115306 - RNA, 14 nt, Streptococcus pyogenes M1 GAS
uugacuauuuuucg

SEQ ID NO: 4115307 - RNA, 15 nt, Streptococcus pyogenes M1 GAS
uugacuucaaaaaua

SEQ ID NO: 4115308 - RNA, 18 nt, Streptococcus pyogenes M1 GAS
uugacuuguuacaaaaaa

SEQ ID NO: 4115309 - RNA, 19 nt, Streptococcus pyogenes M1 GAS
uugagauaacucuucggua

SEQ ID NO: 4115310 - RNA, 13 nt, Streptococcus pyogenes M1 GAS
uugagucuuuucc

SEQ ID NO: 4115311 - RNA, 12 nt, Streptococcus pyogenes M1 GAS
uugauaaaaaac

SEQ ID NO: 4115312 - RNA, 16 nt, Streptococcus pyogenes M1 GAS
uugauacguuuauugu

SEQ ID NO: 4115313 - RNA, 13 nt, Streptococcus pyogenes M1 GAS
uugauauaaaauu

SEQ ID NO: 4115314 - RNA, 20 nt, Streptococcus pyogenes M1 GAS
uugauaucauaaguuaccaa

SEQ ID NO: 4115315 - RNA, 19 nt, Streptococcus pyogenes M1 GAS
uugauaugguggguaaaac

SEQ ID NO: 4115316 - RNA, 22 nt, Streptococcus pyogenes M1 GAS
aaaaaguuucugaguugauuua

SEQ ID NO: 4115317 - RNA, 13 nt, Streptococcus pyogenes M1 GAS
aaaaauauauucu

SEQ ID NO: 4115318 - RNA, 18 nt, Streptococcus pyogenes M1 GAS
aaaaauauauucuaauuu

SEQ ID NO: 4115319 - RNA, 12 nt, Streptococcus pyogenes M1 GAS
aaaaauuaagaa

SEQ ID NO: 4115320 - RNA, 12 nt, Streptococcus pyogenes M1 GAS
aaaaauucugau

SEQ ID NO: 4115321 - RNA, 22 nt, Streptococcus pyogenes M1 GAS
aaaaauuuaauaguuuuccaua

SEQ ID NO: 4115322 - RNA, 13 nt, Streptococcus pyogenes M1 GAS
aaaacaaaaagag

SEQ ID NO: 4115323 - RNA, 17 nt, Streptococcus pyogenes M1 GAS
aaaacaaaaagagaccg

SEQ ID NO: 4115324 - RNA, 17 nt, Streptococcus pyogenes M1 GAS
aaaacaauaacacagaa

SEQ ID NO: 4115325 - RNA, 11 nt, Streptococcus pyogenes M1 GAS
aaaacagaaag

SEQ ID NO: 4115326 - RNA, 18 nt, Streptococcus pyogenes M1 GAS
aaaaccauaccuacugcc

SEQ ID NO: 4115327 - RNA, 19 nt, Streptococcus pyogenes M1 GAS
aaaaccauuauaaaagagu

SEQ ID NO: 4115328 - RNA, 13 nt, Streptococcus pyogenes M1 GAS
aaaaccgcccaga

SEQ ID NO: 4115329 - RNA, 20 nt, Streptococcus pyogenes M1 GAS
aaaacgagcuggugcaccga

SEQ ID NO: 4115330 - RNA, 14 nt, Streptococcus pyogenes M1 GAS
aaaacgaucaaaaa

SEQ ID NO: 4115331 - RNA, 14 nt, Streptococcus pyogenes M1 GAS
aaaacucaaaaagc

SEQ ID NO: 4115332 - RNA, 16 nt, Streptococcus pyogenes M1 GAS
aaaacuucacauugua

SEQ ID NO: 4115333 - RNA, 21 nt, Streptococcus pyogenes M1 GAS
aaaacuucacauuguauuagc

SEQ ID NO: 4115334 - RNA, 23 nt, Streptococcus pyogenes M1 GAS
aaaacuucacauuguauuagcaa

SEQ ID NO: 4115335 - RNA, 22 nt, Streptococcus pyogenes M1 GAS
aaaacuugcaucgcaaacagau

SEQ ID NO: 4115336 - RNA, 22 nt, Streptococcus pyogenes M1 GAS
aaaacuuuugacuugguuuaau

SEQ ID NO: 4115337 - RNA, 17 nt, Streptococcus pyogenes M1 GAS
aaaagaaaaucuaauca

SEQ ID NO: 4115338 - RNA, 12 nt, Streptococcus pyogenes M1 GAS
aaaagaaaggaa

SEQ ID NO: 4115339 - RNA, 15 nt, Streptococcus pyogenes M1 GAS
aaaagaacaaagauu

SEQ ID NO: 4115340 - RNA, 19 nt, Streptococcus pyogenes M1 GAS
aaaagaauuauacuaacua

SEQ ID NO: 4115341 - RNA, 12 nt, Streptococcus pyogenes M1 GAS
aaaagaauugaa

SEQ ID NO: 4115342 - RNA, 15 nt, Streptococcus pyogenes M1 GAS
aaaagauauuuuaaa

SEQ ID NO: 4115343 - RNA, 19 nt, Streptococcus pyogenes M1 GAS
aaaagaugcacacaaaucu

SEQ ID NO: 4115344 - RNA, 16 nt, Streptococcus pyogenes M1 GAS
aaaagcaaauugaaaa

SEQ ID NO: 4115345 - RNA, 18 nt, Streptococcus pyogenes M1 GAS
aaaagcaaauugaaaaaa

SEQ ID NO: 4115346 - RNA, 12 nt, Streptococcus pyogenes M1 GAS
aaaagcaaugac

SEQ ID NO: 4115347 - RNA, 16 nt, Streptococcus pyogenes M1 GAS
aaaagcauuuguuuug

SEQ ID NO: 4115348 - RNA, 23 nt, Streptococcus pyogenes M1 GAS
aaaaggaauugguaguugucaug

SEQ ID NO: 4115349 - RNA, 19 nt, Streptococcus pyogenes M1 GAS
aaaagggauaauaaagugc

SEQ ID NO: 4115350 - RNA, 15 nt, Streptococcus pyogenes M1 GAS
aaaaggggagacgga

SEQ ID NO: 4115351 - RNA, 22 nt, Streptococcus pyogenes M1 GAS
aaaagguaucccauaucucuau

SEQ ID NO: 4115352 - RNA, 17 nt, Streptococcus pyogenes M1 GAS
aaaagucaacugauaua

SEQ ID NO: 4115353 - RNA, 21 nt, Streptococcus pyogenes M1 GAS
aaaaguugauauccccuccuu

SEQ ID NO: 4115354 - RNA, 14 nt, Streptococcus pyogenes M1 GAS
aaaaguuggcuacu

SEQ ID NO: 4115355 - RNA, 15 nt, Streptococcus pyogenes M1 GAS
aaaauaaaauauuuu

SEQ ID NO: 4115356 - RNA, 14 nt, Streptococcus pyogenes M1 GAS
aaaauaacuuuaaa

SEQ ID NO: 4115357 - RNA, 18 nt, Streptococcus pyogenes M1 GAS
aaaauaacuuucuauuac

SEQ ID NO: 4115358 - RNA, 20 nt, Streptococcus pyogenes M1 GAS
aaaauacaauaaagcguuga

SEQ ID NO: 4115359 - RNA, 23 nt, Streptococcus pyogenes M1 GAS
aaaauacauuguuuuucuuuguc

SEQ ID NO: 4115360 - RNA, 15 nt, Streptococcus pyogenes M1 GAS
aaaauacuagaaaaa

SEQ ID NO: 4115361 - RNA, 16 nt, Streptococcus pyogenes M1 GAS
aaaauacuagaaaaag

SEQ ID NO: 4115362 - RNA, 19 nt, Streptococcus pyogenes M1 GAS
aaaauacuagaaaaagcaa

SEQ ID NO: 4115363 - RNA, 23 nt, Streptococcus pyogenes M1 GAS
aaaauauauucuaauuugugaaa

SEQ ID NO: 4115364 - RNA, 13 nt, Streptococcus pyogenes M1 GAS
aaaauaucuagaa

SEQ ID NO: 4115365 - RNA, 20 nt, Streptococcus pyogenes M1 GAS
aaaaucacaccauuaaaaaa

SEQ ID NO: 4115366 - RNA, 19 nt, Streptococcus pyogenes M1 GAS
aaaaucaugggaaaagcua

SEQ ID NO: 4115367 - RNA, 21 nt, Streptococcus pyogenes M1 GAS
aaaauccucuuuuaauuugga

SEQ ID NO: 4115368 - RNA, 17 nt, Streptococcus pyogenes M1 GAS
aaaaucuucuauugucg

SEQ ID NO: 4115369 - RNA, 15 nt, Streptococcus pyogenes M1 GAS
aaaaugacugacaaa

SEQ ID NO: 4115370 - RNA, 19 nt, Streptococcus pyogenes M1 GAS
aaaaugaugagauuaacug

SEQ ID NO: 4115371 - RNA, 20 nt, Streptococcus pyogenes M1 GAS
aaaaugcgcauguugacuau

SEQ ID NO: 4115372 - RNA, 14 nt, Streptococcus pyogenes M1 GAS
aaaauguuauuuau

SEQ ID NO: 4115373 - RNA, 19 nt, Streptococcus pyogenes M1 GAS
aaaauuuuagguaaaguua

SEQ ID NO: 4115374 - RNA, 14 nt, Streptococcus pyogenes M1 GAS
aaacaagugauacu

SEQ ID NO: 4115375 - RNA, 18 nt, Streptococcus pyogenes M1 GAS
aaacacuaccuuaaaugu

SEQ ID NO: 4115376 - RNA, 13 nt, Streptococcus pyogenes M1 GAS
aaacagaaauacu

SEQ ID NO: 4115377 - RNA, 13 nt, Streptococcus pyogenes M1 GAS
aaacauccaauca

SEQ ID NO: 4115378 - RNA, 20 nt, Streptococcus pyogenes M1 GAS
aaacauucacggugggcuuu

SEQ ID NO: 4115379 - RNA, 22 nt, Streptococcus pyogenes M1 GAS
aaaccaagcuaaagggcuuaau

SEQ ID NO: 4115380 - RNA, 22 nt, Streptococcus pyogenes M1 GAS
aaaccaagugccaguaaggaaa

SEQ ID NO: 4115381 - RNA, 23 nt, Streptococcus pyogenes M1 GAS
aaaccaagugccaguaaggaaau

SEQ ID NO: 4115382 - RNA, 20 nt, Streptococcus pyogenes M1 GAS
aaacgaaaauccuugcguag

SEQ ID NO: 4115383 - RNA, 19 nt, Streptococcus pyogenes M1 GAS
aaacguaacguaauagaau

SEQ ID NO: 4115384 - RNA, 18 nt, Streptococcus pyogenes M1 GAS
aaacguguauucuuaaaa

SEQ ID NO: 4115385 - RNA, 17 nt, Streptococcus pyogenes M1 GAS
aaacguuauuaaagaca

SEQ ID NO: 4115386 - RNA, 16 nt, Streptococcus pyogenes M1 GAS
aaacucaaaaaauaca

SEQ ID NO: 4115387 - RNA, 21 nt, Streptococcus pyogenes M1 GAS
aaacucaaaaaauacaauaaa

SEQ ID NO: 4115388 - RNA, 13 nt, Streptococcus pyogenes M1 GAS
aaacucaaaaagc

SEQ ID NO: 4115389 - RNA, 12 nt, Streptococcus pyogenes M1 GAS
aaacucugccaa

SEQ ID NO: 4115390 - RNA, 17 nt, Streptococcus pyogenes M1 GAS
aaacuguauacaaaaag

SEQ ID NO: 4115391 - RNA, 20 nt, Streptococcus pyogenes M1 GAS
aaacuucacauuguauuagc

SEQ ID NO: 4115392 - RNA, 16 nt, Streptococcus pyogenes M1 GAS
aaacuuucaguuaucu

SEQ ID NO: 4115393 - RNA, 13 nt, Streptococcus pyogenes M1 GAS
aaagaaaggaauu

SEQ ID NO: 4115394 - RNA, 12 nt, Streptococcus pyogenes M1 GAS
aaagaagaauua

SEQ ID NO: 4115395 - RNA, 17 nt, Streptococcus pyogenes M1 GAS
aaagacacacaacaccg

SEQ ID NO: 4115396 - RNA, 17 nt, Streptococcus pyogenes M1 GAS
aaagaccauaaaaaacc

SEQ ID NO: 4115397 - RNA, 19 nt, Streptococcus pyogenes M1 GAS
aaagacccuccuagacugu

SEQ ID NO: 4115398 - RNA, 14 nt, Streptococcus pyogenes M1 GAS
aaagaccucucaug

SEQ ID NO: 4115399 - RNA, 14 nt, Streptococcus pyogenes M1 GAS
aaagacuucuuccu

SEQ ID NO: 4115400 - RNA, 15 nt, Streptococcus pyogenes M1 GAS
aaagagaagaugagc

SEQ ID NO: 4115401 - RNA, 17 nt, Streptococcus pyogenes M1 GAS
aaagauaguaaagaaga

SEQ ID NO: 4115402 - RNA, 13 nt, Streptococcus pyogenes M1 GAS
aaagauauuuuaa

SEQ ID NO: 4115403 - RNA, 14 nt, Streptococcus pyogenes M1 GAS
aaagauauuuuaaa

SEQ ID NO: 4115404 - RNA, 20 nt, Streptococcus pyogenes M1 GAS
aaagauauuuuaaaauaguu

SEQ ID NO: 4115405 - RNA, 13 nt, Streptococcus pyogenes M1 GAS
aaagaugucgcaa

SEQ ID NO: 4115406 - RNA, 14 nt, Streptococcus pyogenes M1 GAS
aaagauuuuaaaua

SEQ ID NO: 4115407 - RNA, 17 nt, Streptococcus pyogenes M1 GAS
aaagcaaauugaaaaaa

SEQ ID NO: 4115408 - RNA, 13 nt, Streptococcus pyogenes M1 GAS
aaagcaagcaaca

SEQ ID NO: 4115409 - RNA, 19 nt, Streptococcus pyogenes M1 GAS
aaagcaagggaaacaccac

SEQ ID NO: 4115410 - RNA, 13 nt, Streptococcus pyogenes M1 GAS
aaagcaucagcau

SEQ ID NO: 4115411 - RNA, 19 nt, Streptococcus pyogenes M1 GAS
aaagcaucaggauugccau

SEQ ID NO: 4115412 - RNA, 12 nt, Streptococcus pyogenes M1 GAS
aaagccaagcuu

SEQ ID NO: 4115413 - RNA, 22 nt, Streptococcus pyogenes M1 GAS
aaagccuuaaugagaaaccuau

SEQ ID NO: 4115414 - RNA, 20 nt, Streptococcus pyogenes M1 GAS
aaagcguugacaguuaaaaa

SEQ ID NO: 4115415 - RNA, 22 nt, Streptococcus pyogenes M1 GAS
aaaggaauaucaggcaaaacaa

SEQ ID NO: 4115416 - RNA, 21 nt, Streptococcus pyogenes M1 GAS
aaccauuauaaaagagugcag

SEQ ID NO: 4115417 - RNA, 22 nt, Streptococcus pyogenes M1 GAS
aacccgucuuacaauuaauaga

SEQ ID NO: 4115418 - RNA, 16 nt, Streptococcus pyogenes M1 GAS
aaccgcuauaacaguu

SEQ ID NO: 4115419 - RNA, 14 nt, Streptococcus pyogenes M1 GAS
aaccgcuuccuuug

SEQ ID NO: 4115420 - RNA, 22 nt, Streptococcus pyogenes M1 GAS
aaccguuccugucgcagauggg

SEQ ID NO: 4115421 - RNA, 19 nt, Streptococcus pyogenes M1 GAS
aaccucuuaguuguagaga

SEQ ID NO: 4115422 - RNA, 16 nt, Streptococcus pyogenes M1 GAS
aaccugcauaucugcc

SEQ ID NO: 4115423 - RNA, 21 nt, Streptococcus pyogenes M1 GAS
aaccuuccuguaucaggaggg

SEQ ID NO: 4115424 - RNA, 17 nt, Streptococcus pyogenes M1 GAS
aaccuuuagagaaucaa

SEQ ID NO: 4115425 - RNA, 22 nt, Streptococcus pyogenes M1 GAS
aaccuuuuggcuguauuuacug

SEQ ID NO: 4115426 - RNA, 19 nt, Streptococcus pyogenes M1 GAS
aacgcuauaccuaaaaaau

SEQ ID NO: 4115427 - RNA, 13 nt, Streptococcus pyogenes M1 GAS
aacggaguuccuc

SEQ ID NO: 4115428 - RNA, 17 nt, Streptococcus pyogenes M1 GAS
aacguaauagaauaaaa

SEQ ID NO: 4115429 - RNA, 15 nt, Streptococcus pyogenes M1 GAS
aacguuaacaaaaau

SEQ ID NO: 4115430 - RNA, 14 nt, Streptococcus pyogenes M1 GAS
aacguuccaaaaag

SEQ ID NO: 4115431 - RNA, 14 nt, Streptococcus pyogenes M1 GAS
aacuauaggagaac

SEQ ID NO: 4115432 - RNA, 20 nt, Streptococcus pyogenes M1 GAS
aacuauauuguuaguuuuau

SEQ ID NO: 4115433 - RNA, 21 nt, Streptococcus pyogenes M1 GAS
aacuauauuguuaguuuuauc

SEQ ID NO: 4115434 - RNA, 18 nt, Streptococcus pyogenes M1 GAS
aacuaucaaguaugcuuu

SEQ ID NO: 4115435 - RNA, 23 nt, Streptococcus pyogenes M1 GAS
aacuaucgcucagaauaaagaaa

SEQ ID NO: 4115436 - RNA, 14 nt, Streptococcus pyogenes M1 GAS
aacucaaaaaauac

SEQ ID NO: 4115437 - RNA, 19 nt, Streptococcus pyogenes M1 GAS
aacucaaaaaauacaauaa

SEQ ID NO: 4115438 - RNA, 15 nt, Streptococcus pyogenes M1 GAS
aacucaaaccaaaca

SEQ ID NO: 4115439 - RNA, 13 nt, Streptococcus pyogenes M1 GAS
aacuccugauaau

SEQ ID NO: 4115440 - RNA, 15 nt, Streptococcus pyogenes M1 GAS
aacucgauaaaaacg

SEQ ID NO: 4115441 - RNA, 19 nt, Streptococcus pyogenes M1 GAS
aacucuccaaaguucuucu

SEQ ID NO: 4115442 - RNA, 22 nt, Streptococcus pyogenes M1 GAS
aacucugccaauuguucauuaa

SEQ ID NO: 4115443 - RNA, 22 nt, Streptococcus pyogenes M1 GAS
aacugacaaaaaaagcaagcaa

SEQ ID NO: 4115444 - RNA, 18 nt, Streptococcus pyogenes M1 GAS
aacugacuagccaaaucu

SEQ ID NO: 4115445 - RNA, 20 nt, Streptococcus pyogenes M1 GAS
aacugacuagccaaaucugg

SEQ ID NO: 4115446 - RNA, 21 nt, Streptococcus pyogenes M1 GAS
aacugcacugagccccaaaag

SEQ ID NO: 4115447 - RNA, 18 nt, Streptococcus pyogenes M1 GAS
aacuggcacaaacucugc

SEQ ID NO: 4115448 - RNA, 21 nt, Streptococcus pyogenes M1 GAS
aacuggcacaaacucugccaa

SEQ ID NO: 4115449 - RNA, 17 nt, Streptococcus pyogenes M1 GAS
aacuguuuuucuuauau

SEQ ID NO: 4115450 - RNA, 21 nt, Streptococcus pyogenes M1 GAS
aacuguuuuucuuauauugug

SEQ ID NO: 4115451 - RNA, 22 nt, Streptococcus pyogenes M1 GAS
aacuguuuuucuuauauugugc

SEQ ID NO: 4115452 - RNA, 14 nt, Streptococcus pyogenes M1 GAS
aacuuacaaaaagc

SEQ ID NO: 4115453 - RNA, 17 nt, Streptococcus pyogenes M1 GAS
aacuucaaauuucauga

SEQ ID NO: 4115454 - RNA, 22 nt, Streptococcus pyogenes M1 GAS
aacuugcaucgcaaacagaugc

SEQ ID NO: 4115455 - RNA, 17 nt, Streptococcus pyogenes M1 GAS
aacuugcuuugacaaag

SEQ ID NO: 4115456 - RNA, 16 nt, Streptococcus pyogenes M1 GAS
aacuuucuauuaccua

SEQ ID NO: 4115457 - RNA, 15 nt, Streptococcus pyogenes M1 GAS
aacuuuuagcuaaga

SEQ ID NO: 4115458 - RNA, 19 nt, Streptococcus pyogenes M1 GAS
aacuuuuagcuaagaauaa

SEQ ID NO: 4115459 - RNA, 13 nt, Streptococcus pyogenes M1 GAS
aacuuuuaucacu

SEQ ID NO: 4115460 - RNA, 16 nt, Streptococcus pyogenes M1 GAS
aagaaagacuuaagga

SEQ ID NO: 4115461 - RNA, 21 nt, Streptococcus pyogenes M1 GAS
aagaacagcauuuucaucauc

SEQ ID NO: 4115462 - RNA, 23 nt, Streptococcus pyogenes M1 GAS
aagaacuccuggauuaaaugccc

SEQ ID NO: 4115463 - RNA, 17 nt, Streptococcus pyogenes M1 GAS
aagaagaauuaacguuc

SEQ ID NO: 4115464 - RNA, 15 nt, Streptococcus pyogenes M1 GAS
aagaaggucaugaug

SEQ ID NO: 4115465 - RNA, 20 nt, Streptococcus pyogenes M1 GAS
aagaaggucucaaauuuuuu

SEQ ID NO: 4115466 - RNA, 15 nt, Streptococcus pyogenes M1 GAS
aagaaguugagacua

SEQ ID NO: 4115467 - RNA, 22 nt, Streptococcus pyogenes M1 GAS
aagaauuaacguuccaaaaaga

SEQ ID NO: 4115468 - RNA, 15 nt, Streptococcus pyogenes M1 GAS
aagaauugaaaaacu

SEQ ID NO: 4115469 - RNA, 21 nt, Streptococcus pyogenes M1 GAS
aagacaaaaaacuagaaacug

SEQ ID NO: 4115470 - RNA, 15 nt, Streptococcus pyogenes M1 GAS
aagacacccccugcu

SEQ ID NO: 4115471 - RNA, 14 nt, Streptococcus pyogenes M1 GAS
aagaccauaaaaaa

SEQ ID NO: 4115472 - RNA, 17 nt, Streptococcus pyogenes M1 GAS
aagaccuucaaaaaagg

SEQ ID NO: 4115473 - RNA, 19 nt, Streptococcus pyogenes M1 GAS
aagaccuucaaaaaaggga

SEQ ID NO: 4115474 - RNA, 15 nt, Streptococcus pyogenes M1 GAS
aagacggaguauuuu

SEQ ID NO: 4115475 - RNA, 23 nt, Streptococcus pyogenes M1 GAS
aagacggaguauuuuuuaguaga

SEQ ID NO: 4115476 - RNA, 15 nt, Streptococcus pyogenes M1 GAS
aagacuagagucucu

SEQ ID NO: 4115477 - RNA, 23 nt, Streptococcus pyogenes M1 GAS
aagacuucuuccuuguacaagag

SEQ ID NO: 4115478 - RNA, 15 nt, Streptococcus pyogenes M1 GAS
aagagagcuugguuu

SEQ ID NO: 4115479 - RNA, 16 nt, Streptococcus pyogenes M1 GAS
aagagagguugguaaa

SEQ ID NO: 4115480 - RNA, 19 nt, Streptococcus pyogenes M1 GAS
aagagucauuugacuacua

SEQ ID NO: 4115481 - RNA, 18 nt, Streptococcus pyogenes M1 GAS
aagagugcaguguacuca

SEQ ID NO: 4115482 - RNA, 13 nt, Streptococcus pyogenes M1 GAS
aagauaaacaucu

SEQ ID NO: 4115483 - RNA, 20 nt, Streptococcus pyogenes M1 GAS
aagauaccaaaucaaaaagc

SEQ ID NO: 4115484 - RNA, 21 nt, Streptococcus pyogenes M1 GAS
aagauaccggguuguuuuuuc

SEQ ID NO: 4115485 - RNA, 18 nt, Streptococcus pyogenes M1 GAS
aagauacugcccuugaug

SEQ ID NO: 4115486 - RNA, 15 nt, Streptococcus pyogenes M1 GAS
aagauaguaaagaag

SEQ ID NO: 4115487 - RNA, 21 nt, Streptococcus pyogenes M1 GAS
aagauagugauggcuugaagc

SEQ ID NO: 4115488 - RNA, 15 nt, Streptococcus pyogenes M1 GAS
aagauccuacaagag

SEQ ID NO: 4115489 - RNA, 16 nt, Streptococcus pyogenes M1 GAS
aagauccuacaagagg

SEQ ID NO: 4115490 - RNA, 19 nt, Streptococcus pyogenes M1 GAS
aagaucugcacacacuuuu

SEQ ID NO: 4115491 - RNA, 21 nt, Streptococcus pyogenes M1 GAS
aagauggugacucuguuccua

SEQ ID NO: 4115492 - RNA, 22 nt, Streptococcus pyogenes M1 GAS
aagauggugacucuguuccuau

SEQ ID NO: 4115493 - RNA, 20 nt, Streptococcus pyogenes M1 GAS
aagauggugcuuuaaaaagu

SEQ ID NO: 4115494 - RNA, 22 nt, Streptococcus pyogenes M1 GAS
aagaugucauggauauuacaag

SEQ ID NO: 4115495 - RNA, 20 nt, Streptococcus pyogenes M1 GAS
aagauguggcuaguaaguuu

SEQ ID NO: 4115496 - RNA, 21 nt, Streptococcus pyogenes M1 GAS
aagauguuuacgcuuuacauu

SEQ ID NO: 4115497 - RNA, 19 nt, Streptococcus pyogenes M1 GAS
aagauuaaacuuacaaaaa

SEQ ID NO: 4115498 - RNA, 12 nt, Streptococcus pyogenes M1 GAS
aagauuggauuu

SEQ ID NO: 4115499 - RNA, 21 nt, Streptococcus pyogenes M1 GAS
aagcaaaauaaacuuucaguu

SEQ ID NO: 4115500 - RNA, 13 nt, Streptococcus pyogenes M1 GAS
aagcaaucuaaga

SEQ ID NO: 4115501 - RNA, 18 nt, Streptococcus pyogenes M1 GAS
aagcaaugacuauagaaa

SEQ ID NO: 4115502 - RNA, 20 nt, Streptococcus pyogenes M1 GAS
aagcaauguaugacaacuau

SEQ ID NO: 4115503 - RNA, 16 nt, Streptococcus pyogenes M1 GAS
aagcagugcuuuaaca

SEQ ID NO: 4115504 - RNA, 19 nt, Streptococcus pyogenes M1 GAS
aagcagugcuuuaacaaug

SEQ ID NO: 4115505 - RNA, 21 nt, Streptococcus pyogenes M1 GAS
aagcaguuucccauguuuuau

SEQ ID NO: 4115506 - RNA, 15 nt, Streptococcus pyogenes M1 GAS
aagcauaaaaauauu

SEQ ID NO: 4115507 - RNA, 12 nt, Streptococcus pyogenes M1 GAS
aagcaucuuugc

SEQ ID NO: 4115508 - RNA, 19 nt, Streptococcus pyogenes M1 GAS
aagcauuuguuuugauaaa

SEQ ID NO: 4115509 - RNA, 23 nt, Streptococcus pyogenes M1 GAS
aagcauuuguuuugauaaaaaac

SEQ ID NO: 4115510 - RNA, 14 nt, Streptococcus pyogenes M1 GAS
aagccaaaucuucu

SEQ ID NO: 4115511 - RNA, 16 nt, Streptococcus pyogenes M1 GAS
aagccauaaacaagug

SEQ ID NO: 4115512 - RNA, 22 nt, Streptococcus pyogenes M1 GAS
aagccgugaggacuuauuuuuu

SEQ ID NO: 4115513 - RNA, 21 nt, Streptococcus pyogenes M1 GAS
aagcguugacaguuaaaaaua

SEQ ID NO: 4115514 - RNA, 20 nt, Streptococcus pyogenes M1 GAS
aagcuaucgcuaacauuuau

SEQ ID NO: 4115515 - RNA, 16 nt, Streptococcus pyogenes M1 GAS
aauauuuccuuuuaaa

SEQ ID NO: 4115516 - RNA, 20 nt, Streptococcus pyogenes M1 GAS
aauauuuccuuuuaaagaca

SEQ ID NO: 4115517 - RNA, 20 nt, Streptococcus pyogenes M1 GAS
aaucaaaaagcuaacaccau

SEQ ID NO: 4115518 - RNA, 20 nt, Streptococcus pyogenes M1 GAS
aaucaacauggcuaaugaua

SEQ ID NO: 4115519 - RNA, 18 nt, Streptococcus pyogenes M1 GAS
aaucaccguaacuugcuu

SEQ ID NO: 4115520 - RNA, 21 nt, Streptococcus pyogenes M1 GAS
aaucccuugcuuugauuuuuc

SEQ ID NO: 4115521 - RNA, 17 nt, Streptococcus pyogenes M1 GAS
aauccuaacaauuuuuc

SEQ ID NO: 4115522 - RNA, 17 nt, Streptococcus pyogenes M1 GAS
aauccuuuugaaaaauu

SEQ ID NO: 4115523 - RNA, 13 nt, Streptococcus pyogenes M1 GAS
aauccuuuugcuu

SEQ ID NO: 4115524 - RNA, 14 nt, Streptococcus pyogenes M1 GAS
aauccuuuuucaca

SEQ ID NO: 4115525 - RNA, 13 nt, Streptococcus pyogenes M1 GAS
aaucgaaaugaua

SEQ ID NO: 4115526 - RNA, 14 nt, Streptococcus pyogenes M1 GAS
aaucgaccaaaauc

SEQ ID NO: 4115527 - RNA, 20 nt, Streptococcus pyogenes M1 GAS
aaucguuacuccuuugacca

SEQ ID NO: 4115528 - RNA, 23 nt, Streptococcus pyogenes M1 GAS
aaucuaggacuaaccccuaauca

SEQ ID NO: 4115529 - RNA, 18 nt, Streptococcus pyogenes M1 GAS
aaucuaucucguaauccu

SEQ ID NO: 4115530 - RNA, 17 nt, Streptococcus pyogenes M1 GAS
aaucuggagaugagaaa

SEQ ID NO: 4115531 - RNA, 20 nt, Streptococcus pyogenes M1 GAS
aaucuucaacaccuucguau

SEQ ID NO: 4115532 - RNA, 22 nt, Streptococcus pyogenes M1 GAS
aaucuucaacaccuucguauug

SEQ ID NO: 4115533 - RNA, 20 nt, Streptococcus pyogenes M1 GAS
aaucuucugcauuaucaucu

SEQ ID NO: 4115534 - RNA, 11 nt, Streptococcus pyogenes M1 GAS
aaucuuugaca

SEQ ID NO: 4115535 - RNA, 15 nt, Streptococcus pyogenes M1 GAS
aaugaccuuugauaa

SEQ ID NO: 4115536 - RNA, 16 nt, Streptococcus pyogenes M1 GAS
aaugacuauagaaagu

SEQ ID NO: 4115537 - RNA, 20 nt, Streptococcus pyogenes M1 GAS
aaugacuauagaaaguaaaa

SEQ ID NO: 4115538 - RNA, 21 nt, Streptococcus pyogenes M1 GAS
aaugacuauagaaaguaaaaa

SEQ ID NO: 4115539 - RNA, 16 nt, Streptococcus pyogenes M1 GAS
aaugagaucuucuuuu

SEQ ID NO: 4115540 - RNA, 13 nt, Streptococcus pyogenes M1 GAS
aaugagcaaggca

SEQ ID NO: 4115541 - RNA, 18 nt, Streptococcus pyogenes M1 GAS
aaugauaaggcugcgaug

SEQ ID NO: 4115542 - RNA, 22 nt, Streptococcus pyogenes M1 GAS
aaugauagcuuucaauugauuu

SEQ ID NO: 4115543 - RNA, 18 nt, Streptococcus pyogenes M1 GAS
aaugauaguaaacgaaaa

SEQ ID NO: 4115544 - RNA, 18 nt, Streptococcus pyogenes M1 GAS
aaugaugagauuaacuga

SEQ ID NO: 4115545 - RNA, 21 nt, Streptococcus pyogenes M1 GAS
aaugauuguuauuuguuaaca

SEQ ID NO: 4115546 - RNA, 14 nt, Streptococcus pyogenes M1 GAS
aaugccaucaaaaa

SEQ ID NO: 4115547 - RNA, 17 nt, Streptococcus pyogenes M1 GAS
aaugccaucaaaaaaag

SEQ ID NO: 4115548 - RNA, 24 nt, Streptococcus pyogenes M1 GAS
aaugcuguuugucauacucaauag

SEQ ID NO: 4115549 - RNA, 20 nt, Streptococcus pyogenes M1 GAS
aauggaaauuuuaaaugaca

SEQ ID NO: 4115550 - RNA, 16 nt, Streptococcus pyogenes M1 GAS
aauguaugauuuuaac

SEQ ID NO: 4115551 - RNA, 16 nt, Streptococcus pyogenes M1 GAS
aauguccgaaaaaaac

SEQ ID NO: 4115552 - RNA, 21 nt, Streptococcus pyogenes M1 GAS
aaugugacaauuggugauuaa

SEQ ID NO: 4115553 - RNA, 15 nt, Streptococcus pyogenes M1 GAS
aaugugggauauuua

SEQ ID NO: 4115554 - RNA, 12 nt, Streptococcus pyogenes M1 GAS
aauguuuugcuc

SEQ ID NO: 4115555 - RNA, 20 nt, Streptococcus pyogenes M1 GAS
aauuaacguuccaaaaagaa

SEQ ID NO: 4115556 - RNA, 22 nt, Streptococcus pyogenes M1 GAS
aauuaagaaggaacucuccaaa

SEQ ID NO: 4115557 - RNA, 16 nt, Streptococcus pyogenes M1 GAS
aauuacuuaucaucau

SEQ ID NO: 4115558 - RNA, 19 nt, Streptococcus pyogenes M1 GAS
aauuagcauauuuugauua

SEQ ID NO: 4115559 - RNA, 22 nt, Streptococcus pyogenes M1 GAS
aauuagccaaagaaggccagca

SEQ ID NO: 4115560 - RNA, 16 nt, Streptococcus pyogenes M1 GAS
aauuaguauauuguaa

SEQ ID NO: 4115561 - RNA, 12 nt, Streptococcus pyogenes M1 GAS
aauuaguuuaac

SEQ ID NO: 4115562 - RNA, 14 nt, Streptococcus pyogenes M1 GAS
aauuauuaguaacc

SEQ ID NO: 4115563 - RNA, 22 nt, Streptococcus pyogenes M1 GAS
aauuauuucgucuaaaaagccu

SEQ ID NO: 4115564 - RNA, 12 nt, Streptococcus pyogenes M1 GAS
aauuauuuuaau

SEQ ID NO: 4115565 - RNA, 17 nt, Streptococcus pyogenes M1 GAS
aauuauuuuaauuuuuc

SEQ ID NO: 4115566 - RNA, 19 nt, Streptococcus pyogenes M1 GAS
aauuauuuuggaauaguuu

SEQ ID NO: 4115567 - RNA, 15 nt, Streptococcus pyogenes M1 GAS
aauucagcaucguua

SEQ ID NO: 4115568 - RNA, 20 nt, Streptococcus pyogenes M1 GAS
aauuccaucacuuccauaua

SEQ ID NO: 4115569 - RNA, 12 nt, Streptococcus pyogenes M1 GAS
aauugaaaaaau

SEQ ID NO: 4115570 - RNA, 17 nt, Streptococcus pyogenes M1 GAS
aauugcagcuaaaaaca

SEQ ID NO: 4115571 - RNA, 23 nt, Streptococcus pyogenes M1 GAS
aauugggucuuccaaucuuucau

SEQ ID NO: 4115572 - RNA, 19 nt, Streptococcus pyogenes M1 GAS
aauugguaguugucauggc

SEQ ID NO: 4115573 - RNA, 22 nt, Streptococcus pyogenes M1 GAS
aauuguagggauuuuuuaacua

SEQ ID NO: 4115574 - RNA, 14 nt, Streptococcus pyogenes M1 GAS
aauugugucauuuc

SEQ ID NO: 4115575 - RNA, 18 nt, Streptococcus pyogenes M1 GAS
aauuguucauuaaagcua

SEQ ID NO: 4115576 - RNA, 13 nt, Streptococcus pyogenes M1 GAS
aauuguugaauaa

SEQ ID NO: 4115577 - RNA, 19 nt, Streptococcus pyogenes M1 GAS
aauuguuuuaguaaagccu

SEQ ID NO: 4115578 - RNA, 16 nt, Streptococcus pyogenes M1 GAS
aauuuagccguccuua

SEQ ID NO: 4115579 - RNA, 15 nt, Streptococcus pyogenes M1 GAS
aauuuagucauuucu

SEQ ID NO: 4115580 - RNA, 23 nt, Streptococcus pyogenes M1 GAS
aauuucugauaggagugauugau

SEQ ID NO: 4115581 - RNA, 21 nt, Streptococcus pyogenes M1 GAS
aauuuggagagauaaaaagua

SEQ ID NO: 4115582 - RNA, 14 nt, Streptococcus pyogenes M1 GAS
aauuuuaaaugaca

SEQ ID NO: 4115583 - RNA, 17 nt, Streptococcus pyogenes M1 GAS
aauuuuaaaugacauga

SEQ ID NO: 4115584 - RNA, 18 nt, Streptococcus pyogenes M1 GAS
aauuuuucaaaaaaacuu

SEQ ID NO: 4115585 - RNA, 15 nt, Streptococcus pyogenes M1 GAS
acaaaggauaugagg

SEQ ID NO: 4115586 - RNA, 13 nt, Streptococcus pyogenes M1 GAS
acaaauucuuuuu

SEQ ID NO: 4115587 - RNA, 16 nt, Streptococcus pyogenes M1 GAS
acaacgcuauuuuuaa

SEQ ID NO: 4115588 - RNA, 20 nt, Streptococcus pyogenes M1 GAS
acaacugacuagccaaaucu

SEQ ID NO: 4115589 - RNA, 14 nt, Streptococcus pyogenes M1 GAS
acaagagcuuaaaa

SEQ ID NO: 4115590 - RNA, 14 nt, Streptococcus pyogenes M1 GAS
acaagcaagcauca

SEQ ID NO: 4115591 - RNA, 19 nt, Streptococcus pyogenes M1 GAS
acaagcaagcaucagcucu

SEQ ID NO: 4115592 - RNA, 20 nt, Streptococcus pyogenes M1 GAS
acaagcaagcaucagcucuu

SEQ ID NO: 4115593 - RNA, 21 nt, Streptococcus pyogenes M1 GAS
acaagcaagcaucagcucuug

SEQ ID NO: 4115594 - RNA, 17 nt, Streptococcus pyogenes M1 GAS
acaagcauuuugcaagu

SEQ ID NO: 4115595 - RNA, 20 nt, Streptococcus pyogenes M1 GAS
acaaggcaauccaaaucaac

SEQ ID NO: 4115596 - RNA, 13 nt, Streptococcus pyogenes M1 GAS
acaagucaggaau

SEQ ID NO: 4115597 - RNA, 20 nt, Streptococcus pyogenes M1 GAS
acaagucuugauaacaauau

SEQ ID NO: 4115598 - RNA, 13 nt, Streptococcus pyogenes M1 GAS
acaagugcuuuuu

SEQ ID NO: 4115599 - RNA, 21 nt, Streptococcus pyogenes M1 GAS
acaaguugccuuaucucaguu

SEQ ID NO: 4115600 - RNA, 15 nt, Streptococcus pyogenes M1 GAS
acaauaacacagaag

SEQ ID NO: 4115601 - RNA, 18 nt, Streptococcus pyogenes M1 GAS
acaauaagcccuuaaucu

SEQ ID NO: 4115602 - RNA, 19 nt, Streptococcus pyogenes M1 GAS
acaauaaggucaucagaau

SEQ ID NO: 4115603 - RNA, 19 nt, Streptococcus pyogenes M1 GAS
acaauacaaaaaaccuucc

SEQ ID NO: 4115604 - RNA, 20 nt, Streptococcus pyogenes M1 GAS
acaaucaggacagucuuuuu

SEQ ID NO: 4115605 - RNA, 19 nt, Streptococcus pyogenes M1 GAS
acaaugagaucuucuuuug

SEQ ID NO: 4115606 - RNA, 22 nt, Streptococcus pyogenes M1 GAS
acaaugagaucuucuuuugguu

SEQ ID NO: 4115607 - RNA, 21 nt, Streptococcus pyogenes M1 GAS
acaaugcucuuaacucucaua

SEQ ID NO: 4115608 - RNA, 12 nt, Streptococcus pyogenes M1 GAS
acaauuagccaa

SEQ ID NO: 4115609 - RNA, 16 nt, Streptococcus pyogenes M1 GAS
acaauuuuucaaaaaa

SEQ ID NO: 4115610 - RNA, 22 nt, Streptococcus pyogenes M1 GAS
acacaaaaaaccgcccagaaua

SEQ ID NO: 4115611 - RNA, 15 nt, Streptococcus pyogenes M1 GAS
acacagaagccucuu

SEQ ID NO: 4115612 - RNA, 19 nt, Streptococcus pyogenes M1 GAS
acacagauaagauacugcc

SEQ ID NO: 4115613 - RNA, 14 nt, Streptococcus pyogenes M1 GAS
acaccaaaaaaagc

SEQ ID NO: 4115614 - RNA, 15 nt, Streptococcus pyogenes M1 GAS
acaccguuuuuuguu

SEQ ID NO: 4115615 - RNA, 18 nt, Streptococcus pyogenes M1 GAS
acguguauucuuaaaaaa

SEQ ID NO: 4115616 - RNA, 19 nt, Streptococcus pyogenes M1 GAS
acguguauucuuaaaaaaa

SEQ ID NO: 4115617 - RNA, 20 nt, Streptococcus pyogenes M1 GAS
acguguauucuuaaaaaaau

SEQ ID NO: 4115618 - RNA, 17 nt, Streptococcus pyogenes M1 GAS
acguuauucucugcuag

SEQ ID NO: 4115619 - RNA, 19 nt, Streptococcus pyogenes M1 GAS
acguuccaugauugauuuu

SEQ ID NO: 4115620 - RNA, 12 nt, Streptococcus pyogenes M1 GAS
acuaaaaucaug

SEQ ID NO: 4115621 - RNA, 21 nt, Streptococcus pyogenes M1 GAS
acuaacagcaacaucaaaaag

SEQ ID NO: 4115622 - RNA, 18 nt, Streptococcus pyogenes M1 GAS
acuaaccccuaaucagaa

SEQ ID NO: 4115623 - RNA, 20 nt, Streptococcus pyogenes M1 GAS
acuaaggcugaugacuugua

SEQ ID NO: 4115624 - RNA, 17 nt, Streptococcus pyogenes M1 GAS
acuaagguuacccuuga

SEQ ID NO: 4115625 - RNA, 13 nt, Streptococcus pyogenes M1 GAS
acuaaguccuuuu

SEQ ID NO: 4115626 - RNA, 19 nt, Streptococcus pyogenes M1 GAS
acuaauccuuuuucacaau

SEQ ID NO: 4115627 - RNA, 16 nt, Streptococcus pyogenes M1 GAS
acuaccuuaaauguau

SEQ ID NO: 4115628 - RNA, 13 nt, Streptococcus pyogenes M1 GAS
acuagaaaaagca

SEQ ID NO: 4115629 - RNA, 23 nt, Streptococcus pyogenes M1 GAS
acuagcacaaaaucauuucguuu

SEQ ID NO: 4115630 - RNA, 13 nt, Streptococcus pyogenes M1 GAS
acuagccaaaucu

SEQ ID NO: 4115631 - RNA, 20 nt, Streptococcus pyogenes M1 GAS
acuaggaaucgcuuuaggaa

SEQ ID NO: 4115632 - RNA, 20 nt, Streptococcus pyogenes M1 GAS
acuagucggguaagggugaa

SEQ ID NO: 4115633 - RNA, 13 nt, Streptococcus pyogenes M1 GAS
acuagugacauuu

SEQ ID NO: 4115634 - RNA, 19 nt, Streptococcus pyogenes M1 GAS
acuaguuuauuacaaaacu

SEQ ID NO: 4115635 - RNA, 21 nt, Streptococcus pyogenes M1 GAS
acuaguuuauuacaaaacugu

SEQ ID NO: 4115636 - RNA, 14 nt, Streptococcus pyogenes M1 GAS
acuauaauuucaau

SEQ ID NO: 4115637 - RNA, 21 nt, Streptococcus pyogenes M1 GAS
acuaucugaguccgagaaaga

SEQ ID NO: 4115638 - RNA, 13 nt, Streptococcus pyogenes M1 GAS
acuaugaaaaaag

SEQ ID NO: 4115639 - RNA, 15 nt, Streptococcus pyogenes M1 GAS
acuaugaaaaaagaa

SEQ ID NO: 4115640 - RNA, 20 nt, Streptococcus pyogenes M1 GAS
acuauugaaucuuguuuaac

SEQ ID NO: 4115641 - RNA, 16 nt, Streptococcus pyogenes M1 GAS
acucaaaaaauacaau

SEQ ID NO: 4115642 - RNA, 12 nt, Streptococcus pyogenes M1 GAS
acucaaaaagca

SEQ ID NO: 4115643 - RNA, 17 nt, Streptococcus pyogenes M1 GAS
acucaaaccaaacaagc

SEQ ID NO: 4115644 - RNA, 18 nt, Streptococcus pyogenes M1 GAS
acucaucauauuguuaau

SEQ ID NO: 4115645 - RNA, 17 nt, Streptococcus pyogenes M1 GAS
acucaucuaaaaaagca

SEQ ID NO: 4115646 - RNA, 18 nt, Streptococcus pyogenes M1 GAS
acucaucuaaaaaagcaa

SEQ ID NO: 4115647 - RNA, 18 nt, Streptococcus pyogenes M1 GAS
acucaugauaucccaucu

SEQ ID NO: 4115648 - RNA, 21 nt, Streptococcus pyogenes M1 GAS
acucauuaagguuuuuuuagu

SEQ ID NO: 4115649 - RNA, 20 nt, Streptococcus pyogenes M1 GAS
acuccagcuggaguuuuuuu

SEQ ID NO: 4115650 - RNA, 22 nt, Streptococcus pyogenes M1 GAS
acuccagcuggaguuuuuuuau

SEQ ID NO: 4115651 - RNA, 12 nt, Streptococcus pyogenes M1 GAS
acuccugauaau

SEQ ID NO: 4115652 - RNA, 21 nt, Streptococcus pyogenes M1 GAS
acuccugauaaugauuuauua

SEQ ID NO: 4115653 - RNA, 13 nt, Streptococcus pyogenes M1 GAS
acucguaaaaaga

SEQ ID NO: 4115654 - RNA, 13 nt, Streptococcus pyogenes M1 GAS
acucguaagcauu

SEQ ID NO: 4115655 - RNA, 23 nt, Streptococcus pyogenes M1 GAS
acucgucuuuguccauuuuuuau

SEQ ID NO: 4115656 - RNA, 23 nt, Streptococcus pyogenes M1 GAS
acucuagcauaaaagauauuuua

SEQ ID NO: 4115657 - RNA, 20 nt, Streptococcus pyogenes M1 GAS
acucuauuuuaaguaaagga

SEQ ID NO: 4115658 - RNA, 15 nt, Streptococcus pyogenes M1 GAS
acucuccaaaguucu

SEQ ID NO: 4115659 - RNA, 20 nt, Streptococcus pyogenes M1 GAS
acugaaaaagccuuuacauc

SEQ ID NO: 4115660 - RNA, 13 nt, Streptococcus pyogenes M1 GAS
acugaacuugucc

SEQ ID NO: 4115661 - RNA, 15 nt, Streptococcus pyogenes M1 GAS
acugagccccaaaag

SEQ ID NO: 4115662 - RNA, 15 nt, Streptococcus pyogenes M1 GAS
acugagccuuuuuug

SEQ ID NO: 4115663 - RNA, 15 nt, Streptococcus pyogenes M1 GAS
acuggcacaaacucu

SEQ ID NO: 4115664 - RNA, 18 nt, Streptococcus pyogenes M1 GAS
acuggcauagaaauaguu

SEQ ID NO: 4115665 - RNA, 13 nt, Streptococcus pyogenes M1 GAS
acuggucaaaagc

SEQ ID NO: 4115666 - RNA, 12 nt, Streptococcus pyogenes M1 GAS
acuguaaauaga

SEQ ID NO: 4115667 - RNA, 17 nt, Streptococcus pyogenes M1 GAS
acuguaauauuuccuuu

SEQ ID NO: 4115668 - RNA, 22 nt, Streptococcus pyogenes M1 GAS
acuguaauauuuccuuuuaaag

SEQ ID NO: 4115669 - RNA, 19 nt, Streptococcus pyogenes M1 GAS
acuguggguuaagagaggu

SEQ ID NO: 4115670 - RNA, 13 nt, Streptococcus pyogenes M1 GAS
acuguuuuucuua

SEQ ID NO: 4115671 - RNA, 12 nt, Streptococcus pyogenes M1 GAS
acuuaauugaaa

SEQ ID NO: 4115672 - RNA, 21 nt, Streptococcus pyogenes M1 GAS
acuuaccagcaccuucuuuua

SEQ ID NO: 4115673 - RNA, 23 nt, Streptococcus pyogenes M1 GAS
acuuaucauuuugggacuaggaa

SEQ ID NO: 4115674 - RNA, 15 nt, Streptococcus pyogenes M1 GAS
acuuauuuuuuuaag

SEQ ID NO: 4115675 - RNA, 14 nt, Streptococcus pyogenes M1 GAS
acuucaaaaauacu

SEQ ID NO: 4115676 - RNA, 14 nt, Streptococcus pyogenes M1 GAS
acuucacauuguau

SEQ ID NO: 4115677 - RNA, 23 nt, Streptococcus pyogenes M1 GAS
acuuccaucaucgaguggauaca

SEQ ID NO: 4115678 - RNA, 23 nt, Streptococcus pyogenes M1 GAS
acuucugcagucuuuuucauuuu

SEQ ID NO: 4115679 - RNA, 14 nt, Streptococcus pyogenes M1 GAS
acuugauuucauuu

SEQ ID NO: 4115680 - RNA, 18 nt, Streptococcus pyogenes M1 GAS
acuugauuucauuuucuu

SEQ ID NO: 4115681 - RNA, 17 nt, Streptococcus pyogenes M1 GAS
acuugcaucgcaaacag

SEQ ID NO: 4115682 - RNA, 16 nt, Streptococcus pyogenes M1 GAS
acuugcuuugacaaag

SEQ ID NO: 4115683 - RNA, 14 nt, Streptococcus pyogenes M1 GAS
acuugggagaguuc

SEQ ID NO: 4115684 - RNA, 17 nt, Streptococcus pyogenes M1 GAS
acuugguaucuuaaaua

SEQ ID NO: 4115685 - RNA, 17 nt, Streptococcus pyogenes M1 GAS
acuugguucugaaaaua

SEQ ID NO: 4115686 - RNA, 21 nt, Streptococcus pyogenes M1 GAS
acuugguucugaaaauaaaau

SEQ ID NO: 4115687 - RNA, 13 nt, Streptococcus pyogenes M1 GAS
acuuguuacaaaa

SEQ ID NO: 4115688 - RNA, 16 nt, Streptococcus pyogenes M1 GAS
acuuguuacaaaaaac

SEQ ID NO: 4115689 - RNA, 19 nt, Streptococcus pyogenes M1 GAS
acuuguuacaaaaaacaag

SEQ ID NO: 4115690 - RNA, 21 nt, Streptococcus pyogenes M1 GAS
acuuuaaacacuaccuuaaau

SEQ ID NO: 4115691 - RNA, 17 nt, Streptococcus pyogenes M1 GAS
acuuuauuaaucaaaaa

SEQ ID NO: 4115692 - RNA, 21 nt, Streptococcus pyogenes M1 GAS
acuuugacagacaccaaaaaa

SEQ ID NO: 4115693 - RNA, 14 nt, Streptococcus pyogenes M1 GAS
acuuugcaaaagaa

SEQ ID NO: 4115694 - RNA, 17 nt, Streptococcus pyogenes M1 GAS
acuuugcaaaagaauug

SEQ ID NO: 4115695 - RNA, 15 nt, Streptococcus pyogenes M1 GAS
acuuugguauucuuu

SEQ ID NO: 4115696 - RNA, 16 nt, Streptococcus pyogenes M1 GAS
acuuugguauucuuuu

SEQ ID NO: 4115697 - RNA, 15 nt, Streptococcus pyogenes M1 GAS
agaaaaagcaaugau

SEQ ID NO: 4115698 - RNA, 18 nt, Streptococcus pyogenes M1 GAS
agaaaaucuaaucagaac

SEQ ID NO: 4115699 - RNA, 19 nt, Streptococcus pyogenes M1 GAS
agaaagacuuaaggauuua

SEQ ID NO: 4115700 - RNA, 15 nt, Streptococcus pyogenes M1 GAS
agaaagauucuugcu

SEQ ID NO: 4115701 - RNA, 21 nt, Streptococcus pyogenes M1 GAS
agaaagcggaagaacagcauu

SEQ ID NO: 4115702 - RNA, 13 nt, Streptococcus pyogenes M1 GAS
agaaaggaauuga

SEQ ID NO: 4115703 - RNA, 15 nt, Streptococcus pyogenes M1 GAS
agaaauuaauaaauu

SEQ ID NO: 4115704 - RNA, 18 nt, Streptococcus pyogenes M1 GAS
agaacagauugaagacaa

SEQ ID NO: 4115705 - RNA, 15 nt, Streptococcus pyogenes M1 GAS
agaacagcauuuuca

SEQ ID NO: 4115706 - RNA, 17 nt, Streptococcus pyogenes M1 GAS
agaacagcugcuugaaa

SEQ ID NO: 4115707 - RNA, 21 nt, Streptococcus pyogenes M1 GAS
agaacagcugcuugaaaagau

SEQ ID NO: 4115708 - RNA, 22 nt, Streptococcus pyogenes M1 GAS
agaacgaauugugucauuucuu

SEQ ID NO: 4115709 - RNA, 17 nt, Streptococcus pyogenes M1 GAS
agaacgagucaauuuag

SEQ ID NO: 4115710 - RNA, 20 nt, Streptococcus pyogenes M1 GAS
agaacgucaaaaaaaaggac

SEQ ID NO: 4115711 - RNA, 21 nt, Streptococcus pyogenes M1 GAS
agaagcaaaauuauuauuuug

SEQ ID NO: 4115712 - RNA, 15 nt, Streptococcus pyogenes M1 GAS
agaagcuaaugucuu

SEQ ID NO: 4115713 - RNA, 13 nt, Streptococcus pyogenes M1 GAS
agaauaacgguau

SEQ ID NO: 4115714 - RNA, 21 nt, Streptococcus pyogenes M1 GAS
agaauagguaaagauuuuaaa

SEQ ID NO: 4115715 - RNA, 22 nt, Streptococcus pyogenes M1 GAS
agcguguaccaagcuugaucuu

SEQ ID NO: 4115716 - RNA, 17 nt, Streptococcus pyogenes M1 GAS
agcguuagcuuuuuaaa

SEQ ID NO: 4115717 - RNA, 13 nt, Streptococcus pyogenes M1 GAS
agcuaaaaacaau

SEQ ID NO: 4115718 - RNA, 16 nt, Streptococcus pyogenes M1 GAS
agcuaauccaauaaua

SEQ ID NO: 4115719 - RNA, 23 nt, Streptococcus pyogenes M1 GAS
agcuagauugcuuccaacuccug

SEQ ID NO: 4115720 - RNA, 14 nt, Streptococcus pyogenes M1 GAS
agcuauagaaacuu

SEQ ID NO: 4115721 - RNA, 18 nt, Streptococcus pyogenes M1 GAS
agcuaucauacaacugac

SEQ ID NO: 4115722 - RNA, 22 nt, Streptococcus pyogenes M1 GAS
agcuaucauacaacugacuagc

SEQ ID NO: 4115723 - RNA, 21 nt, Streptococcus pyogenes M1 GAS
agcucaaccucugaaggcaca

SEQ ID NO: 4115724 - RNA, 15 nt, Streptococcus pyogenes M1 GAS
agcucgcuaagggaa

SEQ ID NO: 4115725 - RNA, 20 nt, Streptococcus pyogenes M1 GAS
agcucgcuaagggaaaaauu

SEQ ID NO: 4115726 - RNA, 23 nt, Streptococcus pyogenes M1 GAS
agcucgcuaagggaaaaauuacg

SEQ ID NO: 4115727 - RNA, 14 nt, Streptococcus pyogenes M1 GAS
agcucuuuaucacc

SEQ ID NO: 4115728 - RNA, 18 nt, Streptococcus pyogenes M1 GAS
agcugacagccucuugga

SEQ ID NO: 4115729 - RNA, 21 nt, Streptococcus pyogenes M1 GAS
agcugacaguaucaccuugcu

SEQ ID NO: 4115730 - RNA, 15 nt, Streptococcus pyogenes M1 GAS
agcugagcaaaacaa

SEQ ID NO: 4115731 - RNA, 18 nt, Streptococcus pyogenes M1 GAS
agcugagcaaaacaauaa

SEQ ID NO: 4115732 - RNA, 14 nt, Streptococcus pyogenes M1 GAS
agcuggaguuuuuu

SEQ ID NO: 4115733 - RNA, 22 nt, Streptococcus pyogenes M1 GAS
agcugucgcguuucgaaaaagg

SEQ ID NO: 4115734 - RNA, 22 nt, Streptococcus pyogenes M1 GAS
agcuuacagcugguuuuuuaau

SEQ ID NO: 4115735 - RNA, 15 nt, Streptococcus pyogenes M1 GAS
agcuuaucaagguug

SEQ ID NO: 4115736 - RNA, 18 nt, Streptococcus pyogenes M1 GAS
agcuugaucuuacaaagg

SEQ ID NO: 4115737 - RNA, 12 nt, Streptococcus pyogenes M1 GAS
agcuugcuaaga

SEQ ID NO: 4115738 - RNA, 16 nt, Streptococcus pyogenes M1 GAS
agcuugcuaagagaau

SEQ ID NO: 4115739 - RNA, 17 nt, Streptococcus pyogenes M1 GAS
agcuuuaguugcuucuu

SEQ ID NO: 4115740 - RNA, 20 nt, Streptococcus pyogenes M1 GAS
aggaaagauaguaaagaaga

SEQ ID NO: 4115741 - RNA, 16 nt, Streptococcus pyogenes M1 GAS
aggaaggcuuguucuu

SEQ ID NO: 4115742 - RNA, 11 nt, Streptococcus pyogenes M1 GAS
aggaauaaaau

SEQ ID NO: 4115743 - RNA, 20 nt, Streptococcus pyogenes M1 GAS
aggaauaucaggcaaaacaa

SEQ ID NO: 4115744 - RNA, 19 nt, Streptococcus pyogenes M1 GAS
aggaauaucaugaaguaua

SEQ ID NO: 4115745 - RNA, 13 nt, Streptococcus pyogenes M1 GAS
aggauuaugaaaa

SEQ ID NO: 4115746 - RNA, 18 nt, Streptococcus pyogenes M1 GAS
aggcaaaacaaaaagaga

SEQ ID NO: 4115747 - RNA, 14 nt, Streptococcus pyogenes M1 GAS
aggcacagaaaaaa

SEQ ID NO: 4115748 - RNA, 16 nt, Streptococcus pyogenes M1 GAS
aggcacagaaaaaaga

SEQ ID NO: 4115749 - RNA, 17 nt, Streptococcus pyogenes M1 GAS
aggcagacaauuauuuu

SEQ ID NO: 4115750 - RNA, 14 nt, Streptococcus pyogenes M1 GAS
aggcaggacgguuu

SEQ ID NO: 4115751 - RNA, 23 nt, Streptococcus pyogenes M1 GAS
aggccuagcuuuuuacaucaaaa

SEQ ID NO: 4115752 - RNA, 19 nt, Streptococcus pyogenes M1 GAS
aggcgauuagcccaagggc

SEQ ID NO: 4115753 - RNA, 15 nt, Streptococcus pyogenes M1 GAS
aggcguauaggugag

SEQ ID NO: 4115754 - RNA, 12 nt, Streptococcus pyogenes M1 GAS
aggcuucaucaa

SEQ ID NO: 4115755 - RNA, 19 nt, Streptococcus pyogenes M1 GAS
aggcuucaucaaugauagc

SEQ ID NO: 4115756 - RNA, 21 nt, Streptococcus pyogenes M1 GAS
aggcuuguucuuuauuuugau

SEQ ID NO: 4115757 - RNA, 12 nt, Streptococcus pyogenes M1 GAS
aggcuuucauua

SEQ ID NO: 4115758 - RNA, 20 nt, Streptococcus pyogenes M1 GAS
agggaaacaccaccaauaau

SEQ ID NO: 4115759 - RNA, 21 nt, Streptococcus pyogenes M1 GAS
aggggagacggacuuaaccau

SEQ ID NO: 4115760 - RNA, 21 nt, Streptococcus pyogenes M1 GAS
aggguaucugcucagagcuuu

SEQ ID NO: 4115761 - RNA, 19 nt, Streptococcus pyogenes M1 GAS
aggguuuuucuuuugaccu

SEQ ID NO: 4115762 - RNA, 16 nt, Streptococcus pyogenes M1 GAS
agguaaagauuuuaaa

SEQ ID NO: 4115763 - RNA, 20 nt, Streptococcus pyogenes M1 GAS
agguaauagcguaaagcaag

SEQ ID NO: 4115764 - RNA, 20 nt, Streptococcus pyogenes M1 GAS
aggucuaauuagcauauuuu

SEQ ID NO: 4115765 - RNA, 23 nt, Streptococcus pyogenes M1 GAS
aggucugcuucuuacuaugaaaa

SEQ ID NO: 4115766 - RNA, 18 nt, Streptococcus pyogenes M1 GAS
aggugaguuuuuucuaaa

SEQ ID NO: 4115767 - RNA, 22 nt, Streptococcus pyogenes M1 GAS
aggugaguuuuuucuaaaagag

SEQ ID NO: 4115768 - RNA, 23 nt, Streptococcus pyogenes M1 GAS
aggugaguuuuuucuaaaagaga

SEQ ID NO: 4115769 - RNA, 22 nt, Streptococcus pyogenes M1 GAS
agguggagcuuuaguugcuucu

SEQ ID NO: 4115770 - RNA, 15 nt, Streptococcus pyogenes M1 GAS
agguuaaaauagaag

SEQ ID NO: 4115771 - RNA, 16 nt, Streptococcus pyogenes M1 GAS
agguuaaguaaaaggg

SEQ ID NO: 4115772 - RNA, 20 nt, Streptococcus pyogenes M1 GAS
agguugguaaaaaggcaguu

SEQ ID NO: 4115773 - RNA, 13 nt, Streptococcus pyogenes M1 GAS
aguaaaaagcaaa

SEQ ID NO: 4115774 - RNA, 22 nt, Streptococcus pyogenes M1 GAS
aguaaaaauacuagaaaaagca

SEQ ID NO: 4115775 - RNA, 14 nt, Streptococcus pyogenes M1 GAS
aguaagcagcauca

SEQ ID NO: 4115776 - RNA, 16 nt, Streptococcus pyogenes M1 GAS
aguaaggaccaagauu

SEQ ID NO: 4115777 - RNA, 13 nt, Streptococcus pyogenes M1 GAS
aguaaguuuuuuu

SEQ ID NO: 4115778 - RNA, 21 nt, Streptococcus pyogenes M1 GAS
aguaaugugggauauuuagau

SEQ ID NO: 4115779 - RNA, 13 nt, Streptococcus pyogenes M1 GAS
aguagcaaauaac

SEQ ID NO: 4115780 - RNA, 15 nt, Streptococcus pyogenes M1 GAS
aguagcaaauaacau

SEQ ID NO: 4115781 - RNA, 17 nt, Streptococcus pyogenes M1 GAS
aguagcggcaauuuuau

SEQ ID NO: 4115782 - RNA, 20 nt, Streptococcus pyogenes M1 GAS
aguauaaugcugaacucuuu

SEQ ID NO: 4115783 - RNA, 12 nt, Streptococcus pyogenes M1 GAS
aguauacaucaa

SEQ ID NO: 4115784 - RNA, 21 nt, Streptococcus pyogenes M1 GAS
aguaucuaggagggacuguca

SEQ ID NO: 4115785 - RNA, 14 nt, Streptococcus pyogenes M1 GAS
aguaugcuuuuaau

SEQ ID NO: 4115786 - RNA, 19 nt, Streptococcus pyogenes M1 GAS
aguaugcuuuuaauuuuau

SEQ ID NO: 4115787 - RNA, 20 nt, Streptococcus pyogenes M1 GAS
agucaaaaagacuucuuccu

SEQ ID NO: 4115788 - RNA, 14 nt, Streptococcus pyogenes M1 GAS
agucaaugaaaagu

SEQ ID NO: 4115789 - RNA, 16 nt, Streptococcus pyogenes M1 GAS
agucaauuuagccguc

SEQ ID NO: 4115790 - RNA, 20 nt, Streptococcus pyogenes M1 GAS
agucacgaguguuaaaacga

SEQ ID NO: 4115791 - RNA, 22 nt, Streptococcus pyogenes M1 GAS
agucagaucauuaaauugauua

SEQ ID NO: 4115792 - RNA, 14 nt, Streptococcus pyogenes M1 GAS
agucauuucuucag

SEQ ID NO: 4115793 - RNA, 21 nt, Streptococcus pyogenes M1 GAS
aguccuuuuaguuuuauuuug

SEQ ID NO: 4115794 - RNA, 22 nt, Streptococcus pyogenes M1 GAS
agucggaaauugaccaaaagaa

SEQ ID NO: 4115795 - RNA, 23 nt, Streptococcus pyogenes M1 GAS
agucuaggcguauaggugaguuu

SEQ ID NO: 4115796 - RNA, 18 nt, Streptococcus pyogenes M1 GAS
agucucuagucuuuuuau

SEQ ID NO: 4115797 - RNA, 15 nt, Streptococcus pyogenes M1 GAS
agucugcaugaagug

SEQ ID NO: 4115798 - RNA, 13 nt, Streptococcus pyogenes M1 GAS
agucuuuaaaaaa

SEQ ID NO: 4115799 - RNA, 23 nt, Streptococcus pyogenes M1 GAS
agucuuuuccuaacaaaaucaca

SEQ ID NO: 4115800 - RNA, 15 nt, Streptococcus pyogenes M1 GAS
agucuuuuucauuuu

SEQ ID NO: 4115801 - RNA, 17 nt, Streptococcus pyogenes M1 GAS
agugaguauaaugcuga

SEQ ID NO: 4115802 - RNA, 17 nt, Streptococcus pyogenes M1 GAS
agugcuuuuuuauuagu

SEQ ID NO: 4115803 - RNA, 13 nt, Streptococcus pyogenes M1 GAS
agugguauagaca

SEQ ID NO: 4115804 - RNA, 20 nt, Streptococcus pyogenes M1 GAS
agugguauagacaaacagaa

SEQ ID NO: 4115805 - RNA, 20 nt, Streptococcus pyogenes M1 GAS
aguuaaaaauaacuuuaaaa

SEQ ID NO: 4115806 - RNA, 18 nt, Streptococcus pyogenes M1 GAS
aguuaagcuugcuaagag

SEQ ID NO: 4115807 - RNA, 23 nt, Streptococcus pyogenes M1 GAS
aguuagccaagcaaucuaagaau

SEQ ID NO: 4115808 - RNA, 20 nt, Streptococcus pyogenes M1 GAS
aguuauaauuaguauauugu

SEQ ID NO: 4115809 - RNA, 20 nt, Streptococcus pyogenes M1 GAS
aguuauagcuccuaaaacca

SEQ ID NO: 4115810 - RNA, 19 nt, Streptococcus pyogenes M1 GAS
aguucaauggauauaacaa

SEQ ID NO: 4115811 - RNA, 15 nt, Streptococcus pyogenes M1 GAS
aguucagauauucuu

SEQ ID NO: 4115812 - RNA, 13 nt, Streptococcus pyogenes M1 GAS
aguucagcagcac

SEQ ID NO: 4115813 - RNA, 15 nt, Streptococcus pyogenes M1 GAS
aguucagcagcacug

SEQ ID NO: 4115814 - RNA, 13 nt, Streptococcus pyogenes M1 GAS
auagggguaauuu

SEQ ID NO: 4115815 - RNA, 14 nt, Streptococcus pyogenes M1 GAS
auaguaaacgaaaa

SEQ ID NO: 4115816 - RNA, 17 nt, Streptococcus pyogenes M1 GAS
auaguaaagaagaauua

SEQ ID NO: 4115817 - RNA, 18 nt, Streptococcus pyogenes M1 GAS
auaguaaccauugccauu

SEQ ID NO: 4115818 - RNA, 19 nt, Streptococcus pyogenes M1 GAS
auagugaguauaaugcuga

SEQ ID NO: 4115819 - RNA, 13 nt, Streptococcus pyogenes M1 GAS
auaguucccuuaa

SEQ ID NO: 4115820 - RNA, 15 nt, Streptococcus pyogenes M1 GAS
auaguucccuuaaua

SEQ ID NO: 4115821 - RNA, 10 nt, Streptococcus pyogenes M1 GAS
auauaaaauu

SEQ ID NO: 4115822 - RNA, 13 nt, Streptococcus pyogenes M1 GAS
auauaaauuauua

SEQ ID NO: 4115823 - RNA, 22 nt, Streptococcus pyogenes M1 GAS
auauaacuuuuagcuaagaaua

SEQ ID NO: 4115824 - RNA, 22 nt, Streptococcus pyogenes M1 GAS
auauaagaaggucucaaauuuu

SEQ ID NO: 4115825 - RNA, 23 nt, Streptococcus pyogenes M1 GAS
auauaagcaaucaucauuuagcu

SEQ ID NO: 4115826 - RNA, 15 nt, Streptococcus pyogenes M1 GAS
auauacugaaaaugc

SEQ ID NO: 4115827 - RNA, 16 nt, Streptococcus pyogenes M1 GAS
auaucccaucuuuguu

SEQ ID NO: 4115828 - RNA, 19 nt, Streptococcus pyogenes M1 GAS
auauccccuccuugcaaua

SEQ ID NO: 4115829 - RNA, 12 nt, Streptococcus pyogenes M1 GAS
auaucuagaaca

SEQ ID NO: 4115830 - RNA, 16 nt, Streptococcus pyogenes M1 GAS
auaucuagaacagcug

SEQ ID NO: 4115831 - RNA, 18 nt, Streptococcus pyogenes M1 GAS
auaucuagaacagcugcu

SEQ ID NO: 4115832 - RNA, 19 nt, Streptococcus pyogenes M1 GAS
auaucuagaacagcugcuu

SEQ ID NO: 4115833 - RNA, 13 nt, Streptococcus pyogenes M1 GAS
auaucuaugauuu

SEQ ID NO: 4115834 - RNA, 15 nt, Streptococcus pyogenes M1 GAS
auaucuaugauuugu

SEQ ID NO: 4115835 - RNA, 20 nt, Streptococcus pyogenes M1 GAS
auaucuuucaguuguuuuaa

SEQ ID NO: 4115836 - RNA, 19 nt, Streptococcus pyogenes M1 GAS
auaugagggucaaacugau

SEQ ID NO: 4115837 - RNA, 18 nt, Streptococcus pyogenes M1 GAS
auaugguggguaaaacca

SEQ ID NO: 4115838 - RNA, 14 nt, Streptococcus pyogenes M1 GAS
auauuagcaaaaug

SEQ ID NO: 4115839 - RNA, 15 nt, Streptococcus pyogenes M1 GAS
auauuagcaaaaugc

SEQ ID NO: 4115840 - RNA, 23 nt, Streptococcus pyogenes M1 GAS
auauuauaguaaccauugccauu

SEQ ID NO: 4115841 - RNA, 13 nt, Streptococcus pyogenes M1 GAS
auauucauuuucu

SEQ ID NO: 4115842 - RNA, 18 nt, Streptococcus pyogenes M1 GAS
auauucuuuggcaagaua

SEQ ID NO: 4115843 - RNA, 16 nt, Streptococcus pyogenes M1 GAS
auauugauauuccuag

SEQ ID NO: 4115844 - RNA, 16 nt, Streptococcus pyogenes M1 GAS
auauugaucucugcaa

SEQ ID NO: 4115845 - RNA, 16 nt, Streptococcus pyogenes M1 GAS
auauugggacuuuuca

SEQ ID NO: 4115846 - RNA, 22 nt, Streptococcus pyogenes M1 GAS
auauugguugccugaaauauaa

SEQ ID NO: 4115847 - RNA, 15 nt, Streptococcus pyogenes M1 GAS
auauuuuaaaauagu

SEQ ID NO: 4115848 - RNA, 13 nt, Streptococcus pyogenes M1 GAS
auauuuuauuaau

SEQ ID NO: 4115849 - RNA, 16 nt, Streptococcus pyogenes M1 GAS
auauuuuuucucaaaa

SEQ ID NO: 4115850 - RNA, 18 nt, Streptococcus pyogenes M1 GAS
auauuuuuucucaaaaau

SEQ ID NO: 4115851 - RNA, 12 nt, Streptococcus pyogenes M1 GAS
aucaaaaaaaga

SEQ ID NO: 4115852 - RNA, 13 nt, Streptococcus pyogenes M1 GAS
aucaaaaaaagca

SEQ ID NO: 4115853 - RNA, 16 nt, Streptococcus pyogenes M1 GAS
aucaaaaaaagcaaug

SEQ ID NO: 4115854 - RNA, 18 nt, Streptococcus pyogenes M1 GAS
aucaaaaaaagcaaugac

SEQ ID NO: 4115855 - RNA, 20 nt, Streptococcus pyogenes M1 GAS
aucaaaaaucuuuuucuuuu

SEQ ID NO: 4115856 - RNA, 19 nt, Streptococcus pyogenes M1 GAS
aucaaaagaccauaaaaaa

SEQ ID NO: 4115857 - RNA, 18 nt, Streptococcus pyogenes M1 GAS
aucaaaccaagguauuua

SEQ ID NO: 4115858 - RNA, 22 nt, Streptococcus pyogenes M1 GAS
aucaaagggauuacgauuaaaa

SEQ ID NO: 4115859 - RNA, 18 nt, Streptococcus pyogenes M1 GAS
aucaaaggguguuuuuua

SEQ ID NO: 4115860 - RNA, 21 nt, Streptococcus pyogenes M1 GAS
aucaaccucucagcugucgcg

SEQ ID NO: 4115861 - RNA, 22 nt, Streptococcus pyogenes M1 GAS
aucaagcuaucgcuaacauuua

SEQ ID NO: 4115862 - RNA, 19 nt, Streptococcus pyogenes M1 GAS
aucaauaacagaaauuaau

SEQ ID NO: 4115863 - RNA, 21 nt, Streptococcus pyogenes M1 GAS
aucaauaacagaaauuaauaa

SEQ ID NO: 4115864 - RNA, 20 nt, Streptococcus pyogenes M1 GAS
aucaaugacuugaccaaaua

SEQ ID NO: 4115865 - RNA, 12 nt, Streptococcus pyogenes M1 GAS
aucaauguuuug

SEQ ID NO: 4115866 - RNA, 19 nt, Streptococcus pyogenes M1 GAS
aucaccguaacuugcuuug

SEQ ID NO: 4115867 - RNA, 19 nt, Streptococcus pyogenes M1 GAS
aucacgccaguaaagucac

SEQ ID NO: 4115868 - RNA, 17 nt, Streptococcus pyogenes M1 GAS
aucacucguaaaaagau

SEQ ID NO: 4115869 - RNA, 18 nt, Streptococcus pyogenes M1 GAS
aucagaaagaagaaaauu

SEQ ID NO: 4115870 - RNA, 21 nt, Streptococcus pyogenes M1 GAS
aucagcauaaccuuugccauu

SEQ ID NO: 4115871 - RNA, 18 nt, Streptococcus pyogenes M1 GAS
aucagcuacacuugauuu

SEQ ID NO: 4115872 - RNA, 20 nt, Streptococcus pyogenes M1 GAS
aucaggaggguuuuucuuuu

SEQ ID NO: 4115873 - RNA, 17 nt, Streptococcus pyogenes M1 GAS
aucaggcuuaaacauau

SEQ ID NO: 4115874 - RNA, 22 nt, Streptococcus pyogenes M1 GAS
aucauacaacugacuagccaaa

SEQ ID NO: 4115875 - RNA, 18 nt, Streptococcus pyogenes M1 GAS
aucauauuguuaauaugu

SEQ ID NO: 4115876 - RNA, 17 nt, Streptococcus pyogenes M1 GAS
aucaucaggguugcaug

SEQ ID NO: 4115877 - RNA, 17 nt, Streptococcus pyogenes M1 GAS
aucauggagucaaugaa

SEQ ID NO: 4115878 - RNA, 15 nt, Streptococcus pyogenes M1 GAS
aucauuauugacaaa

SEQ ID NO: 4115879 - RNA, 22 nt, Streptococcus pyogenes M1 GAS
aucauucuaacauggauaccau

SEQ ID NO: 4115880 - RNA, 20 nt, Streptococcus pyogenes M1 GAS
aucauuuugggacuaggaau

SEQ ID NO: 4115881 - RNA, 16 nt, Streptococcus pyogenes M1 GAS
auccauuauaaaucuu

SEQ ID NO: 4115882 - RNA, 18 nt, Streptococcus pyogenes M1 GAS
aucccauaucucuauauc

SEQ ID NO: 4115883 - RNA, 13 nt, Streptococcus pyogenes M1 GAS
aucccaucuuugu

SEQ ID NO: 4115884 - RNA, 18 nt, Streptococcus pyogenes M1 GAS
auccccucguuuaaaugu

SEQ ID NO: 4115885 - RNA, 11 nt, Streptococcus pyogenes M1 GAS
auccuacugac

SEQ ID NO: 4115886 - RNA, 15 nt, Streptococcus pyogenes M1 GAS
auccuccuaaauaua

SEQ ID NO: 4115887 - RNA, 20 nt, Streptococcus pyogenes M1 GAS
auccuuuaucuuauuuuaag

SEQ ID NO: 4115888 - RNA, 16 nt, Streptococcus pyogenes M1 GAS
auccuuuugaaaaauu

SEQ ID NO: 4115889 - RNA, 13 nt, Streptococcus pyogenes M1 GAS
auccuuuugcuuc

SEQ ID NO: 4115890 - RNA, 22 nt, Streptococcus pyogenes M1 GAS
aucgaaaugauagcaccuaauu

SEQ ID NO: 4115891 - RNA, 14 nt, Streptococcus pyogenes M1 GAS
aucgacauuuaugc

SEQ ID NO: 4115892 - RNA, 22 nt, Streptococcus pyogenes M1 GAS
aucgacauuuaugcugauuuug

SEQ ID NO: 4115893 - RNA, 23 nt, Streptococcus pyogenes M1 GAS
aucgaccaaaaucuucuauuguc

SEQ ID NO: 4115894 - RNA, 13 nt, Streptococcus pyogenes M1 GAS
aucgaugauaaua

SEQ ID NO: 4115895 - RNA, 15 nt, Streptococcus pyogenes M1 GAS
aucgauuugguguuu

SEQ ID NO: 4115896 - RNA, 15 nt, Streptococcus pyogenes M1 GAS
aucgcaaacagaugc

SEQ ID NO: 4115897 - RNA, 16 nt, Streptococcus pyogenes M1 GAS
aucgcuaacauuuaug

SEQ ID NO: 4115898 - RNA, 22 nt, Streptococcus pyogenes M1 GAS
aucgcuuugaauacguaaaaag

SEQ ID NO: 4115899 - RNA, 23 nt, Streptococcus pyogenes M1 GAS
aucgcuuugaauacguaaaaaga

SEQ ID NO: 4115900 - RNA, 15 nt, Streptococcus pyogenes M1 GAS
aucggaacagcugaa

SEQ ID NO: 4115901 - RNA, 13 nt, Streptococcus pyogenes M1 GAS
aucguuuugcaau

SEQ ID NO: 4115902 - RNA, 13 nt, Streptococcus pyogenes M1 GAS
aucuaaaaaagca

SEQ ID NO: 4115903 - RNA, 15 nt, Streptococcus pyogenes M1 GAS
aucuaagcuuggauu

SEQ ID NO: 4115904 - RNA, 23 nt, Streptococcus pyogenes M1 GAS
aucuaggagggacugucaaaaaa

SEQ ID NO: 4115905 - RNA, 21 nt, Streptococcus pyogenes M1 GAS
aucuccaagaucugcacacac

SEQ ID NO: 4115906 - RNA, 19 nt, Streptococcus pyogenes M1 GAS
aucucguaauccuugauuu

SEQ ID NO: 4115907 - RNA, 19 nt, Streptococcus pyogenes M1 GAS
aucucuauaucuaugauuu

SEQ ID NO: 4115908 - RNA, 21 nt, Streptococcus pyogenes M1 GAS
aucugcagauuuuaagacaac

SEQ ID NO: 4115909 - RNA, 21 nt, Streptococcus pyogenes M1 GAS
aucuggagaugagaaagccaa

SEQ ID NO: 4115910 - RNA, 14 nt, Streptococcus pyogenes M1 GAS
aucuggucccacac

SEQ ID NO: 4115911 - RNA, 21 nt, Streptococcus pyogenes M1 GAS
aucuguauauuuaauagcauu

SEQ ID NO: 4115912 - RNA, 15 nt, Streptococcus pyogenes M1 GAS
aucuguuuaaaaaca

SEQ ID NO: 4115913 - RNA, 17 nt, Streptococcus pyogenes M1 GAS
aucuguuuaaaaacaaa

SEQ ID NO: 4115914 - RNA, 16 nt, Streptococcus pyogenes M1 GAS
auucaagauagugaug

SEQ ID NO: 4115915 - RNA, 13 nt, Streptococcus pyogenes M1 GAS
auucauuuucuuc

SEQ ID NO: 4115916 - RNA, 14 nt, Streptococcus pyogenes M1 GAS
auuccaaacaucca

SEQ ID NO: 4115917 - RNA, 15 nt, Streptococcus pyogenes M1 GAS
auuccaaacauccaa

SEQ ID NO: 4115918 - RNA, 21 nt, Streptococcus pyogenes M1 GAS
auucuaaaauccucuuuuaau

SEQ ID NO: 4115919 - RNA, 14 nt, Streptococcus pyogenes M1 GAS
auucuaacauggau

SEQ ID NO: 4115920 - RNA, 18 nt, Streptococcus pyogenes M1 GAS
auucuaacucuuguagaa

SEQ ID NO: 4115921 - RNA, 22 nt, Streptococcus pyogenes M1 GAS
auucuaacucuuguagaauuuc

SEQ ID NO: 4115922 - RNA, 20 nt, Streptococcus pyogenes M1 GAS
auucuagacucuagcauaaa

SEQ ID NO: 4115923 - RNA, 18 nt, Streptococcus pyogenes M1 GAS
auucuuaaaaaaaucccu

SEQ ID NO: 4115924 - RNA, 14 nt, Streptococcus pyogenes M1 GAS
auucuuauccauua

SEQ ID NO: 4115925 - RNA, 17 nt, Streptococcus pyogenes M1 GAS
auucuuauccauuauaa

SEQ ID NO: 4115926 - RNA, 10 nt, Streptococcus pyogenes M1 GAS
auucuugcag

SEQ ID NO: 4115927 - RNA, 21 nt, Streptococcus pyogenes M1 GAS
auucuugcagaauagaaauag

SEQ ID NO: 4115928 - RNA, 13 nt, Streptococcus pyogenes M1 GAS
auucuuuuuuacc

SEQ ID NO: 4115929 - RNA, 14 nt, Streptococcus pyogenes M1 GAS
auucuuuuuuaccu

SEQ ID NO: 4115930 - RNA, 21 nt, Streptococcus pyogenes M1 GAS
auugacaaauccaaugacuaa

SEQ ID NO: 4115931 - RNA, 23 nt, Streptococcus pyogenes M1 GAS
auugacuugguucugaaaauaaa

SEQ ID NO: 4115932 - RNA, 15 nt, Streptococcus pyogenes M1 GAS
auugaguaagcagca

SEQ ID NO: 4115933 - RNA, 16 nt, Streptococcus pyogenes M1 GAS
auugaguaagcagcau

SEQ ID NO: 4115934 - RNA, 21 nt, Streptococcus pyogenes M1 GAS
auugaugaguuuauguaugcu

SEQ ID NO: 4115935 - RNA, 15 nt, Streptococcus pyogenes M1 GAS
auugcagcuaaaaac

SEQ ID NO: 4115936 - RNA, 23 nt, Streptococcus pyogenes M1 GAS
auugcuuccaacuccugauaaug

SEQ ID NO: 4115937 - RNA, 19 nt, Streptococcus pyogenes M1 GAS
auuggaacaccguuuuuug

SEQ ID NO: 4115938 - RNA, 22 nt, Streptococcus pyogenes M1 GAS
auuggccuucuuggaaaacaga

SEQ ID NO: 4115939 - RNA, 18 nt, Streptococcus pyogenes M1 GAS
auuggggcggcacuucca

SEQ ID NO: 4115940 - RNA, 17 nt, Streptococcus pyogenes M1 GAS
auuguagggauuuuuua

SEQ ID NO: 4115941 - RNA, 20 nt, Streptococcus pyogenes M1 GAS
auuguagggauuuuuuaacu

SEQ ID NO: 4115942 - RNA, 14 nt, Streptococcus pyogenes M1 GAS
auugucaaauaaaa

SEQ ID NO: 4115943 - RNA, 15 nt, Streptococcus pyogenes M1 GAS
auugucaaauaaaau

SEQ ID NO: 4115944 - RNA, 17 nt, Streptococcus pyogenes M1 GAS
auugucacugaaaaagc

SEQ ID NO: 4115945 - RNA, 22 nt, Streptococcus pyogenes M1 GAS
auuguugacuuugcaaaagaau

SEQ ID NO: 4115946 - RNA, 18 nt, Streptococcus pyogenes M1 GAS
auuuaagguauuguucaa

SEQ ID NO: 4115947 - RNA, 17 nt, Streptococcus pyogenes M1 GAS
auuuaauuuaccccaaa

SEQ ID NO: 4115948 - RNA, 17 nt, Streptococcus pyogenes M1 GAS
auuuacugggucaacuc

SEQ ID NO: 4115949 - RNA, 24 nt, Streptococcus pyogenes M1 GAS
auuuagccuauuaucugauaaggu

SEQ ID NO: 4115950 - RNA, 16 nt, Streptococcus pyogenes M1 GAS
auuuaguuauuuuuga

SEQ ID NO: 4115951 - RNA, 14 nt, Streptococcus pyogenes M1 GAS
auuuaguucuaagu

SEQ ID NO: 4115952 - RNA, 24 nt, Streptococcus pyogenes M1 GAS
auuuaugaggccaauaaugccauc

SEQ ID NO: 4115953 - RNA, 18 nt, Streptococcus pyogenes M1 GAS
auuuaugucuugcuaaaa

SEQ ID NO: 4115954 - RNA, 16 nt, Streptococcus pyogenes M1 GAS
auuuauuaagauuaau

SEQ ID NO: 4115955 - RNA, 17 nt, Streptococcus pyogenes M1 GAS
auuucaaguucucuacu

SEQ ID NO: 4115956 - RNA, 16 nt, Streptococcus pyogenes M1 GAS
auuucaauaauaccau

SEQ ID NO: 4115957 - RNA, 21 nt, Streptococcus pyogenes M1 GAS
auuucaauaauaccauuuuua

SEQ ID NO: 4115958 - RNA, 22 nt, Streptococcus pyogenes M1 GAS
auuucaauaauaccauuuuuau

SEQ ID NO: 4115959 - RNA, 18 nt, Streptococcus pyogenes M1 GAS
auuucacuagacauucgu

SEQ ID NO: 4115960 - RNA, 18 nt, Streptococcus pyogenes M1 GAS
auuucagauaagaccuuc

SEQ ID NO: 4115961 - RNA, 18 nt, Streptococcus pyogenes M1 GAS
auuucauuuucuuuguga

SEQ ID NO: 4115962 - RNA, 16 nt, Streptococcus pyogenes M1 GAS
auuuccuacaaaauaa

SEQ ID NO: 4115963 - RNA, 20 nt, Streptococcus pyogenes M1 GAS
auuuccucuaacauguccaa

SEQ ID NO: 4115964 - RNA, 16 nt, Streptococcus pyogenes M1 GAS
auuucgucuaaaaagc

SEQ ID NO: 4115965 - RNA, 23 nt, Streptococcus pyogenes M1 GAS
auuucgucuaaaaagccuuaaug

SEQ ID NO: 4115966 - RNA, 14 nt, Streptococcus pyogenes M1 GAS
auuucguugacaaa

SEQ ID NO: 4115967 - RNA, 15 nt, Streptococcus pyogenes M1 GAS
auuucguugacaaag

SEQ ID NO: 4115968 - RNA, 14 nt, Streptococcus pyogenes M1 GAS
auuucuucagguuu

SEQ ID NO: 4115969 - RNA, 19 nt, Streptococcus pyogenes M1 GAS
auuucuugaggugauucuu

SEQ ID NO: 4115970 - RNA, 20 nt, Streptococcus pyogenes M1 GAS
auuucuuucauguuuacagu

SEQ ID NO: 4115971 - RNA, 14 nt, Streptococcus pyogenes M1 GAS
auuucuuugcaaaa

SEQ ID NO: 4115972 - RNA, 15 nt, Streptococcus pyogenes M1 GAS
auuucuuugcaaaag

SEQ ID NO: 4115973 - RNA, 22 nt, Streptococcus pyogenes M1 GAS
auuugacauuaguccaaaauac

SEQ ID NO: 4115974 - RNA, 16 nt, Streptococcus pyogenes M1 GAS
auuugacuacuagcau

SEQ ID NO: 4115975 - RNA, 19 nt, Streptococcus pyogenes M1 GAS
auuugacuuguuacaaaaa

SEQ ID NO: 4115976 - RNA, 20 nt, Streptococcus pyogenes M1 GAS
auuugacuuguuacaaaaaa

SEQ ID NO: 4115977 - RNA, 20 nt, Streptococcus pyogenes M1 GAS
auuugcagaggcuugcauuu

SEQ ID NO: 4115978 - RNA, 22 nt, Streptococcus pyogenes M1 GAS
auuugcagaggcuugcauuuuu

SEQ ID NO: 4115979 - RNA, 23 nt, Streptococcus pyogenes M1 GAS
auuugucaaaaaguaaaaagcaa

SEQ ID NO: 4115980 - RNA, 17 nt, Streptococcus pyogenes M1 GAS
auuuguuaacaggugac

SEQ ID NO: 4115981 - RNA, 16 nt, Streptococcus pyogenes M1 GAS
auuuguuuugauaaaa

SEQ ID NO: 4115982 - RNA, 14 nt, Streptococcus pyogenes M1 GAS
auuuuaaaauaguu

SEQ ID NO: 4115983 - RNA, 20 nt, Streptococcus pyogenes M1 GAS
auuuuaaauaucuuaccauu

SEQ ID NO: 4115984 - RNA, 14 nt, Streptococcus pyogenes M1 GAS
auuuuaauuuuucu

SEQ ID NO: 4115985 - RNA, 16 nt, Streptococcus pyogenes M1 GAS
auuuuacuauggcuuc

SEQ ID NO: 4115986 - RNA, 23 nt, Streptococcus pyogenes M1 GAS
auuuuacuauggcuucuaaaaaa

SEQ ID NO: 4115987 - RNA, 15 nt, Streptococcus pyogenes M1 GAS
auuuuauuuuuuaaa

SEQ ID NO: 4115988 - RNA, 23 nt, Streptococcus pyogenes M1 GAS
auuuucaagguuguggcugauaa

SEQ ID NO: 4115989 - RNA, 13 nt, Streptococcus pyogenes M1 GAS
auuuucaucauca

SEQ ID NO: 4115990 - RNA, 20 nt, Streptococcus pyogenes M1 GAS
auuuucuuugugacaugagu

SEQ ID NO: 4115991 - RNA, 22 nt, Streptococcus pyogenes M1 GAS
auuuucuuugugacaugaguau

SEQ ID NO: 4115992 - RNA, 18 nt, Streptococcus pyogenes M1 GAS
auuuugcagguaauuauc

SEQ ID NO: 4115993 - RNA, 19 nt, Streptococcus pyogenes M1 GAS
auuuugcagguaauuaucu

SEQ ID NO: 4115994 - RNA, 11 nt, Streptococcus pyogenes M1 GAS
auuuugguuga

SEQ ID NO: 4115995 - RNA, 17 nt, Streptococcus pyogenes M1 GAS
auuuugguugauagaag

SEQ ID NO: 4115996 - RNA, 19 nt, Streptococcus pyogenes M1 GAS
auuuugguugauagaagua

SEQ ID NO: 4115997 - RNA, 18 nt, Streptococcus pyogenes M1 GAS
auuuuuaccuuuauuugc

SEQ ID NO: 4115998 - RNA, 15 nt, Streptococcus pyogenes M1 GAS
auuuuuacgaaaaau

SEQ ID NO: 4115999 - RNA, 13 nt, Streptococcus pyogenes M1 GAS
auuuuuauaacaa

SEQ ID NO: 4116000 - RNA, 18 nt, Streptococcus pyogenes M1 GAS
auuuuuauaacaauuaca

SEQ ID NO: 4116001 - RNA, 22 nt, Streptococcus pyogenes M1 GAS
auuuuuauaacaauuacaaccc

SEQ ID NO: 4116002 - RNA, 14 nt, Streptococcus pyogenes M1 GAS
auuuuuauuuaagc

SEQ ID NO: 4116003 - RNA, 23 nt, Streptococcus pyogenes M1 GAS
auuuuucaaaaaaacuucacauu

SEQ ID NO: 4116004 - RNA, 10 nt, Streptococcus pyogenes M1 GAS
auuuuuccuu

SEQ ID NO: 4116005 - RNA, 21 nt, Streptococcus pyogenes M1 GAS
auuuuugauuuuaauuuuucu

SEQ ID NO: 4116006 - RNA, 14 nt, Streptococcus pyogenes M1 GAS
auuuuugccaaaau

SEQ ID NO: 4116007 - RNA, 15 nt, Streptococcus pyogenes M1 GAS
auuuuuuauaauggu

SEQ ID NO: 4116008 - RNA, 16 nt, Streptococcus pyogenes M1 GAS
auuuuuucucaaaaau

SEQ ID NO: 4116009 - RNA, 20 nt, Streptococcus pyogenes M1 GAS
auuuuuuucaggauguuuau

SEQ ID NO: 4116010 - RNA, 21 nt, Streptococcus pyogenes M1 GAS
auuuuuuucuaguucguucau

SEQ ID NO: 4116011 - RNA, 12 nt, Streptococcus pyogenes M1 GAS
caaaaaaagaca

SEQ ID NO: 4116012 - RNA, 12 nt, Streptococcus pyogenes M1 GAS
caaaaaaagcaa

SEQ ID NO: 4116013 - RNA, 18 nt, Streptococcus pyogenes M1 GAS
caaaaaaagcaagcaaca

SEQ ID NO: 4116014 - RNA, 15 nt, Streptococcus pyogenes M1 GAS
cacagccgaauaagg

SEQ ID NO: 4116015 - RNA, 14 nt, Streptococcus pyogenes M1 GAS
cacaugcauaggau

SEQ ID NO: 4116016 - RNA, 13 nt, Streptococcus pyogenes M1 GAS
caccaaaaaaagc

SEQ ID NO: 4116017 - RNA, 10 nt, Streptococcus pyogenes M1 GAS
caccaccaau

SEQ ID NO: 4116018 - RNA, 13 nt, Streptococcus pyogenes M1 GAS
caccaccaauaau

SEQ ID NO: 4116019 - RNA, 15 nt, Streptococcus pyogenes M1 GAS
caccagccacuacaa

SEQ ID NO: 4116020 - RNA, 13 nt, Streptococcus pyogenes M1 GAS
cacccaaacauuc

SEQ ID NO: 4116021 - RNA, 15 nt, Streptococcus pyogenes M1 GAS
caccuacuaacaaca

SEQ ID NO: 4116022 - RNA, 21 nt, Streptococcus pyogenes M1 GAS
caccuuaggcagacaauuauu

SEQ ID NO: 4116023 - RNA, 16 nt, Streptococcus pyogenes M1 GAS
cacguuccaugauuga

SEQ ID NO: 4116024 - RNA, 20 nt, Streptococcus pyogenes M1 GAS
cacuaaaaccauuauaaaag

SEQ ID NO: 4116025 - RNA, 14 nt, Streptococcus pyogenes M1 GAS
cacuaccuuaaaug

SEQ ID NO: 4116026 - RNA, 20 nt, Streptococcus pyogenes M1 GAS
cacuaggccuagcuuuuuac

SEQ ID NO: 4116027 - RNA, 20 nt, Streptococcus pyogenes M1 GAS
cagaaagaagaaaauuaguu

SEQ ID NO: 4116028 - RNA, 14 nt, Streptococcus pyogenes M1 GAS
cagaaaugaaaaga

SEQ ID NO: 4116029 - RNA, 21 nt, Streptococcus pyogenes M1 GAS
cagaaauuaauaaauuuuugu

SEQ ID NO: 4116030 - RNA, 22 nt, Streptococcus pyogenes M1 GAS
cagaaauuaauaaauuuuuguc

SEQ ID NO: 4116031 - RNA, 15 nt, Streptococcus pyogenes M1 GAS
cagaacucgucuuua

SEQ ID NO: 4116032 - RNA, 22 nt, Streptococcus pyogenes M1 GAS
cagaacucgucuuuguccauuu

SEQ ID NO: 4116033 - RNA, 16 nt, Streptococcus pyogenes M1 GAS
cagaagccucuucuga

SEQ ID NO: 4116034 - RNA, 15 nt, Streptococcus pyogenes M1 GAS
cagaauaaagaaaaa

SEQ ID NO: 4116035 - RNA, 16 nt, Streptococcus pyogenes M1 GAS
cagaauaagaaaaccu

SEQ ID NO: 4116036 - RNA, 17 nt, Streptococcus pyogenes M1 GAS
cagaauaagaaaaccuu

SEQ ID NO: 4116037 - RNA, 23 nt, Streptococcus pyogenes M1 GAS
cagacaaaagggaagagagaagc

SEQ ID NO: 4116038 - RNA, 15 nt, Streptococcus pyogenes M1 GAS
cagacaccaaaaaaa

SEQ ID NO: 4116039 - RNA, 22 nt, Streptococcus pyogenes M1 GAS
cagagacaauaaggucaucaga

SEQ ID NO: 4116040 - RNA, 14 nt, Streptococcus pyogenes M1 GAS
cagagaugcuucuu

SEQ ID NO: 4116041 - RNA, 21 nt, Streptococcus pyogenes M1 GAS
cagaggcuugcauuuuuugua

SEQ ID NO: 4116042 - RNA, 15 nt, Streptococcus pyogenes M1 GAS
cagaguacaaggcaa

SEQ ID NO: 4116043 - RNA, 17 nt, Streptococcus pyogenes M1 GAS
cagaguacuucugcagu

SEQ ID NO: 4116044 - RNA, 17 nt, Streptococcus pyogenes M1 GAS
cagauagucaaaaagac

SEQ ID NO: 4116045 - RNA, 19 nt, Streptococcus pyogenes M1 GAS
cagaucauuaaauugauua

SEQ ID NO: 4116046 - RNA, 15 nt, Streptococcus pyogenes M1 GAS
cagauugaagacaaa

SEQ ID NO: 4116047 - RNA, 23 nt, Streptococcus pyogenes M1 GAS
cagauugaagacaaacaucgauu

SEQ ID NO: 4116048 - RNA, 13 nt, Streptococcus pyogenes M1 GAS
cagcaaggcaccu

SEQ ID NO: 4116049 - RNA, 16 nt, Streptococcus pyogenes M1 GAS
cagcaaggcaccugag

SEQ ID NO: 4116050 - RNA, 18 nt, Streptococcus pyogenes M1 GAS
cagcaccuucaaccgcuu

SEQ ID NO: 4116051 - RNA, 15 nt, Streptococcus pyogenes M1 GAS
cagcaccuucuuuua

SEQ ID NO: 4116052 - RNA, 19 nt, Streptococcus pyogenes M1 GAS
cagcagcacuggcuuuuuu

SEQ ID NO: 4116053 - RNA, 15 nt, Streptococcus pyogenes M1 GAS
cagcauuuucaucau

SEQ ID NO: 4116054 - RNA, 19 nt, Streptococcus pyogenes M1 GAS
cagccucuuggaaacaaga

SEQ ID NO: 4116055 - RNA, 16 nt, Streptococcus pyogenes M1 GAS
cagcgucugauauuga

SEQ ID NO: 4116056 - RNA, 16 nt, Streptococcus pyogenes M1 GAS
cagcuaaaaacaaugc

SEQ ID NO: 4116057 - RNA, 13 nt, Streptococcus pyogenes M1 GAS
cagcuaaaagcau

SEQ ID NO: 4116058 - RNA, 22 nt, Streptococcus pyogenes M1 GAS
cagcuaaaagcauaaaaauauu

SEQ ID NO: 4116059 - RNA, 15 nt, Streptococcus pyogenes M1 GAS
cagcuacacuugauu

SEQ ID NO: 4116060 - RNA, 13 nt, Streptococcus pyogenes M1 GAS
cagcugaaacacc

SEQ ID NO: 4116061 - RNA, 19 nt, Streptococcus pyogenes M1 GAS
cagcugaaacaccugcugc

SEQ ID NO: 4116062 - RNA, 20 nt, Streptococcus pyogenes M1 GAS
cagcugaaacaccugcugcu

SEQ ID NO: 4116063 - RNA, 21 nt, Streptococcus pyogenes M1 GAS
cagcugaaacaccugcugcuc

SEQ ID NO: 4116064 - RNA, 16 nt, Streptococcus pyogenes M1 GAS
caggacagucuuuuuu

SEQ ID NO: 4116065 - RNA, 23 nt, Streptococcus pyogenes M1 GAS
caggauugccaucaauguuuugc

SEQ ID NO: 4116066 - RNA, 16 nt, Streptococcus pyogenes M1 GAS
cagguuucuuuugguu

SEQ ID NO: 4116067 - RNA, 14 nt, Streptococcus pyogenes M1 GAS
caguaguuuuagcg

SEQ ID NO: 4116068 - RNA, 18 nt, Streptococcus pyogenes M1 GAS
caguauaacuguuuuucu

SEQ ID NO: 4116069 - RNA, 20 nt, Streptococcus pyogenes M1 GAS
caguauguaaauauaaaguc

SEQ ID NO: 4116070 - RNA, 19 nt, Streptococcus pyogenes M1 GAS
cagucuuuuucauuuuuau

SEQ ID NO: 4116071 - RNA, 20 nt, Streptococcus pyogenes M1 GAS
cagucuuuuuuauaauuauu

SEQ ID NO: 4116072 - RNA, 14 nt, Streptococcus pyogenes M1 GAS
cagugcuuuaacaa

SEQ ID NO: 4116073 - RNA, 20 nt, Streptococcus pyogenes M1 GAS
cagugggcuuuuuuguguuc

SEQ ID NO: 4116074 - RNA, 14 nt, Streptococcus pyogenes M1 GAS
caguuaaaaauaac

SEQ ID NO: 4116075 - RNA, 18 nt, Streptococcus pyogenes M1 GAS
caguugcuugcuuuuuuc

SEQ ID NO: 4116076 - RNA, 16 nt, Streptococcus pyogenes M1 GAS
caguuucccauguuuu

SEQ ID NO: 4116077 - RNA, 23 nt, Streptococcus pyogenes M1 GAS
caguuucccauguuuuauuacca

SEQ ID NO: 4116078 - RNA, 23 nt, Streptococcus pyogenes M1 GAS
cauaaauucuaacucuuguagaa

SEQ ID NO: 4116079 - RNA, 20 nt, Streptococcus pyogenes M1 GAS
cauacaacugacuagccaaa

SEQ ID NO: 4116080 - RNA, 17 nt, Streptococcus pyogenes M1 GAS
cauacacaaaaaaccgc

SEQ ID NO: 4116081 - RNA, 14 nt, Streptococcus pyogenes M1 GAS
cauaccaucaauga

SEQ ID NO: 4116082 - RNA, 18 nt, Streptococcus pyogenes M1 GAS
cauacucaauagcugcug

SEQ ID NO: 4116083 - RNA, 19 nt, Streptococcus pyogenes M1 GAS
cauacucuugucgcugaau

SEQ ID NO: 4116084 - RNA, 22 nt, Streptococcus pyogenes M1 GAS
cauacuuuauuaaucaaaaaac

SEQ ID NO: 4116085 - RNA, 14 nt, Streptococcus pyogenes M1 GAS
cauagcuaauccaa

SEQ ID NO: 4116086 - RNA, 11 nt, Streptococcus pyogenes M1 GAS
cauaucucuau

SEQ ID NO: 4116087 - RNA, 12 nt, Streptococcus pyogenes M1 GAS
cauauuguuaau

SEQ ID NO: 4116088 - RNA, 17 nt, Streptococcus pyogenes M1 GAS
caucaaaaaaagcaaug

SEQ ID NO: 4116089 - RNA, 17 nt, Streptococcus pyogenes M1 GAS
caucaaaagaccauaaa

SEQ ID NO: 4116090 - RNA, 19 nt, Streptococcus pyogenes M1 GAS
caucaaaggguguuuuuua

SEQ ID NO: 4116091 - RNA, 21 nt, Streptococcus pyogenes M1 GAS
caucaagacacccccugcugu

SEQ ID NO: 4116092 - RNA, 22 nt, Streptococcus pyogenes M1 GAS
caucaagacacccccugcuguc

SEQ ID NO: 4116093 - RNA, 15 nt, Streptococcus pyogenes M1 GAS
caucaauguuuugcu

SEQ ID NO: 4116094 - RNA, 15 nt, Streptococcus pyogenes M1 GAS
caucacguacagaaa

SEQ ID NO: 4116095 - RNA, 16 nt, Streptococcus pyogenes M1 GAS
caucacguacagaaau

SEQ ID NO: 4116096 - RNA, 15 nt, Streptococcus pyogenes M1 GAS
caucacuuccauaua

SEQ ID NO: 4116097 - RNA, 18 nt, Streptococcus pyogenes M1 GAS
caucagaauaagaaaacc

SEQ ID NO: 4116098 - RNA, 12 nt, Streptococcus pyogenes M1 GAS
caucagcucuug

SEQ ID NO: 4116099 - RNA, 18 nt, Streptococcus pyogenes M1 GAS
caucaggcuuaaacauau

SEQ ID NO: 4116100 - RNA, 13 nt, Streptococcus pyogenes M1 GAS
caucauauuguua

SEQ ID NO: 4116101 - RNA, 21 nt, Streptococcus pyogenes M1 GAS
caucaucaagaauagcuuuug

SEQ ID NO: 4116102 - RNA, 22 nt, Streptococcus pyogenes M1 GAS
caucaucgaguggauacaaggu

SEQ ID NO: 4116103 - RNA, 16 nt, Streptococcus pyogenes M1 GAS
caucggaacagcugaa

SEQ ID NO: 4116104 - RNA, 20 nt, Streptococcus pyogenes M1 GAS
caucguuaaguggaauguuu

SEQ ID NO: 4116105 - RNA, 16 nt, Streptococcus pyogenes M1 GAS
caucuaaaaaagcaau

SEQ ID NO: 4116106 - RNA, 17 nt, Streptococcus pyogenes M1 GAS
caucuacagcaccuuca

SEQ ID NO: 4116107 - RNA, 14 nt, Streptococcus pyogenes M1 GAS
caucuugcauuacc

SEQ ID NO: 4116108 - RNA, 16 nt, Streptococcus pyogenes M1 GAS
caucuugcauuaccuu

SEQ ID NO: 4116109 - RNA, 17 nt, Streptococcus pyogenes M1 GAS
caucuugccaucagcau

SEQ ID NO: 4116110 - RNA, 18 nt, Streptococcus pyogenes M1 GAS
caucuugccaucagcauc

SEQ ID NO: 4116111 - RNA, 19 nt, Streptococcus pyogenes M1 GAS
caugauaucccaucuuugu

SEQ ID NO: 4116112 - RNA, 21 nt, Streptococcus pyogenes M1 GAS
caugaugccauuuaaaagggc

SEQ ID NO: 4116113 - RNA, 18 nt, Streptococcus pyogenes M1 GAS
caugauguuauuaaauaa

SEQ ID NO: 4116114 - RNA, 13 nt, Streptococcus pyogenes M1 GAS
ccuacaagaggag

SEQ ID NO: 4116115 - RNA, 20 nt, Streptococcus pyogenes M1 GAS
ccuacgauaaaacaaauaau

SEQ ID NO: 4116116 - RNA, 21 nt, Streptococcus pyogenes M1 GAS
ccuacuaacaacaacaacccu

SEQ ID NO: 4116117 - RNA, 16 nt, Streptococcus pyogenes M1 GAS
ccuacuagcacaaaau

SEQ ID NO: 4116118 - RNA, 13 nt, Streptococcus pyogenes M1 GAS
ccuaggaauaaaa

SEQ ID NO: 4116119 - RNA, 20 nt, Streptococcus pyogenes M1 GAS
ccuaugcuaacugauaaaac

SEQ ID NO: 4116120 - RNA, 22 nt, Streptococcus pyogenes M1 GAS
ccuaugcuaacugauaaaacuc

SEQ ID NO: 4116121 - RNA, 22 nt, Streptococcus pyogenes M1 GAS
ccuauuugacuuguuacaaaaa

SEQ ID NO: 4116122 - RNA, 13 nt, Streptococcus pyogenes M1 GAS
ccuccaccaaaac

SEQ ID NO: 4116123 - RNA, 17 nt, Streptococcus pyogenes M1 GAS
ccucuaacauguccaaa

SEQ ID NO: 4116124 - RNA, 14 nt, Streptococcus pyogenes M1 GAS
ccucugaaaaguug

SEQ ID NO: 4116125 - RNA, 19 nt, Streptococcus pyogenes M1 GAS
ccucuuggaaacaagagcu

SEQ ID NO: 4116126 - RNA, 16 nt, Streptococcus pyogenes M1 GAS
ccucuuuagaauucuu

SEQ ID NO: 4116127 - RNA, 18 nt, Streptococcus pyogenes M1 GAS
ccucuuuuuuuuaucauu

SEQ ID NO: 4116128 - RNA, 11 nt, Streptococcus pyogenes M1 GAS
ccugcauaucu

SEQ ID NO: 4116129 - RNA, 22 nt, Streptococcus pyogenes M1 GAS
ccuguagcccuuuuugccuuua

SEQ ID NO: 4116130 - RNA, 19 nt, Streptococcus pyogenes M1 GAS
ccugugacacguaagcucc

SEQ ID NO: 4116131 - RNA, 17 nt, Streptococcus pyogenes M1 GAS
ccuuagcaaaggcuuca

SEQ ID NO: 4116132 - RNA, 17 nt, Streptococcus pyogenes M1 GAS
ccuucaaaaaagggaag

SEQ ID NO: 4116133 - RNA, 22 nt, Streptococcus pyogenes M1 GAS
ccuucaaaaaagggaagaagau

SEQ ID NO: 4116134 - RNA, 23 nt, Streptococcus pyogenes M1 GAS
ccuucguauuggccuucuuggaa

SEQ ID NO: 4116135 - RNA, 22 nt, Streptococcus pyogenes M1 GAS
ccuuuaacuguuagccaugugu

SEQ ID NO: 4116136 - RNA, 21 nt, Streptococcus pyogenes M1 GAS
ccuuuagcaauuguuuuuuca

SEQ ID NO: 4116137 - RNA, 14 nt, Streptococcus pyogenes M1 GAS
ccuuuaucuuauuu

SEQ ID NO: 4116138 - RNA, 17 nt, Streptococcus pyogenes M1 GAS
ccuuucuauauaacugu

SEQ ID NO: 4116139 - RNA, 14 nt, Streptococcus pyogenes M1 GAS
ccuuuugcuucuag

SEQ ID NO: 4116140 - RNA, 22 nt, Streptococcus pyogenes M1 GAS
ccuuuuuggugucagcauaaag

SEQ ID NO: 4116141 - RNA, 17 nt, Streptococcus pyogenes M1 GAS
cgaaaugauagcaccua

SEQ ID NO: 4116142 - RNA, 13 nt, Streptococcus pyogenes M1 GAS
cgaagucucuuuu

SEQ ID NO: 4116143 - RNA, 16 nt, Streptococcus pyogenes M1 GAS
cgaagucucuuuugug

SEQ ID NO: 4116144 - RNA, 20 nt, Streptococcus pyogenes M1 GAS
cgaauaugauauaaaaaugg

SEQ ID NO: 4116145 - RNA, 16 nt, Streptococcus pyogenes M1 GAS
cgaccuuucaagacaa

SEQ ID NO: 4116146 - RNA, 18 nt, Streptococcus pyogenes M1 GAS
cgaccuuucaagacaagc

SEQ ID NO: 4116147 - RNA, 18 nt, Streptococcus pyogenes M1 GAS
cgacucaugauaucccau

SEQ ID NO: 4116148 - RNA, 19 nt, Streptococcus pyogenes M1 GAS
cgaggcuuuuuugagcauc

SEQ ID NO: 4116149 - RNA, 16 nt, Streptococcus pyogenes M1 GAS
cgaucaagaaacucau

SEQ ID NO: 4116150 - RNA, 12 nt, Streptococcus pyogenes M1 GAS
cgauuaaaagau

SEQ ID NO: 4116151 - RNA, 22 nt, Streptococcus pyogenes M1 GAS
cgauuugguguuugucuuuuuu

SEQ ID NO: 4116152 - RNA, 21 nt, Streptococcus pyogenes M1 GAS
cgcauacuggguaucaguccu

SEQ ID NO: 4116153 - RNA, 22 nt, Streptococcus pyogenes M1 GAS
cgccaguaaagucacgaguguu

SEQ ID NO: 4116154 - RNA, 17 nt, Streptococcus pyogenes M1 GAS
cgcuaagggaaaaauua

SEQ ID NO: 4116155 - RNA, 21 nt, Streptococcus pyogenes M1 GAS
cgcucaacuggcacaaacucu

SEQ ID NO: 4116156 - RNA, 18 nt, Streptococcus pyogenes M1 GAS
cgcucuaauuuagucauu

SEQ ID NO: 4116157 - RNA, 13 nt, Streptococcus pyogenes M1 GAS
cgcuuccagaaca

SEQ ID NO: 4116158 - RNA, 16 nt, Streptococcus pyogenes M1 GAS
cggaaauugaccaaaa

SEQ ID NO: 4116159 - RNA, 19 nt, Streptococcus pyogenes M1 GAS
cggaaauugaccaaaagaa

SEQ ID NO: 4116160 - RNA, 16 nt, Streptococcus pyogenes M1 GAS
cggagcuuuaccuccu

SEQ ID NO: 4116161 - RNA, 20 nt, Streptococcus pyogenes M1 GAS
cggaguuccucgguuuuuuu

SEQ ID NO: 4116162 - RNA, 17 nt, Streptococcus pyogenes M1 GAS
cggcaucuacagcaccu

SEQ ID NO: 4116163 - RNA, 16 nt, Streptococcus pyogenes M1 GAS
cgguauccuggaacuc

SEQ ID NO: 4116164 - RNA, 14 nt, Streptococcus pyogenes M1 GAS
cguaaaaagagaag

SEQ ID NO: 4116165 - RNA, 20 nt, Streptococcus pyogenes M1 GAS
cguaaaaagaucuuucuuuu

SEQ ID NO: 4116166 - RNA, 15 nt, Streptococcus pyogenes M1 GAS
cguaacguaauagaa

SEQ ID NO: 4116167 - RNA, 15 nt, Streptococcus pyogenes M1 GAS
cguaauaaaauaaca

SEQ ID NO: 4116168 - RNA, 14 nt, Streptococcus pyogenes M1 GAS
cguagcccucgcua

SEQ ID NO: 4116169 - RNA, 18 nt, Streptococcus pyogenes M1 GAS
cguagcccucgcuaucaa

SEQ ID NO: 4116170 - RNA, 15 nt, Streptococcus pyogenes M1 GAS
cguauaggugaguuu

SEQ ID NO: 4116171 - RNA, 15 nt, Streptococcus pyogenes M1 GAS
cguauuggccuucuu

SEQ ID NO: 4116172 - RNA, 21 nt, Streptococcus pyogenes M1 GAS
cguauugucaucgcuuugaau

SEQ ID NO: 4116173 - RNA, 17 nt, Streptococcus pyogenes M1 GAS
cgucauugcuuuuuaug

SEQ ID NO: 4116174 - RNA, 13 nt, Streptococcus pyogenes M1 GAS
cgucuaaaaagcc

SEQ ID NO: 4116175 - RNA, 15 nt, Streptococcus pyogenes M1 GAS
cgucuggcaauaagu

SEQ ID NO: 4116176 - RNA, 17 nt, Streptococcus pyogenes M1 GAS
cgucuuacaauuaauag

SEQ ID NO: 4116177 - RNA, 14 nt, Streptococcus pyogenes M1 GAS
cguguaccaagcuu

SEQ ID NO: 4116178 - RNA, 13 nt, Streptococcus pyogenes M1 GAS
cguuaacaaaaau

SEQ ID NO: 4116179 - RNA, 12 nt, Streptococcus pyogenes M1 GAS
cguuagcuuuuu

SEQ ID NO: 4116180 - RNA, 19 nt, Streptococcus pyogenes M1 GAS
cguuaucuccacagagucu

SEQ ID NO: 4116181 - RNA, 21 nt, Streptococcus pyogenes M1 GAS
cguuuaaauguccgaaaaaaa

SEQ ID NO: 4116182 - RNA, 19 nt, Streptococcus pyogenes M1 GAS
cguuuauuuaguuauuuuu

SEQ ID NO: 4116183 - RNA, 21 nt, Streptococcus pyogenes M1 GAS
cguuuuacggcuucuacacaa

SEQ ID NO: 4116184 - RNA, 22 nt, Streptococcus pyogenes M1 GAS
cguuuuauuuugauacguuuau

SEQ ID NO: 4116185 - RNA, 19 nt, Streptococcus pyogenes M1 GAS
cguuuuguuguauuaugag

SEQ ID NO: 4116186 - RNA, 17 nt, Streptococcus pyogenes M1 GAS
cguuuuuuguuguaaaa

SEQ ID NO: 4116187 - RNA, 13 nt, Streptococcus pyogenes M1 GAS
cuaaaaaaggagc

SEQ ID NO: 4116188 - RNA, 12 nt, Streptococcus pyogenes M1 GAS
cuaaaaaauaac

SEQ ID NO: 4116189 - RNA, 21 nt, Streptococcus pyogenes M1 GAS
cuaaaaagagagcuuaucaag

SEQ ID NO: 4116190 - RNA, 21 nt, Streptococcus pyogenes M1 GAS
cuaaaaagccuuaaugagaaa

SEQ ID NO: 4116191 - RNA, 17 nt, Streptococcus pyogenes M1 GAS
cuaaaagcauaaaaaua

SEQ ID NO: 4116192 - RNA, 18 nt, Streptococcus pyogenes M1 GAS
cuaaaagcauaaaaauau

SEQ ID NO: 4116193 - RNA, 14 nt, Streptococcus pyogenes M1 GAS
cuaaaauaaaccaa

SEQ ID NO: 4116194 - RNA, 17 nt, Streptococcus pyogenes M1 GAS
cuaaaauaaaccaagcu

SEQ ID NO: 4116195 - RNA, 23 nt, Streptococcus pyogenes M1 GAS
cuaaaaucaugggaaaagcuaag

SEQ ID NO: 4116196 - RNA, 15 nt, Streptococcus pyogenes M1 GAS
cuaaaaugaugagau

SEQ ID NO: 4116197 - RNA, 22 nt, Streptococcus pyogenes M1 GAS
cuaaaauuucugauaggaguga

SEQ ID NO: 4116198 - RNA, 21 nt, Streptococcus pyogenes M1 GAS
cuaaagcaucagcauaaccuu

SEQ ID NO: 4116199 - RNA, 20 nt, Streptococcus pyogenes M1 GAS
cuaaauccuuuugaaaaauu

SEQ ID NO: 4116200 - RNA, 21 nt, Streptococcus pyogenes M1 GAS
cuaaauccuuuugaaaaauua

SEQ ID NO: 4116201 - RNA, 23 nt, Streptococcus pyogenes M1 GAS
cuaaauccuuuugaaaaauuaug

SEQ ID NO: 4116202 - RNA, 21 nt, Streptococcus pyogenes M1 GAS
cuaaaugacaguauacaucaa

SEQ ID NO: 4116203 - RNA, 14 nt, Streptococcus pyogenes M1 GAS
cuaacaaaaucaca

SEQ ID NO: 4116204 - RNA, 21 nt, Streptococcus pyogenes M1 GAS
cuaacaacaacaacccuugau

SEQ ID NO: 4116205 - RNA, 20 nt, Streptococcus pyogenes M1 GAS
cuaacaauuuuucaaaaaaa

SEQ ID NO: 4116206 - RNA, 23 nt, Streptococcus pyogenes M1 GAS
cuaacauggauaccauuucuuug

SEQ ID NO: 4116207 - RNA, 14 nt, Streptococcus pyogenes M1 GAS
cuaacuauuuuuac

SEQ ID NO: 4116208 - RNA, 22 nt, Streptococcus pyogenes M1 GAS
cuaacuauuuuuaccuuuauuu

SEQ ID NO: 4116209 - RNA, 23 nt, Streptococcus pyogenes M1 GAS
cuaacucuuguagaauuucaagu

SEQ ID NO: 4116210 - RNA, 23 nt, Streptococcus pyogenes M1 GAS
cuaagcuauagaaacuuuuuaua

SEQ ID NO: 4116211 - RNA, 17 nt, Streptococcus pyogenes M1 GAS
cuaaguccuuuuaguuu

SEQ ID NO: 4116212 - RNA, 18 nt, Streptococcus pyogenes M1 GAS
cuaauaaaauagcaccua

SEQ ID NO: 4116213 - RNA, 20 nt, Streptococcus pyogenes M1 GAS
cugccaucggaacagcugaa

SEQ ID NO: 4116214 - RNA, 16 nt, Streptococcus pyogenes M1 GAS
cugccccaaaaacgcc

SEQ ID NO: 4116215 - RNA, 13 nt, Streptococcus pyogenes M1 GAS
cugccuuggcccc

SEQ ID NO: 4116216 - RNA, 17 nt, Streptococcus pyogenes M1 GAS
cugccuuggccccuuuu

SEQ ID NO: 4116217 - RNA, 21 nt, Streptococcus pyogenes M1 GAS
cugcuaguaugucuaagaugu

SEQ ID NO: 4116218 - RNA, 19 nt, Streptococcus pyogenes M1 GAS
cugcuaugcgaggcuuuuu

SEQ ID NO: 4116219 - RNA, 15 nt, Streptococcus pyogenes M1 GAS
cugcuguuggauaca

SEQ ID NO: 4116220 - RNA, 15 nt, Streptococcus pyogenes M1 GAS
cugcuugaaaagaug

SEQ ID NO: 4116221 - RNA, 18 nt, Streptococcus pyogenes M1 GAS
cuggaccauuaucaauaa

SEQ ID NO: 4116222 - RNA, 14 nt, Streptococcus pyogenes M1 GAS
cuggagaugagaaa

SEQ ID NO: 4116223 - RNA, 22 nt, Streptococcus pyogenes M1 GAS
cuggagaugagaaagccaagcu

SEQ ID NO: 4116224 - RNA, 16 nt, Streptococcus pyogenes M1 GAS
cuggcuuagcagcacc

SEQ ID NO: 4116225 - RNA, 17 nt, Streptococcus pyogenes M1 GAS
cuggcuuagcagcacca

SEQ ID NO: 4116226 - RNA, 19 nt, Streptococcus pyogenes M1 GAS
cuggcuuuuuugcuuuuua

SEQ ID NO: 4116227 - RNA, 21 nt, Streptococcus pyogenes M1 GAS
cuggguaucaguccuccucuu

SEQ ID NO: 4116228 - RNA, 14 nt, Streptococcus pyogenes M1 GAS
cuggucaaaagcua

SEQ ID NO: 4116229 - RNA, 14 nt, Streptococcus pyogenes M1 GAS
cugguguugagacc

SEQ ID NO: 4116230 - RNA, 15 nt, Streptococcus pyogenes M1 GAS
cugguuuaucauuuu

SEQ ID NO: 4116231 - RNA, 19 nt, Streptococcus pyogenes M1 GAS
cuguaaaauguuauuuaug

SEQ ID NO: 4116232 - RNA, 15 nt, Streptococcus pyogenes M1 GAS
cuguaaauagauaau

SEQ ID NO: 4116233 - RNA, 19 nt, Streptococcus pyogenes M1 GAS
cuguaaaucaguagugaug

SEQ ID NO: 4116234 - RNA, 14 nt, Streptococcus pyogenes M1 GAS
cuguauacaaaaag

SEQ ID NO: 4116235 - RNA, 14 nt, Streptococcus pyogenes M1 GAS
cuguauauuuaaua

SEQ ID NO: 4116236 - RNA, 21 nt, Streptococcus pyogenes M1 GAS
cugucaaaaaauuaagaagga

SEQ ID NO: 4116237 - RNA, 23 nt, Streptococcus pyogenes M1 GAS
cugucuacuuauuugacauuagu

SEQ ID NO: 4116238 - RNA, 23 nt, Streptococcus pyogenes M1 GAS
cugugaccaacucuauccauuau

SEQ ID NO: 4116239 - RNA, 16 nt, Streptococcus pyogenes M1 GAS
cugugaugaaucauuu

SEQ ID NO: 4116240 - RNA, 20 nt, Streptococcus pyogenes M1 GAS
cugugaugaaucauuuugga

SEQ ID NO: 4116241 - RNA, 19 nt, Streptococcus pyogenes M1 GAS
cugugcagugggcuuuuuu

SEQ ID NO: 4116242 - RNA, 14 nt, Streptococcus pyogenes M1 GAS
cuguggguuaagag

SEQ ID NO: 4116243 - RNA, 11 nt, Streptococcus pyogenes M1 GAS
cuguucucuuu

SEQ ID NO: 4116244 - RNA, 21 nt, Streptococcus pyogenes M1 GAS
cuguuggauacaguccaaacu

SEQ ID NO: 4116245 - RNA, 23 nt, Streptococcus pyogenes M1 GAS
cuguuugucauacucaauagcug

SEQ ID NO: 4116246 - RNA, 15 nt, Streptococcus pyogenes M1 GAS
cuuaaacauauuaua

SEQ ID NO: 4116247 - RNA, 15 nt, Streptococcus pyogenes M1 GAS
cuuaacggcaucuac

SEQ ID NO: 4116248 - RNA, 17 nt, Streptococcus pyogenes M1 GAS
cuuaacggcaucuacag

SEQ ID NO: 4116249 - RNA, 13 nt, Streptococcus pyogenes M1 GAS
cuuaaggauuuag

SEQ ID NO: 4116250 - RNA, 22 nt, Streptococcus pyogenes M1 GAS
cuuaauaaacuguauacaaaaa

SEQ ID NO: 4116251 - RNA, 23 nt, Streptococcus pyogenes M1 GAS
cuuaauaaacuguauacaaaaag

SEQ ID NO: 4116252 - RNA, 16 nt, Streptococcus pyogenes M1 GAS
cuuaaucuaaaagcac

SEQ ID NO: 4116253 - RNA, 20 nt, Streptococcus pyogenes M1 GAS
cuuaaucuggagaugagaaa

SEQ ID NO: 4116254 - RNA, 23 nt, Streptococcus pyogenes M1 GAS
cuuaaucuggagaugagaaagcc

SEQ ID NO: 4116255 - RNA, 12 nt, Streptococcus pyogenes M1 GAS
cuuaaugagaaa

SEQ ID NO: 4116256 - RNA, 13 nt, Streptococcus pyogenes M1 GAS
cuuacaaaaagcc

SEQ ID NO: 4116257 - RNA, 14 nt, Streptococcus pyogenes M1 GAS
cuuacaaaaagccu

SEQ ID NO: 4116258 - RNA, 19 nt, Streptococcus pyogenes M1 GAS
cuuacaaaaagccuauuua

SEQ ID NO: 4116259 - RNA, 18 nt, Streptococcus pyogenes M1 GAS
cuuacagcugguuuuuua

SEQ ID NO: 4116260 - RNA, 14 nt, Streptococcus pyogenes M1 GAS
cuuacuaugaaaaa

SEQ ID NO: 4116261 - RNA, 19 nt, Streptococcus pyogenes M1 GAS
cuuacuaugaaaaaagaac

SEQ ID NO: 4116262 - RNA, 19 nt, Streptococcus pyogenes M1 GAS
cuuaggcagacaauuauuu

SEQ ID NO: 4116263 - RNA, 17 nt, Streptococcus pyogenes M1 GAS
cuuaguguagauaaacu

SEQ ID NO: 4116264 - RNA, 16 nt, Streptococcus pyogenes M1 GAS
cuuauaguuugacuuc

SEQ ID NO: 4116265 - RNA, 21 nt, Streptococcus pyogenes M1 GAS
cuuauaguuugacuucaaaaa

SEQ ID NO: 4116266 - RNA, 21 nt, Streptococcus pyogenes M1 GAS
cuuaucucggagcuuuaccuc

SEQ ID NO: 4116267 - RNA, 20 nt, Streptococcus pyogenes M1 GAS
cuuaugcagguguuuaaaga

SEQ ID NO: 4116268 - RNA, 18 nt, Streptococcus pyogenes M1 GAS
cuuauuugacauuagucc

SEQ ID NO: 4116269 - RNA, 15 nt, Streptococcus pyogenes M1 GAS
cuuauuuuaagaagc

SEQ ID NO: 4116270 - RNA, 11 nt, Streptococcus pyogenes M1 GAS
cuuauuuuuuu

SEQ ID NO: 4116271 - RNA, 12 nt, Streptococcus pyogenes M1 GAS
cuucaaaaauac

SEQ ID NO: 4116272 - RNA, 21 nt, Streptococcus pyogenes M1 GAS
cuucaaaaauacuaccuuuag

SEQ ID NO: 4116273 - RNA, 20 nt, Streptococcus pyogenes M1 GAS
cuucaaggaaggcuuguucu

SEQ ID NO: 4116274 - RNA, 16 nt, Streptococcus pyogenes M1 GAS
cuucaauuuuugccaa

SEQ ID NO: 4116275 - RNA, 18 nt, Streptococcus pyogenes M1 GAS
cuucaccuuaggcagaca

SEQ ID NO: 4116276 - RNA, 14 nt, Streptococcus pyogenes M1 GAS
cuucagguuucuuu

SEQ ID NO: 4116277 - RNA, 17 nt, Streptococcus pyogenes M1 GAS
cuucagguuucuuuugg

SEQ ID NO: 4116278 - RNA, 19 nt, Streptococcus pyogenes M1 GAS
cuucaucaaugauagcuuu

SEQ ID NO: 4116279 - RNA, 17 nt, Streptococcus pyogenes M1 GAS
cuuccaaucuuucauua

SEQ ID NO: 4116280 - RNA, 17 nt, Streptococcus pyogenes M1 GAS
cuucguauuggccuucu

SEQ ID NO: 4116281 - RNA, 20 nt, Streptococcus pyogenes M1 GAS
cuucuagcucuuuaucaccu

SEQ ID NO: 4116282 - RNA, 16 nt, Streptococcus pyogenes M1 GAS
cuucucuuuugcuuuu

SEQ ID NO: 4116283 - RNA, 13 nt, Streptococcus pyogenes M1 GAS
cuucugacaugau

SEQ ID NO: 4116284 - RNA, 17 nt, Streptococcus pyogenes M1 GAS
cuucugcagucuuuuuc

SEQ ID NO: 4116285 - RNA, 20 nt, Streptococcus pyogenes M1 GAS
cuucugcagucuuuuucauu

SEQ ID NO: 4116286 - RNA, 13 nt, Streptococcus pyogenes M1 GAS
cuucuuggaaaac

SEQ ID NO: 4116287 - RNA, 19 nt, Streptococcus pyogenes M1 GAS
cuucuuggaaaacagaaag

SEQ ID NO: 4116288 - RNA, 23 nt, Streptococcus pyogenes M1 GAS
cuugauaugguggguaaaaccaa

SEQ ID NO: 4116289 - RNA, 18 nt, Streptococcus pyogenes M1 GAS
cuugaucuuacaaaggau

SEQ ID NO: 4116290 - RNA, 19 nt, Streptococcus pyogenes M1 GAS
cuugauuucauuuucuuug

SEQ ID NO: 4116291 - RNA, 15 nt, Streptococcus pyogenes M1 GAS
cuugcauuaccuuau

SEQ ID NO: 4116292 - RNA, 16 nt, Streptococcus pyogenes M1 GAS
cuugcuaaaauuucug

SEQ ID NO: 4116293 - RNA, 21 nt, Streptococcus pyogenes M1 GAS
cuugcuaaaauuucugauagg

SEQ ID NO: 4116294 - RNA, 14 nt, Streptococcus pyogenes M1 GAS
cuugcuaagagaau

SEQ ID NO: 4116295 - RNA, 14 nt, Streptococcus pyogenes M1 GAS
cuugcuuugacaaa

SEQ ID NO: 4116296 - RNA, 21 nt, Streptococcus pyogenes M1 GAS
cuuggaaacaagagcucaacc

SEQ ID NO: 4116297 - RNA, 13 nt, Streptococcus pyogenes M1 GAS
cuuggccuucuag

SEQ ID NO: 4116298 - RNA, 16 nt, Streptococcus pyogenes M1 GAS
cuugggagaguuccug

SEQ ID NO: 4116299 - RNA, 18 nt, Streptococcus pyogenes M1 GAS
cuugguucugaaaauaaa

SEQ ID NO: 4116300 - RNA, 19 nt, Streptococcus pyogenes M1 GAS
cuugguucugaaaauaaaa

SEQ ID NO: 4116301 - RNA, 19 nt, Streptococcus pyogenes M1 GAS
cuuguaaaaugauacuuuc

SEQ ID NO: 4116302 - RNA, 16 nt, Streptococcus pyogenes M1 GAS
cuuguccgaucuuuug

SEQ ID NO: 4116303 - RNA, 16 nt, Streptococcus pyogenes M1 GAS
cuuguccuguaaauca

SEQ ID NO: 4116304 - RNA, 20 nt, Streptococcus pyogenes M1 GAS
cuugucgcugaauaaacaaa

SEQ ID NO: 4116305 - RNA, 24 nt, Streptococcus pyogenes M1 GAS
cuugucuuuuuuuggccucaaagc

SEQ ID NO: 4116306 - RNA, 14 nt, Streptococcus pyogenes M1 GAS
cuugugcuaaucua

SEQ ID NO: 4116307 - RNA, 13 nt, Streptococcus pyogenes M1 GAS
cuuguuacaaaaa

SEQ ID NO: 4116308 - RNA, 12 nt, Streptococcus pyogenes M1 GAS
cuuguucugguu

SEQ ID NO: 4116309 - RNA, 17 nt, Streptococcus pyogenes M1 GAS
cuuguucuuuauuuuga

SEQ ID NO: 4116310 - RNA, 14 nt, Streptococcus pyogenes M1 GAS
cuuguuuugguuga

SEQ ID NO: 4116311 - RNA, 21 nt, Streptococcus pyogenes M1 GAS
cuuguuuugguugauauaaaa

SEQ ID NO: 4116312 - RNA, 22 nt, Streptococcus pyogenes M1 GAS
cuuguuuugguugauauaaaau

SEQ ID NO: 4116313 - RNA, 23 nt, Streptococcus pyogenes M1 GAS
gacagacaccaaaaaaagcaugg

SEQ ID NO: 4116314 - RNA, 17 nt, Streptococcus pyogenes M1 GAS
gacagcaaggaugaaau

SEQ ID NO: 4116315 - RNA, 15 nt, Streptococcus pyogenes M1 GAS
gacaguuaaaaauaa

SEQ ID NO: 4116316 - RNA, 16 nt, Streptococcus pyogenes M1 GAS
gacaguuaaaaauaac

SEQ ID NO: 4116317 - RNA, 17 nt, Streptococcus pyogenes M1 GAS
gacauacaaagcaucag

SEQ ID NO: 4116318 - RNA, 21 nt, Streptococcus pyogenes M1 GAS
gacauaguguuuugaauguug

SEQ ID NO: 4116319 - RNA, 13 nt, Streptococcus pyogenes M1 GAS
gacauucguucua

SEQ ID NO: 4116320 - RNA, 15 nt, Streptococcus pyogenes M1 GAS
gacauucguucuagu

SEQ ID NO: 4116321 - RNA, 19 nt, Streptococcus pyogenes M1 GAS
gacauuuaugcugauuuug

SEQ ID NO: 4116322 - RNA, 12 nt, Streptococcus pyogenes M1 GAS
gaccccuuaguu

SEQ ID NO: 4116323 - RNA, 19 nt, Streptococcus pyogenes M1 GAS
gaccccuuaguucaaugga

SEQ ID NO: 4116324 - RNA, 21 nt, Streptococcus pyogenes M1 GAS
gaccucucaugggcaaauaaa

SEQ ID NO: 4116325 - RNA, 16 nt, Streptococcus pyogenes M1 GAS
gaccuucaaaaaaggg

SEQ ID NO: 4116326 - RNA, 17 nt, Streptococcus pyogenes M1 GAS
gaccuuucaagacaagc

SEQ ID NO: 4116327 - RNA, 18 nt, Streptococcus pyogenes M1 GAS
gaccuuucaagacaagca

SEQ ID NO: 4116328 - RNA, 13 nt, Streptococcus pyogenes M1 GAS
gaccuuugauaag

SEQ ID NO: 4116329 - RNA, 19 nt, Streptococcus pyogenes M1 GAS
gacuaaccugcauaucugc

SEQ ID NO: 4116330 - RNA, 21 nt, Streptococcus pyogenes M1 GAS
gacuaggaaucgcuuuaggaa

SEQ ID NO: 4116331 - RNA, 20 nt, Streptococcus pyogenes M1 GAS
gacuauagaaaguaaaaaua

SEQ ID NO: 4116332 - RNA, 15 nt, Streptococcus pyogenes M1 GAS
gacucuguuccuaug

SEQ ID NO: 4116333 - RNA, 19 nt, Streptococcus pyogenes M1 GAS
gacugacaaaacuucaaau

SEQ ID NO: 4116334 - RNA, 22 nt, Streptococcus pyogenes M1 GAS
gacugcaguagcaugacuguau

SEQ ID NO: 4116335 - RNA, 14 nt, Streptococcus pyogenes M1 GAS
gacuguaaauagau

SEQ ID NO: 4116336 - RNA, 19 nt, Streptococcus pyogenes M1 GAS
gacuuaauugaaagaggug

SEQ ID NO: 4116337 - RNA, 15 nt, Streptococcus pyogenes M1 GAS
gacuucaaaaucacc

SEQ ID NO: 4116338 - RNA, 20 nt, Streptococcus pyogenes M1 GAS
gacuugguucugaaaauaaa

SEQ ID NO: 4116339 - RNA, 23 nt, Streptococcus pyogenes M1 GAS
gacuugguucugaaaauaaaaua

SEQ ID NO: 4116340 - RNA, 17 nt, Streptococcus pyogenes M1 GAS
gagaagugauguuuuua

SEQ ID NO: 4116341 - RNA, 22 nt, Streptococcus pyogenes M1 GAS
gagaagugauguuuuuacauuu

SEQ ID NO: 4116342 - RNA, 20 nt, Streptococcus pyogenes M1 GAS
gagaaugauaguaaacgaaa

SEQ ID NO: 4116343 - RNA, 22 nt, Streptococcus pyogenes M1 GAS
gagacaaguugccuuaucucag

SEQ ID NO: 4116344 - RNA, 14 nt, Streptococcus pyogenes M1 GAS
gagacaauaagguc

SEQ ID NO: 4116345 - RNA, 22 nt, Streptococcus pyogenes M1 GAS
gagacggguagcauauugccac

SEQ ID NO: 4116346 - RNA, 14 nt, Streptococcus pyogenes M1 GAS
gagagguugguaaa

SEQ ID NO: 4116347 - RNA, 14 nt, Streptococcus pyogenes M1 GAS
gagaucuucuuuug

SEQ ID NO: 4116348 - RNA, 17 nt, Streptococcus pyogenes M1 GAS
gagaugagaaagccaag

SEQ ID NO: 4116349 - RNA, 17 nt, Streptococcus pyogenes M1 GAS
gagauuuuaaaaaaccu

SEQ ID NO: 4116350 - RNA, 17 nt, Streptococcus pyogenes M1 GAS
gagcaaggcaagaggag

SEQ ID NO: 4116351 - RNA, 18 nt, Streptococcus pyogenes M1 GAS
gagcaaggcaagaggagg

SEQ ID NO: 4116352 - RNA, 19 nt, Streptococcus pyogenes M1 GAS
gagcaaggcaagaggaggc

SEQ ID NO: 4116353 - RNA, 18 nt, Streptococcus pyogenes M1 GAS
gagcacguuuucugguuu

SEQ ID NO: 4116354 - RNA, 17 nt, Streptococcus pyogenes M1 GAS
gagccuccaacauagcu

SEQ ID NO: 4116355 - RNA, 23 nt, Streptococcus pyogenes M1 GAS
gagcuagauugcuuccaacuccu

SEQ ID NO: 4116356 - RNA, 21 nt, Streptococcus pyogenes M1 GAS
gagcuuuaguugcuucuuuua

SEQ ID NO: 4116357 - RNA, 19 nt, Streptococcus pyogenes M1 GAS
gagcuuuuuuuguuuuggc

SEQ ID NO: 4116358 - RNA, 14 nt, Streptococcus pyogenes M1 GAS
gaggcaauggcuga

SEQ ID NO: 4116359 - RNA, 15 nt, Streptococcus pyogenes M1 GAS
gaggcaauggcugag

SEQ ID NO: 4116360 - RNA, 19 nt, Streptococcus pyogenes M1 GAS
gaguaaggaccaagauuca

SEQ ID NO: 4116361 - RNA, 14 nt, Streptococcus pyogenes M1 GAS
gaguacaaggcaau

SEQ ID NO: 4116362 - RNA, 14 nt, Streptococcus pyogenes M1 GAS
gagucaaugaaaag

SEQ ID NO: 4116363 - RNA, 15 nt, Streptococcus pyogenes M1 GAS
gaguccuuuuuuugu

SEQ ID NO: 4116364 - RNA, 14 nt, Streptococcus pyogenes M1 GAS
gagucucuagucuu

SEQ ID NO: 4116365 - RNA, 13 nt, Streptococcus pyogenes M1 GAS
gagugauugaugc

SEQ ID NO: 4116366 - RNA, 16 nt, Streptococcus pyogenes M1 GAS
gaguggauacaagguu

SEQ ID NO: 4116367 - RNA, 15 nt, Streptococcus pyogenes M1 GAS
gaguuccucgguuuu

SEQ ID NO: 4116368 - RNA, 15 nt, Streptococcus pyogenes M1 GAS
gauaaaacaaauaau

SEQ ID NO: 4116369 - RNA, 19 nt, Streptococcus pyogenes M1 GAS
gauaaaacucaaaaagcau

SEQ ID NO: 4116370 - RNA, 15 nt, Streptococcus pyogenes M1 GAS
gauaaacuacaccau

SEQ ID NO: 4116371 - RNA, 12 nt, Streptococcus pyogenes M1 GAS
gauaaaggccug

SEQ ID NO: 4116372 - RNA, 14 nt, Streptococcus pyogenes M1 GAS
gauaaauaguacau

SEQ ID NO: 4116373 - RNA, 18 nt, Streptococcus pyogenes M1 GAS
gauaagaccuucaaaaaa

SEQ ID NO: 4116374 - RNA, 21 nt, Streptococcus pyogenes M1 GAS
gauaagaccuucaaaaaaggg

SEQ ID NO: 4116375 - RNA, 22 nt, Streptococcus pyogenes M1 GAS
gauaagaccuucaaaaaaggga

SEQ ID NO: 4116376 - RNA, 14 nt, Streptococcus pyogenes M1 GAS
gauaagugccauca

SEQ ID NO: 4116377 - RNA, 15 nt, Streptococcus pyogenes M1 GAS
gauaagugccaucag

SEQ ID NO: 4116378 - RNA, 21 nt, Streptococcus pyogenes M1 GAS
gauaauaguagguagaacgag

SEQ ID NO: 4116379 - RNA, 18 nt, Streptococcus pyogenes M1 GAS
gauaccaaaucaaaaagc

SEQ ID NO: 4116380 - RNA, 13 nt, Streptococcus pyogenes M1 GAS
gauagcaccuaau

SEQ ID NO: 4116381 - RNA, 15 nt, Streptococcus pyogenes M1 GAS
gauaguaaagaagaa

SEQ ID NO: 4116382 - RNA, 18 nt, Streptococcus pyogenes M1 GAS
gauagucaaaaagacuuc

SEQ ID NO: 4116383 - RNA, 20 nt, Streptococcus pyogenes M1 GAS
gauagucaaaaagacuucuu

SEQ ID NO: 4116384 - RNA, 13 nt, Streptococcus pyogenes M1 GAS
gauagugugugug

SEQ ID NO: 4116385 - RNA, 13 nt, Streptococcus pyogenes M1 GAS
gauauaaaauugg

SEQ ID NO: 4116386 - RNA, 12 nt, Streptococcus pyogenes M1 GAS
gauauaagaagg

SEQ ID NO: 4116387 - RNA, 21 nt, Streptococcus pyogenes M1 GAS
gauauagaauagguaaagauu

SEQ ID NO: 4116388 - RNA, 19 nt, Streptococcus pyogenes M1 GAS
gauauaguccguacaauca

SEQ ID NO: 4116389 - RNA, 21 nt, Streptococcus pyogenes M1 GAS
gauauugaucucugcaacauc

SEQ ID NO: 4116390 - RNA, 15 nt, Streptococcus pyogenes M1 GAS
gaucugcacacacuu

SEQ ID NO: 4116391 - RNA, 14 nt, Streptococcus pyogenes M1 GAS
gaugaaaugauugu

SEQ ID NO: 4116392 - RNA, 16 nt, Streptococcus pyogenes M1 GAS
gaugaaucauuuugga

SEQ ID NO: 4116393 - RNA, 23 nt, Streptococcus pyogenes M1 GAS
gaugagaaagccaagcuuuaaaa

SEQ ID NO: 4116394 - RNA, 22 nt, Streptococcus pyogenes M1 GAS
gaugagauuaacugacaaaaaa

SEQ ID NO: 4116395 - RNA, 19 nt, Streptococcus pyogenes M1 GAS
gaugauugaguaagcagca

SEQ ID NO: 4116396 - RNA, 18 nt, Streptococcus pyogenes M1 GAS
gaugccauuuaaaagggc

SEQ ID NO: 4116397 - RNA, 15 nt, Streptococcus pyogenes M1 GAS
gaugcgcaccuccac

SEQ ID NO: 4116398 - RNA, 20 nt, Streptococcus pyogenes M1 GAS
gauguaccaauuuaagguau

SEQ ID NO: 4116399 - RNA, 15 nt, Streptococcus pyogenes M1 GAS
gaugucauggauauu

SEQ ID NO: 4116400 - RNA, 23 nt, Streptococcus pyogenes M1 GAS
gauguuuacgcuuuacauuuuau

SEQ ID NO: 4116401 - RNA, 21 nt, Streptococcus pyogenes M1 GAS
gauguuuuuacauuuuuacaa

SEQ ID NO: 4116402 - RNA, 14 nt, Streptococcus pyogenes M1 GAS
gauuacauuaggau

SEQ ID NO: 4116403 - RNA, 20 nt, Streptococcus pyogenes M1 GAS
gauuaccuguggucaaaagu

SEQ ID NO: 4116404 - RNA, 18 nt, Streptococcus pyogenes M1 GAS
gauuaguuuuuagcagca

SEQ ID NO: 4116405 - RNA, 19 nt, Streptococcus pyogenes M1 GAS
gauuaguuuuuagcagcag

SEQ ID NO: 4116406 - RNA, 19 nt, Streptococcus pyogenes M1 GAS
gauuauccucuuauagcac

SEQ ID NO: 4116407 - RNA, 12 nt, Streptococcus pyogenes M1 GAS
gauuaugaaaaa

SEQ ID NO: 4116408 - RNA, 15 nt, Streptococcus pyogenes M1 GAS
gauuaugaaaaagaa

SEQ ID NO: 4116409 - RNA, 17 nt, Streptococcus pyogenes M1 GAS
gauuauuagguucuuug

SEQ ID NO: 4116410 - RNA, 20 nt, Streptococcus pyogenes M1 GAS
gauuauuauucuaaaugaca

SEQ ID NO: 4116411 - RNA, 17 nt, Streptococcus pyogenes M1 GAS
gauuauucuuagucuag

SEQ ID NO: 4116412 - RNA, 15 nt, Streptococcus pyogenes M1 GAS
gauucccagagauga

SEQ ID NO: 4116413 - RNA, 13 nt, Streptococcus pyogenes M1 GAS
gcuuuuuaauugu

SEQ ID NO: 4116414 - RNA, 20 nt, Streptococcus pyogenes M1 GAS
gcuuuuuaauuguugcaacc

SEQ ID NO: 4116415 - RNA, 15 nt, Streptococcus pyogenes M1 GAS
gcuuuuuuguguuca

SEQ ID NO: 4116416 - RNA, 15 nt, Streptococcus pyogenes M1 GAS
gcuuuuuuuguaucu

SEQ ID NO: 4116417 - RNA, 11 nt, Streptococcus pyogenes M1 GAS
ggaaaacagaa

SEQ ID NO: 4116418 - RNA, 15 nt, Streptococcus pyogenes M1 GAS
ggaaaacagaaagcg

SEQ ID NO: 4116419 - RNA, 22 nt, Streptococcus pyogenes M1 GAS
ggaaaguaaggguuaacaauga

SEQ ID NO: 4116420 - RNA, 17 nt, Streptococcus pyogenes M1 GAS
ggaaauuuuaaaugaca

SEQ ID NO: 4116421 - RNA, 15 nt, Streptococcus pyogenes M1 GAS
ggaacacucaucaua

SEQ ID NO: 4116422 - RNA, 14 nt, Streptococcus pyogenes M1 GAS
ggaagaacagcauu

SEQ ID NO: 4116423 - RNA, 18 nt, Streptococcus pyogenes M1 GAS
ggaagaacagcauuuuca

SEQ ID NO: 4116424 - RNA, 19 nt, Streptococcus pyogenes M1 GAS
ggaagaucuccaagaucug

SEQ ID NO: 4116425 - RNA, 22 nt, Streptococcus pyogenes M1 GAS
ggacacuuugaaaguuccuuag

SEQ ID NO: 4116426 - RNA, 20 nt, Streptococcus pyogenes M1 GAS
ggacuaaccccuaaucagaa

SEQ ID NO: 4116427 - RNA, 18 nt, Streptococcus pyogenes M1 GAS
ggagcuuuuuuugguccu

SEQ ID NO: 4116428 - RNA, 19 nt, Streptococcus pyogenes M1 GAS
ggauuuagcuguuauugga

SEQ ID NO: 4116429 - RNA, 15 nt, Streptococcus pyogenes M1 GAS
ggauuuauggaacua

SEQ ID NO: 4116430 - RNA, 16 nt, Streptococcus pyogenes M1 GAS
ggcaaaacaaaaagag

SEQ ID NO: 4116431 - RNA, 16 nt, Streptococcus pyogenes M1 GAS
ggcaauccaaaucaac

SEQ ID NO: 4116432 - RNA, 16 nt, Streptococcus pyogenes M1 GAS
ggcacagaaaaaagau

SEQ ID NO: 4116433 - RNA, 14 nt, Streptococcus pyogenes M1 GAS
ggccccuuuuuuga

SEQ ID NO: 4116434 - RNA, 15 nt, Streptococcus pyogenes M1 GAS
ggccccuuuuuugac

SEQ ID NO: 4116435 - RNA, 17 nt, Streptococcus pyogenes M1 GAS
ggccuucuaucaaaacg

SEQ ID NO: 4116436 - RNA, 14 nt, Streptococcus pyogenes M1 GAS
ggcgccguuuuuca

SEQ ID NO: 4116437 - RNA, 13 nt, Streptococcus pyogenes M1 GAS
ggcuaaaaagaga

SEQ ID NO: 4116438 - RNA, 12 nt, Streptococcus pyogenes M1 GAS
ggcuaauaagag

SEQ ID NO: 4116439 - RNA, 15 nt, Streptococcus pyogenes M1 GAS
ggcuaguaaguuuuu

SEQ ID NO: 4116440 - RNA, 14 nt, Streptococcus pyogenes M1 GAS
ggcugccuuggccc

SEQ ID NO: 4116441 - RNA, 15 nt, Streptococcus pyogenes M1 GAS
ggcugucgugcucau

SEQ ID NO: 4116442 - RNA, 16 nt, Streptococcus pyogenes M1 GAS
ggcuguuuccgugcuu

SEQ ID NO: 4116443 - RNA, 13 nt, Streptococcus pyogenes M1 GAS
ggcuuaaacauau

SEQ ID NO: 4116444 - RNA, 20 nt, Streptococcus pyogenes M1 GAS
ggcuuaaucuggagaugaga

SEQ ID NO: 4116445 - RNA, 15 nt, Streptococcus pyogenes M1 GAS
ggcuucuaaaaaagu

SEQ ID NO: 4116446 - RNA, 17 nt, Streptococcus pyogenes M1 GAS
ggcuugcauuuuuugua

SEQ ID NO: 4116447 - RNA, 18 nt, Streptococcus pyogenes M1 GAS
ggcuuucauuauagacua

SEQ ID NO: 4116448 - RNA, 14 nt, Streptococcus pyogenes M1 GAS
gguaaaaaggcagu

SEQ ID NO: 4116449 - RNA, 16 nt, Streptococcus pyogenes M1 GAS
gguaaagauuuuaaau

SEQ ID NO: 4116450 - RNA, 23 nt, Streptococcus pyogenes M1 GAS
gguagcauauugccacuaccuga

SEQ ID NO: 4116451 - RNA, 19 nt, Streptococcus pyogenes M1 GAS
gguagguuugaaacauaug

SEQ ID NO: 4116452 - RNA, 15 nt, Streptococcus pyogenes M1 GAS
gguaucacucguaaa

SEQ ID NO: 4116453 - RNA, 15 nt, Streptococcus pyogenes M1 GAS
ggucaucagaauaag

SEQ ID NO: 4116454 - RNA, 21 nt, Streptococcus pyogenes M1 GAS
gguguaauccccucguuuaaa

SEQ ID NO: 4116455 - RNA, 12 nt, Streptococcus pyogenes M1 GAS
ggugucagcaua

SEQ ID NO: 4116456 - RNA, 13 nt, Streptococcus pyogenes M1 GAS
gguuaaaauagaa

SEQ ID NO: 4116457 - RNA, 16 nt, Streptococcus pyogenes M1 GAS
gguuaaguaaaaggga

SEQ ID NO: 4116458 - RNA, 22 nt, Streptococcus pyogenes M1 GAS
gguucaucuugccaucagcauc

SEQ ID NO: 4116459 - RNA, 19 nt, Streptococcus pyogenes M1 GAS
gguuguggcugauaaaaag

SEQ ID NO: 4116460 - RNA, 16 nt, Streptococcus pyogenes M1 GAS
gguuucacgauaagaa

SEQ ID NO: 4116461 - RNA, 11 nt, Streptococcus pyogenes M1 GAS
gguuucuuuug

SEQ ID NO: 4116462 - RNA, 14 nt, Streptococcus pyogenes M1 GAS
gguuuuuuuaagua

SEQ ID NO: 4116463 - RNA, 13 nt, Streptococcus pyogenes M1 GAS
guaaaaagcaaau

SEQ ID NO: 4116464 - RNA, 16 nt, Streptococcus pyogenes M1 GAS
guaaaaauacuagaaa

SEQ ID NO: 4116465 - RNA, 21 nt, Streptococcus pyogenes M1 GAS
guaaaaauacuagaaaaagca

SEQ ID NO: 4116466 - RNA, 20 nt, Streptococcus pyogenes M1 GAS
guaaagauuuuaaauaucuu

SEQ ID NO: 4116467 - RNA, 16 nt, Streptococcus pyogenes M1 GAS
guaaagcaagggaaac

SEQ ID NO: 4116468 - RNA, 19 nt, Streptococcus pyogenes M1 GAS
guaaagcaagggaaacacc

SEQ ID NO: 4116469 - RNA, 21 nt, Streptococcus pyogenes M1 GAS
guaaaggauuuaguucuguau

SEQ ID NO: 4116470 - RNA, 18 nt, Streptococcus pyogenes M1 GAS
guaaaggauuuaguuuug

SEQ ID NO: 4116471 - RNA, 22 nt, Streptococcus pyogenes M1 GAS
guaaaggauuuaguuuuguauu

SEQ ID NO: 4116472 - RNA, 18 nt, Streptococcus pyogenes M1 GAS
guaaaguuaggaaagaua

SEQ ID NO: 4116473 - RNA, 21 nt, Streptococcus pyogenes M1 GAS
guaaaguuaggaaagauagua

SEQ ID NO: 4116474 - RNA, 22 nt, Streptococcus pyogenes M1 GAS
guaaauauaaagucagacuuaa

SEQ ID NO: 4116475 - RNA, 23 nt, Streptococcus pyogenes M1 GAS
guaacaugcccauugaugaguuu

SEQ ID NO: 4116476 - RNA, 17 nt, Streptococcus pyogenes M1 GAS
guaacgcuuguuuauga

SEQ ID NO: 4116477 - RNA, 13 nt, Streptococcus pyogenes M1 GAS
guaacuugcuuug

SEQ ID NO: 4116478 - RNA, 13 nt, Streptococcus pyogenes M1 GAS
guaagaaagacuu

SEQ ID NO: 4116479 - RNA, 20 nt, Streptococcus pyogenes M1 GAS
guaagcaaccucaguucuga

SEQ ID NO: 4116480 - RNA, 13 nt, Streptococcus pyogenes M1 GAS
guaagccaaaucu

SEQ ID NO: 4116481 - RNA, 18 nt, Streptococcus pyogenes M1 GAS
guaagccaaaucuucugc

SEQ ID NO: 4116482 - RNA, 23 nt, Streptococcus pyogenes M1 GAS
guaagcuccaacgaccuccagcu

SEQ ID NO: 4116483 - RNA, 14 nt, Streptococcus pyogenes M1 GAS
guaauagaauaaaa

SEQ ID NO: 4116484 - RNA, 17 nt, Streptococcus pyogenes M1 GAS
guaauagcguaaagcaa

SEQ ID NO: 4116485 - RNA, 18 nt, Streptococcus pyogenes M1 GAS
guaauagcguaaagcaag

SEQ ID NO: 4116486 - RNA, 18 nt, Streptococcus pyogenes M1 GAS
guaauauuuccuuuuaaa

SEQ ID NO: 4116487 - RNA, 13 nt, Streptococcus pyogenes M1 GAS
guaauccaacaac

SEQ ID NO: 4116488 - RNA, 15 nt, Streptococcus pyogenes M1 GAS
guaauuucuugugcu

SEQ ID NO: 4116489 - RNA, 19 nt, Streptococcus pyogenes M1 GAS
guaauuugguggaagagua

SEQ ID NO: 4116490 - RNA, 12 nt, Streptococcus pyogenes M1 GAS
guacaagagcuu

SEQ ID NO: 4116491 - RNA, 15 nt, Streptococcus pyogenes M1 GAS
guacacgugauaaau

SEQ ID NO: 4116492 - RNA, 14 nt, Streptococcus pyogenes M1 GAS
guacagaaaugaaa

SEQ ID NO: 4116493 - RNA, 15 nt, Streptococcus pyogenes M1 GAS
guaccaauuuaaggu

SEQ ID NO: 4116494 - RNA, 18 nt, Streptococcus pyogenes M1 GAS
guacucaucuaaaaaagc

SEQ ID NO: 4116495 - RNA, 21 nt, Streptococcus pyogenes M1 GAS
guagaacgagucaauuuagcc

SEQ ID NO: 4116496 - RNA, 14 nt, Streptococcus pyogenes M1 GAS
guagcguacaugga

SEQ ID NO: 4116497 - RNA, 22 nt, Streptococcus pyogenes M1 GAS
guagcguuuguguugaagaagg

SEQ ID NO: 4116498 - RNA, 18 nt, Streptococcus pyogenes M1 GAS
guauaacuguuuuucuua

SEQ ID NO: 4116499 - RNA, 14 nt, Streptococcus pyogenes M1 GAS
guauacaaaaaggc

SEQ ID NO: 4116500 - RNA, 17 nt, Streptococcus pyogenes M1 GAS
guauacaucaacuauca

SEQ ID NO: 4116501 - RNA, 14 nt, Streptococcus pyogenes M1 GAS
guauagcauaaaau

SEQ ID NO: 4116502 - RNA, 16 nt, Streptococcus pyogenes M1 GAS
guauagcauaaaauag

SEQ ID NO: 4116503 - RNA, 19 nt, Streptococcus pyogenes M1 GAS
guaucacucguaaaaagau

SEQ ID NO: 4116504 - RNA, 14 nt, Streptococcus pyogenes M1 GAS
guaucuaagcuaua

SEQ ID NO: 4116505 - RNA, 16 nt, Streptococcus pyogenes M1 GAS
guaucuaagcuauaga

SEQ ID NO: 4116506 - RNA, 23 nt, Streptococcus pyogenes M1 GAS
guaugcuuuuaauuuuauuuuuu

SEQ ID NO: 4116507 - RNA, 14 nt, Streptococcus pyogenes M1 GAS
guauucuuaaaaaa

SEQ ID NO: 4116508 - RNA, 23 nt, Streptococcus pyogenes M1 GAS
guauucuuuuuccguuugagaua

SEQ ID NO: 4116509 - RNA, 20 nt, Streptococcus pyogenes M1 GAS
guauuggccuucuuggaaaa

SEQ ID NO: 4116510 - RNA, 14 nt, Streptococcus pyogenes M1 GAS
guauuguagaggac

SEQ ID NO: 4116511 - RNA, 20 nt, Streptococcus pyogenes M1 GAS
guauuguagaggacuaaguc

SEQ ID NO: 4116512 - RNA, 20 nt, Streptococcus pyogenes M1 GAS
guauuuacugggucaacucc

SEQ ID NO: 4116513 - RNA, 12 nt, Streptococcus pyogenes M1 GAS
guauuucuuuag

SEQ ID NO: 4116514 - RNA, 21 nt, Streptococcus pyogenes M1 GAS
guuuuuuuagugaauucuaaa

SEQ ID NO: 4116515 - RNA, 13 nt, Streptococcus pyogenes M1 GAS
uaaaaaaaucccu

SEQ ID NO: 4116516 - RNA, 17 nt, Streptococcus pyogenes M1 GAS
uaaaaaaguuaucacua

SEQ ID NO: 4116517 - RNA, 16 nt, Streptococcus pyogenes M1 GAS
uaaaaaauuuaauagu

SEQ ID NO: 4116518 - RNA, 20 nt, Streptococcus pyogenes M1 GAS
uaaaaacgaucaaaaaucuu

SEQ ID NO: 4116519 - RNA, 20 nt, Streptococcus pyogenes M1 GAS
uaaaaagcaaauugaaaaaa

SEQ ID NO: 4116520 - RNA, 20 nt, Streptococcus pyogenes M1 GAS
uaaaaagguaucccauaucu

SEQ ID NO: 4116521 - RNA, 22 nt, Streptococcus pyogenes M1 GAS
uaaaaagguaucccauaucucu

SEQ ID NO: 4116522 - RNA, 16 nt, Streptococcus pyogenes M1 GAS
uaaaaaguaaaaucuu

SEQ ID NO: 4116523 - RNA, 21 nt, Streptococcus pyogenes M1 GAS
uaaaaaguuucugaguugauu

SEQ ID NO: 4116524 - RNA, 17 nt, Streptococcus pyogenes M1 GAS
uaaaaauacuagaaaaa

SEQ ID NO: 4116525 - RNA, 18 nt, Streptococcus pyogenes M1 GAS
uaaaaauacuagaaaaag

SEQ ID NO: 4116526 - RNA, 20 nt, Streptococcus pyogenes M1 GAS
uaaaagauauuuuaaaauag

SEQ ID NO: 4116527 - RNA, 21 nt, Streptococcus pyogenes M1 GAS
uaaaagauauuuuaaaauagu

SEQ ID NO: 4116528 - RNA, 20 nt, Streptococcus pyogenes M1 GAS
uaaaagaugucgcaaaggcu

SEQ ID NO: 4116529 - RNA, 17 nt, Streptococcus pyogenes M1 GAS
uaaaagggucaguuugu

SEQ ID NO: 4116530 - RNA, 18 nt, Streptococcus pyogenes M1 GAS
uaaaagucaacugauaua

SEQ ID NO: 4116531 - RNA, 18 nt, Streptococcus pyogenes M1 GAS
uaaaaguuagccaagcaa

SEQ ID NO: 4116532 - RNA, 14 nt, Streptococcus pyogenes M1 GAS
uaaaauaucuagaa

SEQ ID NO: 4116533 - RNA, 16 nt, Streptococcus pyogenes M1 GAS
uaaaaugacuucaaaa

SEQ ID NO: 4116534 - RNA, 21 nt, Streptococcus pyogenes M1 GAS
uaaaaugacuucaaaaucacc

SEQ ID NO: 4116535 - RNA, 14 nt, Streptococcus pyogenes M1 GAS
uaaaauuuuaggua

SEQ ID NO: 4116536 - RNA, 20 nt, Streptococcus pyogenes M1 GAS
uaaacaaugagucaccugua

SEQ ID NO: 4116537 - RNA, 17 nt, Streptococcus pyogenes M1 GAS
uaaacuguauacaaaaa

SEQ ID NO: 4116538 - RNA, 15 nt, Streptococcus pyogenes M1 GAS
uaaacuuacaaaaag

SEQ ID NO: 4116539 - RNA, 17 nt, Streptococcus pyogenes M1 GAS
uaaacuuacaaaaagcc

SEQ ID NO: 4116540 - RNA, 12 nt, Streptococcus pyogenes M1 GAS
uaaacuuaugau

SEQ ID NO: 4116541 - RNA, 18 nt, Streptococcus pyogenes M1 GAS
uaaagaaacaaaaaugaa

SEQ ID NO: 4116542 - RNA, 12 nt, Streptococcus pyogenes M1 GAS
uaaagaagaauu

SEQ ID NO: 4116543 - RNA, 17 nt, Streptococcus pyogenes M1 GAS
uaaagaagaauuaacgu

SEQ ID NO: 4116544 - RNA, 15 nt, Streptococcus pyogenes M1 GAS
uaaagacaaaaaacu

SEQ ID NO: 4116545 - RNA, 16 nt, Streptococcus pyogenes M1 GAS
uaaagacaaaaaacua

SEQ ID NO: 4116546 - RNA, 21 nt, Streptococcus pyogenes M1 GAS
uaaagacaaaaaacuagaaac

SEQ ID NO: 4116547 - RNA, 15 nt, Streptococcus pyogenes M1 GAS
uaaagagccucagga

SEQ ID NO: 4116548 - RNA, 16 nt, Streptococcus pyogenes M1 GAS
uaaagauuuuaaauau

SEQ ID NO: 4116549 - RNA, 18 nt, Streptococcus pyogenes M1 GAS
uaaagauuuuaaauaucu

SEQ ID NO: 4116550 - RNA, 13 nt, Streptococcus pyogenes M1 GAS
uaaagcaucagca

SEQ ID NO: 4116551 - RNA, 16 nt, Streptococcus pyogenes M1 GAS
uaaagccaaccccaag

SEQ ID NO: 4116552 - RNA, 16 nt, Streptococcus pyogenes M1 GAS
uaaagccuuauccauu

SEQ ID NO: 4116553 - RNA, 17 nt, Streptococcus pyogenes M1 GAS
uaaagcuaaguugaaug

SEQ ID NO: 4116554 - RNA, 12 nt, Streptococcus pyogenes M1 GAS
uaaaggauuuag

SEQ ID NO: 4116555 - RNA, 17 nt, Streptococcus pyogenes M1 GAS
uaaaggauuuaguuuug

SEQ ID NO: 4116556 - RNA, 23 nt, Streptococcus pyogenes M1 GAS
uaaaggccuguauuucuuuagua

SEQ ID NO: 4116557 - RNA, 20 nt, Streptococcus pyogenes M1 GAS
uaaaggugccuguuuuugcu

SEQ ID NO: 4116558 - RNA, 13 nt, Streptococcus pyogenes M1 GAS
uaaaguuaggaaa

SEQ ID NO: 4116559 - RNA, 15 nt, Streptococcus pyogenes M1 GAS
uaaauauaaauuauu

SEQ ID NO: 4116560 - RNA, 19 nt, Streptococcus pyogenes M1 GAS
uaaauaucuuaccauugua

SEQ ID NO: 4116561 - RNA, 22 nt, Streptococcus pyogenes M1 GAS
uaaauuauuaacguuaacaaaa

SEQ ID NO: 4116562 - RNA, 18 nt, Streptococcus pyogenes M1 GAS
uaaauugauuauucuuua

SEQ ID NO: 4116563 - RNA, 19 nt, Streptococcus pyogenes M1 GAS
uaaauugauuauucuuuau

SEQ ID NO: 4116564 - RNA, 20 nt, Streptococcus pyogenes M1 GAS
uaaauugauuauucuuuauu

SEQ ID NO: 4116565 - RNA, 21 nt, Streptococcus pyogenes M1 GAS
uaaauuuggagagauaaaaag

SEQ ID NO: 4116566 - RNA, 23 nt, Streptococcus pyogenes M1 GAS
uaaauuuggagagauaaaaagua

SEQ ID NO: 4116567 - RNA, 23 nt, Streptococcus pyogenes M1 GAS
uaacaaaaugaagcaaaauaaac

SEQ ID NO: 4116568 - RNA, 12 nt, Streptococcus pyogenes M1 GAS
uaacaaauuuau

SEQ ID NO: 4116569 - RNA, 12 nt, Streptococcus pyogenes M1 GAS
uaacaacaacaa

SEQ ID NO: 4116570 - RNA, 20 nt, Streptococcus pyogenes M1 GAS
uaacaacaacaacccuugau

SEQ ID NO: 4116571 - RNA, 22 nt, Streptococcus pyogenes M1 GAS
uaacacagaagccucuucugau

SEQ ID NO: 4116572 - RNA, 19 nt, Streptococcus pyogenes M1 GAS
uaacacgguuuucugucua

SEQ ID NO: 4116573 - RNA, 21 nt, Streptococcus pyogenes M1 GAS
uaacagcaacaucaaaaagag

SEQ ID NO: 4116574 - RNA, 13 nt, Streptococcus pyogenes M1 GAS
uaacaucuugauu

SEQ ID NO: 4116575 - RNA, 16 nt, Streptococcus pyogenes M1 GAS
uaacaucuugauugua

SEQ ID NO: 4116576 - RNA, 20 nt, Streptococcus pyogenes M1 GAS
uaacauuuaugagauuagca

SEQ ID NO: 4116577 - RNA, 16 nt, Streptococcus pyogenes M1 GAS
uaaccauaucacaaaa

SEQ ID NO: 4116578 - RNA, 14 nt, Streptococcus pyogenes M1 GAS
uaaccauugccauu

SEQ ID NO: 4116579 - RNA, 22 nt, Streptococcus pyogenes M1 GAS
uaaccauugccauuaauaauau

SEQ ID NO: 4116580 - RNA, 18 nt, Streptococcus pyogenes M1 GAS
uaacccgucuuacaauua

SEQ ID NO: 4116581 - RNA, 22 nt, Streptococcus pyogenes M1 GAS
uaacccgucuuacaauuaauag

SEQ ID NO: 4116582 - RNA, 23 nt, Streptococcus pyogenes M1 GAS
uaaccucuuaguuguagagacua

SEQ ID NO: 4116583 - RNA, 17 nt, Streptococcus pyogenes M1 GAS
uaaccugcauaucugcc

SEQ ID NO: 4116584 - RNA, 14 nt, Streptococcus pyogenes M1 GAS
uaaccuuugccauu

SEQ ID NO: 4116585 - RNA, 17 nt, Streptococcus pyogenes M1 GAS
uaaccuuuuggcuguau

SEQ ID NO: 4116586 - RNA, 20 nt, Streptococcus pyogenes M1 GAS
uaacuauuucacuuaucauu

SEQ ID NO: 4116587 - RNA, 18 nt, Streptococcus pyogenes M1 GAS
uaacugguccaucauuga

SEQ ID NO: 4116588 - RNA, 20 nt, Streptococcus pyogenes M1 GAS
uaacugguccaucauugaug

SEQ ID NO: 4116589 - RNA, 23 nt, Streptococcus pyogenes M1 GAS
uaacugguccaucauugaugaga

SEQ ID NO: 4116590 - RNA, 13 nt, Streptococcus pyogenes M1 GAS
uaacuuucuauua

SEQ ID NO: 4116591 - RNA, 17 nt, Streptococcus pyogenes M1 GAS
uaacuuucuauuaccua

SEQ ID NO: 4116592 - RNA, 17 nt, Streptococcus pyogenes M1 GAS
uaacuuuuagcuaagaa

SEQ ID NO: 4116593 - RNA, 18 nt, Streptococcus pyogenes M1 GAS
uaacuuuuagcuaagaau

SEQ ID NO: 4116594 - RNA, 19 nt, Streptococcus pyogenes M1 GAS
uaacuuuuagcuaagaaua

SEQ ID NO: 4116595 - RNA, 21 nt, Streptococcus pyogenes M1 GAS
uaacuuuuagcuaagaauaac

SEQ ID NO: 4116596 - RNA, 24 nt, Streptococcus pyogenes M1 GAS
uaagacccuccacccaaacauuca

SEQ ID NO: 4116597 - RNA, 13 nt, Streptococcus pyogenes M1 GAS
uaagaccuucaaa

SEQ ID NO: 4116598 - RNA, 18 nt, Streptococcus pyogenes M1 GAS
uaagaccuucaaaaaagg

SEQ ID NO: 4116599 - RNA, 20 nt, Streptococcus pyogenes M1 GAS
uaagaccuucaaaaaaggga

SEQ ID NO: 4116600 - RNA, 17 nt, Streptococcus pyogenes M1 GAS
uaagacuauguugcuua

SEQ ID NO: 4116601 - RNA, 12 nt, Streptococcus pyogenes M1 GAS
uaagagaauaac

SEQ ID NO: 4116602 - RNA, 22 nt, Streptococcus pyogenes M1 GAS
uaagagagguugguaaaaaggc

SEQ ID NO: 4116603 - RNA, 18 nt, Streptococcus pyogenes M1 GAS
uaagauacugcccuugau

SEQ ID NO: 4116604 - RNA, 15 nt, Streptococcus pyogenes M1 GAS
uaagauggugcuuua

SEQ ID NO: 4116605 - RNA, 13 nt, Streptococcus pyogenes M1 GAS
uaagauucaauau

SEQ ID NO: 4116606 - RNA, 21 nt, Streptococcus pyogenes M1 GAS
uaagcaucauuauugacaaau

SEQ ID NO: 4116607 - RNA, 13 nt, Streptococcus pyogenes M1 GAS
uaagcauuuugag

SEQ ID NO: 4116608 - RNA, 15 nt, Streptococcus pyogenes M1 GAS
uaagcauuuugagaa

SEQ ID NO: 4116609 - RNA, 12 nt, Streptococcus pyogenes M1 GAS
uaagccaaaucu

SEQ ID NO: 4116610 - RNA, 13 nt, Streptococcus pyogenes M1 GAS
uaagccaaaucuu

SEQ ID NO: 4116611 - RNA, 13 nt, Streptococcus pyogenes M1 GAS
uaagcuauagaaa

SEQ ID NO: 4116612 - RNA, 15 nt, Streptococcus pyogenes M1 GAS
uaaggauuaugaaaa

SEQ ID NO: 4116613 - RNA, 20 nt, Streptococcus pyogenes M1 GAS
uaaggauuaugaaaaagaag

SEQ ID NO: 4116614 - RNA, 17 nt, Streptococcus pyogenes M1 GAS
uagagucucuagucuuu

SEQ ID NO: 4116615 - RNA, 15 nt, Streptococcus pyogenes M1 GAS
uagauaaacugguua

SEQ ID NO: 4116616 - RNA, 16 nt, Streptococcus pyogenes M1 GAS
uagauaauguuguuuu

SEQ ID NO: 4116617 - RNA, 18 nt, Streptococcus pyogenes M1 GAS
uagaucaauuccaucacu

SEQ ID NO: 4116618 - RNA, 17 nt, Streptococcus pyogenes M1 GAS
uagcaaguccugcuuuu

SEQ ID NO: 4116619 - RNA, 20 nt, Streptococcus pyogenes M1 GAS
uagcaauuguuuuuucaaca

SEQ ID NO: 4116620 - RNA, 15 nt, Streptococcus pyogenes M1 GAS
uagcacguuggaaaa

SEQ ID NO: 4116621 - RNA, 18 nt, Streptococcus pyogenes M1 GAS
uagcacguuggaaaagga

SEQ ID NO: 4116622 - RNA, 19 nt, Streptococcus pyogenes M1 GAS
uagcacguuggaaaaggaa

SEQ ID NO: 4116623 - RNA, 13 nt, Streptococcus pyogenes M1 GAS
uagcagacaaaag

SEQ ID NO: 4116624 - RNA, 19 nt, Streptococcus pyogenes M1 GAS
uagcaguuauaauuaguau

SEQ ID NO: 4116625 - RNA, 20 nt, Streptococcus pyogenes M1 GAS
uagcauaaaagauauuuuaa

SEQ ID NO: 4116626 - RNA, 20 nt, Streptococcus pyogenes M1 GAS
uagcauuaaggauuaugaaa

SEQ ID NO: 4116627 - RNA, 20 nt, Streptococcus pyogenes M1 GAS
uagcauugucaaauaaaauc

SEQ ID NO: 4116628 - RNA, 13 nt, Streptococcus pyogenes M1 GAS
uagcccaagggca

SEQ ID NO: 4116629 - RNA, 22 nt, Streptococcus pyogenes M1 GAS
uagccugugcagugggcuuuuu

SEQ ID NO: 4116630 - RNA, 21 nt, Streptococcus pyogenes M1 GAS
uagccuuuuuuugucugacuu

SEQ ID NO: 4116631 - RNA, 14 nt, Streptococcus pyogenes M1 GAS
uagcuuuuguaaua

SEQ ID NO: 4116632 - RNA, 20 nt, Streptococcus pyogenes M1 GAS
uaggaauaguuuagugcugc

SEQ ID NO: 4116633 - RNA, 16 nt, Streptococcus pyogenes M1 GAS
uaggaauaucaugaag

SEQ ID NO: 4116634 - RNA, 18 nt, Streptococcus pyogenes M1 GAS
uaggaauaucaugaagua

SEQ ID NO: 4116635 - RNA, 16 nt, Streptococcus pyogenes M1 GAS
uaggaaucacaacuuc

SEQ ID NO: 4116636 - RNA, 17 nt, Streptococcus pyogenes M1 GAS
uaggacuaaccccuaau

SEQ ID NO: 4116637 - RNA, 20 nt, Streptococcus pyogenes M1 GAS
uaggacuaaccccuaaucag

SEQ ID NO: 4116638 - RNA, 22 nt, Streptococcus pyogenes M1 GAS
uaggauauaagaaggucucaaa

SEQ ID NO: 4116639 - RNA, 19 nt, Streptococcus pyogenes M1 GAS
uaggguagcugguuugauu

SEQ ID NO: 4116640 - RNA, 20 nt, Streptococcus pyogenes M1 GAS
uaggguagcugguuugauua

SEQ ID NO: 4116641 - RNA, 21 nt, Streptococcus pyogenes M1 GAS
uagguaaaguuaggaaagaua

SEQ ID NO: 4116642 - RNA, 15 nt, Streptococcus pyogenes M1 GAS
uaggugaguuuuuuc

SEQ ID NO: 4116643 - RNA, 14 nt, Streptococcus pyogenes M1 GAS
uagguuaaaauaga

SEQ ID NO: 4116644 - RNA, 17 nt, Streptococcus pyogenes M1 GAS
uagguucuuugguuuga

SEQ ID NO: 4116645 - RNA, 20 nt, Streptococcus pyogenes M1 GAS
uagguucuuugguuugauga

SEQ ID NO: 4116646 - RNA, 17 nt, Streptococcus pyogenes M1 GAS
uaguaaagccuuaucca

SEQ ID NO: 4116647 - RNA, 17 nt, Streptococcus pyogenes M1 GAS
uaguaaccauugccauu

SEQ ID NO: 4116648 - RNA, 19 nt, Streptococcus pyogenes M1 GAS
uaguacaguauguaaauau

SEQ ID NO: 4116649 - RNA, 15 nt, Streptococcus pyogenes M1 GAS
uaguagcaaauaaca

SEQ ID NO: 4116650 - RNA, 15 nt, Streptococcus pyogenes M1 GAS
uagucaaaaagacuu

SEQ ID NO: 4116651 - RNA, 20 nt, Streptococcus pyogenes M1 GAS
uagucagaucauuaaauuga

SEQ ID NO: 4116652 - RNA, 12 nt, Streptococcus pyogenes M1 GAS
uagucuuuaaaa

SEQ ID NO: 4116653 - RNA, 15 nt, Streptococcus pyogenes M1 GAS
uagucuuuaaaaaac

SEQ ID NO: 4116654 - RNA, 15 nt, Streptococcus pyogenes M1 GAS
uagugaauucuaaaa

SEQ ID NO: 4116655 - RNA, 18 nt, Streptococcus pyogenes M1 GAS
uaguuauguuauaagaga

SEQ ID NO: 4116656 - RNA, 21 nt, Streptococcus pyogenes M1 GAS
uaguucguucauaaauucuaa

SEQ ID NO: 4116657 - RNA, 17 nt, Streptococcus pyogenes M1 GAS
uaguuggauccuuuauc

SEQ ID NO: 4116658 - RNA, 18 nt, Streptococcus pyogenes M1 GAS
uaguugguauauagcuca

SEQ ID NO: 4116659 - RNA, 16 nt, Streptococcus pyogenes M1 GAS
uaguuuuauuuugaua

SEQ ID NO: 4116660 - RNA, 23 nt, Streptococcus pyogenes M1 GAS
uauaaaagagugcaguguacuca

SEQ ID NO: 4116661 - RNA, 11 nt, Streptococcus pyogenes M1 GAS
uauaaacaaag

SEQ ID NO: 4116662 - RNA, 20 nt, Streptococcus pyogenes M1 GAS
uauaaacuuguugacucuga

SEQ ID NO: 4116663 - RNA, 14 nt, Streptococcus pyogenes M1 GAS
uauaaagaaacaaa

SEQ ID NO: 4116664 - RNA, 15 nt, Streptococcus pyogenes M1 GAS
uauaaagaaacaaaa

SEQ ID NO: 4116665 - RNA, 17 nt, Streptococcus pyogenes M1 GAS
uauaaagaaacaaaaau

SEQ ID NO: 4116666 - RNA, 23 nt, Streptococcus pyogenes M1 GAS
uauaaauuauuaacguuaacaaa

SEQ ID NO: 4116667 - RNA, 13 nt, Streptococcus pyogenes M1 GAS
uauaacaauuaca

SEQ ID NO: 4116668 - RNA, 20 nt, Streptococcus pyogenes M1 GAS
uauaaccucuagcuugugag

SEQ ID NO: 4116669 - RNA, 16 nt, Streptococcus pyogenes M1 GAS
uauaacuguuuuucuu

SEQ ID NO: 4116670 - RNA, 12 nt, Streptococcus pyogenes M1 GAS
uauaagcaauca

SEQ ID NO: 4116671 - RNA, 21 nt, Streptococcus pyogenes M1 GAS
uauaauuaguauauuguaaua

SEQ ID NO: 4116672 - RNA, 16 nt, Streptococcus pyogenes M1 GAS
uauacgguaaaaacuc

SEQ ID NO: 4116673 - RNA, 21 nt, Streptococcus pyogenes M1 GAS
uauacgguaaaaacucaaaaa

SEQ ID NO: 4116674 - RNA, 22 nt, Streptococcus pyogenes M1 GAS
uauacgguaaaaacucaaaaaa

SEQ ID NO: 4116675 - RNA, 14 nt, Streptococcus pyogenes M1 GAS
uauacuuuaaacac

SEQ ID NO: 4116676 - RNA, 12 nt, Streptococcus pyogenes M1 GAS
uauagaaaguaa

SEQ ID NO: 4116677 - RNA, 14 nt, Streptococcus pyogenes M1 GAS
uauagaaaguaaaa

SEQ ID NO: 4116678 - RNA, 14 nt, Streptococcus pyogenes M1 GAS
uauagaauagguaa

SEQ ID NO: 4116679 - RNA, 17 nt, Streptococcus pyogenes M1 GAS
uauagcaaucuucaaca

SEQ ID NO: 4116680 - RNA, 16 nt, Streptococcus pyogenes M1 GAS
uauaggugaguuuuuu

SEQ ID NO: 4116681 - RNA, 18 nt, Streptococcus pyogenes M1 GAS
uauauggguguuggaggu

SEQ ID NO: 4116682 - RNA, 21 nt, Streptococcus pyogenes M1 GAS
uauaugucaucaaaagaccau

SEQ ID NO: 4116683 - RNA, 21 nt, Streptococcus pyogenes M1 GAS
uaucaaguaugcuuuuaauuu

SEQ ID NO: 4116684 - RNA, 22 nt, Streptococcus pyogenes M1 GAS
uaucaauaacagaaauuaauaa

SEQ ID NO: 4116685 - RNA, 16 nt, Streptococcus pyogenes M1 GAS
uaucaggcaaaacaaa

SEQ ID NO: 4116686 - RNA, 12 nt, Streptococcus pyogenes M1 GAS
uaucauacucuu

SEQ ID NO: 4116687 - RNA, 17 nt, Streptococcus pyogenes M1 GAS
uaucauauuccauauga

SEQ ID NO: 4116688 - RNA, 19 nt, Streptococcus pyogenes M1 GAS
uaucaugaaguauaguuau

SEQ ID NO: 4116689 - RNA, 13 nt, Streptococcus pyogenes M1 GAS
uaucauucuaaca

SEQ ID NO: 4116690 - RNA, 20 nt, Streptococcus pyogenes M1 GAS
uaucauuggggaaacuagca

SEQ ID NO: 4116691 - RNA, 15 nt, Streptococcus pyogenes M1 GAS
uauccaacuuuuauc

SEQ ID NO: 4116692 - RNA, 16 nt, Streptococcus pyogenes M1 GAS
uauccaaugaaaacuc

SEQ ID NO: 4116693 - RNA, 13 nt, Streptococcus pyogenes M1 GAS
uauccauuauaaa

SEQ ID NO: 4116694 - RNA, 15 nt, Streptococcus pyogenes M1 GAS
uauccauuauaaauc

SEQ ID NO: 4116695 - RNA, 16 nt, Streptococcus pyogenes M1 GAS
uauccauucuuuauaa

SEQ ID NO: 4116696 - RNA, 16 nt, Streptococcus pyogenes M1 GAS
uaucccuggaccauua

SEQ ID NO: 4116697 - RNA, 14 nt, Streptococcus pyogenes M1 GAS
uauccuccuaaaua

SEQ ID NO: 4116698 - RNA, 20 nt, Streptococcus pyogenes M1 GAS
uauccuccuaaauauaaauu

SEQ ID NO: 4116699 - RNA, 17 nt, Streptococcus pyogenes M1 GAS
uauccucuuuuaguuca

SEQ ID NO: 4116700 - RNA, 21 nt, Streptococcus pyogenes M1 GAS
uauccuggaacuccuaaaaca

SEQ ID NO: 4116701 - RNA, 22 nt, Streptococcus pyogenes M1 GAS
uauccuggaacuccuaaaacau

SEQ ID NO: 4116702 - RNA, 18 nt, Streptococcus pyogenes M1 GAS
uaucuagaacagcugcuu

SEQ ID NO: 4116703 - RNA, 14 nt, Streptococcus pyogenes M1 GAS
uaucucguaauccu

SEQ ID NO: 4116704 - RNA, 21 nt, Streptococcus pyogenes M1 GAS
uaucugauaagguuuuuuuaa

SEQ ID NO: 4116705 - RNA, 15 nt, Streptococcus pyogenes M1 GAS
uaucugauauuucau

SEQ ID NO: 4116706 - RNA, 19 nt, Streptococcus pyogenes M1 GAS
uaucuuucaguuguuuuaa

SEQ ID NO: 4116707 - RNA, 18 nt, Streptococcus pyogenes M1 GAS
uaugaaaaaagaacaaag

SEQ ID NO: 4116708 - RNA, 13 nt, Streptococcus pyogenes M1 GAS
uaugaaaaagaag

SEQ ID NO: 4116709 - RNA, 13 nt, Streptococcus pyogenes M1 GAS
uaugacuaaacgu

SEQ ID NO: 4116710 - RNA, 20 nt, Streptococcus pyogenes M1 GAS
uaugauacauugaauaaagu

SEQ ID NO: 4116711 - RNA, 23 nt, Streptococcus pyogenes M1 GAS
uaugauuugucaaaaaguaaaaa

SEQ ID NO: 4116712 - RNA, 16 nt, Streptococcus pyogenes M1 GAS
uaugcuaacugauaaa

SEQ ID NO: 4116713 - RNA, 19 nt, Streptococcus pyogenes M1 GAS
uaugcuaacugauaaaacu

SEQ ID NO: 4116714 - RNA, 19 nt, Streptococcus pyogenes M1 GAS
ucauacaacugacuagcca

SEQ ID NO: 4116715 - RNA, 19 nt, Streptococcus pyogenes M1 GAS
ucauacucaauagcugcug

SEQ ID NO: 4116716 - RNA, 21 nt, Streptococcus pyogenes M1 GAS
ucauauaagcaaucaucauuu

SEQ ID NO: 4116717 - RNA, 14 nt, Streptococcus pyogenes M1 GAS
ucaucaaaagacca

SEQ ID NO: 4116718 - RNA, 16 nt, Streptococcus pyogenes M1 GAS
ucaucaaaagaccaua

SEQ ID NO: 4116719 - RNA, 21 nt, Streptococcus pyogenes M1 GAS
ucaucaaaagaccauaaaaaa

SEQ ID NO: 4116720 - RNA, 17 nt, Streptococcus pyogenes M1 GAS
ucaucaagaauagcuuu

SEQ ID NO: 4116721 - RNA, 21 nt, Streptococcus pyogenes M1 GAS
ucaucaagaauagcuuuugua

SEQ ID NO: 4116722 - RNA, 16 nt, Streptococcus pyogenes M1 GAS
ucaucagaauaagaaa

SEQ ID NO: 4116723 - RNA, 20 nt, Streptococcus pyogenes M1 GAS
ucaucauuuagcugauaauc

SEQ ID NO: 4116724 - RNA, 18 nt, Streptococcus pyogenes M1 GAS
ucaucuugccaucagcau

SEQ ID NO: 4116725 - RNA, 20 nt, Streptococcus pyogenes M1 GAS
ucaucuugccaucagcaucu

SEQ ID NO: 4116726 - RNA, 20 nt, Streptococcus pyogenes M1 GAS
ucaugacgccuccaaauacu

SEQ ID NO: 4116727 - RNA, 22 nt, Streptococcus pyogenes M1 GAS
ucaugacgccuccaaauacugg

SEQ ID NO: 4116728 - RNA, 19 nt, Streptococcus pyogenes M1 GAS
ucaugugcuaucauggagu

SEQ ID NO: 4116729 - RNA, 12 nt, Streptococcus pyogenes M1 GAS
ucauuauagacu

SEQ ID NO: 4116730 - RNA, 14 nt, Streptococcus pyogenes M1 GAS
ucauuauugucacu

SEQ ID NO: 4116731 - RNA, 14 nt, Streptococcus pyogenes M1 GAS
ucauugcuuuuuau

SEQ ID NO: 4116732 - RNA, 21 nt, Streptococcus pyogenes M1 GAS
ucauuuuggagagauuuuaaa

SEQ ID NO: 4116733 - RNA, 14 nt, Streptococcus pyogenes M1 GAS
ucauuuugguugau

SEQ ID NO: 4116734 - RNA, 12 nt, Streptococcus pyogenes M1 GAS
uccaaaauacau

SEQ ID NO: 4116735 - RNA, 17 nt, Streptococcus pyogenes M1 GAS
uccaaaguucuucuaaa

SEQ ID NO: 4116736 - RNA, 18 nt, Streptococcus pyogenes M1 GAS
uccaacaacgcuauuuuu

SEQ ID NO: 4116737 - RNA, 17 nt, Streptococcus pyogenes M1 GAS
uccaagaucugcacaca

SEQ ID NO: 4116738 - RNA, 15 nt, Streptococcus pyogenes M1 GAS
uccaaucuuucauua

SEQ ID NO: 4116739 - RNA, 17 nt, Streptococcus pyogenes M1 GAS
uccaaugaaaacuccag

SEQ ID NO: 4116740 - RNA, 22 nt, Streptococcus pyogenes M1 GAS
uccaguucuguuucuaagcaaa

SEQ ID NO: 4116741 - RNA, 18 nt, Streptococcus pyogenes M1 GAS
uccauaggccacccaaua

SEQ ID NO: 4116742 - RNA, 13 nt, Streptococcus pyogenes M1 GAS
uccauauaauuuu

SEQ ID NO: 4116743 - RNA, 16 nt, Streptococcus pyogenes M1 GAS
uccaucacuuccauau

SEQ ID NO: 4116744 - RNA, 16 nt, Streptococcus pyogenes M1 GAS
uccaugauugauuuua

SEQ ID NO: 4116745 - RNA, 23 nt, Streptococcus pyogenes M1 GAS
uccauuauaaaucuuacuaacua

SEQ ID NO: 4116746 - RNA, 15 nt, Streptococcus pyogenes M1 GAS
uccauucuuuauaau

SEQ ID NO: 4116747 - RNA, 15 nt, Streptococcus pyogenes M1 GAS
uccauuuuuuauaau

SEQ ID NO: 4116748 - RNA, 17 nt, Streptococcus pyogenes M1 GAS
ucccagcagcaaaggcg

SEQ ID NO: 4116749 - RNA, 20 nt, Streptococcus pyogenes M1 GAS
ucccagcagcaaaggcgauu

SEQ ID NO: 4116750 - RNA, 14 nt, Streptococcus pyogenes M1 GAS
ucccauaucucuau

SEQ ID NO: 4116751 - RNA, 12 nt, Streptococcus pyogenes M1 GAS
ucccauguuuua

SEQ ID NO: 4116752 - RNA, 15 nt, Streptococcus pyogenes M1 GAS
ucccauguuuuauua

SEQ ID NO: 4116753 - RNA, 16 nt, Streptococcus pyogenes M1 GAS
ucccuacuaggcuuuc

SEQ ID NO: 4116754 - RNA, 14 nt, Streptococcus pyogenes M1 GAS
uccguacacuccug

SEQ ID NO: 4116755 - RNA, 16 nt, Streptococcus pyogenes M1 GAS
uccuaaaaccauaccu

SEQ ID NO: 4116756 - RNA, 13 nt, Streptococcus pyogenes M1 GAS
uccuaacaauuuu

SEQ ID NO: 4116757 - RNA, 18 nt, Streptococcus pyogenes M1 GAS
uccuaaccuuuuggcugu

SEQ ID NO: 4116758 - RNA, 17 nt, Streptococcus pyogenes M1 GAS
uccucuaacauguccaa

SEQ ID NO: 4116759 - RNA, 13 nt, Streptococcus pyogenes M1 GAS
uccucugaaaagu

SEQ ID NO: 4116760 - RNA, 17 nt, Streptococcus pyogenes M1 GAS
uccuggauuaaaugccc

SEQ ID NO: 4116761 - RNA, 18 nt, Streptococcus pyogenes M1 GAS
uccuuagcaguuauaauu

SEQ ID NO: 4116762 - RNA, 22 nt, Streptococcus pyogenes M1 GAS
uccuuguacaagagcuuaaaag

SEQ ID NO: 4116763 - RNA, 13 nt, Streptococcus pyogenes M1 GAS
uccuuugaccaca

SEQ ID NO: 4116764 - RNA, 14 nt, Streptococcus pyogenes M1 GAS
uccuuuuaaagaca

SEQ ID NO: 4116765 - RNA, 18 nt, Streptococcus pyogenes M1 GAS
ucgaaauugguccucuga

SEQ ID NO: 4116766 - RNA, 23 nt, Streptococcus pyogenes M1 GAS
ucgacauuuaugcugauuuugga

SEQ ID NO: 4116767 - RNA, 20 nt, Streptococcus pyogenes M1 GAS
ucgagcuuucuacuaaaaaa

SEQ ID NO: 4116768 - RNA, 17 nt, Streptococcus pyogenes M1 GAS
ucgccuaggaauaaaau

SEQ ID NO: 4116769 - RNA, 22 nt, Streptococcus pyogenes M1 GAS
ucgcuuugaauacguaaaaaga

SEQ ID NO: 4116770 - RNA, 18 nt, Streptococcus pyogenes M1 GAS
ucggaaaacuuuugacuu

SEQ ID NO: 4116771 - RNA, 18 nt, Streptococcus pyogenes M1 GAS
ucgguuuuuuuaaguaag

SEQ ID NO: 4116772 - RNA, 12 nt, Streptococcus pyogenes M1 GAS
ucguaaaaagau

SEQ ID NO: 4116773 - RNA, 19 nt, Streptococcus pyogenes M1 GAS
ucgucugcaaguucuuugc

SEQ ID NO: 4116774 - RNA, 17 nt, Streptococcus pyogenes M1 GAS
ucgucuuuguccauuuu

SEQ ID NO: 4116775 - RNA, 20 nt, Streptococcus pyogenes M1 GAS
ucguuauaaacaaagccagu

SEQ ID NO: 4116776 - RNA, 21 nt, Streptococcus pyogenes M1 GAS
ucguuuuacggcuucuacaca

SEQ ID NO: 4116777 - RNA, 18 nt, Streptococcus pyogenes M1 GAS
ucguuuugcaauuaagua

SEQ ID NO: 4116778 - RNA, 22 nt, Streptococcus pyogenes M1 GAS
ucuaaaaagccuuaaugagaaa

SEQ ID NO: 4116779 - RNA, 21 nt, Streptococcus pyogenes M1 GAS
ucuaaaauccucuuuuaauuu

SEQ ID NO: 4116780 - RNA, 21 nt, Streptococcus pyogenes M1 GAS
ucuaaaugacaguauacauca

SEQ ID NO: 4116781 - RNA, 19 nt, Streptococcus pyogenes M1 GAS
ucuaagcuauagaaacuuu

SEQ ID NO: 4116782 - RNA, 23 nt, Streptococcus pyogenes M1 GAS
ucuaaguuuuuaucauauuccau

SEQ ID NO: 4116783 - RNA, 12 nt, Streptococcus pyogenes M1 GAS
ucuaaucagaac

SEQ ID NO: 4116784 - RNA, 15 nt, Streptococcus pyogenes M1 GAS
ucuacacaaaagcuu

SEQ ID NO: 4116785 - RNA, 15 nt, Streptococcus pyogenes M1 GAS
ucuacagcaccuuca

SEQ ID NO: 4116786 - RNA, 14 nt, Streptococcus pyogenes M1 GAS
ucuacuugucauga

SEQ ID NO: 4116787 - RNA, 16 nt, Streptococcus pyogenes M1 GAS
ucuagaacagcugcuu

SEQ ID NO: 4116788 - RNA, 23 nt, Streptococcus pyogenes M1 GAS
ucuagacucuagcauaaaagaua

SEQ ID NO: 4116789 - RNA, 14 nt, Streptococcus pyogenes M1 GAS
ucuagcuugugagg

SEQ ID NO: 4116790 - RNA, 20 nt, Streptococcus pyogenes M1 GAS
ucuagucagaucauuaaauu

SEQ ID NO: 4116791 - RNA, 16 nt, Streptococcus pyogenes M1 GAS
ucuagucuuuuuaugu

SEQ ID NO: 4116792 - RNA, 22 nt, Streptococcus pyogenes M1 GAS
ucuaguucguucauaaauucua

SEQ ID NO: 4116793 - RNA, 22 nt, Streptococcus pyogenes M1 GAS
ucuauagcauuaaggauuauga

SEQ ID NO: 4116794 - RNA, 13 nt, Streptococcus pyogenes M1 GAS
ucuauaucuauga

SEQ ID NO: 4116795 - RNA, 18 nt, Streptococcus pyogenes M1 GAS
ucuauauguguaauuucu

SEQ ID NO: 4116796 - RNA, 13 nt, Streptococcus pyogenes M1 GAS
ucuaucaaaacgu

SEQ ID NO: 4116797 - RNA, 15 nt, Streptococcus pyogenes M1 GAS
ucuaucaaaacguua

SEQ ID NO: 4116798 - RNA, 19 nt, Streptococcus pyogenes M1 GAS
ucuauugucguugaugcaa

SEQ ID NO: 4116799 - RNA, 20 nt, Streptococcus pyogenes M1 GAS
ucucaaaaauauauucuaau

SEQ ID NO: 4116800 - RNA, 14 nt, Streptococcus pyogenes M1 GAS
ucucaaauuuuuuu

SEQ ID NO: 4116801 - RNA, 21 nt, Streptococcus pyogenes M1 GAS
ucucagagacaauaaggucau

SEQ ID NO: 4116802 - RNA, 15 nt, Streptococcus pyogenes M1 GAS
ucucauaaacaauga

SEQ ID NO: 4116803 - RNA, 21 nt, Streptococcus pyogenes M1 GAS
ucuccaaaguucuucuaaacg

SEQ ID NO: 4116804 - RNA, 14 nt, Streptococcus pyogenes M1 GAS
ucuccgacugcagu

SEQ ID NO: 4116805 - RNA, 19 nt, Streptococcus pyogenes M1 GAS
ucucuacgauagugucaga

SEQ ID NO: 4116806 - RNA, 15 nt, Streptococcus pyogenes M1 GAS
ucucuagaacagauu

SEQ ID NO: 4116807 - RNA, 18 nt, Streptococcus pyogenes M1 GAS
ucucuauaucuaugauuu

SEQ ID NO: 4116808 - RNA, 14 nt, Streptococcus pyogenes M1 GAS
ucucuuuggagaaa

SEQ ID NO: 4116809 - RNA, 17 nt, Streptococcus pyogenes M1 GAS
ucucuuuggagaaauuc

SEQ ID NO: 4116810 - RNA, 12 nt, Streptococcus pyogenes M1 GAS
ucugaauuauua

SEQ ID NO: 4116811 - RNA, 16 nt, Streptococcus pyogenes M1 GAS
ucugacguaagcauca

SEQ ID NO: 4116812 - RNA, 15 nt, Streptococcus pyogenes M1 GAS
ucugagauauucauu

SEQ ID NO: 4116813 - RNA, 18 nt, Streptococcus pyogenes M1 GAS
ucugagcgguuuugucuu

SEQ ID NO: 4116814 - RNA, 18 nt, Streptococcus pyogenes M1 GAS
ugauaagguuuuuuuaag

SEQ ID NO: 4116815 - RNA, 14 nt, Streptococcus pyogenes M1 GAS
ugauauaaaaaugg

SEQ ID NO: 4116816 - RNA, 16 nt, Streptococcus pyogenes M1 GAS
ugauauaaaaauggag

SEQ ID NO: 4116817 - RNA, 13 nt, Streptococcus pyogenes M1 GAS
ugauauaaaauug

SEQ ID NO: 4116818 - RNA, 13 nt, Streptococcus pyogenes M1 GAS
ugauauacugaaa

SEQ ID NO: 4116819 - RNA, 20 nt, Streptococcus pyogenes M1 GAS
ugauaugguggguaaaacca

SEQ ID NO: 4116820 - RNA, 21 nt, Streptococcus pyogenes M1 GAS
ugauaugguggguaaaaccaa

SEQ ID NO: 4116821 - RNA, 14 nt, Streptococcus pyogenes M1 GAS
ugauauuucaucuu

SEQ ID NO: 4116822 - RNA, 20 nt, Streptococcus pyogenes M1 GAS
ugauauuucaucuugcauua

SEQ ID NO: 4116823 - RNA, 23 nt, Streptococcus pyogenes M1 GAS
ugauauuuuuucucaaaaauaua

SEQ ID NO: 4116824 - RNA, 18 nt, Streptococcus pyogenes M1 GAS
ugaucuguuuaaaaacaa

SEQ ID NO: 4116825 - RNA, 15 nt, Streptococcus pyogenes M1 GAS
ugaucuuacaaagga

SEQ ID NO: 4116826 - RNA, 22 nt, Streptococcus pyogenes M1 GAS
ugaugagacuaaccugcauauc

SEQ ID NO: 4116827 - RNA, 12 nt, Streptococcus pyogenes M1 GAS
ugaugauggagu

SEQ ID NO: 4116828 - RNA, 14 nt, Streptococcus pyogenes M1 GAS
ugaugcguuuauaa

SEQ ID NO: 4116829 - RNA, 15 nt, Streptococcus pyogenes M1 GAS
ugaugcguuuauaaa

SEQ ID NO: 4116830 - RNA, 17 nt, Streptococcus pyogenes M1 GAS
ugauggcuuuccauucu

SEQ ID NO: 4116831 - RNA, 16 nt, Streptococcus pyogenes M1 GAS
ugauguaccaauuuaa

SEQ ID NO: 4116832 - RNA, 20 nt, Streptococcus pyogenes M1 GAS
ugauguagggcuguaaaaug

SEQ ID NO: 4116833 - RNA, 21 nt, Streptococcus pyogenes M1 GAS
ugauguagggcuguaaaaugu

SEQ ID NO: 4116834 - RNA, 14 nt, Streptococcus pyogenes M1 GAS
ugauguuauuaaau

SEQ ID NO: 4116835 - RNA, 15 nt, Streptococcus pyogenes M1 GAS
ugauguuuuuacauu

SEQ ID NO: 4116836 - RNA, 19 nt, Streptococcus pyogenes M1 GAS
ugauuacugauaaacuuga

SEQ ID NO: 4116837 - RNA, 21 nt, Streptococcus pyogenes M1 GAS
ugauuaguuuuuagcagcaga

SEQ ID NO: 4116838 - RNA, 16 nt, Streptococcus pyogenes M1 GAS
ugauuauuauucuaaa

SEQ ID NO: 4116839 - RNA, 17 nt, Streptococcus pyogenes M1 GAS
ugauuauuauucuaaau

SEQ ID NO: 4116840 - RNA, 13 nt, Streptococcus pyogenes M1 GAS
ugauuauucuuua

SEQ ID NO: 4116841 - RNA, 15 nt, Streptococcus pyogenes M1 GAS
ugauugauuugucuu

SEQ ID NO: 4116842 - RNA, 21 nt, Streptococcus pyogenes M1 GAS
ugauuuaugaccauuuuuacu

SEQ ID NO: 4116843 - RNA, 16 nt, Streptococcus pyogenes M1 GAS
ugauuuuaauuuuucu

SEQ ID NO: 4116844 - RNA, 17 nt, Streptococcus pyogenes M1 GAS
ugauuuuaauuuuucuu

SEQ ID NO: 4116845 - RNA, 23 nt, Streptococcus pyogenes M1 GAS
ugauuuuucuuguuuugguugau

SEQ ID NO: 4116846 - RNA, 13 nt, Streptococcus pyogenes M1 GAS
ugcaaauaguuca

SEQ ID NO: 4116847 - RNA, 21 nt, Streptococcus pyogenes M1 GAS
ugcacacaaaucuucuagaau

SEQ ID NO: 4116848 - RNA, 12 nt, Streptococcus pyogenes M1 GAS
ugcagaauagaa

SEQ ID NO: 4116849 - RNA, 17 nt, Streptococcus pyogenes M1 GAS
ugcagaauagaaauagu

SEQ ID NO: 4116850 - RNA, 16 nt, Streptococcus pyogenes M1 GAS
ugcagaguacaaggca

SEQ ID NO: 4116851 - RNA, 22 nt, Streptococcus pyogenes M1 GAS
ugcagaguacaaggcaauccaa

SEQ ID NO: 4116852 - RNA, 15 nt, Streptococcus pyogenes M1 GAS
ugcagcuaaaaacaa

SEQ ID NO: 4116853 - RNA, 13 nt, Streptococcus pyogenes M1 GAS
ugcagguaauuau

SEQ ID NO: 4116854 - RNA, 15 nt, Streptococcus pyogenes M1 GAS
ugcagucuuuuucau

SEQ ID NO: 4116855 - RNA, 14 nt, Streptococcus pyogenes M1 GAS
ugcauuaccuuauu

SEQ ID NO: 4116856 - RNA, 20 nt, Streptococcus pyogenes M1 GAS
ugccacuaccugaauugcug

SEQ ID NO: 4116857 - RNA, 22 nt, Streptococcus pyogenes M1 GAS
ugccaguaaggaaaucaauccu

SEQ ID NO: 4116858 - RNA, 18 nt, Streptococcus pyogenes M1 GAS
ugccaucaaaaaaagaca

SEQ ID NO: 4116859 - RNA, 15 nt, Streptococcus pyogenes M1 GAS
ugccaucagcaucug

SEQ ID NO: 4116860 - RNA, 21 nt, Streptococcus pyogenes M1 GAS
ugccaucugcuuggauuuccu

SEQ ID NO: 4116861 - RNA, 16 nt, Streptococcus pyogenes M1 GAS
ugccauggguaaaaug

SEQ ID NO: 4116862 - RNA, 17 nt, Streptococcus pyogenes M1 GAS
ugccauggguaaaauga

SEQ ID NO: 4116863 - RNA, 17 nt, Streptococcus pyogenes M1 GAS
ugccauuuaaaagggca

SEQ ID NO: 4116864 - RNA, 18 nt, Streptococcus pyogenes M1 GAS
ugccauuuccuacaaaau

SEQ ID NO: 4116865 - RNA, 20 nt, Streptococcus pyogenes M1 GAS
ugccauuuccuacaaaauaa

SEQ ID NO: 4116866 - RNA, 17 nt, Streptococcus pyogenes M1 GAS
ugccuuggccccuuuuu

SEQ ID NO: 4116867 - RNA, 14 nt, Streptococcus pyogenes M1 GAS
ugcgcaccuccacc

SEQ ID NO: 4116868 - RNA, 20 nt, Streptococcus pyogenes M1 GAS
ugcgcauguugacuauuuuu

SEQ ID NO: 4116869 - RNA, 19 nt, Streptococcus pyogenes M1 GAS
ugcgcuauggacuaucuga

SEQ ID NO: 4116870 - RNA, 16 nt, Streptococcus pyogenes M1 GAS
ugcuaucauggaguca

SEQ ID NO: 4116871 - RNA, 13 nt, Streptococcus pyogenes M1 GAS
ugcuccuaucaua

SEQ ID NO: 4116872 - RNA, 15 nt, Streptococcus pyogenes M1 GAS
ugcugaguucuuuuu

SEQ ID NO: 4116873 - RNA, 20 nt, Streptococcus pyogenes M1 GAS
ugcugauuuuggaugaaagu

SEQ ID NO: 4116874 - RNA, 12 nt, Streptococcus pyogenes M1 GAS
ugcuggugacua

SEQ ID NO: 4116875 - RNA, 17 nt, Streptococcus pyogenes M1 GAS
ugcugucucuacgauag

SEQ ID NO: 4116876 - RNA, 16 nt, Streptococcus pyogenes M1 GAS
ugcuguuugucauacu

SEQ ID NO: 4116877 - RNA, 23 nt, Streptococcus pyogenes M1 GAS
ugcuguuugucauacucaauagc

SEQ ID NO: 4116878 - RNA, 13 nt, Streptococcus pyogenes M1 GAS
ugcuucuagucag

SEQ ID NO: 4116879 - RNA, 12 nt, Streptococcus pyogenes M1 GAS
ugcuucuuucaa

SEQ ID NO: 4116880 - RNA, 19 nt, Streptococcus pyogenes M1 GAS
ugcuugcucaauuuuugau

SEQ ID NO: 4116881 - RNA, 21 nt, Streptococcus pyogenes M1 GAS
ugcuugucuuuuuuuggccuc

SEQ ID NO: 4116882 - RNA, 13 nt, Streptococcus pyogenes M1 GAS
ugcuuuaaaaagu

SEQ ID NO: 4116883 - RNA, 21 nt, Streptococcus pyogenes M1 GAS
ugcuuuugaugcagcuaaaag

SEQ ID NO: 4116884 - RNA, 20 nt, Streptococcus pyogenes M1 GAS
ugcuuuugccacgcuucuua

SEQ ID NO: 4116885 - RNA, 13 nt, Streptococcus pyogenes M1 GAS
ugcuuuuuuuguc

SEQ ID NO: 4116886 - RNA, 23 nt, Streptococcus pyogenes M1 GAS
uggaaaguaaggguuaacaauga

SEQ ID NO: 4116887 - RNA, 15 nt, Streptococcus pyogenes M1 GAS
uggaacuccuaaaac

SEQ ID NO: 4116888 - RNA, 17 nt, Streptococcus pyogenes M1 GAS
uggaacuccuaaaacau

SEQ ID NO: 4116889 - RNA, 14 nt, Streptococcus pyogenes M1 GAS
uggaaggcacagaa

SEQ ID NO: 4116890 - RNA, 22 nt, Streptococcus pyogenes M1 GAS
uggaaggcacagaaaaaagaua

SEQ ID NO: 4116891 - RNA, 23 nt, Streptococcus pyogenes M1 GAS
uggaaggcacagaaaaaagauaa

SEQ ID NO: 4116892 - RNA, 18 nt, Streptococcus pyogenes M1 GAS
uggaccacucgugcugcc

SEQ ID NO: 4116893 - RNA, 16 nt, Streptococcus pyogenes M1 GAS
uggaccauuaucaaua

SEQ ID NO: 4116894 - RNA, 21 nt, Streptococcus pyogenes M1 GAS
uggacgaaggcucuuaucuuu

SEQ ID NO: 4116895 - RNA, 16 nt, Streptococcus pyogenes M1 GAS
uggagagauaaaaagu

SEQ ID NO: 4116896 - RNA, 21 nt, Streptococcus pyogenes M1 GAS
uggagagauuucguugacaaa

SEQ ID NO: 4116897 - RNA, 18 nt, Streptococcus pyogenes M1 GAS
uggagcuuuaguugcuuc

SEQ ID NO: 4116898 - RNA, 22 nt, Streptococcus pyogenes M1 GAS
uggagcuuuaguugcuucuuuu

SEQ ID NO: 4116899 - RNA, 22 nt, Streptococcus pyogenes M1 GAS
uggaguucuugacgcaucuccu

SEQ ID NO: 4116900 - RNA, 16 nt, Streptococcus pyogenes M1 GAS
uggauaccauuucuuu

SEQ ID NO: 4116901 - RNA, 21 nt, Streptococcus pyogenes M1 GAS
uggauaccauuucuuugcaaa

SEQ ID NO: 4116902 - RNA, 22 nt, Streptococcus pyogenes M1 GAS
uggauccuuuaucuuauuuuaa

SEQ ID NO: 4116903 - RNA, 15 nt, Streptococcus pyogenes M1 GAS
uggaucguuuugcaa

SEQ ID NO: 4116904 - RNA, 23 nt, Streptococcus pyogenes M1 GAS
uggauuaaaugcccaagaugggu

SEQ ID NO: 4116905 - RNA, 21 nt, Streptococcus pyogenes M1 GAS
uggccaauaaaauaucuagaa

SEQ ID NO: 4116906 - RNA, 23 nt, Streptococcus pyogenes M1 GAS
uggccuucuagucggacuuggua

SEQ ID NO: 4116907 - RNA, 21 nt, Streptococcus pyogenes M1 GAS
uggcgggccuucuaucaaaac

SEQ ID NO: 4116908 - RNA, 14 nt, Streptococcus pyogenes M1 GAS
uggcuaaaaagaga

SEQ ID NO: 4116909 - RNA, 18 nt, Streptococcus pyogenes M1 GAS
uggcuaaaaagagagcuu

SEQ ID NO: 4116910 - RNA, 17 nt, Streptococcus pyogenes M1 GAS
uggcuacucuauuuuaa

SEQ ID NO: 4116911 - RNA, 20 nt, Streptococcus pyogenes M1 GAS
uggcuacucuauuuuaagua

SEQ ID NO: 4116912 - RNA, 21 nt, Streptococcus pyogenes M1 GAS
uggcuguauuuacugggucaa

SEQ ID NO: 4116913 - RNA, 22 nt, Streptococcus pyogenes M1 GAS
uggcuucuagguagguuugaaa

SEQ ID NO: 4116914 - RNA, 18 nt, Streptococcus pyogenes M1 GAS
uuacaucaaaaaaagcaa

SEQ ID NO: 4116915 - RNA, 14 nt, Streptococcus pyogenes M1 GAS
uuaccuuauuuucu

SEQ ID NO: 4116916 - RNA, 19 nt, Streptococcus pyogenes M1 GAS
uuacguccuguuugugaug

SEQ ID NO: 4116917 - RNA, 15 nt, Streptococcus pyogenes M1 GAS
uuacuaacuagcaag

SEQ ID NO: 4116918 - RNA, 14 nt, Streptococcus pyogenes M1 GAS
uuacuaugaaaaaa

SEQ ID NO: 4116919 - RNA, 14 nt, Streptococcus pyogenes M1 GAS
uuacuauggcuucu

SEQ ID NO: 4116920 - RNA, 18 nt, Streptococcus pyogenes M1 GAS
uuacuuggaucuucuucu

SEQ ID NO: 4116921 - RNA, 19 nt, Streptococcus pyogenes M1 GAS
uuagaauccuccucuuuuu

SEQ ID NO: 4116922 - RNA, 19 nt, Streptococcus pyogenes M1 GAS
uuagcaaaaugcuguuugu

SEQ ID NO: 4116923 - RNA, 18 nt, Streptococcus pyogenes M1 GAS
uuagcaauccaacuuuga

SEQ ID NO: 4116924 - RNA, 19 nt, Streptococcus pyogenes M1 GAS
uuagcaccagcauuugcca

SEQ ID NO: 4116925 - RNA, 15 nt, Streptococcus pyogenes M1 GAS
uuagcagacaaaagg

SEQ ID NO: 4116926 - RNA, 17 nt, Streptococcus pyogenes M1 GAS
uuagcagacaaaaggga

SEQ ID NO: 4116927 - RNA, 14 nt, Streptococcus pyogenes M1 GAS
uuagcauauuuuga

SEQ ID NO: 4116928 - RNA, 17 nt, Streptococcus pyogenes M1 GAS
uuagccguccuuaaaag

SEQ ID NO: 4116929 - RNA, 20 nt, Streptococcus pyogenes M1 GAS
uuagcggcacguuauucucu

SEQ ID NO: 4116930 - RNA, 14 nt, Streptococcus pyogenes M1 GAS
uuagcuaagaauaa

SEQ ID NO: 4116931 - RNA, 19 nt, Streptococcus pyogenes M1 GAS
uuagcuuuuuuuaaagcua

SEQ ID NO: 4116932 - RNA, 19 nt, Streptococcus pyogenes M1 GAS
uuagguggagcuuuaguug

SEQ ID NO: 4116933 - RNA, 12 nt, Streptococcus pyogenes M1 GAS
uuagguucuuug

SEQ ID NO: 4116934 - RNA, 13 nt, Streptococcus pyogenes M1 GAS
uuagucauuucuu

SEQ ID NO: 4116935 - RNA, 14 nt, Streptococcus pyogenes M1 GAS
uuagucauuucuuc

SEQ ID NO: 4116936 - RNA, 18 nt, Streptococcus pyogenes M1 GAS
uuaguccaaaauacaucc

SEQ ID NO: 4116937 - RNA, 15 nt, Streptococcus pyogenes M1 GAS
uuagucugaauugga

SEQ ID NO: 4116938 - RNA, 16 nt, Streptococcus pyogenes M1 GAS
uuaguguagauaaacu

SEQ ID NO: 4116939 - RNA, 16 nt, Streptococcus pyogenes M1 GAS
uuaguguuuuuagaua

SEQ ID NO: 4116940 - RNA, 19 nt, Streptococcus pyogenes M1 GAS
uuaguguuuuuagauaaaa

SEQ ID NO: 4116941 - RNA, 17 nt, Streptococcus pyogenes M1 GAS
uuaguugcuucuuuuaa

SEQ ID NO: 4116942 - RNA, 12 nt, Streptococcus pyogenes M1 GAS
uuaguuuuauuu

SEQ ID NO: 4116943 - RNA, 14 nt, Streptococcus pyogenes M1 GAS
uuaguuuuguauug

SEQ ID NO: 4116944 - RNA, 22 nt, Streptococcus pyogenes M1 GAS
uuauacgguaaaaacucaaaaa

SEQ ID NO: 4116945 - RNA, 16 nt, Streptococcus pyogenes M1 GAS
uuaucauauuccauau

SEQ ID NO: 4116946 - RNA, 13 nt, Streptococcus pyogenes M1 GAS
uuaucauuuuggu

SEQ ID NO: 4116947 - RNA, 20 nt, Streptococcus pyogenes M1 GAS
uuaucccuggaccauuauca

SEQ ID NO: 4116948 - RNA, 17 nt, Streptococcus pyogenes M1 GAS
uuauccuccuaaauaua

SEQ ID NO: 4116949 - RNA, 15 nt, Streptococcus pyogenes M1 GAS
uuauccuuuacugua

SEQ ID NO: 4116950 - RNA, 18 nt, Streptococcus pyogenes M1 GAS
uuaucugauauuucaucu

SEQ ID NO: 4116951 - RNA, 16 nt, Streptococcus pyogenes M1 GAS
uuaugcugauuuugga

SEQ ID NO: 4116952 - RNA, 20 nt, Streptococcus pyogenes M1 GAS
uuauuaacguuaacaaaaau

SEQ ID NO: 4116953 - RNA, 19 nt, Streptococcus pyogenes M1 GAS
uuauuaguaaccauagaag

SEQ ID NO: 4116954 - RNA, 13 nt, Streptococcus pyogenes M1 GAS
uuauuuaugucuu

SEQ ID NO: 4116955 - RNA, 17 nt, Streptococcus pyogenes M1 GAS
uuauuugacauuagucc

SEQ ID NO: 4116956 - RNA, 20 nt, Streptococcus pyogenes M1 GAS
uuauuuucuagguuaaaaua

SEQ ID NO: 4116957 - RNA, 16 nt, Streptococcus pyogenes M1 GAS
uuauuuuuuaaagcua

SEQ ID NO: 4116958 - RNA, 17 nt, Streptococcus pyogenes M1 GAS
uucaaaaaaacuucaca

SEQ ID NO: 4116959 - RNA, 19 nt, Streptococcus pyogenes M1 GAS
uucaaaaaaacuucacauu

SEQ ID NO: 4116960 - RNA, 19 nt, Streptococcus pyogenes M1 GAS
uucaaaaaagggaagaaga

SEQ ID NO: 4116961 - RNA, 14 nt, Streptococcus pyogenes M1 GAS
uucaaaaauacuac

SEQ ID NO: 4116962 - RNA, 17 nt, Streptococcus pyogenes M1 GAS
uucaaaaauacuaccuu

SEQ ID NO: 4116963 - RNA, 16 nt, Streptococcus pyogenes M1 GAS
uucaaacggaguucuc

SEQ ID NO: 4116964 - RNA, 15 nt, Streptococcus pyogenes M1 GAS
uucaaguucucuacu

SEQ ID NO: 4116965 - RNA, 15 nt, Streptococcus pyogenes M1 GAS
uucaauauuuuauua

SEQ ID NO: 4116966 - RNA, 23 nt, Streptococcus pyogenes M1 GAS
uucacgauaagaagcuaaugucu

SEQ ID NO: 4116967 - RNA, 19 nt, Streptococcus pyogenes M1 GAS
uucacuauaauuucaauaa

SEQ ID NO: 4116968 - RNA, 16 nt, Streptococcus pyogenes M1 GAS
uucagagaugcuucuu

SEQ ID NO: 4116969 - RNA, 23 nt, Streptococcus pyogenes M1 GAS
uucagagcacguuuucugguuuu

SEQ ID NO: 4116970 - RNA, 11 nt, Streptococcus pyogenes M1 GAS
uucagcagcac

SEQ ID NO: 4116971 - RNA, 19 nt, Streptococcus pyogenes M1 GAS
uucagcagcacuggcuuuu

SEQ ID NO: 4116972 - RNA, 23 nt, Streptococcus pyogenes M1 GAS
uucaggauguuuauuccaaacau

SEQ ID NO: 4116973 - RNA, 14 nt, Streptococcus pyogenes M1 GAS
uucaguuaaacuga

SEQ ID NO: 4116974 - RNA, 18 nt, Streptococcus pyogenes M1 GAS
uucauaaauucuaacucu

SEQ ID NO: 4116975 - RNA, 12 nt, Streptococcus pyogenes M1 GAS
uucauagaagac

SEQ ID NO: 4116976 - RNA, 22 nt, Streptococcus pyogenes M1 GAS
uucauagaagacggaguauuuu

SEQ ID NO: 4116977 - RNA, 15 nt, Streptococcus pyogenes M1 GAS
uucaucuugccauca

SEQ ID NO: 4116978 - RNA, 19 nt, Streptococcus pyogenes M1 GAS
uucaugauguuauuaaaua

SEQ ID NO: 4116979 - RNA, 21 nt, Streptococcus pyogenes M1 GAS
uucaugauguuauuaaauaau

SEQ ID NO: 4116980 - RNA, 12 nt, Streptococcus pyogenes M1 GAS
uuccauaauauc

SEQ ID NO: 4116981 - RNA, 14 nt, Streptococcus pyogenes M1 GAS
uucccauguuuuau

SEQ ID NO: 4116982 - RNA, 13 nt, Streptococcus pyogenes M1 GAS
uuccccacaaaag

SEQ ID NO: 4116983 - RNA, 18 nt, Streptococcus pyogenes M1 GAS
uucccuuaauaaacugua

SEQ ID NO: 4116984 - RNA, 19 nt, Streptococcus pyogenes M1 GAS
uuccuaacaaaaucacacc

SEQ ID NO: 4116985 - RNA, 14 nt, Streptococcus pyogenes M1 GAS
uuccuacaaaauaa

SEQ ID NO: 4116986 - RNA, 16 nt, Streptococcus pyogenes M1 GAS
uuccuuagcaaaggcu

SEQ ID NO: 4116987 - RNA, 19 nt, Streptococcus pyogenes M1 GAS
uuccuuagcaaaggcuuca

SEQ ID NO: 4116988 - RNA, 16 nt, Streptococcus pyogenes M1 GAS
uuccuuguacaagagc

SEQ ID NO: 4116989 - RNA, 19 nt, Streptococcus pyogenes M1 GAS
uucgacucaugauauccca

SEQ ID NO: 4116990 - RNA, 11 nt, Streptococcus pyogenes M1 GAS
uucgcacagcg

SEQ ID NO: 4116991 - RNA, 21 nt, Streptococcus pyogenes M1 GAS
uucgccuaggaauaaaaugcc

SEQ ID NO: 4116992 - RNA, 19 nt, Streptococcus pyogenes M1 GAS
uucggugaugccucuuguc

SEQ ID NO: 4116993 - RNA, 19 nt, Streptococcus pyogenes M1 GAS
uucguaaggguuauuauuu

SEQ ID NO: 4116994 - RNA, 12 nt, Streptococcus pyogenes M1 GAS
uucguuauaaac

SEQ ID NO: 4116995 - RNA, 20 nt, Streptococcus pyogenes M1 GAS
uucguucauaaauucuaacu

SEQ ID NO: 4116996 - RNA, 13 nt, Streptococcus pyogenes M1 GAS
uucguucuaguuu

SEQ ID NO: 4116997 - RNA, 16 nt, Streptococcus pyogenes M1 GAS
uucuacuaaaaaagga

SEQ ID NO: 4116998 - RNA, 23 nt, Streptococcus pyogenes M1 GAS
uucuaguucguucauaaauucua

SEQ ID NO: 4116999 - RNA, 23 nt, Streptococcus pyogenes M1 GAS
uucuaguuuaggauauaagaagg

SEQ ID NO: 4117000 - RNA, 12 nt, Streptococcus pyogenes M1 GAS
uucuaucaaaac

SEQ ID NO: 4117001 - RNA, 14 nt, Streptococcus pyogenes M1 GAS
uucuauuaccuaua

SEQ ID NO: 4117002 - RNA, 18 nt, Streptococcus pyogenes M1 GAS
uucucaaaaauauauucu

SEQ ID NO: 4117003 - RNA, 13 nt, Streptococcus pyogenes M1 GAS
uucucauaaacaa

SEQ ID NO: 4117004 - RNA, 20 nt, Streptococcus pyogenes M1 GAS
uucucauaaacaaugaguca

SEQ ID NO: 4117005 - RNA, 19 nt, Streptococcus pyogenes M1 GAS
uucucuuuggagaaauuca

SEQ ID NO: 4117006 - RNA, 17 nt, Streptococcus pyogenes M1 GAS
uucugauaggagugauu

SEQ ID NO: 4117007 - RNA, 19 nt, Streptococcus pyogenes M1 GAS
uucugauaggagugauuga

SEQ ID NO: 4117008 - RNA, 23 nt, Streptococcus pyogenes M1 GAS
uucugcagucuuuuucauuuuua

SEQ ID NO: 4117009 - RNA, 12 nt, Streptococcus pyogenes M1 GAS
uucugcauuauc

SEQ ID NO: 4117010 - RNA, 14 nt, Streptococcus pyogenes M1 GAS
uucuggugcaaggc

SEQ ID NO: 4117011 - RNA, 15 nt, Streptococcus pyogenes M1 GAS
uucugguuuaucauu

SEQ ID NO: 4117012 - RNA, 21 nt, Streptococcus pyogenes M1 GAS
uucuuacuaugaaaaaagaac

SEQ ID NO: 4117013 - RNA, 14 nt, Streptococcus pyogenes M1 GAS
uucuuauccauuau

SEQ ID NO: 4117014 - RNA, 22 nt, Streptococcus pyogenes M1 GAS
uucuuauccauuauaaaucuua

SEQ ID NO: 4117015 - RNA, 21 nt, Streptococcus pyogenes M1 GAS
uuuaugucuugcuaaaauuuc

SEQ ID NO: 4117016 - RNA, 16 nt, Streptococcus pyogenes M1 GAS
uuuauuaaucaaaaaa

SEQ ID NO: 4117017 - RNA, 16 nt, Streptococcus pyogenes M1 GAS
uuuauuccgguuuuaa

SEQ ID NO: 4117018 - RNA, 22 nt, Streptococcus pyogenes M1 GAS
uuuauuugcuuuucggugaugc

SEQ ID NO: 4117019 - RNA, 16 nt, Streptococcus pyogenes M1 GAS
uuuauuuugauauuuu

SEQ ID NO: 4117020 - RNA, 20 nt, Streptococcus pyogenes M1 GAS
uuuauuuugauauuuuuucu

SEQ ID NO: 4117021 - RNA, 20 nt, Streptococcus pyogenes M1 GAS
uuucaaaaaaacuucacauu

SEQ ID NO: 4117022 - RNA, 14 nt, Streptococcus pyogenes M1 GAS
uuucaacaaauccu

SEQ ID NO: 4117023 - RNA, 13 nt, Streptococcus pyogenes M1 GAS
uuucaaguucucu

SEQ ID NO: 4117024 - RNA, 20 nt, Streptococcus pyogenes M1 GAS
uuucaauaauaccauuuuua

SEQ ID NO: 4117025 - RNA, 13 nt, Streptococcus pyogenes M1 GAS
uuucacgauaaga

SEQ ID NO: 4117026 - RNA, 15 nt, Streptococcus pyogenes M1 GAS
uuucacgauaagaag

SEQ ID NO: 4117027 - RNA, 14 nt, Streptococcus pyogenes M1 GAS
uuucacuuaucauu

SEQ ID NO: 4117028 - RNA, 14 nt, Streptococcus pyogenes M1 GAS
uuucagugguaaug

SEQ ID NO: 4117029 - RNA, 15 nt, Streptococcus pyogenes M1 GAS
uuucaguuguuuuaa

SEQ ID NO: 4117030 - RNA, 13 nt, Streptococcus pyogenes M1 GAS
uuucauuauagac

SEQ ID NO: 4117031 - RNA, 18 nt, Streptococcus pyogenes M1 GAS
uuuccuagcgggaacacu

SEQ ID NO: 4117032 - RNA, 18 nt, Streptococcus pyogenes M1 GAS
uuucguugacaacaauau

SEQ ID NO: 4117033 - RNA, 13 nt, Streptococcus pyogenes M1 GAS
uuucuagguuaaa

SEQ ID NO: 4117034 - RNA, 17 nt, Streptococcus pyogenes M1 GAS
uuucuauauaacuguuc

SEQ ID NO: 4117035 - RNA, 18 nt, Streptococcus pyogenes M1 GAS
uuucucagagacaauaag

SEQ ID NO: 4117036 - RNA, 14 nt, Streptococcus pyogenes M1 GAS
uuucugauaggagu

SEQ ID NO: 4117037 - RNA, 14 nt, Streptococcus pyogenes M1 GAS
uuucuuguuuuggu

SEQ ID NO: 4117038 - RNA, 20 nt, Streptococcus pyogenes M1 GAS
uuucuuugugacaugaguau

SEQ ID NO: 4117039 - RNA, 22 nt, Streptococcus pyogenes M1 GAS
uuugaccuacuagcacaaaauc

SEQ ID NO: 4117040 - RNA, 21 nt, Streptococcus pyogenes M1 GAS
uuugacuuguuacaaaaaaca

SEQ ID NO: 4117041 - RNA, 13 nt, Streptococcus pyogenes M1 GAS
uuugagaacgaau

SEQ ID NO: 4117042 - RNA, 21 nt, Streptococcus pyogenes M1 GAS
uuugagacaguuagcaaauug

SEQ ID NO: 4117043 - RNA, 20 nt, Streptococcus pyogenes M1 GAS
uuugauauuuuuucucaaaa

SEQ ID NO: 4117044 - RNA, 21 nt, Streptococcus pyogenes M1 GAS
uuugauugauuugucuucucc

SEQ ID NO: 4117045 - RNA, 17 nt, Streptococcus pyogenes M1 GAS
uuugcaaauaguagcaa

SEQ ID NO: 4117046 - RNA, 20 nt, Streptococcus pyogenes M1 GAS
uuugcacugcuauuucagcu

SEQ ID NO: 4117047 - RNA, 23 nt, Streptococcus pyogenes M1 GAS
uuugccguguucuagcuuuguca

SEQ ID NO: 4117048 - RNA, 18 nt, Streptococcus pyogenes M1 GAS
uuugcguuguagguaaua

SEQ ID NO: 4117049 - RNA, 20 nt, Streptococcus pyogenes M1 GAS
uuugcugaaauaucuuucag

SEQ ID NO: 4117050 - RNA, 18 nt, Streptococcus pyogenes M1 GAS
uuugcugagcuaaagcca

SEQ ID NO: 4117051 - RNA, 14 nt, Streptococcus pyogenes M1 GAS
uuugcuuuuuaauu

SEQ ID NO: 4117052 - RNA, 21 nt, Streptococcus pyogenes M1 GAS
uuuggaccacucgugcugcca

SEQ ID NO: 4117053 - RNA, 20 nt, Streptococcus pyogenes M1 GAS
uuuggagagauuuuaaaaaa

SEQ ID NO: 4117054 - RNA, 19 nt, Streptococcus pyogenes M1 GAS
uuuggccaauaaaauaucu

SEQ ID NO: 4117055 - RNA, 21 nt, Streptococcus pyogenes M1 GAS
uuugguuucgccuaggaauaa

SEQ ID NO: 4117056 - RNA, 19 nt, Streptococcus pyogenes M1 GAS
uuuguaucucauaacaaau

SEQ ID NO: 4117057 - RNA, 19 nt, Streptococcus pyogenes M1 GAS
uuuguaugacauugacuga

SEQ ID NO: 4117058 - RNA, 18 nt, Streptococcus pyogenes M1 GAS
uuuguauuguagaggacu

SEQ ID NO: 4117059 - RNA, 15 nt, Streptococcus pyogenes M1 GAS
uuugucaaaaaguaa

SEQ ID NO: 4117060 - RNA, 21 nt, Streptococcus pyogenes M1 GAS
uuugucaaaaaguaaaaagca

SEQ ID NO: 4117061 - RNA, 21 nt, Streptococcus pyogenes M1 GAS
uuugucaacucgauaaaaacg

SEQ ID NO: 4117062 - RNA, 12 nt, Streptococcus pyogenes M1 GAS
uuugucuucuuc

SEQ ID NO: 4117063 - RNA, 16 nt, Streptococcus pyogenes M1 GAS
uuugucuucuucuuug

SEQ ID NO: 4117064 - RNA, 16 nt, Streptococcus pyogenes M1 GAS
uuuguuaccagauaaa

SEQ ID NO: 4117065 - RNA, 15 nt, Streptococcus pyogenes M1 GAS
uuuuaaaaaaccuuu

SEQ ID NO: 4117066 - RNA, 13 nt, Streptococcus pyogenes M1 GAS
uuuuaaagcuaag

SEQ ID NO: 4117067 - RNA, 15 nt, Streptococcus pyogenes M1 GAS
uuuuaacguuuugaa

SEQ ID NO: 4117068 - RNA, 22 nt, Streptococcus pyogenes M1 GAS
uuuuaagauuaaacuuacaaaa

SEQ ID NO: 4117069 - RNA, 22 nt, Streptococcus pyogenes M1 GAS
uuuuaauguauuggaaaauaca

SEQ ID NO: 4117070 - RNA, 13 nt, Streptococcus pyogenes M1 GAS
uuuuacaucaaaa

SEQ ID NO: 4117071 - RNA, 13 nt, Streptococcus pyogenes M1 GAS
uuuuacauuuuua

SEQ ID NO: 4117072 - RNA, 14 nt, Streptococcus pyogenes M1 GAS
uuuuacuuuuaaaa

SEQ ID NO: 4117073 - RNA, 23 nt, Streptococcus pyogenes M1 GAS
uuuuagcagcagaagcaaauucu

SEQ ID NO: 4117074 - RNA, 19 nt, Streptococcus pyogenes M1 GAS
uuuuaguaaagccuuaucc

SEQ ID NO: 4117075 - RNA, 19 nt, Streptococcus pyogenes M1 GAS
uuuuaguguuuuuagauaa

SEQ ID NO: 4117076 - RNA, 19 nt, Streptococcus pyogenes M1 GAS
uuuuaguugugauauaaaa

SEQ ID NO: 4117077 - RNA, 16 nt, Streptococcus pyogenes M1 GAS
uuuuauaacaauuaca

SEQ ID NO: 4117078 - RNA, 21 nt, Streptococcus pyogenes M1 GAS
uuuuauaacaauuacaaccca

SEQ ID NO: 4117079 - RNA, 20 nt, Streptococcus pyogenes M1 GAS
uuuuauacgguaaaaacuca

SEQ ID NO: 4117080 - RNA, 19 nt, Streptococcus pyogenes M1 GAS
uuuuauagcugauuuguuu

SEQ ID NO: 4117081 - RNA, 20 nt, Streptococcus pyogenes M1 GAS
uuuuauagcugauuuguuuu

SEQ ID NO: 4117082 - RNA, 18 nt, Streptococcus pyogenes M1 GAS
uuuuauaugucaucaaaa

SEQ ID NO: 4117083 - RNA, 22 nt, Streptococcus pyogenes M1 GAS
uuuuauccccuauucaauauuu

SEQ ID NO: 4117084 - RNA, 17 nt, Streptococcus pyogenes M1 GAS
uuuuaucuguauauuua

SEQ ID NO: 4117085 - RNA, 19 nt, Streptococcus pyogenes M1 GAS
uuuuauuagucuuuaaaaa

SEQ ID NO: 4117086 - RNA, 18 nt, Streptococcus pyogenes M1 GAS
uuuucaaagggagauucu

SEQ ID NO: 4117087 - RNA, 21 nt, Streptococcus pyogenes M1 GAS
uuuucaacaaauccuuuugcu

SEQ ID NO: 4117088 - RNA, 17 nt, Streptococcus pyogenes M1 GAS
uuuucagagaugcuucu

SEQ ID NO: 4117089 - RNA, 13 nt, Streptococcus pyogenes M1 GAS
uuuucauuuuuau

SEQ ID NO: 4117090 - RNA, 15 nt, Streptococcus pyogenes M1 GAS
uuuucccaucaauag

SEQ ID NO: 4117091 - RNA, 15 nt, Streptococcus pyogenes M1 GAS
uuuucguauacuuua

SEQ ID NO: 4117092 - RNA, 16 nt, Streptococcus pyogenes M1 GAS
uuuucuaguucguuca

SEQ ID NO: 4117093 - RNA, 23 nt, Streptococcus pyogenes M1 GAS
uuuucucaaaaauauauucuaau

SEQ ID NO: 4117094 - RNA, 14 nt, Streptococcus pyogenes M1 GAS
uuuucuuuucuuca

SEQ ID NO: 4117095 - RNA, 12 nt, Streptococcus pyogenes M1 GAS
uuuugauaaaaa

SEQ ID NO: 4117096 - RNA, 15 nt, Streptococcus pyogenes M1 GAS
uuuugauaaaaaaca

SEQ ID NO: 4117097 - RNA, 20 nt, Streptococcus pyogenes M1 GAS
uuuugaugcagcuaaaagca

SEQ ID NO: 4117098 - RNA, 14 nt, Streptococcus pyogenes M1 GAS
uuuugauuuuaauu

SEQ ID NO: 4117099 - RNA, 16 nt, Streptococcus pyogenes M1 GAS
uuuugauuuucucagu

SEQ ID NO: 4117100 - RNA, 20 nt, Streptococcus pyogenes M1 GAS
uuuuggaugaaaguaacaug

SEQ ID NO: 4117101 - RNA, 16 nt, Streptococcus pyogenes M1 GAS
uuuugguugauauaaa

SEQ ID NO: 4117102 - RNA, 16 nt, Streptococcus pyogenes M1 GAS
uuuuguaucucauaac

SEQ ID NO: 4117103 - RNA, 17 nt, Streptococcus pyogenes M1 GAS
uuuugucugacuuaaau

SEQ ID NO: 4117104 - RNA, 14 nt, Streptococcus pyogenes M1 GAS
uuuugucuucuucu

SEQ ID NO: 4117105 - RNA, 15 nt, Streptococcus pyogenes M1 GAS
uuuugucuucuucuu

SEQ ID NO: 4117106 - RNA, 23 nt, Streptococcus pyogenes M1 GAS
uuuuguugaguguuaugaugaug

SEQ ID NO: 4117107 - RNA, 13 nt, Streptococcus pyogenes M1 GAS
uuuuguuguaaaa

SEQ ID NO: 4117108 - RNA, 18 nt, Streptococcus pyogenes M1 GAS
uuuuguuguauuaugagg

SEQ ID NO: 4117109 - RNA, 11 nt, Streptococcus pyogenes M1 GAS
uuuuguuuuau

SEQ ID NO: 4117110 - RNA, 14 nt, Streptococcus pyogenes M1 GAS
uuuuuaauuauuuu

SEQ ID NO: 4117111 - RNA, 16 nt, Streptococcus pyogenes M1 GAS
uuuuuacgaaaaauuc

SEQ ID NO: 4117112 - RNA, 19 nt, Streptococcus pyogenes M1 GAS
uuuuuaguugugauauaaa

SEQ ID NO: 4117113 - RNA, 12 nt, Streptococcus pyogenes M1 GAS
uuuuuaucugua

SEQ ID NO: 4117114 - RNA, 12 nt, Streptococcus pyogenes M1 GAS
uuuuugacacag

SEQ ID NO: 4117115 - RNA, 22 nt, Streptococcus pyogenes M1 GAS
aaaaaaacuucacauuguauua

SEQ ID NO: 4117116 - RNA, 14 nt, Streptococcus pyogenes M1 GAS
aaaaaaagcaauga

SEQ ID NO: 4117117 - RNA, 12 nt, Streptococcus pyogenes M1 GAS
aaaaaaaggaca

SEQ ID NO: 4117118 - RNA, 11 nt, Streptococcus pyogenes M1 GAS
aaaaacaaugc

SEQ ID NO: 4117119 - RNA, 21 nt, Streptococcus pyogenes M1 GAS
aaaaaccuuuagagaaucaaa

SEQ ID NO: 4117120 - RNA, 18 nt, Streptococcus pyogenes M1 GAS
aaaaacgaucaaaaaucu

SEQ ID NO: 4117121 - RNA, 19 nt, Streptococcus pyogenes M1 GAS
aaaaacgaucaaaaaucuu

SEQ ID NO: 4117122 - RNA, 13 nt, Streptococcus pyogenes M1 GAS
aaaaacucaaaaa

SEQ ID NO: 4117123 - RNA, 19 nt, Streptococcus pyogenes M1 GAS
aaaaagaaaggaauugaac

SEQ ID NO: 4117124 - RNA, 14 nt, Streptococcus pyogenes M1 GAS
aaaaagaacaaaga

SEQ ID NO: 4117125 - RNA, 17 nt, Streptococcus pyogenes M1 GAS
aaaaagaacaaagauug

SEQ ID NO: 4117126 - RNA, 22 nt, Streptococcus pyogenes M1 GAS
aaaaagagaccgaagucucuuu

SEQ ID NO: 4117127 - RNA, 16 nt, Streptococcus pyogenes M1 GAS
aaaaagauaaacaucu

SEQ ID NO: 4117128 - RNA, 12 nt, Streptococcus pyogenes M1 GAS
aaaaagcaagca

SEQ ID NO: 4117129 - RNA, 13 nt, Streptococcus pyogenes M1 GAS
aaaaagccuauuu

SEQ ID NO: 4117130 - RNA, 13 nt, Streptococcus pyogenes M1 GAS
aaaaagccuuaau

SEQ ID NO: 4117131 - RNA, 14 nt, Streptococcus pyogenes M1 GAS
aaaaagccuuuaca

SEQ ID NO: 4117132 - RNA, 16 nt, Streptococcus pyogenes M1 GAS
aaaaagggaagaagau

SEQ ID NO: 4117133 - RNA, 16 nt, Streptococcus pyogenes M1 GAS
aaaaagguaucccaua

SEQ ID NO: 4117134 - RNA, 11 nt, Streptococcus pyogenes M1 GAS
aaaaaguaaaa

SEQ ID NO: 4117135 - RNA, 14 nt, Streptococcus pyogenes M1 GAS
aaaaaguaaaaagc

SEQ ID NO: 4117136 - RNA, 15 nt, Streptococcus pyogenes M1 GAS
aaaaaguaaaaucuu

SEQ ID NO: 4117137 - RNA, 18 nt, Streptococcus pyogenes M1 GAS
aaaaaguaaaaucuuauu

SEQ ID NO: 4117138 - RNA, 15 nt, Streptococcus pyogenes M1 GAS
aaaaauaacuuuaaa

SEQ ID NO: 4117139 - RNA, 22 nt, Streptococcus pyogenes M1 GAS
aaaaauaaguauagcauaaaau

SEQ ID NO: 4117140 - RNA, 19 nt, Streptococcus pyogenes M1 GAS
aaaaauacaauaaagcguu

SEQ ID NO: 4117141 - RNA, 14 nt, Streptococcus pyogenes M1 GAS
aaaaauacuagaaa

SEQ ID NO: 4117142 - RNA, 17 nt, Streptococcus pyogenes M1 GAS
aaaaauacuagaaaaag

SEQ ID NO: 4117143 - RNA, 18 nt, Streptococcus pyogenes M1 GAS
aaaaauacuagaaaaagc

SEQ ID NO: 4117144 - RNA, 23 nt, Streptococcus pyogenes M1 GAS
aaaaauacuagaaaaagcaauga

SEQ ID NO: 4117145 - RNA, 15 nt, Streptococcus pyogenes M1 GAS
aaaaauuacgaugga

SEQ ID NO: 4117146 - RNA, 14 nt, Streptococcus pyogenes M1 GAS
aaaacaaaaagaga

SEQ ID NO: 4117147 - RNA, 16 nt, Streptococcus pyogenes M1 GAS
aaaacaauaacacaga

SEQ ID NO: 4117148 - RNA, 20 nt, Streptococcus pyogenes M1 GAS
aaaacaauaacacagaagcc

SEQ ID NO: 4117149 - RNA, 22 nt, Streptococcus pyogenes M1 GAS
aaaacagaaagcggaagaacag

SEQ ID NO: 4117150 - RNA, 22 nt, Streptococcus pyogenes M1 GAS
aaaaccauuauaaaagagugca

SEQ ID NO: 4117151 - RNA, 23 nt, Streptococcus pyogenes M1 GAS
aaaacccuuucguaagaaagacu

SEQ ID NO: 4117152 - RNA, 22 nt, Streptococcus pyogenes M1 GAS
aaaacguguauucuuaaaaaaa

SEQ ID NO: 4117153 - RNA, 14 nt, Streptococcus pyogenes M1 GAS
aaaacucaaaaaau

SEQ ID NO: 4117154 - RNA, 15 nt, Streptococcus pyogenes M1 GAS
aaaacuccagcugga

SEQ ID NO: 4117155 - RNA, 14 nt, Streptococcus pyogenes M1 GAS
aaaacugucuggaa

SEQ ID NO: 4117156 - RNA, 16 nt, Streptococcus pyogenes M1 GAS
aaaacuucaaauuuca

SEQ ID NO: 4117157 - RNA, 19 nt, Streptococcus pyogenes M1 GAS
aaaacuuggguugggauau

SEQ ID NO: 4117158 - RNA, 20 nt, Streptococcus pyogenes M1 GAS
aaaagaagcaaaauuauuau

SEQ ID NO: 4117159 - RNA, 13 nt, Streptococcus pyogenes M1 GAS
aaaagaaguugag

SEQ ID NO: 4117160 - RNA, 15 nt, Streptococcus pyogenes M1 GAS
aaaagagaagaugag

SEQ ID NO: 4117161 - RNA, 16 nt, Streptococcus pyogenes M1 GAS
aaaagagagaaugaua

SEQ ID NO: 4117162 - RNA, 18 nt, Streptococcus pyogenes M1 GAS
aaaagagugcaguguacu

SEQ ID NO: 4117163 - RNA, 15 nt, Streptococcus pyogenes M1 GAS
aaaagauaaacaucu

SEQ ID NO: 4117164 - RNA, 13 nt, Streptococcus pyogenes M1 GAS
aaaagcaugggcu

SEQ ID NO: 4117165 - RNA, 14 nt, Streptococcus pyogenes M1 GAS
aaaagcauuuguuu

SEQ ID NO: 4117166 - RNA, 16 nt, Streptococcus pyogenes M1 GAS
aaaagccagagcaguu

SEQ ID NO: 4117167 - RNA, 20 nt, Streptococcus pyogenes M1 GAS
aaaagccuauuuaauaggcu

SEQ ID NO: 4117168 - RNA, 14 nt, Streptococcus pyogenes M1 GAS
aaaagcuaacacca

SEQ ID NO: 4117169 - RNA, 20 nt, Streptococcus pyogenes M1 GAS
aaaagcuaaguaagcgucug

SEQ ID NO: 4117170 - RNA, 20 nt, Streptococcus pyogenes M1 GAS
aaaagguaucccauaucucu

SEQ ID NO: 4117171 - RNA, 14 nt, Streptococcus pyogenes M1 GAS
aaaaguaaaaagca

SEQ ID NO: 4117172 - RNA, 15 nt, Streptococcus pyogenes M1 GAS
aaaaguaaaaagcaa

SEQ ID NO: 4117173 - RNA, 18 nt, Streptococcus pyogenes M1 GAS
aaaaguaaaaagcaaauu

SEQ ID NO: 4117174 - RNA, 19 nt, Streptococcus pyogenes M1 GAS
aaaauaaacuuucaguuau

SEQ ID NO: 4117175 - RNA, 14 nt, Streptococcus pyogenes M1 GAS
aaaauacauccuaa

SEQ ID NO: 4117176 - RNA, 19 nt, Streptococcus pyogenes M1 GAS
aaaauaucuuuuuuacuuu

SEQ ID NO: 4117177 - RNA, 18 nt, Streptococcus pyogenes M1 GAS
aaaauccucuuuuaauuu

SEQ ID NO: 4117178 - RNA, 23 nt, Streptococcus pyogenes M1 GAS
aaaaucuuuuucuuuucuucauc

SEQ ID NO: 4117179 - RNA, 21 nt, Streptococcus pyogenes M1 GAS
aaaaugaugagauuaacugac

SEQ ID NO: 4117180 - RNA, 12 nt, Streptococcus pyogenes M1 GAS
aaaaugcauuac

SEQ ID NO: 4117181 - RNA, 15 nt, Streptococcus pyogenes M1 GAS
aaaaugcauuacauu

SEQ ID NO: 4117182 - RNA, 17 nt, Streptococcus pyogenes M1 GAS
aaaaugcuguuugucau

SEQ ID NO: 4117183 - RNA, 19 nt, Streptococcus pyogenes M1 GAS
aaaauuccccacaaaagac

SEQ ID NO: 4117184 - RNA, 21 nt, Streptococcus pyogenes M1 GAS
aaaauuuaauaguuuuccaua

SEQ ID NO: 4117185 - RNA, 12 nt, Streptococcus pyogenes M1 GAS
aacaaagauugg

SEQ ID NO: 4117186 - RNA, 13 nt, Streptococcus pyogenes M1 GAS
aacaaauccuuuu

SEQ ID NO: 4117187 - RNA, 14 nt, Streptococcus pyogenes M1 GAS
aacaacccuugauu

SEQ ID NO: 4117188 - RNA, 13 nt, Streptococcus pyogenes M1 GAS
aacaagccauaaa

SEQ ID NO: 4117189 - RNA, 15 nt, Streptococcus pyogenes M1 GAS
aacaauaacacagaa

SEQ ID NO: 4117190 - RNA, 21 nt, Streptococcus pyogenes M1 GAS
aacaauaucgagcugauugac

SEQ ID NO: 4117191 - RNA, 22 nt, Streptococcus pyogenes M1 GAS
aacaaugaaacguuauuaaaga

SEQ ID NO: 4117192 - RNA, 19 nt, Streptococcus pyogenes M1 GAS
aacaauuuuucaaaaaaac

SEQ ID NO: 4117193 - RNA, 21 nt, Streptococcus pyogenes M1 GAS
aacaauuuuucaaaaaaacuu

SEQ ID NO: 4117194 - RNA, 15 nt, Streptococcus pyogenes M1 GAS
aacacaauucaagau

SEQ ID NO: 4117195 - RNA, 21 nt, Streptococcus pyogenes M1 GAS
aacaccccccgcuuuuaagcu

SEQ ID NO: 4117196 - RNA, 22 nt, Streptococcus pyogenes M1 GAS
aacaccguuuuuuguuguaaaa

SEQ ID NO: 4117197 - RNA, 11 nt, Streptococcus pyogenes M1 GAS
aacagaaagcg

SEQ ID NO: 4117198 - RNA, 13 nt, Streptococcus pyogenes M1 GAS
aacagaaagcgga

SEQ ID NO: 4117199 - RNA, 19 nt, Streptococcus pyogenes M1 GAS
aacagaaagcggaagaaca

SEQ ID NO: 4117200 - RNA, 18 nt, Streptococcus pyogenes M1 GAS
aacagauagucaaaaaga

SEQ ID NO: 4117201 - RNA, 19 nt, Streptococcus pyogenes M1 GAS
aacagauagucaaaaagac

SEQ ID NO: 4117202 - RNA, 14 nt, Streptococcus pyogenes M1 GAS
aacagauugaagac

SEQ ID NO: 4117203 - RNA, 12 nt, Streptococcus pyogenes M1 GAS
aacagcauuuuc

SEQ ID NO: 4117204 - RNA, 21 nt, Streptococcus pyogenes M1 GAS
aacagcauuuucaucaucaag

SEQ ID NO: 4117205 - RNA, 20 nt, Streptococcus pyogenes M1 GAS
aacauauuauaguaaccauu

SEQ ID NO: 4117206 - RNA, 14 nt, Streptococcus pyogenes M1 GAS
aacaucaaaaagag

SEQ ID NO: 4117207 - RNA, 15 nt, Streptococcus pyogenes M1 GAS
aacaucuugauugua

SEQ ID NO: 4117208 - RNA, 22 nt, Streptococcus pyogenes M1 GAS
aacauggauaccauuucuuugc

SEQ ID NO: 4117209 - RNA, 19 nt, Streptococcus pyogenes M1 GAS
aacauucacggugggcuuu

SEQ ID NO: 4117210 - RNA, 16 nt, Streptococcus pyogenes M1 GAS
aaccaagcuaaagggc

SEQ ID NO: 4117211 - RNA, 19 nt, Streptococcus pyogenes M1 GAS
aaccaauuguugaauaagu

SEQ ID NO: 4117212 - RNA, 16 nt, Streptococcus pyogenes M1 GAS
aaccagcuuacagcug

SEQ ID NO: 4117213 - RNA, 14 nt, Streptococcus pyogenes M1 GAS
aaccauagaagcca

SEQ ID NO: 4117214 - RNA, 17 nt, Streptococcus pyogenes M1 GAS
aaccauagaagccaauu

SEQ ID NO: 4117215 - RNA, 17 nt, Streptococcus pyogenes M1 GAS
aaccauaucacaaaacc

SEQ ID NO: 4117216 - RNA, 19 nt, Streptococcus pyogenes M1 GAS
aaccauaucacaaaacccu

SEQ ID NO: 4117217 - RNA, 13 nt, Streptococcus pyogenes M1 GAS
aaccauugccauu

SEQ ID NO: 4117218 - RNA, 15 nt, Streptococcus pyogenes M1 GAS
aacccacauacggcu

SEQ ID NO: 4117219 - RNA, 15 nt, Streptococcus pyogenes M1 GAS
aaccugcauaucugc

SEQ ID NO: 4117220 - RNA, 17 nt, Streptococcus pyogenes M1 GAS
aaccugcauaucugccc

SEQ ID NO: 4117221 - RNA, 13 nt, Streptococcus pyogenes M1 GAS
aaccuuugccauu

SEQ ID NO: 4117222 - RNA, 14 nt, Streptococcus pyogenes M1 GAS
aacgaucaaaaauc

SEQ ID NO: 4117223 - RNA, 22 nt, Streptococcus pyogenes M1 GAS
aacgguaucacucguaaaaaga

SEQ ID NO: 4117224 - RNA, 20 nt, Streptococcus pyogenes M1 GAS
aacguguauucuuaaaaaaa

SEQ ID NO: 4117225 - RNA, 17 nt, Streptococcus pyogenes M1 GAS
aacguuauuaaagacaa

SEQ ID NO: 4117226 - RNA, 19 nt, Streptococcus pyogenes M1 GAS
aacuauuucacuuaucauu

SEQ ID NO: 4117227 - RNA, 15 nt, Streptococcus pyogenes M1 GAS
aacuauuuuuaccuu

SEQ ID NO: 4117228 - RNA, 18 nt, Streptococcus pyogenes M1 GAS
aacucaaaaaauacaaua

SEQ ID NO: 4117229 - RNA, 12 nt, Streptococcus pyogenes M1 GAS
aacucaaaaagc

SEQ ID NO: 4117230 - RNA, 17 nt, Streptococcus pyogenes M1 GAS
aacucaaaccaaacaag

SEQ ID NO: 4117231 - RNA, 18 nt, Streptococcus pyogenes M1 GAS
aacuccugauaaugauuu

SEQ ID NO: 4117232 - RNA, 20 nt, Streptococcus pyogenes M1 GAS
aacuccuggauuaaaugccc

SEQ ID NO: 4117233 - RNA, 19 nt, Streptococcus pyogenes M1 GAS
aacucgauaaaaacgauca

SEQ ID NO: 4117234 - RNA, 15 nt, Streptococcus pyogenes M1 GAS
aacucucauaaaauu

SEQ ID NO: 4117235 - RNA, 14 nt, Streptococcus pyogenes M1 GAS
aacucuuguagaau

SEQ ID NO: 4117236 - RNA, 22 nt, Streptococcus pyogenes M1 GAS
aacucuuguagaauuucaaguu

SEQ ID NO: 4117237 - RNA, 16 nt, Streptococcus pyogenes M1 GAS
aacugauaaaacucaa

SEQ ID NO: 4117238 - RNA, 19 nt, Streptococcus pyogenes M1 GAS
aacuggcacaaacucugcc

SEQ ID NO: 4117239 - RNA, 22 nt, Streptococcus pyogenes M1 GAS
aacugguccaucauugaugaga

SEQ ID NO: 4117240 - RNA, 21 nt, Streptococcus pyogenes M1 GAS
aacuucacauuguauuagcaa

SEQ ID NO: 4117241 - RNA, 22 nt, Streptococcus pyogenes M1 GAS
aacuucuauauguguaauuucu

SEQ ID NO: 4117242 - RNA, 22 nt, Streptococcus pyogenes M1 GAS
aacuugaauaucgccaauaaaa

SEQ ID NO: 4117243 - RNA, 18 nt, Streptococcus pyogenes M1 GAS
aacuugggagaguuccug

SEQ ID NO: 4117244 - RNA, 16 nt, Streptococcus pyogenes M1 GAS
aacuugucaagccaua

SEQ ID NO: 4117245 - RNA, 13 nt, Streptococcus pyogenes M1 GAS
aacuuucaguuau

SEQ ID NO: 4117246 - RNA, 20 nt, Streptococcus pyogenes M1 GAS
aacuuuuagcuaagaauaac

SEQ ID NO: 4117247 - RNA, 11 nt, Streptococcus pyogenes M1 GAS
aagaaaaccuu

SEQ ID NO: 4117248 - RNA, 24 nt, Streptococcus pyogenes M1 GAS
aagaaauuacuuggaucuucuucu

SEQ ID NO: 4117249 - RNA, 13 nt, Streptococcus pyogenes M1 GAS
aagaacagcauuu

SEQ ID NO: 4117250 - RNA, 14 nt, Streptococcus pyogenes M1 GAS
aagaacuccuggau

SEQ ID NO: 4117251 - RNA, 23 nt, Streptococcus pyogenes M1 GAS
aagaagaauuaacguuccaaaaa

SEQ ID NO: 4117252 - RNA, 22 nt, Streptococcus pyogenes M1 GAS
aagaaggaacucuccaaaguuc

SEQ ID NO: 4117253 - RNA, 22 nt, Streptococcus pyogenes M1 GAS
aagaaggccagcaaggcaccug

SEQ ID NO: 4117254 - RNA, 14 nt, Streptococcus pyogenes M1 GAS
aagaaggucaugau

SEQ ID NO: 4117255 - RNA, 12 nt, Streptococcus pyogenes M1 GAS
aagaauugaaaa

SEQ ID NO: 4117256 - RNA, 22 nt, Streptococcus pyogenes M1 GAS
aagaauuggggcggcacuucca

SEQ ID NO: 4117257 - RNA, 13 nt, Streptococcus pyogenes M1 GAS
aagacaaaaaacu

SEQ ID NO: 4117258 - RNA, 14 nt, Streptococcus pyogenes M1 GAS
aagacacacaacac

SEQ ID NO: 4117259 - RNA, 16 nt, Streptococcus pyogenes M1 GAS
aagaccauaaaaaacc

SEQ ID NO: 4117260 - RNA, 17 nt, Streptococcus pyogenes M1 GAS
aagaccauaaaaaaccu

SEQ ID NO: 4117261 - RNA, 20 nt, Streptococcus pyogenes M1 GAS
aagacccuccacccaaacau

SEQ ID NO: 4117262 - RNA, 22 nt, Streptococcus pyogenes M1 GAS
aagacccuccacccaaacauuc

SEQ ID NO: 4117263 - RNA, 18 nt, Streptococcus pyogenes M1 GAS
aagacuauguugcuuaau

SEQ ID NO: 4117264 - RNA, 16 nt, Streptococcus pyogenes M1 GAS
aagacuuaaggauuua

SEQ ID NO: 4117265 - RNA, 14 nt, Streptococcus pyogenes M1 GAS
aagagagaagcugu

SEQ ID NO: 4117266 - RNA, 23 nt, Streptococcus pyogenes M1 GAS
aagagagguugguaaaaaggcag

SEQ ID NO: 4117267 - RNA, 19 nt, Streptococcus pyogenes M1 GAS
aagagcguuagcuuuuuaa

SEQ ID NO: 4117268 - RNA, 15 nt, Streptococcus pyogenes M1 GAS
aagauaaacaucucc

SEQ ID NO: 4117269 - RNA, 17 nt, Streptococcus pyogenes M1 GAS
aagauaccaaaucaaaa

SEQ ID NO: 4117270 - RNA, 17 nt, Streptococcus pyogenes M1 GAS
aagauauuuuaaaauag

SEQ ID NO: 4117271 - RNA, 18 nt, Streptococcus pyogenes M1 GAS
aagauuaaacuuacaaaa

SEQ ID NO: 4117272 - RNA, 21 nt, Streptococcus pyogenes M1 GAS
aagauuaauuuacuaauccuu

SEQ ID NO: 4117273 - RNA, 20 nt, Streptococcus pyogenes M1 GAS
aagcaaaauuauuauuuugc

SEQ ID NO: 4117274 - RNA, 13 nt, Streptococcus pyogenes M1 GAS
aagcaaauugaaa

SEQ ID NO: 4117275 - RNA, 17 nt, Streptococcus pyogenes M1 GAS
aagcaaucuaagaauug

SEQ ID NO: 4117276 - RNA, 13 nt, Streptococcus pyogenes M1 GAS
aagcauaaaaaua

SEQ ID NO: 4117277 - RNA, 16 nt, Streptococcus pyogenes M1 GAS
aagcaugggcuaagua

SEQ ID NO: 4117278 - RNA, 12 nt, Streptococcus pyogenes M1 GAS
aagcauuuugag

SEQ ID NO: 4117279 - RNA, 13 nt, Streptococcus pyogenes M1 GAS
aagccaaauccac

SEQ ID NO: 4117280 - RNA, 22 nt, Streptococcus pyogenes M1 GAS
aagccagagcaguucagcagca

SEQ ID NO: 4117281 - RNA, 18 nt, Streptococcus pyogenes M1 GAS
aagcccguuagucugcug

SEQ ID NO: 4117282 - RNA, 17 nt, Streptococcus pyogenes M1 GAS
aagccuuaaugagaaac

SEQ ID NO: 4117283 - RNA, 16 nt, Streptococcus pyogenes M1 GAS
aagcggaagaacagca

SEQ ID NO: 4117284 - RNA, 17 nt, Streptococcus pyogenes M1 GAS
aagcguuguagccugug

SEQ ID NO: 4117285 - RNA, 18 nt, Streptococcus pyogenes M1 GAS
aaucagaaagaagaaaau

SEQ ID NO: 4117286 - RNA, 12 nt, Streptococcus pyogenes M1 GAS
aaucagaacucg

SEQ ID NO: 4117287 - RNA, 18 nt, Streptococcus pyogenes M1 GAS
aaucagaacucgucuuua

SEQ ID NO: 4117288 - RNA, 20 nt, Streptococcus pyogenes M1 GAS
aaucauuuuggagagauuuu

SEQ ID NO: 4117289 - RNA, 17 nt, Streptococcus pyogenes M1 GAS
aauccuuuugcuucuag

SEQ ID NO: 4117290 - RNA, 18 nt, Streptococcus pyogenes M1 GAS
aaucgcuuuaggaauauc

SEQ ID NO: 4117291 - RNA, 22 nt, Streptococcus pyogenes M1 GAS
aaucuaagaauuggggcggcac

SEQ ID NO: 4117292 - RNA, 20 nt, Streptococcus pyogenes M1 GAS
aaucuaucucguaauccuug

SEQ ID NO: 4117293 - RNA, 15 nt, Streptococcus pyogenes M1 GAS
aaucuggagaugaga

SEQ ID NO: 4117294 - RNA, 18 nt, Streptococcus pyogenes M1 GAS
aaucuggagaugagaaag

SEQ ID NO: 4117295 - RNA, 14 nt, Streptococcus pyogenes M1 GAS
aaucuggcuuagca

SEQ ID NO: 4117296 - RNA, 17 nt, Streptococcus pyogenes M1 GAS
aaucuucugcauuauca

SEQ ID NO: 4117297 - RNA, 14 nt, Streptococcus pyogenes M1 GAS
aaucuuguuuaacc

SEQ ID NO: 4117298 - RNA, 19 nt, Streptococcus pyogenes M1 GAS
aaucuuucauuagcuuuuu

SEQ ID NO: 4117299 - RNA, 23 nt, Streptococcus pyogenes M1 GAS
aaucuuugugguuacagacuuuu

SEQ ID NO: 4117300 - RNA, 23 nt, Streptococcus pyogenes M1 GAS
aaugaaacguuauuaaagacaaa

SEQ ID NO: 4117301 - RNA, 16 nt, Streptococcus pyogenes M1 GAS
aaugacuucaaaauca

SEQ ID NO: 4117302 - RNA, 20 nt, Streptococcus pyogenes M1 GAS
aaugagcaaggcaagaggag

SEQ ID NO: 4117303 - RNA, 14 nt, Streptococcus pyogenes M1 GAS
aaugauaaggcugc

SEQ ID NO: 4117304 - RNA, 15 nt, Streptococcus pyogenes M1 GAS
aaugauagcaccuaa

SEQ ID NO: 4117305 - RNA, 17 nt, Streptococcus pyogenes M1 GAS
aaugcauuacauuuaaa

SEQ ID NO: 4117306 - RNA, 15 nt, Streptococcus pyogenes M1 GAS
aaugccaaucuuugu

SEQ ID NO: 4117307 - RNA, 16 nt, Streptococcus pyogenes M1 GAS
aaugccaucaaaaaaa

SEQ ID NO: 4117308 - RNA, 23 nt, Streptococcus pyogenes M1 GAS
aaugcccaagauggguuagcucu

SEQ ID NO: 4117309 - RNA, 18 nt, Streptococcus pyogenes M1 GAS
aaugcuguuugucauacu

SEQ ID NO: 4117310 - RNA, 23 nt, Streptococcus pyogenes M1 GAS
aauggaaauuuuaaaugacauga

SEQ ID NO: 4117311 - RNA, 15 nt, Streptococcus pyogenes M1 GAS
aauggcuaaaaagag

SEQ ID NO: 4117312 - RNA, 18 nt, Streptococcus pyogenes M1 GAS
aaugguuuuuugucuucu

SEQ ID NO: 4117313 - RNA, 19 nt, Streptococcus pyogenes M1 GAS
aaugguuuuuuugucuucu

SEQ ID NO: 4117314 - RNA, 15 nt, Streptococcus pyogenes M1 GAS
aauguaugauuuuaa

SEQ ID NO: 4117315 - RNA, 12 nt, Streptococcus pyogenes M1 GAS
aaugucuuguuc

SEQ ID NO: 4117316 - RNA, 17 nt, Streptococcus pyogenes M1 GAS
aaugugacaauugguga

SEQ ID NO: 4117317 - RNA, 16 nt, Streptococcus pyogenes M1 GAS
aauuaacguuccaaaa

SEQ ID NO: 4117318 - RNA, 16 nt, Streptococcus pyogenes M1 GAS
aauuaauaaauuuuug

SEQ ID NO: 4117319 - RNA, 22 nt, Streptococcus pyogenes M1 GAS
aauuacuuaucaucaugacaac

SEQ ID NO: 4117320 - RNA, 20 nt, Streptococcus pyogenes M1 GAS
aauuagcauauuuugauuac

SEQ ID NO: 4117321 - RNA, 15 nt, Streptococcus pyogenes M1 GAS
aauuaguauauugua

SEQ ID NO: 4117322 - RNA, 13 nt, Streptococcus pyogenes M1 GAS
aauuauacuaacu

SEQ ID NO: 4117323 - RNA, 20 nt, Streptococcus pyogenes M1 GAS
aauuauacuaacuauuuuua

SEQ ID NO: 4117324 - RNA, 22 nt, Streptococcus pyogenes M1 GAS
aauuauuaacguuaacaaaaau

SEQ ID NO: 4117325 - RNA, 20 nt, Streptococcus pyogenes M1 GAS
aauuauuuuaauuuuuccuu

SEQ ID NO: 4117326 - RNA, 21 nt, Streptococcus pyogenes M1 GAS
aauuauuuuggaauaguuuau

SEQ ID NO: 4117327 - RNA, 18 nt, Streptococcus pyogenes M1 GAS
aauuccccacaaaagaca

SEQ ID NO: 4117328 - RNA, 20 nt, Streptococcus pyogenes M1 GAS
aauucuaacucuuguagaau

SEQ ID NO: 4117329 - RNA, 15 nt, Streptococcus pyogenes M1 GAS
aauugaccaaaagaa

SEQ ID NO: 4117330 - RNA, 15 nt, Streptococcus pyogenes M1 GAS
aauugauuugcagag

SEQ ID NO: 4117331 - RNA, 19 nt, Streptococcus pyogenes M1 GAS
aauuguugacuuugcaaaa

SEQ ID NO: 4117332 - RNA, 13 nt, Streptococcus pyogenes M1 GAS
aauuuaagguauu

SEQ ID NO: 4117333 - RNA, 13 nt, Streptococcus pyogenes M1 GAS
aauuuaauaguuu

SEQ ID NO: 4117334 - RNA, 17 nt, Streptococcus pyogenes M1 GAS
aauuuaauaguuuucca

SEQ ID NO: 4117335 - RNA, 14 nt, Streptococcus pyogenes M1 GAS
aauuuagucauuuc

SEQ ID NO: 4117336 - RNA, 17 nt, Streptococcus pyogenes M1 GAS
aauuucaauaauaccau

SEQ ID NO: 4117337 - RNA, 18 nt, Streptococcus pyogenes M1 GAS
aauuucaauaauaccauu

SEQ ID NO: 4117338 - RNA, 22 nt, Streptococcus pyogenes M1 GAS
aauuucagauaagaccuucaaa

SEQ ID NO: 4117339 - RNA, 13 nt, Streptococcus pyogenes M1 GAS
aauuucuuucaug

SEQ ID NO: 4117340 - RNA, 17 nt, Streptococcus pyogenes M1 GAS
aauuugguggaagagua

SEQ ID NO: 4117341 - RNA, 17 nt, Streptococcus pyogenes M1 GAS
aauuuuuauaacaauua

SEQ ID NO: 4117342 - RNA, 12 nt, Streptococcus pyogenes M1 GAS
aauuuuuccuua

SEQ ID NO: 4117343 - RNA, 15 nt, Streptococcus pyogenes M1 GAS
aauuuuucuucugac

SEQ ID NO: 4117344 - RNA, 16 nt, Streptococcus pyogenes M1 GAS
aauuuuugauuuuaau

SEQ ID NO: 4117345 - RNA, 14 nt, Streptococcus pyogenes M1 GAS
aauuuuugccaaaa

SEQ ID NO: 4117346 - RNA, 13 nt, Streptococcus pyogenes M1 GAS
acaaaaagagacc

SEQ ID NO: 4117347 - RNA, 16 nt, Streptococcus pyogenes M1 GAS
acaaaacccuuucgua

SEQ ID NO: 4117348 - RNA, 13 nt, Streptococcus pyogenes M1 GAS
acaaaagggaaga

SEQ ID NO: 4117349 - RNA, 15 nt, Streptococcus pyogenes M1 GAS
acaaacagaaauacu

SEQ ID NO: 4117350 - RNA, 14 nt, Streptococcus pyogenes M1 GAS
acaaacugcccuug

SEQ ID NO: 4117351 - RNA, 16 nt, Streptococcus pyogenes M1 GAS
acaaagauuggauuuc

SEQ ID NO: 4117352 - RNA, 14 nt, Streptococcus pyogenes M1 GAS
acaaagcaucagga

SEQ ID NO: 4117353 - RNA, 13 nt, Streptococcus pyogenes M1 GAS
acaaauccuuuug

SEQ ID NO: 4117354 - RNA, 15 nt, Streptococcus pyogenes M1 GAS
acaaaucuucuagaa

SEQ ID NO: 4117355 - RNA, 14 nt, Streptococcus pyogenes M1 GAS
acaaauuuauccug

SEQ ID NO: 4117356 - RNA, 15 nt, Streptococcus pyogenes M1 GAS
acaacacaauucaag

SEQ ID NO: 4117357 - RNA, 13 nt, Streptococcus pyogenes M1 GAS
acaacauccauac

SEQ ID NO: 4117358 - RNA, 13 nt, Streptococcus pyogenes M1 GAS
acaaccuuaaaga

SEQ ID NO: 4117359 - RNA, 15 nt, Streptococcus pyogenes M1 GAS
acaagagcuuaaaag

SEQ ID NO: 4117360 - RNA, 18 nt, Streptococcus pyogenes M1 GAS
acaagagcuuaaaaguua

SEQ ID NO: 4117361 - RNA, 18 nt, Streptococcus pyogenes M1 GAS
acaagcaucuuugcaggg

SEQ ID NO: 4117362 - RNA, 19 nt, Streptococcus pyogenes M1 GAS
acaagcaucuuugcagggu

SEQ ID NO: 4117363 - RNA, 23 nt, Streptococcus pyogenes M1 GAS
acaagucaggaauuguugacuuu

SEQ ID NO: 4117364 - RNA, 18 nt, Streptococcus pyogenes M1 GAS
acaagucuaucugcagau

SEQ ID NO: 4117365 - RNA, 23 nt, Streptococcus pyogenes M1 GAS
acaauagugaguauaaugcugaa

SEQ ID NO: 4117366 - RNA, 21 nt, Streptococcus pyogenes M1 GAS
acaauaucgagcugauugacc

SEQ ID NO: 4117367 - RNA, 21 nt, Streptococcus pyogenes M1 GAS
acaaucgaaaugauagcaccu

SEQ ID NO: 4117368 - RNA, 14 nt, Streptococcus pyogenes M1 GAS
acaaugaaacguua

SEQ ID NO: 4117369 - RNA, 13 nt, Streptococcus pyogenes M1 GAS
acaaugcucuuaa

SEQ ID NO: 4117370 - RNA, 14 nt, Streptococcus pyogenes M1 GAS
acaaugugacaauu

SEQ ID NO: 4117371 - RNA, 17 nt, Streptococcus pyogenes M1 GAS
acaauuauuuugcaggu

SEQ ID NO: 4117372 - RNA, 19 nt, Streptococcus pyogenes M1 GAS
acacagaugcgcaccucca

SEQ ID NO: 4117373 - RNA, 20 nt, Streptococcus pyogenes M1 GAS
acacagaugcgcaccuccac

SEQ ID NO: 4117374 - RNA, 15 nt, Streptococcus pyogenes M1 GAS
acaccaaaaaaagca

SEQ ID NO: 4117375 - RNA, 21 nt, Streptococcus pyogenes M1 GAS
acaccauuaaaaaaaccagcu

SEQ ID NO: 4117376 - RNA, 21 nt, Streptococcus pyogenes M1 GAS
acaccguucauauaagcaauc

SEQ ID NO: 4117377 - RNA, 14 nt, Streptococcus pyogenes M1 GAS
acaccuaauaaaau

SEQ ID NO: 4117378 - RNA, 12 nt, Streptococcus pyogenes M1 GAS
acaccugcugcu

SEQ ID NO: 4117379 - RNA, 21 nt, Streptococcus pyogenes M1 GAS
acacgguuuucugucuacuua

SEQ ID NO: 4117380 - RNA, 13 nt, Streptococcus pyogenes M1 GAS
acacguaagcucc

SEQ ID NO: 4117381 - RNA, 24 nt, Streptococcus pyogenes M1 GAS
acacuacuauuacggcaacuccaa

SEQ ID NO: 4117382 - RNA, 16 nt, Streptococcus pyogenes M1 GAS
acagaagccucuucug

SEQ ID NO: 4117383 - RNA, 14 nt, Streptococcus pyogenes M1 GAS
acagacaccaaaaa

SEQ ID NO: 4117384 - RNA, 23 nt, Streptococcus pyogenes M1 GAS
acagagucuuaguuuaggaauca

SEQ ID NO: 4117385 - RNA, 23 nt, Streptococcus pyogenes M1 GAS
acucaugauaucccaucuuuguu

SEQ ID NO: 4117386 - RNA, 16 nt, Streptococcus pyogenes M1 GAS
acuccugagucggcaa

SEQ ID NO: 4117387 - RNA, 19 nt, Streptococcus pyogenes M1 GAS
acuccuggauuaaaugccc

SEQ ID NO: 4117388 - RNA, 22 nt, Streptococcus pyogenes M1 GAS
acucgauaaaaacgaucaaaaa

SEQ ID NO: 4117389 - RNA, 13 nt, Streptococcus pyogenes M1 GAS
acucgucuuuauc

SEQ ID NO: 4117390 - RNA, 16 nt, Streptococcus pyogenes M1 GAS
acucuauuuuaaguaa

SEQ ID NO: 4117391 - RNA, 15 nt, Streptococcus pyogenes M1 GAS
acucuucgguacuga

SEQ ID NO: 4117392 - RNA, 19 nt, Streptococcus pyogenes M1 GAS
acucuuguagaauuucaag

SEQ ID NO: 4117393 - RNA, 18 nt, Streptococcus pyogenes M1 GAS
acugaaaaugcauuacau

SEQ ID NO: 4117394 - RNA, 15 nt, Streptococcus pyogenes M1 GAS
acugaacuuguccug

SEQ ID NO: 4117395 - RNA, 21 nt, Streptococcus pyogenes M1 GAS
acugacuagccaaaucuggcu

SEQ ID NO: 4117396 - RNA, 18 nt, Streptococcus pyogenes M1 GAS
acugagccccaaaaguug

SEQ ID NO: 4117397 - RNA, 18 nt, Streptococcus pyogenes M1 GAS
acugccauggguaaaaug

SEQ ID NO: 4117398 - RNA, 19 nt, Streptococcus pyogenes M1 GAS
acugccauggguaaaauga

SEQ ID NO: 4117399 - RNA, 21 nt, Streptococcus pyogenes M1 GAS
acugggucaacuccaaucuca

SEQ ID NO: 4117400 - RNA, 18 nt, Streptococcus pyogenes M1 GAS
acuguaaauagauaaugu

SEQ ID NO: 4117401 - RNA, 19 nt, Streptococcus pyogenes M1 GAS
acuguaaauagauaauguu

SEQ ID NO: 4117402 - RNA, 13 nt, Streptococcus pyogenes M1 GAS
acuguaauauuuc

SEQ ID NO: 4117403 - RNA, 22 nt, Streptococcus pyogenes M1 GAS
acugucaaaaaauuaagaagga

SEQ ID NO: 4117404 - RNA, 15 nt, Streptococcus pyogenes M1 GAS
acuuacaaaaagccu

SEQ ID NO: 4117405 - RNA, 20 nt, Streptococcus pyogenes M1 GAS
acuuaccagcaccuucuuuu

SEQ ID NO: 4117406 - RNA, 12 nt, Streptococcus pyogenes M1 GAS
acuuauuuuuuu

SEQ ID NO: 4117407 - RNA, 13 nt, Streptococcus pyogenes M1 GAS
acuucaaaaauac

SEQ ID NO: 4117408 - RNA, 12 nt, Streptococcus pyogenes M1 GAS
acuucaaaauca

SEQ ID NO: 4117409 - RNA, 16 nt, Streptococcus pyogenes M1 GAS
acuucaaaaucaccgu

SEQ ID NO: 4117410 - RNA, 16 nt, Streptococcus pyogenes M1 GAS
acuucaaggaaggcuu

SEQ ID NO: 4117411 - RNA, 21 nt, Streptococcus pyogenes M1 GAS
acuucaaggaaggcuuguucu

SEQ ID NO: 4117412 - RNA, 19 nt, Streptococcus pyogenes M1 GAS
acuucugcagucuuuuuca

SEQ ID NO: 4117413 - RNA, 20 nt, Streptococcus pyogenes M1 GAS
acuucuuccuuguacaagag

SEQ ID NO: 4117414 - RNA, 20 nt, Streptococcus pyogenes M1 GAS
acuugauaaucccuugcuuu

SEQ ID NO: 4117415 - RNA, 18 nt, Streptococcus pyogenes M1 GAS
acuugcaucgcaaacaga

SEQ ID NO: 4117416 - RNA, 16 nt, Streptococcus pyogenes M1 GAS
acuuggccagcgucug

SEQ ID NO: 4117417 - RNA, 17 nt, Streptococcus pyogenes M1 GAS
acuugggagaguuccug

SEQ ID NO: 4117418 - RNA, 14 nt, Streptococcus pyogenes M1 GAS
acuuguaaaaugau

SEQ ID NO: 4117419 - RNA, 18 nt, Streptococcus pyogenes M1 GAS
acuuguuacaaaaaacaa

SEQ ID NO: 4117420 - RNA, 15 nt, Streptococcus pyogenes M1 GAS
acuuuaaacacuacc

SEQ ID NO: 4117421 - RNA, 17 nt, Streptococcus pyogenes M1 GAS
acuuuauugaugauaaa

SEQ ID NO: 4117422 - RNA, 22 nt, Streptococcus pyogenes M1 GAS
acuuuauugaugauaaaggccu

SEQ ID NO: 4117423 - RNA, 22 nt, Streptococcus pyogenes M1 GAS
acuuucaguuaucugauauuuc

SEQ ID NO: 4117424 - RNA, 23 nt, Streptococcus pyogenes M1 GAS
acuuucguaaggguuauuauuua

SEQ ID NO: 4117425 - RNA, 19 nt, Streptococcus pyogenes M1 GAS
acuuugacagacaccaaaa

SEQ ID NO: 4117426 - RNA, 21 nt, Streptococcus pyogenes M1 GAS
acuuugcaaaagaauugaaaa

SEQ ID NO: 4117427 - RNA, 11 nt, Streptococcus pyogenes M1 GAS
agaaaaaagau

SEQ ID NO: 4117428 - RNA, 12 nt, Streptococcus pyogenes M1 GAS
agaaaaagcaau

SEQ ID NO: 4117429 - RNA, 13 nt, Streptococcus pyogenes M1 GAS
agaaaaagcaaug

SEQ ID NO: 4117430 - RNA, 14 nt, Streptococcus pyogenes M1 GAS
agaaaaagcaauga

SEQ ID NO: 4117431 - RNA, 19 nt, Streptococcus pyogenes M1 GAS
agaaaaucuaaucagaacu

SEQ ID NO: 4117432 - RNA, 15 nt, Streptococcus pyogenes M1 GAS
agaaacuaaaggcaa

SEQ ID NO: 4117433 - RNA, 20 nt, Streptococcus pyogenes M1 GAS
agaaagacuuaaggauuuag

SEQ ID NO: 4117434 - RNA, 22 nt, Streptococcus pyogenes M1 GAS
agaaagcggaagaacagcauuu

SEQ ID NO: 4117435 - RNA, 14 nt, Streptococcus pyogenes M1 GAS
agaaaggaauugaa

SEQ ID NO: 4117436 - RNA, 16 nt, Streptococcus pyogenes M1 GAS
agaaaguaaaaauacu

SEQ ID NO: 4117437 - RNA, 22 nt, Streptococcus pyogenes M1 GAS
agaaaguaaaaauacuagaaaa

SEQ ID NO: 4117438 - RNA, 22 nt, Streptococcus pyogenes M1 GAS
agaaauacuccguuucuaguuu

SEQ ID NO: 4117439 - RNA, 14 nt, Streptococcus pyogenes M1 GAS
agaaauuaauaaau

SEQ ID NO: 4117440 - RNA, 17 nt, Streptococcus pyogenes M1 GAS
agaagauccuacaagag

SEQ ID NO: 4117441 - RNA, 20 nt, Streptococcus pyogenes M1 GAS
agaagauccuacaagaggag

SEQ ID NO: 4117442 - RNA, 23 nt, Streptococcus pyogenes M1 GAS
agaagauccuacaagaggaguug

SEQ ID NO: 4117443 - RNA, 14 nt, Streptococcus pyogenes M1 GAS
agaagcaaaauuau

SEQ ID NO: 4117444 - RNA, 14 nt, Streptococcus pyogenes M1 GAS
agaagccaauuacu

SEQ ID NO: 4117445 - RNA, 16 nt, Streptococcus pyogenes M1 GAS
agaagcuaaugucuug

SEQ ID NO: 4117446 - RNA, 21 nt, Streptococcus pyogenes M1 GAS
agaagugauguuuuuacauuu

SEQ ID NO: 4117447 - RNA, 22 nt, Streptococcus pyogenes M1 GAS
agaaguugagacuaaaggucug

SEQ ID NO: 4117448 - RNA, 16 nt, Streptococcus pyogenes M1 GAS
agaauaaagaaaaagu

SEQ ID NO: 4117449 - RNA, 17 nt, Streptococcus pyogenes M1 GAS
agaauaaagaaaaaguc

SEQ ID NO: 4117450 - RNA, 20 nt, Streptococcus pyogenes M1 GAS
agaauaacgguauccuggaa

SEQ ID NO: 4117451 - RNA, 13 nt, Streptococcus pyogenes M1 GAS
agaauaacuaaca

SEQ ID NO: 4117452 - RNA, 14 nt, Streptococcus pyogenes M1 GAS
agaauaaucugagc

SEQ ID NO: 4117453 - RNA, 14 nt, Streptococcus pyogenes M1 GAS
agaauagaaauagu

SEQ ID NO: 4117454 - RNA, 16 nt, Streptococcus pyogenes M1 GAS
agaauagguaaagauu

SEQ ID NO: 4117455 - RNA, 15 nt, Streptococcus pyogenes M1 GAS
agaauccuccucuuu

SEQ ID NO: 4117456 - RNA, 21 nt, Streptococcus pyogenes M1 GAS
agaaugauaguaaacgaaaau

SEQ ID NO: 4117457 - RNA, 22 nt, Streptococcus pyogenes M1 GAS
agaauuaacguuccaaaaagaa

SEQ ID NO: 4117458 - RNA, 21 nt, Streptococcus pyogenes M1 GAS
agaauuggggcggcacuucca

SEQ ID NO: 4117459 - RNA, 16 nt, Streptococcus pyogenes M1 GAS
agaauuuuuauaacaa

SEQ ID NO: 4117460 - RNA, 20 nt, Streptococcus pyogenes M1 GAS
agaauuuuuauaacaauuac

SEQ ID NO: 4117461 - RNA, 19 nt, Streptococcus pyogenes M1 GAS
agacaaggugaguauaaga

SEQ ID NO: 4117462 - RNA, 14 nt, Streptococcus pyogenes M1 GAS
agacaauuauuuug

SEQ ID NO: 4117463 - RNA, 15 nt, Streptococcus pyogenes M1 GAS
agacacccccugcug

SEQ ID NO: 4117464 - RNA, 20 nt, Streptococcus pyogenes M1 GAS
agacaucacgauuugcugag

SEQ ID NO: 4117465 - RNA, 14 nt, Streptococcus pyogenes M1 GAS
agacuuaaggauuu

SEQ ID NO: 4117466 - RNA, 15 nt, Streptococcus pyogenes M1 GAS
agacuuaaggauuua

SEQ ID NO: 4117467 - RNA, 19 nt, Streptococcus pyogenes M1 GAS
agacuuaauugaaagaggu

SEQ ID NO: 4117468 - RNA, 22 nt, Streptococcus pyogenes M1 GAS
agacuucuuccuuguacaagag

SEQ ID NO: 4117469 - RNA, 15 nt, Streptococcus pyogenes M1 GAS
agacuuuuaauguau

SEQ ID NO: 4117470 - RNA, 10 nt, Streptococcus pyogenes M1 GAS
agagaaucaa

SEQ ID NO: 4117471 - RNA, 16 nt, Streptococcus pyogenes M1 GAS
agagaaucaaagggau

SEQ ID NO: 4117472 - RNA, 21 nt, Streptococcus pyogenes M1 GAS
agagacaauaaggucaucaga

SEQ ID NO: 4117473 - RNA, 20 nt, Streptococcus pyogenes M1 GAS
agagagaagcuguucucuuu

SEQ ID NO: 4117474 - RNA, 18 nt, Streptococcus pyogenes M1 GAS
agagagcuuaucaagguu

SEQ ID NO: 4117475 - RNA, 22 nt, Streptococcus pyogenes M1 GAS
agagagguugguaaaaaggcag

SEQ ID NO: 4117476 - RNA, 18 nt, Streptococcus pyogenes M1 GAS
agagauaaaaaguaaaau

SEQ ID NO: 4117477 - RNA, 16 nt, Streptococcus pyogenes M1 GAS
agagaugauagguuuu

SEQ ID NO: 4117478 - RNA, 20 nt, Streptococcus pyogenes M1 GAS
agagcaguucagcagcacug

SEQ ID NO: 4117479 - RNA, 22 nt, Streptococcus pyogenes M1 GAS
agagcucaaccucugaaggcac

SEQ ID NO: 4117480 - RNA, 13 nt, Streptococcus pyogenes M1 GAS
agagcuuuuuuug

SEQ ID NO: 4117481 - RNA, 21 nt, Streptococcus pyogenes M1 GAS
agagcuuuuuuuguuuuggcc

SEQ ID NO: 4117482 - RNA, 13 nt, Streptococcus pyogenes M1 GAS
agaggacuaaguc

SEQ ID NO: 4117483 - RNA, 18 nt, Streptococcus pyogenes M1 GAS
agaggcuugcauuuuuug

SEQ ID NO: 4117484 - RNA, 16 nt, Streptococcus pyogenes M1 GAS
agaggugcaacugcua

SEQ ID NO: 4117485 - RNA, 21 nt, Streptococcus pyogenes M1 GAS
agcuccaacgaccuccagcug

SEQ ID NO: 4117486 - RNA, 14 nt, Streptococcus pyogenes M1 GAS
agcuccuaaaacca

SEQ ID NO: 4117487 - RNA, 16 nt, Streptococcus pyogenes M1 GAS
agcucugucagcaaua

SEQ ID NO: 4117488 - RNA, 20 nt, Streptococcus pyogenes M1 GAS
agcugcugcuaaagcaauca

SEQ ID NO: 4117489 - RNA, 20 nt, Streptococcus pyogenes M1 GAS
agcugguugaccaauauagc

SEQ ID NO: 4117490 - RNA, 22 nt, Streptococcus pyogenes M1 GAS
agcugguugaccaauauagcaa

SEQ ID NO: 4117491 - RNA, 22 nt, Streptococcus pyogenes M1 GAS
agcuuaaaaguuagccaagcaa

SEQ ID NO: 4117492 - RNA, 22 nt, Streptococcus pyogenes M1 GAS
agcuuauaguuugacuucaaaa

SEQ ID NO: 4117493 - RNA, 13 nt, Streptococcus pyogenes M1 GAS
agcuuaucaaggu

SEQ ID NO: 4117494 - RNA, 14 nt, Streptococcus pyogenes M1 GAS
agcuuaucaagguu

SEQ ID NO: 4117495 - RNA, 19 nt, Streptococcus pyogenes M1 GAS
agcuugcuaagagaauaac

SEQ ID NO: 4117496 - RNA, 18 nt, Streptococcus pyogenes M1 GAS
agcuuucuacuaaaaaag

SEQ ID NO: 4117497 - RNA, 16 nt, Streptococcus pyogenes M1 GAS
agcuuuuuaaagagcc

SEQ ID NO: 4117498 - RNA, 23 nt, Streptococcus pyogenes M1 GAS
agcuuuuuuuguuuuggccaaua

SEQ ID NO: 4117499 - RNA, 16 nt, Streptococcus pyogenes M1 GAS
aggaaaaagccagagc

SEQ ID NO: 4117500 - RNA, 13 nt, Streptococcus pyogenes M1 GAS
aggaauaaaaugc

SEQ ID NO: 4117501 - RNA, 20 nt, Streptococcus pyogenes M1 GAS
aggaauaucaugaaguauag

SEQ ID NO: 4117502 - RNA, 20 nt, Streptococcus pyogenes M1 GAS
aggaauugcagcuaaaaaca

SEQ ID NO: 4117503 - RNA, 21 nt, Streptococcus pyogenes M1 GAS
aggaauugcagcuaaaaacaa

SEQ ID NO: 4117504 - RNA, 22 nt, Streptococcus pyogenes M1 GAS
aggaauugcagcuaaaaacaau

SEQ ID NO: 4117505 - RNA, 16 nt, Streptococcus pyogenes M1 GAS
aggaauuguugacuuu

SEQ ID NO: 4117506 - RNA, 13 nt, Streptococcus pyogenes M1 GAS
aggacagguagau

SEQ ID NO: 4117507 - RNA, 15 nt, Streptococcus pyogenes M1 GAS
aggacgguuucccuu

SEQ ID NO: 4117508 - RNA, 13 nt, Streptococcus pyogenes M1 GAS
aggagaacgguau

SEQ ID NO: 4117509 - RNA, 14 nt, Streptococcus pyogenes M1 GAS
aggaggcaacugug

SEQ ID NO: 4117510 - RNA, 20 nt, Streptococcus pyogenes M1 GAS
aggagucggaaauugaccaa

SEQ ID NO: 4117511 - RNA, 23 nt, Streptococcus pyogenes M1 GAS
aggauaugagggucaaacugaug

SEQ ID NO: 4117512 - RNA, 16 nt, Streptococcus pyogenes M1 GAS
aggaucauuauccuuu

SEQ ID NO: 4117513 - RNA, 17 nt, Streptococcus pyogenes M1 GAS
aggauuaugaaaaagaa

SEQ ID NO: 4117514 - RNA, 17 nt, Streptococcus pyogenes M1 GAS
aggauuauuagguucuu

SEQ ID NO: 4117515 - RNA, 17 nt, Streptococcus pyogenes M1 GAS
aggauuuagcuguuauu

SEQ ID NO: 4117516 - RNA, 14 nt, Streptococcus pyogenes M1 GAS
aggauuuaguuuug

SEQ ID NO: 4117517 - RNA, 23 nt, Streptococcus pyogenes M1 GAS
aggcaacuguggguuaagagagg

SEQ ID NO: 4117518 - RNA, 18 nt, Streptococcus pyogenes M1 GAS
aggcaagcaggcuacaca

SEQ ID NO: 4117519 - RNA, 22 nt, Streptococcus pyogenes M1 GAS
aggcaagcaggcuacacaguua

SEQ ID NO: 4117520 - RNA, 17 nt, Streptococcus pyogenes M1 GAS
aggcaauccaaaucaac

SEQ ID NO: 4117521 - RNA, 20 nt, Streptococcus pyogenes M1 GAS
aggcaauccaaaucaacaug

SEQ ID NO: 4117522 - RNA, 12 nt, Streptococcus pyogenes M1 GAS
aggcacagaaaa

SEQ ID NO: 4117523 - RNA, 15 nt, Streptococcus pyogenes M1 GAS
aggcacagaaaaaag

SEQ ID NO: 4117524 - RNA, 20 nt, Streptococcus pyogenes M1 GAS
aggcagacaauuauuuugca

SEQ ID NO: 4117525 - RNA, 19 nt, Streptococcus pyogenes M1 GAS
aggcaggacgguuucccuu

SEQ ID NO: 4117526 - RNA, 16 nt, Streptococcus pyogenes M1 GAS
aggccagcaaggcacc

SEQ ID NO: 4117527 - RNA, 15 nt, Streptococcus pyogenes M1 GAS
aggccgucacaaacu

SEQ ID NO: 4117528 - RNA, 15 nt, Streptococcus pyogenes M1 GAS
aggccuguauuucuu

SEQ ID NO: 4117529 - RNA, 13 nt, Streptococcus pyogenes M1 GAS
aggcucauauuag

SEQ ID NO: 4117530 - RNA, 16 nt, Streptococcus pyogenes M1 GAS
aggcucgacaaaggcu

SEQ ID NO: 4117531 - RNA, 15 nt, Streptococcus pyogenes M1 GAS
agggauccugcuagu

SEQ ID NO: 4117532 - RNA, 18 nt, Streptococcus pyogenes M1 GAS
agggauuuuuacgaaaaa

SEQ ID NO: 4117533 - RNA, 15 nt, Streptococcus pyogenes M1 GAS
agggcuguaaaaugu

SEQ ID NO: 4117534 - RNA, 16 nt, Streptococcus pyogenes M1 GAS
agggcuuaaucuggag

SEQ ID NO: 4117535 - RNA, 16 nt, Streptococcus pyogenes M1 GAS
agggguaaaaaauuua

SEQ ID NO: 4117536 - RNA, 23 nt, Streptococcus pyogenes M1 GAS
agggguaaaaaauuuaauaguuu

SEQ ID NO: 4117537 - RNA, 23 nt, Streptococcus pyogenes M1 GAS
agggguaauuugguggaagagua

SEQ ID NO: 4117538 - RNA, 19 nt, Streptococcus pyogenes M1 GAS
aggguagcugguuugauua

SEQ ID NO: 4117539 - RNA, 18 nt, Streptococcus pyogenes M1 GAS
agggucaaacugaugguu

SEQ ID NO: 4117540 - RNA, 19 nt, Streptococcus pyogenes M1 GAS
aggguguuuuuuauauguc

SEQ ID NO: 4117541 - RNA, 13 nt, Streptococcus pyogenes M1 GAS
aggguuauuauuu

SEQ ID NO: 4117542 - RNA, 21 nt, Streptococcus pyogenes M1 GAS
agguagaugauuacauuagga

SEQ ID NO: 4117543 - RNA, 20 nt, Streptococcus pyogenes M1 GAS
agguagauguuguucuaagu

SEQ ID NO: 4117544 - RNA, 20 nt, Streptococcus pyogenes M1 GAS
agguaucccauaucucuaua

SEQ ID NO: 4117545 - RNA, 15 nt, Streptococcus pyogenes M1 GAS
aggucaucagaauaa

SEQ ID NO: 4117546 - RNA, 15 nt, Streptococcus pyogenes M1 GAS
aggucucaaauuuuu

SEQ ID NO: 4117547 - RNA, 22 nt, Streptococcus pyogenes M1 GAS
aggucugcgcgacuaaaaucau

SEQ ID NO: 4117548 - RNA, 23 nt, Streptococcus pyogenes M1 GAS
aggucugcgcgacuaaaaucaug

SEQ ID NO: 4117549 - RNA, 16 nt, Streptococcus pyogenes M1 GAS
aggucugcuucuuacu

SEQ ID NO: 4117550 - RNA, 18 nt, Streptococcus pyogenes M1 GAS
aggucugugaugaaucau

SEQ ID NO: 4117551 - RNA, 23 nt, Streptococcus pyogenes M1 GAS
aggugaaaauaucuuuuuuacuu

SEQ ID NO: 4117552 - RNA, 16 nt, Streptococcus pyogenes M1 GAS
aggugauugacuugug

SEQ ID NO: 4117553 - RNA, 17 nt, Streptococcus pyogenes M1 GAS
aggugccuguuuuugcu

SEQ ID NO: 4117554 - RNA, 18 nt, Streptococcus pyogenes M1 GAS
aggugccuguuuuugcug

SEQ ID NO: 4117555 - RNA, 17 nt, Streptococcus pyogenes M1 GAS
agguuaaguaaaaggga

SEQ ID NO: 4117556 - RNA, 18 nt, Streptococcus pyogenes M1 GAS
agguuaaucgaccaaaau

SEQ ID NO: 4117557 - RNA, 22 nt, Streptococcus pyogenes M1 GAS
agguuguggcugauaaaaagag

SEQ ID NO: 4117558 - RNA, 12 nt, Streptococcus pyogenes M1 GAS
aguaaaaagcaa

SEQ ID NO: 4117559 - RNA, 16 nt, Streptococcus pyogenes M1 GAS
aguaaaaucuuauuuu

SEQ ID NO: 4117560 - RNA, 18 nt, Streptococcus pyogenes M1 GAS
aguaaagccuuauccauu

SEQ ID NO: 4117561 - RNA, 13 nt, Streptococcus pyogenes M1 GAS
aguaaaggauuua

SEQ ID NO: 4117562 - RNA, 16 nt, Streptococcus pyogenes M1 GAS
aguaaaggauuuaguu

SEQ ID NO: 4117563 - RNA, 16 nt, Streptococcus pyogenes M1 GAS
aguaaccauugccauu

SEQ ID NO: 4117564 - RNA, 14 nt, Streptococcus pyogenes M1 GAS
aguaagaaauuacu

SEQ ID NO: 4117565 - RNA, 15 nt, Streptococcus pyogenes M1 GAS
aguaagaaauuacuu

SEQ ID NO: 4117566 - RNA, 23 nt, Streptococcus pyogenes M1 GAS
aguaagauggugcuuuaaaaagu

SEQ ID NO: 4117567 - RNA, 15 nt, Streptococcus pyogenes M1 GAS
aguaaggaaaucaau

SEQ ID NO: 4117568 - RNA, 19 nt, Streptococcus pyogenes M1 GAS
aguaaggaaaucaauccug

SEQ ID NO: 4117569 - RNA, 18 nt, Streptococcus pyogenes M1 GAS
aguaaggguuaacaauga

SEQ ID NO: 4117570 - RNA, 16 nt, Streptococcus pyogenes M1 GAS
aguacaaggcaaucca

SEQ ID NO: 4117571 - RNA, 13 nt, Streptococcus pyogenes M1 GAS
aguagauacuuug

SEQ ID NO: 4117572 - RNA, 14 nt, Streptococcus pyogenes M1 GAS
aguagcaaauaaca

SEQ ID NO: 4117573 - RNA, 13 nt, Streptococcus pyogenes M1 GAS
aguagcaccuuuu

SEQ ID NO: 4117574 - RNA, 15 nt, Streptococcus pyogenes M1 GAS
aguagcaccuuuuuu

SEQ ID NO: 4117575 - RNA, 20 nt, Streptococcus pyogenes M1 GAS
aguagugaugaguaggcgaa

SEQ ID NO: 4117576 - RNA, 19 nt, Streptococcus pyogenes M1 GAS
aguauacaucaacuaucaa

SEQ ID NO: 4117577 - RNA, 18 nt, Streptococcus pyogenes M1 GAS
aguauauuguaauaacaa

SEQ ID NO: 4117578 - RNA, 13 nt, Streptococcus pyogenes M1 GAS
aguauuuuuuagu

SEQ ID NO: 4117579 - RNA, 20 nt, Streptococcus pyogenes M1 GAS
agucagacuuaauugaaaga

SEQ ID NO: 4117580 - RNA, 14 nt, Streptococcus pyogenes M1 GAS
agucagaucauuaa

SEQ ID NO: 4117581 - RNA, 17 nt, Streptococcus pyogenes M1 GAS
aguccaaaauacauccu

SEQ ID NO: 4117582 - RNA, 18 nt, Streptococcus pyogenes M1 GAS
aguccaaaauacauccua

SEQ ID NO: 4117583 - RNA, 16 nt, Streptococcus pyogenes M1 GAS
aguccaaacucaaacc

SEQ ID NO: 4117584 - RNA, 21 nt, Streptococcus pyogenes M1 GAS
aguccuccucuuuagaauucu

SEQ ID NO: 4117585 - RNA, 14 nt, Streptococcus pyogenes M1 GAS
auagaaaguaaaaa

SEQ ID NO: 4117586 - RNA, 15 nt, Streptococcus pyogenes M1 GAS
auagaaaguaaaaau

SEQ ID NO: 4117587 - RNA, 14 nt, Streptococcus pyogenes M1 GAS
auagaauaaaaaga

SEQ ID NO: 4117588 - RNA, 18 nt, Streptococcus pyogenes M1 GAS
auagacaaacagaaauac

SEQ ID NO: 4117589 - RNA, 20 nt, Streptococcus pyogenes M1 GAS
auagauaauguuguuuuugg

SEQ ID NO: 4117590 - RNA, 23 nt, Streptococcus pyogenes M1 GAS
auagauaguugguauauagcuca

SEQ ID NO: 4117591 - RNA, 17 nt, Streptococcus pyogenes M1 GAS
auagcaauggcuaaaaa

SEQ ID NO: 4117592 - RNA, 18 nt, Streptococcus pyogenes M1 GAS
auagcacguuggaaaagg

SEQ ID NO: 4117593 - RNA, 23 nt, Streptococcus pyogenes M1 GAS
auagcauuaaggauuaugaaaaa

SEQ ID NO: 4117594 - RNA, 18 nt, Streptococcus pyogenes M1 GAS
auagcauugucaaauaaa

SEQ ID NO: 4117595 - RNA, 19 nt, Streptococcus pyogenes M1 GAS
auagcgccagcaauuuucc

SEQ ID NO: 4117596 - RNA, 19 nt, Streptococcus pyogenes M1 GAS
auagcguaaagcaagggaa

SEQ ID NO: 4117597 - RNA, 15 nt, Streptococcus pyogenes M1 GAS
auagcuaauccaaua

SEQ ID NO: 4117598 - RNA, 15 nt, Streptococcus pyogenes M1 GAS
auagcugauuuguuu

SEQ ID NO: 4117599 - RNA, 12 nt, Streptococcus pyogenes M1 GAS
auagcugcugcu

SEQ ID NO: 4117600 - RNA, 21 nt, Streptococcus pyogenes M1 GAS
auagcugcugcuaaagcaauc

SEQ ID NO: 4117601 - RNA, 17 nt, Streptococcus pyogenes M1 GAS
auagcuuucaauugauu

SEQ ID NO: 4117602 - RNA, 12 nt, Streptococcus pyogenes M1 GAS
auagcuuuugua

SEQ ID NO: 4117603 - RNA, 16 nt, Streptococcus pyogenes M1 GAS
auaggaaaaagccaga

SEQ ID NO: 4117604 - RNA, 22 nt, Streptococcus pyogenes M1 GAS
auaggagugauugaugcgcugc

SEQ ID NO: 4117605 - RNA, 19 nt, Streptococcus pyogenes M1 GAS
auaggcagagaugauaggu

SEQ ID NO: 4117606 - RNA, 17 nt, Streptococcus pyogenes M1 GAS
auagguaaagauuuuaa

SEQ ID NO: 4117607 - RNA, 15 nt, Streptococcus pyogenes M1 GAS
auaguaaacgaaaau

SEQ ID NO: 4117608 - RNA, 21 nt, Streptococcus pyogenes M1 GAS
auaguuaacugguaaaguauu

SEQ ID NO: 4117609 - RNA, 21 nt, Streptococcus pyogenes M1 GAS
auaguucagauauucuuuggc

SEQ ID NO: 4117610 - RNA, 21 nt, Streptococcus pyogenes M1 GAS
auaguuugacuucaaaaauac

SEQ ID NO: 4117611 - RNA, 22 nt, Streptococcus pyogenes M1 GAS
auaguuugacuucaaaaauacu

SEQ ID NO: 4117612 - RNA, 15 nt, Streptococcus pyogenes M1 GAS
auauaagcaaucauc

SEQ ID NO: 4117613 - RNA, 19 nt, Streptococcus pyogenes M1 GAS
auauaagcaaucaucauuu

SEQ ID NO: 4117614 - RNA, 13 nt, Streptococcus pyogenes M1 GAS
auauaauaaaaag

SEQ ID NO: 4117615 - RNA, 21 nt, Streptococcus pyogenes M1 GAS
auaucauaaguuaccaauuca

SEQ ID NO: 4117616 - RNA, 17 nt, Streptococcus pyogenes M1 GAS
auaucgacauuuaugcu

SEQ ID NO: 4117617 - RNA, 17 nt, Streptococcus pyogenes M1 GAS
auaucgccaauaaaaaa

SEQ ID NO: 4117618 - RNA, 17 nt, Streptococcus pyogenes M1 GAS
auaucucuauaucuaug

SEQ ID NO: 4117619 - RNA, 16 nt, Streptococcus pyogenes M1 GAS
auaucuuaccauugua

SEQ ID NO: 4117620 - RNA, 21 nt, Streptococcus pyogenes M1 GAS
auaucuuuuuuacuuuuaaaa

SEQ ID NO: 4117621 - RNA, 12 nt, Streptococcus pyogenes M1 GAS
auaugauauaaa

SEQ ID NO: 4117622 - RNA, 14 nt, Streptococcus pyogenes M1 GAS
auaugauauaaaaa

SEQ ID NO: 4117623 - RNA, 20 nt, Streptococcus pyogenes M1 GAS
auauggguguuggaggucug

SEQ ID NO: 4117624 - RNA, 22 nt, Streptococcus pyogenes M1 GAS
auaugguggguaaaaccaaccu

SEQ ID NO: 4117625 - RNA, 14 nt, Streptococcus pyogenes M1 GAS
auaugucaucaaaa

SEQ ID NO: 4117626 - RNA, 21 nt, Streptococcus pyogenes M1 GAS
auauuaaccggcucuaaaaua

SEQ ID NO: 4117627 - RNA, 17 nt, Streptococcus pyogenes M1 GAS
auauuagcaaaaugcug

SEQ ID NO: 4117628 - RNA, 19 nt, Streptococcus pyogenes M1 GAS
auauuauaguaaccauugc

SEQ ID NO: 4117629 - RNA, 13 nt, Streptococcus pyogenes M1 GAS
auauuccauauga

SEQ ID NO: 4117630 - RNA, 14 nt, Streptococcus pyogenes M1 GAS
auauuguuaauaua

SEQ ID NO: 4117631 - RNA, 23 nt, Streptococcus pyogenes M1 GAS
auauuguuaauauagucugcaug

SEQ ID NO: 4117632 - RNA, 22 nt, Streptococcus pyogenes M1 GAS
auauuuccuuuuaaagacauca

SEQ ID NO: 4117633 - RNA, 20 nt, Streptococcus pyogenes M1 GAS
auauuuuuucucaaaaauau

SEQ ID NO: 4117634 - RNA, 19 nt, Streptococcus pyogenes M1 GAS
aucaaaaaaagacacacaa

SEQ ID NO: 4117635 - RNA, 14 nt, Streptococcus pyogenes M1 GAS
aucaaaaaaagcaa

SEQ ID NO: 4117636 - RNA, 15 nt, Streptococcus pyogenes M1 GAS
aucaaaaaaagcaau

SEQ ID NO: 4117637 - RNA, 17 nt, Streptococcus pyogenes M1 GAS
aucaaaaaaagcaauga

SEQ ID NO: 4117638 - RNA, 20 nt, Streptococcus pyogenes M1 GAS
aucaaaaaaagcaaugacua

SEQ ID NO: 4117639 - RNA, 15 nt, Streptococcus pyogenes M1 GAS
aucaaaagaccauaa

SEQ ID NO: 4117640 - RNA, 18 nt, Streptococcus pyogenes M1 GAS
aucaaaagaccauaaaaa

SEQ ID NO: 4117641 - RNA, 16 nt, Streptococcus pyogenes M1 GAS
aucaaagggauuacga

SEQ ID NO: 4117642 - RNA, 18 nt, Streptococcus pyogenes M1 GAS
aucaacauggcuaaugau

SEQ ID NO: 4117643 - RNA, 17 nt, Streptococcus pyogenes M1 GAS
aucaaccucucagcugu

SEQ ID NO: 4117644 - RNA, 14 nt, Streptococcus pyogenes M1 GAS
aucaacgauuacaa

SEQ ID NO: 4117645 - RNA, 22 nt, Streptococcus pyogenes M1 GAS
aucaagaaacucaucuggguag

SEQ ID NO: 4117646 - RNA, 17 nt, Streptococcus pyogenes M1 GAS
aucaagaauagcuuuug

SEQ ID NO: 4117647 - RNA, 14 nt, Streptococcus pyogenes M1 GAS
aucaaggaauugca

SEQ ID NO: 4117648 - RNA, 14 nt, Streptococcus pyogenes M1 GAS
aucaaguaugcuuu

SEQ ID NO: 4117649 - RNA, 21 nt, Streptococcus pyogenes M1 GAS
aucacguaaccaauuguugaa

SEQ ID NO: 4117650 - RNA, 15 nt, Streptococcus pyogenes M1 GAS
aucacucguaaaaag

SEQ ID NO: 4117651 - RNA, 16 nt, Streptococcus pyogenes M1 GAS
aucacucguaaaaaga

SEQ ID NO: 4117652 - RNA, 22 nt, Streptococcus pyogenes M1 GAS
aucacuuccauauaauuuucag

SEQ ID NO: 4117653 - RNA, 19 nt, Streptococcus pyogenes M1 GAS
aucagcucuugcuugucuu

SEQ ID NO: 4117654 - RNA, 19 nt, Streptococcus pyogenes M1 GAS
aucaggauugccaucaaug

SEQ ID NO: 4117655 - RNA, 16 nt, Streptococcus pyogenes M1 GAS
aucaggcaaaacaaaa

SEQ ID NO: 4117656 - RNA, 14 nt, Streptococcus pyogenes M1 GAS
aucaguagugauga

SEQ ID NO: 4117657 - RNA, 16 nt, Streptococcus pyogenes M1 GAS
aucaguccuccucuuu

SEQ ID NO: 4117658 - RNA, 22 nt, Streptococcus pyogenes M1 GAS
aucauaacuugucaagccauag

SEQ ID NO: 4117659 - RNA, 19 nt, Streptococcus pyogenes M1 GAS
aucauacaacugacuagcc

SEQ ID NO: 4117660 - RNA, 21 nt, Streptococcus pyogenes M1 GAS
aucaucgaguggauacaaggu

SEQ ID NO: 4117661 - RNA, 20 nt, Streptococcus pyogenes M1 GAS
aucauggagucaaugaaaag

SEQ ID NO: 4117662 - RNA, 13 nt, Streptococcus pyogenes M1 GAS
aucauuauccuuu

SEQ ID NO: 4117663 - RNA, 22 nt, Streptococcus pyogenes M1 GAS
aucauuuuggagagauuuuaaa

SEQ ID NO: 4117664 - RNA, 14 nt, Streptococcus pyogenes M1 GAS
aucauuuugguuga

SEQ ID NO: 4117665 - RNA, 17 nt, Streptococcus pyogenes M1 GAS
auccaacuuuuaucacu

SEQ ID NO: 4117666 - RNA, 17 nt, Streptococcus pyogenes M1 GAS
auccauucuuuauaaug

SEQ ID NO: 4117667 - RNA, 14 nt, Streptococcus pyogenes M1 GAS
aucccuacuaggcu

SEQ ID NO: 4117668 - RNA, 21 nt, Streptococcus pyogenes M1 GAS
aucccuucauuuuacuauggc

SEQ ID NO: 4117669 - RNA, 13 nt, Streptococcus pyogenes M1 GAS
auccuaacaauuu

SEQ ID NO: 4117670 - RNA, 17 nt, Streptococcus pyogenes M1 GAS
auccuaacaauuuuuca

SEQ ID NO: 4117671 - RNA, 21 nt, Streptococcus pyogenes M1 GAS
auccuggaacuccuaaaacau

SEQ ID NO: 4117672 - RNA, 22 nt, Streptococcus pyogenes M1 GAS
auccuuuacuguaauauuuccu

SEQ ID NO: 4117673 - RNA, 19 nt, Streptococcus pyogenes M1 GAS
aucgacaacauccauacca

SEQ ID NO: 4117674 - RNA, 16 nt, Streptococcus pyogenes M1 GAS
aucgccaauaaaaaag

SEQ ID NO: 4117675 - RNA, 17 nt, Streptococcus pyogenes M1 GAS
aucgcucagaauaaaga

SEQ ID NO: 4117676 - RNA, 23 nt, Streptococcus pyogenes M1 GAS
aucgcucagaauaaagaaaaagu

SEQ ID NO: 4117677 - RNA, 17 nt, Streptococcus pyogenes M1 GAS
aucguaaugucuuguuc

SEQ ID NO: 4117678 - RNA, 23 nt, Streptococcus pyogenes M1 GAS
aucguuauuaauuguuuuaguaa

SEQ ID NO: 4117679 - RNA, 16 nt, Streptococcus pyogenes M1 GAS
aucuaaagcaucagca

SEQ ID NO: 4117680 - RNA, 15 nt, Streptococcus pyogenes M1 GAS
aucuacagcaccuuc

SEQ ID NO: 4117681 - RNA, 16 nt, Streptococcus pyogenes M1 GAS
aucuagaacagcugcu

SEQ ID NO: 4117682 - RNA, 20 nt, Streptococcus pyogenes M1 GAS
aucuaugauuuguauuuuuu

SEQ ID NO: 4117683 - RNA, 21 nt, Streptococcus pyogenes M1 GAS
aucucaguuuuuuugauuuuc

SEQ ID NO: 4117684 - RNA, 14 nt, Streptococcus pyogenes M1 GAS
auucauuuucuucu

SEQ ID NO: 4117685 - RNA, 20 nt, Streptococcus pyogenes M1 GAS
auuccaaacauccaaucacc

SEQ ID NO: 4117686 - RNA, 17 nt, Streptococcus pyogenes M1 GAS
auuccgguuuuaaaagg

SEQ ID NO: 4117687 - RNA, 23 nt, Streptococcus pyogenes M1 GAS
auucuaaaauaaaccaagcuaaa

SEQ ID NO: 4117688 - RNA, 15 nt, Streptococcus pyogenes M1 GAS
auucuaacucuugua

SEQ ID NO: 4117689 - RNA, 15 nt, Streptococcus pyogenes M1 GAS
auucuuuauaauggu

SEQ ID NO: 4117690 - RNA, 12 nt, Streptococcus pyogenes M1 GAS
auucuuuuuccg

SEQ ID NO: 4117691 - RNA, 22 nt, Streptococcus pyogenes M1 GAS
auucuuuuuccguuugagauaa

SEQ ID NO: 4117692 - RNA, 16 nt, Streptococcus pyogenes M1 GAS
auugaagacaaacauc

SEQ ID NO: 4117693 - RNA, 16 nt, Streptococcus pyogenes M1 GAS
auugaaucuuguuuaa

SEQ ID NO: 4117694 - RNA, 17 nt, Streptococcus pyogenes M1 GAS
auugaccaaaagaauua

SEQ ID NO: 4117695 - RNA, 19 nt, Streptococcus pyogenes M1 GAS
auugagaauuuuuauaaca

SEQ ID NO: 4117696 - RNA, 22 nt, Streptococcus pyogenes M1 GAS
auugagguaaucguaaugucuu

SEQ ID NO: 4117697 - RNA, 14 nt, Streptococcus pyogenes M1 GAS
auugauagauaguu

SEQ ID NO: 4117698 - RNA, 22 nt, Streptococcus pyogenes M1 GAS
auugaucucugcaacaucaagg

SEQ ID NO: 4117699 - RNA, 23 nt, Streptococcus pyogenes M1 GAS
auugaucucugcaacaucaaggg

SEQ ID NO: 4117700 - RNA, 16 nt, Streptococcus pyogenes M1 GAS
auugaugagacuaacc

SEQ ID NO: 4117701 - RNA, 17 nt, Streptococcus pyogenes M1 GAS
auugcagcuaaaaacaa

SEQ ID NO: 4117702 - RNA, 18 nt, Streptococcus pyogenes M1 GAS
auugccaucgacgaugug

SEQ ID NO: 4117703 - RNA, 17 nt, Streptococcus pyogenes M1 GAS
auugcuggugacuauca

SEQ ID NO: 4117704 - RNA, 14 nt, Streptococcus pyogenes M1 GAS
auuggaaaauacau

SEQ ID NO: 4117705 - RNA, 21 nt, Streptococcus pyogenes M1 GAS
auuggaacaccguuuuuuguu

SEQ ID NO: 4117706 - RNA, 19 nt, Streptococcus pyogenes M1 GAS
auuguaauaacaaaaugaa

SEQ ID NO: 4117707 - RNA, 20 nt, Streptococcus pyogenes M1 GAS
auuguaauaacaaaaugaag

SEQ ID NO: 4117708 - RNA, 15 nt, Streptococcus pyogenes M1 GAS
auuguagggauuuuu

SEQ ID NO: 4117709 - RNA, 18 nt, Streptococcus pyogenes M1 GAS
auugucaucgcuuugaau

SEQ ID NO: 4117710 - RNA, 19 nt, Streptococcus pyogenes M1 GAS
auugucguugaugcaaaua

SEQ ID NO: 4117711 - RNA, 22 nt, Streptococcus pyogenes M1 GAS
auuguucauuaaagcuaucaua

SEQ ID NO: 4117712 - RNA, 20 nt, Streptococcus pyogenes M1 GAS
auuguugacuuugcaaaaga

SEQ ID NO: 4117713 - RNA, 18 nt, Streptococcus pyogenes M1 GAS
auuguuuuaguaaagccu

SEQ ID NO: 4117714 - RNA, 17 nt, Streptococcus pyogenes M1 GAS
auuuaagguauuguuca

SEQ ID NO: 4117715 - RNA, 18 nt, Streptococcus pyogenes M1 GAS
auuuaauaggcuuuuuuu

SEQ ID NO: 4117716 - RNA, 14 nt, Streptococcus pyogenes M1 GAS
auuuaauaguuuuc

SEQ ID NO: 4117717 - RNA, 16 nt, Streptococcus pyogenes M1 GAS
auuuacuaauccuuuu

SEQ ID NO: 4117718 - RNA, 23 nt, Streptococcus pyogenes M1 GAS
auuuagguacucguaagcauuuu

SEQ ID NO: 4117719 - RNA, 15 nt, Streptococcus pyogenes M1 GAS
auuuauaauuucuuu

SEQ ID NO: 4117720 - RNA, 22 nt, Streptococcus pyogenes M1 GAS
auuuaugcugauuuuggaugaa

SEQ ID NO: 4117721 - RNA, 14 nt, Streptococcus pyogenes M1 GAS
auuuaugucuugcu

SEQ ID NO: 4117722 - RNA, 19 nt, Streptococcus pyogenes M1 GAS
auuuauuaagauaccaaau

SEQ ID NO: 4117723 - RNA, 15 nt, Streptococcus pyogenes M1 GAS
auuuauuaagauuaa

SEQ ID NO: 4117724 - RNA, 22 nt, Streptococcus pyogenes M1 GAS
auuucaaguucucuacuuguca

SEQ ID NO: 4117725 - RNA, 17 nt, Streptococcus pyogenes M1 GAS
auuucaauaauaccauu

SEQ ID NO: 4117726 - RNA, 18 nt, Streptococcus pyogenes M1 GAS
auuucaauaauaccauuu

SEQ ID NO: 4117727 - RNA, 17 nt, Streptococcus pyogenes M1 GAS
auuucagauaagaccuu

SEQ ID NO: 4117728 - RNA, 20 nt, Streptococcus pyogenes M1 GAS
auuucagcuagacuauaaaa

SEQ ID NO: 4117729 - RNA, 12 nt, Streptococcus pyogenes M1 GAS
auuuccuaaugu

SEQ ID NO: 4117730 - RNA, 16 nt, Streptococcus pyogenes M1 GAS
auuucguugacaaagc

SEQ ID NO: 4117731 - RNA, 14 nt, Streptococcus pyogenes M1 GAS
auuucguuuuacgg

SEQ ID NO: 4117732 - RNA, 20 nt, Streptococcus pyogenes M1 GAS
auuucuugaggugauucuuu

SEQ ID NO: 4117733 - RNA, 14 nt, Streptococcus pyogenes M1 GAS
auuucuuucauguu

SEQ ID NO: 4117734 - RNA, 14 nt, Streptococcus pyogenes M1 GAS
auuugacauuaguc

SEQ ID NO: 4117735 - RNA, 17 nt, Streptococcus pyogenes M1 GAS
auuugacauuaguccaa

SEQ ID NO: 4117736 - RNA, 23 nt, Streptococcus pyogenes M1 GAS
auuugacauuaguccaaaauaca

SEQ ID NO: 4117737 - RNA, 22 nt, Streptococcus pyogenes M1 GAS
auuugaccacaccuaauaaaau

SEQ ID NO: 4117738 - RNA, 19 nt, Streptococcus pyogenes M1 GAS
auuugccauggcaagagca

SEQ ID NO: 4117739 - RNA, 13 nt, Streptococcus pyogenes M1 GAS
auuuggaggugaa

SEQ ID NO: 4117740 - RNA, 22 nt, Streptococcus pyogenes M1 GAS
auuugucaaaaaguaaaaagca

SEQ ID NO: 4117741 - RNA, 14 nt, Streptococcus pyogenes M1 GAS
auuuguuuucuuua

SEQ ID NO: 4117742 - RNA, 13 nt, Streptococcus pyogenes M1 GAS
auuuuaagacaac

SEQ ID NO: 4117743 - RNA, 13 nt, Streptococcus pyogenes M1 GAS
auuuuaauuuuuc

SEQ ID NO: 4117744 - RNA, 14 nt, Streptococcus pyogenes M1 GAS
auuuuaauuuuucc

SEQ ID NO: 4117745 - RNA, 22 nt, Streptococcus pyogenes M1 GAS
auuuuacuauggcuucuaaaaa

SEQ ID NO: 4117746 - RNA, 21 nt, Streptococcus pyogenes M1 GAS
auuuuagguaaaguuaggaaa

SEQ ID NO: 4117747 - RNA, 14 nt, Streptococcus pyogenes M1 GAS
auuuuauuaauaag

SEQ ID NO: 4117748 - RNA, 22 nt, Streptococcus pyogenes M1 GAS
auuuuauuaauaaguauucuaa

SEQ ID NO: 4117749 - RNA, 16 nt, Streptococcus pyogenes M1 GAS
auuuuauuuuuuaaag

SEQ ID NO: 4117750 - RNA, 11 nt, Streptococcus pyogenes M1 GAS
auuuucaucau

SEQ ID NO: 4117751 - RNA, 12 nt, Streptococcus pyogenes M1 GAS
auuuucaucauc

SEQ ID NO: 4117752 - RNA, 14 nt, Streptococcus pyogenes M1 GAS
auuuucaucaucaa

SEQ ID NO: 4117753 - RNA, 22 nt, Streptococcus pyogenes M1 GAS
auuuucaucgugacaacacaau

SEQ ID NO: 4117754 - RNA, 22 nt, Streptococcus pyogenes M1 GAS
auuuucuagguuaaaauagaag

SEQ ID NO: 4117755 - RNA, 17 nt, Streptococcus pyogenes M1 GAS
auuuugcaagucucuug

SEQ ID NO: 4117756 - RNA, 18 nt, Streptococcus pyogenes M1 GAS
auuuugcaagucucuugc

SEQ ID NO: 4117757 - RNA, 18 nt, Streptococcus pyogenes M1 GAS
auuuuggagagauuuuaa

SEQ ID NO: 4117758 - RNA, 13 nt, Streptococcus pyogenes M1 GAS
auuuugguugaua

SEQ ID NO: 4117759 - RNA, 21 nt, Streptococcus pyogenes M1 GAS
auuuuucaaaaaaacuucaca

SEQ ID NO: 4117760 - RNA, 20 nt, Streptococcus pyogenes M1 GAS
auuuuuuaccguaacguuug

SEQ ID NO: 4117761 - RNA, 20 nt, Streptococcus pyogenes M1 GAS
auuuuuuguaauucagcauc

SEQ ID NO: 4117762 - RNA, 16 nt, Streptococcus pyogenes M1 GAS
caaaaaaagacacaca

SEQ ID NO: 4117763 - RNA, 13 nt, Streptococcus pyogenes M1 GAS
caaaaaaagcaau

SEQ ID NO: 4117764 - RNA, 17 nt, Streptococcus pyogenes M1 GAS
caaaaaaagcaaugacu

SEQ ID NO: 4117765 - RNA, 15 nt, Streptococcus pyogenes M1 GAS
caaaaaacuagaaac

SEQ ID NO: 4117766 - RNA, 13 nt, Streptococcus pyogenes M1 GAS
caaaaaagggaag

SEQ ID NO: 4117767 - RNA, 22 nt, Streptococcus pyogenes M1 GAS
caaaaacgccacgcucaacugg

SEQ ID NO: 4117768 - RNA, 12 nt, Streptococcus pyogenes M1 GAS
caaaaagacuuc

SEQ ID NO: 4117769 - RNA, 18 nt, Streptococcus pyogenes M1 GAS
caaaaaggcuaagaugga

SEQ ID NO: 4117770 - RNA, 15 nt, Streptococcus pyogenes M1 GAS
caaaaaguaaaaagc

SEQ ID NO: 4117771 - RNA, 19 nt, Streptococcus pyogenes M1 GAS
caaaaaguaaaaagcaaau

SEQ ID NO: 4117772 - RNA, 23 nt, Streptococcus pyogenes M1 GAS
caaaaauauauucuaauuuguga

SEQ ID NO: 4117773 - RNA, 23 nt, Streptococcus pyogenes M1 GAS
caaaacccuuucguaagaaagac

SEQ ID NO: 4117774 - RNA, 13 nt, Streptococcus pyogenes M1 GAS
caaaagcuaaacu

SEQ ID NO: 4117775 - RNA, 18 nt, Streptococcus pyogenes M1 GAS
caaaaguccguacacucc

SEQ ID NO: 4117776 - RNA, 18 nt, Streptococcus pyogenes M1 GAS
caaaaugcuguuugucau

SEQ ID NO: 4117777 - RNA, 18 nt, Streptococcus pyogenes M1 GAS
caaaauuauuauuuugcu

SEQ ID NO: 4117778 - RNA, 14 nt, Streptococcus pyogenes M1 GAS
caaacagaaauacu

SEQ ID NO: 4117779 - RNA, 16 nt, Streptococcus pyogenes M1 GAS
caaacagaaauacucc

SEQ ID NO: 4117780 - RNA, 20 nt, Streptococcus pyogenes M1 GAS
caaacucugccaauuguuca

SEQ ID NO: 4117781 - RNA, 16 nt, Streptococcus pyogenes M1 GAS
caaagaaggccagcaa

SEQ ID NO: 4117782 - RNA, 20 nt, Streptococcus pyogenes M1 GAS
caaagaaggccagcaaggca

SEQ ID NO: 4117783 - RNA, 20 nt, Streptococcus pyogenes M1 GAS
caaaggcuucaucaaugaua

SEQ ID NO: 4117784 - RNA, 16 nt, Streptococcus pyogenes M1 GAS
cagaaaaaagauaaac

SEQ ID NO: 4117785 - RNA, 20 nt, Streptococcus pyogenes M1 GAS
cagaaauacuccguuucuag

SEQ ID NO: 4117786 - RNA, 12 nt, Streptococcus pyogenes M1 GAS
cagaaaugaaaa

SEQ ID NO: 4117787 - RNA, 14 nt, Streptococcus pyogenes M1 GAS
cagaacgucaaaaa

SEQ ID NO: 4117788 - RNA, 14 nt, Streptococcus pyogenes M1 GAS
cagaacucgucuuu

SEQ ID NO: 4117789 - RNA, 21 nt, Streptococcus pyogenes M1 GAS
cagaacucgucuuuauccauu

SEQ ID NO: 4117790 - RNA, 17 nt, Streptococcus pyogenes M1 GAS
cagaacucgucuuuguc

SEQ ID NO: 4117791 - RNA, 21 nt, Streptococcus pyogenes M1 GAS
cagaacucgucuuuguccauu

SEQ ID NO: 4117792 - RNA, 20 nt, Streptococcus pyogenes M1 GAS
cagaagcaaauucuuccuua

SEQ ID NO: 4117793 - RNA, 12 nt, Streptococcus pyogenes M1 GAS
cagaauaaagaa

SEQ ID NO: 4117794 - RNA, 18 nt, Streptococcus pyogenes M1 GAS
cagacuuaauugaaagag

SEQ ID NO: 4117795 - RNA, 22 nt, Streptococcus pyogenes M1 GAS
cagacuuuuaauguauuggaaa

SEQ ID NO: 4117796 - RNA, 15 nt, Streptococcus pyogenes M1 GAS
cagagcaguucagca

SEQ ID NO: 4117797 - RNA, 16 nt, Streptococcus pyogenes M1 GAS
cagagcaguucagcag

SEQ ID NO: 4117798 - RNA, 14 nt, Streptococcus pyogenes M1 GAS
cagauaagaccuuc

SEQ ID NO: 4117799 - RNA, 17 nt, Streptococcus pyogenes M1 GAS
cagauaagaccuucaaa

SEQ ID NO: 4117800 - RNA, 20 nt, Streptococcus pyogenes M1 GAS
cagauaagaccuucaaaaaa

SEQ ID NO: 4117801 - RNA, 23 nt, Streptococcus pyogenes M1 GAS
cagauaagaccuucaaaaaaggg

SEQ ID NO: 4117802 - RNA, 23 nt, Streptococcus pyogenes M1 GAS
cagaugcuugcucaauuuuugau

SEQ ID NO: 4117803 - RNA, 14 nt, Streptococcus pyogenes M1 GAS
cagcaccuucuuuu

SEQ ID NO: 4117804 - RNA, 21 nt, Streptococcus pyogenes M1 GAS
cagcacuggcuuuuuugcuuu

SEQ ID NO: 4117805 - RNA, 20 nt, Streptococcus pyogenes M1 GAS
cagcauaaccuuugccauuu

SEQ ID NO: 4117806 - RNA, 20 nt, Streptococcus pyogenes M1 GAS
cagcuacacuugauuucauu

SEQ ID NO: 4117807 - RNA, 23 nt, Streptococcus pyogenes M1 GAS
cagcuacauugggccccauggcg

SEQ ID NO: 4117808 - RNA, 14 nt, Streptococcus pyogenes M1 GAS
cagcugaaacaccu

SEQ ID NO: 4117809 - RNA, 16 nt, Streptococcus pyogenes M1 GAS
cagcugaaacaccugc

SEQ ID NO: 4117810 - RNA, 21 nt, Streptococcus pyogenes M1 GAS
cagcugacagccucuuggaaa

SEQ ID NO: 4117811 - RNA, 15 nt, Streptococcus pyogenes M1 GAS
cagcugcuugaaaag

SEQ ID NO: 4117812 - RNA, 16 nt, Streptococcus pyogenes M1 GAS
cagcugcuugaaaaga

SEQ ID NO: 4117813 - RNA, 22 nt, Streptococcus pyogenes M1 GAS
cagcugguuuuuuaauuauuuu

SEQ ID NO: 4117814 - RNA, 21 nt, Streptococcus pyogenes M1 GAS
cagcuuacagcugguuuuuua

SEQ ID NO: 4117815 - RNA, 23 nt, Streptococcus pyogenes M1 GAS
cagcuucuacgggauuuaguucu

SEQ ID NO: 4117816 - RNA, 23 nt, Streptococcus pyogenes M1 GAS
caggaauuguugacuuugcaaaa

SEQ ID NO: 4117817 - RNA, 20 nt, Streptococcus pyogenes M1 GAS
caggacagucuuuuuuauaa

SEQ ID NO: 4117818 - RNA, 16 nt, Streptococcus pyogenes M1 GAS
caggauugccaucaau

SEQ ID NO: 4117819 - RNA, 16 nt, Streptococcus pyogenes M1 GAS
caguaaggaaaucaau

SEQ ID NO: 4117820 - RNA, 21 nt, Streptococcus pyogenes M1 GAS
caguauaaccgccaucuaagc

SEQ ID NO: 4117821 - RNA, 16 nt, Streptococcus pyogenes M1 GAS
caguccuccucuuuag

SEQ ID NO: 4117822 - RNA, 17 nt, Streptococcus pyogenes M1 GAS
caguccuccucuuuaga

SEQ ID NO: 4117823 - RNA, 23 nt, Streptococcus pyogenes M1 GAS
caguccuccucuuuagaauucuu

SEQ ID NO: 4117824 - RNA, 16 nt, Streptococcus pyogenes M1 GAS
cagucuuuuuuauaau

SEQ ID NO: 4117825 - RNA, 19 nt, Streptococcus pyogenes M1 GAS
caguguacucaucuaaaaa

SEQ ID NO: 4117826 - RNA, 19 nt, Streptococcus pyogenes M1 GAS
caguuaaaaauaacuuuaa

SEQ ID NO: 4117827 - RNA, 22 nt, Streptococcus pyogenes M1 GAS
caguucugagauauucauuuuc

SEQ ID NO: 4117828 - RNA, 23 nt, Streptococcus pyogenes M1 GAS
caguucugagauauucauuuucu

SEQ ID NO: 4117829 - RNA, 21 nt, Streptococcus pyogenes M1 GAS
caguucuguuucuaagcaaau

SEQ ID NO: 4117830 - RNA, 21 nt, Streptococcus pyogenes M1 GAS
caguuucccauguuuuauuac

SEQ ID NO: 4117831 - RNA, 12 nt, Streptococcus pyogenes M1 GAS
caguuuuuucug

SEQ ID NO: 4117832 - RNA, 20 nt, Streptococcus pyogenes M1 GAS
cauaaaaaaccuuaucaaac

SEQ ID NO: 4117833 - RNA, 12 nt, Streptococcus pyogenes M1 GAS
cauaaaacugug

SEQ ID NO: 4117834 - RNA, 18 nt, Streptococcus pyogenes M1 GAS
cauaaaagauauuuuaaa

SEQ ID NO: 4117835 - RNA, 12 nt, Streptococcus pyogenes M1 GAS
cauaaauucuaa

SEQ ID NO: 4117836 - RNA, 14 nt, Streptococcus pyogenes M1 GAS
cauaacaaauuuau

SEQ ID NO: 4117837 - RNA, 16 nt, Streptococcus pyogenes M1 GAS
cauaaccuuugccauu

SEQ ID NO: 4117838 - RNA, 18 nt, Streptococcus pyogenes M1 GAS
cauacaacugacuagcca

SEQ ID NO: 4117839 - RNA, 21 nt, Streptococcus pyogenes M1 GAS
cauacaacugacuagccaaau

SEQ ID NO: 4117840 - RNA, 22 nt, Streptococcus pyogenes M1 GAS
cauacccgcguuaucuccacag

SEQ ID NO: 4117841 - RNA, 21 nt, Streptococcus pyogenes M1 GAS
cauacuuuauuaaucaaaaaa

SEQ ID NO: 4117842 - RNA, 21 nt, Streptococcus pyogenes M1 GAS
cauagaagacggaguauuuuu

SEQ ID NO: 4117843 - RNA, 22 nt, Streptococcus pyogenes M1 GAS
cauaggaucagugcacucgacc

SEQ ID NO: 4117844 - RNA, 15 nt, Streptococcus pyogenes M1 GAS
cauaucgacauuuau

SEQ ID NO: 4117845 - RNA, 21 nt, Streptococcus pyogenes M1 GAS
cauaugauggaucguuuugca

SEQ ID NO: 4117846 - RNA, 22 nt, Streptococcus pyogenes M1 GAS
cauaugauggaucguuuugcaa

SEQ ID NO: 4117847 - RNA, 19 nt, Streptococcus pyogenes M1 GAS
cauauuagcaaaaugcugu

SEQ ID NO: 4117848 - RNA, 13 nt, Streptococcus pyogenes M1 GAS
cauauuccauaug

SEQ ID NO: 4117849 - RNA, 15 nt, Streptococcus pyogenes M1 GAS
caucaaaaaaagaca

SEQ ID NO: 4117850 - RNA, 14 nt, Streptococcus pyogenes M1 GAS
caucaaaaaaagca

SEQ ID NO: 4117851 - RNA, 15 nt, Streptococcus pyogenes M1 GAS
caucaaaaaaagcaa

SEQ ID NO: 4117852 - RNA, 16 nt, Streptococcus pyogenes M1 GAS
caucaaaaaaagcaau

SEQ ID NO: 4117853 - RNA, 14 nt, Streptococcus pyogenes M1 GAS
caucaaaaagagga

SEQ ID NO: 4117854 - RNA, 20 nt, Streptococcus pyogenes M1 GAS
caucaaaagaccauaaaaaa

SEQ ID NO: 4117855 - RNA, 21 nt, Streptococcus pyogenes M1 GAS
caucaaaagaccauaaaaaac

SEQ ID NO: 4117856 - RNA, 23 nt, Streptococcus pyogenes M1 GAS
caucaaaggcuuuuuguuuuauu

SEQ ID NO: 4117857 - RNA, 14 nt, Streptococcus pyogenes M1 GAS
caucaagaauagcu

SEQ ID NO: 4117858 - RNA, 15 nt, Streptococcus pyogenes M1 GAS
caucaagaauagcuu

SEQ ID NO: 4117859 - RNA, 20 nt, Streptococcus pyogenes M1 GAS
caucaagaauagcuuuugua

SEQ ID NO: 4117860 - RNA, 21 nt, Streptococcus pyogenes M1 GAS
caucaagaauagcuuuuguaa

SEQ ID NO: 4117861 - RNA, 15 nt, Streptococcus pyogenes M1 GAS
caucaaugauagcuu

SEQ ID NO: 4117862 - RNA, 16 nt, Streptococcus pyogenes M1 GAS
caucaauguuuugcuc

SEQ ID NO: 4117863 - RNA, 15 nt, Streptococcus pyogenes M1 GAS
caucaggauugccau

SEQ ID NO: 4117864 - RNA, 17 nt, Streptococcus pyogenes M1 GAS
caucaggcuuaaacaua

SEQ ID NO: 4117865 - RNA, 15 nt, Streptococcus pyogenes M1 GAS
caucaggguugcaug

SEQ ID NO: 4117866 - RNA, 12 nt, Streptococcus pyogenes M1 GAS
caucauauuguu

SEQ ID NO: 4117867 - RNA, 19 nt, Streptococcus pyogenes M1 GAS
caucaucaagaauagcuuu

SEQ ID NO: 4117868 - RNA, 20 nt, Streptococcus pyogenes M1 GAS
caucaucaagaauagcuuuu

SEQ ID NO: 4117869 - RNA, 23 nt, Streptococcus pyogenes M1 GAS
cauccuaauggugucgcuuuuuu

SEQ ID NO: 4117870 - RNA, 21 nt, Streptococcus pyogenes M1 GAS
caucgaguggauacaagguua

SEQ ID NO: 4117871 - RNA, 15 nt, Streptococcus pyogenes M1 GAS
caucuacagcaccuu

SEQ ID NO: 4117872 - RNA, 13 nt, Streptococcus pyogenes M1 GAS
caucugaaaaaau

SEQ ID NO: 4117873 - RNA, 19 nt, Streptococcus pyogenes M1 GAS
caucuugccaucagcaucu

SEQ ID NO: 4117874 - RNA, 22 nt, Streptococcus pyogenes M1 GAS
caugaaaguuauagcuccuaaa

SEQ ID NO: 4117875 - RNA, 22 nt, Streptococcus pyogenes M1 GAS
caugaaguauaguuauguuaua

SEQ ID NO: 4117876 - RNA, 15 nt, Streptococcus pyogenes M1 GAS
caugaagugguucaa

SEQ ID NO: 4117877 - RNA, 18 nt, Streptococcus pyogenes M1 GAS
caugaguaagaaauuacu

SEQ ID NO: 4117878 - RNA, 19 nt, Streptococcus pyogenes M1 GAS
caugaguaagaaauuacuu

SEQ ID NO: 4117879 - RNA, 19 nt, Streptococcus pyogenes M1 GAS
caugaugccauuuaaaagg

SEQ ID NO: 4117880 - RNA, 23 nt, Streptococcus pyogenes M1 GAS
caugaugguuucacgauaagaag

SEQ ID NO: 4117881 - RNA, 15 nt, Streptococcus pyogenes M1 GAS
caugcccauugauga

SEQ ID NO: 4117882 - RNA, 14 nt, Streptococcus pyogenes M1 GAS
caugggaaaagcua

SEQ ID NO: 4117883 - RNA, 21 nt, Streptococcus pyogenes M1 GAS
ccuccaacauagcuaauccaa

SEQ ID NO: 4117884 - RNA, 17 nt, Streptococcus pyogenes M1 GAS
ccuccuugcaauagagc

SEQ ID NO: 4117885 - RNA, 19 nt, Streptococcus pyogenes M1 GAS
ccucgcuaucaaagcugac

SEQ ID NO: 4117886 - RNA, 17 nt, Streptococcus pyogenes M1 GAS
ccucugaaggcacagcc

SEQ ID NO: 4117887 - RNA, 12 nt, Streptococcus pyogenes M1 GAS
ccugaggcaaug

SEQ ID NO: 4117888 - RNA, 17 nt, Streptococcus pyogenes M1 GAS
ccugauaaugauuuauu

SEQ ID NO: 4117889 - RNA, 17 nt, Streptococcus pyogenes M1 GAS
ccugaucccuucauuuu

SEQ ID NO: 4117890 - RNA, 16 nt, Streptococcus pyogenes M1 GAS
ccugcugucccagcag

SEQ ID NO: 4117891 - RNA, 23 nt, Streptococcus pyogenes M1 GAS
ccugucaacuuaccagcaccuuc

SEQ ID NO: 4117892 - RNA, 13 nt, Streptococcus pyogenes M1 GAS
ccuguuuuugcug

SEQ ID NO: 4117893 - RNA, 14 nt, Streptococcus pyogenes M1 GAS
ccuuaaucuaaaag

SEQ ID NO: 4117894 - RNA, 22 nt, Streptococcus pyogenes M1 GAS
ccuuagcaaaggcuucaucaau

SEQ ID NO: 4117895 - RNA, 20 nt, Streptococcus pyogenes M1 GAS
ccuuaggcagacaauuauuu

SEQ ID NO: 4117896 - RNA, 13 nt, Streptococcus pyogenes M1 GAS
ccuuaucucaguu

SEQ ID NO: 4117897 - RNA, 18 nt, Streptococcus pyogenes M1 GAS
ccuuaugcagguguuuaa

SEQ ID NO: 4117898 - RNA, 15 nt, Streptococcus pyogenes M1 GAS
ccuucaaaaaaggga

SEQ ID NO: 4117899 - RNA, 18 nt, Streptococcus pyogenes M1 GAS
ccuucaaccgcuuccuuu

SEQ ID NO: 4117900 - RNA, 13 nt, Streptococcus pyogenes M1 GAS
ccuuccccaucaa

SEQ ID NO: 4117901 - RNA, 20 nt, Streptococcus pyogenes M1 GAS
ccuucguauuggccuucuug

SEQ ID NO: 4117902 - RNA, 13 nt, Streptococcus pyogenes M1 GAS
ccuucuuggaaaa

SEQ ID NO: 4117903 - RNA, 21 nt, Streptococcus pyogenes M1 GAS
ccuugauuaauagcgccagca

SEQ ID NO: 4117904 - RNA, 21 nt, Streptococcus pyogenes M1 GAS
ccuugcaauagagccaagauu

SEQ ID NO: 4117905 - RNA, 22 nt, Streptococcus pyogenes M1 GAS
ccuuguacaagagcuuaaaagu

SEQ ID NO: 4117906 - RNA, 19 nt, Streptococcus pyogenes M1 GAS
ccuuuaucuuauuuuaaga

SEQ ID NO: 4117907 - RNA, 12 nt, Streptococcus pyogenes M1 GAS
ccuuucaagaca

SEQ ID NO: 4117908 - RNA, 20 nt, Streptococcus pyogenes M1 GAS
ccuuucaagacaagcaagca

SEQ ID NO: 4117909 - RNA, 21 nt, Streptococcus pyogenes M1 GAS
ccuuucaagacaagcaagcau

SEQ ID NO: 4117910 - RNA, 17 nt, Streptococcus pyogenes M1 GAS
ccuuugaccacacgauu

SEQ ID NO: 4117911 - RNA, 17 nt, Streptococcus pyogenes M1 GAS
ccuuuuugccuuuaaca

SEQ ID NO: 4117912 - RNA, 18 nt, Streptococcus pyogenes M1 GAS
ccuuuuuggugucagcau

SEQ ID NO: 4117913 - RNA, 18 nt, Streptococcus pyogenes M1 GAS
ccuuuuuuauugaugauu

SEQ ID NO: 4117914 - RNA, 12 nt, Streptococcus pyogenes M1 GAS
cgaaaaaaacuu

SEQ ID NO: 4117915 - RNA, 16 nt, Streptococcus pyogenes M1 GAS
cgaauaugauauaaaa

SEQ ID NO: 4117916 - RNA, 20 nt, Streptococcus pyogenes M1 GAS
cgaauugugucauuucuuga

SEQ ID NO: 4117917 - RNA, 15 nt, Streptococcus pyogenes M1 GAS
cgacauuuaugcuga

SEQ ID NO: 4117918 - RNA, 15 nt, Streptococcus pyogenes M1 GAS
cgaccuuuaacuguu

SEQ ID NO: 4117919 - RNA, 19 nt, Streptococcus pyogenes M1 GAS
cgauaaaaacgaucaaaaa

SEQ ID NO: 4117920 - RNA, 14 nt, Streptococcus pyogenes M1 GAS
cgauaaaacaaaua

SEQ ID NO: 4117921 - RNA, 17 nt, Streptococcus pyogenes M1 GAS
cgauaaucuuugacaau

SEQ ID NO: 4117922 - RNA, 18 nt, Streptococcus pyogenes M1 GAS
cgauaaucuuugacaaug

SEQ ID NO: 4117923 - RNA, 16 nt, Streptococcus pyogenes M1 GAS
cgauggacacuacuau

SEQ ID NO: 4117924 - RNA, 14 nt, Streptococcus pyogenes M1 GAS
cgauuaaaagaugu

SEQ ID NO: 4117925 - RNA, 18 nt, Streptococcus pyogenes M1 GAS
cgauuaaccguuccuguc

SEQ ID NO: 4117926 - RNA, 21 nt, Streptococcus pyogenes M1 GAS
cgauuugcugagcuaaagcca

SEQ ID NO: 4117927 - RNA, 13 nt, Streptococcus pyogenes M1 GAS
cgcaccuccaccg

SEQ ID NO: 4117928 - RNA, 19 nt, Streptococcus pyogenes M1 GAS
cgccguuuuucaaggcugu

SEQ ID NO: 4117929 - RNA, 18 nt, Streptococcus pyogenes M1 GAS
cgccuaggaauaaaaugc

SEQ ID NO: 4117930 - RNA, 14 nt, Streptococcus pyogenes M1 GAS
cgcuauaacaguuc

SEQ ID NO: 4117931 - RNA, 19 nt, Streptococcus pyogenes M1 GAS
cgcuauaccuaaaaaauaa

SEQ ID NO: 4117932 - RNA, 17 nt, Streptococcus pyogenes M1 GAS
cgcugcgcuauggacua

SEQ ID NO: 4117933 - RNA, 21 nt, Streptococcus pyogenes M1 GAS
cgcuucuauguggagcuuuuu

SEQ ID NO: 4117934 - RNA, 14 nt, Streptococcus pyogenes M1 GAS
cggaguauuuuuua

SEQ ID NO: 4117935 - RNA, 13 nt, Streptococcus pyogenes M1 GAS
cggcaucuacagc

SEQ ID NO: 4117936 - RNA, 20 nt, Streptococcus pyogenes M1 GAS
cggcuucuacacaaaagcuu

SEQ ID NO: 4117937 - RNA, 12 nt, Streptococcus pyogenes M1 GAS
cgggauuuaguu

SEQ ID NO: 4117938 - RNA, 13 nt, Streptococcus pyogenes M1 GAS
cgguaaaaacuca

SEQ ID NO: 4117939 - RNA, 17 nt, Streptococcus pyogenes M1 GAS
cguaaagcaagggaaac

SEQ ID NO: 4117940 - RNA, 16 nt, Streptococcus pyogenes M1 GAS
cguaacguaauagaau

SEQ ID NO: 4117941 - RNA, 14 nt, Streptococcus pyogenes M1 GAS
cguaacuugcuuug

SEQ ID NO: 4117942 - RNA, 15 nt, Streptococcus pyogenes M1 GAS
cguaagcauuuugag

SEQ ID NO: 4117943 - RNA, 12 nt, Streptococcus pyogenes M1 GAS
cguaagccaaau

SEQ ID NO: 4117944 - RNA, 20 nt, Streptococcus pyogenes M1 GAS
cguaaggguuauuauuuagg

SEQ ID NO: 4117945 - RNA, 17 nt, Streptococcus pyogenes M1 GAS
cguaaugucuuguucug

SEQ ID NO: 4117946 - RNA, 13 nt, Streptococcus pyogenes M1 GAS
cguauacuuuaaa

SEQ ID NO: 4117947 - RNA, 19 nt, Streptococcus pyogenes M1 GAS
cguauaggugaguuuuuuc

SEQ ID NO: 4117948 - RNA, 23 nt, Streptococcus pyogenes M1 GAS
cguauaggugaguuuuuucuaaa

SEQ ID NO: 4117949 - RNA, 13 nt, Streptococcus pyogenes M1 GAS
cgucacaaacugc

SEQ ID NO: 4117950 - RNA, 12 nt, Streptococcus pyogenes M1 GAS
cgucuaaaaagc

SEQ ID NO: 4117951 - RNA, 16 nt, Streptococcus pyogenes M1 GAS
cgucuggaaggcacag

SEQ ID NO: 4117952 - RNA, 17 nt, Streptococcus pyogenes M1 GAS
cgucuuuauccauucuu

SEQ ID NO: 4117953 - RNA, 15 nt, Streptococcus pyogenes M1 GAS
cgugacaaugugaca

SEQ ID NO: 4117954 - RNA, 19 nt, Streptococcus pyogenes M1 GAS
cgugcucauaaaacugugc

SEQ ID NO: 4117955 - RNA, 13 nt, Streptococcus pyogenes M1 GAS
cguguccccuauc

SEQ ID NO: 4117956 - RNA, 17 nt, Streptococcus pyogenes M1 GAS
cguuagcagacaaaagg

SEQ ID NO: 4117957 - RNA, 18 nt, Streptococcus pyogenes M1 GAS
cguuauuaaagacaaaaa

SEQ ID NO: 4117958 - RNA, 12 nt, Streptococcus pyogenes M1 GAS
cguuauuaauug

SEQ ID NO: 4117959 - RNA, 17 nt, Streptococcus pyogenes M1 GAS
cguucauauaagcaauc

SEQ ID NO: 4117960 - RNA, 16 nt, Streptococcus pyogenes M1 GAS
cguugauugccauuua

SEQ ID NO: 4117961 - RNA, 22 nt, Streptococcus pyogenes M1 GAS
cguuuaaauguccgaaaaaaac

SEQ ID NO: 4117962 - RNA, 18 nt, Streptococcus pyogenes M1 GAS
cuaaaaaagcaauguaug

SEQ ID NO: 4117963 - RNA, 18 nt, Streptococcus pyogenes M1 GAS
cuaaaaaaggagcuagau

SEQ ID NO: 4117964 - RNA, 23 nt, Streptococcus pyogenes M1 GAS
cuaaaaccauuauaaaagagugc

SEQ ID NO: 4117965 - RNA, 16 nt, Streptococcus pyogenes M1 GAS
cuaaaagcauaaaaau

SEQ ID NO: 4117966 - RNA, 15 nt, Streptococcus pyogenes M1 GAS
cuaaaauauauuggu

SEQ ID NO: 4117967 - RNA, 15 nt, Streptococcus pyogenes M1 GAS
cuaaaauccucuuuu

SEQ ID NO: 4117968 - RNA, 14 nt, Streptococcus pyogenes M1 GAS
cuaaacguuuuugg

SEQ ID NO: 4117969 - RNA, 14 nt, Streptococcus pyogenes M1 GAS
cuaaauauaaauua

SEQ ID NO: 4117970 - RNA, 12 nt, Streptococcus pyogenes M1 GAS
cuaacaacaaca

SEQ ID NO: 4117971 - RNA, 14 nt, Streptococcus pyogenes M1 GAS
cuaacaauuuuuca

SEQ ID NO: 4117972 - RNA, 22 nt, Streptococcus pyogenes M1 GAS
cuaacagcaacaucaaaaagag

SEQ ID NO: 4117973 - RNA, 22 nt, Streptococcus pyogenes M1 GAS
cuaacauggauaccauuucuuu

SEQ ID NO: 4117974 - RNA, 15 nt, Streptococcus pyogenes M1 GAS
cuaaccugcauaucu

SEQ ID NO: 4117975 - RNA, 15 nt, Streptococcus pyogenes M1 GAS
cuaacuauuuuuacc

SEQ ID NO: 4117976 - RNA, 24 nt, Streptococcus pyogenes M1 GAS
cuaagauguuuacgcuuuacauuu

SEQ ID NO: 4117977 - RNA, 17 nt, Streptococcus pyogenes M1 GAS
cuaaguagauacuuugg

SEQ ID NO: 4117978 - RNA, 11 nt, Streptococcus pyogenes M1 GAS
cuaauaaaaua

SEQ ID NO: 4117979 - RNA, 17 nt, Streptococcus pyogenes M1 GAS
cuaauaagagugugacg

SEQ ID NO: 4117980 - RNA, 12 nt, Streptococcus pyogenes M1 GAS
cuaauaagauuc

SEQ ID NO: 4117981 - RNA, 13 nt, Streptococcus pyogenes M1 GAS
cuaauccaauaau

SEQ ID NO: 4117982 - RNA, 20 nt, Streptococcus pyogenes M1 GAS
cuaauccaauaauagccauu

SEQ ID NO: 4117983 - RNA, 13 nt, Streptococcus pyogenes M1 GAS
cuaauccuuuuuc

SEQ ID NO: 4117984 - RNA, 18 nt, Streptococcus pyogenes M1 GAS
cugagauauucauuuucu

SEQ ID NO: 4117985 - RNA, 22 nt, Streptococcus pyogenes M1 GAS
cugagcaaaacaauaacacaga

SEQ ID NO: 4117986 - RNA, 20 nt, Streptococcus pyogenes M1 GAS
cugagcuaaagccaacccca

SEQ ID NO: 4117987 - RNA, 18 nt, Streptococcus pyogenes M1 GAS
cugagucggcaauacagu

SEQ ID NO: 4117988 - RNA, 13 nt, Streptococcus pyogenes M1 GAS
cugauaaaaagag

SEQ ID NO: 4117989 - RNA, 13 nt, Streptococcus pyogenes M1 GAS
cugauaaaacuca

SEQ ID NO: 4117990 - RNA, 14 nt, Streptococcus pyogenes M1 GAS
cugauaaaacucaa

SEQ ID NO: 4117991 - RNA, 20 nt, Streptococcus pyogenes M1 GAS
cugauauaguccguacaauc

SEQ ID NO: 4117992 - RNA, 18 nt, Streptococcus pyogenes M1 GAS
cugaucccuucauuuuac

SEQ ID NO: 4117993 - RNA, 15 nt, Streptococcus pyogenes M1 GAS
cugaugacuuguaaa

SEQ ID NO: 4117994 - RNA, 16 nt, Streptococcus pyogenes M1 GAS
cugaugacuuguaaaa

SEQ ID NO: 4117995 - RNA, 15 nt, Streptococcus pyogenes M1 GAS
cugaugcguuuauaa

SEQ ID NO: 4117996 - RNA, 17 nt, Streptococcus pyogenes M1 GAS
cugcaguagcaugacug

SEQ ID NO: 4117997 - RNA, 16 nt, Streptococcus pyogenes M1 GAS
cugcagucuuuuucau

SEQ ID NO: 4117998 - RNA, 14 nt, Streptococcus pyogenes M1 GAS
cugcauaucugccc

SEQ ID NO: 4117999 - RNA, 16 nt, Streptococcus pyogenes M1 GAS
cugcauaucugcccca

SEQ ID NO: 4118000 - RNA, 12 nt, Streptococcus pyogenes M1 GAS
cugccuuggccc

SEQ ID NO: 4118001 - RNA, 20 nt, Streptococcus pyogenes M1 GAS
cugccuuggccccuuuuuug

SEQ ID NO: 4118002 - RNA, 20 nt, Streptococcus pyogenes M1 GAS
cugcgcuauggacuaucuga

SEQ ID NO: 4118003 - RNA, 19 nt, Streptococcus pyogenes M1 GAS
cugcuagacggcuaauaag

SEQ ID NO: 4118004 - RNA, 20 nt, Streptococcus pyogenes M1 GAS
cugcuaguugugucuuuucu

SEQ ID NO: 4118005 - RNA, 14 nt, Streptococcus pyogenes M1 GAS
cugcuaugcgaggc

SEQ ID NO: 4118006 - RNA, 21 nt, Streptococcus pyogenes M1 GAS
cugcuaugcgaggcuuuuuug

SEQ ID NO: 4118007 - RNA, 14 nt, Streptococcus pyogenes M1 GAS
cugcuauuucagcu

SEQ ID NO: 4118008 - RNA, 14 nt, Streptococcus pyogenes M1 GAS
cugcugcuaaagca

SEQ ID NO: 4118009 - RNA, 19 nt, Streptococcus pyogenes M1 GAS
cugcugcuccuaucauagg

SEQ ID NO: 4118010 - RNA, 20 nt, Streptococcus pyogenes M1 GAS
cugcugucccagcagcaaag

SEQ ID NO: 4118011 - RNA, 21 nt, Streptococcus pyogenes M1 GAS
cugcugucccagcagcaaagg

SEQ ID NO: 4118012 - RNA, 21 nt, Streptococcus pyogenes M1 GAS
cuggaaacuggucaaaagcua

SEQ ID NO: 4118013 - RNA, 23 nt, Streptococcus pyogenes M1 GAS
cuggaaggcacagaaaaaagaua

SEQ ID NO: 4118014 - RNA, 14 nt, Streptococcus pyogenes M1 GAS
cuggcacaaacucu

SEQ ID NO: 4118015 - RNA, 16 nt, Streptococcus pyogenes M1 GAS
cugguaaaguauuuua

SEQ ID NO: 4118016 - RNA, 14 nt, Streptococcus pyogenes M1 GAS
cugguacguugauu

SEQ ID NO: 4118017 - RNA, 21 nt, Streptococcus pyogenes M1 GAS
cugguacguugauugccauuu

SEQ ID NO: 4118018 - RNA, 18 nt, Streptococcus pyogenes M1 GAS
cugguugaccaauauagc

SEQ ID NO: 4118019 - RNA, 19 nt, Streptococcus pyogenes M1 GAS
cugguuuuaauauugggac

SEQ ID NO: 4118020 - RNA, 16 nt, Streptococcus pyogenes M1 GAS
cuguaaauagauaaug

SEQ ID NO: 4118021 - RNA, 23 nt, Streptococcus pyogenes M1 GAS
cuguaaauagauaauguuguuuu

SEQ ID NO: 4118022 - RNA, 23 nt, Streptococcus pyogenes M1 GAS
cuguagcguuuguguugaagaag

SEQ ID NO: 4118023 - RNA, 13 nt, Streptococcus pyogenes M1 GAS
cuguauaaacuug

SEQ ID NO: 4118024 - RNA, 13 nt, Streptococcus pyogenes M1 GAS
cuguauacaaaaa

SEQ ID NO: 4118025 - RNA, 19 nt, Streptococcus pyogenes M1 GAS
cuguauccccuugauaugg

SEQ ID NO: 4118026 - RNA, 19 nt, Streptococcus pyogenes M1 GAS
cugucaaaaaauuaagaag

SEQ ID NO: 4118027 - RNA, 20 nt, Streptococcus pyogenes M1 GAS
cugucaacuuaccagcaccu

SEQ ID NO: 4118028 - RNA, 23 nt, Streptococcus pyogenes M1 GAS
cugucaacuuaccagcaccuucu

SEQ ID NO: 4118029 - RNA, 12 nt, Streptococcus pyogenes M1 GAS
cuguccaauacc

SEQ ID NO: 4118030 - RNA, 21 nt, Streptococcus pyogenes M1 GAS
cuguccaauaccuagguaguu

SEQ ID NO: 4118031 - RNA, 16 nt, Streptococcus pyogenes M1 GAS
cugucgugcucauaaa

SEQ ID NO: 4118032 - RNA, 22 nt, Streptococcus pyogenes M1 GAS
cugucuggaaacuggucaaaag

SEQ ID NO: 4118033 - RNA, 13 nt, Streptococcus pyogenes M1 GAS
cugugaugaauca

SEQ ID NO: 4118034 - RNA, 20 nt, Streptococcus pyogenes M1 GAS
cugugcagugggcuuuuuug

SEQ ID NO: 4118035 - RNA, 22 nt, Streptococcus pyogenes M1 GAS
cuguuaucccuggaccauuauc

SEQ ID NO: 4118036 - RNA, 23 nt, Streptococcus pyogenes M1 GAS
cuguucauuuagugguauagaca

SEQ ID NO: 4118037 - RNA, 13 nt, Streptococcus pyogenes M1 GAS
cuguucucuuugg

SEQ ID NO: 4118038 - RNA, 22 nt, Streptococcus pyogenes M1 GAS
cuguucucuuuggagaaauuca

SEQ ID NO: 4118039 - RNA, 23 nt, Streptococcus pyogenes M1 GAS
cuguucucuuuggagaaauucaa

SEQ ID NO: 4118040 - RNA, 16 nt, Streptococcus pyogenes M1 GAS
cuguuugccguguucu

SEQ ID NO: 4118041 - RNA, 22 nt, Streptococcus pyogenes M1 GAS
cuguuugugauggucuugcucu

SEQ ID NO: 4118042 - RNA, 20 nt, Streptococcus pyogenes M1 GAS
cuuaacgaucuauugacuug

SEQ ID NO: 4118043 - RNA, 13 nt, Streptococcus pyogenes M1 GAS
cuuaaucuaaaag

SEQ ID NO: 4118044 - RNA, 21 nt, Streptococcus pyogenes M1 GAS
cuuacaaaaagccuauuuaau

SEQ ID NO: 4118045 - RNA, 19 nt, Streptococcus pyogenes M1 GAS
cuuacagcugguuuuuuaa

SEQ ID NO: 4118046 - RNA, 15 nt, Streptococcus pyogenes M1 GAS
cuuacuaacuagcaa

SEQ ID NO: 4118047 - RNA, 21 nt, Streptococcus pyogenes M1 GAS
cuuaggcagacaauuauuuug

SEQ ID NO: 4118048 - RNA, 19 nt, Streptococcus pyogenes M1 GAS
cuuagguggagcuuuaguu

SEQ ID NO: 4118049 - RNA, 15 nt, Streptococcus pyogenes M1 GAS
cuuagugguuugcaa

SEQ ID NO: 4118050 - RNA, 20 nt, Streptococcus pyogenes M1 GAS
cuuauagcacguuggaaaag

SEQ ID NO: 4118051 - RNA, 18 nt, Streptococcus pyogenes M1 GAS
cuuaucaagguugcaagu

SEQ ID NO: 4118052 - RNA, 14 nt, Streptococcus pyogenes M1 GAS
cuucacauuguauu

SEQ ID NO: 4118053 - RNA, 20 nt, Streptococcus pyogenes M1 GAS
cuucaucaaugauagcuuuc

SEQ ID NO: 4118054 - RNA, 23 nt, Streptococcus pyogenes M1 GAS
cuuccuuagcaaaggcuucauca

SEQ ID NO: 4118055 - RNA, 15 nt, Streptococcus pyogenes M1 GAS
cuucuaaaaaaguua

SEQ ID NO: 4118056 - RNA, 17 nt, Streptococcus pyogenes M1 GAS
cuucuaaaaugaugaga

SEQ ID NO: 4118057 - RNA, 15 nt, Streptococcus pyogenes M1 GAS
cuucuacacaaaagc

SEQ ID NO: 4118058 - RNA, 16 nt, Streptococcus pyogenes M1 GAS
cuucuagcucuuuauc

SEQ ID NO: 4118059 - RNA, 19 nt, Streptococcus pyogenes M1 GAS
cuucuagguagguuugaaa

SEQ ID NO: 4118060 - RNA, 12 nt, Streptococcus pyogenes M1 GAS
cuucuaucaaaa

SEQ ID NO: 4118061 - RNA, 20 nt, Streptococcus pyogenes M1 GAS
cuucuauugucguugaugca

SEQ ID NO: 4118062 - RNA, 13 nt, Streptococcus pyogenes M1 GAS
cuucucuuuugcu

SEQ ID NO: 4118063 - RNA, 19 nt, Streptococcus pyogenes M1 GAS
cuucugaugcguuuauaaa

SEQ ID NO: 4118064 - RNA, 16 nt, Streptococcus pyogenes M1 GAS
cuucugcauuaucauc

SEQ ID NO: 4118065 - RNA, 15 nt, Streptococcus pyogenes M1 GAS
cuucuuacuaugaaa

SEQ ID NO: 4118066 - RNA, 16 nt, Streptococcus pyogenes M1 GAS
cuucuuacuaugaaaa

SEQ ID NO: 4118067 - RNA, 22 nt, Streptococcus pyogenes M1 GAS
cuucuuacuaugaaaaaagaac

SEQ ID NO: 4118068 - RNA, 12 nt, Streptococcus pyogenes M1 GAS
cuucuucuuuuc

SEQ ID NO: 4118069 - RNA, 13 nt, Streptococcus pyogenes M1 GAS
cuucuucuuuuca

SEQ ID NO: 4118070 - RNA, 23 nt, Streptococcus pyogenes M1 GAS
cuucuugaagccgcucuaauuua

SEQ ID NO: 4118071 - RNA, 22 nt, Streptococcus pyogenes M1 GAS
cuucuuugcagagaugcuucuu

SEQ ID NO: 4118072 - RNA, 22 nt, Streptococcus pyogenes M1 GAS
cuucuuuucagagaugcuucuu

SEQ ID NO: 4118073 - RNA, 13 nt, Streptococcus pyogenes M1 GAS
cuucuuuuuauua

SEQ ID NO: 4118074 - RNA, 19 nt, Streptococcus pyogenes M1 GAS
cuugaagccgcucuaauuu

SEQ ID NO: 4118075 - RNA, 22 nt, Streptococcus pyogenes M1 GAS
cuugaauaucgccaauaaaaaa

SEQ ID NO: 4118076 - RNA, 17 nt, Streptococcus pyogenes M1 GAS
cuugaggugauucuuuu

SEQ ID NO: 4118077 - RNA, 14 nt, Streptococcus pyogenes M1 GAS
cuugauaacaauau

SEQ ID NO: 4118078 - RNA, 20 nt, Streptococcus pyogenes M1 GAS
cuugaugucuuggauagacu

SEQ ID NO: 4118079 - RNA, 19 nt, Streptococcus pyogenes M1 GAS
cuugcaaggugcuuuuuuu

SEQ ID NO: 4118080 - RNA, 14 nt, Streptococcus pyogenes M1 GAS
cuugcagaauagaa

SEQ ID NO: 4118081 - RNA, 15 nt, Streptococcus pyogenes M1 GAS
cuugcagaauagaaa

SEQ ID NO: 4118082 - RNA, 16 nt, Streptococcus pyogenes M1 GAS
cuugccaucagcaucu

SEQ ID NO: 4118083 - RNA, 22 nt, Streptococcus pyogenes M1 GAS
gaaguuugcggcucggugcuga

SEQ ID NO: 4118084 - RNA, 13 nt, Streptococcus pyogenes M1 GAS
gaauaaaaugccu

SEQ ID NO: 4118085 - RNA, 13 nt, Streptococcus pyogenes M1 GAS
gaauaaagaaaaa

SEQ ID NO: 4118086 - RNA, 14 nt, Streptococcus pyogenes M1 GAS
gaauaaagaaaaag

SEQ ID NO: 4118087 - RNA, 17 nt, Streptococcus pyogenes M1 GAS
gaauacguaaaaagaga

SEQ ID NO: 4118088 - RNA, 19 nt, Streptococcus pyogenes M1 GAS
gaauacguaaaaagagaag

SEQ ID NO: 4118089 - RNA, 22 nt, Streptococcus pyogenes M1 GAS
gaauagguaaagauuuuaaaua

SEQ ID NO: 4118090 - RNA, 19 nt, Streptococcus pyogenes M1 GAS
gaauaucaggcaaaacaaa

SEQ ID NO: 4118091 - RNA, 19 nt, Streptococcus pyogenes M1 GAS
gaauaugauauaaaaaugg

SEQ ID NO: 4118092 - RNA, 14 nt, Streptococcus pyogenes M1 GAS
gaauuuccuaaugu

SEQ ID NO: 4118093 - RNA, 15 nt, Streptococcus pyogenes M1 GAS
gaauuuuuauaacaa

SEQ ID NO: 4118094 - RNA, 19 nt, Streptococcus pyogenes M1 GAS
gacaaaaaacuagaaacug

SEQ ID NO: 4118095 - RNA, 20 nt, Streptococcus pyogenes M1 GAS
gacaaaaaacuagaaacugc

SEQ ID NO: 4118096 - RNA, 21 nt, Streptococcus pyogenes M1 GAS
gacaacaauaugugauuauua

SEQ ID NO: 4118097 - RNA, 14 nt, Streptococcus pyogenes M1 GAS
gacaacccaacgca

SEQ ID NO: 4118098 - RNA, 18 nt, Streptococcus pyogenes M1 GAS
gacaaccuuaaagacccu

SEQ ID NO: 4118099 - RNA, 16 nt, Streptococcus pyogenes M1 GAS
gacaagcaagcaucag

SEQ ID NO: 4118100 - RNA, 18 nt, Streptococcus pyogenes M1 GAS
gacaauaagcccuuaauc

SEQ ID NO: 4118101 - RNA, 19 nt, Streptococcus pyogenes M1 GAS
gacaauuauuuugcaggua

SEQ ID NO: 4118102 - RNA, 15 nt, Streptococcus pyogenes M1 GAS
gacacagauaagaua

SEQ ID NO: 4118103 - RNA, 15 nt, Streptococcus pyogenes M1 GAS
gacacccccugcugu

SEQ ID NO: 4118104 - RNA, 19 nt, Streptococcus pyogenes M1 GAS
gacacccccugcuguccca

SEQ ID NO: 4118105 - RNA, 18 nt, Streptococcus pyogenes M1 GAS
gacagacaccaaaaaaag

SEQ ID NO: 4118106 - RNA, 20 nt, Streptococcus pyogenes M1 GAS
gacagacaccaaaaaaagca

SEQ ID NO: 4118107 - RNA, 15 nt, Streptococcus pyogenes M1 GAS
gacauuaguccaaaa

SEQ ID NO: 4118108 - RNA, 17 nt, Streptococcus pyogenes M1 GAS
gacauuaguccaaaaua

SEQ ID NO: 4118109 - RNA, 19 nt, Streptococcus pyogenes M1 GAS
gacauuaguccaaaauaca

SEQ ID NO: 4118110 - RNA, 17 nt, Streptococcus pyogenes M1 GAS
gacauuuaugcugauuu

SEQ ID NO: 4118111 - RNA, 21 nt, Streptococcus pyogenes M1 GAS
gacauuuaugcugauuuugga

SEQ ID NO: 4118112 - RNA, 20 nt, Streptococcus pyogenes M1 GAS
gacauuucgugucuaaaaua

SEQ ID NO: 4118113 - RNA, 19 nt, Streptococcus pyogenes M1 GAS
gaccacucgugcugccauc

SEQ ID NO: 4118114 - RNA, 14 nt, Streptococcus pyogenes M1 GAS
gaccauuaucaaua

SEQ ID NO: 4118115 - RNA, 18 nt, Streptococcus pyogenes M1 GAS
gaccuccagcugacagcc

SEQ ID NO: 4118116 - RNA, 23 nt, Streptococcus pyogenes M1 GAS
gaccuuauuggucgcccuuuuua

SEQ ID NO: 4118117 - RNA, 17 nt, Streptococcus pyogenes M1 GAS
gaccuucaaaaaaggga

SEQ ID NO: 4118118 - RNA, 16 nt, Streptococcus pyogenes M1 GAS
gaccuuucaagacaag

SEQ ID NO: 4118119 - RNA, 14 nt, Streptococcus pyogenes M1 GAS
gaccuuugauaaga

SEQ ID NO: 4118120 - RNA, 20 nt, Streptococcus pyogenes M1 GAS
gacgauaagucaguuuuuuc

SEQ ID NO: 4118121 - RNA, 15 nt, Streptococcus pyogenes M1 GAS
gacggaguauuuuuu

SEQ ID NO: 4118122 - RNA, 16 nt, Streptococcus pyogenes M1 GAS
gacgucuggauugaua

SEQ ID NO: 4118123 - RNA, 13 nt, Streptococcus pyogenes M1 GAS
gacuaaguccuuu

SEQ ID NO: 4118124 - RNA, 12 nt, Streptococcus pyogenes M1 GAS
gacuauaaaagu

SEQ ID NO: 4118125 - RNA, 23 nt, Streptococcus pyogenes M1 GAS
gacuaucauuggggaaacuagca

SEQ ID NO: 4118126 - RNA, 23 nt, Streptococcus pyogenes M1 GAS
gacuaucugaguccgagaaagau

SEQ ID NO: 4118127 - RNA, 16 nt, Streptococcus pyogenes M1 GAS
gacucuagcauaaaag

SEQ ID NO: 4118128 - RNA, 17 nt, Streptococcus pyogenes M1 GAS
gacuguauguaucaaga

SEQ ID NO: 4118129 - RNA, 14 nt, Streptococcus pyogenes M1 GAS
gacuuaauugaaag

SEQ ID NO: 4118130 - RNA, 16 nt, Streptococcus pyogenes M1 GAS
gacuuaauugaaagag

SEQ ID NO: 4118131 - RNA, 14 nt, Streptococcus pyogenes M1 GAS
gacuucaaaaauac

SEQ ID NO: 4118132 - RNA, 21 nt, Streptococcus pyogenes M1 GAS
gacuugguucugaaaauaaaa

SEQ ID NO: 4118133 - RNA, 21 nt, Streptococcus pyogenes M1 GAS
gacuuguaaaaugauacuuuc

SEQ ID NO: 4118134 - RNA, 21 nt, Streptococcus pyogenes M1 GAS
gacuuguuacaaaaaacaagu

SEQ ID NO: 4118135 - RNA, 19 nt, Streptococcus pyogenes M1 GAS
gagaaaccuauaaggagau

SEQ ID NO: 4118136 - RNA, 23 nt, Streptococcus pyogenes M1 GAS
gagaaacuaaaggcaauagcaag

SEQ ID NO: 4118137 - RNA, 20 nt, Streptococcus pyogenes M1 GAS
gagacuaaaggucugcuucu

SEQ ID NO: 4118138 - RNA, 16 nt, Streptococcus pyogenes M1 GAS
gagagauuuuaaaaaa

SEQ ID NO: 4118139 - RNA, 21 nt, Streptococcus pyogenes M1 GAS
gagagguugguaaaaaggcag

SEQ ID NO: 4118140 - RNA, 17 nt, Streptococcus pyogenes M1 GAS
gagaugacgguaaauaa

SEQ ID NO: 4118141 - RNA, 14 nt, Streptococcus pyogenes M1 GAS
gagauuaacugaca

SEQ ID NO: 4118142 - RNA, 12 nt, Streptococcus pyogenes M1 GAS
gagcaaggcaag

SEQ ID NO: 4118143 - RNA, 17 nt, Streptococcus pyogenes M1 GAS
gagccaauaacgccagc

SEQ ID NO: 4118144 - RNA, 23 nt, Streptococcus pyogenes M1 GAS
gagcgcacuuuauuauaccaaau

SEQ ID NO: 4118145 - RNA, 14 nt, Streptococcus pyogenes M1 GAS
gaggcuuuuuugag

SEQ ID NO: 4118146 - RNA, 17 nt, Streptococcus pyogenes M1 GAS
gagggacugucaaaaaa

SEQ ID NO: 4118147 - RNA, 16 nt, Streptococcus pyogenes M1 GAS
gagguuaaucgaccaa

SEQ ID NO: 4118148 - RNA, 22 nt, Streptococcus pyogenes M1 GAS
gagguuaaucgaccaaaaucuu

SEQ ID NO: 4118149 - RNA, 17 nt, Streptococcus pyogenes M1 GAS
gagguugguaaaaaggc

SEQ ID NO: 4118150 - RNA, 18 nt, Streptococcus pyogenes M1 GAS
gagguugguaaaaaggca

SEQ ID NO: 4118151 - RNA, 15 nt, Streptococcus pyogenes M1 GAS
gaguaagcagcauca

SEQ ID NO: 4118152 - RNA, 22 nt, Streptococcus pyogenes M1 GAS
gagucggaaauugaccaaaaga

SEQ ID NO: 4118153 - RNA, 13 nt, Streptococcus pyogenes M1 GAS
gagucuuuuccua

SEQ ID NO: 4118154 - RNA, 11 nt, Streptococcus pyogenes M1 GAS
gaguggauaca

SEQ ID NO: 4118155 - RNA, 11 nt, Streptococcus pyogenes M1 GAS
gaguuuugcug

SEQ ID NO: 4118156 - RNA, 12 nt, Streptococcus pyogenes M1 GAS
gauaaaaaacaa

SEQ ID NO: 4118157 - RNA, 12 nt, Streptococcus pyogenes M1 GAS
gauaaaaaguaa

SEQ ID NO: 4118158 - RNA, 14 nt, Streptococcus pyogenes M1 GAS
gauaaaacaaauaa

SEQ ID NO: 4118159 - RNA, 19 nt, Streptococcus pyogenes M1 GAS
gauaaaggccuguauuucu

SEQ ID NO: 4118160 - RNA, 14 nt, Streptococcus pyogenes M1 GAS
gauaagaccuucaa

SEQ ID NO: 4118161 - RNA, 20 nt, Streptococcus pyogenes M1 GAS
gauaagauacugcccuugau

SEQ ID NO: 4118162 - RNA, 21 nt, Streptococcus pyogenes M1 GAS
gauaagauacugcccuugaug

SEQ ID NO: 4118163 - RNA, 15 nt, Streptococcus pyogenes M1 GAS
gauaauauugauauu

SEQ ID NO: 4118164 - RNA, 18 nt, Streptococcus pyogenes M1 GAS
gauaaugauuuauuaaga

SEQ ID NO: 4118165 - RNA, 22 nt, Streptococcus pyogenes M1 GAS
gauacaagguuaaguaaaaggg

SEQ ID NO: 4118166 - RNA, 23 nt, Streptococcus pyogenes M1 GAS
gauacaagguuaaguaaaaggga

SEQ ID NO: 4118167 - RNA, 18 nt, Streptococcus pyogenes M1 GAS
gauacauugaauaaagug

SEQ ID NO: 4118168 - RNA, 16 nt, Streptococcus pyogenes M1 GAS
gauacguuuauuguug

SEQ ID NO: 4118169 - RNA, 17 nt, Streptococcus pyogenes M1 GAS
gauacguuuauuguugc

SEQ ID NO: 4118170 - RNA, 20 nt, Streptococcus pyogenes M1 GAS
gauacuuugguauucuuuuu

SEQ ID NO: 4118171 - RNA, 22 nt, Streptococcus pyogenes M1 GAS
gauagugugugugauguaauug

SEQ ID NO: 4118172 - RNA, 19 nt, Streptococcus pyogenes M1 GAS
gauauagaauagguaaaga

SEQ ID NO: 4118173 - RNA, 21 nt, Streptococcus pyogenes M1 GAS
gauaucccaucuuuguuuuuu

SEQ ID NO: 4118174 - RNA, 23 nt, Streptococcus pyogenes M1 GAS
gauauuuuuucucaaaaauauau

SEQ ID NO: 4118175 - RNA, 19 nt, Streptococcus pyogenes M1 GAS
gaucaaaaaucuuuuucuu

SEQ ID NO: 4118176 - RNA, 19 nt, Streptococcus pyogenes M1 GAS
gauccuuuaucuuauuuua

SEQ ID NO: 4118177 - RNA, 18 nt, Streptococcus pyogenes M1 GAS
gaugaaaugauuguuauu

SEQ ID NO: 4118178 - RNA, 17 nt, Streptococcus pyogenes M1 GAS
gaugaaccucagcaagu

SEQ ID NO: 4118179 - RNA, 23 nt, Streptococcus pyogenes M1 GAS
gaugacuuguaaaaugauacuuu

SEQ ID NO: 4118180 - RNA, 17 nt, Streptococcus pyogenes M1 GAS
gaugagacuaaccugca

SEQ ID NO: 4118181 - RNA, 17 nt, Streptococcus pyogenes M1 GAS
gaugauugaguaagcag

SEQ ID NO: 4118182 - RNA, 15 nt, Streptococcus pyogenes M1 GAS
gaugcacacaaaucu

SEQ ID NO: 4118183 - RNA, 21 nt, Streptococcus pyogenes M1 GAS
gcuauagaaacuuuuuauaag

SEQ ID NO: 4118184 - RNA, 18 nt, Streptococcus pyogenes M1 GAS
gcuaucauacaacugacu

SEQ ID NO: 4118185 - RNA, 21 nt, Streptococcus pyogenes M1 GAS
gcuaugcuuguaggacacuuu

SEQ ID NO: 4118186 - RNA, 16 nt, Streptococcus pyogenes M1 GAS
gcuauggacuaucuga

SEQ ID NO: 4118187 - RNA, 17 nt, Streptococcus pyogenes M1 GAS
gcuauuucagcuagacu

SEQ ID NO: 4118188 - RNA, 17 nt, Streptococcus pyogenes M1 GAS
gcucagaauaaagaaaa

SEQ ID NO: 4118189 - RNA, 14 nt, Streptococcus pyogenes M1 GAS
gcucuaaaauauau

SEQ ID NO: 4118190 - RNA, 21 nt, Streptococcus pyogenes M1 GAS
gcucuaauuuagucauuucuu

SEQ ID NO: 4118191 - RNA, 22 nt, Streptococcus pyogenes M1 GAS
gcucuaauuuagucauuucuuc

SEQ ID NO: 4118192 - RNA, 18 nt, Streptococcus pyogenes M1 GAS
gcucuuaacucucauaaa

SEQ ID NO: 4118193 - RNA, 19 nt, Streptococcus pyogenes M1 GAS
gcucuugcuugucuuuuuu

SEQ ID NO: 4118194 - RNA, 16 nt, Streptococcus pyogenes M1 GAS
gcucuuguuuucucaa

SEQ ID NO: 4118195 - RNA, 13 nt, Streptococcus pyogenes M1 GAS
gcugaaacaccug

SEQ ID NO: 4118196 - RNA, 19 nt, Streptococcus pyogenes M1 GAS
gcugaacucuuuauuccac

SEQ ID NO: 4118197 - RNA, 16 nt, Streptococcus pyogenes M1 GAS
gcugaauaaacaaaau

SEQ ID NO: 4118198 - RNA, 15 nt, Streptococcus pyogenes M1 GAS
gcugagcaaaacaau

SEQ ID NO: 4118199 - RNA, 17 nt, Streptococcus pyogenes M1 GAS
gcugaugacuuguaaaa

SEQ ID NO: 4118200 - RNA, 20 nt, Streptococcus pyogenes M1 GAS
gcugccuuggccccuuuuuu

SEQ ID NO: 4118201 - RNA, 14 nt, Streptococcus pyogenes M1 GAS
gcugcgaugauuuu

SEQ ID NO: 4118202 - RNA, 14 nt, Streptococcus pyogenes M1 GAS
gcugcuaaggacaa

SEQ ID NO: 4118203 - RNA, 15 nt, Streptococcus pyogenes M1 GAS
gcugcugcuaaagca

SEQ ID NO: 4118204 - RNA, 14 nt, Streptococcus pyogenes M1 GAS
gcugucccagcagc

SEQ ID NO: 4118205 - RNA, 15 nt, Streptococcus pyogenes M1 GAS
gcuguuauuggaaag

SEQ ID NO: 4118206 - RNA, 13 nt, Streptococcus pyogenes M1 GAS
gcuuccuuugcau

SEQ ID NO: 4118207 - RNA, 21 nt, Streptococcus pyogenes M1 GAS
gcuucuauguggagcuuuuuu

SEQ ID NO: 4118208 - RNA, 22 nt, Streptococcus pyogenes M1 GAS
gcuucuuacuaugaaaaaagaa

SEQ ID NO: 4118209 - RNA, 14 nt, Streptococcus pyogenes M1 GAS
gcuuguucuuuauu

SEQ ID NO: 4118210 - RNA, 16 nt, Streptococcus pyogenes M1 GAS
gcuuuaggaauaucau

SEQ ID NO: 4118211 - RNA, 17 nt, Streptococcus pyogenes M1 GAS
gcuuugauuuuucuugu

SEQ ID NO: 4118212 - RNA, 19 nt, Streptococcus pyogenes M1 GAS
gcuuugauuuuucuuguuu

SEQ ID NO: 4118213 - RNA, 20 nt, Streptococcus pyogenes M1 GAS
gcuuuuuacaucaaaaaaag

SEQ ID NO: 4118214 - RNA, 17 nt, Streptococcus pyogenes M1 GAS
gcuuuuuugagcaucag

SEQ ID NO: 4118215 - RNA, 16 nt, Streptococcus pyogenes M1 GAS
gcuuuuuuuauuucac

SEQ ID NO: 4118216 - RNA, 13 nt, Streptococcus pyogenes M1 GAS
ggaaaacagaaag

SEQ ID NO: 4118217 - RNA, 22 nt, Streptococcus pyogenes M1 GAS
ggaaaacagaaagcggaagaac

SEQ ID NO: 4118218 - RNA, 23 nt, Streptococcus pyogenes M1 GAS
ggaaaucaauccuguaacuguag

SEQ ID NO: 4118219 - RNA, 16 nt, Streptococcus pyogenes M1 GAS
ggaaauugaccaaaag

SEQ ID NO: 4118220 - RNA, 13 nt, Streptococcus pyogenes M1 GAS
ggaagaagauccu

SEQ ID NO: 4118221 - RNA, 21 nt, Streptococcus pyogenes M1 GAS
ggaauguuuacuggacgaaca

SEQ ID NO: 4118222 - RNA, 14 nt, Streptococcus pyogenes M1 GAS
ggacauggaguccu

SEQ ID NO: 4118223 - RNA, 13 nt, Streptococcus pyogenes M1 GAS
ggaccaagauuca

SEQ ID NO: 4118224 - RNA, 20 nt, Streptococcus pyogenes M1 GAS
ggaccaugccuaaagcccau

SEQ ID NO: 4118225 - RNA, 17 nt, Streptococcus pyogenes M1 GAS
ggacuuuucagucuucu

SEQ ID NO: 4118226 - RNA, 15 nt, Streptococcus pyogenes M1 GAS
ggagcuuuaccuccu

SEQ ID NO: 4118227 - RNA, 19 nt, Streptococcus pyogenes M1 GAS
ggagggacugucaaaaaau

SEQ ID NO: 4118228 - RNA, 18 nt, Streptococcus pyogenes M1 GAS
ggaggguuuuucuuuuga

SEQ ID NO: 4118229 - RNA, 15 nt, Streptococcus pyogenes M1 GAS
ggauacaguccaaac

SEQ ID NO: 4118230 - RNA, 23 nt, Streptococcus pyogenes M1 GAS
ggauauaacaacucccuccuaag

SEQ ID NO: 4118231 - RNA, 18 nt, Streptococcus pyogenes M1 GAS
ggauguuuauuccaaaca

SEQ ID NO: 4118232 - RNA, 16 nt, Streptococcus pyogenes M1 GAS
ggcaauggcugagcca

SEQ ID NO: 4118233 - RNA, 14 nt, Streptococcus pyogenes M1 GAS
ggcacagaaaaaag

SEQ ID NO: 4118234 - RNA, 19 nt, Streptococcus pyogenes M1 GAS
ggcaccugaggcaauggcu

SEQ ID NO: 4118235 - RNA, 16 nt, Streptococcus pyogenes M1 GAS
ggccaauaaaauaucu

SEQ ID NO: 4118236 - RNA, 14 nt, Streptococcus pyogenes M1 GAS
ggccccauggcgug

SEQ ID NO: 4118237 - RNA, 17 nt, Streptococcus pyogenes M1 GAS
ggccuguauuucuuuag

SEQ ID NO: 4118238 - RNA, 20 nt, Streptococcus pyogenes M1 GAS
ggccuucuagucggacuugg

SEQ ID NO: 4118239 - RNA, 20 nt, Streptococcus pyogenes M1 GAS
ggcgccguuuuucaaggcug

SEQ ID NO: 4118240 - RNA, 22 nt, Streptococcus pyogenes M1 GAS
ggcgccguuuuucaaggcuguc

SEQ ID NO: 4118241 - RNA, 19 nt, Streptococcus pyogenes M1 GAS
ggcuacucuauuugaagua

SEQ ID NO: 4118242 - RNA, 17 nt, Streptococcus pyogenes M1 GAS
ggcucauauuagcaaaa

SEQ ID NO: 4118243 - RNA, 16 nt, Streptococcus pyogenes M1 GAS
ggcucgacaaaggcug

SEQ ID NO: 4118244 - RNA, 17 nt, Streptococcus pyogenes M1 GAS
ggcucgacaaaggcugc

SEQ ID NO: 4118245 - RNA, 18 nt, Streptococcus pyogenes M1 GAS
ggcucgacaaaggcugcc

SEQ ID NO: 4118246 - RNA, 18 nt, Streptococcus pyogenes M1 GAS
ggcucgucgcgacgcuga

SEQ ID NO: 4118247 - RNA, 16 nt, Streptococcus pyogenes M1 GAS
ggcuucuaaaaaaguu

SEQ ID NO: 4118248 - RNA, 17 nt, Streptococcus pyogenes M1 GAS
ggcuuuccauucuugca

SEQ ID NO: 4118249 - RNA, 12 nt, Streptococcus pyogenes M1 GAS
ggcuuuuuugcu

SEQ ID NO: 4118250 - RNA, 16 nt, Streptococcus pyogenes M1 GAS
ggcuuuuuugcuuuuu

SEQ ID NO: 4118251 - RNA, 12 nt, Streptococcus pyogenes M1 GAS
gggcaaugccau

SEQ ID NO: 4118252 - RNA, 13 nt, Streptococcus pyogenes M1 GAS
ggguaaaaaaggg

SEQ ID NO: 4118253 - RNA, 17 nt, Streptococcus pyogenes M1 GAS
ggguaaaaugacugaca

SEQ ID NO: 4118254 - RNA, 22 nt, Streptococcus pyogenes M1 GAS
gggugaaucguuacuccuuuga

SEQ ID NO: 4118255 - RNA, 20 nt, Streptococcus pyogenes M1 GAS
gguaaaaacucaaaaaauac

SEQ ID NO: 4118256 - RNA, 14 nt, Streptococcus pyogenes M1 GAS
ggucaacuccaauc

SEQ ID NO: 4118257 - RNA, 18 nt, Streptococcus pyogenes M1 GAS
ggucauuauugucacuga

SEQ ID NO: 4118258 - RNA, 22 nt, Streptococcus pyogenes M1 GAS
ggugaacaccccccgcuuuuaa

SEQ ID NO: 4118259 - RNA, 19 nt, Streptococcus pyogenes M1 GAS
ggugaguuuuuucuaaaag

SEQ ID NO: 4118260 - RNA, 14 nt, Streptococcus pyogenes M1 GAS
ggugcuuuuuuugu

SEQ ID NO: 4118261 - RNA, 11 nt, Streptococcus pyogenes M1 GAS
gguguuuuuua

SEQ ID NO: 4118262 - RNA, 20 nt, Streptococcus pyogenes M1 GAS
gguuucgccuaggaauaaaa

SEQ ID NO: 4118263 - RNA, 11 nt, Streptococcus pyogenes M1 GAS
guaaaaaaggg

SEQ ID NO: 4118264 - RNA, 11 nt, Streptococcus pyogenes M1 GAS
guaaaaacuca

SEQ ID NO: 4118265 - RNA, 19 nt, Streptococcus pyogenes M1 GAS
guaaaaagagaagaugagc

SEQ ID NO: 4118266 - RNA, 18 nt, Streptococcus pyogenes M1 GAS
guaaaaagcaaauugaaa

SEQ ID NO: 4118267 - RNA, 19 nt, Streptococcus pyogenes M1 GAS
guaaaaucuuauuuuuuac

SEQ ID NO: 4118268 - RNA, 11 nt, Streptococcus pyogenes M1 GAS
guaaaaugacu

SEQ ID NO: 4118269 - RNA, 19 nt, Streptococcus pyogenes M1 GAS
guaaaggauuuaguucugu

SEQ ID NO: 4118270 - RNA, 20 nt, Streptococcus pyogenes M1 GAS
guaaccauagaagccaauua

SEQ ID NO: 4118271 - RNA, 17 nt, Streptococcus pyogenes M1 GAS
guaaccauugccauuaa

SEQ ID NO: 4118272 - RNA, 19 nt, Streptococcus pyogenes M1 GAS
guaacgcuuguuuaugaaa

SEQ ID NO: 4118273 - RNA, 15 nt, Streptococcus pyogenes M1 GAS
guaacguaauagaau

SEQ ID NO: 4118274 - RNA, 20 nt, Streptococcus pyogenes M1 GAS
guaacguaauagaauaaaaa

SEQ ID NO: 4118275 - RNA, 16 nt, Streptococcus pyogenes M1 GAS
guaagaaauuacuugg

SEQ ID NO: 4118276 - RNA, 21 nt, Streptococcus pyogenes M1 GAS
guaagcuccaacgaccuccag

SEQ ID NO: 4118277 - RNA, 20 nt, Streptococcus pyogenes M1 GAS
guaaggaaaucaauccugua

SEQ ID NO: 4118278 - RNA, 13 nt, Streptococcus pyogenes M1 GAS
guaaguuuuuuug

SEQ ID NO: 4118279 - RNA, 20 nt, Streptococcus pyogenes M1 GAS
guaauggugaccgguuucuu

SEQ ID NO: 4118280 - RNA, 21 nt, Streptococcus pyogenes M1 GAS
guaauggugaccgguuucuug

SEQ ID NO: 4118281 - RNA, 18 nt, Streptococcus pyogenes M1 GAS
guaaugucuuguucuggu

SEQ ID NO: 4118282 - RNA, 13 nt, Streptococcus pyogenes M1 GAS
guaauucagcauc

SEQ ID NO: 4118283 - RNA, 18 nt, Streptococcus pyogenes M1 GAS
guuugauugauuugucuu

SEQ ID NO: 4118284 - RNA, 22 nt, Streptococcus pyogenes M1 GAS
guuugauugauuugucuucucc

SEQ ID NO: 4118285 - RNA, 15 nt, Streptococcus pyogenes M1 GAS
guuuuagcuucuaaa

SEQ ID NO: 4118286 - RNA, 16 nt, Streptococcus pyogenes M1 GAS
guuuuagcuucuaaau

SEQ ID NO: 4118287 - RNA, 13 nt, Streptococcus pyogenes M1 GAS
guuuuauuuugau

SEQ ID NO: 4118288 - RNA, 20 nt, Streptococcus pyogenes M1 GAS
guuuucucagagacaauaag

SEQ ID NO: 4118289 - RNA, 17 nt, Streptococcus pyogenes M1 GAS
guuuugauuaaaucuuc

SEQ ID NO: 4118290 - RNA, 22 nt, Streptococcus pyogenes M1 GAS
guuuugcacugcuauuucagcu

SEQ ID NO: 4118291 - RNA, 15 nt, Streptococcus pyogenes M1 GAS
guuuuuaaagcgaua

SEQ ID NO: 4118292 - RNA, 22 nt, Streptococcus pyogenes M1 GAS
guuuuuacauuuuuacaauacg

SEQ ID NO: 4118293 - RNA, 15 nt, Streptococcus pyogenes M1 GAS
guuuuuagauaaaaa

SEQ ID NO: 4118294 - RNA, 21 nt, Streptococcus pyogenes M1 GAS
guuuuuggaucgcugugacca

SEQ ID NO: 4118295 - RNA, 16 nt, Streptococcus pyogenes M1 GAS
guuuuuuugucuucuu

SEQ ID NO: 4118296 - RNA, 21 nt, Streptococcus pyogenes M1 GAS
guuuuuuugucuucuucuuug

SEQ ID NO: 4118297 - RNA, 18 nt, Streptococcus pyogenes M1 GAS
uaaaaaaccuuaucaaac

SEQ ID NO: 4118298 - RNA, 21 nt, Streptococcus pyogenes M1 GAS
uaaaaaagaagcaaaauuauu

SEQ ID NO: 4118299 - RNA, 14 nt, Streptococcus pyogenes M1 GAS
uaaaaaauuuaaua

SEQ ID NO: 4118300 - RNA, 12 nt, Streptococcus pyogenes M1 GAS
uaaaaacaaugc

SEQ ID NO: 4118301 - RNA, 19 nt, Streptococcus pyogenes M1 GAS
uaaaaacaaugcucuuaac

SEQ ID NO: 4118302 - RNA, 17 nt, Streptococcus pyogenes M1 GAS
uaaaaacucaaaaaaua

SEQ ID NO: 4118303 - RNA, 18 nt, Streptococcus pyogenes M1 GAS
uaaaaagcaaauugaaaa

SEQ ID NO: 4118304 - RNA, 20 nt, Streptococcus pyogenes M1 GAS
uaaaaauacuagaaaaagca

SEQ ID NO: 4118305 - RNA, 14 nt, Streptococcus pyogenes M1 GAS
uaaaaccauaccua

SEQ ID NO: 4118306 - RNA, 14 nt, Streptococcus pyogenes M1 GAS
uaaaaccauuauaa

SEQ ID NO: 4118307 - RNA, 16 nt, Streptococcus pyogenes M1 GAS
uaaaagaaaaucuaau

SEQ ID NO: 4118308 - RNA, 18 nt, Streptococcus pyogenes M1 GAS
uaaaagagagaaugauag

SEQ ID NO: 4118309 - RNA, 18 nt, Streptococcus pyogenes M1 GAS
uaaaagauauuuuaaaau

SEQ ID NO: 4118310 - RNA, 19 nt, Streptococcus pyogenes M1 GAS
uaaaaguuagccaagcaau

SEQ ID NO: 4118311 - RNA, 13 nt, Streptococcus pyogenes M1 GAS
uaaaauagcaccu

SEQ ID NO: 4118312 - RNA, 21 nt, Streptococcus pyogenes M1 GAS
uaaaauagcaccuacgauaaa

SEQ ID NO: 4118313 - RNA, 21 nt, Streptococcus pyogenes M1 GAS
uaaaauaucuagaacagcugc

SEQ ID NO: 4118314 - RNA, 22 nt, Streptococcus pyogenes M1 GAS
uaaaauaucuagaacagcugcu

SEQ ID NO: 4118315 - RNA, 23 nt, Streptococcus pyogenes M1 GAS
uaaaauaucuagaacagcugcuu

SEQ ID NO: 4118316 - RNA, 16 nt, Streptococcus pyogenes M1 GAS
uaaaauauuuuuccau

SEQ ID NO: 4118317 - RNA, 23 nt, Streptococcus pyogenes M1 GAS
uaaaaucaugggaaaagcuaagu

SEQ ID NO: 4118318 - RNA, 19 nt, Streptococcus pyogenes M1 GAS
uaaaauccucuuuuaauuu

SEQ ID NO: 4118319 - RNA, 16 nt, Streptococcus pyogenes M1 GAS
uaaaaucguuauuaau

SEQ ID NO: 4118320 - RNA, 15 nt, Streptococcus pyogenes M1 GAS
uaaaaugacugacaa

SEQ ID NO: 4118321 - RNA, 16 nt, Streptococcus pyogenes M1 GAS
uaaaaugacugacaaa

SEQ ID NO: 4118322 - RNA, 17 nt, Streptococcus pyogenes M1 GAS
uaaaauuccccacaaaa

SEQ ID NO: 4118323 - RNA, 23 nt, Streptococcus pyogenes M1 GAS
uaaaauuccccacaaaagacaac

SEQ ID NO: 4118324 - RNA, 19 nt, Streptococcus pyogenes M1 GAS
uaaacacuaccuuaaaugu

SEQ ID NO: 4118325 - RNA, 21 nt, Streptococcus pyogenes M1 GAS
uaaacacuaccuuaaauguau

SEQ ID NO: 4118326 - RNA, 23 nt, Streptococcus pyogenes M1 GAS
uaaacacuaccuuaaauguauga

SEQ ID NO: 4118327 - RNA, 16 nt, Streptococcus pyogenes M1 GAS
uaaacauauuauagua

SEQ ID NO: 4118328 - RNA, 20 nt, Streptococcus pyogenes M1 GAS
uaaacauauuauaguaacca

SEQ ID NO: 4118329 - RNA, 23 nt, Streptococcus pyogenes M1 GAS
uaaacauauuauaguaaccauug

SEQ ID NO: 4118330 - RNA, 18 nt, Streptococcus pyogenes M1 GAS
uaaacgugcuuuaaucuc

SEQ ID NO: 4118331 - RNA, 14 nt, Streptococcus pyogenes M1 GAS
uaaacuaauaagau

SEQ ID NO: 4118332 - RNA, 15 nt, Streptococcus pyogenes M1 GAS
uaaacuacaccauuu

SEQ ID NO: 4118333 - RNA, 19 nt, Streptococcus pyogenes M1 GAS
uaaacuguauacaaaaagg

SEQ ID NO: 4118334 - RNA, 14 nt, Streptococcus pyogenes M1 GAS
uaaacuuacaaaaa

SEQ ID NO: 4118335 - RNA, 23 nt, Streptococcus pyogenes M1 GAS
uaaacuuaugauuauccucuuau

SEQ ID NO: 4118336 - RNA, 15 nt, Streptococcus pyogenes M1 GAS
uaaagaccucucaug

SEQ ID NO: 4118337 - RNA, 13 nt, Streptococcus pyogenes M1 GAS
uaaagauuuuaaa

SEQ ID NO: 4118338 - RNA, 13 nt, Streptococcus pyogenes M1 GAS
uaaagcaagggaa

SEQ ID NO: 4118339 - RNA, 14 nt, Streptococcus pyogenes M1 GAS
uaaagcaagggaaa

SEQ ID NO: 4118340 - RNA, 12 nt, Streptococcus pyogenes M1 GAS
uaaagcaaucau

SEQ ID NO: 4118341 - RNA, 16 nt, Streptococcus pyogenes M1 GAS
uaaagcaucagcauaa

SEQ ID NO: 4118342 - RNA, 23 nt, Streptococcus pyogenes M1 GAS
uaaagcguugacaguuaaaaaua

SEQ ID NO: 4118343 - RNA, 21 nt, Streptococcus pyogenes M1 GAS
uaaagcuaucauacaacugac

SEQ ID NO: 4118344 - RNA, 17 nt, Streptococcus pyogenes M1 GAS
uaaaggccuguauuucu

SEQ ID NO: 4118345 - RNA, 19 nt, Streptococcus pyogenes M1 GAS
uaaaggccuguauuucuuu

SEQ ID NO: 4118346 - RNA, 15 nt, Streptococcus pyogenes M1 GAS
uaaagggcuuaaucu

SEQ ID NO: 4118347 - RNA, 16 nt, Streptococcus pyogenes M1 GAS
uaaagggcuuaaucug

SEQ ID NO: 4118348 - RNA, 22 nt, Streptococcus pyogenes M1 GAS
uaaaggucugcuucuuacuaug

SEQ ID NO: 4118349 - RNA, 18 nt, Streptococcus pyogenes M1 GAS
uaaaggugccuguuuuug

SEQ ID NO: 4118350 - RNA, 15 nt, Streptococcus pyogenes M1 GAS
uaaaguaauaaguag

SEQ ID NO: 4118351 - RNA, 23 nt, Streptococcus pyogenes M1 GAS
uaaagucacgaguguuaaaacga

SEQ ID NO: 4118352 - RNA, 15 nt, Streptococcus pyogenes M1 GAS
uaaaguuaggaaaga

SEQ ID NO: 4118353 - RNA, 18 nt, Streptococcus pyogenes M1 GAS
uaaaguuaggaaagauag

SEQ ID NO: 4118354 - RNA, 12 nt, Streptococcus pyogenes M1 GAS
uaaauaguacau

SEQ ID NO: 4118355 - RNA, 14 nt, Streptococcus pyogenes M1 GAS
uaaauauaaauuau

SEQ ID NO: 4118356 - RNA, 21 nt, Streptococcus pyogenes M1 GAS
uaaauauccaaugaaaacucc

SEQ ID NO: 4118357 - RNA, 17 nt, Streptococcus pyogenes M1 GAS
uaaauccuuuugaaaaa

SEQ ID NO: 4118358 - RNA, 14 nt, Streptococcus pyogenes M1 GAS
uaaaugacaugaaa

SEQ ID NO: 4118359 - RNA, 22 nt, Streptococcus pyogenes M1 GAS
uaaauugcgacacagauaagau

SEQ ID NO: 4118360 - RNA, 17 nt, Streptococcus pyogenes M1 GAS
uaaauuugggcaguagu

SEQ ID NO: 4118361 - RNA, 13 nt, Streptococcus pyogenes M1 GAS
uaacaaaaauaag

SEQ ID NO: 4118362 - RNA, 15 nt, Streptococcus pyogenes M1 GAS
uaacaaaaauaagua

SEQ ID NO: 4118363 - RNA, 19 nt, Streptococcus pyogenes M1 GAS
uaacaacaacaacccuuga

SEQ ID NO: 4118364 - RNA, 23 nt, Streptococcus pyogenes M1 GAS
uaacaaugagaucuucuuuuggu

SEQ ID NO: 4118365 - RNA, 21 nt, Streptococcus pyogenes M1 GAS
uaacaauuacaacccacauac

SEQ ID NO: 4118366 - RNA, 15 nt, Streptococcus pyogenes M1 GAS
uaacacgguuuucug

SEQ ID NO: 4118367 - RNA, 17 nt, Streptococcus pyogenes M1 GAS
uaacagaaauuaauaaa

SEQ ID NO: 4118368 - RNA, 20 nt, Streptococcus pyogenes M1 GAS
uaacagaaauuaauaaauuu

SEQ ID NO: 4118369 - RNA, 18 nt, Streptococcus pyogenes M1 GAS
uaaccauagaagccaauu

SEQ ID NO: 4118370 - RNA, 17 nt, Streptococcus pyogenes M1 GAS
uaaccauaucacaaaac

SEQ ID NO: 4118371 - RNA, 15 nt, Streptococcus pyogenes M1 GAS
uaaccauugccauua

SEQ ID NO: 4118372 - RNA, 16 nt, Streptococcus pyogenes M1 GAS
uaacgccagcuacauu

SEQ ID NO: 4118373 - RNA, 14 nt, Streptococcus pyogenes M1 GAS
uaacgcuaugcuug

SEQ ID NO: 4118374 - RNA, 18 nt, Streptococcus pyogenes M1 GAS
uaacgcuuguuuaugaaa

SEQ ID NO: 4118375 - RNA, 16 nt, Streptococcus pyogenes M1 GAS
uaacguuccaaaaaga

SEQ ID NO: 4118376 - RNA, 17 nt, Streptococcus pyogenes M1 GAS
uaacguuccaaaaagaa

SEQ ID NO: 4118377 - RNA, 18 nt, Streptococcus pyogenes M1 GAS
uaacguuccaaaaagaaa

SEQ ID NO: 4118378 - RNA, 16 nt, Streptococcus pyogenes M1 GAS
uaacuaacagcaacau

SEQ ID NO: 4118379 - RNA, 15 nt, Streptococcus pyogenes M1 GAS
uaacuauuucacuua

SEQ ID NO: 4118380 - RNA, 13 nt, Streptococcus pyogenes M1 GAS
uaacugauaaaac

SEQ ID NO: 4118381 - RNA, 16 nt, Streptococcus pyogenes M1 GAS
uaacugauaaaacuca

SEQ ID NO: 4118382 - RNA, 16 nt, Streptococcus pyogenes M1 GAS
uaacugguaaaguauu

SEQ ID NO: 4118383 - RNA, 21 nt, Streptococcus pyogenes M1 GAS
uacuauggcuucuaaaaaagu

SEQ ID NO: 4118384 - RNA, 14 nt, Streptococcus pyogenes M1 GAS
uacucaucuaaaaa

SEQ ID NO: 4118385 - RNA, 17 nt, Streptococcus pyogenes M1 GAS
uacucaucuaaaaaagc

SEQ ID NO: 4118386 - RNA, 18 nt, Streptococcus pyogenes M1 GAS
uacucaucuaaaaaagca

SEQ ID NO: 4118387 - RNA, 16 nt, Streptococcus pyogenes M1 GAS
uacucuauuuuaagua

SEQ ID NO: 4118388 - RNA, 18 nt, Streptococcus pyogenes M1 GAS
uacucuauuuuaaguaaa

SEQ ID NO: 4118389 - RNA, 12 nt, Streptococcus pyogenes M1 GAS
uacugcccuuga

SEQ ID NO: 4118390 - RNA, 18 nt, Streptococcus pyogenes M1 GAS
uacuggucaauggaaauu

SEQ ID NO: 4118391 - RNA, 14 nt, Streptococcus pyogenes M1 GAS
uacuguauaaacuu

SEQ ID NO: 4118392 - RNA, 16 nt, Streptococcus pyogenes M1 GAS
uacuguauaaacuugu

SEQ ID NO: 4118393 - RNA, 14 nt, Streptococcus pyogenes M1 GAS
uacuucaaggaagg

SEQ ID NO: 4118394 - RNA, 21 nt, Streptococcus pyogenes M1 GAS
uacuucugcagucuuuuucau

SEQ ID NO: 4118395 - RNA, 16 nt, Streptococcus pyogenes M1 GAS
uacuuugguauucuuu

SEQ ID NO: 4118396 - RNA, 19 nt, Streptococcus pyogenes M1 GAS
uacuuugguauucuuuuuc

SEQ ID NO: 4118397 - RNA, 12 nt, Streptococcus pyogenes M1 GAS
uagaaaaagcaa

SEQ ID NO: 4118398 - RNA, 13 nt, Streptococcus pyogenes M1 GAS
uagaauaaaaaga

SEQ ID NO: 4118399 - RNA, 19 nt, Streptococcus pyogenes M1 GAS
uagaauccuccucuuuuuu

SEQ ID NO: 4118400 - RNA, 18 nt, Streptococcus pyogenes M1 GAS
uagaauuucaaguucucu

SEQ ID NO: 4118401 - RNA, 19 nt, Streptococcus pyogenes M1 GAS
uagacaaacagaaauacuc

SEQ ID NO: 4118402 - RNA, 19 nt, Streptococcus pyogenes M1 GAS
uagacugguucaucuugcc

SEQ ID NO: 4118403 - RNA, 16 nt, Streptococcus pyogenes M1 GAS
uagagaaucaaaggga

SEQ ID NO: 4118404 - RNA, 15 nt, Streptococcus pyogenes M1 GAS
uagagucucuagucu

SEQ ID NO: 4118405 - RNA, 12 nt, Streptococcus pyogenes M1 GAS
uagauaaaaaug

SEQ ID NO: 4118406 - RNA, 16 nt, Streptococcus pyogenes M1 GAS
uagauaaaaauggcug

SEQ ID NO: 4118407 - RNA, 19 nt, Streptococcus pyogenes M1 GAS
uagauaaaaauggcuguuu

SEQ ID NO: 4118408 - RNA, 15 nt, Streptococcus pyogenes M1 GAS
uagauguuguucuaa

SEQ ID NO: 4118409 - RNA, 18 nt, Streptococcus pyogenes M1 GAS
uagauugcuuccaacucc

SEQ ID NO: 4118410 - RNA, 19 nt, Streptococcus pyogenes M1 GAS
uagcaaaaugcuguuuguc

SEQ ID NO: 4118411 - RNA, 18 nt, Streptococcus pyogenes M1 GAS
uagcaaaggcuucaucaa

SEQ ID NO: 4118412 - RNA, 20 nt, Streptococcus pyogenes M1 GAS
uagcaaagugauauacugaa

SEQ ID NO: 4118413 - RNA, 21 nt, Streptococcus pyogenes M1 GAS
uagcaaguccugcuuuugaug

SEQ ID NO: 4118414 - RNA, 16 nt, Streptococcus pyogenes M1 GAS
uagcaauggcuaaaaa

SEQ ID NO: 4118415 - RNA, 19 nt, Streptococcus pyogenes M1 GAS
uagcaauggcuaaaaagag

SEQ ID NO: 4118416 - RNA, 19 nt, Streptococcus pyogenes M1 GAS
uagcaccuuuuuuauugau

SEQ ID NO: 4118417 - RNA, 16 nt, Streptococcus pyogenes M1 GAS
uagcagcagaagcaaa

SEQ ID NO: 4118418 - RNA, 16 nt, Streptococcus pyogenes M1 GAS
uagcauaaaagauauu

SEQ ID NO: 4118419 - RNA, 12 nt, Streptococcus pyogenes M1 GAS
uagcauaaaaua

SEQ ID NO: 4118420 - RNA, 14 nt, Streptococcus pyogenes M1 GAS
uagcauauuuugau

SEQ ID NO: 4118421 - RNA, 23 nt, Streptococcus pyogenes M1 GAS
uagcauuaaggauuaugaaaaag

SEQ ID NO: 4118422 - RNA, 22 nt, Streptococcus pyogenes M1 GAS
uagccaaagaaggccagcaagg

SEQ ID NO: 4118423 - RNA, 18 nt, Streptococcus pyogenes M1 GAS
uagccaagcaaucuaaga

SEQ ID NO: 4118424 - RNA, 21 nt, Streptococcus pyogenes M1 GAS
uagccagauggugcuacugau

SEQ ID NO: 4118425 - RNA, 17 nt, Streptococcus pyogenes M1 GAS
uagcguaaagcaaggga

SEQ ID NO: 4118426 - RNA, 16 nt, Streptococcus pyogenes M1 GAS
uagcuaauccaauaau

SEQ ID NO: 4118427 - RNA, 21 nt, Streptococcus pyogenes M1 GAS
uagcucaucccuacuaggcuu

SEQ ID NO: 4118428 - RNA, 20 nt, Streptococcus pyogenes M1 GAS
uagcugcugcuaaagcaauc

SEQ ID NO: 4118429 - RNA, 15 nt, Streptococcus pyogenes M1 GAS
uagcugguugaccaa

SEQ ID NO: 4118430 - RNA, 18 nt, Streptococcus pyogenes M1 GAS
uagcugguuugauuaccu

SEQ ID NO: 4118431 - RNA, 15 nt, Streptococcus pyogenes M1 GAS
uagcuuuuuaaagag

SEQ ID NO: 4118432 - RNA, 19 nt, Streptococcus pyogenes M1 GAS
uagcuuuuuacaucaaaaa

SEQ ID NO: 4118433 - RNA, 20 nt, Streptococcus pyogenes M1 GAS
uagcuuuuuacaucaaaaaa

SEQ ID NO: 4118434 - RNA, 23 nt, Streptococcus pyogenes M1 GAS
uagcuuuuuacaucaaaaaaagc

SEQ ID NO: 4118435 - RNA, 16 nt, Streptococcus pyogenes M1 GAS
uagcuuuuuuuaaagc

SEQ ID NO: 4118436 - RNA, 19 nt, Streptococcus pyogenes M1 GAS
uaggaaagauaguaaagaa

SEQ ID NO: 4118437 - RNA, 22 nt, Streptococcus pyogenes M1 GAS
uaggaaagauaguaaagaagaa

SEQ ID NO: 4118438 - RNA, 13 nt, Streptococcus pyogenes M1 GAS
uaggaauaaaaug

SEQ ID NO: 4118439 - RNA, 17 nt, Streptococcus pyogenes M1 GAS
uaggaaucgcuuuagga

SEQ ID NO: 4118440 - RNA, 21 nt, Streptococcus pyogenes M1 GAS
uaggauauagaauagguaaag

SEQ ID NO: 4118441 - RNA, 16 nt, Streptococcus pyogenes M1 GAS
uaggcagacaauuauu

SEQ ID NO: 4118442 - RNA, 17 nt, Streptococcus pyogenes M1 GAS
uaggccaauccuaacaa

SEQ ID NO: 4118443 - RNA, 20 nt, Streptococcus pyogenes M1 GAS
uaggcuuuuuuuguaucuca

SEQ ID NO: 4118444 - RNA, 17 nt, Streptococcus pyogenes M1 GAS
uagggauuuuuuaacua

SEQ ID NO: 4118445 - RNA, 17 nt, Streptococcus pyogenes M1 GAS
uaggguagcugguuuga

SEQ ID NO: 4118446 - RNA, 23 nt, Streptococcus pyogenes M1 GAS
uagguacucguaagcauuuugag

SEQ ID NO: 4118447 - RNA, 22 nt, Streptococcus pyogenes M1 GAS
uaggucuaauuagcauauuuug

SEQ ID NO: 4118448 - RNA, 18 nt, Streptococcus pyogenes M1 GAS
uaggugauguagggcugu

SEQ ID NO: 4118449 - RNA, 15 nt, Streptococcus pyogenes M1 GAS
uagguuaaaauagaa

SEQ ID NO: 4118450 - RNA, 14 nt, Streptococcus pyogenes M1 GAS
uagguucuuugguu

SEQ ID NO: 4118451 - RNA, 15 nt, Streptococcus pyogenes M1 GAS
uaguaaccauugcca

SEQ ID NO: 4118452 - RNA, 14 nt, Streptococcus pyogenes M1 GAS
uaguauuagcacca

SEQ ID NO: 4118453 - RNA, 20 nt, Streptococcus pyogenes M1 GAS
uagucuaggcguauagguga

SEQ ID NO: 4118454 - RNA, 16 nt, Streptococcus pyogenes M1 GAS
uagugaauucuaaaau

SEQ ID NO: 4118455 - RNA, 14 nt, Streptococcus pyogenes M1 GAS
uagugguauagaca

SEQ ID NO: 4118456 - RNA, 18 nt, Streptococcus pyogenes M1 GAS
uagugguauagacaaaca

SEQ ID NO: 4118457 - RNA, 17 nt, Streptococcus pyogenes M1 GAS
uagugugugugauguaa

SEQ ID NO: 4118458 - RNA, 21 nt, Streptococcus pyogenes M1 GAS
uaguguuuuuagauaaaaaug

SEQ ID NO: 4118459 - RNA, 21 nt, Streptococcus pyogenes M1 GAS
uaguuaagcuugcuaagagaa

SEQ ID NO: 4118460 - RNA, 15 nt, Streptococcus pyogenes M1 GAS
uaguugcuucuuuua

SEQ ID NO: 4118461 - RNA, 16 nt, Streptococcus pyogenes M1 GAS
uaguugugauauaaaa

SEQ ID NO: 4118462 - RNA, 17 nt, Streptococcus pyogenes M1 GAS
uaguugugucuuuucuu

SEQ ID NO: 4118463 - RNA, 21 nt, Streptococcus pyogenes M1 GAS
uaguuuaacguaauaaaauaa

SEQ ID NO: 4118464 - RNA, 22 nt, Streptococcus pyogenes M1 GAS
uaguuuaggaaucacaacuucu

SEQ ID NO: 4118465 - RNA, 13 nt, Streptococcus pyogenes M1 GAS
uaguuuaucacuc

SEQ ID NO: 4118466 - RNA, 14 nt, Streptococcus pyogenes M1 GAS
uaguuuauuacaaa

SEQ ID NO: 4118467 - RNA, 15 nt, Streptococcus pyogenes M1 GAS
uaguuuauuacaaaa

SEQ ID NO: 4118468 - RNA, 21 nt, Streptococcus pyogenes M1 GAS
uaguuuauuacaaaacugucu

SEQ ID NO: 4118469 - RNA, 17 nt, Streptococcus pyogenes M1 GAS
uaguuuugcacugcuau

SEQ ID NO: 4118470 - RNA, 17 nt, Streptococcus pyogenes M1 GAS
uaguuuuuagcagcaga

SEQ ID NO: 4118471 - RNA, 13 nt, Streptococcus pyogenes M1 GAS
uauaaacaaagcc

SEQ ID NO: 4118472 - RNA, 17 nt, Streptococcus pyogenes M1 GAS
uauaaacaaagccagug

SEQ ID NO: 4118473 - RNA, 19 nt, Streptococcus pyogenes M1 GAS
uauaaaucuuacuaacuag

SEQ ID NO: 4118474 - RNA, 15 nt, Streptococcus pyogenes M1 GAS
uauaacuguucauuu

SEQ ID NO: 4118475 - RNA, 15 nt, Streptococcus pyogenes M1 GAS
uauaacuguuuuucu

SEQ ID NO: 4118476 - RNA, 17 nt, Streptococcus pyogenes M1 GAS
uauaacuguuuuucuua

SEQ ID NO: 4118477 - RNA, 13 nt, Streptococcus pyogenes M1 GAS
uauaaugguuuuu

SEQ ID NO: 4118478 - RNA, 18 nt, Streptococcus pyogenes M1 GAS
uauaaugguuuuuugucu

SEQ ID NO: 4118479 - RNA, 14 nt, Streptococcus pyogenes M1 GAS
uauaauuucaauaa

SEQ ID NO: 4118480 - RNA, 15 nt, Streptococcus pyogenes M1 GAS
uauaccuaaaaaaua

SEQ ID NO: 4118481 - RNA, 13 nt, Streptococcus pyogenes M1 GAS
uauagcauaaaau

SEQ ID NO: 4118482 - RNA, 23 nt, Streptococcus pyogenes M1 GAS
uauagcuccuaaaaccauaccua

SEQ ID NO: 4118483 - RNA, 23 nt, Streptococcus pyogenes M1 GAS
ucacgauaagaagcuaaugucuu

SEQ ID NO: 4118484 - RNA, 19 nt, Streptococcus pyogenes M1 GAS
ucacgaucaagaaacucau

SEQ ID NO: 4118485 - RNA, 12 nt, Streptococcus pyogenes M1 GAS
ucacuauaauuu

SEQ ID NO: 4118486 - RNA, 23 nt, Streptococcus pyogenes M1 GAS
ucacuauaauuucaauaauacca

SEQ ID NO: 4118487 - RNA, 14 nt, Streptococcus pyogenes M1 GAS
ucagaauaaagaaa

SEQ ID NO: 4118488 - RNA, 13 nt, Streptococcus pyogenes M1 GAS
ucagaauaagaaa

SEQ ID NO: 4118489 - RNA, 14 nt, Streptococcus pyogenes M1 GAS
ucagaauaagaaaa

SEQ ID NO: 4118490 - RNA, 16 nt, Streptococcus pyogenes M1 GAS
ucagaauaagaaaacc

SEQ ID NO: 4118491 - RNA, 19 nt, Streptococcus pyogenes M1 GAS
ucagaauaagaaaaccuua

SEQ ID NO: 4118492 - RNA, 15 nt, Streptococcus pyogenes M1 GAS
ucagagacaauaagg

SEQ ID NO: 4118493 - RNA, 13 nt, Streptococcus pyogenes M1 GAS
ucagagaugcuuc

SEQ ID NO: 4118494 - RNA, 20 nt, Streptococcus pyogenes M1 GAS
ucagagcuuuuuuuguuuug

SEQ ID NO: 4118495 - RNA, 21 nt, Streptococcus pyogenes M1 GAS
ucagauaagaccuucaaaaaa

SEQ ID NO: 4118496 - RNA, 21 nt, Streptococcus pyogenes M1 GAS
ucagauauucuuuggcaagau

SEQ ID NO: 4118497 - RNA, 20 nt, Streptococcus pyogenes M1 GAS
ucagcauaaccuuugccauu

SEQ ID NO: 4118498 - RNA, 19 nt, Streptococcus pyogenes M1 GAS
ucagcaucguuaaguggaa

SEQ ID NO: 4118499 - RNA, 16 nt, Streptococcus pyogenes M1 GAS
ucagcuagacuauaaa

SEQ ID NO: 4118500 - RNA, 17 nt, Streptococcus pyogenes M1 GAS
ucagcuagacuauaaaa

SEQ ID NO: 4118501 - RNA, 15 nt, Streptococcus pyogenes M1 GAS
ucaggggguaaaaaa

SEQ ID NO: 4118502 - RNA, 13 nt, Streptococcus pyogenes M1 GAS
ucaguaaucuaaa

SEQ ID NO: 4118503 - RNA, 23 nt, Streptococcus pyogenes M1 GAS
ucaguaaucuaaagcaucagcau

SEQ ID NO: 4118504 - RNA, 16 nt, Streptococcus pyogenes M1 GAS
ucaguagugaugagua

SEQ ID NO: 4118505 - RNA, 23 nt, Streptococcus pyogenes M1 GAS
ucaguccuccucuuuagaauucu

SEQ ID NO: 4118506 - RNA, 18 nt, Streptococcus pyogenes M1 GAS
ucagucuguccaauaccu

SEQ ID NO: 4118507 - RNA, 20 nt, Streptococcus pyogenes M1 GAS
ucaguucugagauauucauu

SEQ ID NO: 4118508 - RNA, 23 nt, Streptococcus pyogenes M1 GAS
ucaguucugagauauucauuuuc

SEQ ID NO: 4118509 - RNA, 15 nt, Streptococcus pyogenes M1 GAS
ucaguuuuuuugauu

SEQ ID NO: 4118510 - RNA, 16 nt, Streptococcus pyogenes M1 GAS
ucauaaacaaugaguc

SEQ ID NO: 4118511 - RNA, 15 nt, Streptococcus pyogenes M1 GAS
ucauaacuugucaag

SEQ ID NO: 4118512 - RNA, 17 nt, Streptococcus pyogenes M1 GAS
ucauacacaaaaaaccg

SEQ ID NO: 4118513 - RNA, 21 nt, Streptococcus pyogenes M1 GAS
ucauacucaauagcugcugcu

SEQ ID NO: 4118514 - RNA, 12 nt, Streptococcus pyogenes M1 GAS
ucauauuccaua

SEQ ID NO: 4118515 - RNA, 15 nt, Streptococcus pyogenes M1 GAS
ucaucaaaagaccau

SEQ ID NO: 4118516 - RNA, 12 nt, Streptococcus pyogenes M1 GAS
ucaucuaaaaaa

SEQ ID NO: 4118517 - RNA, 15 nt, Streptococcus pyogenes M1 GAS
ucaucuugccaucag

SEQ ID NO: 4118518 - RNA, 19 nt, Streptococcus pyogenes M1 GAS
ucaugaugguuucacgaua

SEQ ID NO: 4118519 - RNA, 21 nt, Streptococcus pyogenes M1 GAS
ucaugauguuauuaaauaaua

SEQ ID NO: 4118520 - RNA, 21 nt, Streptococcus pyogenes M1 GAS
ucauggagucaaugaaaaguu

SEQ ID NO: 4118521 - RNA, 15 nt, Streptococcus pyogenes M1 GAS
ucauggauauuacaa

SEQ ID NO: 4118522 - RNA, 18 nt, Streptococcus pyogenes M1 GAS
ucauuaaagcuaucauac

SEQ ID NO: 4118523 - RNA, 23 nt, Streptococcus pyogenes M1 GAS
ucauucuaacauggauaccauuu

SEQ ID NO: 4118524 - RNA, 18 nt, Streptococcus pyogenes M1 GAS
ucauugcuuuuuaugauu

SEQ ID NO: 4118525 - RNA, 14 nt, Streptococcus pyogenes M1 GAS
ucauuuucuucuug

SEQ ID NO: 4118526 - RNA, 22 nt, Streptococcus pyogenes M1 GAS
ucauuuucuuugugacaugagu

SEQ ID NO: 4118527 - RNA, 11 nt, Streptococcus pyogenes M1 GAS
ucauuuugguu

SEQ ID NO: 4118528 - RNA, 18 nt, Streptococcus pyogenes M1 GAS
ucauuuuuauuuaagcaa

SEQ ID NO: 4118529 - RNA, 12 nt, Streptococcus pyogenes M1 GAS
uccaaaaagaaa

SEQ ID NO: 4118530 - RNA, 21 nt, Streptococcus pyogenes M1 GAS
uccaaaaagaaaggaauugaa

SEQ ID NO: 4118531 - RNA, 17 nt, Streptococcus pyogenes M1 GAS
uccaaacauccaaucac

SEQ ID NO: 4118532 - RNA, 18 nt, Streptococcus pyogenes M1 GAS
uccaaacauccaaucacc

SEQ ID NO: 4118533 - RNA, 12 nt, Streptococcus pyogenes M1 GAS
uccaacaacgcu

SEQ ID NO: 4118534 - RNA, 16 nt, Streptococcus pyogenes M1 GAS
uccaacuuuuaucacu

SEQ ID NO: 4118535 - RNA, 19 nt, Streptococcus pyogenes M1 GAS
uccaagaucugcacacacu

SEQ ID NO: 4118536 - RNA, 18 nt, Streptococcus pyogenes M1 GAS
uccaaucuuucauuagcu

SEQ ID NO: 4118537 - RNA, 13 nt, Streptococcus pyogenes M1 GAS
uccaaugacuaag

SEQ ID NO: 4118538 - RNA, 18 nt, Streptococcus pyogenes M1 GAS
uccaccggucgauggguc

SEQ ID NO: 4118539 - RNA, 15 nt, Streptococcus pyogenes M1 GAS
uccauaauaucagcu

SEQ ID NO: 4118540 - RNA, 13 nt, Streptococcus pyogenes M1 GAS
uccaugauugauu

SEQ ID NO: 4118541 - RNA, 12 nt, Streptococcus pyogenes M1 GAS
uccaugauuuuc

SEQ ID NO: 4118542 - RNA, 13 nt, Streptococcus pyogenes M1 GAS
uccauuauaaauc

SEQ ID NO: 4118543 - RNA, 15 nt, Streptococcus pyogenes M1 GAS
uccauuauaaaucuu

SEQ ID NO: 4118544 - RNA, 18 nt, Streptococcus pyogenes M1 GAS
uccauuauaaaucuuacu

SEQ ID NO: 4118545 - RNA, 20 nt, Streptococcus pyogenes M1 GAS
ucccaucuuuaucagucugu

SEQ ID NO: 4118546 - RNA, 19 nt, Streptococcus pyogenes M1 GAS
ucccauguuuuauuaccag

SEQ ID NO: 4118547 - RNA, 18 nt, Streptococcus pyogenes M1 GAS
uccccuccuugcaauaga

SEQ ID NO: 4118548 - RNA, 16 nt, Streptococcus pyogenes M1 GAS
ucccuucauuuuacua

SEQ ID NO: 4118549 - RNA, 16 nt, Streptococcus pyogenes M1 GAS
uccgaaaaaaacuugc

SEQ ID NO: 4118550 - RNA, 20 nt, Streptococcus pyogenes M1 GAS
uccgaucuuuuggaccacuc

SEQ ID NO: 4118551 - RNA, 21 nt, Streptococcus pyogenes M1 GAS
uccggcaggggucauuauugu

SEQ ID NO: 4118552 - RNA, 12 nt, Streptococcus pyogenes M1 GAS
uccguuugagau

SEQ ID NO: 4118553 - RNA, 22 nt, Streptococcus pyogenes M1 GAS
uccuaacaaaaucacaccauua

SEQ ID NO: 4118554 - RNA, 17 nt, Streptococcus pyogenes M1 GAS
uccuaacaauuuuucaa

SEQ ID NO: 4118555 - RNA, 17 nt, Streptococcus pyogenes M1 GAS
uccuagacugugaaagu

SEQ ID NO: 4118556 - RNA, 18 nt, Streptococcus pyogenes M1 GAS
uccuagacugugaaagua

SEQ ID NO: 4118557 - RNA, 15 nt, Streptococcus pyogenes M1 GAS
uccuccuaaauauaa

SEQ ID NO: 4118558 - RNA, 19 nt, Streptococcus pyogenes M1 GAS
uccuccucuuuuuuuuauc

SEQ ID NO: 4118559 - RNA, 16 nt, Streptococcus pyogenes M1 GAS
uccucgguuuuuuuaa

SEQ ID NO: 4118560 - RNA, 19 nt, Streptococcus pyogenes M1 GAS
uccucgguuuuuuuaagua

SEQ ID NO: 4118561 - RNA, 14 nt, Streptococcus pyogenes M1 GAS
uccucugaaaaguu

SEQ ID NO: 4118562 - RNA, 23 nt, Streptococcus pyogenes M1 GAS
uccucuuauagcacguuggaaaa

SEQ ID NO: 4118563 - RNA, 13 nt, Streptococcus pyogenes M1 GAS
uccucuuuuaauu

SEQ ID NO: 4118564 - RNA, 23 nt, Streptococcus pyogenes M1 GAS
uccucuuuuaauuuggaggugaa

SEQ ID NO: 4118565 - RNA, 22 nt, Streptococcus pyogenes M1 GAS
uccuuagcaguuauaauuagua

SEQ ID NO: 4118566 - RNA, 16 nt, Streptococcus pyogenes M1 GAS
uccuuggccuucuagu

SEQ ID NO: 4118567 - RNA, 12 nt, Streptococcus pyogenes M1 GAS
uccuuuugcuuc

SEQ ID NO: 4118568 - RNA, 13 nt, Streptococcus pyogenes M1 GAS
uccuuuugcuucu

SEQ ID NO: 4118569 - RNA, 17 nt, Streptococcus pyogenes M1 GAS
uccuuuuuuugugaggc

SEQ ID NO: 4118570 - RNA, 21 nt, Streptococcus pyogenes M1 GAS
ucgacauuuaugcugauuuug

SEQ ID NO: 4118571 - RNA, 18 nt, Streptococcus pyogenes M1 GAS
ucgagcuuucuacuaaaa

SEQ ID NO: 4118572 - RNA, 21 nt, Streptococcus pyogenes M1 GAS
ucgauaaaaacgaucaaaaau

SEQ ID NO: 4118573 - RNA, 15 nt, Streptococcus pyogenes M1 GAS
ucgccaauaaaaaag

SEQ ID NO: 4118574 - RNA, 20 nt, Streptococcus pyogenes M1 GAS
ucgcguuuaggcucauauua

SEQ ID NO: 4118575 - RNA, 19 nt, Streptococcus pyogenes M1 GAS
ucgcuaagggaaaaauuac

SEQ ID NO: 4118576 - RNA, 15 nt, Streptococcus pyogenes M1 GAS
ucgcucagaauaaag

SEQ ID NO: 4118577 - RNA, 17 nt, Streptococcus pyogenes M1 GAS
ucggaaauugaccaaaa

SEQ ID NO: 4118578 - RNA, 21 nt, Streptococcus pyogenes M1 GAS
ucggaacagcugaaacaccug

SEQ ID NO: 4118579 - RNA, 15 nt, Streptococcus pyogenes M1 GAS
ucggacuguuuuuua

SEQ ID NO: 4118580 - RNA, 21 nt, Streptococcus pyogenes M1 GAS
ucggcaauacagugaauaaug

SEQ ID NO: 4118581 - RNA, 19 nt, Streptococcus pyogenes M1 GAS
ucgguuuuagcuucuaaau

SEQ ID NO: 4118582 - RNA, 15 nt, Streptococcus pyogenes M1 GAS
ucguauacuuuaaac

SEQ ID NO: 4118583 - RNA, 14 nt, Streptococcus pyogenes M1 GAS
ucgucgugacaaug

SEQ ID NO: 4118584 - RNA, 18 nt, Streptococcus pyogenes M1 GAS
ucgugaauaaucuucaga

SEQ ID NO: 4118585 - RNA, 13 nt, Streptococcus pyogenes M1 GAS
ucguguuaagacc

SEQ ID NO: 4118586 - RNA, 14 nt, Streptococcus pyogenes M1 GAS
ucguucauaaauuc

SEQ ID NO: 4118587 - RNA, 16 nt, Streptococcus pyogenes M1 GAS
ucguucauaaauucua

SEQ ID NO: 4118588 - RNA, 22 nt, Streptococcus pyogenes M1 GAS
ucguucauaaauucuaacucuu

SEQ ID NO: 4118589 - RNA, 19 nt, Streptococcus pyogenes M1 GAS
ucguuuuuugcuuuugaua

SEQ ID NO: 4118590 - RNA, 20 nt, Streptococcus pyogenes M1 GAS
ucuaaaaaagcaauguauga

SEQ ID NO: 4118591 - RNA, 23 nt, Streptococcus pyogenes M1 GAS
ucuaaaaagccuuaaugagaaac

SEQ ID NO: 4118592 - RNA, 15 nt, Streptococcus pyogenes M1 GAS
ucuaaaagcacuugu

SEQ ID NO: 4118593 - RNA, 11 nt, Streptococcus pyogenes M1 GAS
ucuaaaauaua

SEQ ID NO: 4118594 - RNA, 14 nt, Streptococcus pyogenes M1 GAS
ucuaaaauauauug

SEQ ID NO: 4118595 - RNA, 13 nt, Streptococcus pyogenes M1 GAS
ucuaaacuuauga

SEQ ID NO: 4118596 - RNA, 17 nt, Streptococcus pyogenes M1 GAS
ucuaacucuuguagaau

SEQ ID NO: 4118597 - RNA, 22 nt, Streptococcus pyogenes M1 GAS
ucuaaucagaacucgucuuuau

SEQ ID NO: 4118598 - RNA, 19 nt, Streptococcus pyogenes M1 GAS
ucuaauuagcauauuuuga

SEQ ID NO: 4118599 - RNA, 14 nt, Streptococcus pyogenes M1 GAS
ucuaauuugugaaa

SEQ ID NO: 4118600 - RNA, 22 nt, Streptococcus pyogenes M1 GAS
ucuacuaaaaaaggagcuagau

SEQ ID NO: 4118601 - RNA, 24 nt, Streptococcus pyogenes M1 GAS
ucuagaacagauugaagacaaaca

SEQ ID NO: 4118602 - RNA, 20 nt, Streptococcus pyogenes M1 GAS
ucuagacucuagcauaaaag

SEQ ID NO: 4118603 - RNA, 17 nt, Streptococcus pyogenes M1 GAS
ucuagcucuuuaucacc

SEQ ID NO: 4118604 - RNA, 23 nt, Streptococcus pyogenes M1 GAS
ucuaggagggacugucaaaaaau

SEQ ID NO: 4118605 - RNA, 16 nt, Streptococcus pyogenes M1 GAS
ucuagguuaaaauaga

SEQ ID NO: 4118606 - RNA, 12 nt, Streptococcus pyogenes M1 GAS
ucuaucaaaacg

SEQ ID NO: 4118607 - RNA, 12 nt, Streptococcus pyogenes M1 GAS
ucuaucugcaga

SEQ ID NO: 4118608 - RNA, 22 nt, Streptococcus pyogenes M1 GAS
ucuauuugaaguaaaggauuua

SEQ ID NO: 4118609 - RNA, 13 nt, Streptococcus pyogenes M1 GAS
ucuauuuuaagua

SEQ ID NO: 4118610 - RNA, 15 nt, Streptococcus pyogenes M1 GAS
ucuauuuuaaguaaa

SEQ ID NO: 4118611 - RNA, 12 nt, Streptococcus pyogenes M1 GAS
ucucaaaaauau

SEQ ID NO: 4118612 - RNA, 14 nt, Streptococcus pyogenes M1 GAS
ucucauaacaaauu

SEQ ID NO: 4118613 - RNA, 16 nt, Streptococcus pyogenes M1 GAS
ucucauaacaaauuua

SEQ ID NO: 4118614 - RNA, 22 nt, Streptococcus pyogenes M1 GAS
ucucuacuugucaugaugguuu

SEQ ID NO: 4118615 - RNA, 17 nt, Streptococcus pyogenes M1 GAS
ucucuuugggaaaaaca

SEQ ID NO: 4118616 - RNA, 14 nt, Streptococcus pyogenes M1 GAS
ucugaaaauaaaau

SEQ ID NO: 4118617 - RNA, 19 nt, Streptococcus pyogenes M1 GAS
ucugaaaauaaaauauuuu

SEQ ID NO: 4118618 - RNA, 23 nt, Streptococcus pyogenes M1 GAS
ucugaaaauaaaauauuuuucca

SEQ ID NO: 4118619 - RNA, 13 nt, Streptococcus pyogenes M1 GAS
ucugagauauuca

SEQ ID NO: 4118620 - RNA, 15 nt, Streptococcus pyogenes M1 GAS
ucugagcgguuuugu

SEQ ID NO: 4118621 - RNA, 13 nt, Streptococcus pyogenes M1 GAS
ucugauauuucau

SEQ ID NO: 4118622 - RNA, 15 nt, Streptococcus pyogenes M1 GAS
ucugcaaguucuuug

SEQ ID NO: 4118623 - RNA, 19 nt, Streptococcus pyogenes M1 GAS
ucugcaaguucuuugccuu

SEQ ID NO: 4118624 - RNA, 18 nt, Streptococcus pyogenes M1 GAS
ucugcagauuuuaagaca

SEQ ID NO: 4118625 - RNA, 17 nt, Streptococcus pyogenes M1 GAS
ucugcagucuuuuucau

SEQ ID NO: 4118626 - RNA, 18 nt, Streptococcus pyogenes M1 GAS
ucugcagucuuuuucauu

SEQ ID NO: 4118627 - RNA, 16 nt, Streptococcus pyogenes M1 GAS
ucugcauuaucaucug

SEQ ID NO: 4118628 - RNA, 15 nt, Streptococcus pyogenes M1 GAS
ucugcuagacggcua

SEQ ID NO: 4118629 - RNA, 20 nt, Streptococcus pyogenes M1 GAS
ucuggaaacuggucaaaagc

SEQ ID NO: 4118630 - RNA, 23 nt, Streptococcus pyogenes M1 GAS
ucuggaaggcacagaaaaaagau

SEQ ID NO: 4118631 - RNA, 21 nt, Streptococcus pyogenes M1 GAS
ucugugaugaaucauuuugga

SEQ ID NO: 4118632 - RNA, 13 nt, Streptococcus pyogenes M1 GAS
ucuguuccuaugc

SEQ ID NO: 4118633 - RNA, 21 nt, Streptococcus pyogenes M1 GAS
ucuuaaaagaaaaucuaauca

SEQ ID NO: 4118634 - RNA, 18 nt, Streptococcus pyogenes M1 GAS
ucuuaaauaugacuaaac

SEQ ID NO: 4118635 - RNA, 14 nt, Streptococcus pyogenes M1 GAS
ucuuacaauuaaua

SEQ ID NO: 4118636 - RNA, 14 nt, Streptococcus pyogenes M1 GAS
ucuuacuaugaaaa

SEQ ID NO: 4118637 - RNA, 15 nt, Streptococcus pyogenes M1 GAS
ucuuacuaugaaaaa

SEQ ID NO: 4118638 - RNA, 14 nt, Streptococcus pyogenes M1 GAS
ucuuauagcacguu

SEQ ID NO: 4118639 - RNA, 17 nt, Streptococcus pyogenes M1 GAS
ucuuccaaucuuucauu

SEQ ID NO: 4118640 - RNA, 21 nt, Streptococcus pyogenes M1 GAS
ucuuccuuguacaagagcuua

SEQ ID NO: 4118641 - RNA, 22 nt, Streptococcus pyogenes M1 GAS
ucuucuaaaaugaugagauuaa

SEQ ID NO: 4118642 - RNA, 15 nt, Streptococcus pyogenes M1 GAS
ucuucugcauuauca

SEQ ID NO: 4118643 - RNA, 20 nt, Streptococcus pyogenes M1 GAS
ucuucuuguccgaucuuuug

SEQ ID NO: 4118644 - RNA, 19 nt, Streptococcus pyogenes M1 GAS
ucuucuuuuuauuauacuc

SEQ ID NO: 4118645 - RNA, 22 nt, Streptococcus pyogenes M1 GAS
ucuugaggugauucuuuuuuac

SEQ ID NO: 4118646 - RNA, 13 nt, Streptococcus pyogenes M1 GAS
ucuugcuaaaauu

SEQ ID NO: 4118647 - RNA, 19 nt, Streptococcus pyogenes M1 GAS
ucuugcucuuguuuucuca

SEQ ID NO: 4118648 - RNA, 23 nt, Streptococcus pyogenes M1 GAS
ucuuggauagacugguucaucuu

SEQ ID NO: 4118649 - RNA, 23 nt, Streptococcus pyogenes M1 GAS
ucuuguuuaacccccuaaacuaa

SEQ ID NO: 4118650 - RNA, 13 nt, Streptococcus pyogenes M1 GAS
ucuuguuuugguu

SEQ ID NO: 4118651 - RNA, 20 nt, Streptococcus pyogenes M1 GAS
ucuuguuuugguugauauaa

SEQ ID NO: 4118652 - RNA, 23 nt, Streptococcus pyogenes M1 GAS
ucuuguuuugguugauauaaaau

SEQ ID NO: 4118653 - RNA, 14 nt, Streptococcus pyogenes M1 GAS
ucuuuaccauuuau

SEQ ID NO: 4118654 - RNA, 22 nt, Streptococcus pyogenes M1 GAS
ucuuuauaaugguuuuuugucu

SEQ ID NO: 4118655 - RNA, 16 nt, Streptococcus pyogenes M1 GAS
ucuuuauccauucuuu

SEQ ID NO: 4118656 - RNA, 21 nt, Streptococcus pyogenes M1 GAS
ucuuuauuuugauauuuuuuc

SEQ ID NO: 4118657 - RNA, 23 nt, Streptococcus pyogenes M1 GAS
ucuuuauuuugauauuuuuucuc

SEQ ID NO: 4118658 - RNA, 19 nt, Streptococcus pyogenes M1 GAS
ucuuucaguuguuuuaacu

SEQ ID NO: 4118659 - RNA, 14 nt, Streptococcus pyogenes M1 GAS
ucuuucauguuuac

SEQ ID NO: 4118660 - RNA, 17 nt, Streptococcus pyogenes M1 GAS
ucuuucuuuugccuguc

SEQ ID NO: 4118661 - RNA, 19 nt, Streptococcus pyogenes M1 GAS
ucuuugcagagaugcuucu

SEQ ID NO: 4118662 - RNA, 20 nt, Streptococcus pyogenes M1 GAS
ucuuugcaggguaucugcuc

SEQ ID NO: 4118663 - RNA, 19 nt, Streptococcus pyogenes M1 GAS
ucuuugguuugaugaaccu

SEQ ID NO: 4118664 - RNA, 20 nt, Streptococcus pyogenes M1 GAS
ucuuuuaaccauaucacaaa

SEQ ID NO: 4118665 - RNA, 22 nt, Streptococcus pyogenes M1 GAS
ucuuuuaggccaccagaugcuu

SEQ ID NO: 4118666 - RNA, 18 nt, Streptococcus pyogenes M1 GAS
ucuuuucagagaugcuuc

SEQ ID NO: 4118667 - RNA, 20 nt, Streptococcus pyogenes M1 GAS
ucuuuuucguauacuuuaaa

SEQ ID NO: 4118668 - RNA, 13 nt, Streptococcus pyogenes M1 GAS
ucuuuuuggcuga

SEQ ID NO: 4118669 - RNA, 19 nt, Streptococcus pyogenes M1 GAS
ucuuuuuuacuuuuaaaau

SEQ ID NO: 4118670 - RNA, 18 nt, Streptococcus pyogenes M1 GAS
ugaaaaaaucgcccugga

SEQ ID NO: 4118671 - RNA, 14 nt, Streptococcus pyogenes M1 GAS
ugaaaaacuugggu

SEQ ID NO: 4118672 - RNA, 12 nt, Streptococcus pyogenes M1 GAS
ugaaaaauuaug

SEQ ID NO: 4118673 - RNA, 21 nt, Streptococcus pyogenes M1 GAS
ugaaaagaugcacacaaaucu

SEQ ID NO: 4118674 - RNA, 22 nt, Streptococcus pyogenes M1 GAS
ugaaaagaugcacacaaaucuu

SEQ ID NO: 4118675 - RNA, 23 nt, Streptococcus pyogenes M1 GAS
ugaaaagaugcacacaaaucuuc

SEQ ID NO: 4118676 - RNA, 13 nt, Streptococcus pyogenes M1 GAS
ugaaaauaaaaua

SEQ ID NO: 4118677 - RNA, 17 nt, Streptococcus pyogenes M1 GAS
ugaaaauaucuuuuuua

SEQ ID NO: 4118678 - RNA, 15 nt, Streptococcus pyogenes M1 GAS
ugaaacaccugcugc

SEQ ID NO: 4118679 - RNA, 20 nt, Streptococcus pyogenes M1 GAS
ugaaacguuauuaaagacaa

SEQ ID NO: 4118680 - RNA, 15 nt, Streptococcus pyogenes M1 GAS
ugaaaguaucuagga

SEQ ID NO: 4118681 - RNA, 12 nt, Streptococcus pyogenes M1 GAS
ugaaaugauugu

SEQ ID NO: 4118682 - RNA, 15 nt, Streptococcus pyogenes M1 GAS
ugaaccgcuauaaca

SEQ ID NO: 4118683 - RNA, 18 nt, Streptococcus pyogenes M1 GAS
ugcgcgacuaaaaucaug

SEQ ID NO: 4118684 - RNA, 13 nt, Streptococcus pyogenes M1 GAS
ugcguuuauaaag

SEQ ID NO: 4118685 - RNA, 19 nt, Streptococcus pyogenes M1 GAS
ugcuagacggcuaauaaga

SEQ ID NO: 4118686 - RNA, 21 nt, Streptococcus pyogenes M1 GAS
ugcuauuucagcuagacuaua

SEQ ID NO: 4118687 - RNA, 13 nt, Streptococcus pyogenes M1 GAS
ugcucuuguuuuc

SEQ ID NO: 4118688 - RNA, 16 nt, Streptococcus pyogenes M1 GAS
ugcucuuguuuucuca

SEQ ID NO: 4118689 - RNA, 17 nt, Streptococcus pyogenes M1 GAS
ugcucuuguuuucucaa

SEQ ID NO: 4118690 - RNA, 15 nt, Streptococcus pyogenes M1 GAS
ugcugauuuuggaug

SEQ ID NO: 4118691 - RNA, 19 nt, Streptococcus pyogenes M1 GAS
ugcuguuggauacagucca

SEQ ID NO: 4118692 - RNA, 17 nt, Streptococcus pyogenes M1 GAS
ugcuguuugucauacuc

SEQ ID NO: 4118693 - RNA, 16 nt, Streptococcus pyogenes M1 GAS
ugcuucuagcucuuua

SEQ ID NO: 4118694 - RNA, 15 nt, Streptococcus pyogenes M1 GAS
ugcuucuuacuauga

SEQ ID NO: 4118695 - RNA, 12 nt, Streptococcus pyogenes M1 GAS
ugcuuuaaaaag

SEQ ID NO: 4118696 - RNA, 21 nt, Streptococcus pyogenes M1 GAS
ugcuuugacaaagcagugcuu

SEQ ID NO: 4118697 - RNA, 21 nt, Streptococcus pyogenes M1 GAS
ugcuuuuuaugauuugucaaa

SEQ ID NO: 4118698 - RNA, 23 nt, Streptococcus pyogenes M1 GAS
ugcuuuuuuugucguuuuuugcu

SEQ ID NO: 4118699 - RNA, 20 nt, Streptococcus pyogenes M1 GAS
uggaaaaggaauaucaggca

SEQ ID NO: 4118700 - RNA, 14 nt, Streptococcus pyogenes M1 GAS
uggaaauuuuaaau

SEQ ID NO: 4118701 - RNA, 18 nt, Streptococcus pyogenes M1 GAS
uggaaauuuuaaaugaca

SEQ ID NO: 4118702 - RNA, 12 nt, Streptococcus pyogenes M1 GAS
uggacgaaggcu

SEQ ID NO: 4118703 - RNA, 20 nt, Streptococcus pyogenes M1 GAS
uggacgucuucuuuuuauua

SEQ ID NO: 4118704 - RNA, 21 nt, Streptococcus pyogenes M1 GAS
uggacgucuucuuuuuauuau

SEQ ID NO: 4118705 - RNA, 15 nt, Streptococcus pyogenes M1 GAS
uggacuaucugaguc

SEQ ID NO: 4118706 - RNA, 14 nt, Streptococcus pyogenes M1 GAS
uggagaugagaaag

SEQ ID NO: 4118707 - RNA, 19 nt, Streptococcus pyogenes M1 GAS
uggagcuuuaguugcuucu

SEQ ID NO: 4118708 - RNA, 23 nt, Streptococcus pyogenes M1 GAS
uggagcuuuaguugcuucuuuua

SEQ ID NO: 4118709 - RNA, 16 nt, Streptococcus pyogenes M1 GAS
uggaugaaaguaacau

SEQ ID NO: 4118710 - RNA, 22 nt, Streptococcus pyogenes M1 GAS
uggauuaaaugcccaagauggg

SEQ ID NO: 4118711 - RNA, 13 nt, Streptococcus pyogenes M1 GAS
uggauuuccucua

SEQ ID NO: 4118712 - RNA, 16 nt, Streptococcus pyogenes M1 GAS
uggccagcgucugaua

SEQ ID NO: 4118713 - RNA, 16 nt, Streptococcus pyogenes M1 GAS
uggccuucuuggaaaa

SEQ ID NO: 4118714 - RNA, 18 nt, Streptococcus pyogenes M1 GAS
ugggauauuuagauggua

SEQ ID NO: 4118715 - RNA, 18 nt, Streptococcus pyogenes M1 GAS
uggguaguugguacuuga

SEQ ID NO: 4118716 - RNA, 13 nt, Streptococcus pyogenes M1 GAS
ugguaaaaaggca

SEQ ID NO: 4118717 - RNA, 16 nt, Streptococcus pyogenes M1 GAS
ugguaaaguauuuuau

SEQ ID NO: 4118718 - RNA, 13 nt, Streptococcus pyogenes M1 GAS
ugguauucuuuuu

SEQ ID NO: 4118719 - RNA, 23 nt, Streptococcus pyogenes M1 GAS
uggucaauggaaauuuuaaauga

SEQ ID NO: 4118720 - RNA, 23 nt, Streptococcus pyogenes M1 GAS
uggucuaccgcuaggauuuuucc

SEQ ID NO: 4118721 - RNA, 21 nt, Streptococcus pyogenes M1 GAS
uggugacucuguuccuaugcu

SEQ ID NO: 4118722 - RNA, 18 nt, Streptococcus pyogenes M1 GAS
ugguugccugaaauauaa

SEQ ID NO: 4118723 - RNA, 22 nt, Streptococcus pyogenes M1 GAS
ugguuucacgauaagaagcuaa

SEQ ID NO: 4118724 - RNA, 14 nt, Streptococcus pyogenes M1 GAS
ugguuuuuuugucu

SEQ ID NO: 4118725 - RNA, 12 nt, Streptococcus pyogenes M1 GAS
uguaaaaugaua

SEQ ID NO: 4118726 - RNA, 17 nt, Streptococcus pyogenes M1 GAS
uguaaauagauaauguu

SEQ ID NO: 4118727 - RNA, 18 nt, Streptococcus pyogenes M1 GAS
uguaaauauaaagucaga

SEQ ID NO: 4118728 - RNA, 19 nt, Streptococcus pyogenes M1 GAS
uguaaaucaguagugauga

SEQ ID NO: 4118729 - RNA, 19 nt, Streptococcus pyogenes M1 GAS
uguaacgcuuguuuaugaa

SEQ ID NO: 4118730 - RNA, 20 nt, Streptococcus pyogenes M1 GAS
uguaacgcuuguuuaugaaa

SEQ ID NO: 4118731 - RNA, 12 nt, Streptococcus pyogenes M1 GAS
uguaauaacaaa

SEQ ID NO: 4118732 - RNA, 23 nt, Streptococcus pyogenes M1 GAS
uguaauaacaaaaugaagcaaaa

SEQ ID NO: 4118733 - RNA, 15 nt, Streptococcus pyogenes M1 GAS
uguaauucagcaucg

SEQ ID NO: 4118734 - RNA, 24 nt, Streptococcus pyogenes M1 GAS
uguaauuucuugugcuaaucuauc

SEQ ID NO: 4118735 - RNA, 19 nt, Streptococcus pyogenes M1 GAS
uguagaauuucaaguucuc

SEQ ID NO: 4118736 - RNA, 13 nt, Streptococcus pyogenes M1 GAS
uguauacaaaaag

SEQ ID NO: 4118737 - RNA, 18 nt, Streptococcus pyogenes M1 GAS
uguauacaaaaaggcuaa

SEQ ID NO: 4118738 - RNA, 13 nt, Streptococcus pyogenes M1 GAS
uguauagguagau

SEQ ID NO: 4118739 - RNA, 16 nt, Streptococcus pyogenes M1 GAS
uguauuaugaggugaa

SEQ ID NO: 4118740 - RNA, 15 nt, Streptococcus pyogenes M1 GAS
uguauuucuuuagua

SEQ ID NO: 4118741 - RNA, 20 nt, Streptococcus pyogenes M1 GAS
ugucacgaucaagaaacuca

SEQ ID NO: 4118742 - RNA, 17 nt, Streptococcus pyogenes M1 GAS
ugucaggggaauuuccu

SEQ ID NO: 4118743 - RNA, 17 nt, Streptococcus pyogenes M1 GAS
ugucauacucaauagcu

SEQ ID NO: 4118744 - RNA, 20 nt, Streptococcus pyogenes M1 GAS
ugucauggcccgguucguua

SEQ ID NO: 4118745 - RNA, 13 nt, Streptococcus pyogenes M1 GAS
uguccaauaccua

SEQ ID NO: 4118746 - RNA, 15 nt, Streptococcus pyogenes M1 GAS
uguccauuuuuuaua

SEQ ID NO: 4118747 - RNA, 18 nt, Streptococcus pyogenes M1 GAS
uguccguuguuuucacua

SEQ ID NO: 4118748 - RNA, 17 nt, Streptococcus pyogenes M1 GAS
uguccuaaccuuuuggc

SEQ ID NO: 4118749 - RNA, 18 nt, Streptococcus pyogenes M1 GAS
uguccuaaccuuuuggcu

SEQ ID NO: 4118750 - RNA, 20 nt, Streptococcus pyogenes M1 GAS
uguccuaaccuuuuggcugu

SEQ ID NO: 4118751 - RNA, 19 nt, Streptococcus pyogenes M1 GAS
uguccuacacguuccauga

SEQ ID NO: 4118752 - RNA, 17 nt, Streptococcus pyogenes M1 GAS
ugucgcuuuuuuuauuu

SEQ ID NO: 4118753 - RNA, 17 nt, Streptococcus pyogenes M1 GAS
ugucgugcucauaaaac

SEQ ID NO: 4118754 - RNA, 17 nt, Streptococcus pyogenes M1 GAS
ugucuaagauguuuacg

SEQ ID NO: 4118755 - RNA, 13 nt, Streptococcus pyogenes M1 GAS
ugucuacuuauuu

SEQ ID NO: 4118756 - RNA, 13 nt, Streptococcus pyogenes M1 GAS
ugucucuacgaua

SEQ ID NO: 4118757 - RNA, 18 nt, Streptococcus pyogenes M1 GAS
ugucuuagccuuuuuuug

SEQ ID NO: 4118758 - RNA, 21 nt, Streptococcus pyogenes M1 GAS
ugucuuagccuuuuuuugucu

SEQ ID NO: 4118759 - RNA, 16 nt, Streptococcus pyogenes M1 GAS
ugucuucuucuuuuca

SEQ ID NO: 4118760 - RNA, 17 nt, Streptococcus pyogenes M1 GAS
ugucuugcuaaaauuuc

SEQ ID NO: 4118761 - RNA, 19 nt, Streptococcus pyogenes M1 GAS
ugugacaauuggugauuaa

SEQ ID NO: 4118762 - RNA, 23 nt, Streptococcus pyogenes M1 GAS
ugugacaugaguauaaauuuggg

SEQ ID NO: 4118763 - RNA, 22 nt, Streptococcus pyogenes M1 GAS
ugugauuaguuuuuagcagcag

SEQ ID NO: 4118764 - RNA, 18 nt, Streptococcus pyogenes M1 GAS
ugugauuauuauucuaaa

SEQ ID NO: 4118765 - RNA, 20 nt, Streptococcus pyogenes M1 GAS
uguggcuaguaaguuuuuuu

SEQ ID NO: 4118766 - RNA, 22 nt, Streptococcus pyogenes M1 GAS
ugugucuuuucuuuuuggcuga

SEQ ID NO: 4118767 - RNA, 17 nt, Streptococcus pyogenes M1 GAS
uguuaauauagucugca

SEQ ID NO: 4118768 - RNA, 14 nt, Streptococcus pyogenes M1 GAS
uguuacaaaaaaca

SEQ ID NO: 4118769 - RNA, 21 nt, Streptococcus pyogenes M1 GAS
uguuaucccuggaccauuauc

SEQ ID NO: 4118770 - RNA, 22 nt, Streptococcus pyogenes M1 GAS
uguuauuggaaaguaaggguua

SEQ ID NO: 4118771 - RNA, 19 nt, Streptococcus pyogenes M1 GAS
uguucaggggguaaaaaag

SEQ ID NO: 4118772 - RNA, 15 nt, Streptococcus pyogenes M1 GAS
uguucucauaaacaa

SEQ ID NO: 4118773 - RNA, 19 nt, Streptococcus pyogenes M1 GAS
uguucucauaaacaaugag

SEQ ID NO: 4118774 - RNA, 20 nt, Streptococcus pyogenes M1 GAS
uguugacucugauccgaguu

SEQ ID NO: 4118775 - RNA, 16 nt, Streptococcus pyogenes M1 GAS
uguuguauuaugaggu

SEQ ID NO: 4118776 - RNA, 15 nt, Streptococcus pyogenes M1 GAS
uguugucaaacauaa

SEQ ID NO: 4118777 - RNA, 18 nt, Streptococcus pyogenes M1 GAS
uguuguucuaaguuuuua

SEQ ID NO: 4118778 - RNA, 24 nt, Streptococcus pyogenes M1 GAS
uguuuaacccccuaaacuaauaag

SEQ ID NO: 4118779 - RNA, 14 nt, Streptococcus pyogenes M1 GAS
uguuuaagauggug

SEQ ID NO: 4118780 - RNA, 15 nt, Streptococcus pyogenes M1 GAS
uguuuauuuauaauu

SEQ ID NO: 4118781 - RNA, 21 nt, Streptococcus pyogenes M1 GAS
uguuugugauggucuugcucu

SEQ ID NO: 4118782 - RNA, 22 nt, Streptococcus pyogenes M1 GAS
uguuuuggccaauaaaauaucu

SEQ ID NO: 4118783 - RNA, 18 nt, Streptococcus pyogenes M1 GAS
uugauauuuuuucucaaa

SEQ ID NO: 4118784 - RNA, 23 nt, Streptococcus pyogenes M1 GAS
uugauauuuuuucucaaaaauau

SEQ ID NO: 4118785 - RNA, 16 nt, Streptococcus pyogenes M1 GAS
uugaugagacuaaccu

SEQ ID NO: 4118786 - RNA, 21 nt, Streptococcus pyogenes M1 GAS
uugaugauugaguaagcagca

SEQ ID NO: 4118787 - RNA, 22 nt, Streptococcus pyogenes M1 GAS
uugaugauugaguaagcagcau

SEQ ID NO: 4118788 - RNA, 17 nt, Streptococcus pyogenes M1 GAS
uugauuacugauaaacu

SEQ ID NO: 4118789 - RNA, 15 nt, Streptococcus pyogenes M1 GAS
uugauuucauuuucu

SEQ ID NO: 4118790 - RNA, 21 nt, Streptococcus pyogenes M1 GAS
uugcaauaaucgaugauaaua

SEQ ID NO: 4118791 - RNA, 22 nt, Streptococcus pyogenes M1 GAS
uugcaauagagccaagauuuua

SEQ ID NO: 4118792 - RNA, 20 nt, Streptococcus pyogenes M1 GAS
uugcagaggcuugcauuuuu

SEQ ID NO: 4118793 - RNA, 16 nt, Streptococcus pyogenes M1 GAS
uugcagcuaaaaacaa

SEQ ID NO: 4118794 - RNA, 17 nt, Streptococcus pyogenes M1 GAS
uugcagcuaaaaacaau

SEQ ID NO: 4118795 - RNA, 20 nt, Streptococcus pyogenes M1 GAS
uugcagguaauuaucugaau

SEQ ID NO: 4118796 - RNA, 17 nt, Streptococcus pyogenes M1 GAS
uugcauggguaugccug

SEQ ID NO: 4118797 - RNA, 22 nt, Streptococcus pyogenes M1 GAS
uugccaucaauguuuugcucga

SEQ ID NO: 4118798 - RNA, 20 nt, Streptococcus pyogenes M1 GAS
uugccaucgacgaugugacu

SEQ ID NO: 4118799 - RNA, 13 nt, Streptococcus pyogenes M1 GAS
uugccauuuaauu

SEQ ID NO: 4118800 - RNA, 13 nt, Streptococcus pyogenes M1 GAS
uugcuuaaugacc

SEQ ID NO: 4118801 - RNA, 20 nt, Streptococcus pyogenes M1 GAS
uugcuuaaugaccuuugaua

SEQ ID NO: 4118802 - RNA, 21 nt, Streptococcus pyogenes M1 GAS
uugcuugucuuuuuuuggccu

SEQ ID NO: 4118803 - RNA, 17 nt, Streptococcus pyogenes M1 GAS
uugcuuuuuaauuguug

SEQ ID NO: 4118804 - RNA, 17 nt, Streptococcus pyogenes M1 GAS
uugcuuuuuucuaaccu

SEQ ID NO: 4118805 - RNA, 13 nt, Streptococcus pyogenes M1 GAS
uuggaaaaggaau

SEQ ID NO: 4118806 - RNA, 19 nt, Streptococcus pyogenes M1 GAS
uuggaauaguuuaucacuc

SEQ ID NO: 4118807 - RNA, 14 nt, Streptococcus pyogenes M1 GAS
uuggagagauuuua

SEQ ID NO: 4118808 - RNA, 23 nt, Streptococcus pyogenes M1 GAS
uuggccaauaaaauaucuagaac

SEQ ID NO: 4118809 - RNA, 22 nt, Streptococcus pyogenes M1 GAS
uuggcuacucuauuugaaguaa

SEQ ID NO: 4118810 - RNA, 17 nt, Streptococcus pyogenes M1 GAS
uuggcuacucuauuuua

SEQ ID NO: 4118811 - RNA, 21 nt, Streptococcus pyogenes M1 GAS
uuggcuacucuauuuuaagua

SEQ ID NO: 4118812 - RNA, 12 nt, Streptococcus pyogenes M1 GAS
uugguccucuga

SEQ ID NO: 4118813 - RNA, 16 nt, Streptococcus pyogenes M1 GAS
uugguggaagaguaag

SEQ ID NO: 4118814 - RNA, 22 nt, Streptococcus pyogenes M1 GAS
uugguggaagaguaaggaccaa

SEQ ID NO: 4118815 - RNA, 19 nt, Streptococcus pyogenes M1 GAS
uuguaauaacaaaaugaag

SEQ ID NO: 4118816 - RNA, 13 nt, Streptococcus pyogenes M1 GAS
uuguaauucagca

SEQ ID NO: 4118817 - RNA, 22 nt, Streptococcus pyogenes M1 GAS
uuguacaagagcuuaaaaguua

SEQ ID NO: 4118818 - RNA, 23 nt, Streptococcus pyogenes M1 GAS
uuguagaggacuaaguccuuuua

SEQ ID NO: 4118819 - RNA, 15 nt, Streptococcus pyogenes M1 GAS
uuguaucucauaaca

SEQ ID NO: 4118820 - RNA, 20 nt, Streptococcus pyogenes M1 GAS
uugucaaaaaguaaaaagca

SEQ ID NO: 4118821 - RNA, 24 nt, Streptococcus pyogenes M1 GAS
uugucaacucgauaaaaacgauca

SEQ ID NO: 4118822 - RNA, 19 nt, Streptococcus pyogenes M1 GAS
uuguccauuuuuuauaaug

SEQ ID NO: 4118823 - RNA, 20 nt, Streptococcus pyogenes M1 GAS
uugugacaugaguauaaauu

SEQ ID NO: 4118824 - RNA, 23 nt, Streptococcus pyogenes M1 GAS
uugugaggccgucacaaacugcc

SEQ ID NO: 4118825 - RNA, 22 nt, Streptococcus pyogenes M1 GAS
uugugauuaguuuuuagcagca

SEQ ID NO: 4118826 - RNA, 23 nt, Streptococcus pyogenes M1 GAS
uugugauuaguuuuuagcagcag

SEQ ID NO: 4118827 - RNA, 13 nt, Streptococcus pyogenes M1 GAS
uugugcuauucaa

SEQ ID NO: 4118828 - RNA, 17 nt, Streptococcus pyogenes M1 GAS
uuguggcgggccuucua

SEQ ID NO: 4118829 - RNA, 22 nt, Streptococcus pyogenes M1 GAS
uuguggcgggccuucuaucaaa

SEQ ID NO: 4118830 - RNA, 18 nt, Streptococcus pyogenes M1 GAS
uuguggcugauaaaaaga

SEQ ID NO: 4118831 - RNA, 19 nt, Streptococcus pyogenes M1 GAS
uuguggcugauaaaaagag

SEQ ID NO: 4118832 - RNA, 13 nt, Streptococcus pyogenes M1 GAS
uuguuacaaaaaa

SEQ ID NO: 4118833 - RNA, 14 nt, Streptococcus pyogenes M1 GAS
uuguuacaaaaaac

SEQ ID NO: 4118834 - RNA, 16 nt, Streptococcus pyogenes M1 GAS
uuguuacaaaaaacaa

SEQ ID NO: 4118835 - RNA, 23 nt, Streptococcus pyogenes M1 GAS
uuguuuuuucaaagggagauucu

SEQ ID NO: 4118836 - RNA, 22 nt, Streptococcus pyogenes M1 GAS
uuuaaaaaacgcgguaaacaua

SEQ ID NO: 4118837 - RNA, 21 nt, Streptococcus pyogenes M1 GAS
uuuaaaagggucaguuuguuu

SEQ ID NO: 4118838 - RNA, 23 nt, Streptococcus pyogenes M1 GAS
uuuaaaauaguucccuuaauaaa

SEQ ID NO: 4118839 - RNA, 19 nt, Streptococcus pyogenes M1 GAS
uuuaaacacuaccuuaaau

SEQ ID NO: 4118840 - RNA, 13 nt, Streptococcus pyogenes M1 GAS
uuuaaagcgauaa

SEQ ID NO: 4118841 - RNA, 20 nt, Streptococcus pyogenes M1 GAS
uuuaacaugauguaccaauu

SEQ ID NO: 4118842 - RNA, 23 nt, Streptococcus pyogenes M1 GAS
uuuaacuguuagccauguguugu

SEQ ID NO: 4118843 - RNA, 17 nt, Streptococcus pyogenes M1 GAS
uuuaagcugagcaaaac

SEQ ID NO: 4118844 - RNA, 20 nt, Streptococcus pyogenes M1 GAS
uuuaagguauuguucaaccg

SEQ ID NO: 4118845 - RNA, 15 nt, Streptococcus pyogenes M1 GAS
uuuacaucaaaaaaa

SEQ ID NO: 4118846 - RNA, 18 nt, Streptococcus pyogenes M1 GAS
uuuacuauggcuucuaaa

SEQ ID NO: 4118847 - RNA, 21 nt, Streptococcus pyogenes M1 GAS
uuuacuauggcuucuaaaaaa

SEQ ID NO: 4118848 - RNA, 13 nt, Streptococcus pyogenes M1 GAS
uuuagauaaaaau

SEQ ID NO: 4118849 - RNA, 17 nt, Streptococcus pyogenes M1 GAS
uuuagcgguaucccuuu

SEQ ID NO: 4118850 - RNA, 13 nt, Streptococcus pyogenes M1 GAS
uuuagcuaagaau

SEQ ID NO: 4118851 - RNA, 21 nt, Streptococcus pyogenes M1 GAS
uuuagcuuauaguuugacuuc

SEQ ID NO: 4118852 - RNA, 23 nt, Streptococcus pyogenes M1 GAS
uuuagcuuauaguuugacuucaa

SEQ ID NO: 4118853 - RNA, 15 nt, Streptococcus pyogenes M1 GAS
uuuagcuucuaaaug

SEQ ID NO: 4118854 - RNA, 17 nt, Streptococcus pyogenes M1 GAS
uuuagugaauucuaaaa

SEQ ID NO: 4118855 - RNA, 18 nt, Streptococcus pyogenes M1 GAS
uuuagugaauucuaaaau

SEQ ID NO: 4118856 - RNA, 20 nt, Streptococcus pyogenes M1 GAS
uuuagugguauagacaaaca

SEQ ID NO: 4118857 - RNA, 21 nt, Streptococcus pyogenes M1 GAS
uuuagugguauagacaaacag

SEQ ID NO: 4118858 - RNA, 22 nt, Streptococcus pyogenes M1 GAS
uuuaguugugauauaaaaugcc

SEQ ID NO: 4118859 - RNA, 19 nt, Streptococcus pyogenes M1 GAS
uuuauaaaguuuucucaga

SEQ ID NO: 4118860 - RNA, 11 nt, Streptococcus pyogenes M1 GAS
uuuauaacaau

SEQ ID NO: 4118861 - RNA, 13 nt, Streptococcus pyogenes M1 GAS
uuuauaauuucuu

SEQ ID NO: 4118862 - RNA, 19 nt, Streptococcus pyogenes M1 GAS
uuuaugaccauuuuuacug

SEQ ID NO: 4118863 - RNA, 19 nt, Streptococcus pyogenes M1 GAS
uuuauguaugcuguccaug

SEQ ID NO: 4118864 - RNA, 21 nt, Streptococcus pyogenes M1 GAS
uuuauuaauaaguauucuaaa

SEQ ID NO: 4118865 - RNA, 19 nt, Streptococcus pyogenes M1 GAS
uuuauuuguugaagugucu

SEQ ID NO: 4118866 - RNA, 23 nt, Streptococcus pyogenes M1 GAS
uuuauuuugauauuuuuucucaa

SEQ ID NO: 4118867 - RNA, 15 nt, Streptococcus pyogenes M1 GAS
uuucaaaaaaacuuc

SEQ ID NO: 4118868 - RNA, 23 nt, Streptococcus pyogenes M1 GAS
uuucaaaaaaacuucacauugua

SEQ ID NO: 4118869 - RNA, 21 nt, Streptococcus pyogenes M1 GAS
uuucaacaaauccuuuugcuu

SEQ ID NO: 4118870 - RNA, 22 nt, Streptococcus pyogenes M1 GAS
uuucaauugauuugcagaggcu

SEQ ID NO: 4118871 - RNA, 16 nt, Streptococcus pyogenes M1 GAS
uuucaggauguuuauu

SEQ ID NO: 4118872 - RNA, 16 nt, Streptococcus pyogenes M1 GAS
uuucagucuucuguaa

SEQ ID NO: 4118873 - RNA, 13 nt, Streptococcus pyogenes M1 GAS
uuucaucaucaag

SEQ ID NO: 4118874 - RNA, 16 nt, Streptococcus pyogenes M1 GAS
uuucauuauagacuau

SEQ ID NO: 4118875 - RNA, 14 nt, Streptococcus pyogenes M1 GAS
uuuccuacaaaaua

SEQ ID NO: 4118876 - RNA, 21 nt, Streptococcus pyogenes M1 GAS
uuucggaaaacuuuugacuug

SEQ ID NO: 4118877 - RNA, 16 nt, Streptococcus pyogenes M1 GAS
uuucggacuguuuuuu

SEQ ID NO: 4118878 - RNA, 13 nt, Streptococcus pyogenes M1 GAS
uuucgucuaaaaa

SEQ ID NO: 4118879 - RNA, 15 nt, Streptococcus pyogenes M1 GAS
uuucgugucuaaaau

SEQ ID NO: 4118880 - RNA, 12 nt, Streptococcus pyogenes M1 GAS
uuucuauauaac

SEQ ID NO: 4118881 - RNA, 20 nt, Streptococcus pyogenes M1 GAS
uuucucagagacaauaaggu

SEQ ID NO: 4118882 - RNA, 11 nt, Streptococcus pyogenes M1 GAS
uuucucaguaa

SEQ ID NO: 4118883 - RNA, 21 nt, Streptococcus pyogenes M1 GAS
uuucuuauauugugcuauuca

SEQ ID NO: 4118884 - RNA, 19 nt, Streptococcus pyogenes M1 GAS
uuucuucagguuucuuuug

SEQ ID NO: 4118885 - RNA, 13 nt, Streptococcus pyogenes M1 GAS
uuucuuugucaug

SEQ ID NO: 4118886 - RNA, 15 nt, Streptococcus pyogenes M1 GAS
uuugaaguaaaggau

SEQ ID NO: 4118887 - RNA, 19 nt, Streptococcus pyogenes M1 GAS
uuugaauacguaaaaagag

SEQ ID NO: 4118888 - RNA, 12 nt, Streptococcus pyogenes M1 GAS
uuugaauguugu

SEQ ID NO: 4118889 - RNA, 19 nt, Streptococcus pyogenes M1 GAS
uuugacagacaccaaaaaa

SEQ ID NO: 4118890 - RNA, 22 nt, Streptococcus pyogenes M1 GAS
uuugacauuaguccaaaauaca

SEQ ID NO: 4118891 - RNA, 17 nt, Streptococcus pyogenes M1 GAS
uuugaccuacuagcaca

SEQ ID NO: 4118892 - RNA, 21 nt, Streptococcus pyogenes M1 GAS
uuugaccuacuagcacaaaau

SEQ ID NO: 4118893 - RNA, 14 nt, Streptococcus pyogenes M1 GAS
uuugacuucaaaaa

SEQ ID NO: 4118894 - RNA, 16 nt, Streptococcus pyogenes M1 GAS
uuugacuucaaaaaua

SEQ ID NO: 4118895 - RNA, 20 nt, Streptococcus pyogenes M1 GAS
uuugaggugauguucucaua

SEQ ID NO: 4118896 - RNA, 15 nt, Streptococcus pyogenes M1 GAS
uuugauaaaaaacaa

SEQ ID NO: 4118897 - RNA, 19 nt, Streptococcus pyogenes M1 GAS
uuugauauuuuuucucaaa

SEQ ID NO: 4118898 - RNA, 22 nt, Streptococcus pyogenes M1 GAS
uuugaugcagcuaaaagcauaa

SEQ ID NO: 4118899 - RNA, 15 nt, Streptococcus pyogenes M1 GAS
uuugcaaaagaauug

SEQ ID NO: 4118900 - RNA, 20 nt, Streptococcus pyogenes M1 GAS
uuugcaaauaguagcaaaua

SEQ ID NO: 4118901 - RNA, 21 nt, Streptococcus pyogenes M1 GAS
uuugcaaauaguagcaaauaa

SEQ ID NO: 4118902 - RNA, 13 nt, Streptococcus pyogenes M1 GAS
uuugcacugcuau

SEQ ID NO: 4118903 - RNA, 19 nt, Streptococcus pyogenes M1 GAS
uuugccauggcaagagcac

SEQ ID NO: 4118904 - RNA, 18 nt, Streptococcus pyogenes M1 GAS
uuuggagagauuuuaaaa

SEQ ID NO: 4118905 - RNA, 20 nt, Streptococcus pyogenes M1 GAS
uuuggaggugaaaauaucuu

SEQ ID NO: 4118906 - RNA, 22 nt, Streptococcus pyogenes M1 GAS
uuuggcaagauaauauugauau

SEQ ID NO: 4118907 - RNA, 17 nt, Streptococcus pyogenes M1 GAS
uuuguaucucauaacaa

SEQ ID NO: 4118908 - RNA, 13 nt, Streptococcus pyogenes M1 GAS
uuuguaugacauu

SEQ ID NO: 4118909 - RNA, 20 nt, Streptococcus pyogenes M1 GAS
uuuguccauuuuuuauaaug

SEQ ID NO: 4118910 - RNA, 21 nt, Streptococcus pyogenes M1 GAS
uuugucugacuuaaauuugga

SEQ ID NO: 4118911 - RNA, 19 nt, Streptococcus pyogenes M1 GAS
uuugucuucuucuuuucag

SEQ ID NO: 4118912 - RNA, 13 nt, Streptococcus pyogenes M1 GAS
uuugugauggucu

SEQ ID NO: 4118913 - RNA, 21 nt, Streptococcus pyogenes M1 GAS
uuuguguugaagaaggucaug

SEQ ID NO: 4118914 - RNA, 13 nt, Streptococcus pyogenes M1 GAS
uuuguuaacaggu

SEQ ID NO: 4118915 - RNA, 15 nt, Streptococcus pyogenes M1 GAS
uuuguuaacagguga

SEQ ID NO: 4118916 - RNA, 17 nt, Streptococcus pyogenes M1 GAS
uuuguuuauuuauaauu

SEQ ID NO: 4118917 - RNA, 19 nt, Streptococcus pyogenes M1 GAS
uuuuaaauaucuuaccauu

SEQ ID NO: 4118918 - RNA, 22 nt, Streptococcus pyogenes M1 GAS
uuuuaagggcaaugccaucugc

SEQ ID NO: 4118919 - RNA, 14 nt, Streptococcus pyogenes M1 GAS
uuuuacaucaaaaa

SEQ ID NO: 4118920 - RNA, 19 nt, Streptococcus pyogenes M1 GAS
uuuuacaucaaaaaaagca

SEQ ID NO: 4118921 - RNA, 16 nt, Streptococcus pyogenes M1 GAS
uuuuacgaaaaauucu

SEQ ID NO: 4118922 - RNA, 13 nt, Streptococcus pyogenes M1 GAS
uuuuacuuuuaaa

SEQ ID NO: 4118923 - RNA, 13 nt, Streptococcus pyogenes M1 GAS
uuuuagauaaaaa

SEQ ID NO: 4118924 - RNA, 20 nt, Streptococcus pyogenes M1 GAS
uuuuagcggcacguuauucu

SEQ ID NO: 4118925 - RNA, 16 nt, Streptococcus pyogenes M1 GAS
uuuuagcuaagaauaa

SEQ ID NO: 4118926 - RNA, 19 nt, Streptococcus pyogenes M1 GAS
uuuuaggccaccagaugcu

SEQ ID NO: 4118927 - RNA, 22 nt, Streptococcus pyogenes M1 GAS
uuuuaguaaagccuuauccauu

SEQ ID NO: 4118928 - RNA, 23 nt, Streptococcus pyogenes M1 GAS
uuuuaguugugauauaaaaugcc

SEQ ID NO: 4118929 - RNA, 12 nt, Streptococcus pyogenes M1 GAS
uuuuaguuuuau

SEQ ID NO: 4118930 - RNA, 18 nt, Streptococcus pyogenes M1 GAS
uuuuauaaugguuuuuuu

SEQ ID NO: 4118931 - RNA, 17 nt, Streptococcus pyogenes M1 GAS
uuuuauccccuauucaa

SEQ ID NO: 4118932 - RNA, 18 nt, Streptococcus pyogenes M1 GAS
uuuuauccccuauucaau

SEQ ID NO: 4118933 - RNA, 18 nt, Streptococcus pyogenes M1 GAS
uuuuaugauuugucaaaa

SEQ ID NO: 4118934 - RNA, 19 nt, Streptococcus pyogenes M1 GAS
uuuuaugauuugucaaaaa

SEQ ID NO: 4118935 - RNA, 16 nt, Streptococcus pyogenes M1 GAS
uuuuauuauacucaau

SEQ ID NO: 4118936 - RNA, 15 nt, Streptococcus pyogenes M1 GAS
uuuuauuuuuuaaag

SEQ ID NO: 4118937 - RNA, 20 nt, Streptococcus pyogenes M1 GAS
uuuucacaauuagccaaaga

SEQ ID NO: 4118938 - RNA, 12 nt, Streptococcus pyogenes M1 GAS
uuuucucaaaaa

SEQ ID NO: 4118939 - RNA, 15 nt, Streptococcus pyogenes M1 GAS
uuuucugguuuuaau

SEQ ID NO: 4118940 - RNA, 14 nt, Streptococcus pyogenes M1 GAS
uuuucuuuuuggcu

SEQ ID NO: 4118941 - RNA, 14 nt, Streptococcus pyogenes M1 GAS
uuuugauaaaaaac

SEQ ID NO: 4118942 - RNA, 18 nt, Streptococcus pyogenes M1 GAS
uuuugccuuuaacaugau

SEQ ID NO: 4118943 - RNA, 15 nt, Streptococcus pyogenes M1 GAS
uuuugggguuauccu

SEQ ID NO: 4118944 - RNA, 19 nt, Streptococcus pyogenes M1 GAS
uuuugguccugugacacgu

SEQ ID NO: 4118945 - RNA, 18 nt, Streptococcus pyogenes M1 GAS
uuuugguugauauaaaau

SEQ ID NO: 4118946 - RNA, 17 nt, Streptococcus pyogenes M1 GAS
uuuugucguuuuuugcu

SEQ ID NO: 4118947 - RNA, 13 nt, Streptococcus pyogenes M1 GAS
uuuuuacaauacg

SEQ ID NO: 4118948 - RNA, 12 nt, Streptococcus pyogenes M1 GAS
uuuuuaguguuu

SEQ ID NO: 4118949 - RNA, 23 nt, Streptococcus pyogenes M1 GAS
uuuuucucaaaaauauauucuaa

SEQ ID NO: 4118950 - RNA, 16 nt, Streptococcus pyogenes M1 GAS
uuuuucuuuugaccua

SEQ ID NO: 4118951 - RNA, 21 nt, Streptococcus pyogenes M1 GAS
uuuuuggaucgcugugaccaa

SEQ ID NO: 4118952 - RNA, 14 nt, Streptococcus pyogenes M1 GAS
uuuuuuaaagcuaa

SEQ ID NO: 4118953 - RNA, 14 nt, Streptococcus pyogenes M1 GAS
uuuuuuauacggua

SEQ ID NO: 4118954 - RNA, 14 nt, Streptococcus pyogenes MGAS315
aaaaaaagcaauga

SEQ ID NO: 4118955 - RNA, 21 nt, Streptococcus pyogenes MGAS315
aaaaaaccgcccagaaauaau

SEQ ID NO: 4118956 - RNA, 22 nt, Streptococcus pyogenes MGAS315
aaaaaaccgcccagaaauaauc

SEQ ID NO: 4118957 - RNA, 22 nt, Streptococcus pyogenes MGAS315
aaaaaagaagcaaaauuauuau

SEQ ID NO: 4118958 - RNA, 13 nt, Streptococcus pyogenes MGAS315
aaaaaagacccaa

SEQ ID NO: 4118959 - RNA, 15 nt, Streptococcus pyogenes MGAS315
aaaaacaaauuguag

SEQ ID NO: 4118960 - RNA, 18 nt, Streptococcus pyogenes MGAS315
aaaaacaccccaaacguu

SEQ ID NO: 4118961 - RNA, 21 nt, Streptococcus pyogenes MGAS315
aaaaacgccacgcucaacugg

SEQ ID NO: 4118962 - RNA, 18 nt, Streptococcus pyogenes MGAS315
aaaaacucaaaaaauaca

SEQ ID NO: 4118963 - RNA, 17 nt, Streptococcus pyogenes MGAS315
aaaaagcaaaaaagcca

SEQ ID NO: 4118964 - RNA, 21 nt, Streptococcus pyogenes MGAS315
aaaaagcaaauugaaaaaauc

SEQ ID NO: 4118965 - RNA, 13 nt, Streptococcus pyogenes MGAS315
aaaaagccuauuu

SEQ ID NO: 4118966 - RNA, 23 nt, Streptococcus pyogenes MGAS315
aaaaagccuauuuaauaggcuuu

SEQ ID NO: 4118967 - RNA, 14 nt, Streptococcus pyogenes MGAS315
aaaaagccuuuaca

SEQ ID NO: 4118968 - RNA, 14 nt, Streptococcus pyogenes MGAS315
aaaaaggcaaagaa

SEQ ID NO: 4118969 - RNA, 16 nt, Streptococcus pyogenes MGAS315
aaaaaggcaaagaaag

SEQ ID NO: 4118970 - RNA, 12 nt, Streptococcus pyogenes MGAS315
aaaaaguaaaaa

SEQ ID NO: 4118971 - RNA, 14 nt, Streptococcus pyogenes MGAS315
aaaaaguaaaaagc

SEQ ID NO: 4118972 - RNA, 15 nt, Streptococcus pyogenes MGAS315
aaaaaguaaaaucuu

SEQ ID NO: 4118973 - RNA, 23 nt, Streptococcus pyogenes MGAS315
aaaaauacuagaaaaagcaauga

SEQ ID NO: 4118974 - RNA, 18 nt, Streptococcus pyogenes MGAS315
aaaaauauauucuaauuu

SEQ ID NO: 4118975 - RNA, 21 nt, Streptococcus pyogenes MGAS315
aaaaaucccuaugaucuguuu

SEQ ID NO: 4118976 - RNA, 12 nt, Streptococcus pyogenes MGAS315
aaaaauuaagaa

SEQ ID NO: 4118977 - RNA, 11 nt, Streptococcus pyogenes MGAS315
aaaacaauaac

SEQ ID NO: 4118978 - RNA, 16 nt, Streptococcus pyogenes MGAS315
aaaacaauaacacaga

SEQ ID NO: 4118979 - RNA, 18 nt, Streptococcus pyogenes MGAS315
aaaaccauaccuacugcc

SEQ ID NO: 4118980 - RNA, 19 nt, Streptococcus pyogenes MGAS315
aaaaccgcccagaaauaau

SEQ ID NO: 4118981 - RNA, 14 nt, Streptococcus pyogenes MGAS315
aaaacgaucaaaaa

SEQ ID NO: 4118982 - RNA, 17 nt, Streptococcus pyogenes MGAS315
aaccacagcaauuuguu

SEQ ID NO: 4118983 - RNA, 19 nt, Streptococcus pyogenes MGAS315
aaccacagcaauuuguucc

SEQ ID NO: 4118984 - RNA, 15 nt, Streptococcus pyogenes MGAS315
aaccgcuaaaacagu

SEQ ID NO: 4118985 - RNA, 16 nt, Streptococcus pyogenes MGAS315
aaccgcucauuugaug

SEQ ID NO: 4118986 - RNA, 22 nt, Streptococcus pyogenes MGAS315
aaccguuccugucgcagauggg

SEQ ID NO: 4118987 - RNA, 17 nt, Streptococcus pyogenes MGAS315
aaccugcauaucugccc

SEQ ID NO: 4118988 - RNA, 13 nt, Streptococcus pyogenes MGAS315
aaccuuugccauu

SEQ ID NO: 4118989 - RNA, 14 nt, Streptococcus pyogenes MGAS315
aacgaucaaaaauc

SEQ ID NO: 4118990 - RNA, 22 nt, Streptococcus pyogenes MGAS315
aacgcuaugcucguaggacacu

SEQ ID NO: 4118991 - RNA, 20 nt, Streptococcus pyogenes MGAS315
aacguguauucuuaaaaaaa

SEQ ID NO: 4118992 - RNA, 21 nt, Streptococcus pyogenes MGAS315
aacuauauuguuaguuuuauc

SEQ ID NO: 4118993 - RNA, 14 nt, Streptococcus pyogenes MGAS315
aacuauuuaacuua

SEQ ID NO: 4118994 - RNA, 19 nt, Streptococcus pyogenes MGAS315
aacuauuuaacuuaucauu

SEQ ID NO: 4118995 - RNA, 17 nt, Streptococcus pyogenes MGAS315
aacucaaaccaaacaag

SEQ ID NO: 4118996 - RNA, 19 nt, Streptococcus pyogenes MGAS315
aacucgauaaaaacgauca

SEQ ID NO: 4118997 - RNA, 22 nt, Streptococcus pyogenes MGAS315
aacucugccaauuguucauuaa

SEQ ID NO: 4118998 - RNA, 23 nt, Streptococcus pyogenes MGAS315
aacugcucuggcuuuuuccuauc

SEQ ID NO: 4118999 - RNA, 19 nt, Streptococcus pyogenes MGAS315
aacuggcacaaacucugcc

SEQ ID NO: 4119000 - RNA, 21 nt, Streptococcus pyogenes MGAS315
aacuggcacaaacucugccaa

SEQ ID NO: 4119001 - RNA, 14 nt, Streptococcus pyogenes MGAS315
aacuuacaaaaagc

SEQ ID NO: 4119002 - RNA, 17 nt, Streptococcus pyogenes MGAS315
aacuucaaauuucauga

SEQ ID NO: 4119003 - RNA, 22 nt, Streptococcus pyogenes MGAS315
aacuucuauauguguaauuucu

SEQ ID NO: 4119004 - RNA, 22 nt, Streptococcus pyogenes MGAS315
aacuugaauaucgccaauaaaa

SEQ ID NO: 4119005 - RNA, 16 nt, Streptococcus pyogenes MGAS315
aacuugucaagccaua

SEQ ID NO: 4119006 - RNA, 15 nt, Streptococcus pyogenes MGAS315
aacuuguuaacaaua

SEQ ID NO: 4119007 - RNA, 13 nt, Streptococcus pyogenes MGAS315
aacuuucaguuau

SEQ ID NO: 4119008 - RNA, 13 nt, Streptococcus pyogenes MGAS315
aacuuuucagguu

SEQ ID NO: 4119009 - RNA, 12 nt, Streptococcus pyogenes MGAS315
aagaagaaaaua

SEQ ID NO: 4119010 - RNA, 15 nt, Streptococcus pyogenes MGAS315
aagaaggucaugaug

SEQ ID NO: 4119011 - RNA, 13 nt, Streptococcus pyogenes MGAS315
aagacaaaaaacu

SEQ ID NO: 4119012 - RNA, 14 nt, Streptococcus pyogenes MGAS315
aagaccauaaaaaa

SEQ ID NO: 4119013 - RNA, 14 nt, Streptococcus pyogenes MGAS315
aagacuaaagcauu

SEQ ID NO: 4119014 - RNA, 17 nt, Streptococcus pyogenes MGAS315
aagacuauguugcuuaa

SEQ ID NO: 4119015 - RNA, 17 nt, Streptococcus pyogenes MGAS315
aagagaaguaauguuuu

SEQ ID NO: 4119016 - RNA, 15 nt, Streptococcus pyogenes MGAS315
aagagagcuugguuu

SEQ ID NO: 4119017 - RNA, 19 nt, Streptococcus pyogenes MGAS315
aagagcguuagcuuuuuaa

SEQ ID NO: 4119018 - RNA, 21 nt, Streptococcus pyogenes MGAS315
aagauaccggguuguuuuuuc

SEQ ID NO: 4119019 - RNA, 18 nt, Streptococcus pyogenes MGAS315
aagauacugcccuugaug

SEQ ID NO: 4119020 - RNA, 18 nt, Streptococcus pyogenes MGAS315
aagaugguuuugauuaaa

SEQ ID NO: 4119021 - RNA, 18 nt, Streptococcus pyogenes MGAS315
aagauuaaacuuacaaaa

SEQ ID NO: 4119022 - RNA, 15 nt, Streptococcus pyogenes MGAS315
aagcaaaaaagccag

SEQ ID NO: 4119023 - RNA, 20 nt, Streptococcus pyogenes MGAS315
aagcaaaaaagccagugcug

SEQ ID NO: 4119024 - RNA, 20 nt, Streptococcus pyogenes MGAS315
aagcaaaauuauuauuuugc

SEQ ID NO: 4119025 - RNA, 13 nt, Streptococcus pyogenes MGAS315
aagcaaucuaaga

SEQ ID NO: 4119026 - RNA, 15 nt, Streptococcus pyogenes MGAS315
aagcauaaaaauauu

SEQ ID NO: 4119027 - RNA, 16 nt, Streptococcus pyogenes MGAS315
aagcaugggcuaagua

SEQ ID NO: 4119028 - RNA, 22 nt, Streptococcus pyogenes MGAS315
aagccgugaggacuuauuuuuu

SEQ ID NO: 4119029 - RNA, 19 nt, Streptococcus pyogenes MGAS315
aagcuaucauacaacuggc

SEQ ID NO: 4119030 - RNA, 22 nt, Streptococcus pyogenes MGAS315
aagcugacgauaagucaguuuu

SEQ ID NO: 4119031 - RNA, 17 nt, Streptococcus pyogenes MGAS315
aagcugaguaaaacaau

SEQ ID NO: 4119032 - RNA, 22 nt, Streptococcus pyogenes MGAS315
aagcuugucuaugagauaccuu

SEQ ID NO: 4119033 - RNA, 15 nt, Streptococcus pyogenes MGAS315
aagcuuuaagcuuug

SEQ ID NO: 4119034 - RNA, 21 nt, Streptococcus pyogenes MGAS315
aaggaaggcuuguucuuuauu

SEQ ID NO: 4119035 - RNA, 19 nt, Streptococcus pyogenes MGAS315
aaggagcuuuaccuccuaa

SEQ ID NO: 4119036 - RNA, 13 nt, Streptococcus pyogenes MGAS315
aaggaguuuuaua

SEQ ID NO: 4119037 - RNA, 18 nt, Streptococcus pyogenes MGAS315
aaggaguuuuauagcuga

SEQ ID NO: 4119038 - RNA, 15 nt, Streptococcus pyogenes MGAS315
aaggaugaaaugauu

SEQ ID NO: 4119039 - RNA, 18 nt, Streptococcus pyogenes MGAS315
aaggcaauccaaaucaac

SEQ ID NO: 4119040 - RNA, 21 nt, Streptococcus pyogenes MGAS315
aaggcagucgcagaguacaag

SEQ ID NO: 4119041 - RNA, 20 nt, Streptococcus pyogenes MGAS315
aagguuaaguaaaagcgaua

SEQ ID NO: 4119042 - RNA, 19 nt, Streptococcus pyogenes MGAS315
aagguuuuuuuaagcauga

SEQ ID NO: 4119043 - RNA, 13 nt, Streptococcus pyogenes MGAS315
aaguaaaaagcaa

SEQ ID NO: 4119044 - RNA, 20 nt, Streptococcus pyogenes MGAS315
aaguaaaaagcaaauugaaa

SEQ ID NO: 4119045 - RNA, 16 nt, Streptococcus pyogenes MGAS315
aaguaagauggugcuu

SEQ ID NO: 4119046 - RNA, 14 nt, Streptococcus pyogenes MGAS315
aaguagauacuuug

SEQ ID NO: 4119047 - RNA, 17 nt, Streptococcus pyogenes MGAS315
aaguauagcauaaaaua

SEQ ID NO: 4119048 - RNA, 23 nt, Streptococcus pyogenes MGAS315
aaguauuuuaaaauccucuuuua

SEQ ID NO: 4119049 - RNA, 20 nt, Streptococcus pyogenes MGAS315
aagucagacucaauugaaag

SEQ ID NO: 4119050 - RNA, 22 nt, Streptococcus pyogenes MGAS315
aagucaguuuuuucugccauau

SEQ ID NO: 4119051 - RNA, 21 nt, Streptococcus pyogenes MGAS315
aagucguuuagcuuuuucaag

SEQ ID NO: 4119052 - RNA, 13 nt, Streptococcus pyogenes MGAS315
aagucucuugcaa

SEQ ID NO: 4119053 - RNA, 21 nt, Streptococcus pyogenes MGAS315
aagugugacuaguuuauuaca

SEQ ID NO: 4119054 - RNA, 15 nt, Streptococcus pyogenes MGAS315
aaguguuuugucuua

SEQ ID NO: 4119055 - RNA, 22 nt, Streptococcus pyogenes MGAS315
aaguguuuugucuuauagaaua

SEQ ID NO: 4119056 - RNA, 22 nt, Streptococcus pyogenes MGAS315
aaguuagggucugagugacuaa

SEQ ID NO: 4119057 - RNA, 23 nt, Streptococcus pyogenes MGAS315
aaguuagggucugagugacuaaa

SEQ ID NO: 4119058 - RNA, 18 nt, Streptococcus pyogenes MGAS315
aaguuccuuagcaguuau

SEQ ID NO: 4119059 - RNA, 20 nt, Streptococcus pyogenes MGAS315
aaguugccuuaucucaguuu

SEQ ID NO: 4119060 - RNA, 17 nt, Streptococcus pyogenes MGAS315
aaguuuagaacuuuuca

SEQ ID NO: 4119061 - RNA, 21 nt, Streptococcus pyogenes MGAS315
aaguuuucucagagacaauaa

SEQ ID NO: 4119062 - RNA, 14 nt, Streptococcus pyogenes MGAS315
aauaaaauagcacc

SEQ ID NO: 4119063 - RNA, 15 nt, Streptococcus pyogenes MGAS315
aauaaaauagcaccu

SEQ ID NO: 4119064 - RNA, 22 nt, Streptococcus pyogenes MGAS315
aauaaagcguugacaguuaaaa

SEQ ID NO: 4119065 - RNA, 22 nt, Streptococcus pyogenes MGAS315
aauaacagaaauuaauaaauuu

SEQ ID NO: 4119066 - RNA, 13 nt, Streptococcus pyogenes MGAS315
aauaacuuuaaaa

SEQ ID NO: 4119067 - RNA, 13 nt, Streptococcus pyogenes MGAS315
aauaagaaaaccu

SEQ ID NO: 4119068 - RNA, 11 nt, Streptococcus pyogenes MGAS315
aauaagauuca

SEQ ID NO: 4119069 - RNA, 19 nt, Streptococcus pyogenes MGAS315
aauaagauucaauaugaaa

SEQ ID NO: 4119070 - RNA, 21 nt, Streptococcus pyogenes MGAS315
aauaaguauagcauaaaauag

SEQ ID NO: 4119071 - RNA, 15 nt, Streptococcus pyogenes MGAS315
aauaaguauuuuaaa

SEQ ID NO: 4119072 - RNA, 18 nt, Streptococcus pyogenes MGAS315
aauaaguauuuuaaaauc

SEQ ID NO: 4119073 - RNA, 19 nt, Streptococcus pyogenes MGAS315
aauaauacagcauacauca

SEQ ID NO: 4119074 - RNA, 15 nt, Streptococcus pyogenes MGAS315
aauaaucugagcggu

SEQ ID NO: 4119075 - RNA, 16 nt, Streptococcus pyogenes MGAS315
aauaaugccaucaaaa

SEQ ID NO: 4119076 - RNA, 20 nt, Streptococcus pyogenes MGAS315
aauaauggcagagucauuua

SEQ ID NO: 4119077 - RNA, 15 nt, Streptococcus pyogenes MGAS315
aauacagaaaaaagc

SEQ ID NO: 4119078 - RNA, 14 nt, Streptococcus pyogenes MGAS315
aauaccauuuuuau

SEQ ID NO: 4119079 - RNA, 17 nt, Streptococcus pyogenes MGAS315
aauacuagaaaaagcaa

SEQ ID NO: 4119080 - RNA, 23 nt, Streptococcus pyogenes MGAS315
accguguucgauaaauucagguu

SEQ ID NO: 4119081 - RNA, 20 nt, Streptococcus pyogenes MGAS315
accguucauauaagcaauca

SEQ ID NO: 4119082 - RNA, 20 nt, Streptococcus pyogenes MGAS315
accguucguauuagcgccag

SEQ ID NO: 4119083 - RNA, 19 nt, Streptococcus pyogenes MGAS315
accuaauugugagaaacua

SEQ ID NO: 4119084 - RNA, 16 nt, Streptococcus pyogenes MGAS315
accuacgauaaaacaa

SEQ ID NO: 4119085 - RNA, 22 nt, Streptococcus pyogenes MGAS315
accuacgauaaaacaaauaauu

SEQ ID NO: 4119086 - RNA, 23 nt, Streptococcus pyogenes MGAS315
accuacugccauggguaaaauga

SEQ ID NO: 4119087 - RNA, 21 nt, Streptococcus pyogenes MGAS315
accuauagaaaguuauaaaga

SEQ ID NO: 4119088 - RNA, 17 nt, Streptococcus pyogenes MGAS315
accuccuaaacuaauaa

SEQ ID NO: 4119089 - RNA, 20 nt, Streptococcus pyogenes MGAS315
accuccuaaugcugcaaaau

SEQ ID NO: 4119090 - RNA, 17 nt, Streptococcus pyogenes MGAS315
accucuaacaccaaaau

SEQ ID NO: 4119091 - RNA, 20 nt, Streptococcus pyogenes MGAS315
accuuacgaguaugaacaaa

SEQ ID NO: 4119092 - RNA, 18 nt, Streptococcus pyogenes MGAS315
accuuagugguuugcaaa

SEQ ID NO: 4119093 - RNA, 20 nt, Streptococcus pyogenes MGAS315
accuuaugcagguguuuaaa

SEQ ID NO: 4119094 - RNA, 13 nt, Streptococcus pyogenes MGAS315
accuucauagaca

SEQ ID NO: 4119095 - RNA, 19 nt, Streptococcus pyogenes MGAS315
accuugaugcugcuuaucu

SEQ ID NO: 4119096 - RNA, 12 nt, Streptococcus pyogenes MGAS315
accuuugccauu

SEQ ID NO: 4119097 - RNA, 13 nt, Streptococcus pyogenes MGAS315
accuuugccauuu

SEQ ID NO: 4119098 - RNA, 16 nt, Streptococcus pyogenes MGAS315
acgaguaugaacaaag

SEQ ID NO: 4119099 - RNA, 21 nt, Streptococcus pyogenes MGAS315
acgaugagauuaacugacaaa

SEQ ID NO: 4119100 - RNA, 16 nt, Streptococcus pyogenes MGAS315
acgcauuucuuuuuug

SEQ ID NO: 4119101 - RNA, 18 nt, Streptococcus pyogenes MGAS315
acggcuucuacacaaaag

SEQ ID NO: 4119102 - RNA, 12 nt, Streptococcus pyogenes MGAS315
acgggcugccau

SEQ ID NO: 4119103 - RNA, 17 nt, Streptococcus pyogenes MGAS315
acgugcuauaagaggau

SEQ ID NO: 4119104 - RNA, 18 nt, Streptococcus pyogenes MGAS315
acguguauucuuaaaaaa

SEQ ID NO: 4119105 - RNA, 19 nt, Streptococcus pyogenes MGAS315
acguguauucuuaaaaaaa

SEQ ID NO: 4119106 - RNA, 20 nt, Streptococcus pyogenes MGAS315
acguguauucuuaaaaaaau

SEQ ID NO: 4119107 - RNA, 17 nt, Streptococcus pyogenes MGAS315
acguucuguuuaaaaua

SEQ ID NO: 4119108 - RNA, 11 nt, Streptococcus pyogenes MGAS315
acuaaagcauu

SEQ ID NO: 4119109 - RNA, 16 nt, Streptococcus pyogenes MGAS315
acuaaguccuuuucgu

SEQ ID NO: 4119110 - RNA, 14 nt, Streptococcus pyogenes MGAS315
acuaauauuauauu

SEQ ID NO: 4119111 - RNA, 19 nt, Streptococcus pyogenes MGAS315
acuacuagagcuuugccaa

SEQ ID NO: 4119112 - RNA, 14 nt, Streptococcus pyogenes MGAS315
acuagaaaaagcaa

SEQ ID NO: 4119113 - RNA, 16 nt, Streptococcus pyogenes MGAS315
acuagaaaaagcaaug

SEQ ID NO: 4119114 - RNA, 17 nt, Streptococcus pyogenes MGAS315
acuagagcuuugccaau

SEQ ID NO: 4119115 - RNA, 20 nt, Streptococcus pyogenes MGAS315
acuaggaaucgcuuuaggaa

SEQ ID NO: 4119116 - RNA, 23 nt, Streptococcus pyogenes MGAS315
acuaggauugccgucgaccugcu

SEQ ID NO: 4119117 - RNA, 19 nt, Streptococcus pyogenes MGAS315
acuaguuuauuacaaaacu

SEQ ID NO: 4119118 - RNA, 21 nt, Streptococcus pyogenes MGAS315
acuaguuuauuacaaaacugu

SEQ ID NO: 4119119 - RNA, 14 nt, Streptococcus pyogenes MGAS315
acuauaauuucaau

SEQ ID NO: 4119120 - RNA, 14 nt, Streptococcus pyogenes MGAS315
acucaaaaaauaca

SEQ ID NO: 4119121 - RNA, 16 nt, Streptococcus pyogenes MGAS315
acucaaaaaauacaau

SEQ ID NO: 4119122 - RNA, 17 nt, Streptococcus pyogenes MGAS315
acucaauagcugcugcu

SEQ ID NO: 4119123 - RNA, 20 nt, Streptococcus pyogenes MGAS315
acucaauauaauaaaaagca

SEQ ID NO: 4119124 - RNA, 16 nt, Streptococcus pyogenes MGAS315
acucagucacugcagc

SEQ ID NO: 4119125 - RNA, 18 nt, Streptococcus pyogenes MGAS315
acucaucauauuguuaau

SEQ ID NO: 4119126 - RNA, 22 nt, Streptococcus pyogenes MGAS315
acuccagcuggaguuuuuuuau

SEQ ID NO: 4119127 - RNA, 18 nt, Streptococcus pyogenes MGAS315
acugagccccaaaaguug

SEQ ID NO: 4119128 - RNA, 16 nt, Streptococcus pyogenes MGAS315
acugagccuuuuuuug

SEQ ID NO: 4119129 - RNA, 14 nt, Streptococcus pyogenes MGAS315
acugcuagucgggu

SEQ ID NO: 4119130 - RNA, 22 nt, Streptococcus pyogenes MGAS315
acugcucuggcuuuuuccuauc

SEQ ID NO: 4119131 - RNA, 21 nt, Streptococcus pyogenes MGAS315
acugcuggauuuagaaauuuu

SEQ ID NO: 4119132 - RNA, 22 nt, Streptococcus pyogenes MGAS315
acugcuggauuuagaaauuuua

SEQ ID NO: 4119133 - RNA, 17 nt, Streptococcus pyogenes MGAS315
acuggcuagccaaaucu

SEQ ID NO: 4119134 - RNA, 21 nt, Streptococcus pyogenes MGAS315
acugggucaacuccaaucuca

SEQ ID NO: 4119135 - RNA, 13 nt, Streptococcus pyogenes MGAS315
acuguaauauuuc

SEQ ID NO: 4119136 - RNA, 23 nt, Streptococcus pyogenes MGAS315
acuuaucauuuugggacuaggaa

SEQ ID NO: 4119137 - RNA, 16 nt, Streptococcus pyogenes MGAS315
acuuauuuuuuuaaga

SEQ ID NO: 4119138 - RNA, 14 nt, Streptococcus pyogenes MGAS315
acuucaaaaauacu

SEQ ID NO: 4119139 - RNA, 16 nt, Streptococcus pyogenes MGAS315
acuucaaggaaggcuu

SEQ ID NO: 4119140 - RNA, 21 nt, Streptococcus pyogenes MGAS315
acuucaaggaaggcuuguucu

SEQ ID NO: 4119141 - RNA, 23 nt, Streptococcus pyogenes MGAS315
acuuccaucaucaaguggauaca

SEQ ID NO: 4119142 - RNA, 21 nt, Streptococcus pyogenes MGAS315
acuucucaaagggauugcaaa

SEQ ID NO: 4119143 - RNA, 20 nt, Streptococcus pyogenes MGAS315
acuucuuccuuguacaagag

SEQ ID NO: 4119144 - RNA, 16 nt, Streptococcus pyogenes MGAS315
acuuguuacaaaaaac

SEQ ID NO: 4119145 - RNA, 18 nt, Streptococcus pyogenes MGAS315
acuuguuacaaaaaacaa

SEQ ID NO: 4119146 - RNA, 19 nt, Streptococcus pyogenes MGAS315
acuuguuacaaaaaacaag

SEQ ID NO: 4119147 - RNA, 21 nt, Streptococcus pyogenes MGAS315
acuuuaaacacuaccuuaaau

SEQ ID NO: 4119148 - RNA, 22 nt, Streptococcus pyogenes MGAS315
acuuucaguuaucugauauuuc

SEQ ID NO: 4119149 - RNA, 21 nt, Streptococcus pyogenes MGAS315
acuuugacagacaccaaaaaa

SEQ ID NO: 4119150 - RNA, 15 nt, Streptococcus pyogenes MGAS315
acuuugguauucuuu

SEQ ID NO: 4119151 - RNA, 16 nt, Streptococcus pyogenes MGAS315
acuuugguauucuuuu

SEQ ID NO: 4119152 - RNA, 12 nt, Streptococcus pyogenes MGAS315
acuuuuaaaauc

SEQ ID NO: 4119153 - RNA, 12 nt, Streptococcus pyogenes MGAS315
agaaaaagcaau

SEQ ID NO: 4119154 - RNA, 13 nt, Streptococcus pyogenes MGAS315
agaaaaagcaaug

SEQ ID NO: 4119155 - RNA, 15 nt, Streptococcus pyogenes MGAS315
agaaaaagcaaugau

SEQ ID NO: 4119156 - RNA, 15 nt, Streptococcus pyogenes MGAS315
agaaacuaaaggcaa

SEQ ID NO: 4119157 - RNA, 21 nt, Streptococcus pyogenes MGAS315
agaaagccaagacuaaagcau

SEQ ID NO: 4119158 - RNA, 22 nt, Streptococcus pyogenes MGAS315
agaaaguaaaaauacuagaaaa

SEQ ID NO: 4119159 - RNA, 21 nt, Streptococcus pyogenes MGAS315
agaaauuguaaccacagcaau

SEQ ID NO: 4119160 - RNA, 22 nt, Streptococcus pyogenes MGAS315
agaacgaauugugucauuucuu

SEQ ID NO: 4119161 - RNA, 17 nt, Streptococcus pyogenes MGAS315
agaagauccuacaagag

SEQ ID NO: 4119162 - RNA, 14 nt, Streptococcus pyogenes MGAS315
agaagcaaaauuau

SEQ ID NO: 4119163 - RNA, 16 nt, Streptococcus pyogenes MGAS315
agaauaaccagcugau

SEQ ID NO: 4119164 - RNA, 21 nt, Streptococcus pyogenes MGAS315
agaauuggggcggcacuucca

SEQ ID NO: 4119165 - RNA, 20 nt, Streptococcus pyogenes MGAS315
agacaucacgauuugcugag

SEQ ID NO: 4119166 - RNA, 19 nt, Streptococcus pyogenes MGAS315
agacucaauugaaagaggu

SEQ ID NO: 4119167 - RNA, 14 nt, Streptococcus pyogenes MGAS315
agacugauucaucu

SEQ ID NO: 4119168 - RNA, 22 nt, Streptococcus pyogenes MGAS315
agacuucuuccuuguacaagag

SEQ ID NO: 4119169 - RNA, 15 nt, Streptococcus pyogenes MGAS315
agagaaguaauguuu

SEQ ID NO: 4119170 - RNA, 19 nt, Streptococcus pyogenes MGAS315
agagaaugauaguaaacga

SEQ ID NO: 4119171 - RNA, 20 nt, Streptococcus pyogenes MGAS315
agagagaagcuguucucuuu

SEQ ID NO: 4119172 - RNA, 21 nt, Streptococcus pyogenes MGAS315
agagagaaugauaguaaacga

SEQ ID NO: 4119173 - RNA, 16 nt, Streptococcus pyogenes MGAS315
agagaugauagguuuu

SEQ ID NO: 4119174 - RNA, 16 nt, Streptococcus pyogenes MGAS315
agaggugcaacugcua

SEQ ID NO: 4119175 - RNA, 21 nt, Streptococcus pyogenes MGAS315
agagguugguaaaaaggcagu

SEQ ID NO: 4119176 - RNA, 14 nt, Streptococcus pyogenes MGAS315
agaguacaaggcaa

SEQ ID NO: 4119177 - RNA, 18 nt, Streptococcus pyogenes MGAS315
agagucauuuaguuuaga

SEQ ID NO: 4119178 - RNA, 14 nt, Streptococcus pyogenes MGAS315
aguuaauaagacaa

SEQ ID NO: 4119179 - RNA, 16 nt, Streptococcus pyogenes MGAS315
aguuaauaagacaaag

SEQ ID NO: 4119180 - RNA, 22 nt, Streptococcus pyogenes MGAS315
aguuaccguguucgauaaauuc

SEQ ID NO: 4119181 - RNA, 14 nt, Streptococcus pyogenes MGAS315
aguuagauuuugga

SEQ ID NO: 4119182 - RNA, 23 nt, Streptococcus pyogenes MGAS315
aguuagcaaauuguuugauugau

SEQ ID NO: 4119183 - RNA, 23 nt, Streptococcus pyogenes MGAS315
aguuagccaagcaaucuaagaau

SEQ ID NO: 4119184 - RNA, 20 nt, Streptococcus pyogenes MGAS315
aguuauaaagaaacaaaaau

SEQ ID NO: 4119185 - RNA, 23 nt, Streptococcus pyogenes MGAS315
aguuauaaagaaacaaaaaugaa

SEQ ID NO: 4119186 - RNA, 21 nt, Streptococcus pyogenes MGAS315
aguuauguuauaagagaagua

SEQ ID NO: 4119187 - RNA, 12 nt, Streptococcus pyogenes MGAS315
aguuauuuuuga

SEQ ID NO: 4119188 - RNA, 16 nt, Streptococcus pyogenes MGAS315
aguucaauggauauaa

SEQ ID NO: 4119189 - RNA, 18 nt, Streptococcus pyogenes MGAS315
aguucgauuauuaaccaa

SEQ ID NO: 4119190 - RNA, 14 nt, Streptococcus pyogenes MGAS315
aguucuucuaaacg

SEQ ID NO: 4119191 - RNA, 21 nt, Streptococcus pyogenes MGAS315
aguugcgaucauaaauaaaga

SEQ ID NO: 4119192 - RNA, 22 nt, Streptococcus pyogenes MGAS315
aguuguaagguuuguugaaaug

SEQ ID NO: 4119193 - RNA, 23 nt, Streptococcus pyogenes MGAS315
aguuugguuuuuugguguugcaa

SEQ ID NO: 4119194 - RNA, 18 nt, Streptococcus pyogenes MGAS315
aguuuuuucuaaaagaga

SEQ ID NO: 4119195 - RNA, 22 nt, Streptococcus pyogenes MGAS315
auaaaaaaccuuaucaaaccaa

SEQ ID NO: 4119196 - RNA, 18 nt, Streptococcus pyogenes MGAS315
auaaaaaagaagcaaaau

SEQ ID NO: 4119197 - RNA, 23 nt, Streptococcus pyogenes MGAS315
auaaaaacgaucaaaaaucuuuu

SEQ ID NO: 4119198 - RNA, 22 nt, Streptococcus pyogenes MGAS315
auaaaaauauucccaaugcccc

SEQ ID NO: 4119199 - RNA, 17 nt, Streptococcus pyogenes MGAS315
auaaaaccuucaaaaaa

SEQ ID NO: 4119200 - RNA, 18 nt, Streptococcus pyogenes MGAS315
auaaaaccuucaaaaaag

SEQ ID NO: 4119201 - RNA, 18 nt, Streptococcus pyogenes MGAS315
auaaaagauauuuuaaaa

SEQ ID NO: 4119202 - RNA, 20 nt, Streptococcus pyogenes MGAS315
auaaaagauauuuuaaaaua

SEQ ID NO: 4119203 - RNA, 16 nt, Streptococcus pyogenes MGAS315
auaaaauauuuuucca

SEQ ID NO: 4119204 - RNA, 18 nt, Streptococcus pyogenes MGAS315
auaaaaucguuauuaauu

SEQ ID NO: 4119205 - RNA, 23 nt, Streptococcus pyogenes MGAS315
auaaaaucguuauuaauuguuuu

SEQ ID NO: 4119206 - RNA, 12 nt, Streptococcus pyogenes MGAS315
auaaaaugccuc

SEQ ID NO: 4119207 - RNA, 16 nt, Streptococcus pyogenes MGAS315
auaaagauaauuuauu

SEQ ID NO: 4119208 - RNA, 23 nt, Streptococcus pyogenes MGAS315
auaaagcguugacaguuaaaaau

SEQ ID NO: 4119209 - RNA, 16 nt, Streptococcus pyogenes MGAS315
auaaaucuuacuaacu

SEQ ID NO: 4119210 - RNA, 14 nt, Streptococcus pyogenes MGAS315
auaaccgccaucua

SEQ ID NO: 4119211 - RNA, 20 nt, Streptococcus pyogenes MGAS315
auaaggcugcgaugauuuug

SEQ ID NO: 4119212 - RNA, 12 nt, Streptococcus pyogenes MGAS315
auaagguuuuuu

SEQ ID NO: 4119213 - RNA, 13 nt, Streptococcus pyogenes MGAS315
auaagguuuuuuu

SEQ ID NO: 4119214 - RNA, 21 nt, Streptococcus pyogenes MGAS315
auaaguauagcauaaaauagu

SEQ ID NO: 4119215 - RNA, 20 nt, Streptococcus pyogenes MGAS315
auaaguauaucauuaucaac

SEQ ID NO: 4119216 - RNA, 15 nt, Streptococcus pyogenes MGAS315
auaaguauuuuaaaa

SEQ ID NO: 4119217 - RNA, 19 nt, Streptococcus pyogenes MGAS315
auaaguauuuuaaaauccu

SEQ ID NO: 4119218 - RNA, 12 nt, Streptococcus pyogenes MGAS315
auaauaaaaagc

SEQ ID NO: 4119219 - RNA, 15 nt, Streptococcus pyogenes MGAS315
auaaucccuugcuuu

SEQ ID NO: 4119220 - RNA, 18 nt, Streptococcus pyogenes MGAS315
auaaucgaugauaauagu

SEQ ID NO: 4119221 - RNA, 17 nt, Streptococcus pyogenes MGAS315
auaaucguaacuggucc

SEQ ID NO: 4119222 - RNA, 16 nt, Streptococcus pyogenes MGAS315
auaaugagcaaggcaa

SEQ ID NO: 4119223 - RNA, 16 nt, Streptococcus pyogenes MGAS315
auaaugccaucaaaaa

SEQ ID NO: 4119224 - RNA, 19 nt, Streptococcus pyogenes MGAS315
auaaugccaucaaaaaaag

SEQ ID NO: 4119225 - RNA, 16 nt, Streptococcus pyogenes MGAS315
auaauuccugugacaa

SEQ ID NO: 4119226 - RNA, 21 nt, Streptococcus pyogenes MGAS315
auaauuccugugacaacccaa

SEQ ID NO: 4119227 - RNA, 15 nt, Streptococcus pyogenes MGAS315
auaauuucaauaaua

SEQ ID NO: 4119228 - RNA, 21 nt, Streptococcus pyogenes MGAS315
auaauuugacuucaaaaauac

SEQ ID NO: 4119229 - RNA, 22 nt, Streptococcus pyogenes MGAS315
auaauuugacuucaaaaauacu

SEQ ID NO: 4119230 - RNA, 16 nt, Streptococcus pyogenes MGAS315
auacaaaaaaccuucc

SEQ ID NO: 4119231 - RNA, 23 nt, Streptococcus pyogenes MGAS315
auacaacuggcuagccaaaucug

SEQ ID NO: 4119232 - RNA, 19 nt, Streptococcus pyogenes MGAS315
auacaagguuaaguaaaag

SEQ ID NO: 4119233 - RNA, 18 nt, Streptococcus pyogenes MGAS315
auacagaaaaaagcuugu

SEQ ID NO: 4119234 - RNA, 14 nt, Streptococcus pyogenes MGAS315
auacagcauacauc

SEQ ID NO: 4119235 - RNA, 23 nt, Streptococcus pyogenes MGAS315
auacaguccaaacucaaaccaaa

SEQ ID NO: 4119236 - RNA, 15 nt, Streptococcus pyogenes MGAS315
auaccaaaucaaaaa

SEQ ID NO: 4119237 - RNA, 17 nt, Streptococcus pyogenes MGAS315
auaccaaaucaaaaagc

SEQ ID NO: 4119238 - RNA, 18 nt, Streptococcus pyogenes MGAS315
auaccaaaucaaaaagcu

SEQ ID NO: 4119239 - RNA, 19 nt, Streptococcus pyogenes MGAS315
auaccaaaucaaaaagcua

SEQ ID NO: 4119240 - RNA, 16 nt, Streptococcus pyogenes MGAS315
auaccaucaaugacuu

SEQ ID NO: 4119241 - RNA, 14 nt, Streptococcus pyogenes MGAS315
auaccuaaaaaaua

SEQ ID NO: 4119242 - RNA, 15 nt, Streptococcus pyogenes MGAS315
auaccuucauagaca

SEQ ID NO: 4119243 - RNA, 12 nt, Streptococcus pyogenes MGAS315
auacgguaaaaa

SEQ ID NO: 4119244 - RNA, 23 nt, Streptococcus pyogenes MGAS315
auacguuuauuuaguuauuuuug

SEQ ID NO: 4119245 - RNA, 15 nt, Streptococcus pyogenes MGAS315
auacuaauauuauau

SEQ ID NO: 4119246 - RNA, 16 nt, Streptococcus pyogenes MGAS315
auacuagaaaaagcaa

SEQ ID NO: 4119247 - RNA, 17 nt, Streptococcus pyogenes MGAS315
auacuagucuuuggcac

SEQ ID NO: 4119248 - RNA, 21 nt, Streptococcus pyogenes MGAS315
auacucaauauaauaaaaagc

SEQ ID NO: 4119249 - RNA, 13 nt, Streptococcus pyogenes MGAS315
auacucagucacu

SEQ ID NO: 4119250 - RNA, 22 nt, Streptococcus pyogenes MGAS315
auacuuugguauucuuuuuccg

SEQ ID NO: 4119251 - RNA, 14 nt, Streptococcus pyogenes MGAS315
auagaaaguaaaaa

SEQ ID NO: 4119252 - RNA, 15 nt, Streptococcus pyogenes MGAS315
auagaaaguaaaaau

SEQ ID NO: 4119253 - RNA, 17 nt, Streptococcus pyogenes MGAS315
auagaagacaaggugaa

SEQ ID NO: 4119254 - RNA, 18 nt, Streptococcus pyogenes MGAS315
auagaagacaaggugaau

SEQ ID NO: 4119255 - RNA, 14 nt, Streptococcus pyogenes MGAS315
auagaauaaccagc

SEQ ID NO: 4119256 - RNA, 14 nt, Streptococcus pyogenes MGAS315
auagacaagcuuuu

SEQ ID NO: 4119257 - RNA, 14 nt, Streptococcus pyogenes MGAS315
auagacaggagcuu

SEQ ID NO: 4119258 - RNA, 22 nt, Streptococcus pyogenes MGAS315
auagaccccuuaguucaaugga

SEQ ID NO: 4119259 - RNA, 20 nt, Streptococcus pyogenes MGAS315
auagagccaagauuuuaagg

SEQ ID NO: 4119260 - RNA, 17 nt, Streptococcus pyogenes MGAS315
auagcaaugguuaaaaa

SEQ ID NO: 4119261 - RNA, 19 nt, Streptococcus pyogenes MGAS315
auagcaaugguuaaaaaga

SEQ ID NO: 4119262 - RNA, 21 nt, Streptococcus pyogenes MGAS315
auagcaccuacgauaaaacaa

SEQ ID NO: 4119263 - RNA, 18 nt, Streptococcus pyogenes MGAS315
auagcauugucaaauaaa

SEQ ID NO: 4119264 - RNA, 19 nt, Streptococcus pyogenes MGAS315
auagcgccagcaauuuucc

SEQ ID NO: 4119265 - RNA, 20 nt, Streptococcus pyogenes MGAS315
auagcguaaagcaagggaaa

SEQ ID NO: 4119266 - RNA, 12 nt, Streptococcus pyogenes MGAS315
auagcugcugcu

SEQ ID NO: 4119267 - RNA, 21 nt, Streptococcus pyogenes MGAS315
auagcugcugcuaaagcaauc

SEQ ID NO: 4119268 - RNA, 19 nt, Streptococcus pyogenes MGAS315
auaggaaucguaggguguu

SEQ ID NO: 4119269 - RNA, 19 nt, Streptococcus pyogenes MGAS315
auaggcagagaugauaggu

SEQ ID NO: 4119270 - RNA, 12 nt, Streptococcus pyogenes MGAS315
auaggcuuuuuu

SEQ ID NO: 4119271 - RNA, 14 nt, Streptococcus pyogenes MGAS315
auaguaaacgaaaa

SEQ ID NO: 4119272 - RNA, 19 nt, Streptococcus pyogenes MGAS315
auaguuagcaaauuguuug

SEQ ID NO: 4119273 - RNA, 13 nt, Streptococcus pyogenes MGAS315
auaguucccuuaa

SEQ ID NO: 4119274 - RNA, 10 nt, Streptococcus pyogenes MGAS315
auauaaaauu

SEQ ID NO: 4119275 - RNA, 15 nt, Streptococcus pyogenes MGAS315
auauaagcaaucauc

SEQ ID NO: 4119276 - RNA, 23 nt, Streptococcus pyogenes MGAS315
auuaagauuugaccacaccuaau

SEQ ID NO: 4119277 - RNA, 15 nt, Streptococcus pyogenes MGAS315
auuaauaaauuuuug

SEQ ID NO: 4119278 - RNA, 19 nt, Streptococcus pyogenes MGAS315
auuaauaaguauuuuaaaa

SEQ ID NO: 4119279 - RNA, 14 nt, Streptococcus pyogenes MGAS315
auuaauaauauuaa

SEQ ID NO: 4119280 - RNA, 22 nt, Streptococcus pyogenes MGAS315
auuaaucaaaaaacugagacaa

SEQ ID NO: 4119281 - RNA, 14 nt, Streptococcus pyogenes MGAS315
auuaauuguuuuag

SEQ ID NO: 4119282 - RNA, 17 nt, Streptococcus pyogenes MGAS315
auuacaagcauuuugca

SEQ ID NO: 4119283 - RNA, 16 nt, Streptococcus pyogenes MGAS315
auuauacuaauauuau

SEQ ID NO: 4119284 - RNA, 19 nt, Streptococcus pyogenes MGAS315
auuauacucaauauaauaa

SEQ ID NO: 4119285 - RNA, 18 nt, Streptococcus pyogenes MGAS315
auuauauuaaugauucaa

SEQ ID NO: 4119286 - RNA, 14 nt, Streptococcus pyogenes MGAS315
auuauauuaggaua

SEQ ID NO: 4119287 - RNA, 22 nt, Streptococcus pyogenes MGAS315
auuaucaacaaucuuaaaauaa

SEQ ID NO: 4119288 - RNA, 17 nt, Streptococcus pyogenes MGAS315
auuaucaauaacagaaa

SEQ ID NO: 4119289 - RNA, 23 nt, Streptococcus pyogenes MGAS315
auuaucugaauuauuaguaacca

SEQ ID NO: 4119290 - RNA, 20 nt, Streptococcus pyogenes MGAS315
auuaugaaggugauugacuu

SEQ ID NO: 4119291 - RNA, 13 nt, Streptococcus pyogenes MGAS315
auuaugaggugac

SEQ ID NO: 4119292 - RNA, 16 nt, Streptococcus pyogenes MGAS315
auuaugaggugacacu

SEQ ID NO: 4119293 - RNA, 21 nt, Streptococcus pyogenes MGAS315
auuauuaguaaccauagaagc

SEQ ID NO: 4119294 - RNA, 13 nt, Streptococcus pyogenes MGAS315
auuauuuugcuuc

SEQ ID NO: 4119295 - RNA, 21 nt, Streptococcus pyogenes MGAS315
auucaccguggacuugauggu

SEQ ID NO: 4119296 - RNA, 16 nt, Streptococcus pyogenes MGAS315
auuccuuaaauuauau

SEQ ID NO: 4119297 - RNA, 18 nt, Streptococcus pyogenes MGAS315
auucuuaaaaaaaucccu

SEQ ID NO: 4119298 - RNA, 17 nt, Streptococcus pyogenes MGAS315
auucuuauccauuauaa

SEQ ID NO: 4119299 - RNA, 10 nt, Streptococcus pyogenes MGAS315
auucuugcag

SEQ ID NO: 4119300 - RNA, 12 nt, Streptococcus pyogenes MGAS315
auucuuuuuccg

SEQ ID NO: 4119301 - RNA, 23 nt, Streptococcus pyogenes MGAS315
auugacuugguucugaaaauaaa

SEQ ID NO: 4119302 - RNA, 18 nt, Streptococcus pyogenes MGAS315
auuggggcggcacuucca

SEQ ID NO: 4119303 - RNA, 15 nt, Streptococcus pyogenes MGAS315
auuguaaccacagca

SEQ ID NO: 4119304 - RNA, 23 nt, Streptococcus pyogenes MGAS315
auuguaaccacagcaauuuguuc

SEQ ID NO: 4119305 - RNA, 23 nt, Streptococcus pyogenes MGAS315
auuguaauaacaaaaugaagcaa

SEQ ID NO: 4119306 - RNA, 15 nt, Streptococcus pyogenes MGAS315
auugucaaauaaaau

SEQ ID NO: 4119307 - RNA, 22 nt, Streptococcus pyogenes MGAS315
auuguucauuaaagcuaucaua

SEQ ID NO: 4119308 - RNA, 18 nt, Streptococcus pyogenes MGAS315
auuuaagguauuguucaa

SEQ ID NO: 4119309 - RNA, 14 nt, Streptococcus pyogenes MGAS315
auuuagaaauuuua

SEQ ID NO: 4119310 - RNA, 24 nt, Streptococcus pyogenes MGAS315
auuuagccuauuaucugauaaggu

SEQ ID NO: 4119311 - RNA, 14 nt, Streptococcus pyogenes MGAS315
auuuaguucuaagu

SEQ ID NO: 4119312 - RNA, 19 nt, Streptococcus pyogenes MGAS315
auuuauuaagauaccaaau

SEQ ID NO: 4119313 - RNA, 20 nt, Streptococcus pyogenes MGAS315
auuucaaaaaauuuuuagac

SEQ ID NO: 4119314 - RNA, 16 nt, Streptococcus pyogenes MGAS315
auuucaauaauaccau

SEQ ID NO: 4119315 - RNA, 22 nt, Streptococcus pyogenes MGAS315
auuucaauaauaccauuuuuau

SEQ ID NO: 4119316 - RNA, 18 nt, Streptococcus pyogenes MGAS315
auuucagauaaaaccuuc

SEQ ID NO: 4119317 - RNA, 20 nt, Streptococcus pyogenes MGAS315
auuuccucuaacauguccaa

SEQ ID NO: 4119318 - RNA, 14 nt, Streptococcus pyogenes MGAS315
auuucguugacaaa

SEQ ID NO: 4119319 - RNA, 14 nt, Streptococcus pyogenes MGAS315
auuucguuuuacgg

SEQ ID NO: 4119320 - RNA, 19 nt, Streptococcus pyogenes MGAS315
auuucuugaggugauucuu

SEQ ID NO: 4119321 - RNA, 20 nt, Streptococcus pyogenes MGAS315
auuucuugaggugauucuuu

SEQ ID NO: 4119322 - RNA, 23 nt, Streptococcus pyogenes MGAS315
auuugaacguucuguuuaaaaua

SEQ ID NO: 4119323 - RNA, 12 nt, Streptococcus pyogenes MGAS315
auuugaaguaaa

SEQ ID NO: 4119324 - RNA, 22 nt, Streptococcus pyogenes MGAS315
auuugaccacaccuaauaaaau

SEQ ID NO: 4119325 - RNA, 19 nt, Streptococcus pyogenes MGAS315
auuugacuuguuacaaaaa

SEQ ID NO: 4119326 - RNA, 20 nt, Streptococcus pyogenes MGAS315
auuugacuuguuacaaaaaa

SEQ ID NO: 4119327 - RNA, 20 nt, Streptococcus pyogenes MGAS315
auuugagcacccaagauacg

SEQ ID NO: 4119328 - RNA, 13 nt, Streptococcus pyogenes MGAS315
auuuggaggugaa

SEQ ID NO: 4119329 - RNA, 23 nt, Streptococcus pyogenes MGAS315
auuugucaaaaaguaaaaagcaa

SEQ ID NO: 4119330 - RNA, 14 nt, Streptococcus pyogenes MGAS315
auuuguuuucuuua

SEQ ID NO: 4119331 - RNA, 18 nt, Streptococcus pyogenes MGAS315
auuuuaaucuuuuuguga

SEQ ID NO: 4119332 - RNA, 23 nt, Streptococcus pyogenes MGAS315
auuuuaaucuuuuugugauaugu

SEQ ID NO: 4119333 - RNA, 22 nt, Streptococcus pyogenes MGAS315
auuuuacuauggcuucuaaaaa

SEQ ID NO: 4119334 - RNA, 23 nt, Streptococcus pyogenes MGAS315
auuuuacuauggcuucuaaaaaa

SEQ ID NO: 4119335 - RNA, 18 nt, Streptococcus pyogenes MGAS315
auuuugcaagucucuugc

SEQ ID NO: 4119336 - RNA, 18 nt, Streptococcus pyogenes MGAS315
auuuugcagguaauuauc

SEQ ID NO: 4119337 - RNA, 19 nt, Streptococcus pyogenes MGAS315
auuuugcagguaauuaucu

SEQ ID NO: 4119338 - RNA, 14 nt, Streptococcus pyogenes MGAS315
auuuuugccaaaau

SEQ ID NO: 4119339 - RNA, 15 nt, Streptococcus pyogenes MGAS315
auuuuuguauuuguc

SEQ ID NO: 4119340 - RNA, 20 nt, Streptococcus pyogenes MGAS315
auuuuuuaccguaacguuug

SEQ ID NO: 4119341 - RNA, 12 nt, Streptococcus pyogenes MGAS315
caaaaaaagaca

SEQ ID NO: 4119342 - RNA, 16 nt, Streptococcus pyogenes MGAS315
caaaaaaagacacaca

SEQ ID NO: 4119343 - RNA, 18 nt, Streptococcus pyogenes MGAS315
caaaaaaagcaagcaaca

SEQ ID NO: 4119344 - RNA, 17 nt, Streptococcus pyogenes MGAS315
caaaaaaagcaaugacu

SEQ ID NO: 4119345 - RNA, 11 nt, Streptococcus pyogenes MGAS315
caaaaaagcca

SEQ ID NO: 4119346 - RNA, 20 nt, Streptococcus pyogenes MGAS315
caaaaaauuaagaaggaacu

SEQ ID NO: 4119347 - RNA, 16 nt, Streptococcus pyogenes MGAS315
caaaaacaccccaaac

SEQ ID NO: 4119348 - RNA, 20 nt, Streptococcus pyogenes MGAS315
caaaaacaccccaaacguua

SEQ ID NO: 4119349 - RNA, 22 nt, Streptococcus pyogenes MGAS315
caaaaacgccacgcucaacugg

SEQ ID NO: 4119350 - RNA, 18 nt, Streptococcus pyogenes MGAS315
caaaaaggcuaagaugga

SEQ ID NO: 4119351 - RNA, 19 nt, Streptococcus pyogenes MGAS315
caaaaaguaaaaagcaaau

SEQ ID NO: 4119352 - RNA, 17 nt, Streptococcus pyogenes MGAS315
caaaaauaaguauagca

SEQ ID NO: 4119353 - RNA, 16 nt, Streptococcus pyogenes MGAS315
caaaacuucaaauuuc

SEQ ID NO: 4119354 - RNA, 13 nt, Streptococcus pyogenes MGAS315
caaaagcuaaacu

SEQ ID NO: 4119355 - RNA, 16 nt, Streptococcus pyogenes MGAS315
caaaagugugaccaga

SEQ ID NO: 4119356 - RNA, 11 nt, Streptococcus pyogenes MGAS315
caaaauuauua

SEQ ID NO: 4119357 - RNA, 18 nt, Streptococcus pyogenes MGAS315
caaaauuauuauuuugcu

SEQ ID NO: 4119358 - RNA, 14 nt, Streptococcus pyogenes MGAS315
caaacuauauuguu

SEQ ID NO: 4119359 - RNA, 14 nt, Streptococcus pyogenes MGAS315
caaacucaaaccaa

SEQ ID NO: 4119360 - RNA, 13 nt, Streptococcus pyogenes MGAS315
caaaggcuuuuuu

SEQ ID NO: 4119361 - RNA, 13 nt, Streptococcus pyogenes MGAS315
caaaguaauccaa

SEQ ID NO: 4119362 - RNA, 18 nt, Streptococcus pyogenes MGAS315
caaauacagaaaaaagcu

SEQ ID NO: 4119363 - RNA, 17 nt, Streptococcus pyogenes MGAS315
caaauaguggcaaauga

SEQ ID NO: 4119364 - RNA, 14 nt, Streptococcus pyogenes MGAS315
caaaucaacauggc

SEQ ID NO: 4119365 - RNA, 17 nt, Streptococcus pyogenes MGAS315
caaaucuucugcauuau

SEQ ID NO: 4119366 - RNA, 13 nt, Streptococcus pyogenes MGAS315
caaauucuuuuug

SEQ ID NO: 4119367 - RNA, 14 nt, Streptococcus pyogenes MGAS315
caaauucuuuuuga

SEQ ID NO: 4119368 - RNA, 14 nt, Streptococcus pyogenes MGAS315
caaauuuauccuga

SEQ ID NO: 4119369 - RNA, 15 nt, Streptococcus pyogenes MGAS315
caaauuuauccugau

SEQ ID NO: 4119370 - RNA, 22 nt, Streptococcus pyogenes MGAS315
caacaaguguuuugucuuauag

SEQ ID NO: 4119371 - RNA, 16 nt, Streptococcus pyogenes MGAS315
caacacgcuaucaaca

SEQ ID NO: 4119372 - RNA, 23 nt, Streptococcus pyogenes MGAS315
caacaguugcuugcuuuuuucua

SEQ ID NO: 4119373 - RNA, 14 nt, Streptococcus pyogenes MGAS315
caacauacuuuauu

SEQ ID NO: 4119374 - RNA, 18 nt, Streptococcus pyogenes MGAS315
caacauccauaccaucaa

SEQ ID NO: 4119375 - RNA, 13 nt, Streptococcus pyogenes MGAS315
caucugaaaaaau

SEQ ID NO: 4119376 - RNA, 17 nt, Streptococcus pyogenes MGAS315
caucuugccaucagcau

SEQ ID NO: 4119377 - RNA, 19 nt, Streptococcus pyogenes MGAS315
caucuugccaucagcaucu

SEQ ID NO: 4119378 - RNA, 20 nt, Streptococcus pyogenes MGAS315
caugaaguauaguuauguua

SEQ ID NO: 4119379 - RNA, 22 nt, Streptococcus pyogenes MGAS315
caugaaguauaguuauguuaua

SEQ ID NO: 4119380 - RNA, 21 nt, Streptococcus pyogenes MGAS315
caugaugccauuuaaaagggc

SEQ ID NO: 4119381 - RNA, 18 nt, Streptococcus pyogenes MGAS315
caugauguuauuaaauaa

SEQ ID NO: 4119382 - RNA, 12 nt, Streptococcus pyogenes MGAS315
cauggguaugcc

SEQ ID NO: 4119383 - RNA, 16 nt, Streptococcus pyogenes MGAS315
caugugaauucccauu

SEQ ID NO: 4119384 - RNA, 16 nt, Streptococcus pyogenes MGAS315
cauguugacuauuuuu

SEQ ID NO: 4119385 - RNA, 20 nt, Streptococcus pyogenes MGAS315
cauuagaauaagaaaaccuu

SEQ ID NO: 4119386 - RNA, 16 nt, Streptococcus pyogenes MGAS315
cauuaucaucuggucc

SEQ ID NO: 4119387 - RNA, 14 nt, Streptococcus pyogenes MGAS315
cauuauugacaaau

SEQ ID NO: 4119388 - RNA, 21 nt, Streptococcus pyogenes MGAS315
cauugccauuaauaauauuaa

SEQ ID NO: 4119389 - RNA, 21 nt, Streptococcus pyogenes MGAS315
cauuuaaauguucgaaaaaau

SEQ ID NO: 4119390 - RNA, 16 nt, Streptococcus pyogenes MGAS315
cauuuccuacaaaaua

SEQ ID NO: 4119391 - RNA, 19 nt, Streptococcus pyogenes MGAS315
cauuucggacuguuuuuua

SEQ ID NO: 4119392 - RNA, 20 nt, Streptococcus pyogenes MGAS315
cauuucgugucuaaaauaau

SEQ ID NO: 4119393 - RNA, 13 nt, Streptococcus pyogenes MGAS315
cauuucuugaggu

SEQ ID NO: 4119394 - RNA, 23 nt, Streptococcus pyogenes MGAS315
cauuucuugaggugauucuuuuu

SEQ ID NO: 4119395 - RNA, 21 nt, Streptococcus pyogenes MGAS315
cauuugacuacuagcaugucc

SEQ ID NO: 4119396 - RNA, 14 nt, Streptococcus pyogenes MGAS315
cauuugccauggca

SEQ ID NO: 4119397 - RNA, 22 nt, Streptococcus pyogenes MGAS315
cauuuugcaagucucuugcaag

SEQ ID NO: 4119398 - RNA, 17 nt, Streptococcus pyogenes MGAS315
cauuuuuaucuguauau

SEQ ID NO: 4119399 - RNA, 15 nt, Streptococcus pyogenes MGAS315
ccaaacucaaaccaa

SEQ ID NO: 4119400 - RNA, 21 nt, Streptococcus pyogenes MGAS315
ccaaaucuuguggguuuugaa

SEQ ID NO: 4119401 - RNA, 20 nt, Streptococcus pyogenes MGAS315
ccaaauuucagauaaaaccu

SEQ ID NO: 4119402 - RNA, 20 nt, Streptococcus pyogenes MGAS315
ccaaggucugcgcgacuaaa

SEQ ID NO: 4119403 - RNA, 16 nt, Streptococcus pyogenes MGAS315
ccaagugccaguaagg

SEQ ID NO: 4119404 - RNA, 13 nt, Streptococcus pyogenes MGAS315
ccaaugacuaagg

SEQ ID NO: 4119405 - RNA, 15 nt, Streptococcus pyogenes MGAS315
ccacaccuaauaaaa

SEQ ID NO: 4119406 - RNA, 19 nt, Streptococcus pyogenes MGAS315
ccacaccuacuaacaacaa

SEQ ID NO: 4119407 - RNA, 15 nt, Streptococcus pyogenes MGAS315
ccacgcucaacuggc

SEQ ID NO: 4119408 - RNA, 13 nt, Streptococcus pyogenes MGAS315
ccagauacuucug

SEQ ID NO: 4119409 - RNA, 14 nt, Streptococcus pyogenes MGAS315
ccagauacuucuga

SEQ ID NO: 4119410 - RNA, 21 nt, Streptococcus pyogenes MGAS315
ccagauacuucugauaaaaau

SEQ ID NO: 4119411 - RNA, 16 nt, Streptococcus pyogenes MGAS315
ccagccacuacaagca

SEQ ID NO: 4119412 - RNA, 21 nt, Streptococcus pyogenes MGAS315
ccauagaaauuguaaccacag

SEQ ID NO: 4119413 - RNA, 13 nt, Streptococcus pyogenes MGAS315
ccaucaaaaaaag

SEQ ID NO: 4119414 - RNA, 14 nt, Streptococcus pyogenes MGAS315
ccaucaauuuucau

SEQ ID NO: 4119415 - RNA, 15 nt, Streptococcus pyogenes MGAS315
ccaugcucauaggca

SEQ ID NO: 4119416 - RNA, 16 nt, Streptococcus pyogenes MGAS315
ccauuuccuacaaaau

SEQ ID NO: 4119417 - RNA, 18 nt, Streptococcus pyogenes MGAS315
ccccuauucaauauuuua

SEQ ID NO: 4119418 - RNA, 13 nt, Streptococcus pyogenes MGAS315
ccgaguuuugcug

SEQ ID NO: 4119419 - RNA, 17 nt, Streptococcus pyogenes MGAS315
ccguaagccgcaaaauc

SEQ ID NO: 4119420 - RNA, 12 nt, Streptococcus pyogenes MGAS315
ccgugaggacuu

SEQ ID NO: 4119421 - RNA, 14 nt, Streptococcus pyogenes MGAS315
ccguuaagagggcc

SEQ ID NO: 4119422 - RNA, 21 nt, Streptococcus pyogenes MGAS315
ccguuugagauaacucuucgg

SEQ ID NO: 4119423 - RNA, 14 nt, Streptococcus pyogenes MGAS315
ccuaaaaaauaacu

SEQ ID NO: 4119424 - RNA, 20 nt, Streptococcus pyogenes MGAS315
ccuaaagcccauagaggacu

SEQ ID NO: 4119425 - RNA, 22 nt, Streptococcus pyogenes MGAS315
ccuaaauccuuuugaaaaauua

SEQ ID NO: 4119426 - RNA, 20 nt, Streptococcus pyogenes MGAS315
ccuaaugcugcaaaauuuua

SEQ ID NO: 4119427 - RNA, 21 nt, Streptococcus pyogenes MGAS315
ccuacuaacaacaacaacccu

SEQ ID NO: 4119428 - RNA, 20 nt, Streptococcus pyogenes MGAS315
ccuacuagcacaaaaucauu

SEQ ID NO: 4119429 - RNA, 13 nt, Streptococcus pyogenes MGAS315
ccuaggaauaaaa

SEQ ID NO: 4119430 - RNA, 22 nt, Streptococcus pyogenes MGAS315
ccuauuugacuuguuacaaaaa

SEQ ID NO: 4119431 - RNA, 15 nt, Streptococcus pyogenes MGAS315
ccucauuugccgaaa

SEQ ID NO: 4119432 - RNA, 23 nt, Streptococcus pyogenes MGAS315
ccuccuaaacuaauaagauucaa

SEQ ID NO: 4119433 - RNA, 17 nt, Streptococcus pyogenes MGAS315
ccuccuugcaauagagc

SEQ ID NO: 4119434 - RNA, 17 nt, Streptococcus pyogenes MGAS315
ccugaucccuucauuuu

SEQ ID NO: 4119435 - RNA, 11 nt, Streptococcus pyogenes MGAS315
ccugcauaucu

SEQ ID NO: 4119436 - RNA, 14 nt, Streptococcus pyogenes MGAS315
ccuuaauaaacucu

SEQ ID NO: 4119437 - RNA, 14 nt, Streptococcus pyogenes MGAS315
ccuucaaaaaaggg

SEQ ID NO: 4119438 - RNA, 17 nt, Streptococcus pyogenes MGAS315
ccuucaaaaaagggaag

SEQ ID NO: 4119439 - RNA, 21 nt, Streptococcus pyogenes MGAS315
ccuucuuggauagcaagugag

SEQ ID NO: 4119440 - RNA, 21 nt, Streptococcus pyogenes MGAS315
ccuugauuaauagcgccagca

SEQ ID NO: 4119441 - RNA, 21 nt, Streptococcus pyogenes MGAS315
ccuugcaauagagccaagauu

SEQ ID NO: 4119442 - RNA, 22 nt, Streptococcus pyogenes MGAS315
ccuuguacaagagcuuaaaagu

SEQ ID NO: 4119443 - RNA, 14 nt, Streptococcus pyogenes MGAS315
ccuuuaucuuauuu

SEQ ID NO: 4119444 - RNA, 17 nt, Streptococcus pyogenes MGAS315
ccuuuuugccuuuaaca

SEQ ID NO: 4119445 - RNA, 20 nt, Streptococcus pyogenes MGAS315
ccuuuuugccuuuaacauga

SEQ ID NO: 4119446 - RNA, 16 nt, Streptococcus pyogenes MGAS315
cgaauaugauauaaaa

SEQ ID NO: 4119447 - RNA, 20 nt, Streptococcus pyogenes MGAS315
cgaauugugucauuucuuga

SEQ ID NO: 4119448 - RNA, 21 nt, Streptococcus pyogenes MGAS315
cgaccugcucaaaacuucggc

SEQ ID NO: 4119449 - RNA, 22 nt, Streptococcus pyogenes MGAS315
cgagcuauuggcaguccaucaa

SEQ ID NO: 4119450 - RNA, 18 nt, Streptococcus pyogenes MGAS315
cgauaaucuuugacaaug

SEQ ID NO: 4119451 - RNA, 16 nt, Streptococcus pyogenes MGAS315
cgaugagauuaacuga

SEQ ID NO: 4119452 - RNA, 20 nt, Streptococcus pyogenes MGAS315
cgaugagauuaacugacaaa

SEQ ID NO: 4119453 - RNA, 21 nt, Streptococcus pyogenes MGAS315
cgauuugcugagcuaaagcca

SEQ ID NO: 4119454 - RNA, 16 nt, Streptococcus pyogenes MGAS315
cgcagaguacaaggca

SEQ ID NO: 4119455 - RNA, 20 nt, Streptococcus pyogenes MGAS315
cgcagauggggugucagggg

SEQ ID NO: 4119456 - RNA, 21 nt, Streptococcus pyogenes MGAS315
cgcucaacuggcacaaacucu

SEQ ID NO: 4119457 - RNA, 15 nt, Streptococcus pyogenes MGAS315
cgcuguaauguugua

SEQ ID NO: 4119458 - RNA, 23 nt, Streptococcus pyogenes MGAS315
cgcuguaauguuguaaacuuccu

SEQ ID NO: 4119459 - RNA, 13 nt, Streptococcus pyogenes MGAS315
cgcuuccagaaca

SEQ ID NO: 4119460 - RNA, 17 nt, Streptococcus pyogenes MGAS315
cggaaaacuuuugacuu

SEQ ID NO: 4119461 - RNA, 12 nt, Streptococcus pyogenes MGAS315
cgggcugccauu

SEQ ID NO: 4119462 - RNA, 15 nt, Streptococcus pyogenes MGAS315
cguaagcauuuugag

SEQ ID NO: 4119463 - RNA, 18 nt, Streptococcus pyogenes MGAS315
cguaggguguuuuuuagu

SEQ ID NO: 4119464 - RNA, 13 nt, Streptococcus pyogenes MGAS315
cguauacuuuaaa

SEQ ID NO: 4119465 - RNA, 15 nt, Streptococcus pyogenes MGAS315
cguauaggugaguuu

SEQ ID NO: 4119466 - RNA, 17 nt, Streptococcus pyogenes MGAS315
cgucuuacaauuaauag

SEQ ID NO: 4119467 - RNA, 17 nt, Streptococcus pyogenes MGAS315
cgucuuuguccauucuu

SEQ ID NO: 4119468 - RNA, 17 nt, Streptococcus pyogenes MGAS315
cguuagcagacaaaagg

SEQ ID NO: 4119469 - RNA, 19 nt, Streptococcus pyogenes MGAS315
cguuaucuccacagagucu

SEQ ID NO: 4119470 - RNA, 15 nt, Streptococcus pyogenes MGAS315
cguuuagcuuuuuca

SEQ ID NO: 4119471 - RNA, 16 nt, Streptococcus pyogenes MGAS315
cguuuagcuuuuucaa

SEQ ID NO: 4119472 - RNA, 19 nt, Streptococcus pyogenes MGAS315
cguuuauuuaguuauuuuu

SEQ ID NO: 4119473 - RNA, 22 nt, Streptococcus pyogenes MGAS315
cguuuggggugcaguucauagu

SEQ ID NO: 4119474 - RNA, 21 nt, Streptococcus pyogenes MGAS315
cuuaggcagacaauuauuuug

SEQ ID NO: 4119475 - RNA, 17 nt, Streptococcus pyogenes MGAS315
cuuaguguagauaaacu

SEQ ID NO: 4119476 - RNA, 12 nt, Streptococcus pyogenes MGAS315
cuuauaauaaau

SEQ ID NO: 4119477 - RNA, 18 nt, Streptococcus pyogenes MGAS315
cuuaucaagguugcaagu

SEQ ID NO: 4119478 - RNA, 17 nt, Streptococcus pyogenes MGAS315
cuuaucacgguucagcu

SEQ ID NO: 4119479 - RNA, 11 nt, Streptococcus pyogenes MGAS315
cuuaucaucau

SEQ ID NO: 4119480 - RNA, 15 nt, Streptococcus pyogenes MGAS315
cuuauuuuaagaagc

SEQ ID NO: 4119481 - RNA, 11 nt, Streptococcus pyogenes MGAS315
cuuauuuuuuu

SEQ ID NO: 4119482 - RNA, 12 nt, Streptococcus pyogenes MGAS315
cuucaaaaauac

SEQ ID NO: 4119483 - RNA, 20 nt, Streptococcus pyogenes MGAS315
cuucaaggaaggcuuguucu

SEQ ID NO: 4119484 - RNA, 18 nt, Streptococcus pyogenes MGAS315
cuucaccuuaggcagaca

SEQ ID NO: 4119485 - RNA, 15 nt, Streptococcus pyogenes MGAS315
cuucuaaaaaaguua

SEQ ID NO: 4119486 - RNA, 15 nt, Streptococcus pyogenes MGAS315
cuucuacacaaaagc

SEQ ID NO: 4119487 - RNA, 16 nt, Streptococcus pyogenes MGAS315
cuucugcauuaucauc

SEQ ID NO: 4119488 - RNA, 19 nt, Streptococcus pyogenes MGAS315
cuucuuuuuguugcuagcu

SEQ ID NO: 4119489 - RNA, 22 nt, Streptococcus pyogenes MGAS315
cuugaauaucgccaauaaaaaa

SEQ ID NO: 4119490 - RNA, 17 nt, Streptococcus pyogenes MGAS315
cuugaggugauucuuuu

SEQ ID NO: 4119491 - RNA, 20 nt, Streptococcus pyogenes MGAS315
cuugaugucuuggauagacu

SEQ ID NO: 4119492 - RNA, 11 nt, Streptococcus pyogenes MGAS315
cuugcaauaga

SEQ ID NO: 4119493 - RNA, 16 nt, Streptococcus pyogenes MGAS315
cuugccaucagcaucu

SEQ ID NO: 4119494 - RNA, 19 nt, Streptococcus pyogenes MGAS315
cuugcguagacagcaagga

SEQ ID NO: 4119495 - RNA, 15 nt, Streptococcus pyogenes MGAS315
cuuggauagcaagug

SEQ ID NO: 4119496 - RNA, 18 nt, Streptococcus pyogenes MGAS315
cuugguucugaaaauaaa

SEQ ID NO: 4119497 - RNA, 21 nt, Streptococcus pyogenes MGAS315
cuugguucugaaaauaaaaua

SEQ ID NO: 4119498 - RNA, 19 nt, Streptococcus pyogenes MGAS315
cuuguaaaaugauacuuuc

SEQ ID NO: 4119499 - RNA, 16 nt, Streptococcus pyogenes MGAS315
cuuguccuguaaauca

SEQ ID NO: 4119500 - RNA, 20 nt, Streptococcus pyogenes MGAS315
cuugucgcugaauaaacaaa

SEQ ID NO: 4119501 - RNA, 17 nt, Streptococcus pyogenes MGAS315
cuuguucuuuauuuuga

SEQ ID NO: 4119502 - RNA, 14 nt, Streptococcus pyogenes MGAS315
cuuguuuugguuga

SEQ ID NO: 4119503 - RNA, 21 nt, Streptococcus pyogenes MGAS315
cuuguuuugguugauauaaaa

SEQ ID NO: 4119504 - RNA, 21 nt, Streptococcus pyogenes MGAS315
cuuguuuugguuuaucauuuu

SEQ ID NO: 4119505 - RNA, 15 nt, Streptococcus pyogenes MGAS315
cuuuaacaugaugua

SEQ ID NO: 4119506 - RNA, 17 nt, Streptococcus pyogenes MGAS315
cuuuacuguaauauuuc

SEQ ID NO: 4119507 - RNA, 23 nt, Streptococcus pyogenes MGAS315
cuuuaucaacuuguuaacaauaa

SEQ ID NO: 4119508 - RNA, 13 nt, Streptococcus pyogenes MGAS315
cuuuauugaugau

SEQ ID NO: 4119509 - RNA, 14 nt, Streptococcus pyogenes MGAS315
cuuuccauucuugc

SEQ ID NO: 4119510 - RNA, 22 nt, Streptococcus pyogenes MGAS315
cuuucguaaggguuauuauuua

SEQ ID NO: 4119511 - RNA, 19 nt, Streptococcus pyogenes MGAS315
cuuugacaaugucaauuga

SEQ ID NO: 4119512 - RNA, 21 nt, Streptococcus pyogenes MGAS315
cuuugacagacaccaaaaaaa

SEQ ID NO: 4119513 - RNA, 20 nt, Streptococcus pyogenes MGAS315
cuuugaguuuggugucaauc

SEQ ID NO: 4119514 - RNA, 19 nt, Streptococcus pyogenes MGAS315
cuuugcaggguaucugcuc

SEQ ID NO: 4119515 - RNA, 15 nt, Streptococcus pyogenes MGAS315
cuuugccaauaucaa

SEQ ID NO: 4119516 - RNA, 17 nt, Streptococcus pyogenes MGAS315
cuuuggcaccaagugcu

SEQ ID NO: 4119517 - RNA, 15 nt, Streptococcus pyogenes MGAS315
cuuugguauucuuuu

SEQ ID NO: 4119518 - RNA, 13 nt, Streptococcus pyogenes MGAS315
cuuuguugcauug

SEQ ID NO: 4119519 - RNA, 12 nt, Streptococcus pyogenes MGAS315
cuuuuaaaaucu

SEQ ID NO: 4119520 - RNA, 14 nt, Streptococcus pyogenes MGAS315
cuuuuaauuuggag

SEQ ID NO: 4119521 - RNA, 19 nt, Streptococcus pyogenes MGAS315
cuuuucguuuuauuuugau

SEQ ID NO: 4119522 - RNA, 17 nt, Streptococcus pyogenes MGAS315
cuuuugacuugguuuaa

SEQ ID NO: 4119523 - RNA, 18 nt, Streptococcus pyogenes MGAS315
cuuuugauaccuuuuuug

SEQ ID NO: 4119524 - RNA, 22 nt, Streptococcus pyogenes MGAS315
cuuuuggccuacuagcacaaaa

SEQ ID NO: 4119525 - RNA, 14 nt, Streptococcus pyogenes MGAS315
cuuuuuucuaaccu

SEQ ID NO: 4119526 - RNA, 19 nt, Streptococcus pyogenes MGAS315
cuuuuuuugucguuuuuug

SEQ ID NO: 4119527 - RNA, 20 nt, Streptococcus pyogenes MGAS315
cuuuuuuugucugacuuaaa

SEQ ID NO: 4119528 - RNA, 14 nt, Streptococcus pyogenes MGAS315
gaaaaagcaaugau

SEQ ID NO: 4119529 - RNA, 20 nt, Streptococcus pyogenes MGAS315
gaaaagaugcacacaaaucu

SEQ ID NO: 4119530 - RNA, 16 nt, Streptococcus pyogenes MGAS315
gaaaaguugauauccc

SEQ ID NO: 4119531 - RNA, 13 nt, Streptococcus pyogenes MGAS315
gaaaauaaaauau

SEQ ID NO: 4119532 - RNA, 13 nt, Streptococcus pyogenes MGAS315
gaaacaccaccaa

SEQ ID NO: 4119533 - RNA, 19 nt, Streptococcus pyogenes MGAS315
gaaacaccaccaauaauga

SEQ ID NO: 4119534 - RNA, 20 nt, Streptococcus pyogenes MGAS315
gaaacguuauuaaagacaaa

SEQ ID NO: 4119535 - RNA, 21 nt, Streptococcus pyogenes MGAS315
gaaacguuuaggaucuguuaa

SEQ ID NO: 4119536 - RNA, 18 nt, Streptococcus pyogenes MGAS315
gaaagaggugcaacugcu

SEQ ID NO: 4119537 - RNA, 14 nt, Streptococcus pyogenes MGAS315
gaaaguaaaaauac

SEQ ID NO: 4119538 - RNA, 15 nt, Streptococcus pyogenes MGAS315
gaaaugauagcaccu

SEQ ID NO: 4119539 - RNA, 16 nt, Streptococcus pyogenes MGAS315
gaaaugauagcaccua

SEQ ID NO: 4119540 - RNA, 20 nt, Streptococcus pyogenes MGAS315
gaaauuguaaccacagcaau

SEQ ID NO: 4119541 - RNA, 19 nt, Streptococcus pyogenes MGAS315
gaacaugugaauucccauu

SEQ ID NO: 4119542 - RNA, 19 nt, Streptococcus pyogenes MGAS315
gaaccaacuuggacgaagg

SEQ ID NO: 4119543 - RNA, 16 nt, Streptococcus pyogenes MGAS315
gaaccgcuaaaacagu

SEQ ID NO: 4119544 - RNA, 19 nt, Streptococcus pyogenes MGAS315
gaacgaagucaagggaauu

SEQ ID NO: 4119545 - RNA, 20 nt, Streptococcus pyogenes MGAS315
gaacguucuguuuaaaauau

SEQ ID NO: 4119546 - RNA, 19 nt, Streptococcus pyogenes MGAS315
gaagaaggucaugaugcca

SEQ ID NO: 4119547 - RNA, 15 nt, Streptococcus pyogenes MGAS315
gaagagagaagcugu

SEQ ID NO: 4119548 - RNA, 15 nt, Streptococcus pyogenes MGAS315
gaagcuguucucuuu

SEQ ID NO: 4119549 - RNA, 16 nt, Streptococcus pyogenes MGAS315
gaaggcucuuaucuuu

SEQ ID NO: 4119550 - RNA, 13 nt, Streptococcus pyogenes MGAS315
gaauaaaaugccu

SEQ ID NO: 4119551 - RNA, 13 nt, Streptococcus pyogenes MGAS315
gaauaagaaaacc

SEQ ID NO: 4119552 - RNA, 19 nt, Streptococcus pyogenes MGAS315
gaauaugauauaaaaaugg

SEQ ID NO: 4119553 - RNA, 17 nt, Streptococcus pyogenes MGAS315
gaauuauuaguaaccau

SEQ ID NO: 4119554 - RNA, 17 nt, Streptococcus pyogenes MGAS315
gaauucccauugacaua

SEQ ID NO: 4119555 - RNA, 14 nt, Streptococcus pyogenes MGAS315
gaauuuccuaaugu

SEQ ID NO: 4119556 - RNA, 14 nt, Streptococcus pyogenes MGAS315
gacaacccaacgca

SEQ ID NO: 4119557 - RNA, 13 nt, Streptococcus pyogenes MGAS315
gacaaugugacaa

SEQ ID NO: 4119558 - RNA, 19 nt, Streptococcus pyogenes MGAS315
gacaauuauuuugcaggua

SEQ ID NO: 4119559 - RNA, 20 nt, Streptococcus pyogenes MGAS315
gacagacaccaaaaaaagca

SEQ ID NO: 4119560 - RNA, 15 nt, Streptococcus pyogenes MGAS315
gacaguuaaaaauaa

SEQ ID NO: 4119561 - RNA, 16 nt, Streptococcus pyogenes MGAS315
gacaguuaaaaauaac

SEQ ID NO: 4119562 - RNA, 21 nt, Streptococcus pyogenes MGAS315
gacaucaaaggguguuuuuua

SEQ ID NO: 4119563 - RNA, 14 nt, Streptococcus pyogenes MGAS315
gaccauuaucaaua

SEQ ID NO: 4119564 - RNA, 12 nt, Streptococcus pyogenes MGAS315
gaccccuuaguu

SEQ ID NO: 4119565 - RNA, 19 nt, Streptococcus pyogenes MGAS315
gaccccuuaguucaaugga

SEQ ID NO: 4119566 - RNA, 23 nt, Streptococcus pyogenes MGAS315
gaccuuauuggucgcccuuuuua

SEQ ID NO: 4119567 - RNA, 20 nt, Streptococcus pyogenes MGAS315
gacgauaagucaguuuuuuc

SEQ ID NO: 4119568 - RNA, 23 nt, Streptococcus pyogenes MGAS315
gacuagucuaggcguauagguga

SEQ ID NO: 4119569 - RNA, 19 nt, Streptococcus pyogenes MGAS315
gacucaauugaaagaggug

SEQ ID NO: 4119570 - RNA, 19 nt, Streptococcus pyogenes MGAS315
gacugacaaaacuucaaau

SEQ ID NO: 4119571 - RNA, 22 nt, Streptococcus pyogenes MGAS315
gacugcaguagcaugacuguau

SEQ ID NO: 4119572 - RNA, 18 nt, Streptococcus pyogenes MGAS315
gacuucggucucuuuuug

SEQ ID NO: 4119573 - RNA, 16 nt, Streptococcus pyogenes MGAS315
gcugaauaaacaaaau

SEQ ID NO: 4119574 - RNA, 18 nt, Streptococcus pyogenes MGAS315
gcugaucucccgucaaca

SEQ ID NO: 4119575 - RNA, 17 nt, Streptococcus pyogenes MGAS315
gcugaugacuuguaaaa

SEQ ID NO: 4119576 - RNA, 14 nt, Streptococcus pyogenes MGAS315
gcugcaaaauuuua

SEQ ID NO: 4119577 - RNA, 16 nt, Streptococcus pyogenes MGAS315
gcugcuaaagcaauca

SEQ ID NO: 4119578 - RNA, 15 nt, Streptococcus pyogenes MGAS315
gcugcugcuaaagca

SEQ ID NO: 4119579 - RNA, 13 nt, Streptococcus pyogenes MGAS315
gcuggauuuagaa

SEQ ID NO: 4119580 - RNA, 13 nt, Streptococcus pyogenes MGAS315
gcuuagcaacuau

SEQ ID NO: 4119581 - RNA, 21 nt, Streptococcus pyogenes MGAS315
gcuugcuuuuuucuaaccucu

SEQ ID NO: 4119582 - RNA, 18 nt, Streptococcus pyogenes MGAS315
gcuuggauuuccucuaac

SEQ ID NO: 4119583 - RNA, 23 nt, Streptococcus pyogenes MGAS315
gcuugucuaugagauaccuucau

SEQ ID NO: 4119584 - RNA, 16 nt, Streptococcus pyogenes MGAS315
gcuuuugauaccuuuu

SEQ ID NO: 4119585 - RNA, 21 nt, Streptococcus pyogenes MGAS315
gcuuuuggcaaccuuaccuac

SEQ ID NO: 4119586 - RNA, 20 nt, Streptococcus pyogenes MGAS315
gcuuuuuacaucaaaaaaag

SEQ ID NO: 4119587 - RNA, 11 nt, Streptococcus pyogenes MGAS315
ggaacacucau

SEQ ID NO: 4119588 - RNA, 15 nt, Streptococcus pyogenes MGAS315
ggaacacucaucaua

SEQ ID NO: 4119589 - RNA, 22 nt, Streptococcus pyogenes MGAS315
ggacacuuugaaaguuccuuag

SEQ ID NO: 4119590 - RNA, 19 nt, Streptococcus pyogenes MGAS315
ggagggacugucaaaaaau

SEQ ID NO: 4119591 - RNA, 23 nt, Streptococcus pyogenes MGAS315
ggauauaacaacucccuccuaag

SEQ ID NO: 4119592 - RNA, 18 nt, Streptococcus pyogenes MGAS315
ggcaaagaaagccaagac

SEQ ID NO: 4119593 - RNA, 23 nt, Streptococcus pyogenes MGAS315
ggcaaccuuaccuacugcuggau

SEQ ID NO: 4119594 - RNA, 16 nt, Streptococcus pyogenes MGAS315
ggccaauaaaauaucu

SEQ ID NO: 4119595 - RNA, 17 nt, Streptococcus pyogenes MGAS315
ggccuguauuucuuuag

SEQ ID NO: 4119596 - RNA, 17 nt, Streptococcus pyogenes MGAS315
ggcucauauuagcaaaa

SEQ ID NO: 4119597 - RNA, 15 nt, Streptococcus pyogenes MGAS315
ggcuucuaaaaaagu

SEQ ID NO: 4119598 - RNA, 17 nt, Streptococcus pyogenes MGAS315
ggcuuuccauucuugca

SEQ ID NO: 4119599 - RNA, 12 nt, Streptococcus pyogenes MGAS315
gggcaaugccau

SEQ ID NO: 4119600 - RNA, 17 nt, Streptococcus pyogenes MGAS315
ggggugcaguucauagu

SEQ ID NO: 4119601 - RNA, 14 nt, Streptococcus pyogenes MGAS315
gguaaaaaggcagu

SEQ ID NO: 4119602 - RNA, 16 nt, Streptococcus pyogenes MGAS315
gguaaagauuuuaaau

SEQ ID NO: 4119603 - RNA, 22 nt, Streptococcus pyogenes MGAS315
gguaagaagaaaauaucaguua

SEQ ID NO: 4119604 - RNA, 14 nt, Streptococcus pyogenes MGAS315
ggucaacuccaauc

SEQ ID NO: 4119605 - RNA, 15 nt, Streptococcus pyogenes MGAS315
ggucauuagaauaag

SEQ ID NO: 4119606 - RNA, 18 nt, Streptococcus pyogenes MGAS315
ggucauuauugucacuga

SEQ ID NO: 4119607 - RNA, 19 nt, Streptococcus pyogenes MGAS315
ggugaguuuuuucuaaaag

SEQ ID NO: 4119608 - RNA, 20 nt, Streptococcus pyogenes MGAS315
gguuucgccuaggaauaaaa

SEQ ID NO: 4119609 - RNA, 14 nt, Streptococcus pyogenes MGAS315
gguuuguugaaaug

SEQ ID NO: 4119610 - RNA, 13 nt, Streptococcus pyogenes MGAS315
guaaaaagcaaau

SEQ ID NO: 4119611 - RNA, 21 nt, Streptococcus pyogenes MGAS315
guaaaaauacuagaaaaagca

SEQ ID NO: 4119612 - RNA, 11 nt, Streptococcus pyogenes MGAS315
guaaaaugacu

SEQ ID NO: 4119613 - RNA, 20 nt, Streptococcus pyogenes MGAS315
guaaacaaucuuaaugguua

SEQ ID NO: 4119614 - RNA, 20 nt, Streptococcus pyogenes MGAS315
guaaagauuuuaaauaucuu

SEQ ID NO: 4119615 - RNA, 19 nt, Streptococcus pyogenes MGAS315
guaaaggauuuaguucugu

SEQ ID NO: 4119616 - RNA, 17 nt, Streptococcus pyogenes MGAS315
guaacgcuuguuuauga

SEQ ID NO: 4119617 - RNA, 19 nt, Streptococcus pyogenes MGAS315
guaacgcuuguuuaugaaa

SEQ ID NO: 4119618 - RNA, 18 nt, Streptococcus pyogenes MGAS315
guaagccaaaucuucugc

SEQ ID NO: 4119619 - RNA, 20 nt, Streptococcus pyogenes MGAS315
guaaggaaaucaauccugua

SEQ ID NO: 4119620 - RNA, 21 nt, Streptococcus pyogenes MGAS315
guaagguuuguugaaaugugg

SEQ ID NO: 4119621 - RNA, 14 nt, Streptococcus pyogenes MGAS315
guaauagaauaaaa

SEQ ID NO: 4119622 - RNA, 17 nt, Streptococcus pyogenes MGAS315
guaauagcguaaagcaa

SEQ ID NO: 4119623 - RNA, 18 nt, Streptococcus pyogenes MGAS315
guaauagcguaaagcaag

SEQ ID NO: 4119624 - RNA, 19 nt, Streptococcus pyogenes MGAS315
guaauccccucauuuaaau

SEQ ID NO: 4119625 - RNA, 18 nt, Streptococcus pyogenes MGAS315
guaaugucuuguuuuggu

SEQ ID NO: 4119626 - RNA, 21 nt, Streptococcus pyogenes MGAS315
guaaugucuuguuuugguuua

SEQ ID NO: 4119627 - RNA, 19 nt, Streptococcus pyogenes MGAS315
guaauuugguggaagagua

SEQ ID NO: 4119628 - RNA, 14 nt, Streptococcus pyogenes MGAS315
guagcguacaugga

SEQ ID NO: 4119629 - RNA, 22 nt, Streptococcus pyogenes MGAS315
guagcguuuguguugaagaagg

SEQ ID NO: 4119630 - RNA, 16 nt, Streptococcus pyogenes MGAS315
guauagcauaaaauag

SEQ ID NO: 4119631 - RNA, 14 nt, Streptococcus pyogenes MGAS315
guaucuaagcuaua

SEQ ID NO: 4119632 - RNA, 17 nt, Streptococcus pyogenes MGAS315
guaucuaagcuauagaa

SEQ ID NO: 4119633 - RNA, 20 nt, Streptococcus pyogenes MGAS315
guaucuaagcuauagaaacu

SEQ ID NO: 4119634 - RNA, 13 nt, Streptococcus pyogenes MGAS315
guauguaaauaua

SEQ ID NO: 4119635 - RNA, 19 nt, Streptococcus pyogenes MGAS315
guauuacuucuuuuuguug

SEQ ID NO: 4119636 - RNA, 14 nt, Streptococcus pyogenes MGAS315
guauucuuaaaaaa

SEQ ID NO: 4119637 - RNA, 18 nt, Streptococcus pyogenes MGAS315
gucaaaaaguaaaaagca

SEQ ID NO: 4119638 - RNA, 13 nt, Streptococcus pyogenes MGAS315
gucaacuccaauc

SEQ ID NO: 4119639 - RNA, 17 nt, Streptococcus pyogenes MGAS315
gucacugcagcaucaaa

SEQ ID NO: 4119640 - RNA, 17 nt, Streptococcus pyogenes MGAS315
guccaucauugaugaga

SEQ ID NO: 4119641 - RNA, 19 nt, Streptococcus pyogenes MGAS315
gucccacaccuacuaacaa

SEQ ID NO: 4119642 - RNA, 17 nt, Streptococcus pyogenes MGAS315
guccuuaaaagaaaauc

SEQ ID NO: 4119643 - RNA, 15 nt, Streptococcus pyogenes MGAS315
gucgaccugcucaaa

SEQ ID NO: 4119644 - RNA, 16 nt, Streptococcus pyogenes MGAS315
gucgaccugcucaaaa

SEQ ID NO: 4119645 - RNA, 17 nt, Streptococcus pyogenes MGAS315
gucgcagaguacaaggc

SEQ ID NO: 4119646 - RNA, 13 nt, Streptococcus pyogenes MGAS315
gucguuuuuugcu

SEQ ID NO: 4119647 - RNA, 14 nt, Streptococcus pyogenes MGAS315
gucguuuuuugcuu

SEQ ID NO: 4119648 - RNA, 21 nt, Streptococcus pyogenes MGAS315
gucguuuuuugcuuuugauac

SEQ ID NO: 4119649 - RNA, 20 nt, Streptococcus pyogenes MGAS315
gucuagcuuaucuucauagc

SEQ ID NO: 4119650 - RNA, 18 nt, Streptococcus pyogenes MGAS315
gucuaucugcagauuuua

SEQ ID NO: 4119651 - RNA, 17 nt, Streptococcus pyogenes MGAS315
gucuggaaacuggucaa

SEQ ID NO: 4119652 - RNA, 16 nt, Streptococcus pyogenes MGAS315
gucuuuguccauucuu

SEQ ID NO: 4119653 - RNA, 22 nt, Streptococcus pyogenes MGAS315
gugaaaguaucuaggagggacu

SEQ ID NO: 4119654 - RNA, 17 nt, Streptococcus pyogenes MGAS315
gugaggacuuauuuuuu

SEQ ID NO: 4119655 - RNA, 20 nt, Streptococcus pyogenes MGAS315
gugauugauugauacaaaga

SEQ ID NO: 4119656 - RNA, 22 nt, Streptococcus pyogenes MGAS315
gugcaacugcuaguugugccuu

SEQ ID NO: 4119657 - RNA, 20 nt, Streptococcus pyogenes MGAS315
gugccaguaaggaaaucaau

SEQ ID NO: 4119658 - RNA, 21 nt, Streptococcus pyogenes MGAS315
gugccuuuucuuuuuggcuga

SEQ ID NO: 4119659 - RNA, 22 nt, Streptococcus pyogenes MGAS315
gugcuagauguuggaacuuugu

SEQ ID NO: 4119660 - RNA, 21 nt, Streptococcus pyogenes MGAS315
guggauacaagguuaaguaaa

SEQ ID NO: 4119661 - RNA, 16 nt, Streptococcus pyogenes MGAS315
gugggauauuuagaug

SEQ ID NO: 4119662 - RNA, 20 nt, Streptococcus pyogenes MGAS315
guguaauccccucauuuaaa

SEQ ID NO: 4119663 - RNA, 21 nt, Streptococcus pyogenes MGAS315
guguaauccccucauuuaaau

SEQ ID NO: 4119664 - RNA, 14 nt, Streptococcus pyogenes MGAS315
guguauuacuucuu

SEQ ID NO: 4119665 - RNA, 18 nt, Streptococcus pyogenes MGAS315
guguauucuuaaaaaaau

SEQ ID NO: 4119666 - RNA, 20 nt, Streptococcus pyogenes MGAS315
guguuuaaagaccucucaug

SEQ ID NO: 4119667 - RNA, 12 nt, Streptococcus pyogenes MGAS315
guuaacagguga

SEQ ID NO: 4119668 - RNA, 15 nt, Streptococcus pyogenes MGAS315
guuaauauagucugc

SEQ ID NO: 4119669 - RNA, 19 nt, Streptococcus pyogenes MGAS315
guuaggagcacaaaagagg

SEQ ID NO: 4119670 - RNA, 19 nt, Streptococcus pyogenes MGAS315
guuauccucuuuuaguuca

SEQ ID NO: 4119671 - RNA, 20 nt, Streptococcus pyogenes MGAS315
uaagauuaaacuuacaaaaa

SEQ ID NO: 4119672 - RNA, 13 nt, Streptococcus pyogenes MGAS315
uaagauucaauau

SEQ ID NO: 4119673 - RNA, 20 nt, Streptococcus pyogenes MGAS315
uaagauuugaccacaccuaa

SEQ ID NO: 4119674 - RNA, 13 nt, Streptococcus pyogenes MGAS315
uaagcauuuugag

SEQ ID NO: 4119675 - RNA, 15 nt, Streptococcus pyogenes MGAS315
uaagcauuuugagaa

SEQ ID NO: 4119676 - RNA, 12 nt, Streptococcus pyogenes MGAS315
uaagccaaaucu

SEQ ID NO: 4119677 - RNA, 17 nt, Streptococcus pyogenes MGAS315
uaaggcugcgaugauuu

SEQ ID NO: 4119678 - RNA, 15 nt, Streptococcus pyogenes MGAS315
uaaguauuuuaaaau

SEQ ID NO: 4119679 - RNA, 17 nt, Streptococcus pyogenes MGAS315
uaaguauuuuaaaaucc

SEQ ID NO: 4119680 - RNA, 17 nt, Streptococcus pyogenes MGAS315
uaagugagcgcccuaaa

SEQ ID NO: 4119681 - RNA, 15 nt, Streptococcus pyogenes MGAS315
uaauaaacucuauac

SEQ ID NO: 4119682 - RNA, 19 nt, Streptococcus pyogenes MGAS315
uaauaaacucuauacaaaa

SEQ ID NO: 4119683 - RNA, 15 nt, Streptococcus pyogenes MGAS315
uaauaacaaaaugaa

SEQ ID NO: 4119684 - RNA, 18 nt, Streptococcus pyogenes MGAS315
uaauaagauucaauauga

SEQ ID NO: 4119685 - RNA, 20 nt, Streptococcus pyogenes MGAS315
uaauaagauucaauaugaaa

SEQ ID NO: 4119686 - RNA, 20 nt, Streptococcus pyogenes MGAS315
uaauaaguauuuuaaaaucc

SEQ ID NO: 4119687 - RNA, 21 nt, Streptococcus pyogenes MGAS315
uaauaaguauuuuaaaauccu

SEQ ID NO: 4119688 - RNA, 19 nt, Streptococcus pyogenes MGAS315
uaauacguuuauuuaguua

SEQ ID NO: 4119689 - RNA, 13 nt, Streptococcus pyogenes MGAS315
uaauagaauaaaa

SEQ ID NO: 4119690 - RNA, 15 nt, Streptococcus pyogenes MGAS315
uaauagaauaaaaaa

SEQ ID NO: 4119691 - RNA, 13 nt, Streptococcus pyogenes MGAS315
uaaucaaaaaacu

SEQ ID NO: 4119692 - RNA, 20 nt, Streptococcus pyogenes MGAS315
uaaucaaaaaacugagacaa

SEQ ID NO: 4119693 - RNA, 14 nt, Streptococcus pyogenes MGAS315
uaaucgaugauaau

SEQ ID NO: 4119694 - RNA, 18 nt, Streptococcus pyogenes MGAS315
uaaucguaaugucuuguu

SEQ ID NO: 4119695 - RNA, 18 nt, Streptococcus pyogenes MGAS315
uaaucuuugacaauguca

SEQ ID NO: 4119696 - RNA, 21 nt, Streptococcus pyogenes MGAS315
uaaucuuuuugugauauguuu

SEQ ID NO: 4119697 - RNA, 15 nt, Streptococcus pyogenes MGAS315
uaaugauaaggcugc

SEQ ID NO: 4119698 - RNA, 17 nt, Streptococcus pyogenes MGAS315
uaaugccaucaaaaaaa

SEQ ID NO: 4119699 - RNA, 19 nt, Streptococcus pyogenes MGAS315
uaaugccaucaaaaaaaga

SEQ ID NO: 4119700 - RNA, 18 nt, Streptococcus pyogenes MGAS315
uaauguaacggccguuaa

SEQ ID NO: 4119701 - RNA, 18 nt, Streptococcus pyogenes MGAS315
uaaugucuuguuuugguu

SEQ ID NO: 4119702 - RNA, 23 nt, Streptococcus pyogenes MGAS315
uaauguuaggagcacaaaagagg

SEQ ID NO: 4119703 - RNA, 15 nt, Streptococcus pyogenes MGAS315
uaauuagcauauuuu

SEQ ID NO: 4119704 - RNA, 11 nt, Streptococcus pyogenes MGAS315
uaauuaucuga

SEQ ID NO: 4119705 - RNA, 13 nt, Streptococcus pyogenes MGAS315
uaauuaucugaau

SEQ ID NO: 4119706 - RNA, 19 nt, Streptococcus pyogenes MGAS315
uaauuccugugacaaccca

SEQ ID NO: 4119707 - RNA, 12 nt, Streptococcus pyogenes MGAS315
uacaaaaaacaa

SEQ ID NO: 4119708 - RNA, 21 nt, Streptococcus pyogenes MGAS315
uacaaaacugucuggaaacug

SEQ ID NO: 4119709 - RNA, 13 nt, Streptococcus pyogenes MGAS315
uacaaaauaaccc

SEQ ID NO: 4119710 - RNA, 12 nt, Streptococcus pyogenes MGAS315
uacaacagcagc

SEQ ID NO: 4119711 - RNA, 17 nt, Streptococcus pyogenes MGAS315
uacaacagcagcaguug

SEQ ID NO: 4119712 - RNA, 18 nt, Streptococcus pyogenes MGAS315
uacaacuggcuagccaaa

SEQ ID NO: 4119713 - RNA, 16 nt, Streptococcus pyogenes MGAS315
uacaccauuuauuaag

SEQ ID NO: 4119714 - RNA, 13 nt, Streptococcus pyogenes MGAS315
uacaucaaaaaaa

SEQ ID NO: 4119715 - RNA, 14 nt, Streptococcus pyogenes MGAS315
uacaucaaaaaaag

SEQ ID NO: 4119716 - RNA, 19 nt, Streptococcus pyogenes MGAS315
uacaucaaaaaaagcaaug

SEQ ID NO: 4119717 - RNA, 15 nt, Streptococcus pyogenes MGAS315
uaccaaaucaaaaag

SEQ ID NO: 4119718 - RNA, 23 nt, Streptococcus pyogenes MGAS315
uaccauuuaugaggccaauaaug

SEQ ID NO: 4119719 - RNA, 17 nt, Streptococcus pyogenes MGAS315
uaccuuauuuucuaggu

SEQ ID NO: 4119720 - RNA, 19 nt, Streptococcus pyogenes MGAS315
uacggcuucuacacaaaag

SEQ ID NO: 4119721 - RNA, 13 nt, Streptococcus pyogenes MGAS315
uacuaacaacaac

SEQ ID NO: 4119722 - RNA, 16 nt, Streptococcus pyogenes MGAS315
uacuagaaaaagcaau

SEQ ID NO: 4119723 - RNA, 17 nt, Streptococcus pyogenes MGAS315
uacuagaaaaagcaaug

SEQ ID NO: 4119724 - RNA, 19 nt, Streptococcus pyogenes MGAS315
uacuagaaaaagcaaugau

SEQ ID NO: 4119725 - RNA, 18 nt, Streptococcus pyogenes MGAS315
uacuauggcuucuaaaaa

SEQ ID NO: 4119726 - RNA, 17 nt, Streptococcus pyogenes MGAS315
uacucaauauaauaaaa

SEQ ID NO: 4119727 - RNA, 19 nt, Streptococcus pyogenes MGAS315
uacuccucucacaaauaca

SEQ ID NO: 4119728 - RNA, 17 nt, Streptococcus pyogenes MGAS315
uacucgugaauaauuuu

SEQ ID NO: 4119729 - RNA, 15 nt, Streptococcus pyogenes MGAS315
uacugauaaacuuga

SEQ ID NO: 4119730 - RNA, 12 nt, Streptococcus pyogenes MGAS315
uacugcccuuga

SEQ ID NO: 4119731 - RNA, 18 nt, Streptococcus pyogenes MGAS315
uacuggucaauggaaauu

SEQ ID NO: 4119732 - RNA, 20 nt, Streptococcus pyogenes MGAS315
uacuguaauauuuccuuuua

SEQ ID NO: 4119733 - RNA, 14 nt, Streptococcus pyogenes MGAS315
uacuguauaaacuu

SEQ ID NO: 4119734 - RNA, 11 nt, Streptococcus pyogenes MGAS315
uacuucucaaa

SEQ ID NO: 4119735 - RNA, 15 nt, Streptococcus pyogenes MGAS315
uacuucugauaaaaa

SEQ ID NO: 4119736 - RNA, 16 nt, Streptococcus pyogenes MGAS315
uacuuugguauucuuu

SEQ ID NO: 4119737 - RNA, 21 nt, Streptococcus pyogenes MGAS315
uacuuugguauucuuuuuccg

SEQ ID NO: 4119738 - RNA, 12 nt, Streptococcus pyogenes MGAS315
uacuuuuaaaau

SEQ ID NO: 4119739 - RNA, 16 nt, Streptococcus pyogenes MGAS315
uagaaauuguaaccac

SEQ ID NO: 4119740 - RNA, 13 nt, Streptococcus pyogenes MGAS315
uagaacuuuucag

SEQ ID NO: 4119741 - RNA, 14 nt, Streptococcus pyogenes MGAS315
uagaauaaaaaaga

SEQ ID NO: 4119742 - RNA, 15 nt, Streptococcus pyogenes MGAS315
uagaauaaaaaagac

SEQ ID NO: 4119743 - RNA, 16 nt, Streptococcus pyogenes MGAS315
uagaauaaaaaagacu

SEQ ID NO: 4119744 - RNA, 15 nt, Streptococcus pyogenes MGAS315
uagagucucuagucu

SEQ ID NO: 4119745 - RNA, 18 nt, Streptococcus pyogenes MGAS315
uagagucucuuaauuuau

SEQ ID NO: 4119746 - RNA, 18 nt, Streptococcus pyogenes MGAS315
uagauguuggaacuuugu

SEQ ID NO: 4119747 - RNA, 19 nt, Streptococcus pyogenes MGAS315
uagcaguuauaauuaguau

SEQ ID NO: 4119748 - RNA, 16 nt, Streptococcus pyogenes MGAS315
uagcauaaaagauauu

SEQ ID NO: 4119749 - RNA, 20 nt, Streptococcus pyogenes MGAS315
uagcauugucaaauaaaauc

SEQ ID NO: 4119750 - RNA, 21 nt, Streptococcus pyogenes MGAS315
uagccagauggugcuacugau

SEQ ID NO: 4119751 - RNA, 15 nt, Streptococcus pyogenes MGAS315
uagcgggaacacuca

SEQ ID NO: 4119752 - RNA, 17 nt, Streptococcus pyogenes MGAS315
uagcguaaagcaaggga

SEQ ID NO: 4119753 - RNA, 20 nt, Streptococcus pyogenes MGAS315
uagcugcugcuaaagcaauc

SEQ ID NO: 4119754 - RNA, 23 nt, Streptococcus pyogenes MGAS315
uagcuuuuuacaucaaaaaaagc

SEQ ID NO: 4119755 - RNA, 13 nt, Streptococcus pyogenes MGAS315
uaggaauaaaaug

SEQ ID NO: 4119756 - RNA, 16 nt, Streptococcus pyogenes MGAS315
uaggaaucacaacuuc

SEQ ID NO: 4119757 - RNA, 16 nt, Streptococcus pyogenes MGAS315
uaggcagacaauuauu

SEQ ID NO: 4119758 - RNA, 18 nt, Streptococcus pyogenes MGAS315
uagggauuuuuuuaacua

SEQ ID NO: 4119759 - RNA, 22 nt, Streptococcus pyogenes MGAS315
uagguaaagauuuuaaauaucu

SEQ ID NO: 4119760 - RNA, 23 nt, Streptococcus pyogenes MGAS315
uagguacucguaagcauuuugag

SEQ ID NO: 4119761 - RNA, 22 nt, Streptococcus pyogenes MGAS315
uaggucuaauuagcauauuuug

SEQ ID NO: 4119762 - RNA, 17 nt, Streptococcus pyogenes MGAS315
uaguaaagccuuaucca

SEQ ID NO: 4119763 - RNA, 17 nt, Streptococcus pyogenes MGAS315
uaguaaccauugccauu

SEQ ID NO: 4119764 - RNA, 20 nt, Streptococcus pyogenes MGAS315
uagucagaucauuaaauuga

SEQ ID NO: 4119765 - RNA, 21 nt, Streptococcus pyogenes MGAS315
uagucuuuuuugugaucuguu

SEQ ID NO: 4119766 - RNA, 14 nt, Streptococcus pyogenes MGAS315
uaguguauuacuuc

SEQ ID NO: 4119767 - RNA, 17 nt, Streptococcus pyogenes MGAS315
uagugugugugauguaa

SEQ ID NO: 4119768 - RNA, 18 nt, Streptococcus pyogenes MGAS315
uaguugauauuuuuuagg

SEQ ID NO: 4119769 - RNA, 17 nt, Streptococcus pyogenes MGAS315
uaguuggauccuuuauc

SEQ ID NO: 4119770 - RNA, 20 nt, Streptococcus pyogenes MGAS315
ucagagcuuuuuuuguuuug

SEQ ID NO: 4119771 - RNA, 18 nt, Streptococcus pyogenes MGAS315
ucagauaaaaccuucaaa

SEQ ID NO: 4119772 - RNA, 19 nt, Streptococcus pyogenes MGAS315
ucagauaaaaccuucaaaa

SEQ ID NO: 4119773 - RNA, 23 nt, Streptococcus pyogenes MGAS315
ucagauaaaaccuucaaaaaagg

SEQ ID NO: 4119774 - RNA, 12 nt, Streptococcus pyogenes MGAS315
ucagauacuagu

SEQ ID NO: 4119775 - RNA, 19 nt, Streptococcus pyogenes MGAS315
ucagaucauuaaauugauu

SEQ ID NO: 4119776 - RNA, 14 nt, Streptococcus pyogenes MGAS315
ucagcaucugaaaa

SEQ ID NO: 4119777 - RNA, 20 nt, Streptococcus pyogenes MGAS315
ucagcccccucuuuaccauu

SEQ ID NO: 4119778 - RNA, 11 nt, Streptococcus pyogenes MGAS315
ucaggccacua

SEQ ID NO: 4119779 - RNA, 17 nt, Streptococcus pyogenes MGAS315
ucagguugcaacaauua

SEQ ID NO: 4119780 - RNA, 23 nt, Streptococcus pyogenes MGAS315
ucaguaaucuaaagcaucagcau

SEQ ID NO: 4119781 - RNA, 14 nt, Streptococcus pyogenes MGAS315
ucaguauacucagu

SEQ ID NO: 4119782 - RNA, 21 nt, Streptococcus pyogenes MGAS315
ucaguuaaugccaacuuuuca

SEQ ID NO: 4119783 - RNA, 18 nt, Streptococcus pyogenes MGAS315
ucaguuuuuuugauuuuc

SEQ ID NO: 4119784 - RNA, 15 nt, Streptococcus pyogenes MGAS315
ucauaaauaaagaua

SEQ ID NO: 4119785 - RNA, 20 nt, Streptococcus pyogenes MGAS315
ucauaaguuuagaacuuuuc

SEQ ID NO: 4119786 - RNA, 13 nt, Streptococcus pyogenes MGAS315
ucauacaaaaaca

SEQ ID NO: 4119787 - RNA, 19 nt, Streptococcus pyogenes MGAS315
ucauacucaauagcugcug

SEQ ID NO: 4119788 - RNA, 21 nt, Streptococcus pyogenes MGAS315
ucauauaagcaaucaucauuu

SEQ ID NO: 4119789 - RNA, 16 nt, Streptococcus pyogenes MGAS315
ucaucaaaagaccaua

SEQ ID NO: 4119790 - RNA, 18 nt, Streptococcus pyogenes MGAS315
ucaucuugccaucagcau

SEQ ID NO: 4119791 - RNA, 20 nt, Streptococcus pyogenes MGAS315
ucaucuugccaucagcaucu

SEQ ID NO: 4119792 - RNA, 20 nt, Streptococcus pyogenes MGAS315
ucaugacgccuccaaauacu

SEQ ID NO: 4119793 - RNA, 21 nt, Streptococcus pyogenes MGAS315
ucaugauguuauuaaauaaua

SEQ ID NO: 4119794 - RNA, 21 nt, Streptococcus pyogenes MGAS315
ucaugggaaaagcuaaguaaa

SEQ ID NO: 4119795 - RNA, 16 nt, Streptococcus pyogenes MGAS315
ucauuagaauaagaaa

SEQ ID NO: 4119796 - RNA, 19 nt, Streptococcus pyogenes MGAS315
ucauuagaauaagaaaacc

SEQ ID NO: 4119797 - RNA, 16 nt, Streptococcus pyogenes MGAS315
ucauuaguuaauaaga

SEQ ID NO: 4119798 - RNA, 20 nt, Streptococcus pyogenes MGAS315
ucauuaguuaauaagacaaa

SEQ ID NO: 4119799 - RNA, 20 nt, Streptococcus pyogenes MGAS315
ucauuaucaacaaucuuaaa

SEQ ID NO: 4119800 - RNA, 23 nt, Streptococcus pyogenes MGAS315
ucauuaucaacaaucuuaaaaua

SEQ ID NO: 4119801 - RNA, 14 nt, Streptococcus pyogenes MGAS315
ucauugcuuuuuau

SEQ ID NO: 4119802 - RNA, 11 nt, Streptococcus pyogenes MGAS315
ucauuuugguu

SEQ ID NO: 4119803 - RNA, 21 nt, Streptococcus pyogenes MGAS315
ucauuuuuggagagaccuugu

SEQ ID NO: 4119804 - RNA, 17 nt, Streptococcus pyogenes MGAS315
uccaaaguucuucuaaa

SEQ ID NO: 4119805 - RNA, 12 nt, Streptococcus pyogenes MGAS315
uccaacaacgcu

SEQ ID NO: 4119806 - RNA, 17 nt, Streptococcus pyogenes MGAS315
uccaagaucugcacaca

SEQ ID NO: 4119807 - RNA, 17 nt, Streptococcus pyogenes MGAS315
uccaaugaaaacuccag

SEQ ID NO: 4119808 - RNA, 13 nt, Streptococcus pyogenes MGAS315
uccaaugacuaag

SEQ ID NO: 4119809 - RNA, 20 nt, Streptococcus pyogenes MGAS315
uccaucaaucgugauugauu

SEQ ID NO: 4119810 - RNA, 17 nt, Streptococcus pyogenes MGAS315
uccaucugcacaugcuu

SEQ ID NO: 4119811 - RNA, 13 nt, Streptococcus pyogenes MGAS315
uccauuauaaauc

SEQ ID NO: 4119812 - RNA, 18 nt, Streptococcus pyogenes MGAS315
uccauuauaaaucuuacu

SEQ ID NO: 4119813 - RNA, 23 nt, Streptococcus pyogenes MGAS315
uccauuauaaaucuuacuaacua

SEQ ID NO: 4119814 - RNA, 15 nt, Streptococcus pyogenes MGAS315
uccauucuuuauaau

SEQ ID NO: 4119815 - RNA, 12 nt, Streptococcus pyogenes MGAS315
ucccauguuuua

SEQ ID NO: 4119816 - RNA, 18 nt, Streptococcus pyogenes MGAS315
ucccauuuuucgacagac

SEQ ID NO: 4119817 - RNA, 16 nt, Streptococcus pyogenes MGAS315
ucccuucauuuuacua

SEQ ID NO: 4119818 - RNA, 16 nt, Streptococcus pyogenes MGAS315
uccuaaacuaauaaga

SEQ ID NO: 4119819 - RNA, 18 nt, Streptococcus pyogenes MGAS315
uccuaaccuuuuggcugu

SEQ ID NO: 4119820 - RNA, 15 nt, Streptococcus pyogenes MGAS315
uccuccuaaauauaa

SEQ ID NO: 4119821 - RNA, 17 nt, Streptococcus pyogenes MGAS315
uccucuaacauguccaa

SEQ ID NO: 4119822 - RNA, 14 nt, Streptococcus pyogenes MGAS315
uccucugaaaaguu

SEQ ID NO: 4119823 - RNA, 15 nt, Streptococcus pyogenes MGAS315
uccuuaaauuauauu

SEQ ID NO: 4119824 - RNA, 22 nt, Streptococcus pyogenes MGAS315
uccuuguacaagagcuuaaaag

SEQ ID NO: 4119825 - RNA, 17 nt, Streptococcus pyogenes MGAS315
uccuuuacuguaauauu

SEQ ID NO: 4119826 - RNA, 14 nt, Streptococcus pyogenes MGAS315
uccuuuuaaagaca

SEQ ID NO: 4119827 - RNA, 18 nt, Streptococcus pyogenes MGAS315
ucgaaauugguccucuga

SEQ ID NO: 4119828 - RNA, 15 nt, Streptococcus pyogenes MGAS315
ucgccaauaaaaaag

SEQ ID NO: 4119829 - RNA, 22 nt, Streptococcus pyogenes MGAS315
ucgcccuuuuuagcuuauaauu

SEQ ID NO: 4119830 - RNA, 20 nt, Streptococcus pyogenes MGAS315
ucgcguuuaggcucauauua

SEQ ID NO: 4119831 - RNA, 14 nt, Streptococcus pyogenes MGAS315
ucggcaucgguaau

SEQ ID NO: 4119832 - RNA, 19 nt, Streptococcus pyogenes MGAS315
ucggcaucgguaaugcuuu

SEQ ID NO: 4119833 - RNA, 17 nt, Streptococcus pyogenes MGAS315
ucggccacguuuuucaa

SEQ ID NO: 4119834 - RNA, 14 nt, Streptococcus pyogenes MGAS315
ucggcuaauucuua

SEQ ID NO: 4119835 - RNA, 21 nt, Streptococcus pyogenes MGAS315
ucguaaugucuuguuuugguu

SEQ ID NO: 4119836 - RNA, 15 nt, Streptococcus pyogenes MGAS315
ucguauacuuuaaac

SEQ ID NO: 4119837 - RNA, 19 nt, Streptococcus pyogenes MGAS315
ucgucuuuguccauucuuu

SEQ ID NO: 4119838 - RNA, 19 nt, Streptococcus pyogenes MGAS315
ucguuacuccuuugaccac

SEQ ID NO: 4119839 - RNA, 18 nt, Streptococcus pyogenes MGAS315
ucguuuuuugcuuuugau

SEQ ID NO: 4119840 - RNA, 19 nt, Streptococcus pyogenes MGAS315
ucguuuuuugcuuuugaua

SEQ ID NO: 4119841 - RNA, 14 nt, Streptococcus pyogenes MGAS315
ucuaaaauauauug

SEQ ID NO: 4119842 - RNA, 19 nt, Streptococcus pyogenes MGAS315
ucuaauuagcauauuuuga

SEQ ID NO: 4119843 - RNA, 15 nt, Streptococcus pyogenes MGAS315
ucuacacaaaagcuu

SEQ ID NO: 4119844 - RNA, 20 nt, Streptococcus pyogenes MGAS315
ucuagacccuagcauaaaag

SEQ ID NO: 4119845 - RNA, 23 nt, Streptococcus pyogenes MGAS315
ucuaggagggacugucaaaaaau

SEQ ID NO: 4119846 - RNA, 18 nt, Streptococcus pyogenes MGAS315
ucuauauguguaauuucu

SEQ ID NO: 4119847 - RNA, 12 nt, Streptococcus pyogenes MGAS315
ucuaucugcaga

SEQ ID NO: 4119848 - RNA, 11 nt, Streptococcus pyogenes MGAS315
ucuauuguauu

SEQ ID NO: 4119849 - RNA, 15 nt, Streptococcus pyogenes MGAS315
ucuauuguauuugau

SEQ ID NO: 4119850 - RNA, 22 nt, Streptococcus pyogenes MGAS315
ucuauuugaaguaaaggauuua

SEQ ID NO: 4119851 - RNA, 12 nt, Streptococcus pyogenes MGAS315
ucucaaaaauau

SEQ ID NO: 4119852 - RNA, 15 nt, Streptococcus pyogenes MGAS315
ucucacaaauacaga

SEQ ID NO: 4119853 - RNA, 21 nt, Streptococcus pyogenes MGAS315
ucucagagacaauaaggucau

SEQ ID NO: 4119854 - RNA, 14 nt, Streptococcus pyogenes MGAS315
ucucauaacaaauu

SEQ ID NO: 4119855 - RNA, 16 nt, Streptococcus pyogenes MGAS315
ucucauaacaaauuua

SEQ ID NO: 4119856 - RNA, 21 nt, Streptococcus pyogenes MGAS315
ucuccaaaguucuucuaaacg

SEQ ID NO: 4119857 - RNA, 14 nt, Streptococcus pyogenes MGAS315
ucuccgacugcagu

SEQ ID NO: 4119858 - RNA, 15 nt, Streptococcus pyogenes MGAS315
ucucgauuguaauca

SEQ ID NO: 4119859 - RNA, 19 nt, Streptococcus pyogenes MGAS315
ucucuuaauuuauauuuua

SEQ ID NO: 4119860 - RNA, 20 nt, Streptococcus pyogenes MGAS315
ucucuugcaaggugcuuuuu

SEQ ID NO: 4119861 - RNA, 23 nt, Streptococcus pyogenes MGAS315
ucugaaaauaaaauauuuuucca

SEQ ID NO: 4119862 - RNA, 12 nt, Streptococcus pyogenes MGAS315
ucugaauuauua

SEQ ID NO: 4119863 - RNA, 16 nt, Streptococcus pyogenes MGAS315
ucugacguaagcauca

SEQ ID NO: 4119864 - RNA, 18 nt, Streptococcus pyogenes MGAS315
ucugcagauuuuaagaca

SEQ ID NO: 4119865 - RNA, 16 nt, Streptococcus pyogenes MGAS315
ucugcauuaucaucug

SEQ ID NO: 4119866 - RNA, 13 nt, Streptococcus pyogenes MGAS315
ucuggcaauaagu

SEQ ID NO: 4119867 - RNA, 16 nt, Streptococcus pyogenes MGAS315
ucugguuuuaauauug

SEQ ID NO: 4119868 - RNA, 16 nt, Streptococcus pyogenes MGAS315
ucuguuucuaagcaaa

SEQ ID NO: 4119869 - RNA, 23 nt, Streptococcus pyogenes MGAS315
ugcuguuugucauacucaauagc

SEQ ID NO: 4119870 - RNA, 13 nt, Streptococcus pyogenes MGAS315
ugcuucuagucag

SEQ ID NO: 4119871 - RNA, 13 nt, Streptococcus pyogenes MGAS315
ugcuucuuaucac

SEQ ID NO: 4119872 - RNA, 13 nt, Streptococcus pyogenes MGAS315
ugcuuuaaaaagu

SEQ ID NO: 4119873 - RNA, 21 nt, Streptococcus pyogenes MGAS315
ugcuuuugaugcagcuaaaag

SEQ ID NO: 4119874 - RNA, 21 nt, Streptococcus pyogenes MGAS315
ugcuuuuuaugauuugucaaa

SEQ ID NO: 4119875 - RNA, 22 nt, Streptococcus pyogenes MGAS315
uggaaacugcacugagccccaa

SEQ ID NO: 4119876 - RNA, 14 nt, Streptococcus pyogenes MGAS315
uggaaauuuuaaau

SEQ ID NO: 4119877 - RNA, 18 nt, Streptococcus pyogenes MGAS315
uggaaauuuuaaaugaca

SEQ ID NO: 4119878 - RNA, 19 nt, Streptococcus pyogenes MGAS315
uggacaaucuuaaguuagg

SEQ ID NO: 4119879 - RNA, 12 nt, Streptococcus pyogenes MGAS315
uggacgaaggcu

SEQ ID NO: 4119880 - RNA, 19 nt, Streptococcus pyogenes MGAS315
uggacuugaugguaauauu

SEQ ID NO: 4119881 - RNA, 15 nt, Streptococcus pyogenes MGAS315
uggaucguuuugcaa

SEQ ID NO: 4119882 - RNA, 22 nt, Streptococcus pyogenes MGAS315
uggauuaaaugcccaagauggg

SEQ ID NO: 4119883 - RNA, 23 nt, Streptococcus pyogenes MGAS315
uggauuaaaugcccaagaugggu

SEQ ID NO: 4119884 - RNA, 17 nt, Streptococcus pyogenes MGAS315
uggcaccaagugcugcc

SEQ ID NO: 4119885 - RNA, 20 nt, Streptococcus pyogenes MGAS315
uggcaccaagugcugccauu

SEQ ID NO: 4119886 - RNA, 15 nt, Streptococcus pyogenes MGAS315
uggcuagccaaaucu

SEQ ID NO: 4119887 - RNA, 18 nt, Streptococcus pyogenes MGAS315
ugggauauuuagauggua

SEQ ID NO: 4119888 - RNA, 18 nt, Streptococcus pyogenes MGAS315
uggguaguugguacuuga

SEQ ID NO: 4119889 - RNA, 13 nt, Streptococcus pyogenes MGAS315
ugguaaaaaggca

SEQ ID NO: 4119890 - RNA, 23 nt, Streptococcus pyogenes MGAS315
uggucaauggaaauuuuaaauga

SEQ ID NO: 4119891 - RNA, 23 nt, Streptococcus pyogenes MGAS315
uggucuaccgcuaggauuuuucc

SEQ ID NO: 4119892 - RNA, 18 nt, Streptococcus pyogenes MGAS315
ugguuaaaaagagagcuu

SEQ ID NO: 4119893 - RNA, 12 nt, Streptococcus pyogenes MGAS315
ugguuuaucauu

SEQ ID NO: 4119894 - RNA, 12 nt, Streptococcus pyogenes MGAS315
uguaaaaugaua

SEQ ID NO: 4119895 - RNA, 18 nt, Streptococcus pyogenes MGAS315
uguaaauauaaagucaga

SEQ ID NO: 4119896 - RNA, 19 nt, Streptococcus pyogenes MGAS315
uguaacgcuuguuuaugaa

SEQ ID NO: 4119897 - RNA, 20 nt, Streptococcus pyogenes MGAS315
uguaacgcuuguuuaugaaa

SEQ ID NO: 4119898 - RNA, 21 nt, Streptococcus pyogenes MGAS315
uguaacuguagcguuuguguu

SEQ ID NO: 4119899 - RNA, 19 nt, Streptococcus pyogenes MGAS315
uguaauauuuccuuuuaaa

SEQ ID NO: 4119900 - RNA, 23 nt, Streptococcus pyogenes MGAS315
uguaauccccucauuuaaauguu

SEQ ID NO: 4119901 - RNA, 13 nt, Streptococcus pyogenes MGAS315
uguaauugucucu

SEQ ID NO: 4119902 - RNA, 24 nt, Streptococcus pyogenes MGAS315
uguaauuucuugugcuaaucuauc

SEQ ID NO: 4119903 - RNA, 13 nt, Streptococcus pyogenes MGAS315
uguauagguagau

SEQ ID NO: 4119904 - RNA, 20 nt, Streptococcus pyogenes MGAS315
uguaucucauaacaaauuua

SEQ ID NO: 4119905 - RNA, 16 nt, Streptococcus pyogenes MGAS315
uguauuaugaggugac

SEQ ID NO: 4119906 - RNA, 15 nt, Streptococcus pyogenes MGAS315
uguauucuuaaaaaa

SEQ ID NO: 4119907 - RNA, 15 nt, Streptococcus pyogenes MGAS315
uguauuucuuuagua

SEQ ID NO: 4119908 - RNA, 15 nt, Streptococcus pyogenes MGAS315
ugucaaaaaguaaaa

SEQ ID NO: 4119909 - RNA, 20 nt, Streptococcus pyogenes MGAS315
ugucaaacauaacaauccua

SEQ ID NO: 4119910 - RNA, 14 nt, Streptococcus pyogenes MGAS315
ugucaaauaaaauc

SEQ ID NO: 4119911 - RNA, 14 nt, Streptococcus pyogenes MGAS315
ugucauacaaaaac

SEQ ID NO: 4119912 - RNA, 17 nt, Streptococcus pyogenes MGAS315
ugucauacucaauagcu

SEQ ID NO: 4119913 - RNA, 14 nt, Streptococcus pyogenes MGAS315
ugucauuucuugag

SEQ ID NO: 4119914 - RNA, 21 nt, Streptococcus pyogenes MGAS315
uguccauucuuuauaaugguu

SEQ ID NO: 4119915 - RNA, 14 nt, Streptococcus pyogenes MGAS315
uguccuaaccuuuu

SEQ ID NO: 4119916 - RNA, 17 nt, Streptococcus pyogenes MGAS315
uguccuaaccuuuuggc

SEQ ID NO: 4119917 - RNA, 20 nt, Streptococcus pyogenes MGAS315
uguccuaaccuuuuggcugu

SEQ ID NO: 4119918 - RNA, 21 nt, Streptococcus pyogenes MGAS315
uguccuaaccuuuuggcugua

SEQ ID NO: 4119919 - RNA, 23 nt, Streptococcus pyogenes MGAS315
ugucuggaaacuggucaaaagcu

SEQ ID NO: 4119920 - RNA, 21 nt, Streptococcus pyogenes MGAS315
ugucuuagccuuuuuuugucu

SEQ ID NO: 4119921 - RNA, 20 nt, Streptococcus pyogenes MGAS315
ugucuuaucuaaaggagcuu

SEQ ID NO: 4119922 - RNA, 19 nt, Streptococcus pyogenes MGAS315
ugucuucuccgacugcagu

SEQ ID NO: 4119923 - RNA, 22 nt, Streptococcus pyogenes MGAS315
ugugacuaguuuauuacaaaac

SEQ ID NO: 4119924 - RNA, 16 nt, Streptococcus pyogenes MGAS315
ugugauguaauugucu

SEQ ID NO: 4119925 - RNA, 20 nt, Streptococcus pyogenes MGAS315
ugugccuacuccucucacaa

SEQ ID NO: 4119926 - RNA, 22 nt, Streptococcus pyogenes MGAS315
ugugccuuuucuuuuuggcuga

SEQ ID NO: 4119927 - RNA, 17 nt, Streptococcus pyogenes MGAS315
uguuaauauagucugca

SEQ ID NO: 4119928 - RNA, 13 nt, Streptococcus pyogenes MGAS315
uguuaauauguaa

SEQ ID NO: 4119929 - RNA, 22 nt, Streptococcus pyogenes MGAS315
uguucaaccgucacuauugaau

SEQ ID NO: 4119930 - RNA, 15 nt, Streptococcus pyogenes MGAS315
uguuccaucugcaca

SEQ ID NO: 4119931 - RNA, 15 nt, Streptococcus pyogenes MGAS315
uguucgauaaauuca

SEQ ID NO: 4119932 - RNA, 19 nt, Streptococcus pyogenes MGAS315
uguucgauaaauucagguu

SEQ ID NO: 4119933 - RNA, 16 nt, Streptococcus pyogenes MGAS315
uguuguauuaugaggu

SEQ ID NO: 4119934 - RNA, 15 nt, Streptococcus pyogenes MGAS315
uguuuaaaauauauu

SEQ ID NO: 4119935 - RNA, 22 nt, Streptococcus pyogenes MGAS315
uguuuaaaauauauuuuggauc

SEQ ID NO: 4119936 - RNA, 12 nt, Streptococcus pyogenes MGAS315
uguuuaugaaag

SEQ ID NO: 4119937 - RNA, 20 nt, Streptococcus pyogenes MGAS315
uguuuuaguaaagccuuauc

SEQ ID NO: 4119938 - RNA, 16 nt, Streptococcus pyogenes MGAS315
uguuuucacuauaauu

SEQ ID NO: 4119939 - RNA, 22 nt, Streptococcus pyogenes MGAS315
uguuuuggccaauaaaauaucu

SEQ ID NO: 4119940 - RNA, 15 nt, Streptococcus pyogenes MGAS315
uguuuuuuaguguau

SEQ ID NO: 4119941 - RNA, 14 nt, Streptococcus pyogenes MGAS315
uuaaaaagcaaaaa

SEQ ID NO: 4119942 - RNA, 13 nt, Streptococcus pyogenes MGAS315
uuaaaaauaacuu

SEQ ID NO: 4119943 - RNA, 13 nt, Streptococcus pyogenes MGAS315
uuaaacauauuau

SEQ ID NO: 4119944 - RNA, 15 nt, Streptococcus pyogenes MGAS315
uuaaagacaaaaaac

SEQ ID NO: 4119945 - RNA, 13 nt, Streptococcus pyogenes MGAS315
uuaacaaaaauaa

SEQ ID NO: 4119946 - RNA, 17 nt, Streptococcus pyogenes MGAS315
uuaacaaugaaacguua

SEQ ID NO: 4119947 - RNA, 20 nt, Streptococcus pyogenes MGAS315
uuaacaggugacauaguguu

SEQ ID NO: 4119948 - RNA, 14 nt, Streptococcus pyogenes MGAS315
uuaaccuccuaaac

SEQ ID NO: 4119949 - RNA, 15 nt, Streptococcus pyogenes MGAS315
uuaacugguaaagua

SEQ ID NO: 4119950 - RNA, 23 nt, Streptococcus pyogenes MGAS315
uuaagacaacauacuuuauuaau

SEQ ID NO: 4119951 - RNA, 19 nt, Streptococcus pyogenes MGAS315
uuaagacuauguugcuuaa

SEQ ID NO: 4119952 - RNA, 18 nt, Streptococcus pyogenes MGAS315
uuaagcugaguaaaacaa

SEQ ID NO: 4119953 - RNA, 17 nt, Streptococcus pyogenes MGAS315
uuaagcuuuguugcauu

SEQ ID NO: 4119954 - RNA, 13 nt, Streptococcus pyogenes MGAS315
uuaauaaaagauu

SEQ ID NO: 4119955 - RNA, 17 nt, Streptococcus pyogenes MGAS315
uuaauaagacaaagacg

SEQ ID NO: 4119956 - RNA, 14 nt, Streptococcus pyogenes MGAS315
uuaauaauauuaac

SEQ ID NO: 4119957 - RNA, 18 nt, Streptococcus pyogenes MGAS315
uuaauagagaacagauaa

SEQ ID NO: 4119958 - RNA, 23 nt, Streptococcus pyogenes MGAS315
uuaauagcauugucaaauaaaau

SEQ ID NO: 4119959 - RNA, 17 nt, Streptococcus pyogenes MGAS315
uuaauauagucugcaug

SEQ ID NO: 4119960 - RNA, 19 nt, Streptococcus pyogenes MGAS315
uuaauauagucugcaugaa

SEQ ID NO: 4119961 - RNA, 12 nt, Streptococcus pyogenes MGAS315
uuaaucaaaaaa

SEQ ID NO: 4119962 - RNA, 16 nt, Streptococcus pyogenes MGAS315
uuaaugccaacuuuuc

SEQ ID NO: 4119963 - RNA, 15 nt, Streptococcus pyogenes MGAS315
uuaaugucauacaaa

SEQ ID NO: 4119964 - RNA, 19 nt, Streptococcus pyogenes MGAS315
uuaaugucauacaaaaaca

SEQ ID NO: 4119965 - RNA, 17 nt, Streptococcus pyogenes MGAS315
uuacaucaaaaaaagca

SEQ ID NO: 4119966 - RNA, 14 nt, Streptococcus pyogenes MGAS315
uuaccuuauuuucu

SEQ ID NO: 4119967 - RNA, 15 nt, Streptococcus pyogenes MGAS315
uuacuaacuagcaag

SEQ ID NO: 4119968 - RNA, 16 nt, Streptococcus pyogenes MGAS315
uuggaagaucuccaag

SEQ ID NO: 4119969 - RNA, 12 nt, Streptococcus pyogenes MGAS315
uuggauccuuua

SEQ ID NO: 4119970 - RNA, 17 nt, Streptococcus pyogenes MGAS315
uuggauuuuuguauuug

SEQ ID NO: 4119971 - RNA, 23 nt, Streptococcus pyogenes MGAS315
uuggccaauaaaauaucuagaac

SEQ ID NO: 4119972 - RNA, 14 nt, Streptococcus pyogenes MGAS315
uugguaaaaaggca

SEQ ID NO: 4119973 - RNA, 15 nt, Streptococcus pyogenes MGAS315
uuggugauuaacgcu

SEQ ID NO: 4119974 - RNA, 15 nt, Streptococcus pyogenes MGAS315
uugguggaagaguaa

SEQ ID NO: 4119975 - RNA, 16 nt, Streptococcus pyogenes MGAS315
uugguggaagaguaag

SEQ ID NO: 4119976 - RNA, 22 nt, Streptococcus pyogenes MGAS315
uuguaaccacagcaauuuguuc

SEQ ID NO: 4119977 - RNA, 19 nt, Streptococcus pyogenes MGAS315
uuguaauaacaaaaugaag

SEQ ID NO: 4119978 - RNA, 22 nt, Streptococcus pyogenes MGAS315
uuguacaagagcuuaaaaguua

SEQ ID NO: 4119979 - RNA, 21 nt, Streptococcus pyogenes MGAS315
uuguagaguuugaggugaugc

SEQ ID NO: 4119980 - RNA, 20 nt, Streptococcus pyogenes MGAS315
uuguagggauuuuuuuaacu

SEQ ID NO: 4119981 - RNA, 22 nt, Streptococcus pyogenes MGAS315
uuguauuacucaauuaauguua

SEQ ID NO: 4119982 - RNA, 22 nt, Streptococcus pyogenes MGAS315
uuguauuaugaggugacacucc

SEQ ID NO: 4119983 - RNA, 14 nt, Streptococcus pyogenes MGAS315
uugucuuauagaau

SEQ ID NO: 4119984 - RNA, 20 nt, Streptococcus pyogenes MGAS315
uugucuuaucuaaaggagcu

SEQ ID NO: 4119985 - RNA, 13 nt, Streptococcus pyogenes MGAS315
uugugauauguuu

SEQ ID NO: 4119986 - RNA, 16 nt, Streptococcus pyogenes MGAS315
uuguguugaagaaggu

SEQ ID NO: 4119987 - RNA, 13 nt, Streptococcus pyogenes MGAS315
uuguuacaaaaaa

SEQ ID NO: 4119988 - RNA, 19 nt, Streptococcus pyogenes MGAS315
uuguucauuaaagcuauca

SEQ ID NO: 4119989 - RNA, 13 nt, Streptococcus pyogenes MGAS315
uuguuguauuaug

SEQ ID NO: 4119990 - RNA, 17 nt, Streptococcus pyogenes MGAS315
uuguuuaaccuccuaaa

SEQ ID NO: 4119991 - RNA, 23 nt, Streptococcus pyogenes MGAS315
uuuaaaauaguucccuuaauaaa

SEQ ID NO: 4119992 - RNA, 19 nt, Streptococcus pyogenes MGAS315
uuuaaacacuaccuuaaau

SEQ ID NO: 4119993 - RNA, 20 nt, Streptococcus pyogenes MGAS315
uuuaaauguucgaaaaaaua

SEQ ID NO: 4119994 - RNA, 15 nt, Streptococcus pyogenes MGAS315
uuuaacaugauguac

SEQ ID NO: 4119995 - RNA, 19 nt, Streptococcus pyogenes MGAS315
uuuaaccuccuaaacuaau

SEQ ID NO: 4119996 - RNA, 18 nt, Streptococcus pyogenes MGAS315
uuuaacuauuuaacuuau

SEQ ID NO: 4119997 - RNA, 21 nt, Streptococcus pyogenes MGAS315
uuuaagauuaaacuuacaaaa

SEQ ID NO: 4119998 - RNA, 19 nt, Streptococcus pyogenes MGAS315
uuuaagcugaguaaaacaa

SEQ ID NO: 4119999 - RNA, 22 nt, Streptococcus pyogenes MGAS315
uuuaauagcauugucaaauaaa

SEQ ID NO: 4120000 - RNA, 18 nt, Streptococcus pyogenes MGAS315
uuuacaucaaaaaaagca

SEQ ID NO: 4120001 - RNA, 22 nt, Streptococcus pyogenes MGAS315
uuuacaucaaaaaaagcaauga

SEQ ID NO: 4120002 - RNA, 18 nt, Streptococcus pyogenes MGAS315
uuuacuauggcuucuaaa

SEQ ID NO: 4120003 - RNA, 21 nt, Streptococcus pyogenes MGAS315
uuuacuauggcuucuaaaaaa

SEQ ID NO: 4120004 - RNA, 18 nt, Streptococcus pyogenes MGAS315
uuuagaacuuuucagguu

SEQ ID NO: 4120005 - RNA, 17 nt, Streptococcus pyogenes MGAS315
uuuagcuuauaauuuga

SEQ ID NO: 4120006 - RNA, 14 nt, Streptococcus pyogenes MGAS315
uuuaugaaagguau

SEQ ID NO: 4120007 - RNA, 18 nt, Streptococcus pyogenes MGAS315
uuuauuaauaaguauuuu

SEQ ID NO: 4120008 - RNA, 16 nt, Streptococcus pyogenes MGAS315
uuuauuaaucaaaaaa

SEQ ID NO: 4120009 - RNA, 20 nt, Streptococcus pyogenes MGAS315
uuucaauaauaccauuuuua

SEQ ID NO: 4120010 - RNA, 22 nt, Streptococcus pyogenes MGAS315
uuucagauaaaaccuucaaaaa

SEQ ID NO: 4120011 - RNA, 21 nt, Streptococcus pyogenes MGAS315
uuucauuaguuaauaagacaa

SEQ ID NO: 4120012 - RNA, 22 nt, Streptococcus pyogenes MGAS315
uuucauuaguuaauaagacaaa

SEQ ID NO: 4120013 - RNA, 14 nt, Streptococcus pyogenes MGAS315
uuuccuacaaaaua

SEQ ID NO: 4120014 - RNA, 21 nt, Streptococcus pyogenes MGAS315
uuucggaaaacuuuugacuug

SEQ ID NO: 4120015 - RNA, 16 nt, Streptococcus pyogenes MGAS315
uuucggacuguuuuuu

SEQ ID NO: 4120016 - RNA, 20 nt, Streptococcus pyogenes MGAS315
uuucucagagacaauaaggu

SEQ ID NO: 4120017 - RNA, 11 nt, Streptococcus pyogenes MGAS315
uuucucaguaa

SEQ ID NO: 4120018 - RNA, 18 nt, Streptococcus pyogenes MGAS315
uuucugguuuuaauauug

SEQ ID NO: 4120019 - RNA, 14 nt, Streptococcus pyogenes MGAS315
uuucuuguuuuggu

SEQ ID NO: 4120020 - RNA, 22 nt, Streptococcus pyogenes MGAS315
uuugaaccgaaacguaacguaa

SEQ ID NO: 4120021 - RNA, 13 nt, Streptococcus pyogenes MGAS315
uuugaccgaaaaa

SEQ ID NO: 4120022 - RNA, 23 nt, Streptococcus pyogenes MGAS315
uuugaccgaaaaaggcaaagaaa

SEQ ID NO: 4120023 - RNA, 21 nt, Streptococcus pyogenes MGAS315
uuugacuuguuacaaaaaaca

SEQ ID NO: 4120024 - RNA, 21 nt, Streptococcus pyogenes MGAS315
uuugauugauuugucuucucc

SEQ ID NO: 4120025 - RNA, 18 nt, Streptococcus pyogenes MGAS315
uuugcguuguagguaaua

SEQ ID NO: 4120026 - RNA, 15 nt, Streptococcus pyogenes MGAS315
uuuggagagaccuug

SEQ ID NO: 4120027 - RNA, 19 nt, Streptococcus pyogenes MGAS315
uuuggccaauaaaauaucu

SEQ ID NO: 4120028 - RNA, 17 nt, Streptococcus pyogenes MGAS315
uuuggccuacuagcaca

SEQ ID NO: 4120029 - RNA, 15 nt, Streptococcus pyogenes MGAS315
uuugggaaaaacacc

SEQ ID NO: 4120030 - RNA, 14 nt, Streptococcus pyogenes MGAS315
uuugguuaucagua

SEQ ID NO: 4120031 - RNA, 19 nt, Streptococcus pyogenes MGAS315
uuuguaucucauaacaaau

SEQ ID NO: 4120032 - RNA, 15 nt, Streptococcus pyogenes MGAS315
uuugucaaaaaguaa

SEQ ID NO: 4120033 - RNA, 21 nt, Streptococcus pyogenes MGAS315
uuugucaaaaaguaaaaagca

SEQ ID NO: 4120034 - RNA, 21 nt, Streptococcus pyogenes MGAS315
uuugucaacucgauaaaaacg

SEQ ID NO: 4120035 - RNA, 22 nt, Streptococcus pyogenes MGAS315
uuugucuucuucuuuucagaga

SEQ ID NO: 4120036 - RNA, 15 nt, Streptococcus pyogenes MGAS315
uuuguuaacagguga

SEQ ID NO: 4120037 - RNA, 17 nt, Streptococcus pyogenes MGAS315
uuuguuccaucugcaca

SEQ ID NO: 4120038 - RNA, 14 nt, Streptococcus pyogenes MGAS315
uuuguuuucuuuag

SEQ ID NO: 4120039 - RNA, 21 nt, Streptococcus pyogenes MGAS315
uuuuaaaauccucuuuuaauu

SEQ ID NO: 4120040 - RNA, 15 nt, Streptococcus pyogenes MGAS315
uuuuaacguuuugaa

SEQ ID NO: 4120041 - RNA, 22 nt, Streptococcus pyogenes MGAS315
uuuuaagauuaaacuuacaaaa

SEQ ID NO: 4120042 - RNA, 13 nt, Streptococcus pyogenes MGAS315
uuuuacaucaaaa

SEQ ID NO: 4120043 - RNA, 19 nt, Streptococcus pyogenes MGAS315
uuuuacaucaaaaaaagca

SEQ ID NO: 4120044 - RNA, 13 nt, Streptococcus pyogenes MGAS315
uuuuacauuuuua

SEQ ID NO: 4120045 - RNA, 13 nt, Streptococcus pyogenes MGAS315
uuuuacuuuuaaa

SEQ ID NO: 4120046 - RNA, 14 nt, Streptococcus pyogenes MGAS315
uuuuacuuuuaaaa

SEQ ID NO: 4120047 - RNA, 22 nt, Streptococcus pyogenes MGAS315
uuuuaguaaagccuuauccauu

SEQ ID NO: 4120048 - RNA, 19 nt, Streptococcus pyogenes MGAS315
uuuuauagcugauuuguuu

SEQ ID NO: 4120049 - RNA, 18 nt, Streptococcus pyogenes MGAS315
uuuuauccccuauucaau

SEQ ID NO: 4120050 - RNA, 18 nt, Streptococcus pyogenes MGAS315
uuuuaugauuugucaaaa

SEQ ID NO: 4120051 - RNA, 23 nt, Streptococcus pyogenes MGAS315
uuuuauuaauaaguauuuuaaaa

SEQ ID NO: 4120052 - RNA, 18 nt, Streptococcus pyogenes MGAS315
uuuucaaagggagauucu

SEQ ID NO: 4120053 - RNA, 15 nt, Streptococcus pyogenes MGAS315
uuuucccaucaauag

SEQ ID NO: 4120054 - RNA, 15 nt, Streptococcus pyogenes MGAS315
uuuucugguuuuaau

SEQ ID NO: 4120055 - RNA, 14 nt, Streptococcus pyogenes MGAS315
uuuucuuuuuggcu

SEQ ID NO: 4120056 - RNA, 20 nt, Streptococcus pyogenes MGAS315
uuuugaugcagcuaaaagca

SEQ ID NO: 4120057 - RNA, 14 nt, Streptococcus pyogenes MGAS315
uuuugguuaucagu

SEQ ID NO: 4120058 - RNA, 16 nt, Streptococcus pyogenes MGAS315
uuuuguaucucauaac

SEQ ID NO: 4120059 - RNA, 17 nt, Streptococcus pyogenes MGAS315
uuuugucguuuuuugcu

SEQ ID NO: 4120060 - RNA, 16 nt, Streptococcus pyogenes MGAS315
uuuugucuuauagaau

SEQ ID NO: 4120061 - RNA, 15 nt, Streptococcus pyogenes MGAS315
uuuugucuucuucuu

SEQ ID NO: 4120062 - RNA, 23 nt, Streptococcus pyogenes MGAS315
uuuuguugaguguuaugaugaug

SEQ ID NO: 4120063 - RNA, 18 nt, Streptococcus pyogenes MGAS315
uuuuucauuugaaauucc

SEQ ID NO: 4120064 - RNA, 23 nt, Streptococcus pyogenes MGAS315
uuuuucucaaaaauauauucuaa

SEQ ID NO: 4120065 - RNA, 17 nt, Streptococcus pyogenes MGAS315
uuuuuggugucagcaua

SEQ ID NO: 4120066 - RNA, 20 nt, Streptococcus pyogenes MGAS315
aaaguuuucucagagacaau

SEQ ID NO: 4120067 - RNA, 14 nt, Streptococcus pyogenes MGAS315
aaauaaaauauuuu

SEQ ID NO: 4120068 - RNA, 13 nt, Streptococcus pyogenes MGAS315
aaauaaaaucguu

SEQ ID NO: 4120069 - RNA, 13 nt, Streptococcus pyogenes MGAS315
aaauaaagauaau

SEQ ID NO: 4120070 - RNA, 14 nt, Streptococcus pyogenes MGAS315
aaauaacuuuaaaa

SEQ ID NO: 4120071 - RNA, 15 nt, Streptococcus pyogenes MGAS315
aaauaacuuuaaaag

SEQ ID NO: 4120072 - RNA, 13 nt, Streptococcus pyogenes MGAS315
aaauaaucaaccu

SEQ ID NO: 4120073 - RNA, 16 nt, Streptococcus pyogenes MGAS315
aaauacagaaaaaagc

SEQ ID NO: 4120074 - RNA, 19 nt, Streptococcus pyogenes MGAS315
aaauacagaaaaaagcuug

SEQ ID NO: 4120075 - RNA, 16 nt, Streptococcus pyogenes MGAS315
aaauacuagaaaaagc

SEQ ID NO: 4120076 - RNA, 17 nt, Streptococcus pyogenes MGAS315
aaauacuagaaaaagca

SEQ ID NO: 4120077 - RNA, 19 nt, Streptococcus pyogenes MGAS315
aaauacuagaaaaagcaau

SEQ ID NO: 4120078 - RNA, 19 nt, Streptococcus pyogenes MGAS315
aaauagcaaugguuaaaaa

SEQ ID NO: 4120079 - RNA, 21 nt, Streptococcus pyogenes MGAS315
aaauagcaaugguuaaaaaga

SEQ ID NO: 4120080 - RNA, 13 nt, Streptococcus pyogenes MGAS315
aaauauaaauuau

SEQ ID NO: 4120081 - RNA, 17 nt, Streptococcus pyogenes MGAS315
aaauauaaauuauuaac

SEQ ID NO: 4120082 - RNA, 14 nt, Streptococcus pyogenes MGAS315
aaauauauucuaau

SEQ ID NO: 4120083 - RNA, 11 nt, Streptococcus pyogenes MGAS315
aaauauauuuu

SEQ ID NO: 4120084 - RNA, 14 nt, Streptococcus pyogenes MGAS315
aaauauauuuugga

SEQ ID NO: 4120085 - RNA, 12 nt, Streptococcus pyogenes MGAS315
aaauaucuagaa

SEQ ID NO: 4120086 - RNA, 15 nt, Streptococcus pyogenes MGAS315
aaauaucuuaccauu

SEQ ID NO: 4120087 - RNA, 21 nt, Streptococcus pyogenes MGAS315
aaauaucuuuuuuacuuuuaa

SEQ ID NO: 4120088 - RNA, 23 nt, Streptococcus pyogenes MGAS315
aaauaucuuuuuuacuuuuaaaa

SEQ ID NO: 4120089 - RNA, 21 nt, Streptococcus pyogenes MGAS315
aaaucaaaaagcuaacaccau

SEQ ID NO: 4120090 - RNA, 20 nt, Streptococcus pyogenes MGAS315
aaauccuuuugaaaaauuau

SEQ ID NO: 4120091 - RNA, 20 nt, Streptococcus pyogenes MGAS315
aaaucgcccuggagcuguug

SEQ ID NO: 4120092 - RNA, 17 nt, Streptococcus pyogenes MGAS315
aaaucuuacuaacuagc

SEQ ID NO: 4120093 - RNA, 15 nt, Streptococcus pyogenes MGAS315
aaaucuucuagaauc

SEQ ID NO: 4120094 - RNA, 20 nt, Streptococcus pyogenes MGAS315
aaaucuucugcauuaucauc

SEQ ID NO: 4120095 - RNA, 14 nt, Streptococcus pyogenes MGAS315
aaaugacaucaaag

SEQ ID NO: 4120096 - RNA, 15 nt, Streptococcus pyogenes MGAS315
aaaugacaugaaagu

SEQ ID NO: 4120097 - RNA, 13 nt, Streptococcus pyogenes MGAS315
aaaugauacuuuc

SEQ ID NO: 4120098 - RNA, 20 nt, Streptococcus pyogenes MGAS315
aaaugccuccgacaaucgaa

SEQ ID NO: 4120099 - RNA, 18 nt, Streptococcus pyogenes MGAS315
aaauguagagaauuugaa

SEQ ID NO: 4120100 - RNA, 18 nt, Streptococcus pyogenes MGAS315
aaauguaugauuuuaacg

SEQ ID NO: 4120101 - RNA, 13 nt, Streptococcus pyogenes MGAS315
aaaugucuagcuu

SEQ ID NO: 4120102 - RNA, 19 nt, Streptococcus pyogenes MGAS315
aaaugucuagcuuaucuuc

SEQ ID NO: 4120103 - RNA, 15 nt, Streptococcus pyogenes MGAS315
aaaugugguaagaag

SEQ ID NO: 4120104 - RNA, 19 nt, Streptococcus pyogenes MGAS315
aaaugugguaagaagaaaa

SEQ ID NO: 4120105 - RNA, 19 nt, Streptococcus pyogenes MGAS315
aaauguucgaaaaaauacu

SEQ ID NO: 4120106 - RNA, 23 nt, Streptococcus pyogenes MGAS315
aaauuauauuauacuaauauuau

SEQ ID NO: 4120107 - RNA, 21 nt, Streptococcus pyogenes MGAS315
aaauuauuaacguuaacaaaa

SEQ ID NO: 4120108 - RNA, 17 nt, Streptococcus pyogenes MGAS315
aaauuauuauuuugcuu

SEQ ID NO: 4120109 - RNA, 13 nt, Streptococcus pyogenes MGAS315
aaauucaaauacu

SEQ ID NO: 4120110 - RNA, 14 nt, Streptococcus pyogenes MGAS315
aaauucuuuuugaa

SEQ ID NO: 4120111 - RNA, 23 nt, Streptococcus pyogenes MGAS315
aaauucuuuuugaauugaaaaaa

SEQ ID NO: 4120112 - RNA, 22 nt, Streptococcus pyogenes MGAS315
aaauugguccucugaaaaguug

SEQ ID NO: 4120113 - RNA, 17 nt, Streptococcus pyogenes MGAS315
aaauuguaaccacagca

SEQ ID NO: 4120114 - RNA, 23 nt, Streptococcus pyogenes MGAS315
aaauuguagggauuuuuuuaacu

SEQ ID NO: 4120115 - RNA, 14 nt, Streptococcus pyogenes MGAS315
aaauuguuugauug

SEQ ID NO: 4120116 - RNA, 18 nt, Streptococcus pyogenes MGAS315
aaauuucagauaaaaccu

SEQ ID NO: 4120117 - RNA, 23 nt, Streptococcus pyogenes MGAS315
aaauuucaugauguuauuaaaua

SEQ ID NO: 4120118 - RNA, 18 nt, Streptococcus pyogenes MGAS315
aacaauaacacagaagcc

SEQ ID NO: 4120119 - RNA, 17 nt, Streptococcus pyogenes MGAS315
aacaaucuuaaaauaau

SEQ ID NO: 4120120 - RNA, 18 nt, Streptococcus pyogenes MGAS315
aacaaucuuaaaauaauc

SEQ ID NO: 4120121 - RNA, 14 nt, Streptococcus pyogenes MGAS315
aacaaugaaacguu

SEQ ID NO: 4120122 - RNA, 15 nt, Streptococcus pyogenes MGAS315
aacaauuaaaaagca

SEQ ID NO: 4120123 - RNA, 20 nt, Streptococcus pyogenes MGAS315
aacaccaccaauaaugagca

SEQ ID NO: 4120124 - RNA, 22 nt, Streptococcus pyogenes MGAS315
aacaccguucauauaagcaauc

SEQ ID NO: 4120125 - RNA, 18 nt, Streptococcus pyogenes MGAS315
aacacucaucauauuguu

SEQ ID NO: 4120126 - RNA, 22 nt, Streptococcus pyogenes MGAS315
aacagauaagugccaucaggcu

SEQ ID NO: 4120127 - RNA, 18 nt, Streptococcus pyogenes MGAS315
aacagauagucaaaaaga

SEQ ID NO: 4120128 - RNA, 19 nt, Streptococcus pyogenes MGAS315
aacagauagucaaaaagac

SEQ ID NO: 4120129 - RNA, 12 nt, Streptococcus pyogenes MGAS315
aacauaacaauc

SEQ ID NO: 4120130 - RNA, 15 nt, Streptococcus pyogenes MGAS315
aacaucuugauugua

SEQ ID NO: 4120131 - RNA, 22 nt, Streptococcus pyogenes MGAS315
aaccaagugccaguaaggaaau

SEQ ID NO: 4120132 - RNA, 19 nt, Streptococcus pyogenes MGAS315
aaccaauuguugaauaagu

SEQ ID NO: 4120133 - RNA, 19 nt, Streptococcus pyogenes MGAS315
aaccaguugauaccaugug

SEQ ID NO: 4120134 - RNA, 14 nt, Streptococcus pyogenes MGAS315
aaccauagaagcca

SEQ ID NO: 4120135 - RNA, 17 nt, Streptococcus pyogenes MGAS315
aaccauagaagccaauu

SEQ ID NO: 4120136 - RNA, 13 nt, Streptococcus pyogenes MGAS315
aaccauugccauu

SEQ ID NO: 4120137 - RNA, 16 nt, Streptococcus pyogenes MGAS315
aaccugcauaucugcc

SEQ ID NO: 4120138 - RNA, 14 nt, Streptococcus pyogenes MGAS315
aaccuucaaaaaag

SEQ ID NO: 4120139 - RNA, 21 nt, Streptococcus pyogenes MGAS315
aaccuuccuguaucaggaggg

SEQ ID NO: 4120140 - RNA, 22 nt, Streptococcus pyogenes MGAS315
aaccuuuuggcuguauuuacug

SEQ ID NO: 4120141 - RNA, 21 nt, Streptococcus pyogenes MGAS315
aacgaugagauuaacugacaa

SEQ ID NO: 4120142 - RNA, 17 nt, Streptococcus pyogenes MGAS315
aacguaauagaauaaaa

SEQ ID NO: 4120143 - RNA, 15 nt, Streptococcus pyogenes MGAS315
aacguuaacaaaaau

SEQ ID NO: 4120144 - RNA, 19 nt, Streptococcus pyogenes MGAS315
aacguucuguuuaaaauau

SEQ ID NO: 4120145 - RNA, 22 nt, Streptococcus pyogenes MGAS315
aacguucuguuuaaaauauauu

SEQ ID NO: 4120146 - RNA, 20 nt, Streptococcus pyogenes MGAS315
aacuauauuguuaguuuuau

SEQ ID NO: 4120147 - RNA, 18 nt, Streptococcus pyogenes MGAS315
aacuauucuagacccuag

SEQ ID NO: 4120148 - RNA, 18 nt, Streptococcus pyogenes MGAS315
aacucaaaaaauacaaua

SEQ ID NO: 4120149 - RNA, 15 nt, Streptococcus pyogenes MGAS315
aacucaaaccaaaca

SEQ ID NO: 4120150 - RNA, 15 nt, Streptococcus pyogenes MGAS315
aacucgauaaaaacg

SEQ ID NO: 4120151 - RNA, 19 nt, Streptococcus pyogenes MGAS315
aacucuccaaaguucuucu

SEQ ID NO: 4120152 - RNA, 18 nt, Streptococcus pyogenes MGAS315
aacugcacugagccccaa

SEQ ID NO: 4120153 - RNA, 18 nt, Streptococcus pyogenes MGAS315
aacuggcuagccaaaucu

SEQ ID NO: 4120154 - RNA, 22 nt, Streptococcus pyogenes MGAS315
aacuuguuaacaauaaguauau

SEQ ID NO: 4120155 - RNA, 16 nt, Streptococcus pyogenes MGAS315
aacuuucuauuaccua

SEQ ID NO: 4120156 - RNA, 15 nt, Streptococcus pyogenes MGAS315
aagaaagccaagacu

SEQ ID NO: 4120157 - RNA, 22 nt, Streptococcus pyogenes MGAS315
aagaaggaacucuccaaaguuc

SEQ ID NO: 4120158 - RNA, 14 nt, Streptococcus pyogenes MGAS315
aagaaggucaugau

SEQ ID NO: 4120159 - RNA, 22 nt, Streptococcus pyogenes MGAS315
aagaauuggggcggcacuucca

SEQ ID NO: 4120160 - RNA, 16 nt, Streptococcus pyogenes MGAS315
aagacaaaaaacugga

SEQ ID NO: 4120161 - RNA, 14 nt, Streptococcus pyogenes MGAS315
aagacacacaacac

SEQ ID NO: 4120162 - RNA, 15 nt, Streptococcus pyogenes MGAS315
aagacuagagucucu

SEQ ID NO: 4120163 - RNA, 18 nt, Streptococcus pyogenes MGAS315
aagacuauguugcuuaau

SEQ ID NO: 4120164 - RNA, 16 nt, Streptococcus pyogenes MGAS315
aagagaaguaauguuu

SEQ ID NO: 4120165 - RNA, 15 nt, Streptococcus pyogenes MGAS315
aaugaccuuugauaa

SEQ ID NO: 4120166 - RNA, 21 nt, Streptococcus pyogenes MGAS315
aaugacuauagaaaguaaaaa

SEQ ID NO: 4120167 - RNA, 20 nt, Streptococcus pyogenes MGAS315
aaugagcaaggcaagaggag

SEQ ID NO: 4120168 - RNA, 15 nt, Streptococcus pyogenes MGAS315
aaugauagcaccuaa

SEQ ID NO: 4120169 - RNA, 18 nt, Streptococcus pyogenes MGAS315
aaugauaguaaacgaaaa

SEQ ID NO: 4120170 - RNA, 18 nt, Streptococcus pyogenes MGAS315
aaugccaacuuuucaaug

SEQ ID NO: 4120171 - RNA, 23 nt, Streptococcus pyogenes MGAS315
aaugcccaagauggguuagcucu

SEQ ID NO: 4120172 - RNA, 16 nt, Streptococcus pyogenes MGAS315
aaugcugcaaaauuuu

SEQ ID NO: 4120173 - RNA, 19 nt, Streptococcus pyogenes MGAS315
aaugcugcaaaauuuuaaa

SEQ ID NO: 4120174 - RNA, 18 nt, Streptococcus pyogenes MGAS315
aaugcuguuugucauacu

SEQ ID NO: 4120175 - RNA, 21 nt, Streptococcus pyogenes MGAS315
aaugcuuuuuaaucugucggu

SEQ ID NO: 4120176 - RNA, 23 nt, Streptococcus pyogenes MGAS315
aauggaaauuuuaaaugacauga

SEQ ID NO: 4120177 - RNA, 15 nt, Streptococcus pyogenes MGAS315
aauguaugauuuuaa

SEQ ID NO: 4120178 - RNA, 17 nt, Streptococcus pyogenes MGAS315
aaugucauacaaaaaca

SEQ ID NO: 4120179 - RNA, 18 nt, Streptococcus pyogenes MGAS315
aaugucauacaaaaacac

SEQ ID NO: 4120180 - RNA, 23 nt, Streptococcus pyogenes MGAS315
aaugucuagcuuaucuucauagc

SEQ ID NO: 4120181 - RNA, 12 nt, Streptococcus pyogenes MGAS315
aaugucuuguuu

SEQ ID NO: 4120182 - RNA, 21 nt, Streptococcus pyogenes MGAS315
aaugugacaauuggugauuaa

SEQ ID NO: 4120183 - RNA, 18 nt, Streptococcus pyogenes MGAS315
aaugugguaagaagaaaa

SEQ ID NO: 4120184 - RNA, 15 nt, Streptococcus pyogenes MGAS315
aauguucgaaaaaau

SEQ ID NO: 4120185 - RNA, 17 nt, Streptococcus pyogenes MGAS315
aauuaaaaagcaaaaaa

SEQ ID NO: 4120186 - RNA, 16 nt, Streptococcus pyogenes MGAS315
aauuaauaaauuuuug

SEQ ID NO: 4120187 - RNA, 16 nt, Streptococcus pyogenes MGAS315
aauuacuuaucaucau

SEQ ID NO: 4120188 - RNA, 22 nt, Streptococcus pyogenes MGAS315
aauuacuuaucaucaugacaac

SEQ ID NO: 4120189 - RNA, 19 nt, Streptococcus pyogenes MGAS315
aauuagcauauuuugauua

SEQ ID NO: 4120190 - RNA, 15 nt, Streptococcus pyogenes MGAS315
aauuaguauauugua

SEQ ID NO: 4120191 - RNA, 17 nt, Streptococcus pyogenes MGAS315
aauugccaucaauuuuc

SEQ ID NO: 4120192 - RNA, 17 nt, Streptococcus pyogenes MGAS315
aauuguaaccacagcaa

SEQ ID NO: 4120193 - RNA, 14 nt, Streptococcus pyogenes MGAS315
aauugugucauuuc

SEQ ID NO: 4120194 - RNA, 18 nt, Streptococcus pyogenes MGAS315
aauuguucauuaaagcua

SEQ ID NO: 4120195 - RNA, 19 nt, Streptococcus pyogenes MGAS315
aauuguuuuaguaaagccu

SEQ ID NO: 4120196 - RNA, 19 nt, Streptococcus pyogenes MGAS315
aauuuauuuuucauuugaa

SEQ ID NO: 4120197 - RNA, 20 nt, Streptococcus pyogenes MGAS315
aauuuauuuuucauuugaaa

SEQ ID NO: 4120198 - RNA, 16 nt, Streptococcus pyogenes MGAS315
aauuucagauaaaacc

SEQ ID NO: 4120199 - RNA, 21 nt, Streptococcus pyogenes MGAS315
aauuuggagagauaaaaagua

SEQ ID NO: 4120200 - RNA, 17 nt, Streptococcus pyogenes MGAS315
aauuugguggaagagua

SEQ ID NO: 4120201 - RNA, 13 nt, Streptococcus pyogenes MGAS315
aauuuucauuuuu

SEQ ID NO: 4120202 - RNA, 13 nt, Streptococcus pyogenes MGAS315
acaaaagggaaga

SEQ ID NO: 4120203 - RNA, 20 nt, Streptococcus pyogenes MGAS315
acaaaaugaagcaaaauaaa

SEQ ID NO: 4120204 - RNA, 14 nt, Streptococcus pyogenes MGAS315
acaaacucugccaa

SEQ ID NO: 4120205 - RNA, 18 nt, Streptococcus pyogenes MGAS315
acaaaguuucaagugcua

SEQ ID NO: 4120206 - RNA, 17 nt, Streptococcus pyogenes MGAS315
acaaauacagaaaaaag

SEQ ID NO: 4120207 - RNA, 20 nt, Streptococcus pyogenes MGAS315
acaaauacagaaaaaagcuu

SEQ ID NO: 4120208 - RNA, 13 nt, Streptococcus pyogenes MGAS315
acaacauccauac

SEQ ID NO: 4120209 - RNA, 18 nt, Streptococcus pyogenes MGAS315
acaacauccauaccauca

SEQ ID NO: 4120210 - RNA, 20 nt, Streptococcus pyogenes MGAS315
acaacuggcuagccaaaucu

SEQ ID NO: 4120211 - RNA, 14 nt, Streptococcus pyogenes MGAS315
acaagagcuuaaaa

SEQ ID NO: 4120212 - RNA, 15 nt, Streptococcus pyogenes MGAS315
acaagagcuuaaaag

SEQ ID NO: 4120213 - RNA, 18 nt, Streptococcus pyogenes MGAS315
acaagcaucuuugcaggg

SEQ ID NO: 4120214 - RNA, 14 nt, Streptococcus pyogenes MGAS315
acaaggcaauccaa

SEQ ID NO: 4120215 - RNA, 20 nt, Streptococcus pyogenes MGAS315
acaaggcaauccaaaucaac

SEQ ID NO: 4120216 - RNA, 19 nt, Streptococcus pyogenes MGAS315
acaauacaaaaaaccuucc

SEQ ID NO: 4120217 - RNA, 14 nt, Streptococcus pyogenes MGAS315
acaaugaaacguua

SEQ ID NO: 4120218 - RNA, 15 nt, Streptococcus pyogenes MGAS315
acaauuaaaaagcaa

SEQ ID NO: 4120219 - RNA, 15 nt, Streptococcus pyogenes MGAS315
acacagaagccucuu

SEQ ID NO: 4120220 - RNA, 15 nt, Streptococcus pyogenes MGAS315
acaccaaaaaaagca

SEQ ID NO: 4120221 - RNA, 14 nt, Streptococcus pyogenes MGAS315
acaccuaauaaaau

SEQ ID NO: 4120222 - RNA, 21 nt, Streptococcus pyogenes MGAS315
acaccuaauaaaauagcaccu

SEQ ID NO: 4120223 - RNA, 16 nt, Streptococcus pyogenes MGAS315
acagaagccucuucug

SEQ ID NO: 4120224 - RNA, 15 nt, Streptococcus pyogenes MGAS315
acagcguaagccaaa

SEQ ID NO: 4120225 - RNA, 18 nt, Streptococcus pyogenes MGAS315
acagcguaagccaaaucu

SEQ ID NO: 4120226 - RNA, 19 nt, Streptococcus pyogenes MGAS315
acagcguaagccaaaucuu

SEQ ID NO: 4120227 - RNA, 16 nt, Streptococcus pyogenes MGAS315
acaguauguaaauaua

SEQ ID NO: 4120228 - RNA, 15 nt, Streptococcus pyogenes MGAS315
acaguuaaaaauaac

SEQ ID NO: 4120229 - RNA, 13 nt, Streptococcus pyogenes MGAS315
acauaguguuuug

SEQ ID NO: 4120230 - RNA, 13 nt, Streptococcus pyogenes MGAS315
acaucaaaaaaag

SEQ ID NO: 4120231 - RNA, 14 nt, Streptococcus pyogenes MGAS315
acaucaaaaaaagc

SEQ ID NO: 4120232 - RNA, 16 nt, Streptococcus pyogenes MGAS315
acaucaaaaaaagcaa

SEQ ID NO: 4120233 - RNA, 19 nt, Streptococcus pyogenes MGAS315
acaucaaaaaaagcaauga

SEQ ID NO: 4120234 - RNA, 20 nt, Streptococcus pyogenes MGAS315
acaucaaaggcuuuuuugua

SEQ ID NO: 4120235 - RNA, 21 nt, Streptococcus pyogenes MGAS315
acaucaaaggcuuuuuuguau

SEQ ID NO: 4120236 - RNA, 15 nt, Streptococcus pyogenes MGAS315
acaucacguaaccaa

SEQ ID NO: 4120237 - RNA, 19 nt, Streptococcus pyogenes MGAS315
acauuucgugucuaaaaua

SEQ ID NO: 4120238 - RNA, 15 nt, Streptococcus pyogenes MGAS315
accaaaaccaagugc

SEQ ID NO: 4120239 - RNA, 18 nt, Streptococcus pyogenes MGAS315
accaacuuggacgaaggc

SEQ ID NO: 4120240 - RNA, 15 nt, Streptococcus pyogenes MGAS315
accaagugcugccau

SEQ ID NO: 4120241 - RNA, 20 nt, Streptococcus pyogenes MGAS315
accaagugcugccauuguga

SEQ ID NO: 4120242 - RNA, 18 nt, Streptococcus pyogenes MGAS315
accaauaaugagcaaggc

SEQ ID NO: 4120243 - RNA, 16 nt, Streptococcus pyogenes MGAS315
accaauuguugaauaa

SEQ ID NO: 4120244 - RNA, 17 nt, Streptococcus pyogenes MGAS315
accaauuuaagguauug

SEQ ID NO: 4120245 - RNA, 21 nt, Streptococcus pyogenes MGAS315
accaauuuaagguauuguuca

SEQ ID NO: 4120246 - RNA, 18 nt, Streptococcus pyogenes MGAS315
accacaccuaauaaaaua

SEQ ID NO: 4120247 - RNA, 20 nt, Streptococcus pyogenes MGAS315
accacacgauuaaccguucc

SEQ ID NO: 4120248 - RNA, 21 nt, Streptococcus pyogenes MGAS315
accaucaaugacuugaccaaa

SEQ ID NO: 4120249 - RNA, 12 nt, Streptococcus pyogenes MGAS315
accaugccuaaa

SEQ ID NO: 4120250 - RNA, 12 nt, Streptococcus pyogenes MGAS315
accauugccauu

SEQ ID NO: 4120251 - RNA, 13 nt, Streptococcus pyogenes MGAS315
accauugccauua

SEQ ID NO: 4120252 - RNA, 22 nt, Streptococcus pyogenes MGAS315
accauugccauuaauaauauua

SEQ ID NO: 4120253 - RNA, 21 nt, Streptococcus pyogenes MGAS315
accauuuaugaggccaauaau

SEQ ID NO: 4120254 - RNA, 15 nt, Streptococcus pyogenes MGAS315
acccgucuuacaauu

SEQ ID NO: 4120255 - RNA, 19 nt, Streptococcus pyogenes MGAS315
acccgucuuacaauuaaua

SEQ ID NO: 4120256 - RNA, 19 nt, Streptococcus pyogenes MGAS315
accgaaaaaggcaaagaaa

SEQ ID NO: 4120257 - RNA, 15 nt, Streptococcus pyogenes MGAS315
accgcgaauaugaua

SEQ ID NO: 4120258 - RNA, 14 nt, Streptococcus pyogenes MGAS315
accgcuaaaacagu

SEQ ID NO: 4120259 - RNA, 18 nt, Streptococcus pyogenes MGAS315
accgcucauuugaugagc

SEQ ID NO: 4120260 - RNA, 15 nt, Streptococcus pyogenes MGAS315
accgucacuauugaa

SEQ ID NO: 4120261 - RNA, 18 nt, Streptococcus pyogenes MGAS315
accguuccugucgcagau

SEQ ID NO: 4120262 - RNA, 13 nt, Streptococcus pyogenes MGAS315
accuaauaaaaua

SEQ ID NO: 4120263 - RNA, 19 nt, Streptococcus pyogenes MGAS315
accuccuaaacuaauaaga

SEQ ID NO: 4120264 - RNA, 16 nt, Streptococcus pyogenes MGAS315
agcaagugagaacaug

SEQ ID NO: 4120265 - RNA, 22 nt, Streptococcus pyogenes MGAS315
agcaaucauacccgcguuaucu

SEQ ID NO: 4120266 - RNA, 22 nt, Streptococcus pyogenes MGAS315
agcaaucaucauuuagcugaua

SEQ ID NO: 4120267 - RNA, 17 nt, Streptococcus pyogenes MGAS315
agcaaugguuaaaaaga

SEQ ID NO: 4120268 - RNA, 19 nt, Streptococcus pyogenes MGAS315
agcaaugguuaaaaagaga

SEQ ID NO: 4120269 - RNA, 15 nt, Streptococcus pyogenes MGAS315
agcaggcguuuuguu

SEQ ID NO: 4120270 - RNA, 15 nt, Streptococcus pyogenes MGAS315
agcaguuauaauuag

SEQ ID NO: 4120271 - RNA, 23 nt, Streptococcus pyogenes MGAS315
agcaguugcgaucauaaauaaag

SEQ ID NO: 4120272 - RNA, 23 nt, Streptococcus pyogenes MGAS315
agcauaaaagauauuuuaaaaua

SEQ ID NO: 4120273 - RNA, 18 nt, Streptococcus pyogenes MGAS315
agcauaaccuuugccauu

SEQ ID NO: 4120274 - RNA, 15 nt, Streptococcus pyogenes MGAS315
agcaucaaaaccaag

SEQ ID NO: 4120275 - RNA, 18 nt, Streptococcus pyogenes MGAS315
agcaugauuuaguuuuua

SEQ ID NO: 4120276 - RNA, 16 nt, Streptococcus pyogenes MGAS315
agcauuugccauggca

SEQ ID NO: 4120277 - RNA, 17 nt, Streptococcus pyogenes MGAS315
agcauuuugagaacgaa

SEQ ID NO: 4120278 - RNA, 22 nt, Streptococcus pyogenes MGAS315
agccaaaucuggcuuagcagca

SEQ ID NO: 4120279 - RNA, 12 nt, Streptococcus pyogenes MGAS315
agccaagcaauc

SEQ ID NO: 4120280 - RNA, 22 nt, Streptococcus pyogenes MGAS315
agcccuuuuugccuuuaacaug

SEQ ID NO: 4120281 - RNA, 17 nt, Streptococcus pyogenes MGAS315
agccuacaacagcagca

SEQ ID NO: 4120282 - RNA, 13 nt, Streptococcus pyogenes MGAS315
agccuuauccauu

SEQ ID NO: 4120283 - RNA, 15 nt, Streptococcus pyogenes MGAS315
agccuuuaucaacuu

SEQ ID NO: 4120284 - RNA, 20 nt, Streptococcus pyogenes MGAS315
agcgccagcaauuuucccau

SEQ ID NO: 4120285 - RNA, 17 nt, Streptococcus pyogenes MGAS315
agcguaagccaaaucuu

SEQ ID NO: 4120286 - RNA, 22 nt, Streptococcus pyogenes MGAS315
agcguugacaguuaaaaauaac

SEQ ID NO: 4120287 - RNA, 14 nt, Streptococcus pyogenes MGAS315
agcuauagaaacuu

SEQ ID NO: 4120288 - RNA, 14 nt, Streptococcus pyogenes MGAS315
agcuccuaaaacca

SEQ ID NO: 4120289 - RNA, 18 nt, Streptococcus pyogenes MGAS315
agcugaguaaaacaauaa

SEQ ID NO: 4120290 - RNA, 15 nt, Streptococcus pyogenes MGAS315
agcugauaggucugc

SEQ ID NO: 4120291 - RNA, 20 nt, Streptococcus pyogenes MGAS315
agcugcugcuaaagcaauca

SEQ ID NO: 4120292 - RNA, 20 nt, Streptococcus pyogenes MGAS315
agcuuaaugucauacaaaaa

SEQ ID NO: 4120293 - RNA, 15 nt, Streptococcus pyogenes MGAS315
agcuuaucaagguug

SEQ ID NO: 4120294 - RNA, 15 nt, Streptococcus pyogenes MGAS315
agcuuguagcuuagc

SEQ ID NO: 4120295 - RNA, 19 nt, Streptococcus pyogenes MGAS315
agcuuguagcuuagcaacu

SEQ ID NO: 4120296 - RNA, 16 nt, Streptococcus pyogenes MGAS315
agcuuuuuaaagagcc

SEQ ID NO: 4120297 - RNA, 13 nt, Streptococcus pyogenes MGAS315
aggaauaaaaugc

SEQ ID NO: 4120298 - RNA, 15 nt, Streptococcus pyogenes MGAS315
aggacgguuucccuu

SEQ ID NO: 4120299 - RNA, 14 nt, Streptococcus pyogenes MGAS315
aggaggcaacugug

SEQ ID NO: 4120300 - RNA, 20 nt, Streptococcus pyogenes MGAS315
aggcaauccaaaucaacaug

SEQ ID NO: 4120301 - RNA, 17 nt, Streptococcus pyogenes MGAS315
aggcagacaauuauuuu

SEQ ID NO: 4120302 - RNA, 14 nt, Streptococcus pyogenes MGAS315
aggcaggacgguuu

SEQ ID NO: 4120303 - RNA, 17 nt, Streptococcus pyogenes MGAS315
aggcaguucgauuauua

SEQ ID NO: 4120304 - RNA, 23 nt, Streptococcus pyogenes MGAS315
aggccuagcuuuuuacaucaaaa

SEQ ID NO: 4120305 - RNA, 15 nt, Streptococcus pyogenes MGAS315
aggccuguauuucuu

SEQ ID NO: 4120306 - RNA, 13 nt, Streptococcus pyogenes MGAS315
aggcucugcugau

SEQ ID NO: 4120307 - RNA, 21 nt, Streptococcus pyogenes MGAS315
aggcuuguucuuuauuuugau

SEQ ID NO: 4120308 - RNA, 20 nt, Streptococcus pyogenes MGAS315
agggaaacaccaccaauaau

SEQ ID NO: 4120309 - RNA, 23 nt, Streptococcus pyogenes MGAS315
agggguaauuugguggaagagua

SEQ ID NO: 4120310 - RNA, 13 nt, Streptococcus pyogenes MGAS315
aggguuauuauuu

SEQ ID NO: 4120311 - RNA, 16 nt, Streptococcus pyogenes MGAS315
agguaaagauuuuaaa

SEQ ID NO: 4120312 - RNA, 21 nt, Streptococcus pyogenes MGAS315
agguagaugauuauauuagga

SEQ ID NO: 4120313 - RNA, 23 nt, Streptococcus pyogenes MGAS315
aggucugcgcgacuaaaaucaug

SEQ ID NO: 4120314 - RNA, 18 nt, Streptococcus pyogenes MGAS315
aggugaguuuuuucuaaa

SEQ ID NO: 4120315 - RNA, 22 nt, Streptococcus pyogenes MGAS315
aggugaguuuuuucuaaaagag

SEQ ID NO: 4120316 - RNA, 16 nt, Streptococcus pyogenes MGAS315
aggugauugacuugug

SEQ ID NO: 4120317 - RNA, 20 nt, Streptococcus pyogenes MGAS315
agguugguaaaaaggcaguc

SEQ ID NO: 4120318 - RNA, 13 nt, Streptococcus pyogenes MGAS315
aguaaaaagcaaa

SEQ ID NO: 4120319 - RNA, 18 nt, Streptococcus pyogenes MGAS315
aguaaaggauuuaguucu

SEQ ID NO: 4120320 - RNA, 15 nt, Streptococcus pyogenes MGAS315
aguaaggaaaucaau

SEQ ID NO: 4120321 - RNA, 16 nt, Streptococcus pyogenes MGAS315
aguaaggaccaagauu

SEQ ID NO: 4120322 - RNA, 21 nt, Streptococcus pyogenes MGAS315
aguaaugugggauauuuagau

SEQ ID NO: 4120323 - RNA, 16 nt, Streptococcus pyogenes MGAS315
aguauacucagucacu

SEQ ID NO: 4120324 - RNA, 23 nt, Streptococcus pyogenes MGAS315
aguauacucagucacugcagcau

SEQ ID NO: 4120325 - RNA, 23 nt, Streptococcus pyogenes MGAS315
aguauaucauuaucaacaaucuu

SEQ ID NO: 4120326 - RNA, 21 nt, Streptococcus pyogenes MGAS315
aguaucuaggagggacuguca

SEQ ID NO: 4120327 - RNA, 16 nt, Streptococcus pyogenes MGAS315
aguauuuuaaaauccu

SEQ ID NO: 4120328 - RNA, 12 nt, Streptococcus pyogenes MGAS315
agucaaaccagu

SEQ ID NO: 4120329 - RNA, 22 nt, Streptococcus pyogenes MGAS315
agucacugcagcaucaaaacca

SEQ ID NO: 4120330 - RNA, 14 nt, Streptococcus pyogenes MGAS315
agucagaucauuaa

SEQ ID NO: 4120331 - RNA, 22 nt, Streptococcus pyogenes MGAS315
agucagaucauuaaauugauua

SEQ ID NO: 4120332 - RNA, 15 nt, Streptococcus pyogenes MGAS315
agucugcaugaagug

SEQ ID NO: 4120333 - RNA, 15 nt, Streptococcus pyogenes MGAS315
agugcgcuuccagaa

SEQ ID NO: 4120334 - RNA, 13 nt, Streptococcus pyogenes MGAS315
agugcugccauug

SEQ ID NO: 4120335 - RNA, 16 nt, Streptococcus pyogenes MGAS315
agugguuugcaaauag

SEQ ID NO: 4120336 - RNA, 17 nt, Streptococcus pyogenes MGAS315
aguguauuacuucuuuu

SEQ ID NO: 4120337 - RNA, 13 nt, Streptococcus pyogenes MGAS315
aguguuuugaaug

SEQ ID NO: 4120338 - RNA, 20 nt, Streptococcus pyogenes MGAS315
aguuaaaaauaacuuuaaaa

SEQ ID NO: 4120339 - RNA, 13 nt, Streptococcus pyogenes MGAS315
aguuaauaagaca

SEQ ID NO: 4120340 - RNA, 16 nt, Streptococcus pyogenes MGAS315
aguuaaugccaacuuu

SEQ ID NO: 4120341 - RNA, 19 nt, Streptococcus pyogenes MGAS315
aguuaaugccaacuuuuca

SEQ ID NO: 4120342 - RNA, 20 nt, Streptococcus pyogenes MGAS315
aguuauagcuccuaaaacca

SEQ ID NO: 4120343 - RNA, 17 nt, Streptococcus pyogenes MGAS315
aguuaucacuaaggcug

SEQ ID NO: 4120344 - RNA, 19 nt, Streptococcus pyogenes MGAS315
aguucaauggauauaacaa

SEQ ID NO: 4120345 - RNA, 23 nt, Streptococcus pyogenes MGAS315
aguucauaguugugcuagucuuu

SEQ ID NO: 4120346 - RNA, 14 nt, Streptococcus pyogenes MGAS315
aguucgauuauuaa

SEQ ID NO: 4120347 - RNA, 17 nt, Streptococcus pyogenes MGAS315
aguugguacuugauaau

SEQ ID NO: 4120348 - RNA, 15 nt, Streptococcus pyogenes MGAS315
aguugugccuuuucu

SEQ ID NO: 4120349 - RNA, 16 nt, Streptococcus pyogenes MGAS315
aguugugccuuuucuu

SEQ ID NO: 4120350 - RNA, 23 nt, Streptococcus pyogenes MGAS315
aguuuucucagagacaauaaggu

SEQ ID NO: 4120351 - RNA, 14 nt, Streptococcus pyogenes MGAS315
auaaaacaaauaau

SEQ ID NO: 4120352 - RNA, 15 nt, Streptococcus pyogenes MGAS315
auaaaacaaauaauu

SEQ ID NO: 4120353 - RNA, 14 nt, Streptococcus pyogenes MGAS315
auaaaaccuucaaa

SEQ ID NO: 4120354 - RNA, 15 nt, Streptococcus pyogenes MGAS315
auaaaaccuucaaaa

SEQ ID NO: 4120355 - RNA, 16 nt, Streptococcus pyogenes MGAS315
auaaaaccuucaaaaa

SEQ ID NO: 4120356 - RNA, 14 nt, Streptococcus pyogenes MGAS315
auaaaagauauuuu

SEQ ID NO: 4120357 - RNA, 13 nt, Streptococcus pyogenes MGAS315
auaaacuacacca

SEQ ID NO: 4120358 - RNA, 19 nt, Streptococcus pyogenes MGAS315
auaaacucuauacaaaaag

SEQ ID NO: 4120359 - RNA, 18 nt, Streptococcus pyogenes MGAS315
auaaagaaacaaaaauga

SEQ ID NO: 4120360 - RNA, 22 nt, Streptococcus pyogenes MGAS315
auaaagcguugacaguuaaaaa

SEQ ID NO: 4120361 - RNA, 15 nt, Streptococcus pyogenes MGAS315
auaacaaauuuaucc

SEQ ID NO: 4120362 - RNA, 17 nt, Streptococcus pyogenes MGAS315
auaaccagcugauaggu

SEQ ID NO: 4120363 - RNA, 16 nt, Streptococcus pyogenes MGAS315
augacgguaaauaaag

SEQ ID NO: 4120364 - RNA, 18 nt, Streptococcus pyogenes MGAS315
augacugacaaaacuuca

SEQ ID NO: 4120365 - RNA, 14 nt, Streptococcus pyogenes MGAS315
augacuguauguau

SEQ ID NO: 4120366 - RNA, 14 nt, Streptococcus pyogenes MGAS315
augacuugaccaaa

SEQ ID NO: 4120367 - RNA, 14 nt, Streptococcus pyogenes MGAS315
augagacuaaccug

SEQ ID NO: 4120368 - RNA, 23 nt, Streptococcus pyogenes MGAS315
augagauaccuucauagacaagc

SEQ ID NO: 4120369 - RNA, 13 nt, Streptococcus pyogenes MGAS315
augagcaaggcaa

SEQ ID NO: 4120370 - RNA, 19 nt, Streptococcus pyogenes MGAS315
augauagccuuuaucaacu

SEQ ID NO: 4120371 - RNA, 16 nt, Streptococcus pyogenes MGAS315
augaucuguuuaaaaa

SEQ ID NO: 4120372 - RNA, 17 nt, Streptococcus pyogenes MGAS315
augaucuguuuaaaaac

SEQ ID NO: 4120373 - RNA, 22 nt, Streptococcus pyogenes MGAS315
augaugccauuuaaaagggcaa

SEQ ID NO: 4120374 - RNA, 18 nt, Streptococcus pyogenes MGAS315
augauuauauuaggauau

SEQ ID NO: 4120375 - RNA, 20 nt, Streptococcus pyogenes MGAS315
augauuugucaaaaaguaaa

SEQ ID NO: 4120376 - RNA, 23 nt, Streptococcus pyogenes MGAS315
augcacacaaaucuucuagaauc

SEQ ID NO: 4120377 - RNA, 20 nt, Streptococcus pyogenes MGAS315
augcagguguuuaaagaccu

SEQ ID NO: 4120378 - RNA, 23 nt, Streptococcus pyogenes MGAS315
augccaagauaccggguuguuuu

SEQ ID NO: 4120379 - RNA, 19 nt, Streptococcus pyogenes MGAS315
augccccaaaguaauccaa

SEQ ID NO: 4120380 - RNA, 18 nt, Streptococcus pyogenes MGAS315
augcgcucaagcauuuug

SEQ ID NO: 4120381 - RNA, 17 nt, Streptococcus pyogenes MGAS315
augcucauaggcagaga

SEQ ID NO: 4120382 - RNA, 22 nt, Streptococcus pyogenes MGAS315
augcuccuccaccaaaaccaag

SEQ ID NO: 4120383 - RNA, 18 nt, Streptococcus pyogenes MGAS315
augcucucauaaacaaug

SEQ ID NO: 4120384 - RNA, 16 nt, Streptococcus pyogenes MGAS315
augcugaguucuuuuu

SEQ ID NO: 4120385 - RNA, 18 nt, Streptococcus pyogenes MGAS315
augcuucuuucaaacgga

SEQ ID NO: 4120386 - RNA, 21 nt, Streptococcus pyogenes MGAS315
auggacgucuucuuuuuauua

SEQ ID NO: 4120387 - RNA, 19 nt, Streptococcus pyogenes MGAS315
auggcagagucauuuaguu

SEQ ID NO: 4120388 - RNA, 13 nt, Streptococcus pyogenes MGAS315
auggguaugccug

SEQ ID NO: 4120389 - RNA, 14 nt, Streptococcus pyogenes MGAS315
auguaauugucucu

SEQ ID NO: 4120390 - RNA, 16 nt, Streptococcus pyogenes MGAS315
auguaguuguaagguu

SEQ ID NO: 4120391 - RNA, 15 nt, Streptococcus pyogenes MGAS315
augucauacaaaaac

SEQ ID NO: 4120392 - RNA, 17 nt, Streptococcus pyogenes MGAS315
auguucgaaaaaauacu

SEQ ID NO: 4120393 - RNA, 18 nt, Streptococcus pyogenes MGAS315
auguucgaaaaaauacuu

SEQ ID NO: 4120394 - RNA, 13 nt, Streptococcus pyogenes MGAS315
auguuuuauuacc

SEQ ID NO: 4120395 - RNA, 23 nt, Streptococcus pyogenes MGAS315
auuaaauaauacagcauacauca

SEQ ID NO: 4120396 - RNA, 12 nt, Streptococcus pyogenes MGAS315
auuaauaaauuu

SEQ ID NO: 4120397 - RNA, 13 nt, Streptococcus pyogenes MGAS315
auuaaucaaaaaa

SEQ ID NO: 4120398 - RNA, 14 nt, Streptococcus pyogenes MGAS315
auuacucaauuaau

SEQ ID NO: 4120399 - RNA, 23 nt, Streptococcus pyogenes MGAS315
auuacugaaauauaugaugaggu

SEQ ID NO: 4120400 - RNA, 16 nt, Streptococcus pyogenes MGAS315
auuagaauaagaaaac

SEQ ID NO: 4120401 - RNA, 15 nt, Streptococcus pyogenes MGAS315
auuagcaaaaugcug

SEQ ID NO: 4120402 - RNA, 17 nt, Streptococcus pyogenes MGAS315
auuagcgccagcauuug

SEQ ID NO: 4120403 - RNA, 14 nt, Streptococcus pyogenes MGAS315
auuaguaaccauag

SEQ ID NO: 4120404 - RNA, 13 nt, Streptococcus pyogenes MGAS315
auuauauuaggau

SEQ ID NO: 4120405 - RNA, 13 nt, Streptococcus pyogenes MGAS315
auuaucaauaaca

SEQ ID NO: 4120406 - RNA, 17 nt, Streptococcus pyogenes MGAS315
auuaucugaauuauuag

SEQ ID NO: 4120407 - RNA, 19 nt, Streptococcus pyogenes MGAS315
auuaucugaauuauuagua

SEQ ID NO: 4120408 - RNA, 15 nt, Streptococcus pyogenes MGAS315
auuaucugauaaggu

SEQ ID NO: 4120409 - RNA, 19 nt, Streptococcus pyogenes MGAS315
auuaugccaaauuucagau

SEQ ID NO: 4120410 - RNA, 18 nt, Streptococcus pyogenes MGAS315
auuauuaaccaauuccuc

SEQ ID NO: 4120411 - RNA, 22 nt, Streptococcus pyogenes MGAS315
auuauuaaccaauuccucccua

SEQ ID NO: 4120412 - RNA, 21 nt, Streptococcus pyogenes MGAS315
auuauuaacguuaacaaaaau

SEQ ID NO: 4120413 - RNA, 18 nt, Streptococcus pyogenes MGAS315
auuauugucacugaaaaa

SEQ ID NO: 4120414 - RNA, 17 nt, Streptococcus pyogenes MGAS315
auucaauauuuuauuaa

SEQ ID NO: 4120415 - RNA, 12 nt, Streptococcus pyogenes MGAS315
auucaucuugcc

SEQ ID NO: 4120416 - RNA, 19 nt, Streptococcus pyogenes MGAS315
auucaugacgccuccaaau

SEQ ID NO: 4120417 - RNA, 16 nt, Streptococcus pyogenes MGAS315
auuccggcagggguca

SEQ ID NO: 4120418 - RNA, 15 nt, Streptococcus pyogenes MGAS315
auuccuuaaauuaua

SEQ ID NO: 4120419 - RNA, 20 nt, Streptococcus pyogenes MGAS315
auucuagacccuagcauaaa

SEQ ID NO: 4120420 - RNA, 14 nt, Streptococcus pyogenes MGAS315
auucuuauccauua

SEQ ID NO: 4120421 - RNA, 15 nt, Streptococcus pyogenes MGAS315
auucuuuauaauggu

SEQ ID NO: 4120422 - RNA, 22 nt, Streptococcus pyogenes MGAS315
auucuuuuuccguuugagauaa

SEQ ID NO: 4120423 - RNA, 13 nt, Streptococcus pyogenes MGAS315
auucuuuuuuacc

SEQ ID NO: 4120424 - RNA, 14 nt, Streptococcus pyogenes MGAS315
auucuuuuuuaccu

SEQ ID NO: 4120425 - RNA, 16 nt, Streptococcus pyogenes MGAS315
auugaaucuuguuuaa

SEQ ID NO: 4120426 - RNA, 21 nt, Streptococcus pyogenes MGAS315
auugacaaauccaaugacuaa

SEQ ID NO: 4120427 - RNA, 18 nt, Streptococcus pyogenes MGAS315
auugagaccaaaugaccu

SEQ ID NO: 4120428 - RNA, 22 nt, Streptococcus pyogenes MGAS315
auugagguaaucguaaugucuu

SEQ ID NO: 4120429 - RNA, 16 nt, Streptococcus pyogenes MGAS315
auugauacaaagacuu

SEQ ID NO: 4120430 - RNA, 17 nt, Streptococcus pyogenes MGAS315
auugauuauucucuauu

SEQ ID NO: 4120431 - RNA, 20 nt, Streptococcus pyogenes MGAS315
auuguaauaacaaaaugaag

SEQ ID NO: 4120432 - RNA, 15 nt, Streptococcus pyogenes MGAS315
auuguagggauuuuu

SEQ ID NO: 4120433 - RNA, 21 nt, Streptococcus pyogenes MGAS315
auuguagggauuuuuuuaacu

SEQ ID NO: 4120434 - RNA, 13 nt, Streptococcus pyogenes MGAS315
auuguauuugaug

SEQ ID NO: 4120435 - RNA, 14 nt, Streptococcus pyogenes MGAS315
auugucaaauaaaa

SEQ ID NO: 4120436 - RNA, 17 nt, Streptococcus pyogenes MGAS315
auugucacugaaaaagc

SEQ ID NO: 4120437 - RNA, 18 nt, Streptococcus pyogenes MGAS315
auuguuuuaguaaagccu

SEQ ID NO: 4120438 - RNA, 17 nt, Streptococcus pyogenes MGAS315
auuuaagguauuguuca

SEQ ID NO: 4120439 - RNA, 14 nt, Streptococcus pyogenes MGAS315
auuuacagauguau

SEQ ID NO: 4120440 - RNA, 15 nt, Streptococcus pyogenes MGAS315
auuuagaaauuuuau

SEQ ID NO: 4120441 - RNA, 17 nt, Streptococcus pyogenes MGAS315
auuuagaaauuuuauug

SEQ ID NO: 4120442 - RNA, 23 nt, Streptococcus pyogenes MGAS315
auuuagguacucguaagcauuuu

SEQ ID NO: 4120443 - RNA, 16 nt, Streptococcus pyogenes MGAS315
auuuaguuauuuuuga

SEQ ID NO: 4120444 - RNA, 24 nt, Streptococcus pyogenes MGAS315
auuuaugaggccaauaaugccauc

SEQ ID NO: 4120445 - RNA, 17 nt, Streptococcus pyogenes MGAS315
auuucaauaauaccauu

SEQ ID NO: 4120446 - RNA, 18 nt, Streptococcus pyogenes MGAS315
auuucaauaauaccauuu

SEQ ID NO: 4120447 - RNA, 21 nt, Streptococcus pyogenes MGAS315
auuucaauaauaccauuuuua

SEQ ID NO: 4120448 - RNA, 16 nt, Streptococcus pyogenes MGAS315
auuucagauaaaaccu

SEQ ID NO: 4120449 - RNA, 16 nt, Streptococcus pyogenes MGAS315
auuuccuacaaaauaa

SEQ ID NO: 4120450 - RNA, 15 nt, Streptococcus pyogenes MGAS315
auuucguugacaaag

SEQ ID NO: 4120451 - RNA, 16 nt, Streptococcus pyogenes MGAS315
auuucguugacaaagc

SEQ ID NO: 4120452 - RNA, 21 nt, Streptococcus pyogenes MGAS315
auuugaacguucuguuuaaaa

SEQ ID NO: 4120453 - RNA, 16 nt, Streptococcus pyogenes MGAS315
auuugacuacuagcau

SEQ ID NO: 4120454 - RNA, 19 nt, Streptococcus pyogenes MGAS315
auuugccauggcaagagca

SEQ ID NO: 4120455 - RNA, 22 nt, Streptococcus pyogenes MGAS315
auuugucuauuguauuugaugg

SEQ ID NO: 4120456 - RNA, 17 nt, Streptococcus pyogenes MGAS315
auuuguuaacaggugac

SEQ ID NO: 4120457 - RNA, 14 nt, Streptococcus pyogenes MGAS315
auuuuaaaauaguu

SEQ ID NO: 4120458 - RNA, 21 nt, Streptococcus pyogenes MGAS315
auuuuaaaauccucuuuuaau

SEQ ID NO: 4120459 - RNA, 20 nt, Streptococcus pyogenes MGAS315
auuuuaaauaucuuaccauu

SEQ ID NO: 4120460 - RNA, 13 nt, Streptococcus pyogenes MGAS315
auuuuaagacaac

SEQ ID NO: 4120461 - RNA, 19 nt, Streptococcus pyogenes MGAS315
auuuuaaucuuuuugugau

SEQ ID NO: 4120462 - RNA, 11 nt, Streptococcus pyogenes MGAS315
cagugcugcug

SEQ ID NO: 4120463 - RNA, 17 nt, Streptococcus pyogenes MGAS315
cagugcugcugaacugc

SEQ ID NO: 4120464 - RNA, 16 nt, Streptococcus pyogenes MGAS315
caguuucccauguuuu

SEQ ID NO: 4120465 - RNA, 21 nt, Streptococcus pyogenes MGAS315
caguuucccauguuuuauuac

SEQ ID NO: 4120466 - RNA, 23 nt, Streptococcus pyogenes MGAS315
caguuucccauguuuuauuacca

SEQ ID NO: 4120467 - RNA, 20 nt, Streptococcus pyogenes MGAS315
cauaaaaaaccuuaucaaac

SEQ ID NO: 4120468 - RNA, 14 nt, Streptococcus pyogenes MGAS315
cauaacaaauuuau

SEQ ID NO: 4120469 - RNA, 20 nt, Streptococcus pyogenes MGAS315
cauacaaaaacaccccaaac

SEQ ID NO: 4120470 - RNA, 14 nt, Streptococcus pyogenes MGAS315
cauaccaucaauga

SEQ ID NO: 4120471 - RNA, 18 nt, Streptococcus pyogenes MGAS315
cauacucaauagcugcug

SEQ ID NO: 4120472 - RNA, 19 nt, Streptococcus pyogenes MGAS315
cauacucuugucgcugaau

SEQ ID NO: 4120473 - RNA, 22 nt, Streptococcus pyogenes MGAS315
cauacuuuauuaaucaaaaaac

SEQ ID NO: 4120474 - RNA, 19 nt, Streptococcus pyogenes MGAS315
cauaguugugcuagucuuu

SEQ ID NO: 4120475 - RNA, 22 nt, Streptococcus pyogenes MGAS315
cauaucuucacgggcugccauu

SEQ ID NO: 4120476 - RNA, 22 nt, Streptococcus pyogenes MGAS315
cauaugauggaucguuuugcaa

SEQ ID NO: 4120477 - RNA, 23 nt, Streptococcus pyogenes MGAS315
cauauuuuaaucuuuuugugaua

SEQ ID NO: 4120478 - RNA, 15 nt, Streptococcus pyogenes MGAS315
caucaaaaaaagaca

SEQ ID NO: 4120479 - RNA, 14 nt, Streptococcus pyogenes MGAS315
caucaaaaaaagca

SEQ ID NO: 4120480 - RNA, 16 nt, Streptococcus pyogenes MGAS315
caucaaaaaaagcaau

SEQ ID NO: 4120481 - RNA, 12 nt, Streptococcus pyogenes MGAS315
caucaaaaccaa

SEQ ID NO: 4120482 - RNA, 17 nt, Streptococcus pyogenes MGAS315
caucaaaagaccauaaa

SEQ ID NO: 4120483 - RNA, 21 nt, Streptococcus pyogenes MGAS315
caucaaaagaccauaaaaaac

SEQ ID NO: 4120484 - RNA, 21 nt, Streptococcus pyogenes MGAS315
caucaaaggcuuuuuuguauu

SEQ ID NO: 4120485 - RNA, 21 nt, Streptococcus pyogenes MGAS315
caucaaguggauacaagguua

SEQ ID NO: 4120486 - RNA, 16 nt, Streptococcus pyogenes MGAS315
caucagcaucugaaaa

SEQ ID NO: 4120487 - RNA, 17 nt, Streptococcus pyogenes MGAS315
caucaggcuuaaacaua

SEQ ID NO: 4120488 - RNA, 18 nt, Streptococcus pyogenes MGAS315
caucaggcuuaaacauau

SEQ ID NO: 4120489 - RNA, 15 nt, Streptococcus pyogenes MGAS315
caucaggguugcaug

SEQ ID NO: 4120490 - RNA, 12 nt, Streptococcus pyogenes MGAS315
caucauauuguu

SEQ ID NO: 4120491 - RNA, 18 nt, Streptococcus pyogenes MGAS315
caucuugccaucagcauc

SEQ ID NO: 4120492 - RNA, 22 nt, Streptococcus pyogenes MGAS315
caugaaaguuauagcuccuaaa

SEQ ID NO: 4120493 - RNA, 15 nt, Streptococcus pyogenes MGAS315
caugaagugguucaa

SEQ ID NO: 4120494 - RNA, 19 nt, Streptococcus pyogenes MGAS315
caugaugccauuuaaaagg

SEQ ID NO: 4120495 - RNA, 23 nt, Streptococcus pyogenes MGAS315
cauggcaagagcaccgcgaauau

SEQ ID NO: 4120496 - RNA, 21 nt, Streptococcus pyogenes MGAS315
cauggcuaaugauaaggcugc

SEQ ID NO: 4120497 - RNA, 14 nt, Streptococcus pyogenes MGAS315
caugggaaaagcua

SEQ ID NO: 4120498 - RNA, 16 nt, Streptococcus pyogenes MGAS315
cauggguaaaaugacu

SEQ ID NO: 4120499 - RNA, 15 nt, Streptococcus pyogenes MGAS315
cauuaauaauauuaa

SEQ ID NO: 4120500 - RNA, 17 nt, Streptococcus pyogenes MGAS315
cauuaccuuauuuucua

SEQ ID NO: 4120501 - RNA, 20 nt, Streptococcus pyogenes MGAS315
cauuaucaacaaucuuaaaa

SEQ ID NO: 4120502 - RNA, 21 nt, Streptococcus pyogenes MGAS315
cauuauugacaaauccaauga

SEQ ID NO: 4120503 - RNA, 12 nt, Streptococcus pyogenes MGAS315
cauucuugcaga

SEQ ID NO: 4120504 - RNA, 21 nt, Streptococcus pyogenes MGAS315
cauugaugagacuaaccugca

SEQ ID NO: 4120505 - RNA, 15 nt, Streptococcus pyogenes MGAS315
cauugccauuaauaa

SEQ ID NO: 4120506 - RNA, 13 nt, Streptococcus pyogenes MGAS315
cauugcuuuuuau

SEQ ID NO: 4120507 - RNA, 15 nt, Streptococcus pyogenes MGAS315
cauugucaaauaaaa

SEQ ID NO: 4120508 - RNA, 17 nt, Streptococcus pyogenes MGAS315
cauugucaaauaaaauc

SEQ ID NO: 4120509 - RNA, 18 nt, Streptococcus pyogenes MGAS315
cauuuagcugauaaucuu

SEQ ID NO: 4120510 - RNA, 15 nt, Streptococcus pyogenes MGAS315
cauuuccuacaaaau

SEQ ID NO: 4120511 - RNA, 22 nt, Streptococcus pyogenes MGAS315
cauuucuugaggugauucuuuu

SEQ ID NO: 4120512 - RNA, 12 nt, Streptococcus pyogenes MGAS315
cauuugaugagc

SEQ ID NO: 4120513 - RNA, 23 nt, Streptococcus pyogenes MGAS315
cauuuuacuauggcuucuaaaaa

SEQ ID NO: 4120514 - RNA, 17 nt, Streptococcus pyogenes MGAS315
ccaaauuucagauaaaa

SEQ ID NO: 4120515 - RNA, 20 nt, Streptococcus pyogenes MGAS315
ccaagacuaaagcauuuauu

SEQ ID NO: 4120516 - RNA, 22 nt, Streptococcus pyogenes MGAS315
ccaaggucugcgcgacuaaaau

SEQ ID NO: 4120517 - RNA, 20 nt, Streptococcus pyogenes MGAS315
ccaagugccaguaaggaaau

SEQ ID NO: 4120518 - RNA, 16 nt, Streptococcus pyogenes MGAS315
ccaauaaugagcaagg

SEQ ID NO: 4120519 - RNA, 15 nt, Streptococcus pyogenes MGAS315
ccaauuguugaauaa

SEQ ID NO: 4120520 - RNA, 18 nt, Streptococcus pyogenes MGAS315
ccacaccuacuaacaaca

SEQ ID NO: 4120521 - RNA, 15 nt, Streptococcus pyogenes MGAS315
ccagcauuugccaug

SEQ ID NO: 4120522 - RNA, 11 nt, Streptococcus pyogenes MGAS315
ccauagaagcc

SEQ ID NO: 4120523 - RNA, 15 nt, Streptococcus pyogenes MGAS315
ccauagaagccaauu

SEQ ID NO: 4120524 - RNA, 19 nt, Streptococcus pyogenes MGAS315
ccaucaggcuuaaacauau

SEQ ID NO: 4120525 - RNA, 16 nt, Streptococcus pyogenes MGAS315
ccaucugcacaugcuu

SEQ ID NO: 4120526 - RNA, 15 nt, Streptococcus pyogenes MGAS315
ccauuaauaauauua

SEQ ID NO: 4120527 - RNA, 15 nt, Streptococcus pyogenes MGAS315
ccauuauaaaucuua

SEQ ID NO: 4120528 - RNA, 16 nt, Streptococcus pyogenes MGAS315
ccauuauaaaucuuac

SEQ ID NO: 4120529 - RNA, 18 nt, Streptococcus pyogenes MGAS315
cccgucuuacaauuaaua

SEQ ID NO: 4120530 - RNA, 20 nt, Streptococcus pyogenes MGAS315
ccgcgaauaugauauaaaaa

SEQ ID NO: 4120531 - RNA, 17 nt, Streptococcus pyogenes MGAS315
ccgcuaaaacaguucca

SEQ ID NO: 4120532 - RNA, 13 nt, Streptococcus pyogenes MGAS315
ccggcagggguca

SEQ ID NO: 4120533 - RNA, 15 nt, Streptococcus pyogenes MGAS315
ccggcucuaaaauau

SEQ ID NO: 4120534 - RNA, 18 nt, Streptococcus pyogenes MGAS315
ccgugaggacuuauuuuu

SEQ ID NO: 4120535 - RNA, 19 nt, Streptococcus pyogenes MGAS315
ccuaauaaaauagcaccua

SEQ ID NO: 4120536 - RNA, 19 nt, Streptococcus pyogenes MGAS315
ccuacgauaaaacaaauaa

SEQ ID NO: 4120537 - RNA, 20 nt, Streptococcus pyogenes MGAS315
ccuacgauaaaacaaauaau

SEQ ID NO: 4120538 - RNA, 16 nt, Streptococcus pyogenes MGAS315
ccuacuagcacaaaau

SEQ ID NO: 4120539 - RNA, 21 nt, Streptococcus pyogenes MGAS315
ccuauagaaaguuauaaagaa

SEQ ID NO: 4120540 - RNA, 16 nt, Streptococcus pyogenes MGAS315
ccuaugaucuguuuaa

SEQ ID NO: 4120541 - RNA, 21 nt, Streptococcus pyogenes MGAS315
ccucauuugccgaaacaguuu

SEQ ID NO: 4120542 - RNA, 13 nt, Streptococcus pyogenes MGAS315
ccuccaccaaaac

SEQ ID NO: 4120543 - RNA, 13 nt, Streptococcus pyogenes MGAS315
ccucuaacaccaa

SEQ ID NO: 4120544 - RNA, 19 nt, Streptococcus pyogenes MGAS315
ccucucacaaauacagaaa

SEQ ID NO: 4120545 - RNA, 19 nt, Streptococcus pyogenes MGAS315
ccugauauuccuuuuccaa

SEQ ID NO: 4120546 - RNA, 22 nt, Streptococcus pyogenes MGAS315
ccuguagcccuuuuugccuuua

SEQ ID NO: 4120547 - RNA, 20 nt, Streptococcus pyogenes MGAS315
ccuuaggcagacaauuauuu

SEQ ID NO: 4120548 - RNA, 13 nt, Streptococcus pyogenes MGAS315
ccuuaucucaguu

SEQ ID NO: 4120549 - RNA, 18 nt, Streptococcus pyogenes MGAS315
ccuuaugcagguguuuaa

SEQ ID NO: 4120550 - RNA, 22 nt, Streptococcus pyogenes MGAS315
ccuucaaaaaagggaagaagau

SEQ ID NO: 4120551 - RNA, 17 nt, Streptococcus pyogenes MGAS315
ccuucauagacaagcuu

SEQ ID NO: 4120552 - RNA, 19 nt, Streptococcus pyogenes MGAS315
ccuuuaucuuauuuuaaga

SEQ ID NO: 4120553 - RNA, 17 nt, Streptococcus pyogenes MGAS315
ccuuugaccacacgauu

SEQ ID NO: 4120554 - RNA, 19 nt, Streptococcus pyogenes MGAS315
ccuuuuuagcuuauaauuu

SEQ ID NO: 4120555 - RNA, 18 nt, Streptococcus pyogenes MGAS315
ccuuuuuggugucagcau

SEQ ID NO: 4120556 - RNA, 22 nt, Streptococcus pyogenes MGAS315
ccuuuuuggugucagcauaaag

SEQ ID NO: 4120557 - RNA, 20 nt, Streptococcus pyogenes MGAS315
cgaauaugauauaaaaaugg

SEQ ID NO: 4120558 - RNA, 19 nt, Streptococcus pyogenes MGAS315
cgauaaaaacgaucaaaaa

SEQ ID NO: 4120559 - RNA, 14 nt, Streptococcus pyogenes MGAS315
cgauaaaacaaaua

SEQ ID NO: 4120560 - RNA, 14 nt, Streptococcus pyogenes MGAS315
cugaguucuuuuuc

SEQ ID NO: 4120561 - RNA, 14 nt, Streptococcus pyogenes MGAS315
cugauaaaaauaaa

SEQ ID NO: 4120562 - RNA, 15 nt, Streptococcus pyogenes MGAS315
cugauauuccuuuuc

SEQ ID NO: 4120563 - RNA, 16 nt, Streptococcus pyogenes MGAS315
cugauauuccuuuucc

SEQ ID NO: 4120564 - RNA, 17 nt, Streptococcus pyogenes MGAS315
cugauauuccuuuucca

SEQ ID NO: 4120565 - RNA, 18 nt, Streptococcus pyogenes MGAS315
cugaucucccgucaacaa

SEQ ID NO: 4120566 - RNA, 15 nt, Streptococcus pyogenes MGAS315
cugaugcguuuauaa

SEQ ID NO: 4120567 - RNA, 20 nt, Streptococcus pyogenes MGAS315
cugauguacuuuguccuuga

SEQ ID NO: 4120568 - RNA, 14 nt, Streptococcus pyogenes MGAS315
cugcaaaauuuuaa

SEQ ID NO: 4120569 - RNA, 22 nt, Streptococcus pyogenes MGAS315
cugcaauauccauagaaauugu

SEQ ID NO: 4120570 - RNA, 23 nt, Streptococcus pyogenes MGAS315
cugcaauauccauagaaauugua

SEQ ID NO: 4120571 - RNA, 18 nt, Streptococcus pyogenes MGAS315
cugcacugagccccaaaa

SEQ ID NO: 4120572 - RNA, 14 nt, Streptococcus pyogenes MGAS315
cugcauaucugccc

SEQ ID NO: 4120573 - RNA, 16 nt, Streptococcus pyogenes MGAS315
cugccccaaaaacgcc

SEQ ID NO: 4120574 - RNA, 17 nt, Streptococcus pyogenes MGAS315
cugcuaguugugccuuu

SEQ ID NO: 4120575 - RNA, 18 nt, Streptococcus pyogenes MGAS315
cugcucuggcuuuuuccu

SEQ ID NO: 4120576 - RNA, 14 nt, Streptococcus pyogenes MGAS315
cugcugcuaaagca

SEQ ID NO: 4120577 - RNA, 20 nt, Streptococcus pyogenes MGAS315
cugcuuaucucuugagaucu

SEQ ID NO: 4120578 - RNA, 21 nt, Streptococcus pyogenes MGAS315
cuggaaacuggucaaaagcua

SEQ ID NO: 4120579 - RNA, 18 nt, Streptococcus pyogenes MGAS315
cuggaccauuaucaauaa

SEQ ID NO: 4120580 - RNA, 14 nt, Streptococcus pyogenes MGAS315
cuggcacaaacucu

SEQ ID NO: 4120581 - RNA, 16 nt, Streptococcus pyogenes MGAS315
cuggcuuagcagcacc

SEQ ID NO: 4120582 - RNA, 22 nt, Streptococcus pyogenes MGAS315
cuggcuuuuuccuaucagauac

SEQ ID NO: 4120583 - RNA, 19 nt, Streptococcus pyogenes MGAS315
cugguuuuaauauugggac

SEQ ID NO: 4120584 - RNA, 19 nt, Streptococcus pyogenes MGAS315
cuguaaaucaguagugaug

SEQ ID NO: 4120585 - RNA, 23 nt, Streptococcus pyogenes MGAS315
cuguagcguuuguguugaagaag

SEQ ID NO: 4120586 - RNA, 21 nt, Streptococcus pyogenes MGAS315
cugucaaaaaauuaagaagga

SEQ ID NO: 4120587 - RNA, 22 nt, Streptococcus pyogenes MGAS315
cugucuggaaacuggucaaaag

SEQ ID NO: 4120588 - RNA, 14 nt, Streptococcus pyogenes MGAS315
cuguggguuaagag

SEQ ID NO: 4120589 - RNA, 12 nt, Streptococcus pyogenes MGAS315
cuguuaauuuau

SEQ ID NO: 4120590 - RNA, 22 nt, Streptococcus pyogenes MGAS315
cuguuaucccuggaccauuauc

SEQ ID NO: 4120591 - RNA, 15 nt, Streptococcus pyogenes MGAS315
cuguucagucuucug

SEQ ID NO: 4120592 - RNA, 13 nt, Streptococcus pyogenes MGAS315
cuguucucuuugg

SEQ ID NO: 4120593 - RNA, 21 nt, Streptococcus pyogenes MGAS315
cuguuggauacaguccaaacu

SEQ ID NO: 4120594 - RNA, 19 nt, Streptococcus pyogenes MGAS315
cuguuuaaaauauauuuug

SEQ ID NO: 4120595 - RNA, 20 nt, Streptococcus pyogenes MGAS315
cuguuuaaaauauauuuugg

SEQ ID NO: 4120596 - RNA, 15 nt, Streptococcus pyogenes MGAS315
cuuaaacauauuaua

SEQ ID NO: 4120597 - RNA, 23 nt, Streptococcus pyogenes MGAS315
cuuaaauuauauuauacuaauau

SEQ ID NO: 4120598 - RNA, 23 nt, Streptococcus pyogenes MGAS315
cuuaauaaacucuauacaaaaag

SEQ ID NO: 4120599 - RNA, 17 nt, Streptococcus pyogenes MGAS315
cuuaauuuauauuuuag

SEQ ID NO: 4120600 - RNA, 13 nt, Streptococcus pyogenes MGAS315
cuuacaaaaagcc

SEQ ID NO: 4120601 - RNA, 14 nt, Streptococcus pyogenes MGAS315
cuuacaaaaagccu

SEQ ID NO: 4120602 - RNA, 21 nt, Streptococcus pyogenes MGAS315
cuuacaaaaagccuauuuaau

SEQ ID NO: 4120603 - RNA, 17 nt, Streptococcus pyogenes MGAS315
cuuacgaguaugaacaa

SEQ ID NO: 4120604 - RNA, 19 nt, Streptococcus pyogenes MGAS315
cuuaggcagacaauuauuu

SEQ ID NO: 4120605 - RNA, 15 nt, Streptococcus pyogenes MGAS315
cuuagugguuugcaa

SEQ ID NO: 4120606 - RNA, 21 nt, Streptococcus pyogenes MGAS315
cuuauaauuugacuucaaaaa

SEQ ID NO: 4120607 - RNA, 21 nt, Streptococcus pyogenes MGAS315
cuucaaaaauacuaccuuuag

SEQ ID NO: 4120608 - RNA, 16 nt, Streptococcus pyogenes MGAS315
cuucaauuuuugccaa

SEQ ID NO: 4120609 - RNA, 19 nt, Streptococcus pyogenes MGAS315
cuucuagguagguuugaaa

SEQ ID NO: 4120610 - RNA, 19 nt, Streptococcus pyogenes MGAS315
cuucugaugcguuuauaaa

SEQ ID NO: 4120611 - RNA, 17 nt, Streptococcus pyogenes MGAS315
cuucugcauuaucaucu

SEQ ID NO: 4120612 - RNA, 13 nt, Streptococcus pyogenes MGAS315
cuucuggcaauaa

SEQ ID NO: 4120613 - RNA, 15 nt, Streptococcus pyogenes MGAS315
cuucuggcaauaagu

SEQ ID NO: 4120614 - RNA, 13 nt, Streptococcus pyogenes MGAS315
cuucuucuuuuca

SEQ ID NO: 4120615 - RNA, 22 nt, Streptococcus pyogenes MGAS315
cuucuuuucagagaugcuucuu

SEQ ID NO: 4120616 - RNA, 13 nt, Streptococcus pyogenes MGAS315
cuucuuuuuauua

SEQ ID NO: 4120617 - RNA, 21 nt, Streptococcus pyogenes MGAS315
cuuggacgaaggcucuuaucu

SEQ ID NO: 4120618 - RNA, 19 nt, Streptococcus pyogenes MGAS315
cuugguucugaaaauaaaa

SEQ ID NO: 4120619 - RNA, 14 nt, Streptococcus pyogenes MGAS315
cuugucuaugagau

SEQ ID NO: 4120620 - RNA, 13 nt, Streptococcus pyogenes MGAS315
cuuguuacaaaaa

SEQ ID NO: 4120621 - RNA, 14 nt, Streptococcus pyogenes MGAS315
cuuguuacaaaaaa

SEQ ID NO: 4120622 - RNA, 17 nt, Streptococcus pyogenes MGAS315
cuuguuuugguugauau

SEQ ID NO: 4120623 - RNA, 22 nt, Streptococcus pyogenes MGAS315
cuuguuuugguugauauaaaau

SEQ ID NO: 4120624 - RNA, 11 nt, Streptococcus pyogenes MGAS315
cuuuaaaaagu

SEQ ID NO: 4120625 - RNA, 20 nt, Streptococcus pyogenes MGAS315
cuuuaaaaaguuucugaguu

SEQ ID NO: 4120626 - RNA, 22 nt, Streptococcus pyogenes MGAS315
cuuuaaaaaguuucugaguuga

SEQ ID NO: 4120627 - RNA, 16 nt, Streptococcus pyogenes MGAS315
cuuuaggaucauuauc

SEQ ID NO: 4120628 - RNA, 18 nt, Streptococcus pyogenes MGAS315
cuuuauaaugguuuuuug

SEQ ID NO: 4120629 - RNA, 19 nt, Streptococcus pyogenes MGAS315
cuuuaucuuauuuuaagaa

SEQ ID NO: 4120630 - RNA, 17 nt, Streptococcus pyogenes MGAS315
cuuuauuaaucaaaaaa

SEQ ID NO: 4120631 - RNA, 11 nt, Streptococcus pyogenes MGAS315
cuuuauugaug

SEQ ID NO: 4120632 - RNA, 12 nt, Streptococcus pyogenes MGAS315
cuuuauuuugau

SEQ ID NO: 4120633 - RNA, 18 nt, Streptococcus pyogenes MGAS315
cuuuauuuugauauuuuu

SEQ ID NO: 4120634 - RNA, 13 nt, Streptococcus pyogenes MGAS315
cuuucaaacggag

SEQ ID NO: 4120635 - RNA, 19 nt, Streptococcus pyogenes MGAS315
cuuucaguuaucugauauu

SEQ ID NO: 4120636 - RNA, 15 nt, Streptococcus pyogenes MGAS315
cuuuggcaccaagug

SEQ ID NO: 4120637 - RNA, 20 nt, Streptococcus pyogenes MGAS315
cuuuggcaccaagugcugcc

SEQ ID NO: 4120638 - RNA, 13 nt, Streptococcus pyogenes MGAS315
cuuuuaaaaucug

SEQ ID NO: 4120639 - RNA, 22 nt, Streptococcus pyogenes MGAS315
cuuuuaagcugaguaaaacaau

SEQ ID NO: 4120640 - RNA, 22 nt, Streptococcus pyogenes MGAS315
cuuuucaauggucacuccuucu

SEQ ID NO: 4120641 - RNA, 19 nt, Streptococcus pyogenes MGAS315
cuuuucagguugcaacaau

SEQ ID NO: 4120642 - RNA, 15 nt, Streptococcus pyogenes MGAS315
cuuuuccaacgugcu

SEQ ID NO: 4120643 - RNA, 15 nt, Streptococcus pyogenes MGAS315
cuuuugauaccuuuu

SEQ ID NO: 4120644 - RNA, 19 nt, Streptococcus pyogenes MGAS315
cuuuuggccuacuagcaca

SEQ ID NO: 4120645 - RNA, 22 nt, Streptococcus pyogenes MGAS315
cuuuuuaaagagccucaggaca

SEQ ID NO: 4120646 - RNA, 22 nt, Streptococcus pyogenes MGAS315
cuuuuuacaucaaaaaaagcaa

SEQ ID NO: 4120647 - RNA, 17 nt, Streptococcus pyogenes MGAS315
cuuuuuccguuugagau

SEQ ID NO: 4120648 - RNA, 13 nt, Streptococcus pyogenes MGAS315
cuuuuucuuuucu

SEQ ID NO: 4120649 - RNA, 18 nt, Streptococcus pyogenes MGAS315
cuuuuugccuuuaacaug

SEQ ID NO: 4120650 - RNA, 17 nt, Streptococcus pyogenes MGAS315
cuuuuuggugucagcau

SEQ ID NO: 4120651 - RNA, 17 nt, Streptococcus pyogenes MGAS315
cuuuuuuacuuuuaaaa

SEQ ID NO: 4120652 - RNA, 17 nt, Streptococcus pyogenes MGAS315
gaaaacguguauucuua

SEQ ID NO: 4120653 - RNA, 21 nt, Streptococcus pyogenes MGAS315
gaaaacguguauucuuaaaaa

SEQ ID NO: 4120654 - RNA, 19 nt, Streptococcus pyogenes MGAS315
gaaacaguuugguuuuuug

SEQ ID NO: 4120655 - RNA, 13 nt, Streptococcus pyogenes MGAS315
gaaacuaaaggca

SEQ ID NO: 4120656 - RNA, 19 nt, Streptococcus pyogenes MGAS315
gaaacuaaaggcaauagca

SEQ ID NO: 4120657 - RNA, 16 nt, Streptococcus pyogenes MGAS315
gaaacugcacugagcc

SEQ ID NO: 4120658 - RNA, 17 nt, Streptococcus pyogenes MGAS315
gaaacuggucaaaagcu

SEQ ID NO: 4120659 - RNA, 15 nt, Streptococcus pyogenes MGAS315
gcaauagagccaaga

SEQ ID NO: 4120660 - RNA, 15 nt, Streptococcus pyogenes MGAS315
gcaauccaaaucaac

SEQ ID NO: 4120661 - RNA, 17 nt, Streptococcus pyogenes MGAS315
gcaaugguuaaaaagag

SEQ ID NO: 4120662 - RNA, 18 nt, Streptococcus pyogenes MGAS315
gcaaugguuaaaaagaga

SEQ ID NO: 4120663 - RNA, 19 nt, Streptococcus pyogenes MGAS315
gcaauucuuuuauuaaugu

SEQ ID NO: 4120664 - RNA, 22 nt, Streptococcus pyogenes MGAS315
gcacaaacucugccaauuguuc

SEQ ID NO: 4120665 - RNA, 15 nt, Streptococcus pyogenes MGAS315
gcaccaagugcugcc

SEQ ID NO: 4120666 - RNA, 12 nt, Streptococcus pyogenes MGAS315
gcacguuuucug

SEQ ID NO: 4120667 - RNA, 22 nt, Streptococcus pyogenes MGAS315
gcagauggggugucaggggaau

SEQ ID NO: 4120668 - RNA, 13 nt, Streptococcus pyogenes MGAS315
gcaggcguuuugu

SEQ ID NO: 4120669 - RNA, 19 nt, Streptococcus pyogenes MGAS315
gcaguuauaauuaguauau

SEQ ID NO: 4120670 - RNA, 17 nt, Streptococcus pyogenes MGAS315
gcaucgcaaacagaugc

SEQ ID NO: 4120671 - RNA, 19 nt, Streptococcus pyogenes MGAS315
gcaucuacguacgcuguaa

SEQ ID NO: 4120672 - RNA, 22 nt, Streptococcus pyogenes MGAS315
gcaucuacguacgcuguaaugu

SEQ ID NO: 4120673 - RNA, 16 nt, Streptococcus pyogenes MGAS315
gcauuaucaucugguc

SEQ ID NO: 4120674 - RNA, 15 nt, Streptococcus pyogenes MGAS315
gcauugucaaauaaa

SEQ ID NO: 4120675 - RNA, 21 nt, Streptococcus pyogenes MGAS315
gccaaaucuucugcauuauca

SEQ ID NO: 4120676 - RNA, 17 nt, Streptococcus pyogenes MGAS315
gccaacuuuucaauggu

SEQ ID NO: 4120677 - RNA, 17 nt, Streptococcus pyogenes MGAS315
gccaauuguucauuaaa

SEQ ID NO: 4120678 - RNA, 17 nt, Streptococcus pyogenes MGAS315
gccaguaaggaaaucaa

SEQ ID NO: 4120679 - RNA, 21 nt, Streptococcus pyogenes MGAS315
gccaucaaaaaaagacacaca

SEQ ID NO: 4120680 - RNA, 16 nt, Streptococcus pyogenes MGAS315
gccaucagcaucugaa

SEQ ID NO: 4120681 - RNA, 20 nt, Streptococcus pyogenes MGAS315
gccaucugcuuggauuuccu

SEQ ID NO: 4120682 - RNA, 14 nt, Streptococcus pyogenes MGAS315
gccauuuaaaaggg

SEQ ID NO: 4120683 - RNA, 18 nt, Streptococcus pyogenes MGAS315
gcccccucuuuaccauuu

SEQ ID NO: 4120684 - RNA, 19 nt, Streptococcus pyogenes MGAS315
gccguccuuaaaagaaaau

SEQ ID NO: 4120685 - RNA, 20 nt, Streptococcus pyogenes MGAS315
gccuacaacagcagcaguug

SEQ ID NO: 4120686 - RNA, 13 nt, Streptococcus pyogenes MGAS315
gcgauaauaaagu

SEQ ID NO: 4120687 - RNA, 22 nt, Streptococcus pyogenes MGAS315
gcgcauguugacuauuuuucgc

SEQ ID NO: 4120688 - RNA, 20 nt, Streptococcus pyogenes MGAS315
gcgcgacuaaaaucauggga

SEQ ID NO: 4120689 - RNA, 23 nt, Streptococcus pyogenes MGAS315
gcguagacagcaaggaugaaaug

SEQ ID NO: 4120690 - RNA, 21 nt, Streptococcus pyogenes MGAS315
gcguauaggugaguuuuuucu

SEQ ID NO: 4120691 - RNA, 12 nt, Streptococcus pyogenes MGAS315
gcuagucuuuuu

SEQ ID NO: 4120692 - RNA, 21 nt, Streptococcus pyogenes MGAS315
gcuauaagaggauaaucauaa

SEQ ID NO: 4120693 - RNA, 21 nt, Streptococcus pyogenes MGAS315
gcuauagaaacuuuuuauaag

SEQ ID NO: 4120694 - RNA, 15 nt, Streptococcus pyogenes MGAS315
gcugauaggucugca

SEQ ID NO: 4120695 - RNA, 20 nt, Streptococcus pyogenes MGAS315
gcugauaggucugcaauauc

SEQ ID NO: 4120696 - RNA, 23 nt, Streptococcus pyogenes MGAS315
gcugaugacuuguaaaaugauac

SEQ ID NO: 4120697 - RNA, 14 nt, Streptococcus pyogenes MGAS315
gcugcgaugauuuu

SEQ ID NO: 4120698 - RNA, 14 nt, Streptococcus pyogenes MGAS315
gcugcugaacugcu

SEQ ID NO: 4120699 - RNA, 13 nt, Streptococcus pyogenes MGAS315
gcuguuggauaca

SEQ ID NO: 4120700 - RNA, 20 nt, Streptococcus pyogenes MGAS315
gcuuaaugucauacaaaaac

SEQ ID NO: 4120701 - RNA, 23 nt, Streptococcus pyogenes MGAS315
gcuuaucucuugagaucuugugc

SEQ ID NO: 4120702 - RNA, 13 nt, Streptococcus pyogenes MGAS315
gcuugucuaugag

SEQ ID NO: 4120703 - RNA, 14 nt, Streptococcus pyogenes MGAS315
gcuuguucuuuauu

SEQ ID NO: 4120704 - RNA, 19 nt, Streptococcus pyogenes MGAS315
gcuuugauuuuucuuguuu

SEQ ID NO: 4120705 - RNA, 18 nt, Streptococcus pyogenes MGAS315
gcuuuugauaccuuuuuu

SEQ ID NO: 4120706 - RNA, 14 nt, Streptococcus pyogenes MGAS315
gcuuuuggcaaccu

SEQ ID NO: 4120707 - RNA, 15 nt, Streptococcus pyogenes MGAS315
gcuuuuuuuguaucu

SEQ ID NO: 4120708 - RNA, 17 nt, Streptococcus pyogenes MGAS315
ggaaauuuuaaaugaca

SEQ ID NO: 4120709 - RNA, 19 nt, Streptococcus pyogenes MGAS315
ggaagaucuccaagaucug

SEQ ID NO: 4120710 - RNA, 13 nt, Streptococcus pyogenes MGAS315
ggaccaagauuca

SEQ ID NO: 4120711 - RNA, 20 nt, Streptococcus pyogenes MGAS315
ggaccaugccuaaagcccau

SEQ ID NO: 4120712 - RNA, 18 nt, Streptococcus pyogenes MGAS315
ggacuguuuuuuaguuga

SEQ ID NO: 4120713 - RNA, 17 nt, Streptococcus pyogenes MGAS315
ggauuuuuuuaacuauu

SEQ ID NO: 4120714 - RNA, 16 nt, Streptococcus pyogenes MGAS315
ggcaauccaaaucaac

SEQ ID NO: 4120715 - RNA, 16 nt, Streptococcus pyogenes MGAS315
ggcaaugccaucugcu

SEQ ID NO: 4120716 - RNA, 18 nt, Streptococcus pyogenes MGAS315
ggcaccaagugcugccau

SEQ ID NO: 4120717 - RNA, 19 nt, Streptococcus pyogenes MGAS315
ggcuacucuauuugaagua

SEQ ID NO: 4120718 - RNA, 18 nt, Streptococcus pyogenes MGAS315
ggcugccauuugagcacc

SEQ ID NO: 4120719 - RNA, 13 nt, Streptococcus pyogenes MGAS315
ggcuuaaacauau

SEQ ID NO: 4120720 - RNA, 16 nt, Streptococcus pyogenes MGAS315
ggcuucuaaaaaaguu

SEQ ID NO: 4120721 - RNA, 13 nt, Streptococcus pyogenes MGAS315
gggacuaggaauc

SEQ ID NO: 4120722 - RNA, 19 nt, Streptococcus pyogenes MGAS315
gggguaauuugguggaaga

SEQ ID NO: 4120723 - RNA, 17 nt, Streptococcus pyogenes MGAS315
ggguaaaaugacugaca

SEQ ID NO: 4120724 - RNA, 20 nt, Streptococcus pyogenes MGAS315
gguaaaaacucaaaaaauac

SEQ ID NO: 4120725 - RNA, 22 nt, Streptococcus pyogenes MGAS315
gguaaucccauuuuucgacaga

SEQ ID NO: 4120726 - RNA, 15 nt, Streptococcus pyogenes MGAS315
gguaaugcuuuuuaa

SEQ ID NO: 4120727 - RNA, 24 nt, Streptococcus pyogenes MGAS315
gguagaugauuauauuaggauaug

SEQ ID NO: 4120728 - RNA, 19 nt, Streptococcus pyogenes MGAS315
gguagguuugaaacauaug

SEQ ID NO: 4120729 - RNA, 20 nt, Streptococcus pyogenes MGAS315
ggugacacucccgcuuuuaa

SEQ ID NO: 4120730 - RNA, 12 nt, Streptococcus pyogenes MGAS315
ggugucagcaua

SEQ ID NO: 4120731 - RNA, 13 nt, Streptococcus pyogenes MGAS315
gguuaaaaagaga

SEQ ID NO: 4120732 - RNA, 22 nt, Streptococcus pyogenes MGAS315
gguuacuggggaguuaccgugu

SEQ ID NO: 4120733 - RNA, 20 nt, Streptococcus pyogenes MGAS315
gguuaucaggccacuagaac

SEQ ID NO: 4120734 - RNA, 20 nt, Streptococcus pyogenes MGAS315
gguucagcugauuacugaaa

SEQ ID NO: 4120735 - RNA, 11 nt, Streptococcus pyogenes MGAS315
guaaaaacuca

SEQ ID NO: 4120736 - RNA, 17 nt, Streptococcus pyogenes MGAS315
guaaaaacucaaaaaau

SEQ ID NO: 4120737 - RNA, 18 nt, Streptococcus pyogenes MGAS315
guaaacaaucuuaauggu

SEQ ID NO: 4120738 - RNA, 16 nt, Streptococcus pyogenes MGAS315
guaaagcaagggaaac

SEQ ID NO: 4120739 - RNA, 21 nt, Streptococcus pyogenes MGAS315
guaaaggauuuaguucuguau

SEQ ID NO: 4120740 - RNA, 20 nt, Streptococcus pyogenes MGAS315
guaaccauagaagccaauua

SEQ ID NO: 4120741 - RNA, 20 nt, Streptococcus pyogenes MGAS315
guaacguaauagaauaaaaa

SEQ ID NO: 4120742 - RNA, 13 nt, Streptococcus pyogenes MGAS315
guaagccaaaucu

SEQ ID NO: 4120743 - RNA, 15 nt, Streptococcus pyogenes MGAS315
guaauauugcucaag

SEQ ID NO: 4120744 - RNA, 21 nt, Streptococcus pyogenes MGAS315
guaauauugcucaagacuagg

SEQ ID NO: 4120745 - RNA, 18 nt, Streptococcus pyogenes MGAS315
guaauauuuccuuuuaaa

SEQ ID NO: 4120746 - RNA, 20 nt, Streptococcus pyogenes MGAS315
guaaugucuuguuuugguuu

SEQ ID NO: 4120747 - RNA, 14 nt, Streptococcus pyogenes MGAS315
guaauguuguaaac

SEQ ID NO: 4120748 - RNA, 15 nt, Streptococcus pyogenes MGAS315
guaauuucuugugcu

SEQ ID NO: 4120749 - RNA, 15 nt, Streptococcus pyogenes MGAS315
guacacgugauaaau

SEQ ID NO: 4120750 - RNA, 17 nt, Streptococcus pyogenes MGAS315
guacggucauuaauaaa

SEQ ID NO: 4120751 - RNA, 14 nt, Streptococcus pyogenes MGAS315
guauagcauaaaau

SEQ ID NO: 4120752 - RNA, 15 nt, Streptococcus pyogenes MGAS315
guauagcauaaaaua

SEQ ID NO: 4120753 - RNA, 16 nt, Streptococcus pyogenes MGAS315
guaucuaagcuauaga

SEQ ID NO: 4120754 - RNA, 23 nt, Streptococcus pyogenes MGAS315
guauucuuuuuccguuugagaua

SEQ ID NO: 4120755 - RNA, 14 nt, Streptococcus pyogenes MGAS315
guauuguagaggac

SEQ ID NO: 4120756 - RNA, 20 nt, Streptococcus pyogenes MGAS315
guauuguagaggacuaaguc

SEQ ID NO: 4120757 - RNA, 22 nt, Streptococcus pyogenes MGAS315
guauuguucaaccgucacuauu

SEQ ID NO: 4120758 - RNA, 17 nt, Streptococcus pyogenes MGAS315
uaaacucuauacaaaaa

SEQ ID NO: 4120759 - RNA, 18 nt, Streptococcus pyogenes MGAS315
uaaagaaacaaaaaugaa

SEQ ID NO: 4120760 - RNA, 15 nt, Streptococcus pyogenes MGAS315
uaaagaccucucaug

SEQ ID NO: 4120761 - RNA, 13 nt, Streptococcus pyogenes MGAS315
uaaagauuuuaaa

SEQ ID NO: 4120762 - RNA, 13 nt, Streptococcus pyogenes MGAS315
uaaagcaagggaa

SEQ ID NO: 4120763 - RNA, 14 nt, Streptococcus pyogenes MGAS315
uaaagcaagggaaa

SEQ ID NO: 4120764 - RNA, 13 nt, Streptococcus pyogenes MGAS315
uaaagcaucagca

SEQ ID NO: 4120765 - RNA, 16 nt, Streptococcus pyogenes MGAS315
uaaagcaucagcauaa

SEQ ID NO: 4120766 - RNA, 17 nt, Streptococcus pyogenes MGAS315
uaaagccuacaacagca

SEQ ID NO: 4120767 - RNA, 16 nt, Streptococcus pyogenes MGAS315
uaaagccuuauccauu

SEQ ID NO: 4120768 - RNA, 23 nt, Streptococcus pyogenes MGAS315
uaaagcguugacaguuaaaaaua

SEQ ID NO: 4120769 - RNA, 16 nt, Streptococcus pyogenes MGAS315
uaaagcuaucauacaa

SEQ ID NO: 4120770 - RNA, 22 nt, Streptococcus pyogenes MGAS315
uaaagcuaucauacaacuggcu

SEQ ID NO: 4120771 - RNA, 11 nt, Streptococcus pyogenes MGAS315
uaaaggagcuu

SEQ ID NO: 4120772 - RNA, 19 nt, Streptococcus pyogenes MGAS315
uaaaggccuguauuucuuu

SEQ ID NO: 4120773 - RNA, 23 nt, Streptococcus pyogenes MGAS315
uaaaggccuguauuucuuuagua

SEQ ID NO: 4120774 - RNA, 19 nt, Streptococcus pyogenes MGAS315
uaaauaaagauaauuuauu

SEQ ID NO: 4120775 - RNA, 20 nt, Streptococcus pyogenes MGAS315
uaaauaaagauaauuuauuu

SEQ ID NO: 4120776 - RNA, 19 nt, Streptococcus pyogenes MGAS315
uaaauaucuuaccauugua

SEQ ID NO: 4120777 - RNA, 14 nt, Streptococcus pyogenes MGAS315
uaaaugacaugaaa

SEQ ID NO: 4120778 - RNA, 15 nt, Streptococcus pyogenes MGAS315
uaaauguuggauuuu

SEQ ID NO: 4120779 - RNA, 22 nt, Streptococcus pyogenes MGAS315
uaaauuauuaacguuaacaaaa

SEQ ID NO: 4120780 - RNA, 22 nt, Streptococcus pyogenes MGAS315
uaaauugcgacacagauaagau

SEQ ID NO: 4120781 - RNA, 21 nt, Streptococcus pyogenes MGAS315
uaaauuuggagagauaaaaag

SEQ ID NO: 4120782 - RNA, 23 nt, Streptococcus pyogenes MGAS315
uaaauuuggagagauaaaaagua

SEQ ID NO: 4120783 - RNA, 15 nt, Streptococcus pyogenes MGAS315
uaacaaaaauaagua

SEQ ID NO: 4120784 - RNA, 12 nt, Streptococcus pyogenes MGAS315
uaacaaauuuau

SEQ ID NO: 4120785 - RNA, 17 nt, Streptococcus pyogenes MGAS315
uaacagaaauuaauaaa

SEQ ID NO: 4120786 - RNA, 16 nt, Streptococcus pyogenes MGAS315
uaacaucuugauugua

SEQ ID NO: 4120787 - RNA, 14 nt, Streptococcus pyogenes MGAS315
uaaccacagcaauu

SEQ ID NO: 4120788 - RNA, 18 nt, Streptococcus pyogenes MGAS315
uaaccauagaagccaauu

SEQ ID NO: 4120789 - RNA, 15 nt, Streptococcus pyogenes MGAS315
uaaccuccuaaacua

SEQ ID NO: 4120790 - RNA, 14 nt, Streptococcus pyogenes MGAS315
uaaccuuugccauu

SEQ ID NO: 4120791 - RNA, 18 nt, Streptococcus pyogenes MGAS315
uaacgcuuguuuaugaaa

SEQ ID NO: 4120792 - RNA, 20 nt, Streptococcus pyogenes MGAS315
uaacuauuuaacuuaucauu

SEQ ID NO: 4120793 - RNA, 16 nt, Streptococcus pyogenes MGAS315
uaacugguaaaguauu

SEQ ID NO: 4120794 - RNA, 14 nt, Streptococcus pyogenes MGAS315
uaacuguugucuca

SEQ ID NO: 4120795 - RNA, 12 nt, Streptococcus pyogenes MGAS315
uaagacaaagac

SEQ ID NO: 4120796 - RNA, 17 nt, Streptococcus pyogenes MGAS315
uaagacuauguugcuua

SEQ ID NO: 4120797 - RNA, 22 nt, Streptococcus pyogenes MGAS315
uaagagagguugguaaaaaggc

SEQ ID NO: 4120798 - RNA, 21 nt, Streptococcus pyogenes MGAS315
uaagagcguuagcuuuuuaaa

SEQ ID NO: 4120799 - RNA, 16 nt, Streptococcus pyogenes MGAS315
uaagauggugcuuuaa

SEQ ID NO: 4120800 - RNA, 15 nt, Streptococcus pyogenes MGAS315
uaagcaaucaucauu

SEQ ID NO: 4120801 - RNA, 17 nt, Streptococcus pyogenes MGAS315
uaagcaaucaucauuua

SEQ ID NO: 4120802 - RNA, 21 nt, Streptococcus pyogenes MGAS315
uaagcaucauuauugacaaau

SEQ ID NO: 4120803 - RNA, 13 nt, Streptococcus pyogenes MGAS315
uaagccaaaucuu

SEQ ID NO: 4120804 - RNA, 18 nt, Streptococcus pyogenes MGAS315
uaagcugacgauaaguca

SEQ ID NO: 4120805 - RNA, 19 nt, Streptococcus pyogenes MGAS315
uaagcugaguaaaacaaua

SEQ ID NO: 4120806 - RNA, 15 nt, Streptococcus pyogenes MGAS315
uaaggaccaagauuc

SEQ ID NO: 4120807 - RNA, 14 nt, Streptococcus pyogenes MGAS315
uaaggguuaacaau

SEQ ID NO: 4120808 - RNA, 13 nt, Streptococcus pyogenes MGAS315
uaaguaaaagcga

SEQ ID NO: 4120809 - RNA, 14 nt, Streptococcus pyogenes MGAS315
uaaguaagauggug

SEQ ID NO: 4120810 - RNA, 14 nt, Streptococcus pyogenes MGAS315
uaaguaauguguug

SEQ ID NO: 4120811 - RNA, 18 nt, Streptococcus pyogenes MGAS315
uaaguaauguguuguaua

SEQ ID NO: 4120812 - RNA, 19 nt, Streptococcus pyogenes MGAS315
uaaguauaucauuaucaac

SEQ ID NO: 4120813 - RNA, 18 nt, Streptococcus pyogenes MGAS315
uaaguccuuuucguuuua

SEQ ID NO: 4120814 - RNA, 12 nt, Streptococcus pyogenes MGAS315
uaauaagauuca

SEQ ID NO: 4120815 - RNA, 22 nt, Streptococcus pyogenes MGAS315
uaauaagauucaauaugaaaac

SEQ ID NO: 4120816 - RNA, 14 nt, Streptococcus pyogenes MGAS315
uaauaaguauuuua

SEQ ID NO: 4120817 - RNA, 17 nt, Streptococcus pyogenes MGAS315
uaauaaguauuuuaaaa

SEQ ID NO: 4120818 - RNA, 19 nt, Streptococcus pyogenes MGAS315
uaauaaguauuuuaaaauc

SEQ ID NO: 4120819 - RNA, 16 nt, Streptococcus pyogenes MGAS315
uaauauguaacgcuug

SEQ ID NO: 4120820 - RNA, 15 nt, Streptococcus pyogenes MGAS315
uaauauugcucaaga

SEQ ID NO: 4120821 - RNA, 16 nt, Streptococcus pyogenes MGAS315
uaauauugcucaagac

SEQ ID NO: 4120822 - RNA, 16 nt, Streptococcus pyogenes MGAS315
uaauccaacaacgcua

SEQ ID NO: 4120823 - RNA, 18 nt, Streptococcus pyogenes MGAS315
uaaucgagagauuauucu

SEQ ID NO: 4120824 - RNA, 16 nt, Streptococcus pyogenes MGAS315
uaaucguaacuggucc

SEQ ID NO: 4120825 - RNA, 15 nt, Streptococcus pyogenes MGAS315
uaaucguaaugucuu

SEQ ID NO: 4120826 - RNA, 15 nt, Streptococcus pyogenes MGAS315
uaaucuaaagcauca

SEQ ID NO: 4120827 - RNA, 15 nt, Streptococcus pyogenes MGAS315
uaaugaccuuugaua

SEQ ID NO: 4120828 - RNA, 20 nt, Streptococcus pyogenes MGAS315
uaaugagcaaggcaagagga

SEQ ID NO: 4120829 - RNA, 15 nt, Streptococcus pyogenes MGAS315
uaaugauucaauauc

SEQ ID NO: 4120830 - RNA, 18 nt, Streptococcus pyogenes MGAS315
uaaugauucaauaucaua

SEQ ID NO: 4120831 - RNA, 21 nt, Streptococcus pyogenes MGAS315
uaaugauucaauaucauauuu

SEQ ID NO: 4120832 - RNA, 15 nt, Streptococcus pyogenes MGAS315
uaaugccaucaaaaa

SEQ ID NO: 4120833 - RNA, 16 nt, Streptococcus pyogenes MGAS315
uaaugucauacaaaaa

SEQ ID NO: 4120834 - RNA, 15 nt, Streptococcus pyogenes MGAS315
uaauguuuuuacauu

SEQ ID NO: 4120835 - RNA, 16 nt, Streptococcus pyogenes MGAS315
uaauguuuuuacauuu

SEQ ID NO: 4120836 - RNA, 11 nt, Streptococcus pyogenes MGAS315
uaauuagcaua

SEQ ID NO: 4120837 - RNA, 15 nt, Streptococcus pyogenes MGAS315
uaauuaguauauugu

SEQ ID NO: 4120838 - RNA, 17 nt, Streptococcus pyogenes MGAS315
uaauuaucugaauuauu

SEQ ID NO: 4120839 - RNA, 15 nt, Streptococcus pyogenes MGAS315
uaauuuauauuuuag

SEQ ID NO: 4120840 - RNA, 14 nt, Streptococcus pyogenes MGAS315
uaauuucuugugcu

SEQ ID NO: 4120841 - RNA, 11 nt, Streptococcus pyogenes MGAS315
uacaaaaaaca

SEQ ID NO: 4120842 - RNA, 19 nt, Streptococcus pyogenes MGAS315
uacaaaaaaccuuccugua

SEQ ID NO: 4120843 - RNA, 13 nt, Streptococcus pyogenes MGAS315
uacaacagcagca

SEQ ID NO: 4120844 - RNA, 15 nt, Streptococcus pyogenes MGAS315
uacaagagcuuaaaa

SEQ ID NO: 4120845 - RNA, 16 nt, Streptococcus pyogenes MGAS315
uacaagagcuuaaaag

SEQ ID NO: 4120846 - RNA, 18 nt, Streptococcus pyogenes MGAS315
uacaagagcuuaaaaguu

SEQ ID NO: 4120847 - RNA, 15 nt, Streptococcus pyogenes MGAS315
uacaagcauuuugca

SEQ ID NO: 4120848 - RNA, 19 nt, Streptococcus pyogenes MGAS315
uacaagguuaaguaaaagc

SEQ ID NO: 4120849 - RNA, 21 nt, Streptococcus pyogenes MGAS315
uacagaaaaaagcuugucuau

SEQ ID NO: 4120850 - RNA, 16 nt, Streptococcus pyogenes MGAS315
uacaguauguaaauau

SEQ ID NO: 4120851 - RNA, 16 nt, Streptococcus pyogenes MGAS315
uacaucaaaaaaagca

SEQ ID NO: 4120852 - RNA, 20 nt, Streptococcus pyogenes MGAS315
uacaucaaaaaaagcaauga

SEQ ID NO: 4120853 - RNA, 21 nt, Streptococcus pyogenes MGAS315
uacaucaaaaaaagcaaugac

SEQ ID NO: 4120854 - RNA, 17 nt, Streptococcus pyogenes MGAS315
uaccaaaucaaaaagcu

SEQ ID NO: 4120855 - RNA, 14 nt, Streptococcus pyogenes MGAS315
uaccaucaaugacu

SEQ ID NO: 4120856 - RNA, 19 nt, Streptococcus pyogenes MGAS315
uaccaucaaugacuugacc

SEQ ID NO: 4120857 - RNA, 17 nt, Streptococcus pyogenes MGAS315
uaccauuuuuaucugua

SEQ ID NO: 4120858 - RNA, 23 nt, Streptococcus pyogenes MGAS315
uaugauuugucaaaaaguaaaaa

SEQ ID NO: 4120859 - RNA, 18 nt, Streptococcus pyogenes MGAS315
uaugcagguguuuaaaga

SEQ ID NO: 4120860 - RNA, 16 nt, Streptococcus pyogenes MGAS315
uauggcuauaaaugga

SEQ ID NO: 4120861 - RNA, 16 nt, Streptococcus pyogenes MGAS315
uauguaaauauaaagu

SEQ ID NO: 4120862 - RNA, 19 nt, Streptococcus pyogenes MGAS315
uauguaacgcuuguuuaug

SEQ ID NO: 4120863 - RNA, 22 nt, Streptococcus pyogenes MGAS315
uauguaacgcuuguuuaugaaa

SEQ ID NO: 4120864 - RNA, 20 nt, Streptococcus pyogenes MGAS315
uauguugcuuaaugaccuuu

SEQ ID NO: 4120865 - RNA, 13 nt, Streptococcus pyogenes MGAS315
uauuaaagacaaa

SEQ ID NO: 4120866 - RNA, 20 nt, Streptococcus pyogenes MGAS315
uauuaacguuaacaaaaaua

SEQ ID NO: 4120867 - RNA, 20 nt, Streptococcus pyogenes MGAS315
uauuaauaaguauuuuaaaa

SEQ ID NO: 4120868 - RNA, 16 nt, Streptococcus pyogenes MGAS315
uauuaaugauucaaua

SEQ ID NO: 4120869 - RNA, 13 nt, Streptococcus pyogenes MGAS315
uauuacaaauaac

SEQ ID NO: 4120870 - RNA, 11 nt, Streptococcus pyogenes MGAS315
uauuacuucuu

SEQ ID NO: 4120871 - RNA, 12 nt, Streptococcus pyogenes MGAS315
uauuauuuugcu

SEQ ID NO: 4120872 - RNA, 17 nt, Streptococcus pyogenes MGAS315
uauucaccguggacuug

SEQ ID NO: 4120873 - RNA, 16 nt, Streptococcus pyogenes MGAS315
uauucuuaaaaaaauc

SEQ ID NO: 4120874 - RNA, 21 nt, Streptococcus pyogenes MGAS315
uauugguugccugaaauauaa

SEQ ID NO: 4120875 - RNA, 15 nt, Streptococcus pyogenes MGAS315
uauuguuaauauagu

SEQ ID NO: 4120876 - RNA, 12 nt, Streptococcus pyogenes MGAS315
uauuuaauagca

SEQ ID NO: 4120877 - RNA, 23 nt, Streptococcus pyogenes MGAS315
uauuuaauagcauugucaaauaa

SEQ ID NO: 4120878 - RNA, 22 nt, Streptococcus pyogenes MGAS315
uauuuacugggucaacuccaau

SEQ ID NO: 4120879 - RNA, 17 nt, Streptococcus pyogenes MGAS315
uauuugaaguaaaggau

SEQ ID NO: 4120880 - RNA, 23 nt, Streptococcus pyogenes MGAS315
uauuugacuuguuacaaaaaaca

SEQ ID NO: 4120881 - RNA, 13 nt, Streptococcus pyogenes MGAS315
uauuuuaaaauag

SEQ ID NO: 4120882 - RNA, 20 nt, Streptococcus pyogenes MGAS315
uauuuuaaaauccucuuuua

SEQ ID NO: 4120883 - RNA, 22 nt, Streptococcus pyogenes MGAS315
uauuuuaaaauccucuuuuaau

SEQ ID NO: 4120884 - RNA, 15 nt, Streptococcus pyogenes MGAS315
uauuuuauuaauaag

SEQ ID NO: 4120885 - RNA, 22 nt, Streptococcus pyogenes MGAS315
uauuuugauacgguuauuggug

SEQ ID NO: 4120886 - RNA, 15 nt, Streptococcus pyogenes MGAS315
uauuuugauauuuuu

SEQ ID NO: 4120887 - RNA, 14 nt, Streptococcus pyogenes MGAS315
uauuuuucgcacag

SEQ ID NO: 4120888 - RNA, 12 nt, Streptococcus pyogenes MGAS315
ucaaaaaaagac

SEQ ID NO: 4120889 - RNA, 13 nt, Streptococcus pyogenes MGAS315
ucaaaaaaagaca

SEQ ID NO: 4120890 - RNA, 13 nt, Streptococcus pyogenes MGAS315
ucaaaaaagggaa

SEQ ID NO: 4120891 - RNA, 17 nt, Streptococcus pyogenes MGAS315
ucaaaaaauuaagaagg

SEQ ID NO: 4120892 - RNA, 16 nt, Streptococcus pyogenes MGAS315
ucaaaaauacuaccuu

SEQ ID NO: 4120893 - RNA, 15 nt, Streptococcus pyogenes MGAS315
ucaaaaccaagucgu

SEQ ID NO: 4120894 - RNA, 18 nt, Streptococcus pyogenes MGAS315
ucaaaagaccauaaaaaa

SEQ ID NO: 4120895 - RNA, 20 nt, Streptococcus pyogenes MGAS315
ucaaacuauauuguuaguuu

SEQ ID NO: 4120896 - RNA, 21 nt, Streptococcus pyogenes MGAS315
ucaaaggguguuuuuuauaug

SEQ ID NO: 4120897 - RNA, 22 nt, Streptococcus pyogenes MGAS315
ucaaauaaaaucguuauuaauu

SEQ ID NO: 4120898 - RNA, 17 nt, Streptococcus pyogenes MGAS315
ucaacaaucuuaaaaua

SEQ ID NO: 4120899 - RNA, 21 nt, Streptococcus pyogenes MGAS315
ucaacagauagucaaaaagac

SEQ ID NO: 4120900 - RNA, 15 nt, Streptococcus pyogenes MGAS315
ucaacaguugcuugc

SEQ ID NO: 4120901 - RNA, 21 nt, Streptococcus pyogenes MGAS315
ucaacaguugcuugcuuuuuu

SEQ ID NO: 4120902 - RNA, 23 nt, Streptococcus pyogenes MGAS315
ucaaccugcucucauaauuugaa

SEQ ID NO: 4120903 - RNA, 19 nt, Streptococcus pyogenes MGAS315
ucaauaacagaaauuaaua

SEQ ID NO: 4120904 - RNA, 14 nt, Streptococcus pyogenes MGAS315
ucaauauaauaaaa

SEQ ID NO: 4120905 - RNA, 15 nt, Streptococcus pyogenes MGAS315
ucaauaucauauuuu

SEQ ID NO: 4120906 - RNA, 22 nt, Streptococcus pyogenes MGAS315
ucaauauuuuauuaauaaguau

SEQ ID NO: 4120907 - RNA, 19 nt, Streptococcus pyogenes MGAS315
ucaaugacuugaccaaaua

SEQ ID NO: 4120908 - RNA, 22 nt, Streptococcus pyogenes MGAS315
ucaaugacuugaccaaauacag

SEQ ID NO: 4120909 - RNA, 20 nt, Streptococcus pyogenes MGAS315
ucaauggaaauuuuaaauga

SEQ ID NO: 4120910 - RNA, 22 nt, Streptococcus pyogenes MGAS315
ucaauuaauguuaggagcacaa

SEQ ID NO: 4120911 - RNA, 15 nt, Streptococcus pyogenes MGAS315
ucaauuuucauuuuu

SEQ ID NO: 4120912 - RNA, 18 nt, Streptococcus pyogenes MGAS315
ucaauuuuugccaaaauc

SEQ ID NO: 4120913 - RNA, 14 nt, Streptococcus pyogenes MGAS315
ucacaacuucuaua

SEQ ID NO: 4120914 - RNA, 19 nt, Streptococcus pyogenes MGAS315
ucaccuuaggcagacaauu

SEQ ID NO: 4120915 - RNA, 15 nt, Streptococcus pyogenes MGAS315
ucacuauaauuucaa

SEQ ID NO: 4120916 - RNA, 20 nt, Streptococcus pyogenes MGAS315
ucagcauaaccuuugccauu

SEQ ID NO: 4120917 - RNA, 22 nt, Streptococcus pyogenes MGAS315
ucagcccccucuuuaccauuua

SEQ ID NO: 4120918 - RNA, 19 nt, Streptococcus pyogenes MGAS315
ucagguugcaacaauuaaa

SEQ ID NO: 4120919 - RNA, 16 nt, Streptococcus pyogenes MGAS315
ucaguagugaugagua

SEQ ID NO: 4120920 - RNA, 13 nt, Streptococcus pyogenes MGAS315
ucaguauacucag

SEQ ID NO: 4120921 - RNA, 15 nt, Streptococcus pyogenes MGAS315
ucaguuuuuuugauu

SEQ ID NO: 4120922 - RNA, 16 nt, Streptococcus pyogenes MGAS315
ucauaaacaaugaguc

SEQ ID NO: 4120923 - RNA, 21 nt, Streptococcus pyogenes MGAS315
ucauaaacaaugagucaccug

SEQ ID NO: 4120924 - RNA, 15 nt, Streptococcus pyogenes MGAS315
ucauaacuugucaag

SEQ ID NO: 4120925 - RNA, 21 nt, Streptococcus pyogenes MGAS315
ucauacucaauagcugcugcu

SEQ ID NO: 4120926 - RNA, 14 nt, Streptococcus pyogenes MGAS315
ucauauuuuaaucu

SEQ ID NO: 4120927 - RNA, 21 nt, Streptococcus pyogenes MGAS315
ucaucaaaagaccauaaaaaa

SEQ ID NO: 4120928 - RNA, 20 nt, Streptococcus pyogenes MGAS315
ucaucauuuagcugauaauc

SEQ ID NO: 4120929 - RNA, 22 nt, Streptococcus pyogenes MGAS315
ucaugacgccuccaaauacugg

SEQ ID NO: 4120930 - RNA, 18 nt, Streptococcus pyogenes MGAS315
ucauuaaagcuaucauac

SEQ ID NO: 4120931 - RNA, 17 nt, Streptococcus pyogenes MGAS315
ucauuagaauaagaaaa

SEQ ID NO: 4120932 - RNA, 22 nt, Streptococcus pyogenes MGAS315
ucauuagaauaagaaaaccuua

SEQ ID NO: 4120933 - RNA, 18 nt, Streptococcus pyogenes MGAS315
ucauugcuuuuuaugauu

SEQ ID NO: 4120934 - RNA, 14 nt, Streptococcus pyogenes MGAS315
ucauuuugguugau

SEQ ID NO: 4120935 - RNA, 18 nt, Streptococcus pyogenes MGAS315
uccaacaacgcuauuuuu

SEQ ID NO: 4120936 - RNA, 20 nt, Streptococcus pyogenes MGAS315
uccaacgugcuauaagagga

SEQ ID NO: 4120937 - RNA, 19 nt, Streptococcus pyogenes MGAS315
uccaagaucugcacacacu

SEQ ID NO: 4120938 - RNA, 22 nt, Streptococcus pyogenes MGAS315
uccaguucuguuucuaagcaaa

SEQ ID NO: 4120939 - RNA, 16 nt, Streptococcus pyogenes MGAS315
uccaucauugaugaga

SEQ ID NO: 4120940 - RNA, 15 nt, Streptococcus pyogenes MGAS315
uccauuauaaaucuu

SEQ ID NO: 4120941 - RNA, 15 nt, Streptococcus pyogenes MGAS315
ucccauguuuuauua

SEQ ID NO: 4120942 - RNA, 18 nt, Streptococcus pyogenes MGAS315
uccccuccuugcaauaga

SEQ ID NO: 4120943 - RNA, 21 nt, Streptococcus pyogenes MGAS315
uccggcaggggucauuauugu

SEQ ID NO: 4120944 - RNA, 12 nt, Streptococcus pyogenes MGAS315
uccguuugagau

SEQ ID NO: 4120945 - RNA, 16 nt, Streptococcus pyogenes MGAS315
uccuaaaaccauaccu

SEQ ID NO: 4120946 - RNA, 18 nt, Streptococcus pyogenes MGAS315
uccuaaugcugcaaaauu

SEQ ID NO: 4120947 - RNA, 16 nt, Streptococcus pyogenes MGAS315
uccuaucagauacuag

SEQ ID NO: 4120948 - RNA, 13 nt, Streptococcus pyogenes MGAS315
uccucugaaaagu

SEQ ID NO: 4120949 - RNA, 23 nt, Streptococcus pyogenes MGAS315
uccucuuuuaauuuggaggugaa

SEQ ID NO: 4120950 - RNA, 13 nt, Streptococcus pyogenes MGAS315
uccuuugaccaca

SEQ ID NO: 4120951 - RNA, 14 nt, Streptococcus pyogenes MGAS315
ucgauuauuaacca

SEQ ID NO: 4120952 - RNA, 17 nt, Streptococcus pyogenes MGAS315
ucgcagaguacaaggca

SEQ ID NO: 4120953 - RNA, 17 nt, Streptococcus pyogenes MGAS315
ucgccuaggaauaaaau

SEQ ID NO: 4120954 - RNA, 20 nt, Streptococcus pyogenes MGAS315
ucgucgugccaccucuaaca

SEQ ID NO: 4120955 - RNA, 21 nt, Streptococcus pyogenes MGAS315
ucguuuuacggcuucuacaca

SEQ ID NO: 4120956 - RNA, 14 nt, Streptococcus pyogenes MGAS315
ugauauaaaaaugg

SEQ ID NO: 4120957 - RNA, 16 nt, Streptococcus pyogenes MGAS315
ugauauaaaaauggag

SEQ ID NO: 4120958 - RNA, 20 nt, Streptococcus pyogenes MGAS315
ugauauuucaucuugcauua

SEQ ID NO: 4120959 - RNA, 17 nt, Streptococcus pyogenes MGAS315
ugaucuguuaugugaug

SEQ ID NO: 4120960 - RNA, 16 nt, Streptococcus pyogenes MGAS315
ugaucuguuuaaaaac

SEQ ID NO: 4120961 - RNA, 18 nt, Streptococcus pyogenes MGAS315
ugaucuguuuaaaaacaa

SEQ ID NO: 4120962 - RNA, 15 nt, Streptococcus pyogenes MGAS315
ugaugagacuaaccu

SEQ ID NO: 4120963 - RNA, 22 nt, Streptococcus pyogenes MGAS315
ugaugagacuaaccugcauauc

SEQ ID NO: 4120964 - RNA, 21 nt, Streptococcus pyogenes MGAS315
ugaugaguaggcgaacuuuau

SEQ ID NO: 4120965 - RNA, 12 nt, Streptococcus pyogenes MGAS315
ugaugauggagu

SEQ ID NO: 4120966 - RNA, 15 nt, Streptococcus pyogenes MGAS315
ugaugcguuuauaaa

SEQ ID NO: 4120967 - RNA, 17 nt, Streptococcus pyogenes MGAS315
ugauggcuuuccauucu

SEQ ID NO: 4120968 - RNA, 14 nt, Streptococcus pyogenes MGAS315
ugauguuauuaaau

SEQ ID NO: 4120969 - RNA, 15 nt, Streptococcus pyogenes MGAS315
ugauguuauuaaaua

SEQ ID NO: 4120970 - RNA, 12 nt, Streptococcus pyogenes MGAS315
ugauuacugaua

SEQ ID NO: 4120971 - RNA, 15 nt, Streptococcus pyogenes MGAS315
ugauuauuacaaaua

SEQ ID NO: 4120972 - RNA, 17 nt, Streptococcus pyogenes MGAS315
ugauuauucucuauuuu

SEQ ID NO: 4120973 - RNA, 12 nt, Streptococcus pyogenes MGAS315
ugauucuuuuuu

SEQ ID NO: 4120974 - RNA, 17 nt, Streptococcus pyogenes MGAS315
ugauugauuugucuucu

SEQ ID NO: 4120975 - RNA, 13 nt, Streptococcus pyogenes MGAS315
ugauugccauuua

SEQ ID NO: 4120976 - RNA, 21 nt, Streptococcus pyogenes MGAS315
ugauuuaugaccauuuuuacu

SEQ ID NO: 4120977 - RNA, 20 nt, Streptococcus pyogenes MGAS315
ugauuuuaacguuuugaacu

SEQ ID NO: 4120978 - RNA, 21 nt, Streptococcus pyogenes MGAS315
ugcaaauaguggcaaaugaca

SEQ ID NO: 4120979 - RNA, 17 nt, Streptococcus pyogenes MGAS315
ugcaauauccauagaaa

SEQ ID NO: 4120980 - RNA, 20 nt, Streptococcus pyogenes MGAS315
ugcaauauccauagaaauug

SEQ ID NO: 4120981 - RNA, 21 nt, Streptococcus pyogenes MGAS315
ugcacacaaaucuucuagaau

SEQ ID NO: 4120982 - RNA, 18 nt, Streptococcus pyogenes MGAS315
ugcaguucauaguugugc

SEQ ID NO: 4120983 - RNA, 14 nt, Streptococcus pyogenes MGAS315
ugcaugaagugguu

SEQ ID NO: 4120984 - RNA, 14 nt, Streptococcus pyogenes MGAS315
ugcauuaccuuauu

SEQ ID NO: 4120985 - RNA, 13 nt, Streptococcus pyogenes MGAS315
ugcauuaucaucu

SEQ ID NO: 4120986 - RNA, 23 nt, Streptococcus pyogenes MGAS315
ugccaccucuaacaccaaaauca

SEQ ID NO: 4120987 - RNA, 15 nt, Streptococcus pyogenes MGAS315
ugccaguaaggaaau

SEQ ID NO: 4120988 - RNA, 18 nt, Streptococcus pyogenes MGAS315
ugccaucaaaaaaagaca

SEQ ID NO: 4120989 - RNA, 21 nt, Streptococcus pyogenes MGAS315
ugccaucugcuuggauuuccu

SEQ ID NO: 4120990 - RNA, 16 nt, Streptococcus pyogenes MGAS315
ugccauggguaaaaug

SEQ ID NO: 4120991 - RNA, 17 nt, Streptococcus pyogenes MGAS315
ugccauggguaaaauga

SEQ ID NO: 4120992 - RNA, 12 nt, Streptococcus pyogenes MGAS315
ugccauuaauaa

SEQ ID NO: 4120993 - RNA, 18 nt, Streptococcus pyogenes MGAS315
ugccauuuccuacaaaau

SEQ ID NO: 4120994 - RNA, 14 nt, Streptococcus pyogenes MGAS315
ugccauuugagcac

SEQ ID NO: 4120995 - RNA, 20 nt, Streptococcus pyogenes MGAS315
ugcgcauguugacuauuuuu

SEQ ID NO: 4120996 - RNA, 13 nt, Streptococcus pyogenes MGAS315
ugcguuuauaaag

SEQ ID NO: 4120997 - RNA, 14 nt, Streptococcus pyogenes MGAS315
ugcuagucuuuuuu

SEQ ID NO: 4120998 - RNA, 14 nt, Streptococcus pyogenes MGAS315
ugcucaaaacuucg

SEQ ID NO: 4120999 - RNA, 15 nt, Streptococcus pyogenes MGAS315
ugcugaguucuuuuu

SEQ ID NO: 4121000 - RNA, 16 nt, Streptococcus pyogenes MGAS315
ugcuguuugucauacu

SEQ ID NO: 4121001 - RNA, 12 nt, Streptococcus pyogenes MGAS315
ugcuucuuucaa

SEQ ID NO: 4121002 - RNA, 12 nt, Streptococcus pyogenes MGAS315
ugcuuuaaaaag

SEQ ID NO: 4121003 - RNA, 17 nt, Streptococcus pyogenes MGAS315
ugcuuuuuucuaaccuc

SEQ ID NO: 4121004 - RNA, 13 nt, Streptococcus pyogenes MGAS315
ugcuuuuuuuguc

SEQ ID NO: 4121005 - RNA, 23 nt, Streptococcus pyogenes MGAS315
ugcuuuuuuugucguuuuuugcu

SEQ ID NO: 4121006 - RNA, 15 nt, Streptococcus pyogenes MGAS315
uggaaaguaaggguu

SEQ ID NO: 4121007 - RNA, 17 nt, Streptococcus pyogenes MGAS315
uggaauagguaaagauu

SEQ ID NO: 4121008 - RNA, 21 nt, Streptococcus pyogenes MGAS315
uggaauagguaaagauuuuaa

SEQ ID NO: 4121009 - RNA, 21 nt, Streptococcus pyogenes MGAS315
uggacgaaggcucuuaucuuu

SEQ ID NO: 4121010 - RNA, 20 nt, Streptococcus pyogenes MGAS315
uggacgucuucuuuuuauua

SEQ ID NO: 4121011 - RNA, 21 nt, Streptococcus pyogenes MGAS315
uggacgucuucuuuuuauuau

SEQ ID NO: 4121012 - RNA, 16 nt, Streptococcus pyogenes MGAS315
uggagagauaaaaagu

SEQ ID NO: 4121013 - RNA, 21 nt, Streptococcus pyogenes MGAS315
uggagagauuucguugacaaa

SEQ ID NO: 4121014 - RNA, 13 nt, Streptococcus pyogenes MGAS315
uggauagacugau

SEQ ID NO: 4121015 - RNA, 20 nt, Streptococcus pyogenes MGAS315
uggauauaacaacucccucc

SEQ ID NO: 4121016 - RNA, 13 nt, Streptococcus pyogenes MGAS315
uggauuuccucua

SEQ ID NO: 4121017 - RNA, 21 nt, Streptococcus pyogenes MGAS315
uggccaauaaaauaucuagaa

SEQ ID NO: 4121018 - RNA, 23 nt, Streptococcus pyogenes MGAS315
uggcuauaaauggacaaucuuaa

SEQ ID NO: 4121019 - RNA, 22 nt, Streptococcus pyogenes MGAS315
uggcuucuagguagguuugaaa

SEQ ID NO: 4121020 - RNA, 14 nt, Streptococcus pyogenes MGAS315
uggguaaaaugacu

SEQ ID NO: 4121021 - RNA, 20 nt, Streptococcus pyogenes MGAS315
uggguauucaccguggacuu

SEQ ID NO: 4121022 - RNA, 13 nt, Streptococcus pyogenes MGAS315
ugguauucuuuuu

SEQ ID NO: 4121023 - RNA, 16 nt, Streptococcus pyogenes MGAS315
uggugcuacugaugua

SEQ ID NO: 4121024 - RNA, 20 nt, Streptococcus pyogenes MGAS315
ugguguuauccucuuuuagu

SEQ ID NO: 4121025 - RNA, 12 nt, Streptococcus pyogenes MGAS315
ugguuaaaaaga

SEQ ID NO: 4121026 - RNA, 13 nt, Streptococcus pyogenes MGAS315
ugguuaaaaagag

SEQ ID NO: 4121027 - RNA, 14 nt, Streptococcus pyogenes MGAS315
ugguuaaaaagaga

SEQ ID NO: 4121028 - RNA, 23 nt, Streptococcus pyogenes MGAS315
ugguucaagagguucgucaagca

SEQ ID NO: 4121029 - RNA, 18 nt, Streptococcus pyogenes MGAS315
ugguugccugaaauauaa

SEQ ID NO: 4121030 - RNA, 13 nt, Streptococcus pyogenes MGAS315
ugguuuuaauauu

SEQ ID NO: 4121031 - RNA, 18 nt, Streptococcus pyogenes MGAS315
ugguuuuuugucuucuuc

SEQ ID NO: 4121032 - RNA, 19 nt, Streptococcus pyogenes MGAS315
uguaaaucaguagugauga

SEQ ID NO: 4121033 - RNA, 12 nt, Streptococcus pyogenes MGAS315
uguaauaacaaa

SEQ ID NO: 4121034 - RNA, 23 nt, Streptococcus pyogenes MGAS315
uguaauaacaaaaugaagcaaaa

SEQ ID NO: 4121035 - RNA, 12 nt, Streptococcus pyogenes MGAS315
uguaauccccuc

SEQ ID NO: 4121036 - RNA, 17 nt, Streptococcus pyogenes MGAS315
uguaauguuguaaacuu

SEQ ID NO: 4121037 - RNA, 20 nt, Streptococcus pyogenes MGAS315
uguaauguuguaaacuuccu

SEQ ID NO: 4121038 - RNA, 13 nt, Streptococcus pyogenes MGAS315
uguacaagagcuu

SEQ ID NO: 4121039 - RNA, 19 nt, Streptococcus pyogenes MGAS315
uguagggauuuuuuuaacu

SEQ ID NO: 4121040 - RNA, 21 nt, Streptococcus pyogenes MGAS315
uguauauuuaauagcauuguc

SEQ ID NO: 4121041 - RNA, 21 nt, Streptococcus pyogenes MGAS315
uguaucaagagucauuugacu

SEQ ID NO: 4121042 - RNA, 16 nt, Streptococcus pyogenes MGAS315
uguauuacucaauuaa

SEQ ID NO: 4121043 - RNA, 13 nt, Streptococcus pyogenes MGAS315
uguauuacuucuu

SEQ ID NO: 4121044 - RNA, 14 nt, Streptococcus pyogenes MGAS315
uguauucuuaaaaa

SEQ ID NO: 4121045 - RNA, 23 nt, Streptococcus pyogenes MGAS315
ugucaagccauagccagauggug

SEQ ID NO: 4121046 - RNA, 18 nt, Streptococcus pyogenes MGAS315
ugucagcauaaaggguaa

SEQ ID NO: 4121047 - RNA, 17 nt, Streptococcus pyogenes MGAS315
ugucaggggaauuuccu

SEQ ID NO: 4121048 - RNA, 18 nt, Streptococcus pyogenes MGAS315
uguccuaaccuuuuggcu

SEQ ID NO: 4121049 - RNA, 16 nt, Streptococcus pyogenes MGAS315
ugucguuuuuugcuuu

SEQ ID NO: 4121050 - RNA, 21 nt, Streptococcus pyogenes MGAS315
ugucguuuuuugcuuuugaua

SEQ ID NO: 4121051 - RNA, 16 nt, Streptococcus pyogenes MGAS315
ugucucacuauuuugu

SEQ ID NO: 4121052 - RNA, 18 nt, Streptococcus pyogenes MGAS315
ugucuuagccuuuuuuug

SEQ ID NO: 4121053 - RNA, 19 nt, Streptococcus pyogenes MGAS315
ugugacaauuggugauuaa

SEQ ID NO: 4121054 - RNA, 17 nt, Streptococcus pyogenes MGAS315
ugugaccagauacuucu

SEQ ID NO: 4121055 - RNA, 23 nt, Streptococcus pyogenes MGAS315
uucuagacccuagcauaaaagau

SEQ ID NO: 4121056 - RNA, 14 nt, Streptococcus pyogenes MGAS315
uucuauuaccuaua

SEQ ID NO: 4121057 - RNA, 12 nt, Streptococcus pyogenes MGAS315
uucugcauuauc

SEQ ID NO: 4121058 - RNA, 21 nt, Streptococcus pyogenes MGAS315
uucuguauuguagaggacuaa

SEQ ID NO: 4121059 - RNA, 16 nt, Streptococcus pyogenes MGAS315
uucuguuuaaaauaua

SEQ ID NO: 4121060 - RNA, 23 nt, Streptococcus pyogenes MGAS315
uucuguuuaaaauauauuuugga

SEQ ID NO: 4121061 - RNA, 18 nt, Streptococcus pyogenes MGAS315
uucuucuuuucagagaug

SEQ ID NO: 4121062 - RNA, 14 nt, Streptococcus pyogenes MGAS315
uucuuuuuggcuga

SEQ ID NO: 4121063 - RNA, 12 nt, Streptococcus pyogenes MGAS315
uucuuuuuuacc

SEQ ID NO: 4121064 - RNA, 19 nt, Streptococcus pyogenes MGAS315
uugaaaagaugcacacaaa

SEQ ID NO: 4121065 - RNA, 18 nt, Streptococcus pyogenes MGAS315
uugaaagaggugcaacug

SEQ ID NO: 4121066 - RNA, 19 nt, Streptococcus pyogenes MGAS315
uugaaaugugguaagaaga

SEQ ID NO: 4121067 - RNA, 21 nt, Streptococcus pyogenes MGAS315
uugaauaucgccaauaaaaaa

SEQ ID NO: 4121068 - RNA, 19 nt, Streptococcus pyogenes MGAS315
uugaaucuuguuuaaccuc

SEQ ID NO: 4121069 - RNA, 14 nt, Streptococcus pyogenes MGAS315
uugaauguuguauu

SEQ ID NO: 4121070 - RNA, 13 nt, Streptococcus pyogenes MGAS315
uugacaaagccau

SEQ ID NO: 4121071 - RNA, 22 nt, Streptococcus pyogenes MGAS315
uugacagacaccaaaaaaagca

SEQ ID NO: 4121072 - RNA, 16 nt, Streptococcus pyogenes MGAS315
uugacaguuaaaaaua

SEQ ID NO: 4121073 - RNA, 13 nt, Streptococcus pyogenes MGAS315
uugaccacaccua

SEQ ID NO: 4121074 - RNA, 18 nt, Streptococcus pyogenes MGAS315
uugacuuguuacaaaaaa

SEQ ID NO: 4121075 - RNA, 15 nt, Streptococcus pyogenes MGAS315
uugauaccaugugca

SEQ ID NO: 4121076 - RNA, 15 nt, Streptococcus pyogenes MGAS315
uugauauuuuuucuc

SEQ ID NO: 4121077 - RNA, 18 nt, Streptococcus pyogenes MGAS315
uugauauuuuuucucaaa

SEQ ID NO: 4121078 - RNA, 22 nt, Streptococcus pyogenes MGAS315
uugauauuuuuucucaaaaaua

SEQ ID NO: 4121079 - RNA, 16 nt, Streptococcus pyogenes MGAS315
uugaugagacuaaccu

SEQ ID NO: 4121080 - RNA, 13 nt, Streptococcus pyogenes MGAS315
uugauuugccgcu

SEQ ID NO: 4121081 - RNA, 20 nt, Streptococcus pyogenes MGAS315
uugauuuuucuuguuuuggu

SEQ ID NO: 4121082 - RNA, 22 nt, Streptococcus pyogenes MGAS315
uugcaaauaguggcaaaugaca

SEQ ID NO: 4121083 - RNA, 20 nt, Streptococcus pyogenes MGAS315
uugcagguaauuaucugaau

SEQ ID NO: 4121084 - RNA, 16 nt, Streptococcus pyogenes MGAS315
uugcaucgcaaacaga

SEQ ID NO: 4121085 - RNA, 22 nt, Streptococcus pyogenes MGAS315
uugccauuaauaauauuaaccg

SEQ ID NO: 4121086 - RNA, 13 nt, Streptococcus pyogenes MGAS315
uugccauuuaauu

SEQ ID NO: 4121087 - RNA, 14 nt, Streptococcus pyogenes MGAS315
uugccuuuaacaug

SEQ ID NO: 4121088 - RNA, 13 nt, Streptococcus pyogenes MGAS315
uugcuuaaugacc

SEQ ID NO: 4121089 - RNA, 14 nt, Streptococcus pyogenes MGAS315
uugcuuuugauacc

SEQ ID NO: 4121090 - RNA, 13 nt, Streptococcus pyogenes MGAS315
uuggaucuucaac

SEQ ID NO: 4121091 - RNA, 20 nt, Streptococcus pyogenes MGAS315
uuggccuacuagcacaaaau

SEQ ID NO: 4121092 - RNA, 22 nt, Streptococcus pyogenes MGAS315
uugguggaagaguaaggaccaa

SEQ ID NO: 4121093 - RNA, 12 nt, Streptococcus pyogenes MGAS315
uuguauagguag

SEQ ID NO: 4121094 - RNA, 20 nt, Streptococcus pyogenes MGAS315
uugucaaaaaguaaaaagca

SEQ ID NO: 4121095 - RNA, 23 nt, Streptococcus pyogenes MGAS315
uugucaaaaaguaaaaagcaaau

SEQ ID NO: 4121096 - RNA, 13 nt, Streptococcus pyogenes MGAS315
uugugaucuguua

SEQ ID NO: 4121097 - RNA, 22 nt, Streptococcus pyogenes MGAS315
uugugcuaaucuaucucguaau

SEQ ID NO: 4121098 - RNA, 14 nt, Streptococcus pyogenes MGAS315
uuguuacaaaaaac

SEQ ID NO: 4121099 - RNA, 16 nt, Streptococcus pyogenes MGAS315
uuguuacaaaaaacaa

SEQ ID NO: 4121100 - RNA, 19 nt, Streptococcus pyogenes MGAS315
uuguuaguuuuauccccua

SEQ ID NO: 4121101 - RNA, 19 nt, Streptococcus pyogenes MGAS315
uuguuuuaguaaagccuua

SEQ ID NO: 4121102 - RNA, 22 nt, Streptococcus pyogenes MGAS315
uuguuuuggccaauaaaauauc

SEQ ID NO: 4121103 - RNA, 23 nt, Streptococcus pyogenes MGAS315
uuguuuuuucaaagggagauucu

SEQ ID NO: 4121104 - RNA, 16 nt, Streptococcus pyogenes MGAS315
uuuaaaaacaaauugu

SEQ ID NO: 4121105 - RNA, 17 nt, Streptococcus pyogenes MGAS315
uuuaaaagggcugaccu

SEQ ID NO: 4121106 - RNA, 21 nt, Streptococcus pyogenes MGAS315
uuuaaaauccucuuuuaauuu

SEQ ID NO: 4121107 - RNA, 20 nt, Streptococcus pyogenes MGAS315
uuuaacaugauguaccaauu

SEQ ID NO: 4121108 - RNA, 14 nt, Streptococcus pyogenes MGAS315
uuuaagacaacaua

SEQ ID NO: 4121109 - RNA, 14 nt, Streptococcus pyogenes MGAS315
uuuaagcugaguaa

SEQ ID NO: 4121110 - RNA, 15 nt, Streptococcus pyogenes MGAS315
uuuaagcugaguaaa

SEQ ID NO: 4121111 - RNA, 20 nt, Streptococcus pyogenes MGAS315
uuuaagguauuguucaaccg

SEQ ID NO: 4121112 - RNA, 16 nt, Streptococcus pyogenes MGAS315
uuuaauacguuuauuu

SEQ ID NO: 4121113 - RNA, 15 nt, Streptococcus pyogenes MGAS315
uuuacaucaaaaaaa

SEQ ID NO: 4121114 - RNA, 19 nt, Streptococcus pyogenes MGAS315
uuuacggcuucuacacaaa

SEQ ID NO: 4121115 - RNA, 20 nt, Streptococcus pyogenes MGAS315
uuuacuauggcuucuaaaaa

SEQ ID NO: 4121116 - RNA, 15 nt, Streptococcus pyogenes MGAS315
uuuacuuuuaaaauc

SEQ ID NO: 4121117 - RNA, 15 nt, Streptococcus pyogenes MGAS315
uuuagccguccuuaa

SEQ ID NO: 4121118 - RNA, 21 nt, Streptococcus pyogenes MGAS315
uuuagcuuauaauuugacuuc

SEQ ID NO: 4121119 - RNA, 17 nt, Streptococcus pyogenes MGAS315
uuuagguacucguaagc

SEQ ID NO: 4121120 - RNA, 13 nt, Streptococcus pyogenes MGAS315
uuuaggucuaauu

SEQ ID NO: 4121121 - RNA, 18 nt, Streptococcus pyogenes MGAS315
uuuauacgguaaaaacuc

SEQ ID NO: 4121122 - RNA, 19 nt, Streptococcus pyogenes MGAS315
uuuaugaccauuuuuacug

SEQ ID NO: 4121123 - RNA, 16 nt, Streptococcus pyogenes MGAS315
uuuauuuugauauuuu

SEQ ID NO: 4121124 - RNA, 23 nt, Streptococcus pyogenes MGAS315
uuuauuuugauauuuuuucucaa

SEQ ID NO: 4121125 - RNA, 15 nt, Streptococcus pyogenes MGAS315
uuucaguuguuuuaa

SEQ ID NO: 4121126 - RNA, 17 nt, Streptococcus pyogenes MGAS315
uuucauuugaaauuccu

SEQ ID NO: 4121127 - RNA, 18 nt, Streptococcus pyogenes MGAS315
uuuccuagcgggaacacu

SEQ ID NO: 4121128 - RNA, 16 nt, Streptococcus pyogenes MGAS315
uuucgacagacaucgu

SEQ ID NO: 4121129 - RNA, 15 nt, Streptococcus pyogenes MGAS315
uuucgugucuaaaau

SEQ ID NO: 4121130 - RNA, 13 nt, Streptococcus pyogenes MGAS315
uuucguuuuauuu

SEQ ID NO: 4121131 - RNA, 15 nt, Streptococcus pyogenes MGAS315
uuugaaguaaaggau

SEQ ID NO: 4121132 - RNA, 12 nt, Streptococcus pyogenes MGAS315
uuugaauguugu

SEQ ID NO: 4121133 - RNA, 19 nt, Streptococcus pyogenes MGAS315
uuugacagacaccaaaaaa

SEQ ID NO: 4121134 - RNA, 16 nt, Streptococcus pyogenes MGAS315
uuugacuucaaaaaua

SEQ ID NO: 4121135 - RNA, 13 nt, Streptococcus pyogenes MGAS315
uuugagaacgaau

SEQ ID NO: 4121136 - RNA, 21 nt, Streptococcus pyogenes MGAS315
uuugagauaguuagcaaauug

SEQ ID NO: 4121137 - RNA, 22 nt, Streptococcus pyogenes MGAS315
uuugaggugaugcucucauaaa

SEQ ID NO: 4121138 - RNA, 19 nt, Streptococcus pyogenes MGAS315
uuugauauuuuuucucaaa

SEQ ID NO: 4121139 - RNA, 20 nt, Streptococcus pyogenes MGAS315
uuugauauuuuuucucaaaa

SEQ ID NO: 4121140 - RNA, 23 nt, Streptococcus pyogenes MGAS315
uuugccaauaucaagccccucua

SEQ ID NO: 4121141 - RNA, 19 nt, Streptococcus pyogenes MGAS315
uuugccauggcaagagcac

SEQ ID NO: 4121142 - RNA, 20 nt, Streptococcus pyogenes MGAS315
uuugcugaaauaucuuucag

SEQ ID NO: 4121143 - RNA, 18 nt, Streptococcus pyogenes MGAS315
uuugcugagcuaaagcca

SEQ ID NO: 4121144 - RNA, 20 nt, Streptococcus pyogenes MGAS315
uuuggaggugaaaauaucuu

SEQ ID NO: 4121145 - RNA, 13 nt, Streptococcus pyogenes MGAS315
uuuggaucuucaa

SEQ ID NO: 4121146 - RNA, 19 nt, Streptococcus pyogenes MGAS315
uuuggccuacuagcacaaa

SEQ ID NO: 4121147 - RNA, 22 nt, Streptococcus pyogenes MGAS315
uuuggccuacuagcacaaaauc

SEQ ID NO: 4121148 - RNA, 16 nt, Streptococcus pyogenes MGAS315
uuugguggaagaguaa

SEQ ID NO: 4121149 - RNA, 21 nt, Streptococcus pyogenes MGAS315
uuugguguuauccucuuuuag

SEQ ID NO: 4121150 - RNA, 12 nt, Streptococcus pyogenes MGAS315
uuugguugauag

SEQ ID NO: 4121151 - RNA, 17 nt, Streptococcus pyogenes MGAS315
uuuguaucucauaacaa

SEQ ID NO: 4121152 - RNA, 21 nt, Streptococcus pyogenes MGAS315
uuugucugacuuaaauuugga

SEQ ID NO: 4121153 - RNA, 19 nt, Streptococcus pyogenes MGAS315
uuugucuucuucuuuucag

SEQ ID NO: 4121154 - RNA, 23 nt, Streptococcus pyogenes MGAS315
aaaacgaugagauuaacugacaa

SEQ ID NO: 4121155 - RNA, 22 nt, Streptococcus pyogenes MGAS315
aaaacguguauucuuaaaaaaa

SEQ ID NO: 4121156 - RNA, 12 nt, Streptococcus pyogenes MGAS315
aaaacucaaaaa

SEQ ID NO: 4121157 - RNA, 17 nt, Streptococcus pyogenes MGAS315
aaaagaaaaucuaauca

SEQ ID NO: 4121158 - RNA, 20 nt, Streptococcus pyogenes MGAS315
aaaagaagcaaaauuauuau

SEQ ID NO: 4121159 - RNA, 15 nt, Streptococcus pyogenes MGAS315
aaaagauauuuuaaa

SEQ ID NO: 4121160 - RNA, 19 nt, Streptococcus pyogenes MGAS315
aaaagaugcacacaaaucu

SEQ ID NO: 4121161 - RNA, 16 nt, Streptococcus pyogenes MGAS315
aaaagcaaauugaaaa

SEQ ID NO: 4121162 - RNA, 12 nt, Streptococcus pyogenes MGAS315
aaaagcaaugac

SEQ ID NO: 4121163 - RNA, 20 nt, Streptococcus pyogenes MGAS315
aaaagccuauuuaauaggcu

SEQ ID NO: 4121164 - RNA, 19 nt, Streptococcus pyogenes MGAS315
aaaagcgauaauaaagugc

SEQ ID NO: 4121165 - RNA, 14 nt, Streptococcus pyogenes MGAS315
aaaagcuaacacca

SEQ ID NO: 4121166 - RNA, 15 nt, Streptococcus pyogenes MGAS315
aaaagggcugaccuu

SEQ ID NO: 4121167 - RNA, 14 nt, Streptococcus pyogenes MGAS315
aaaaguaaaaagca

SEQ ID NO: 4121168 - RNA, 15 nt, Streptococcus pyogenes MGAS315
aaaagugugaccaga

SEQ ID NO: 4121169 - RNA, 21 nt, Streptococcus pyogenes MGAS315
aaaaguugauauccccuccuu

SEQ ID NO: 4121170 - RNA, 15 nt, Streptococcus pyogenes MGAS315
aaaauaaaauauuuu

SEQ ID NO: 4121171 - RNA, 19 nt, Streptococcus pyogenes MGAS315
aaaauaaacuuucaguuau

SEQ ID NO: 4121172 - RNA, 15 nt, Streptococcus pyogenes MGAS315
aaaauacuagaaaaa

SEQ ID NO: 4121173 - RNA, 23 nt, Streptococcus pyogenes MGAS315
aaaauauauucuaauuugugaaa

SEQ ID NO: 4121174 - RNA, 19 nt, Streptococcus pyogenes MGAS315
aaaauaucuuuuuuacuuu

SEQ ID NO: 4121175 - RNA, 19 nt, Streptococcus pyogenes MGAS315
aaaaucaugggaaaagcua

SEQ ID NO: 4121176 - RNA, 18 nt, Streptococcus pyogenes MGAS315
aaaauccucuuuuaauuu

SEQ ID NO: 4121177 - RNA, 14 nt, Streptococcus pyogenes MGAS315
aaaaugacugacaa

SEQ ID NO: 4121178 - RNA, 15 nt, Streptococcus pyogenes MGAS315
aaaaugacugacaaa

SEQ ID NO: 4121179 - RNA, 18 nt, Streptococcus pyogenes MGAS315
aaacaagucuaucugcag

SEQ ID NO: 4121180 - RNA, 12 nt, Streptococcus pyogenes MGAS315
aaacaccccaaa

SEQ ID NO: 4121181 - RNA, 18 nt, Streptococcus pyogenes MGAS315
aaacacuaccuuaaaugu

SEQ ID NO: 4121182 - RNA, 21 nt, Streptococcus pyogenes MGAS315
aaacacuaccuuaaauguaug

SEQ ID NO: 4121183 - RNA, 23 nt, Streptococcus pyogenes MGAS315
aaaccaagucguuuagcuuuuuc

SEQ ID NO: 4121184 - RNA, 23 nt, Streptococcus pyogenes MGAS315
aaaccaagugccaguaaggaaau

SEQ ID NO: 4121185 - RNA, 19 nt, Streptococcus pyogenes MGAS315
aaacguaacguaauagaau

SEQ ID NO: 4121186 - RNA, 18 nt, Streptococcus pyogenes MGAS315
aaacguguauucuuaaaa

SEQ ID NO: 4121187 - RNA, 20 nt, Streptococcus pyogenes MGAS315
aaacguguauucuuaaaaaa

SEQ ID NO: 4121188 - RNA, 21 nt, Streptococcus pyogenes MGAS315
aaacguuaggguuuuauaucu

SEQ ID NO: 4121189 - RNA, 12 nt, Streptococcus pyogenes MGAS315
aaacucugccaa

SEQ ID NO: 4121190 - RNA, 20 nt, Streptococcus pyogenes MGAS315
aaacugcacugagccccaaa

SEQ ID NO: 4121191 - RNA, 14 nt, Streptococcus pyogenes MGAS315
aaacuuacaaaaag

SEQ ID NO: 4121192 - RNA, 14 nt, Streptococcus pyogenes MGAS315
aaagacaaaaaacu

SEQ ID NO: 4121193 - RNA, 14 nt, Streptococcus pyogenes MGAS315
aaagaccucucaug

SEQ ID NO: 4121194 - RNA, 14 nt, Streptococcus pyogenes MGAS315
aaagauauuuuaaa

SEQ ID NO: 4121195 - RNA, 16 nt, Streptococcus pyogenes MGAS315
aaagauauuuuaaaau

SEQ ID NO: 4121196 - RNA, 20 nt, Streptococcus pyogenes MGAS315
aaagauauuuuaaaauaguu

SEQ ID NO: 4121197 - RNA, 15 nt, Streptococcus pyogenes MGAS315
aaagcaaaaaagcca

SEQ ID NO: 4121198 - RNA, 14 nt, Streptococcus pyogenes MGAS315
aaagcaaauugaaa

SEQ ID NO: 4121199 - RNA, 17 nt, Streptococcus pyogenes MGAS315
aaagcaaauugaaaaaa

SEQ ID NO: 4121200 - RNA, 19 nt, Streptococcus pyogenes MGAS315
aaagcaagggaaacaccac

SEQ ID NO: 4121201 - RNA, 16 nt, Streptococcus pyogenes MGAS315
aaagcauaaaaauauu

SEQ ID NO: 4121202 - RNA, 21 nt, Streptococcus pyogenes MGAS315
aaagccaagacuaaagcauuu

SEQ ID NO: 4121203 - RNA, 18 nt, Streptococcus pyogenes MGAS315
aaagccagugcugcugaa

SEQ ID NO: 4121204 - RNA, 17 nt, Streptococcus pyogenes MGAS315
aaagccuacaacagcag

SEQ ID NO: 4121205 - RNA, 20 nt, Streptococcus pyogenes MGAS315
aaagcguugacaguuaaaaa

SEQ ID NO: 4121206 - RNA, 13 nt, Streptococcus pyogenes MGAS315
aaagggaagaaga

SEQ ID NO: 4121207 - RNA, 22 nt, Streptococcus pyogenes MGAS315
aaaguaaaaagcaaauugaaaa

SEQ ID NO: 4121208 - RNA, 12 nt, Streptococcus pyogenes MGAS315
aaaguaaaaaua

SEQ ID NO: 4121209 - RNA, 22 nt, Streptococcus pyogenes MGAS315
aaaguaauaaguagcguacaug

SEQ ID NO: 4121210 - RNA, 17 nt, Streptococcus pyogenes MGAS315
aaaguucuucuaaacgu

SEQ ID NO: 4121211 - RNA, 22 nt, Streptococcus pyogenes MGAS315
aaaguuggcuacucuauuugaa

SEQ ID NO: 4121212 - RNA, 23 nt, Streptococcus pyogenes MGAS315
aaaguuuucucagagacaauaag

SEQ ID NO: 4121213 - RNA, 13 nt, Streptococcus pyogenes MGAS315
aaauaaacuuuca

SEQ ID NO: 4121214 - RNA, 23 nt, Streptococcus pyogenes MGAS315
aaauaacgcgagcuauuggcagu

SEQ ID NO: 4121215 - RNA, 18 nt, Streptococcus pyogenes MGAS315
aaauacuagaaaaagcaa

SEQ ID NO: 4121216 - RNA, 18 nt, Streptococcus pyogenes MGAS315
aaauauaaccucuagcuu

SEQ ID NO: 4121217 - RNA, 21 nt, Streptococcus pyogenes MGAS315
aaauauauucuaauuugugaa

SEQ ID NO: 4121218 - RNA, 18 nt, Streptococcus pyogenes MGAS315
aaauaucuuuuuuacuuu

SEQ ID NO: 4121219 - RNA, 19 nt, Streptococcus pyogenes MGAS315
aaaucaguagugaugagua

SEQ ID NO: 4121220 - RNA, 21 nt, Streptococcus pyogenes MGAS315
aaaucaugggaaaagcuaagu

SEQ ID NO: 4121221 - RNA, 21 nt, Streptococcus pyogenes MGAS315
aaauccuugcguagacagcaa

SEQ ID NO: 4121222 - RNA, 23 nt, Streptococcus pyogenes MGAS315
aaaucuaaucagacucgucuuug

SEQ ID NO: 4121223 - RNA, 18 nt, Streptococcus pyogenes MGAS315
aaaucucagaagcuuuau

SEQ ID NO: 4121224 - RNA, 15 nt, Streptococcus pyogenes MGAS315
aaaucucgauuguaa

SEQ ID NO: 4121225 - RNA, 18 nt, Streptococcus pyogenes MGAS315
aaaucuggcuuagcagca

SEQ ID NO: 4121226 - RNA, 22 nt, Streptococcus pyogenes MGAS315
aaaucuggcuuagcagcaccag

SEQ ID NO: 4121227 - RNA, 22 nt, Streptococcus pyogenes MGAS315
aaaucuuacuaacuagcaagug

SEQ ID NO: 4121228 - RNA, 13 nt, Streptococcus pyogenes MGAS315
aaaucuucuagaa

SEQ ID NO: 4121229 - RNA, 21 nt, Streptococcus pyogenes MGAS315
aaaucuucugcauuaucaucu

SEQ ID NO: 4121230 - RNA, 19 nt, Streptococcus pyogenes MGAS315
aaaugaagcaaaauaaacu

SEQ ID NO: 4121231 - RNA, 13 nt, Streptococcus pyogenes MGAS315
aaaugauagcacc

SEQ ID NO: 4121232 - RNA, 20 nt, Streptococcus pyogenes MGAS315
aaauggacaaucuuaaguua

SEQ ID NO: 4121233 - RNA, 21 nt, Streptococcus pyogenes MGAS315
aaauggacaaucuuaaguuag

SEQ ID NO: 4121234 - RNA, 17 nt, Streptococcus pyogenes MGAS315
aaauguaugauuuuaac

SEQ ID NO: 4121235 - RNA, 15 nt, Streptococcus pyogenes MGAS315
aaauuaagaaggaac

SEQ ID NO: 4121236 - RNA, 16 nt, Streptococcus pyogenes MGAS315
aaauuaauaaauuuuu

SEQ ID NO: 4121237 - RNA, 15 nt, Streptococcus pyogenes MGAS315
aaauuccuuaaauua

SEQ ID NO: 4121238 - RNA, 19 nt, Streptococcus pyogenes MGAS315
aaauuccuuaaauuauauu

SEQ ID NO: 4121239 - RNA, 14 nt, Streptococcus pyogenes MGAS315
aaauugauuauucu

SEQ ID NO: 4121240 - RNA, 12 nt, Streptococcus pyogenes MGAS315
aaauuuuaaaug

SEQ ID NO: 4121241 - RNA, 14 nt, Streptococcus pyogenes MGAS315
aacaaaaugaagca

SEQ ID NO: 4121242 - RNA, 14 nt, Streptococcus pyogenes MGAS315
aacaaauaauuccu

SEQ ID NO: 4121243 - RNA, 15 nt, Streptococcus pyogenes MGAS315
aacaaucuuaaaaua

SEQ ID NO: 4121244 - RNA, 19 nt, Streptococcus pyogenes MGAS315
aacaaucuuaaugguuacu

SEQ ID NO: 4121245 - RNA, 13 nt, Streptococcus pyogenes MGAS315
aacacucaucaua

SEQ ID NO: 4121246 - RNA, 22 nt, Streptococcus pyogenes MGAS315
aacagcugcuugaaaagaugca

SEQ ID NO: 4121247 - RNA, 12 nt, Streptococcus pyogenes MGAS315
aacaguuccagu

SEQ ID NO: 4121248 - RNA, 17 nt, Streptococcus pyogenes MGAS315
aacaguuccaguucugu

SEQ ID NO: 4121249 - RNA, 20 nt, Streptococcus pyogenes MGAS315
aacauauuauaguaaccauu

SEQ ID NO: 4121250 - RNA, 17 nt, Streptococcus pyogenes MGAS315
aacaucuugauuguaag

SEQ ID NO: 4121251 - RNA, 12 nt, Streptococcus pyogenes MGAS315
aaccaagugcca

SEQ ID NO: 4121252 - RNA, 20 nt, Streptococcus pyogenes MGAS315
aauacuagaaaaagcaauga

SEQ ID NO: 4121253 - RNA, 16 nt, Streptococcus pyogenes MGAS315
aauagaauaaaaaaga

SEQ ID NO: 4121254 - RNA, 17 nt, Streptococcus pyogenes MGAS315
aauagcaaugguuaaaa

SEQ ID NO: 4121255 - RNA, 21 nt, Streptococcus pyogenes MGAS315
aauagcaaugguuaaaaagag

SEQ ID NO: 4121256 - RNA, 22 nt, Streptococcus pyogenes MGAS315
aauagcauugucaaauaaaauc

SEQ ID NO: 4121257 - RNA, 16 nt, Streptococcus pyogenes MGAS315
aauagcugcugcuaaa

SEQ ID NO: 4121258 - RNA, 19 nt, Streptococcus pyogenes MGAS315
aauagcugcugcuaaagca

SEQ ID NO: 4121259 - RNA, 16 nt, Streptococcus pyogenes MGAS315
aauagguaaagauuuu

SEQ ID NO: 4121260 - RNA, 17 nt, Streptococcus pyogenes MGAS315
aauaguggcaaaugaca

SEQ ID NO: 4121261 - RNA, 14 nt, Streptococcus pyogenes MGAS315
aauauagucugcau

SEQ ID NO: 4121262 - RNA, 15 nt, Streptococcus pyogenes MGAS315
aauaucauauuuuaa

SEQ ID NO: 4121263 - RNA, 14 nt, Streptococcus pyogenes MGAS315
aauaucaugaagua

SEQ ID NO: 4121264 - RNA, 17 nt, Streptococcus pyogenes MGAS315
aauaucgccaauaaaaa

SEQ ID NO: 4121265 - RNA, 20 nt, Streptococcus pyogenes MGAS315
aauaucgccaauaaaaaaga

SEQ ID NO: 4121266 - RNA, 13 nt, Streptococcus pyogenes MGAS315
aauaucuuaccau

SEQ ID NO: 4121267 - RNA, 24 nt, Streptococcus pyogenes MGAS315
aauaugaaaacguguauucuuaaa

SEQ ID NO: 4121268 - RNA, 12 nt, Streptococcus pyogenes MGAS315
aauauuuccuuu

SEQ ID NO: 4121269 - RNA, 16 nt, Streptococcus pyogenes MGAS315
aauauuuccuuuuaaa

SEQ ID NO: 4121270 - RNA, 20 nt, Streptococcus pyogenes MGAS315
aauauuuccuuuuaaagaca

SEQ ID NO: 4121271 - RNA, 20 nt, Streptococcus pyogenes MGAS315
aaucaaaaagcuaacaccau

SEQ ID NO: 4121272 - RNA, 16 nt, Streptococcus pyogenes MGAS315
aaucaauaauggcaga

SEQ ID NO: 4121273 - RNA, 16 nt, Streptococcus pyogenes MGAS315
aaucagacucgucuuu

SEQ ID NO: 4121274 - RNA, 13 nt, Streptococcus pyogenes MGAS315
aaucgaaaugaua

SEQ ID NO: 4121275 - RNA, 18 nt, Streptococcus pyogenes MGAS315
aaucgcuuuaggaauauc

SEQ ID NO: 4121276 - RNA, 14 nt, Streptococcus pyogenes MGAS315
aaucuggcuuagca

SEQ ID NO: 4121277 - RNA, 17 nt, Streptococcus pyogenes MGAS315
aaucuuaaguuaggguc

SEQ ID NO: 4121278 - RNA, 20 nt, Streptococcus pyogenes MGAS315
aaucuucugcauuaucaucu

SEQ ID NO: 4121279 - RNA, 14 nt, Streptococcus pyogenes MGAS315
aaucuuguuuaacc

SEQ ID NO: 4121280 - RNA, 19 nt, Streptococcus pyogenes MGAS315
aaugacaucaaaggguguu

SEQ ID NO: 4121281 - RNA, 13 nt, Streptococcus pyogenes MGAS315
aaugagcaaggca

SEQ ID NO: 4121282 - RNA, 14 nt, Streptococcus pyogenes MGAS315
aaugauaaggcugc

SEQ ID NO: 4121283 - RNA, 14 nt, Streptococcus pyogenes MGAS315
aaugccaucaaaaa

SEQ ID NO: 4121284 - RNA, 17 nt, Streptococcus pyogenes MGAS315
aaugccaucaaaaaaag

SEQ ID NO: 4121285 - RNA, 14 nt, Streptococcus pyogenes MGAS315
aaugcgcucaagca

SEQ ID NO: 4121286 - RNA, 20 nt, Streptococcus pyogenes MGAS315
aaugcgcucaagcauuuugu

SEQ ID NO: 4121287 - RNA, 24 nt, Streptococcus pyogenes MGAS315
aaugcuguuugucauacucaauag

SEQ ID NO: 4121288 - RNA, 20 nt, Streptococcus pyogenes MGAS315
aauggaaauuuuaaaugaca

SEQ ID NO: 4121289 - RNA, 16 nt, Streptococcus pyogenes MGAS315
aauguaugauuuuaac

SEQ ID NO: 4121290 - RNA, 16 nt, Streptococcus pyogenes MGAS315
aaugucauacaaaaac

SEQ ID NO: 4121291 - RNA, 16 nt, Streptococcus pyogenes MGAS315
aauguucgaaaaaaua

SEQ ID NO: 4121292 - RNA, 21 nt, Streptococcus pyogenes MGAS315
aauguuuuuacauuuuuacaa

SEQ ID NO: 4121293 - RNA, 23 nt, Streptococcus pyogenes MGAS315
aauguuuuuacauuuuuacaaua

SEQ ID NO: 4121294 - RNA, 22 nt, Streptococcus pyogenes MGAS315
aauuauuaacguuaacaaaaau

SEQ ID NO: 4121295 - RNA, 14 nt, Streptococcus pyogenes MGAS315
aauuauuaguaacc

SEQ ID NO: 4121296 - RNA, 14 nt, Streptococcus pyogenes MGAS315
aauucagguuuuug

SEQ ID NO: 4121297 - RNA, 17 nt, Streptococcus pyogenes MGAS315
aauuccucccuauuuac

SEQ ID NO: 4121298 - RNA, 19 nt, Streptococcus pyogenes MGAS315
aauucuuuuauuaauguaa

SEQ ID NO: 4121299 - RNA, 20 nt, Streptococcus pyogenes MGAS315
aauucuuuuauuaauguaaa

SEQ ID NO: 4121300 - RNA, 12 nt, Streptococcus pyogenes MGAS315
aauugaaaaaau

SEQ ID NO: 4121301 - RNA, 23 nt, Streptococcus pyogenes MGAS315
aauuguagggauuuuuuuaacua

SEQ ID NO: 4121302 - RNA, 13 nt, Streptococcus pyogenes MGAS315
aauuguugaauaa

SEQ ID NO: 4121303 - RNA, 21 nt, Streptococcus pyogenes MGAS315
aauuuacgccguaagccgcaa

SEQ ID NO: 4121304 - RNA, 17 nt, Streptococcus pyogenes MGAS315
aauuucaauaauaccau

SEQ ID NO: 4121305 - RNA, 18 nt, Streptococcus pyogenes MGAS315
aauuucaauaauaccauu

SEQ ID NO: 4121306 - RNA, 17 nt, Streptococcus pyogenes MGAS315
aauuucagauaaaaccu

SEQ ID NO: 4121307 - RNA, 14 nt, Streptococcus pyogenes MGAS315
aauuuuaaaugaca

SEQ ID NO: 4121308 - RNA, 17 nt, Streptococcus pyogenes MGAS315
aauuuuaaaugacauga

SEQ ID NO: 4121309 - RNA, 21 nt, Streptococcus pyogenes MGAS315
aauuuuauugcaauucuuuua

SEQ ID NO: 4121310 - RNA, 15 nt, Streptococcus pyogenes MGAS315
aauuuucauuuuugg

SEQ ID NO: 4121311 - RNA, 13 nt, Streptococcus pyogenes MGAS315
aauuuuguugagu

SEQ ID NO: 4121312 - RNA, 14 nt, Streptococcus pyogenes MGAS315
aauuuuugccaaaa

SEQ ID NO: 4121313 - RNA, 19 nt, Streptococcus pyogenes MGAS315
acaaaaugaagcaaaauaa

SEQ ID NO: 4121314 - RNA, 20 nt, Streptococcus pyogenes MGAS315
acaaaguuucaagugcuaga

SEQ ID NO: 4121315 - RNA, 13 nt, Streptococcus pyogenes MGAS315
acaaauucuuuuu

SEQ ID NO: 4121316 - RNA, 13 nt, Streptococcus pyogenes MGAS315
acaaccuuaaaga

SEQ ID NO: 4121317 - RNA, 16 nt, Streptococcus pyogenes MGAS315
acaacgcuauuuuuaa

SEQ ID NO: 4121318 - RNA, 18 nt, Streptococcus pyogenes MGAS315
acaagagcuuaaaaguua

SEQ ID NO: 4121319 - RNA, 19 nt, Streptococcus pyogenes MGAS315
acaagcaucuuugcagggu

SEQ ID NO: 4121320 - RNA, 13 nt, Streptococcus pyogenes MGAS315
acaauaacacaga

SEQ ID NO: 4121321 - RNA, 21 nt, Streptococcus pyogenes MGAS315
acaaucgaaaugauagcaccu

SEQ ID NO: 4121322 - RNA, 14 nt, Streptococcus pyogenes MGAS315
acaaucuuaaaaua

SEQ ID NO: 4121323 - RNA, 20 nt, Streptococcus pyogenes MGAS315
acaaucuuaaguuagggucu

SEQ ID NO: 4121324 - RNA, 16 nt, Streptococcus pyogenes MGAS315
acaauuaaaaagcaaa

SEQ ID NO: 4121325 - RNA, 17 nt, Streptococcus pyogenes MGAS315
acaauuauuuugcaggu

SEQ ID NO: 4121326 - RNA, 15 nt, Streptococcus pyogenes MGAS315
acaauuggugauuaa

SEQ ID NO: 4121327 - RNA, 19 nt, Streptococcus pyogenes MGAS315
acacagauaagauacugcc

SEQ ID NO: 4121328 - RNA, 14 nt, Streptococcus pyogenes MGAS315
acaccaaaaaaagc

SEQ ID NO: 4121329 - RNA, 14 nt, Streptococcus pyogenes MGAS315
acagacaccaaaaa

SEQ ID NO: 4121330 - RNA, 18 nt, Streptococcus pyogenes MGAS315
acagacaucgucgugcca

SEQ ID NO: 4121331 - RNA, 11 nt, Streptococcus pyogenes MGAS315
acagagucuua

SEQ ID NO: 4121332 - RNA, 23 nt, Streptococcus pyogenes MGAS315
acagagucuuaguuuaggaauca

SEQ ID NO: 4121333 - RNA, 17 nt, Streptococcus pyogenes MGAS315
acagauagucaaaaaga

SEQ ID NO: 4121334 - RNA, 20 nt, Streptococcus pyogenes MGAS315
acagaugcucaaacuauauu

SEQ ID NO: 4121335 - RNA, 16 nt, Streptococcus pyogenes MGAS315
acaguauaaccgccau

SEQ ID NO: 4121336 - RNA, 14 nt, Streptococcus pyogenes MGAS315
acaguuaaaaauaa

SEQ ID NO: 4121337 - RNA, 21 nt, Streptococcus pyogenes MGAS315
acauacuuuauuaaucaaaaa

SEQ ID NO: 4121338 - RNA, 15 nt, Streptococcus pyogenes MGAS315
acaucaaaaaaagca

SEQ ID NO: 4121339 - RNA, 20 nt, Streptococcus pyogenes MGAS315
acaucaaaaaaagcaaugac

SEQ ID NO: 4121340 - RNA, 16 nt, Streptococcus pyogenes MGAS315
accaaaucaaaaagcu

SEQ ID NO: 4121341 - RNA, 18 nt, Streptococcus pyogenes MGAS315
accaaaucaaaaagcuaa

SEQ ID NO: 4121342 - RNA, 12 nt, Streptococcus pyogenes MGAS315
accaagauucau

SEQ ID NO: 4121343 - RNA, 19 nt, Streptococcus pyogenes MGAS315
accaagucguuuagcuuuu

SEQ ID NO: 4121344 - RNA, 15 nt, Streptococcus pyogenes MGAS315
accacaccuaauaaa

SEQ ID NO: 4121345 - RNA, 14 nt, Streptococcus pyogenes MGAS315
accagccacuacaa

SEQ ID NO: 4121346 - RNA, 15 nt, Streptococcus pyogenes MGAS315
accauuguagaguuu

SEQ ID NO: 4121347 - RNA, 16 nt, Streptococcus pyogenes MGAS315
acccgagcaacaaaag

SEQ ID NO: 4121348 - RNA, 17 nt, Streptococcus pyogenes MGAS315
accgcuaggauuuuucc

SEQ ID NO: 4121349 - RNA, 15 nt, Streptococcus pyogenes MGAS315
accgcucauuugaug

SEQ ID NO: 4121350 - RNA, 22 nt, Streptococcus pyogenes MGAS315
accguguucgauaaauucaggu

SEQ ID NO: 4121351 - RNA, 15 nt, Streptococcus pyogenes MGAS315
agagucauuugacua

SEQ ID NO: 4121352 - RNA, 21 nt, Streptococcus pyogenes MGAS315
agagucuuaguuuaggaauca

SEQ ID NO: 4121353 - RNA, 22 nt, Streptococcus pyogenes MGAS315
agauaaaaccuucaaaaaaggg

SEQ ID NO: 4121354 - RNA, 23 nt, Streptococcus pyogenes MGAS315
agauaaaaccuucaaaaaaggga

SEQ ID NO: 4121355 - RNA, 18 nt, Streptococcus pyogenes MGAS315
agauaagugccaucaggc

SEQ ID NO: 4121356 - RNA, 17 nt, Streptococcus pyogenes MGAS315
agauaccaaaucaaaaa

SEQ ID NO: 4121357 - RNA, 21 nt, Streptococcus pyogenes MGAS315
agauacuuugguauucuuuuu

SEQ ID NO: 4121358 - RNA, 23 nt, Streptococcus pyogenes MGAS315
agauacuuugguauucuuuuucc

SEQ ID NO: 4121359 - RNA, 17 nt, Streptococcus pyogenes MGAS315
agaucauuaaauugauu

SEQ ID NO: 4121360 - RNA, 14 nt, Streptococcus pyogenes MGAS315
agauccuacaagag

SEQ ID NO: 4121361 - RNA, 17 nt, Streptococcus pyogenes MGAS315
agauggggugucagggg

SEQ ID NO: 4121362 - RNA, 18 nt, Streptococcus pyogenes MGAS315
agcaaaaaagccagugcu

SEQ ID NO: 4121363 - RNA, 16 nt, Streptococcus pyogenes MGAS315
agcaaaaugcuguuug

SEQ ID NO: 4121364 - RNA, 22 nt, Streptococcus pyogenes MGAS315
agcaaauagcaaugguuaaaaa

SEQ ID NO: 4121365 - RNA, 13 nt, Streptococcus pyogenes MGAS315
agcaaauugaaaa

SEQ ID NO: 4121366 - RNA, 16 nt, Streptococcus pyogenes MGAS315
agcaaauugaaaaaau

SEQ ID NO: 4121367 - RNA, 17 nt, Streptococcus pyogenes MGAS315
agcaaggaugaaaugau

SEQ ID NO: 4121368 - RNA, 17 nt, Streptococcus pyogenes MGAS315
agcaagugagaacaugu

SEQ ID NO: 4121369 - RNA, 19 nt, Streptococcus pyogenes MGAS315
agcaagugagaacauguga

SEQ ID NO: 4121370 - RNA, 21 nt, Streptococcus pyogenes MGAS315
agcaagugugacuaguuuauu

SEQ ID NO: 4121371 - RNA, 23 nt, Streptococcus pyogenes MGAS315
agcaaugacuauagaaaguaaaa

SEQ ID NO: 4121372 - RNA, 18 nt, Streptococcus pyogenes MGAS315
agcaaugguuaaaaagag

SEQ ID NO: 4121373 - RNA, 15 nt, Streptococcus pyogenes MGAS315
agcacaaaagaggca

SEQ ID NO: 4121374 - RNA, 18 nt, Streptococcus pyogenes MGAS315
agcaccuacgauaaaaca

SEQ ID NO: 4121375 - RNA, 23 nt, Streptococcus pyogenes MGAS315
agcagacaaaagggaagagagaa

SEQ ID NO: 4121376 - RNA, 22 nt, Streptococcus pyogenes MGAS315
agcagcaccaguaaaggcagga

SEQ ID NO: 4121377 - RNA, 17 nt, Streptococcus pyogenes MGAS315
agcaguuauaauuagua

SEQ ID NO: 4121378 - RNA, 22 nt, Streptococcus pyogenes MGAS315
agcaucuacguacgcuguaaug

SEQ ID NO: 4121379 - RNA, 15 nt, Streptococcus pyogenes MGAS315
agcaucugaaaaaau

SEQ ID NO: 4121380 - RNA, 14 nt, Streptococcus pyogenes MGAS315
agccaaauccaccu

SEQ ID NO: 4121381 - RNA, 12 nt, Streptococcus pyogenes MGAS315
agccaauuacuu

SEQ ID NO: 4121382 - RNA, 23 nt, Streptococcus pyogenes MGAS315
agccagauggugcuacugaugua

SEQ ID NO: 4121383 - RNA, 13 nt, Streptococcus pyogenes MGAS315
agccagugcugcu

SEQ ID NO: 4121384 - RNA, 16 nt, Streptococcus pyogenes MGAS315
agccuauuuaauaggc

SEQ ID NO: 4121385 - RNA, 21 nt, Streptococcus pyogenes MGAS315
agcgcacuuuauuaugccaaa

SEQ ID NO: 4121386 - RNA, 23 nt, Streptococcus pyogenes MGAS315
agcgccagcaauuuucccaucaa

SEQ ID NO: 4121387 - RNA, 22 nt, Streptococcus pyogenes MGAS315
agcgccagcauuugccauggca

SEQ ID NO: 4121388 - RNA, 21 nt, Streptococcus pyogenes MGAS315
agcgggaacacucaucauauu

SEQ ID NO: 4121389 - RNA, 17 nt, Streptococcus pyogenes MGAS315
agcguuagcuuuuuaaa

SEQ ID NO: 4121390 - RNA, 18 nt, Streptococcus pyogenes MGAS315
agcguugacaguuaaaaa

SEQ ID NO: 4121391 - RNA, 17 nt, Streptococcus pyogenes MGAS315
agcuaaaagcauaaaaa

SEQ ID NO: 4121392 - RNA, 16 nt, Streptococcus pyogenes MGAS315
agcucugucagcaaua

SEQ ID NO: 4121393 - RNA, 13 nt, Streptococcus pyogenes MGAS315
agcugauuacuga

SEQ ID NO: 4121394 - RNA, 14 nt, Streptococcus pyogenes MGAS315
agcuggaguuuuuu

SEQ ID NO: 4121395 - RNA, 22 nt, Streptococcus pyogenes MGAS315
agcuuaaaaguuagccaagcaa

SEQ ID NO: 4121396 - RNA, 19 nt, Streptococcus pyogenes MGAS315
agcuuaaugucauacaaaa

SEQ ID NO: 4121397 - RNA, 22 nt, Streptococcus pyogenes MGAS315
agcuuauaauuugacuucaaaa

SEQ ID NO: 4121398 - RNA, 13 nt, Streptococcus pyogenes MGAS315
agcuuaucaaggu

SEQ ID NO: 4121399 - RNA, 14 nt, Streptococcus pyogenes MGAS315
agcuuaucaagguu

SEQ ID NO: 4121400 - RNA, 18 nt, Streptococcus pyogenes MGAS315
agcuugauuauaaucuau

SEQ ID NO: 4121401 - RNA, 23 nt, Streptococcus pyogenes MGAS315
agcuuuaccuccuaaugcugcaa

SEQ ID NO: 4121402 - RNA, 23 nt, Streptococcus pyogenes MGAS315
agcuuuuuuuguuuuggccaaua

SEQ ID NO: 4121403 - RNA, 16 nt, Streptococcus pyogenes MGAS315
aggaaggcuuguucuu

SEQ ID NO: 4121404 - RNA, 11 nt, Streptococcus pyogenes MGAS315
aggaauaaaau

SEQ ID NO: 4121405 - RNA, 19 nt, Streptococcus pyogenes MGAS315
aggaauaucaugaaguaua

SEQ ID NO: 4121406 - RNA, 13 nt, Streptococcus pyogenes MGAS315
aggauauggaaua

SEQ ID NO: 4121407 - RNA, 23 nt, Streptococcus pyogenes MGAS315
aggauauggaauagguaaagauu

SEQ ID NO: 4121408 - RNA, 16 nt, Streptococcus pyogenes MGAS315
aggaucauuauccuuu

SEQ ID NO: 4121409 - RNA, 15 nt, Streptococcus pyogenes MGAS315
aggcaaagaaagcca

SEQ ID NO: 4121410 - RNA, 21 nt, Streptococcus pyogenes MGAS315
aggcaaagaaagccaagacua

SEQ ID NO: 4121411 - RNA, 23 nt, Streptococcus pyogenes MGAS315
aggcaacuguggguuaagagagg

SEQ ID NO: 4121412 - RNA, 17 nt, Streptococcus pyogenes MGAS315
aggcaauccaaaucaac

SEQ ID NO: 4121413 - RNA, 19 nt, Streptococcus pyogenes MGAS315
aggcaggacgguuucccuu

SEQ ID NO: 4121414 - RNA, 15 nt, Streptococcus pyogenes MGAS315
aggcguauaggugag

SEQ ID NO: 4121415 - RNA, 13 nt, Streptococcus pyogenes MGAS315
aggcuaaagccua

SEQ ID NO: 4121416 - RNA, 13 nt, Streptococcus pyogenes MGAS315
aggcucauauuag

SEQ ID NO: 4121417 - RNA, 21 nt, Streptococcus pyogenes MGAS315
aggguaucugcucagagcuuu

SEQ ID NO: 4121418 - RNA, 19 nt, Streptococcus pyogenes MGAS315
aggguguuuuuuauauguc

SEQ ID NO: 4121419 - RNA, 20 nt, Streptococcus pyogenes MGAS315
agguaauagcguaaagcaag

SEQ ID NO: 4121420 - RNA, 22 nt, Streptococcus pyogenes MGAS315
aggucugcaauauccauagaaa

SEQ ID NO: 4121421 - RNA, 23 nt, Streptococcus pyogenes MGAS315
aggugaaaauaucuuuuuuacuu

SEQ ID NO: 4121422 - RNA, 23 nt, Streptococcus pyogenes MGAS315
aggugaguuuuuucuaaaagaga

SEQ ID NO: 4121423 - RNA, 15 nt, Streptococcus pyogenes MGAS315
agguuaaguaaaagc

SEQ ID NO: 4121424 - RNA, 16 nt, Streptococcus pyogenes MGAS315
agguuuguugaaaugu

SEQ ID NO: 4121425 - RNA, 22 nt, Streptococcus pyogenes MGAS315
aguaaaaauacuagaaaaagca

SEQ ID NO: 4121426 - RNA, 13 nt, Streptococcus pyogenes MGAS315
aguaaaacaauaa

SEQ ID NO: 4121427 - RNA, 16 nt, Streptococcus pyogenes MGAS315
aguaaaacaauaacac

SEQ ID NO: 4121428 - RNA, 16 nt, Streptococcus pyogenes MGAS315
aguaaaaucuuauuuu

SEQ ID NO: 4121429 - RNA, 18 nt, Streptococcus pyogenes MGAS315
aguaaagccuuauccauu

SEQ ID NO: 4121430 - RNA, 23 nt, Streptococcus pyogenes MGAS315
aguaagauggugcuuuaaaaagu

SEQ ID NO: 4121431 - RNA, 19 nt, Streptococcus pyogenes MGAS315
aguaaggaaaucaauccug

SEQ ID NO: 4121432 - RNA, 16 nt, Streptococcus pyogenes MGAS315
aguacaaggcaaucca

SEQ ID NO: 4121433 - RNA, 13 nt, Streptococcus pyogenes MGAS315
aguagauacuuug

SEQ ID NO: 4121434 - RNA, 20 nt, Streptococcus pyogenes MGAS315
aguagugaugaguaggcgaa

SEQ ID NO: 4121435 - RNA, 18 nt, Streptococcus pyogenes MGAS315
aguauauuguaauaacaa

SEQ ID NO: 4121436 - RNA, 20 nt, Streptococcus pyogenes MGAS315
aguauauuguaauaacaaaa

SEQ ID NO: 4121437 - RNA, 12 nt, Streptococcus pyogenes MGAS315
aguaugaacaaa

SEQ ID NO: 4121438 - RNA, 12 nt, Streptococcus pyogenes MGAS315
aguauuuuaaaa

SEQ ID NO: 4121439 - RNA, 20 nt, Streptococcus pyogenes MGAS315
agucaaaaagacuucuuccu

SEQ ID NO: 4121440 - RNA, 21 nt, Streptococcus pyogenes MGAS315
agucaaaccaguugauaccau

SEQ ID NO: 4121441 - RNA, 16 nt, Streptococcus pyogenes MGAS315
aguccaaacucaaacc

SEQ ID NO: 4121442 - RNA, 19 nt, Streptococcus pyogenes MGAS315
agucuaggcguauagguga

SEQ ID NO: 4121443 - RNA, 23 nt, Streptococcus pyogenes MGAS315
agucuaggcguauaggugaguuu

SEQ ID NO: 4121444 - RNA, 18 nt, Streptococcus pyogenes MGAS315
agucuuuaucguaaacaa

SEQ ID NO: 4121445 - RNA, 23 nt, Streptococcus pyogenes MGAS315
agucuuuggcaccaagugcugcc

SEQ ID NO: 4121446 - RNA, 17 nt, Streptococcus pyogenes MGAS315
agucuuuuuugugaucu

SEQ ID NO: 4121447 - RNA, 16 nt, Streptococcus pyogenes MGAS315
aguguagauaaacugg

SEQ ID NO: 4121448 - RNA, 23 nt, Streptococcus pyogenes MGAS315
aguguguugucaaacauaacaau

SEQ ID NO: 4121449 - RNA, 15 nt, Streptococcus pyogenes MGAS315
auaucauauuuuaau

SEQ ID NO: 4121450 - RNA, 20 nt, Streptococcus pyogenes MGAS315
auauccauagaaauuguaac

SEQ ID NO: 4121451 - RNA, 12 nt, Streptococcus pyogenes MGAS315
auaucuagaaca

SEQ ID NO: 4121452 - RNA, 18 nt, Streptococcus pyogenes MGAS315
auaucuagaacagcugcu

SEQ ID NO: 4121453 - RNA, 19 nt, Streptococcus pyogenes MGAS315
auaucuagaacagcugcuu

SEQ ID NO: 4121454 - RNA, 20 nt, Streptococcus pyogenes MGAS315
auaucuuucaguuguuuuaa

SEQ ID NO: 4121455 - RNA, 21 nt, Streptococcus pyogenes MGAS315
auaucuuuuuuacuuuuaaaa

SEQ ID NO: 4121456 - RNA, 12 nt, Streptococcus pyogenes MGAS315
auaugauauaaa

SEQ ID NO: 4121457 - RNA, 16 nt, Streptococcus pyogenes MGAS315
auaugaugaggugaua

SEQ ID NO: 4121458 - RNA, 14 nt, Streptococcus pyogenes MGAS315
auaugucaucaaaa

SEQ ID NO: 4121459 - RNA, 21 nt, Streptococcus pyogenes MGAS315
auauuaaccggcucuaaaaua

SEQ ID NO: 4121460 - RNA, 15 nt, Streptococcus pyogenes MGAS315
auauuagcaaaaugc

SEQ ID NO: 4121461 - RNA, 17 nt, Streptococcus pyogenes MGAS315
auauuagcaaaaugcug

SEQ ID NO: 4121462 - RNA, 13 nt, Streptococcus pyogenes MGAS315
auauugcucaaga

SEQ ID NO: 4121463 - RNA, 14 nt, Streptococcus pyogenes MGAS315
auauugcucaagac

SEQ ID NO: 4121464 - RNA, 14 nt, Streptococcus pyogenes MGAS315
auauuguuaauaua

SEQ ID NO: 4121465 - RNA, 14 nt, Streptococcus pyogenes MGAS315
auauuuuuuaggaa

SEQ ID NO: 4121466 - RNA, 18 nt, Streptococcus pyogenes MGAS315
aucaaaaaaagcaaugac

SEQ ID NO: 4121467 - RNA, 20 nt, Streptococcus pyogenes MGAS315
aucaaaaaaagcaaugacua

SEQ ID NO: 4121468 - RNA, 18 nt, Streptococcus pyogenes MGAS315
aucaaaagaccauaaaaa

SEQ ID NO: 4121469 - RNA, 19 nt, Streptococcus pyogenes MGAS315
aucaaaagaccauaaaaaa

SEQ ID NO: 4121470 - RNA, 18 nt, Streptococcus pyogenes MGAS315
aucaaaccaagguauuua

SEQ ID NO: 4121471 - RNA, 18 nt, Streptococcus pyogenes MGAS315
aucaacaaucuuaaaaua

SEQ ID NO: 4121472 - RNA, 17 nt, Streptococcus pyogenes MGAS315
aucaacucgacuccaau

SEQ ID NO: 4121473 - RNA, 19 nt, Streptococcus pyogenes MGAS315
aucaauaacagaaauuaau

SEQ ID NO: 4121474 - RNA, 15 nt, Streptococcus pyogenes MGAS315
aucaauaauggcaga

SEQ ID NO: 4121475 - RNA, 21 nt, Streptococcus pyogenes MGAS315
aucagcauaaccuuugccauu

SEQ ID NO: 4121476 - RNA, 14 nt, Streptococcus pyogenes MGAS315
aucaguagugauga

SEQ ID NO: 4121477 - RNA, 19 nt, Streptococcus pyogenes MGAS315
aucauaaguuuagaacuuu

SEQ ID NO: 4121478 - RNA, 22 nt, Streptococcus pyogenes MGAS315
aucauaaguuuagaacuuuuca

SEQ ID NO: 4121479 - RNA, 18 nt, Streptococcus pyogenes MGAS315
aucauauuguuaauaugu

SEQ ID NO: 4121480 - RNA, 21 nt, Streptococcus pyogenes MGAS315
aucaucaaguggauacaaggu

SEQ ID NO: 4121481 - RNA, 17 nt, Streptococcus pyogenes MGAS315
aucaucaggguugcaug

SEQ ID NO: 4121482 - RNA, 20 nt, Streptococcus pyogenes MGAS315
aucauuuugggacuaggaau

SEQ ID NO: 4121483 - RNA, 17 nt, Streptococcus pyogenes MGAS315
aucauuuuuaagacagu

SEQ ID NO: 4121484 - RNA, 18 nt, Streptococcus pyogenes MGAS315
auccccucauuuaaaugu

SEQ ID NO: 4121485 - RNA, 20 nt, Streptococcus pyogenes MGAS315
auccuuuaucuuauuuuaag

SEQ ID NO: 4121486 - RNA, 16 nt, Streptococcus pyogenes MGAS315
auccuuuugaaaaauu

SEQ ID NO: 4121487 - RNA, 22 nt, Streptococcus pyogenes MGAS315
aucgaaaugauagcaccuaauu

SEQ ID NO: 4121488 - RNA, 19 nt, Streptococcus pyogenes MGAS315
aucgacaacauccauacca

SEQ ID NO: 4121489 - RNA, 16 nt, Streptococcus pyogenes MGAS315
aucgccaauaaaaaag

SEQ ID NO: 4121490 - RNA, 22 nt, Streptococcus pyogenes MGAS315
aucguaaacaaucuuaaugguu

SEQ ID NO: 4121491 - RNA, 17 nt, Streptococcus pyogenes MGAS315
aucguaggguguuuuuu

SEQ ID NO: 4121492 - RNA, 13 nt, Streptococcus pyogenes MGAS315
aucguuuugcaau

SEQ ID NO: 4121493 - RNA, 16 nt, Streptococcus pyogenes MGAS315
aucuaaagcaucagca

SEQ ID NO: 4121494 - RNA, 21 nt, Streptococcus pyogenes MGAS315
aucuccaagaucugcacacac

SEQ ID NO: 4121495 - RNA, 16 nt, Streptococcus pyogenes MGAS315
aucucccgucaacaag

SEQ ID NO: 4121496 - RNA, 19 nt, Streptococcus pyogenes MGAS315
aucucguaauccuugauuu

SEQ ID NO: 4121497 - RNA, 15 nt, Streptococcus pyogenes MGAS315
aucucuugagaucuu

SEQ ID NO: 4121498 - RNA, 16 nt, Streptococcus pyogenes MGAS315
aucugcacaugcuuga

SEQ ID NO: 4121499 - RNA, 21 nt, Streptococcus pyogenes MGAS315
aucugcagauuuuaagacaac

SEQ ID NO: 4121500 - RNA, 14 nt, Streptococcus pyogenes MGAS315
aucuggucccacac

SEQ ID NO: 4121501 - RNA, 15 nt, Streptococcus pyogenes MGAS315
aucuguuuaaaaaca

SEQ ID NO: 4121502 - RNA, 16 nt, Streptococcus pyogenes MGAS315
aucuguuuaaaaacaa

SEQ ID NO: 4121503 - RNA, 18 nt, Streptococcus pyogenes MGAS315
aucuuaaaauaaucaacc

SEQ ID NO: 4121504 - RNA, 19 nt, Streptococcus pyogenes MGAS315
aucuucaauuuuugccaaa

SEQ ID NO: 4121505 - RNA, 18 nt, Streptococcus pyogenes MGAS315
aucuucacgggcugccau

SEQ ID NO: 4121506 - RNA, 20 nt, Streptococcus pyogenes MGAS315
aucuucacgggcugccauuu

SEQ ID NO: 4121507 - RNA, 14 nt, Streptococcus pyogenes MGAS315
aucuugugccuacu

SEQ ID NO: 4121508 - RNA, 14 nt, Streptococcus pyogenes MGAS315
aucuuugacaaugu

SEQ ID NO: 4121509 - RNA, 14 nt, Streptococcus pyogenes MGAS315
augaaaacguguau

SEQ ID NO: 4121510 - RNA, 17 nt, Streptococcus pyogenes MGAS315
augaccuuugauaagau

SEQ ID NO: 4121511 - RNA, 20 nt, Streptococcus pyogenes MGAS315
augaccuuugauaagauauu

SEQ ID NO: 4121512 - RNA, 22 nt, Streptococcus pyogenes MGAS315
augacgccuccaaauacuggua

SEQ ID NO: 4121513 - RNA, 18 nt, Streptococcus pyogenes MGAS315
augacuauagaaaguaaa

SEQ ID NO: 4121514 - RNA, 19 nt, Streptococcus pyogenes MGAS315
augacuauagaaaguaaaa

SEQ ID NO: 4121515 - RNA, 22 nt, Streptococcus pyogenes MGAS315
augacuauagaaaguaaaaaua

SEQ ID NO: 4121516 - RNA, 20 nt, Streptococcus pyogenes MGAS315
augagauuaacugacaaaaa

SEQ ID NO: 4121517 - RNA, 14 nt, Streptococcus pyogenes MGAS315
augagcaaggcaag

SEQ ID NO: 4121518 - RNA, 13 nt, Streptococcus pyogenes MGAS315
augauauaaaaau

SEQ ID NO: 4121519 - RNA, 14 nt, Streptococcus pyogenes MGAS315
augauauaaaaaug

SEQ ID NO: 4121520 - RNA, 21 nt, Streptococcus pyogenes MGAS315
augaucuguuuaaaaacaaau

SEQ ID NO: 4121521 - RNA, 17 nt, Streptococcus pyogenes MGAS315
augauuuaguuuuuaaa

SEQ ID NO: 4121522 - RNA, 15 nt, Streptococcus pyogenes MGAS315
augauuugucaaaaa

SEQ ID NO: 4121523 - RNA, 21 nt, Streptococcus pyogenes MGAS315
augauuugucaaaaaguaaaa

SEQ ID NO: 4121524 - RNA, 23 nt, Streptococcus pyogenes MGAS315
augauuugucaaaaaguaaaaag

SEQ ID NO: 4121525 - RNA, 16 nt, Streptococcus pyogenes MGAS315
augauuuuaacguuuu

SEQ ID NO: 4121526 - RNA, 15 nt, Streptococcus pyogenes MGAS315
augcacacaaaucuu

SEQ ID NO: 4121527 - RNA, 15 nt, Streptococcus pyogenes MGAS315
augcucucauaaaca

SEQ ID NO: 4121528 - RNA, 15 nt, Streptococcus pyogenes MGAS315
augcugaguucuuuu

SEQ ID NO: 4121529 - RNA, 14 nt, Streptococcus pyogenes MGAS315
augcugcaaaauuu

SEQ ID NO: 4121530 - RNA, 16 nt, Streptococcus pyogenes MGAS315
augcugcaaaauuuua

SEQ ID NO: 4121531 - RNA, 19 nt, Streptococcus pyogenes MGAS315
augcuugaguagcuacugc

SEQ ID NO: 4121532 - RNA, 16 nt, Streptococcus pyogenes MGAS315
augcuuuuuaaucugu

SEQ ID NO: 4121533 - RNA, 20 nt, Streptococcus pyogenes MGAS315
auggaaauuuuaaaugacau

SEQ ID NO: 4121534 - RNA, 21 nt, Streptococcus pyogenes MGAS315
auggauauaacaacucccucc

SEQ ID NO: 4121535 - RNA, 22 nt, Streptococcus pyogenes MGAS315
auggaugcuccuccaccaaaac

SEQ ID NO: 4121536 - RNA, 15 nt, Streptococcus pyogenes MGAS315
auggcuuuccauucu

SEQ ID NO: 4121537 - RNA, 16 nt, Streptococcus pyogenes MGAS315
auggguaaaaugacug

SEQ ID NO: 4121538 - RNA, 14 nt, Streptococcus pyogenes MGAS315
auggucacuccuuc

SEQ ID NO: 4121539 - RNA, 17 nt, Streptococcus pyogenes MGAS315
augguuaaaaagagagc

SEQ ID NO: 4121540 - RNA, 23 nt, Streptococcus pyogenes MGAS315
auguaccaauuuaagguauuguu

SEQ ID NO: 4121541 - RNA, 20 nt, Streptococcus pyogenes MGAS315
auguuaggagcacaaaagag

SEQ ID NO: 4121542 - RNA, 16 nt, Streptococcus pyogenes MGAS315
auguuauuaaauaaua

SEQ ID NO: 4121543 - RNA, 13 nt, Streptococcus pyogenes MGAS315
auguuggauuuuu

SEQ ID NO: 4121544 - RNA, 17 nt, Streptococcus pyogenes MGAS315
auuaaacuuacaaaaag

SEQ ID NO: 4121545 - RNA, 16 nt, Streptococcus pyogenes MGAS315
auuaaccguuccuguc

SEQ ID NO: 4121546 - RNA, 18 nt, Streptococcus pyogenes MGAS315
auuaacguuaacaaaaau

SEQ ID NO: 4121547 - RNA, 21 nt, Streptococcus pyogenes MGAS315
auuaagaaggaacucuccaaa

SEQ ID NO: 4121548 - RNA, 21 nt, Streptococcus pyogenes MGAS315
caacgcauuucuuuuuugguc

SEQ ID NO: 4121549 - RNA, 17 nt, Streptococcus pyogenes MGAS315
caacgugcuauaagagg

SEQ ID NO: 4121550 - RNA, 13 nt, Streptococcus pyogenes MGAS315
caacucccuccua

SEQ ID NO: 4121551 - RNA, 16 nt, Streptococcus pyogenes MGAS315
caacucgauaaaaacg

SEQ ID NO: 4121552 - RNA, 15 nt, Streptococcus pyogenes MGAS315
caacugcuaguugug

SEQ ID NO: 4121553 - RNA, 14 nt, Streptococcus pyogenes MGAS315
caacuggcacaaac

SEQ ID NO: 4121554 - RNA, 20 nt, Streptococcus pyogenes MGAS315
caacuuguuaacaauaagua

SEQ ID NO: 4121555 - RNA, 16 nt, Streptococcus pyogenes MGAS315
caagaacuccuggauu

SEQ ID NO: 4121556 - RNA, 19 nt, Streptococcus pyogenes MGAS315
caagacuaaagcauuuauu

SEQ ID NO: 4121557 - RNA, 16 nt, Streptococcus pyogenes MGAS315
caagacuaggauugcc

SEQ ID NO: 4121558 - RNA, 13 nt, Streptococcus pyogenes MGAS315
caagagcuuaaaa

SEQ ID NO: 4121559 - RNA, 15 nt, Streptococcus pyogenes MGAS315
caagagcuuaaaagu

SEQ ID NO: 4121560 - RNA, 23 nt, Streptococcus pyogenes MGAS315
caagaggaggcaacuguggguua

SEQ ID NO: 4121561 - RNA, 17 nt, Streptococcus pyogenes MGAS315
caagagucauuugacua

SEQ ID NO: 4121562 - RNA, 17 nt, Streptococcus pyogenes MGAS315
caagaucugcacacacu

SEQ ID NO: 4121563 - RNA, 23 nt, Streptococcus pyogenes MGAS315
caagcauuuugcaagucucuugc

SEQ ID NO: 4121564 - RNA, 14 nt, Streptococcus pyogenes MGAS315
caaggcaagaggag

SEQ ID NO: 4121565 - RNA, 15 nt, Streptococcus pyogenes MGAS315
caaggcuaaagccua

SEQ ID NO: 4121566 - RNA, 19 nt, Streptococcus pyogenes MGAS315
caagguuaaguaaaagcga

SEQ ID NO: 4121567 - RNA, 18 nt, Streptococcus pyogenes MGAS315
caagugccaguaaggaaa

SEQ ID NO: 4121568 - RNA, 19 nt, Streptococcus pyogenes MGAS315
caagugcuagauguuggaa

SEQ ID NO: 4121569 - RNA, 14 nt, Streptococcus pyogenes MGAS315
caagugcugccauu

SEQ ID NO: 4121570 - RNA, 16 nt, Streptococcus pyogenes MGAS315
caaguggauacaaggu

SEQ ID NO: 4121571 - RNA, 23 nt, Streptococcus pyogenes MGAS315
caauaaaauaucuagaacagcug

SEQ ID NO: 4121572 - RNA, 17 nt, Streptococcus pyogenes MGAS315
caauaacagaaauuaau

SEQ ID NO: 4121573 - RNA, 19 nt, Streptococcus pyogenes MGAS315
caauaaugccaucaaaaaa

SEQ ID NO: 4121574 - RNA, 20 nt, Streptococcus pyogenes MGAS315
caauaaugccaucaaaaaaa

SEQ ID NO: 4121575 - RNA, 22 nt, Streptococcus pyogenes MGAS315
caauacaaaaaaccuuccugua

SEQ ID NO: 4121576 - RNA, 16 nt, Streptococcus pyogenes MGAS315
caauacucccuucucu

SEQ ID NO: 4121577 - RNA, 19 nt, Streptococcus pyogenes MGAS315
caauacucccuucucuagu

SEQ ID NO: 4121578 - RNA, 23 nt, Streptococcus pyogenes MGAS315
caauagcaaguccugcuuuugau

SEQ ID NO: 4121579 - RNA, 15 nt, Streptococcus pyogenes MGAS315
caauagcugcugcua

SEQ ID NO: 4121580 - RNA, 12 nt, Streptococcus pyogenes MGAS315
caauauccauag

SEQ ID NO: 4121581 - RNA, 15 nt, Streptococcus pyogenes MGAS315
caauauccauagaaa

SEQ ID NO: 4121582 - RNA, 16 nt, Streptococcus pyogenes MGAS315
caaucaucaggguugc

SEQ ID NO: 4121583 - RNA, 22 nt, Streptococcus pyogenes MGAS315
caaucaucauuuagcugauaau

SEQ ID NO: 4121584 - RNA, 13 nt, Streptococcus pyogenes MGAS315
caaucauuuuuaa

SEQ ID NO: 4121585 - RNA, 13 nt, Streptococcus pyogenes MGAS315
caaucgaaaugau

SEQ ID NO: 4121586 - RNA, 17 nt, Streptococcus pyogenes MGAS315
caaucgaaaugauagca

SEQ ID NO: 4121587 - RNA, 20 nt, Streptococcus pyogenes MGAS315
caaucgaaaugauagcaccu

SEQ ID NO: 4121588 - RNA, 14 nt, Streptococcus pyogenes MGAS315
caaugcgcucaagc

SEQ ID NO: 4121589 - RNA, 16 nt, Streptococcus pyogenes MGAS315
caauuaaaaagcaaaa

SEQ ID NO: 4121590 - RNA, 22 nt, Streptococcus pyogenes MGAS315
caauuaaaaagcaaaaaagcca

SEQ ID NO: 4121591 - RNA, 23 nt, Streptococcus pyogenes MGAS315
caauuaauguuaggagcacaaaa

SEQ ID NO: 4121592 - RNA, 17 nt, Streptococcus pyogenes MGAS315
caauuuucauuuuugga

SEQ ID NO: 4121593 - RNA, 11 nt, Streptococcus pyogenes MGAS315
cacagcaauuu

SEQ ID NO: 4121594 - RNA, 21 nt, Streptococcus pyogenes MGAS315
cacagcaauuuguuccaucug

SEQ ID NO: 4121595 - RNA, 21 nt, Streptococcus pyogenes MGAS315
cacauacuggucaauggaaau

SEQ ID NO: 4121596 - RNA, 14 nt, Streptococcus pyogenes MGAS315
caccaaaaaaagca

SEQ ID NO: 4121597 - RNA, 21 nt, Streptococcus pyogenes MGAS315
caccaaaaucauagacaggag

SEQ ID NO: 4121598 - RNA, 22 nt, Streptococcus pyogenes MGAS315
caccaauaaugagcaaggcaag

SEQ ID NO: 4121599 - RNA, 13 nt, Streptococcus pyogenes MGAS315
caccaccaauaau

SEQ ID NO: 4121600 - RNA, 15 nt, Streptococcus pyogenes MGAS315
caccagccacuacaa

SEQ ID NO: 4121601 - RNA, 23 nt, Streptococcus pyogenes MGAS315
caccuacgauaaaacaaauaauu

SEQ ID NO: 4121602 - RNA, 21 nt, Streptococcus pyogenes MGAS315
caccuuaggcagacaauuauu

SEQ ID NO: 4121603 - RNA, 14 nt, Streptococcus pyogenes MGAS315
cacuaccuuaaaug

SEQ ID NO: 4121604 - RNA, 15 nt, Streptococcus pyogenes MGAS315
cacuauuuugugacu

SEQ ID NO: 4121605 - RNA, 19 nt, Streptococcus pyogenes MGAS315
cacugcagcaucaaaacca

SEQ ID NO: 4121606 - RNA, 17 nt, Streptococcus pyogenes MGAS315
cacuuccaucaucaagu

SEQ ID NO: 4121607 - RNA, 12 nt, Streptococcus pyogenes MGAS315
cagaaauaaucu

SEQ ID NO: 4121608 - RNA, 21 nt, Streptococcus pyogenes MGAS315
cagaaauuaauaaauuuuugu

SEQ ID NO: 4121609 - RNA, 19 nt, Streptococcus pyogenes MGAS315
cagagacaauaaggucauu

SEQ ID NO: 4121610 - RNA, 15 nt, Streptococcus pyogenes MGAS315
cagaguacaaggcaa

SEQ ID NO: 4121611 - RNA, 17 nt, Streptococcus pyogenes MGAS315
cagauaaaaccuucaaa

SEQ ID NO: 4121612 - RNA, 20 nt, Streptococcus pyogenes MGAS315
cagauaaaaccuucaaaaaa

SEQ ID NO: 4121613 - RNA, 23 nt, Streptococcus pyogenes MGAS315
cagauacuucugauaaaaauaaa

SEQ ID NO: 4121614 - RNA, 16 nt, Streptococcus pyogenes MGAS315
cagcaucaaaaccaag

SEQ ID NO: 4121615 - RNA, 23 nt, Streptococcus pyogenes MGAS315
cagcuucuacgggauuuaguucu

SEQ ID NO: 4121616 - RNA, 13 nt, Streptococcus pyogenes MGAS315
cagguugcaacaa

SEQ ID NO: 4121617 - RNA, 23 nt, Streptococcus pyogenes MGAS315
cagguuuuugguuaucaguauac

SEQ ID NO: 4121618 - RNA, 16 nt, Streptococcus pyogenes MGAS315
caguaaggaaaucaau

SEQ ID NO: 4121619 - RNA, 20 nt, Streptococcus pyogenes MGAS315
caguauguaaauauaaaguc

SEQ ID NO: 4121620 - RNA, 15 nt, Streptococcus pyogenes MGAS315
caguccaucaaucgu

SEQ ID NO: 4121621 - RNA, 14 nt, Streptococcus pyogenes MGAS315
caguuaaaaauaac

SEQ ID NO: 4121622 - RNA, 19 nt, Streptococcus pyogenes MGAS315
caguuaaaaauaacuuuaa

SEQ ID NO: 4121623 - RNA, 20 nt, Streptococcus pyogenes MGAS315
caguuaaugccaacuuuuca

SEQ ID NO: 4121624 - RNA, 21 nt, Streptococcus pyogenes MGAS315
caguucuguuucuaagcaaau

SEQ ID NO: 4121625 - RNA, 16 nt, Streptococcus pyogenes MGAS315
caguugauaccaugug

SEQ ID NO: 4121626 - RNA, 18 nt, Streptococcus pyogenes MGAS315
caguugcuugcuuuuuuc

SEQ ID NO: 4121627 - RNA, 12 nt, Streptococcus pyogenes MGAS315
caguuuuuucug

SEQ ID NO: 4121628 - RNA, 18 nt, Streptococcus pyogenes MGAS315
cauaaaagauauuuuaaa

SEQ ID NO: 4121629 - RNA, 21 nt, Streptococcus pyogenes MGAS315
cauaaauaaagauaauuuauu

SEQ ID NO: 4121630 - RNA, 16 nt, Streptococcus pyogenes MGAS315
cauaaccuuugccauu

SEQ ID NO: 4121631 - RNA, 12 nt, Streptococcus pyogenes MGAS315
cauacaaaaaca

SEQ ID NO: 4121632 - RNA, 20 nt, Streptococcus pyogenes MGAS315
cauacaacuggcuagccaaa

SEQ ID NO: 4121633 - RNA, 21 nt, Streptococcus pyogenes MGAS315
cauacaacuggcuagccaaau

SEQ ID NO: 4121634 - RNA, 22 nt, Streptococcus pyogenes MGAS315
cauacccgcguuaucuccacag

SEQ ID NO: 4121635 - RNA, 21 nt, Streptococcus pyogenes MGAS315
cauacuuuauuaaucaaaaaa

SEQ ID NO: 4121636 - RNA, 15 nt, Streptococcus pyogenes MGAS315
cauagaagccaauua

SEQ ID NO: 4121637 - RNA, 21 nt, Streptococcus pyogenes MGAS315
cauagacaagcuuuuuuauaa

SEQ ID NO: 4121638 - RNA, 19 nt, Streptococcus pyogenes MGAS315
cauauuagcaaaaugcugu

SEQ ID NO: 4121639 - RNA, 15 nt, Streptococcus pyogenes MGAS315
caucaaaaaaagcaa

SEQ ID NO: 4121640 - RNA, 17 nt, Streptococcus pyogenes MGAS315
caucaaaaaaagcaaug

SEQ ID NO: 4121641 - RNA, 14 nt, Streptococcus pyogenes MGAS315
caucaaaaccaagu

SEQ ID NO: 4121642 - RNA, 20 nt, Streptococcus pyogenes MGAS315
caucaaaagaccauaaaaaa

SEQ ID NO: 4121643 - RNA, 19 nt, Streptococcus pyogenes MGAS315
caucaaaggguguuuuuua

SEQ ID NO: 4121644 - RNA, 18 nt, Streptococcus pyogenes MGAS315
caucaauuuucauuuuug

SEQ ID NO: 4121645 - RNA, 13 nt, Streptococcus pyogenes MGAS315
caucauauuguua

SEQ ID NO: 4121646 - RNA, 16 nt, Streptococcus pyogenes MGAS315
cguuuguacucgugaa

SEQ ID NO: 4121647 - RNA, 21 nt, Streptococcus pyogenes MGAS315
cguuuguacucgugaauaauu

SEQ ID NO: 4121648 - RNA, 21 nt, Streptococcus pyogenes MGAS315
cguuuuacggcuucuacacaa

SEQ ID NO: 4121649 - RNA, 13 nt, Streptococcus pyogenes MGAS315
cguuuuuuuagcg

SEQ ID NO: 4121650 - RNA, 12 nt, Streptococcus pyogenes MGAS315
cuaaaaaauaac

SEQ ID NO: 4121651 - RNA, 16 nt, Streptococcus pyogenes MGAS315
cuaaaagcauaaaaau

SEQ ID NO: 4121652 - RNA, 18 nt, Streptococcus pyogenes MGAS315
cuaaaagcauaaaaauau

SEQ ID NO: 4121653 - RNA, 15 nt, Streptococcus pyogenes MGAS315
cuaaaauauauuggu

SEQ ID NO: 4121654 - RNA, 21 nt, Streptococcus pyogenes MGAS315
cuaaagcaucagcauaaccuu

SEQ ID NO: 4121655 - RNA, 23 nt, Streptococcus pyogenes MGAS315
cuaaauccuuuugaaaaauuaug

SEQ ID NO: 4121656 - RNA, 20 nt, Streptococcus pyogenes MGAS315
cuaaaugucuagcuuaucuu

SEQ ID NO: 4121657 - RNA, 12 nt, Streptococcus pyogenes MGAS315
cuaacaacaaca

SEQ ID NO: 4121658 - RNA, 21 nt, Streptococcus pyogenes MGAS315
cuaacaacaacaacccuugau

SEQ ID NO: 4121659 - RNA, 15 nt, Streptococcus pyogenes MGAS315
cuaaccugcauaucu

SEQ ID NO: 4121660 - RNA, 23 nt, Streptococcus pyogenes MGAS315
cuaacguuuggggugcaguucau

SEQ ID NO: 4121661 - RNA, 21 nt, Streptococcus pyogenes MGAS315
cuaagaugguuuugauuaaau

SEQ ID NO: 4121662 - RNA, 23 nt, Streptococcus pyogenes MGAS315
cuaagcuauagaaacuuuuuaua

SEQ ID NO: 4121663 - RNA, 22 nt, Streptococcus pyogenes MGAS315
cuaagguacggucauuaauaaa

SEQ ID NO: 4121664 - RNA, 17 nt, Streptococcus pyogenes MGAS315
cuaaguagauacuuugg

SEQ ID NO: 4121665 - RNA, 11 nt, Streptococcus pyogenes MGAS315
cuaauaaaaua

SEQ ID NO: 4121666 - RNA, 18 nt, Streptococcus pyogenes MGAS315
cuaauaaaauagcaccua

SEQ ID NO: 4121667 - RNA, 12 nt, Streptococcus pyogenes MGAS315
cuaauaagauuc

SEQ ID NO: 4121668 - RNA, 22 nt, Streptococcus pyogenes MGAS315
cuaaugcugcaaaauuuuaaau

SEQ ID NO: 4121669 - RNA, 16 nt, Streptococcus pyogenes MGAS315
cuaauugugagaaacu

SEQ ID NO: 4121670 - RNA, 14 nt, Streptococcus pyogenes MGAS315
cuacacaaaagcuu

SEQ ID NO: 4121671 - RNA, 23 nt, Streptococcus pyogenes MGAS315
cuacagcuugauuauaaucuaug

SEQ ID NO: 4121672 - RNA, 23 nt, Streptococcus pyogenes MGAS315
cuacugcuggauuuagaaauuuu

SEQ ID NO: 4121673 - RNA, 14 nt, Streptococcus pyogenes MGAS315
cuagaaaaagcaau

SEQ ID NO: 4121674 - RNA, 20 nt, Streptococcus pyogenes MGAS315
cuagaacucuuauaauaaau

SEQ ID NO: 4121675 - RNA, 16 nt, Streptococcus pyogenes MGAS315
cuagacugugaaagua

SEQ ID NO: 4121676 - RNA, 13 nt, Streptococcus pyogenes MGAS315
cuagccaaaucug

SEQ ID NO: 4121677 - RNA, 14 nt, Streptococcus pyogenes MGAS315
cuagcuuaucuuca

SEQ ID NO: 4121678 - RNA, 16 nt, Streptococcus pyogenes MGAS315
cuagcuuaucuucaua

SEQ ID NO: 4121679 - RNA, 17 nt, Streptococcus pyogenes MGAS315
cuagguuaaaauagaag

SEQ ID NO: 4121680 - RNA, 22 nt, Streptococcus pyogenes MGAS315
cuagucgaaauugguccucuga

SEQ ID NO: 4121681 - RNA, 15 nt, Streptococcus pyogenes MGAS315
cuagucuuuuuugug

SEQ ID NO: 4121682 - RNA, 15 nt, Streptococcus pyogenes MGAS315
cuauaauuucaauaa

SEQ ID NO: 4121683 - RNA, 14 nt, Streptococcus pyogenes MGAS315
cuauaccuaaaaaa

SEQ ID NO: 4121684 - RNA, 15 nt, Streptococcus pyogenes MGAS315
cuauaccuaaaaaau

SEQ ID NO: 4121685 - RNA, 16 nt, Streptococcus pyogenes MGAS315
cuauagaaaguaaaaa

SEQ ID NO: 4121686 - RNA, 13 nt, Streptococcus pyogenes MGAS315
cuaucagauacua

SEQ ID NO: 4121687 - RNA, 16 nt, Streptococcus pyogenes MGAS315
cuaugaucuguuuaaa

SEQ ID NO: 4121688 - RNA, 20 nt, Streptococcus pyogenes MGAS315
cuaugaucuguuuaaaaaca

SEQ ID NO: 4121689 - RNA, 16 nt, Streptococcus pyogenes MGAS315
cuauuaccuauagaaa

SEQ ID NO: 4121690 - RNA, 18 nt, Streptococcus pyogenes MGAS315
cuauugaaucuuguuuaa

SEQ ID NO: 4121691 - RNA, 15 nt, Streptococcus pyogenes MGAS315
cuauuguauuugaug

SEQ ID NO: 4121692 - RNA, 17 nt, Streptococcus pyogenes MGAS315
cuauuguauuugauggg

SEQ ID NO: 4121693 - RNA, 12 nt, Streptococcus pyogenes MGAS315
cucaaaaaauac

SEQ ID NO: 4121694 - RNA, 20 nt, Streptococcus pyogenes MGAS315
cucaaaaauauauucuaauu

SEQ ID NO: 4121695 - RNA, 17 nt, Streptococcus pyogenes MGAS315
cucaaagggauugcaaa

SEQ ID NO: 4121696 - RNA, 14 nt, Streptococcus pyogenes MGAS315
cucaauagcugcug

SEQ ID NO: 4121697 - RNA, 16 nt, Streptococcus pyogenes MGAS315
cucacaaauacagaaa

SEQ ID NO: 4121698 - RNA, 13 nt, Streptococcus pyogenes MGAS315
cucaguaaucuaa

SEQ ID NO: 4121699 - RNA, 20 nt, Streptococcus pyogenes MGAS315
cucauuuaaauguucgaaaa

SEQ ID NO: 4121700 - RNA, 16 nt, Streptococcus pyogenes MGAS315
cuccaaaguucuucua

SEQ ID NO: 4121701 - RNA, 21 nt, Streptococcus pyogenes MGAS315
cucccgcuuuuaagcugagua

SEQ ID NO: 4121702 - RNA, 22 nt, Streptococcus pyogenes MGAS315
cuccuaaggaguaguugcuggu

SEQ ID NO: 4121703 - RNA, 22 nt, Streptococcus pyogenes MGAS315
cuccuaaugcugcaaaauuuua

SEQ ID NO: 4121704 - RNA, 20 nt, Streptococcus pyogenes MGAS315
cuccuugcaauagagccaag

SEQ ID NO: 4121705 - RNA, 19 nt, Streptococcus pyogenes MGAS315
cucuaacaccaaaaucaua

SEQ ID NO: 4121706 - RNA, 21 nt, Streptococcus pyogenes MGAS315
cucuaacauguccaaaucgua

SEQ ID NO: 4121707 - RNA, 22 nt, Streptococcus pyogenes MGAS315
cucuacgcauccguauuuuuua

SEQ ID NO: 4121708 - RNA, 20 nt, Streptococcus pyogenes MGAS315
cucucauaaacaaugaguca

SEQ ID NO: 4121709 - RNA, 13 nt, Streptococcus pyogenes MGAS315
cucucguuuuuuu

SEQ ID NO: 4121710 - RNA, 20 nt, Streptococcus pyogenes MGAS315
cugaaaauaaaauauuuuuc

SEQ ID NO: 4121711 - RNA, 22 nt, Streptococcus pyogenes MGAS315
cugaacugcucuggcuuuuucc

SEQ ID NO: 4121712 - RNA, 22 nt, Streptococcus pyogenes MGAS315
cugacgauaagucaguuuuuuc

SEQ ID NO: 4121713 - RNA, 12 nt, Streptococcus pyogenes MGAS315
cugacuuaaauu

SEQ ID NO: 4121714 - RNA, 20 nt, Streptococcus pyogenes MGAS315
cugagcuaaagccaacccca

SEQ ID NO: 4121715 - RNA, 15 nt, Streptococcus pyogenes MGAS315
cugaguucuuuuucg

SEQ ID NO: 4121716 - RNA, 19 nt, Streptococcus pyogenes MGAS315
cugauaagguuuuuuuaag

SEQ ID NO: 4121717 - RNA, 16 nt, Streptococcus pyogenes MGAS315
cugaucccuucauuuu

SEQ ID NO: 4121718 - RNA, 18 nt, Streptococcus pyogenes MGAS315
cugaucccuucauuuuac

SEQ ID NO: 4121719 - RNA, 16 nt, Streptococcus pyogenes MGAS315
cugaugacuuguaaaa

SEQ ID NO: 4121720 - RNA, 14 nt, Streptococcus pyogenes MGAS315
cugauuacugaaau

SEQ ID NO: 4121721 - RNA, 15 nt, Streptococcus pyogenes MGAS315
cugcaauauccauag

SEQ ID NO: 4121722 - RNA, 18 nt, Streptococcus pyogenes MGAS315
cugcaauauccauagaaa

SEQ ID NO: 4121723 - RNA, 17 nt, Streptococcus pyogenes MGAS315
cugcaguagcaugacug

SEQ ID NO: 4121724 - RNA, 20 nt, Streptococcus pyogenes MGAS315
cugcuagucggguaagggug

SEQ ID NO: 4121725 - RNA, 21 nt, Streptococcus pyogenes MGAS315
cugcuggauuuagaaauuuua

SEQ ID NO: 4121726 - RNA, 15 nt, Streptococcus pyogenes MGAS315
cugcuguuggauaca

SEQ ID NO: 4121727 - RNA, 18 nt, Streptococcus pyogenes MGAS315
cuggauuuagaaauuuua

SEQ ID NO: 4121728 - RNA, 17 nt, Streptococcus pyogenes MGAS315
cuggcuuagcagcacca

SEQ ID NO: 4121729 - RNA, 12 nt, Streptococcus pyogenes MGAS315
cuggcuuuuucc

SEQ ID NO: 4121730 - RNA, 21 nt, Streptococcus pyogenes MGAS315
cugguacguugauugccauuu

SEQ ID NO: 4121731 - RNA, 17 nt, Streptococcus pyogenes MGAS315
cuguaauguuguaaacu

SEQ ID NO: 4121732 - RNA, 13 nt, Streptococcus pyogenes MGAS315
cuguauaaacuug

SEQ ID NO: 4121733 - RNA, 14 nt, Streptococcus pyogenes MGAS315
cuguauauuuaaua

SEQ ID NO: 4121734 - RNA, 19 nt, Streptococcus pyogenes MGAS315
cugucaaaaaauuaagaag

SEQ ID NO: 4121735 - RNA, 18 nt, Streptococcus pyogenes MGAS315
cuguucagucuucuguaa

SEQ ID NO: 4121736 - RNA, 22 nt, Streptococcus pyogenes MGAS315
cuguucucuuuggagaaauuca

SEQ ID NO: 4121737 - RNA, 16 nt, Streptococcus pyogenes MGAS315
cuguuugccguguucu

SEQ ID NO: 4121738 - RNA, 22 nt, Streptococcus pyogenes MGAS315
cuuaauaaacucuauacaaaaa

SEQ ID NO: 4121739 - RNA, 19 nt, Streptococcus pyogenes MGAS315
cuuaaugucauacaaaaac

SEQ ID NO: 4121740 - RNA, 15 nt, Streptococcus pyogenes MGAS315
cuuaauuuauauuuu

SEQ ID NO: 4121741 - RNA, 19 nt, Streptococcus pyogenes MGAS315
cuuacaaaaagccuauuua

SEQ ID NO: 4121742 - RNA, 15 nt, Streptococcus pyogenes MGAS315
cuuacuaacuagcaa

SEQ ID NO: 4121743 - RNA, 22 nt, Streptococcus pyogenes MGAS315
cuuagcgauagggguaauuugg

SEQ ID NO: 4121744 - RNA, 21 nt, Streptococcus pyogenes MGAS315
gacuugguucugaaaauaaaa

SEQ ID NO: 4121745 - RNA, 23 nt, Streptococcus pyogenes MGAS315
gacuugguucugaaaauaaaaua

SEQ ID NO: 4121746 - RNA, 21 nt, Streptococcus pyogenes MGAS315
gacuuguaaaaugauacuuuc

SEQ ID NO: 4121747 - RNA, 21 nt, Streptococcus pyogenes MGAS315
gacuuguuacaaaaaacaagu

SEQ ID NO: 4121748 - RNA, 23 nt, Streptococcus pyogenes MGAS315
gagaaacuaaaggcaauagcaag

SEQ ID NO: 4121749 - RNA, 13 nt, Streptococcus pyogenes MGAS315
gagaacaugugaa

SEQ ID NO: 4121750 - RNA, 19 nt, Streptococcus pyogenes MGAS315
gagauaccuucauagacaa

SEQ ID NO: 4121751 - RNA, 17 nt, Streptococcus pyogenes MGAS315
gagaugacgguaaauaa

SEQ ID NO: 4121752 - RNA, 12 nt, Streptococcus pyogenes MGAS315
gagcaaggcaag

SEQ ID NO: 4121753 - RNA, 18 nt, Streptococcus pyogenes MGAS315
gagcaaggcaagaggagg

SEQ ID NO: 4121754 - RNA, 19 nt, Streptococcus pyogenes MGAS315
gagcaaggcaagaggaggc

SEQ ID NO: 4121755 - RNA, 17 nt, Streptococcus pyogenes MGAS315
gagggacugucaaaaaa

SEQ ID NO: 4121756 - RNA, 17 nt, Streptococcus pyogenes MGAS315
gagguugguaaaaaggc

SEQ ID NO: 4121757 - RNA, 18 nt, Streptococcus pyogenes MGAS315
gagguugguaaaaaggca

SEQ ID NO: 4121758 - RNA, 19 nt, Streptococcus pyogenes MGAS315
gaguaaggaccaagauuca

SEQ ID NO: 4121759 - RNA, 14 nt, Streptococcus pyogenes MGAS315
gaguacaaggcaau

SEQ ID NO: 4121760 - RNA, 13 nt, Streptococcus pyogenes MGAS315
gaguaugaacaaa

SEQ ID NO: 4121761 - RNA, 21 nt, Streptococcus pyogenes MGAS315
gaguugaaccgcuaaaacagu

SEQ ID NO: 4121762 - RNA, 15 nt, Streptococcus pyogenes MGAS315
gauaaaacaaauaau

SEQ ID NO: 4121763 - RNA, 18 nt, Streptococcus pyogenes MGAS315
gauaaaaccuucaaaaaa

SEQ ID NO: 4121764 - RNA, 22 nt, Streptococcus pyogenes MGAS315
gauaaaaccuucaaaaaaggga

SEQ ID NO: 4121765 - RNA, 15 nt, Streptococcus pyogenes MGAS315
gauaaacuacaccau

SEQ ID NO: 4121766 - RNA, 12 nt, Streptococcus pyogenes MGAS315
gauaaaggccug

SEQ ID NO: 4121767 - RNA, 18 nt, Streptococcus pyogenes MGAS315
gauaccaaaucaaaaagc

SEQ ID NO: 4121768 - RNA, 20 nt, Streptococcus pyogenes MGAS315
gauacuuugguauucuuuuu

SEQ ID NO: 4121769 - RNA, 13 nt, Streptococcus pyogenes MGAS315
gauagcaccuaau

SEQ ID NO: 4121770 - RNA, 23 nt, Streptococcus pyogenes MGAS315
gauaggucugcaauauccauaga

SEQ ID NO: 4121771 - RNA, 18 nt, Streptococcus pyogenes MGAS315
gauagucaaaaagacuuc

SEQ ID NO: 4121772 - RNA, 13 nt, Streptococcus pyogenes MGAS315
gauagugugugug

SEQ ID NO: 4121773 - RNA, 13 nt, Streptococcus pyogenes MGAS315
gauauaaaauugg

SEQ ID NO: 4121774 - RNA, 19 nt, Streptococcus pyogenes MGAS315
gauauggaauagguaaaga

SEQ ID NO: 4121775 - RNA, 19 nt, Streptococcus pyogenes MGAS315
gaucaaaaaucuuuuucuu

SEQ ID NO: 4121776 - RNA, 22 nt, Streptococcus pyogenes MGAS315
gaucauuaaauugauuauucuc

SEQ ID NO: 4121777 - RNA, 14 nt, Streptococcus pyogenes MGAS315
gaugaaaugauugu

SEQ ID NO: 4121778 - RNA, 22 nt, Streptococcus pyogenes MGAS315
gaugagauuaacugacaaaaaa

SEQ ID NO: 4121779 - RNA, 15 nt, Streptococcus pyogenes MGAS315
gaugauauuuuucau

SEQ ID NO: 4121780 - RNA, 16 nt, Streptococcus pyogenes MGAS315
gaugccauuuaaaagg

SEQ ID NO: 4121781 - RNA, 15 nt, Streptococcus pyogenes MGAS315
gaugcguuuauaaag

SEQ ID NO: 4121782 - RNA, 14 nt, Streptococcus pyogenes MGAS315
gaugcuucuuucaa

SEQ ID NO: 4121783 - RNA, 22 nt, Streptococcus pyogenes MGAS315
gauucaucuugccaucagcauc

SEQ ID NO: 4121784 - RNA, 19 nt, Streptococcus pyogenes MGAS315
gauugagaccaaaugaccu

SEQ ID NO: 4121785 - RNA, 16 nt, Streptococcus pyogenes MGAS315
gauugauacaaagacu

SEQ ID NO: 4121786 - RNA, 19 nt, Streptococcus pyogenes MGAS315
gauugccauuuaauuggua

SEQ ID NO: 4121787 - RNA, 15 nt, Streptococcus pyogenes MGAS315
gauuuagaaauuuua

SEQ ID NO: 4121788 - RNA, 17 nt, Streptococcus pyogenes MGAS315
gauuuccucuaacaugu

SEQ ID NO: 4121789 - RNA, 20 nt, Streptococcus pyogenes MGAS315
gauuucggaccaugccuaaa

SEQ ID NO: 4121790 - RNA, 21 nt, Streptococcus pyogenes MGAS315
gauuugaccacaccuaauaaa

SEQ ID NO: 4121791 - RNA, 20 nt, Streptococcus pyogenes MGAS315
gauuugcugagcuaaagcca

SEQ ID NO: 4121792 - RNA, 19 nt, Streptococcus pyogenes MGAS315
gcaaaaguuagauuuugga

SEQ ID NO: 4121793 - RNA, 19 nt, Streptococcus pyogenes MGAS315
gcaaagaaagccaagacua

SEQ ID NO: 4121794 - RNA, 15 nt, Streptococcus pyogenes MGAS315
gcaaauagcaauggu

SEQ ID NO: 4121795 - RNA, 15 nt, Streptococcus pyogenes MGAS315
gcaaauugaaaaaau

SEQ ID NO: 4121796 - RNA, 17 nt, Streptococcus pyogenes MGAS315
gcaauaacaucuugauu

SEQ ID NO: 4121797 - RNA, 20 nt, Streptococcus pyogenes MGAS315
gcaauaacaucuugauugua

SEQ ID NO: 4121798 - RNA, 19 nt, Streptococcus pyogenes MGAS315
gcaauaaucgaugauaaua

SEQ ID NO: 4121799 - RNA, 14 nt, Streptococcus pyogenes MGAS315
gcaauccaaaucaa

SEQ ID NO: 4121800 - RNA, 16 nt, Streptococcus pyogenes MGAS315
gcaaugguuaaaaaga

SEQ ID NO: 4121801 - RNA, 23 nt, Streptococcus pyogenes MGAS315
gcaauucuuuuauuaauguaaaa

SEQ ID NO: 4121802 - RNA, 20 nt, Streptococcus pyogenes MGAS315
gcagauggggugucagggga

SEQ ID NO: 4121803 - RNA, 14 nt, Streptococcus pyogenes MGAS315
gcagcaccaguaaa

SEQ ID NO: 4121804 - RNA, 15 nt, Streptococcus pyogenes MGAS315
gcaggguaucugcuc

SEQ ID NO: 4121805 - RNA, 17 nt, Streptococcus pyogenes MGAS315
gcaggguaucugcucag

SEQ ID NO: 4121806 - RNA, 20 nt, Streptococcus pyogenes MGAS315
gcagguaauuaucugaauua

SEQ ID NO: 4121807 - RNA, 13 nt, Streptococcus pyogenes MGAS315
gcaguucgauuau

SEQ ID NO: 4121808 - RNA, 19 nt, Streptococcus pyogenes MGAS315
gcaguucgauuauuaacca

SEQ ID NO: 4121809 - RNA, 23 nt, Streptococcus pyogenes MGAS315
gcaguugcgaucauaaauaaaga

SEQ ID NO: 4121810 - RNA, 22 nt, Streptococcus pyogenes MGAS315
gcauaaaagauauuuuaaaaua

SEQ ID NO: 4121811 - RNA, 15 nt, Streptococcus pyogenes MGAS315
gcaucgcaaacagau

SEQ ID NO: 4121812 - RNA, 15 nt, Streptococcus pyogenes MGAS315
gcaucuuugcagggu

SEQ ID NO: 4121813 - RNA, 23 nt, Streptococcus pyogenes MGAS315
gcaucuuugcaggguaucugcuc

SEQ ID NO: 4121814 - RNA, 17 nt, Streptococcus pyogenes MGAS315
gcaugauuuaguuuuua

SEQ ID NO: 4121815 - RNA, 17 nt, Streptococcus pyogenes MGAS315
gcauguccuaaccuuuu

SEQ ID NO: 4121816 - RNA, 15 nt, Streptococcus pyogenes MGAS315
gcauugacgacugcu

SEQ ID NO: 4121817 - RNA, 16 nt, Streptococcus pyogenes MGAS315
gcauugucaaauaaaa

SEQ ID NO: 4121818 - RNA, 17 nt, Streptococcus pyogenes MGAS315
gcauuuugcaagucucu

SEQ ID NO: 4121819 - RNA, 15 nt, Streptococcus pyogenes MGAS315
gccaaaucuggcuua

SEQ ID NO: 4121820 - RNA, 18 nt, Streptococcus pyogenes MGAS315
gccaagacuaaagcauuu

SEQ ID NO: 4121821 - RNA, 14 nt, Streptococcus pyogenes MGAS315
gccaucaaaaaaag

SEQ ID NO: 4121822 - RNA, 19 nt, Streptococcus pyogenes MGAS315
gccaucuaagcuuggauug

SEQ ID NO: 4121823 - RNA, 15 nt, Streptococcus pyogenes MGAS315
gcccagaaauaaucu

SEQ ID NO: 4121824 - RNA, 14 nt, Streptococcus pyogenes MGAS315
gcccuggagcuguu

SEQ ID NO: 4121825 - RNA, 19 nt, Streptococcus pyogenes MGAS315
gccuaaagcccauagagga

SEQ ID NO: 4121826 - RNA, 14 nt, Streptococcus pyogenes MGAS315
gccuacaacagcag

SEQ ID NO: 4121827 - RNA, 23 nt, Streptococcus pyogenes MGAS315
gccucuucugaugcguuuauaaa

SEQ ID NO: 4121828 - RNA, 20 nt, Streptococcus pyogenes MGAS315
gccugauauuccuuuuccaa

SEQ ID NO: 4121829 - RNA, 20 nt, Streptococcus pyogenes MGAS315
gccuuuaacaugauguacca

SEQ ID NO: 4121830 - RNA, 22 nt, Streptococcus pyogenes MGAS315
gcgaauaugauauaaaaaugga

SEQ ID NO: 4121831 - RNA, 15 nt, Streptococcus pyogenes MGAS315
gcguaagccaaaucu

SEQ ID NO: 4121832 - RNA, 12 nt, Streptococcus pyogenes MGAS315
gcguuagcuuuu

SEQ ID NO: 4121833 - RNA, 20 nt, Streptococcus pyogenes MGAS315
gcguuaucuccacagagucu

SEQ ID NO: 4121834 - RNA, 15 nt, Streptococcus pyogenes MGAS315
gcuaaaacaguucca

SEQ ID NO: 4121835 - RNA, 18 nt, Streptococcus pyogenes MGAS315
gcuaaaacaguuccaguu

SEQ ID NO: 4121836 - RNA, 16 nt, Streptococcus pyogenes MGAS315
gcuaaaagcauaaaaa

SEQ ID NO: 4121837 - RNA, 18 nt, Streptococcus pyogenes MGAS315
gcuaaguagauacuuugg

SEQ ID NO: 4121838 - RNA, 17 nt, Streptococcus pyogenes MGAS315
gcuagaccucugcucac

SEQ ID NO: 4121839 - RNA, 16 nt, Streptococcus pyogenes MGAS315
gcuauaagaggauaau

SEQ ID NO: 4121840 - RNA, 20 nt, Streptococcus pyogenes MGAS315
gcucaacuggcacaaacucu

SEQ ID NO: 4121841 - RNA, 20 nt, Streptococcus pyogenes MGAS315
gcugaacugcucuggcuuuu

SEQ ID NO: 4121842 - RNA, 14 nt, Streptococcus pyogenes MGAS315
guuauguuauaaga

SEQ ID NO: 4121843 - RNA, 13 nt, Streptococcus pyogenes MGAS315
guuauuaaagaca

SEQ ID NO: 4121844 - RNA, 14 nt, Streptococcus pyogenes MGAS315
guuauuaaagacaa

SEQ ID NO: 4121845 - RNA, 19 nt, Streptococcus pyogenes MGAS315
guuauuaaagacaaaaaac

SEQ ID NO: 4121846 - RNA, 19 nt, Streptococcus pyogenes MGAS315
guuauuggugcaauaaucg

SEQ ID NO: 4121847 - RNA, 19 nt, Streptococcus pyogenes MGAS315
guucaauggauauaacaac

SEQ ID NO: 4121848 - RNA, 14 nt, Streptococcus pyogenes MGAS315
guucauaguugugc

SEQ ID NO: 4121849 - RNA, 18 nt, Streptococcus pyogenes MGAS315
guugacaguuaaaaauaa

SEQ ID NO: 4121850 - RNA, 17 nt, Streptococcus pyogenes MGAS315
guugcaagugacaaccu

SEQ ID NO: 4121851 - RNA, 19 nt, Streptococcus pyogenes MGAS315
guugcuacaauuuuuucaa

SEQ ID NO: 4121852 - RNA, 22 nt, Streptococcus pyogenes MGAS315
guuggauuuuuguauuugucua

SEQ ID NO: 4121853 - RNA, 13 nt, Streptococcus pyogenes MGAS315
guugguaaaaagg

SEQ ID NO: 4121854 - RNA, 13 nt, Streptococcus pyogenes MGAS315
guugugccuuuuc

SEQ ID NO: 4121855 - RNA, 18 nt, Streptococcus pyogenes MGAS315
guuuagaacuuuucaggu

SEQ ID NO: 4121856 - RNA, 19 nt, Streptococcus pyogenes MGAS315
guuuagcuuuuucaagagu

SEQ ID NO: 4121857 - RNA, 12 nt, Streptococcus pyogenes MGAS315
guuuauuuaguu

SEQ ID NO: 4121858 - RNA, 14 nt, Streptococcus pyogenes MGAS315
guuucaagugcuag

SEQ ID NO: 4121859 - RNA, 16 nt, Streptococcus pyogenes MGAS315
guuugauugauuuguc

SEQ ID NO: 4121860 - RNA, 16 nt, Streptococcus pyogenes MGAS315
guuuuauaucuaacgu

SEQ ID NO: 4121861 - RNA, 13 nt, Streptococcus pyogenes MGAS315
guuuuauuuugau

SEQ ID NO: 4121862 - RNA, 17 nt, Streptococcus pyogenes MGAS315
guuuugauuaaaucuuc

SEQ ID NO: 4121863 - RNA, 13 nt, Streptococcus pyogenes MGAS315
guuuugcaauuaa

SEQ ID NO: 4121864 - RNA, 13 nt, Streptococcus pyogenes MGAS315
uaaaaaaaucccu

SEQ ID NO: 4121865 - RNA, 21 nt, Streptococcus pyogenes MGAS315
uaaaaaagaagcaaaauuauu

SEQ ID NO: 4121866 - RNA, 17 nt, Streptococcus pyogenes MGAS315
uaaaaaaguuaucacua

SEQ ID NO: 4121867 - RNA, 17 nt, Streptococcus pyogenes MGAS315
uaaaaacgaucaaaaau

SEQ ID NO: 4121868 - RNA, 20 nt, Streptococcus pyogenes MGAS315
uaaaaacgaucaaaaaucuu

SEQ ID NO: 4121869 - RNA, 17 nt, Streptococcus pyogenes MGAS315
uaaaaacucaaaaaaua

SEQ ID NO: 4121870 - RNA, 18 nt, Streptococcus pyogenes MGAS315
uaaaaagcaaaaaagcca

SEQ ID NO: 4121871 - RNA, 20 nt, Streptococcus pyogenes MGAS315
uaaaaagcaaauugaaaaaa

SEQ ID NO: 4121872 - RNA, 15 nt, Streptococcus pyogenes MGAS315
uaaaaaguaaaaucu

SEQ ID NO: 4121873 - RNA, 16 nt, Streptococcus pyogenes MGAS315
uaaaaaguaaaaucuu

SEQ ID NO: 4121874 - RNA, 21 nt, Streptococcus pyogenes MGAS315
uaaaaaguuucugaguugauu

SEQ ID NO: 4121875 - RNA, 17 nt, Streptococcus pyogenes MGAS315
uaaaaauacuagaaaaa

SEQ ID NO: 4121876 - RNA, 18 nt, Streptococcus pyogenes MGAS315
uaaaaauacuagaaaaag

SEQ ID NO: 4121877 - RNA, 22 nt, Streptococcus pyogenes MGAS315
uaaaagaaaaucuaaucagacu

SEQ ID NO: 4121878 - RNA, 18 nt, Streptococcus pyogenes MGAS315
uaaaagagagaaugauag

SEQ ID NO: 4121879 - RNA, 20 nt, Streptococcus pyogenes MGAS315
uaaaagauauuuuaaaauag

SEQ ID NO: 4121880 - RNA, 19 nt, Streptococcus pyogenes MGAS315
uaaaaguuagccaagcaau

SEQ ID NO: 4121881 - RNA, 13 nt, Streptococcus pyogenes MGAS315
uaaaauagcaccu

SEQ ID NO: 4121882 - RNA, 21 nt, Streptococcus pyogenes MGAS315
uaaaauagcaccuacgauaaa

SEQ ID NO: 4121883 - RNA, 12 nt, Streptococcus pyogenes MGAS315
uaaaauauauuu

SEQ ID NO: 4121884 - RNA, 22 nt, Streptococcus pyogenes MGAS315
uaaaauaucuagaacagcugcu

SEQ ID NO: 4121885 - RNA, 23 nt, Streptococcus pyogenes MGAS315
uaaaauaucuagaacagcugcuu

SEQ ID NO: 4121886 - RNA, 16 nt, Streptococcus pyogenes MGAS315
uaaaauauuuuuccau

SEQ ID NO: 4121887 - RNA, 16 nt, Streptococcus pyogenes MGAS315
uaaaaucguuauuaau

SEQ ID NO: 4121888 - RNA, 15 nt, Streptococcus pyogenes MGAS315
uaaaaugacugacaa

SEQ ID NO: 4121889 - RNA, 16 nt, Streptococcus pyogenes MGAS315
uaaaaugacugacaaa

SEQ ID NO: 4121890 - RNA, 11 nt, Streptococcus pyogenes MGAS315
uaaacaaucuu

SEQ ID NO: 4121891 - RNA, 20 nt, Streptococcus pyogenes MGAS315
uaaacaaugagucaccugua

SEQ ID NO: 4121892 - RNA, 23 nt, Streptococcus pyogenes MGAS315
uaaacacuaccuuaaauguauga

SEQ ID NO: 4121893 - RNA, 20 nt, Streptococcus pyogenes MGAS315
uaaacauauuauaguaacca

SEQ ID NO: 4121894 - RNA, 23 nt, Streptococcus pyogenes MGAS315
uaaacauauuauaguaaccauug

SEQ ID NO: 4121895 - RNA, 15 nt, Streptococcus pyogenes MGAS315
uaaacuacaccauuu

SEQ ID NO: 4121896 - RNA, 16 nt, Streptococcus pyogenes MGAS315
uaaacuacaccauuua

SEQ ID NO: 4121897 - RNA, 16 nt, Streptococcus pyogenes MGAS315
uaaacucuauacaaaa

SEQ ID NO: 4121898 - RNA, 19 nt, Streptococcus pyogenes MGAS315
uaaacucuauacaaaaagg

SEQ ID NO: 4121899 - RNA, 14 nt, Streptococcus pyogenes MGAS315
uaaacuuacaaaaa

SEQ ID NO: 4121900 - RNA, 15 nt, Streptococcus pyogenes MGAS315
uaaacuuacaaaaag

SEQ ID NO: 4121901 - RNA, 12 nt, Streptococcus pyogenes MGAS315
uaaagacaaaaa

SEQ ID NO: 4121902 - RNA, 15 nt, Streptococcus pyogenes MGAS315
uaaagagccucagga

SEQ ID NO: 4121903 - RNA, 14 nt, Streptococcus pyogenes MGAS315
uaaagauaauuuau

SEQ ID NO: 4121904 - RNA, 15 nt, Streptococcus pyogenes MGAS315
uaaagauaauuuauu

SEQ ID NO: 4121905 - RNA, 16 nt, Streptococcus pyogenes MGAS315
uaaagauuuuaaauau

SEQ ID NO: 4121906 - RNA, 18 nt, Streptococcus pyogenes MGAS315
uaaagauuuuaaauaucu

SEQ ID NO: 4121907 - RNA, 16 nt, Streptococcus pyogenes MGAS315
uaaagccaaccccaag

SEQ ID NO: 4121908 - RNA, 17 nt, Streptococcus pyogenes MGAS315
uaaaggccuguauuucu

SEQ ID NO: 4121909 - RNA, 15 nt, Streptococcus pyogenes MGAS315
uaaaguaauaaguag

SEQ ID NO: 4121910 - RNA, 16 nt, Streptococcus pyogenes MGAS315
uaaauaaagauaauuu

SEQ ID NO: 4121911 - RNA, 14 nt, Streptococcus pyogenes MGAS315
uaaauauaaauuau

SEQ ID NO: 4121912 - RNA, 15 nt, Streptococcus pyogenes MGAS315
uaaauauaaauuauu

SEQ ID NO: 4121913 - RNA, 16 nt, Streptococcus pyogenes MGAS315
uaaauauaaauuauua

SEQ ID NO: 4121914 - RNA, 21 nt, Streptococcus pyogenes MGAS315
uaaauauccaaugaaaacucc

SEQ ID NO: 4121915 - RNA, 17 nt, Streptococcus pyogenes MGAS315
uaaauccuuuugaaaaa

SEQ ID NO: 4121916 - RNA, 15 nt, Streptococcus pyogenes MGAS315
uaaaugucuagcuua

SEQ ID NO: 4121917 - RNA, 14 nt, Streptococcus pyogenes MGAS315
uaaauuauauuaua

SEQ ID NO: 4121918 - RNA, 18 nt, Streptococcus pyogenes MGAS315
uaaauugauuauucucua

SEQ ID NO: 4121919 - RNA, 13 nt, Streptococcus pyogenes MGAS315
uaacaaaaauaag

SEQ ID NO: 4121920 - RNA, 23 nt, Streptococcus pyogenes MGAS315
uaacaaaaugaagcaaaauaaac

SEQ ID NO: 4121921 - RNA, 19 nt, Streptococcus pyogenes MGAS315
uaacaacaacaacccuuga

SEQ ID NO: 4121922 - RNA, 20 nt, Streptococcus pyogenes MGAS315
uaacagaaauuaauaaauuu

SEQ ID NO: 4121923 - RNA, 13 nt, Streptococcus pyogenes MGAS315
uaacaucuugauu

SEQ ID NO: 4121924 - RNA, 17 nt, Streptococcus pyogenes MGAS315
uaaccaauuccucccua

SEQ ID NO: 4121925 - RNA, 14 nt, Streptococcus pyogenes MGAS315
uaaccauugccauu

SEQ ID NO: 4121926 - RNA, 22 nt, Streptococcus pyogenes MGAS315
uaaccauugccauuaauaauau

SEQ ID NO: 4121927 - RNA, 22 nt, Streptococcus pyogenes MGAS315
uaacccgucuuacaauuaauag

SEQ ID NO: 4121928 - RNA, 23 nt, Streptococcus pyogenes MGAS315
uaaccucuuaguuggagagacua

SEQ ID NO: 4121929 - RNA, 17 nt, Streptococcus pyogenes MGAS315
uaaccugcauaucugcc

SEQ ID NO: 4121930 - RNA, 17 nt, Streptococcus pyogenes MGAS315
uaaccuuuuggcuguau

SEQ ID NO: 4121931 - RNA, 14 nt, Streptococcus pyogenes MGAS315
uaacguuuggggug

SEQ ID NO: 4121932 - RNA, 18 nt, Streptococcus pyogenes MGAS315
uaacguuuggggugcagu

SEQ ID NO: 4121933 - RNA, 21 nt, Streptococcus pyogenes MGAS315
uaacuauuuaacuuaucauuu

SEQ ID NO: 4121934 - RNA, 18 nt, Streptococcus pyogenes MGAS315
uaacugguccaucauuga

SEQ ID NO: 4121935 - RNA, 20 nt, Streptococcus pyogenes MGAS315
uaacuuuaaaagggcugacc

SEQ ID NO: 4121936 - RNA, 13 nt, Streptococcus pyogenes MGAS315
uaacuuucuauua

SEQ ID NO: 4121937 - RNA, 21 nt, Streptococcus pyogenes MGAS315
uaagaagaaaauaucaguuaa

SEQ ID NO: 4121938 - RNA, 22 nt, Streptococcus pyogenes MGAS315
uaagacaaagacguuuuacuua

SEQ ID NO: 4121939 - RNA, 19 nt, Streptococcus pyogenes MGAS315
uaagacagucgccaaaucu

SEQ ID NO: 4121940 - RNA, 23 nt, Streptococcus pyogenes MGAS315
uaagagagguugguaaaaaggca

SEQ ID NO: 4121941 - RNA, 16 nt, Streptococcus pyogenes MGAS315
uaguugguacuugaua

SEQ ID NO: 4121942 - RNA, 17 nt, Streptococcus pyogenes MGAS315
uaguugugccuuuucuu

SEQ ID NO: 4121943 - RNA, 13 nt, Streptococcus pyogenes MGAS315
uaguugugcuagu

SEQ ID NO: 4121944 - RNA, 15 nt, Streptococcus pyogenes MGAS315
uaguugugcuagucu

SEQ ID NO: 4121945 - RNA, 14 nt, Streptococcus pyogenes MGAS315
uaguuuauuacaaa

SEQ ID NO: 4121946 - RNA, 15 nt, Streptococcus pyogenes MGAS315
uaguuuauuacaaaa

SEQ ID NO: 4121947 - RNA, 20 nt, Streptococcus pyogenes MGAS315
uauaaacuuguugacucuga

SEQ ID NO: 4121948 - RNA, 23 nt, Streptococcus pyogenes MGAS315
uauaaauuauuaacguuaacaaa

SEQ ID NO: 4121949 - RNA, 12 nt, Streptococcus pyogenes MGAS315
uauaagcaauca

SEQ ID NO: 4121950 - RNA, 18 nt, Streptococcus pyogenes MGAS315
uauaaugguuuuuugucu

SEQ ID NO: 4121951 - RNA, 14 nt, Streptococcus pyogenes MGAS315
uauaauuucaauaa

SEQ ID NO: 4121952 - RNA, 19 nt, Streptococcus pyogenes MGAS315
uauaauuugacuucaaaaa

SEQ ID NO: 4121953 - RNA, 21 nt, Streptococcus pyogenes MGAS315
uauaauuugacuucaaaaaua

SEQ ID NO: 4121954 - RNA, 15 nt, Streptococcus pyogenes MGAS315
uauaccuaaaaaaua

SEQ ID NO: 4121955 - RNA, 22 nt, Streptococcus pyogenes MGAS315
uauacgguaaaaacucaaaaaa

SEQ ID NO: 4121956 - RNA, 14 nt, Streptococcus pyogenes MGAS315
uauacuuuaaacac

SEQ ID NO: 4121957 - RNA, 23 nt, Streptococcus pyogenes MGAS315
uauagcuccuaaaaccauaccua

SEQ ID NO: 4121958 - RNA, 16 nt, Streptococcus pyogenes MGAS315
uauaggugaguuuuuu

SEQ ID NO: 4121959 - RNA, 23 nt, Streptococcus pyogenes MGAS315
uauaguaaccauugccauuaaua

SEQ ID NO: 4121960 - RNA, 13 nt, Streptococcus pyogenes MGAS315
uauaguuauguua

SEQ ID NO: 4121961 - RNA, 18 nt, Streptococcus pyogenes MGAS315
uauauuguaauaacaaaa

SEQ ID NO: 4121962 - RNA, 20 nt, Streptococcus pyogenes MGAS315
uauauuuuaguugauauuuu

SEQ ID NO: 4121963 - RNA, 23 nt, Streptococcus pyogenes MGAS315
uauauuuuggaucuucaacuacu

SEQ ID NO: 4121964 - RNA, 19 nt, Streptococcus pyogenes MGAS315
uaucaacuuguuaacaaua

SEQ ID NO: 4121965 - RNA, 14 nt, Streptococcus pyogenes MGAS315
uaucagauacuagu

SEQ ID NO: 4121966 - RNA, 20 nt, Streptococcus pyogenes MGAS315
uaucaggccacuagaacucu

SEQ ID NO: 4121967 - RNA, 16 nt, Streptococcus pyogenes MGAS315
uaucaguauacucagu

SEQ ID NO: 4121968 - RNA, 18 nt, Streptococcus pyogenes MGAS315
uaucaguuaaugccaacu

SEQ ID NO: 4121969 - RNA, 12 nt, Streptococcus pyogenes MGAS315
uaucauacucuu

SEQ ID NO: 4121970 - RNA, 22 nt, Streptococcus pyogenes MGAS315
uaucauuaucaacaaucuuaaa

SEQ ID NO: 4121971 - RNA, 13 nt, Streptococcus pyogenes MGAS315
uauccauuauaaa

SEQ ID NO: 4121972 - RNA, 15 nt, Streptococcus pyogenes MGAS315
uauccauuauaaauc

SEQ ID NO: 4121973 - RNA, 14 nt, Streptococcus pyogenes MGAS315
uaucuagaacagcu

SEQ ID NO: 4121974 - RNA, 18 nt, Streptococcus pyogenes MGAS315
uaucugauaagguuuuuu

SEQ ID NO: 4121975 - RNA, 14 nt, Streptococcus pyogenes MGAS315
uaugauauaaaaau

SEQ ID NO: 4121976 - RNA, 18 nt, Streptococcus pyogenes MGAS315
uauggcuucuaaaaaagu

SEQ ID NO: 4121977 - RNA, 19 nt, Streptococcus pyogenes MGAS315
uauguaucaagagucauuu

SEQ ID NO: 4121978 - RNA, 16 nt, Streptococcus pyogenes MGAS315
uauguuauaagagaag

SEQ ID NO: 4121979 - RNA, 15 nt, Streptococcus pyogenes MGAS315
uauuaaagacaaaaa

SEQ ID NO: 4121980 - RNA, 15 nt, Streptococcus pyogenes MGAS315
uauuaaauaauacag

SEQ ID NO: 4121981 - RNA, 15 nt, Streptococcus pyogenes MGAS315
uauuaaccaauuccu

SEQ ID NO: 4121982 - RNA, 20 nt, Streptococcus pyogenes MGAS315
uauuaaccggcucuaaaaua

SEQ ID NO: 4121983 - RNA, 22 nt, Streptococcus pyogenes MGAS315
uauuaaccggcucuaaaauaua

SEQ ID NO: 4121984 - RNA, 21 nt, Streptococcus pyogenes MGAS315
uauuaagauaccaaaucaaaa

SEQ ID NO: 4121985 - RNA, 19 nt, Streptococcus pyogenes MGAS315
uauuaauaaguauuuuaaa

SEQ ID NO: 4121986 - RNA, 15 nt, Streptococcus pyogenes MGAS315
uauuaaucaaaaaac

SEQ ID NO: 4121987 - RNA, 16 nt, Streptococcus pyogenes MGAS315
uauuaauguaaaaacc

SEQ ID NO: 4121988 - RNA, 16 nt, Streptococcus pyogenes MGAS315
uauuacaaaacugucu

SEQ ID NO: 4121989 - RNA, 17 nt, Streptococcus pyogenes MGAS315
uauuacuucuuuuuguu

SEQ ID NO: 4121990 - RNA, 15 nt, Streptococcus pyogenes MGAS315
uauuagcaaaaugcu

SEQ ID NO: 4121991 - RNA, 22 nt, Streptococcus pyogenes MGAS315
uauuauacucaauauaauaaaa

SEQ ID NO: 4121992 - RNA, 16 nt, Streptococcus pyogenes MGAS315
uauucucuauuuuugg

SEQ ID NO: 4121993 - RNA, 14 nt, Streptococcus pyogenes MGAS315
uauugcucaagacu

SEQ ID NO: 4121994 - RNA, 20 nt, Streptococcus pyogenes MGAS315
uauuggcaguccaucaaucg

SEQ ID NO: 4121995 - RNA, 14 nt, Streptococcus pyogenes MGAS315
uauuguuaguuuua

SEQ ID NO: 4121996 - RNA, 14 nt, Streptococcus pyogenes MGAS315
uauuuaauagcauu

SEQ ID NO: 4121997 - RNA, 15 nt, Streptococcus pyogenes MGAS315
uauuuacugggucaa

SEQ ID NO: 4121998 - RNA, 16 nt, Streptococcus pyogenes MGAS315
uauuuugauacgguua

SEQ ID NO: 4121999 - RNA, 19 nt, Streptococcus pyogenes MGAS315
uauuuugauauuuuuucuc

SEQ ID NO: 4122000 - RNA, 13 nt, Streptococcus pyogenes MGAS315
uauuuugcuucua

SEQ ID NO: 4122001 - RNA, 18 nt, Streptococcus pyogenes MGAS315
uauuuuucauuugaaauu

SEQ ID NO: 4122002 - RNA, 17 nt, Streptococcus pyogenes MGAS315
uauuuuuucucaaaaau

SEQ ID NO: 4122003 - RNA, 17 nt, Streptococcus pyogenes MGAS315
ucaaaaaaagacacaca

SEQ ID NO: 4122004 - RNA, 19 nt, Streptococcus pyogenes MGAS315
ucaaaaaauuaagaaggaa

SEQ ID NO: 4122005 - RNA, 14 nt, Streptococcus pyogenes MGAS315
ucaaaaaguaaaaa

SEQ ID NO: 4122006 - RNA, 15 nt, Streptococcus pyogenes MGAS315
ucaaaaauauauucu

SEQ ID NO: 4122007 - RNA, 15 nt, Streptococcus pyogenes MGAS315
ucaaaaaucuuuuuc

SEQ ID NO: 4122008 - RNA, 11 nt, Streptococcus pyogenes MGAS315
ucaaaaccaag

SEQ ID NO: 4122009 - RNA, 23 nt, Streptococcus pyogenes MGAS315
ucaaaacuucggccacguuuuuc

SEQ ID NO: 4122010 - RNA, 18 nt, Streptococcus pyogenes MGAS315
ucaacaaucuuaaaauaa

SEQ ID NO: 4122011 - RNA, 18 nt, Streptococcus pyogenes MGAS315
ucaacaguugcuugcuuu

SEQ ID NO: 4122012 - RNA, 18 nt, Streptococcus pyogenes MGAS315
ucaacggcgacucuauca

SEQ ID NO: 4122013 - RNA, 19 nt, Streptococcus pyogenes MGAS315
ucaacggcgacucuaucaa

SEQ ID NO: 4122014 - RNA, 21 nt, Streptococcus pyogenes MGAS315
ucaacggcgacucuaucaacu

SEQ ID NO: 4122015 - RNA, 18 nt, Streptococcus pyogenes MGAS315
ucaacuggcacaaacucu

SEQ ID NO: 4122016 - RNA, 16 nt, Streptococcus pyogenes MGAS315
ucaagagucaaaccag

SEQ ID NO: 4122017 - RNA, 23 nt, Streptococcus pyogenes MGAS315
ucaaggaaggcuuguucuuuauu

SEQ ID NO: 4122018 - RNA, 18 nt, Streptococcus pyogenes MGAS315
ucaagugcuagauguugg

SEQ ID NO: 4122019 - RNA, 17 nt, Streptococcus pyogenes MGAS315
ucaauaacagaaauuaa

SEQ ID NO: 4122020 - RNA, 20 nt, Streptococcus pyogenes MGAS315
ucaauaacagaaauuaauaa

SEQ ID NO: 4122021 - RNA, 13 nt, Streptococcus pyogenes MGAS315
ucaauagcugcug

SEQ ID NO: 4122022 - RNA, 17 nt, Streptococcus pyogenes MGAS315
ucaauauaauaaaaagc

SEQ ID NO: 4122023 - RNA, 12 nt, Streptococcus pyogenes MGAS315
ucaauaucauau

SEQ ID NO: 4122024 - RNA, 21 nt, Streptococcus pyogenes MGAS315
ucaauauuuuauuaauaagua

SEQ ID NO: 4122025 - RNA, 12 nt, Streptococcus pyogenes MGAS315
ucaaucauuuuu

SEQ ID NO: 4122026 - RNA, 13 nt, Streptococcus pyogenes MGAS315
ucaaucauuuuua

SEQ ID NO: 4122027 - RNA, 21 nt, Streptococcus pyogenes MGAS315
ucaauuaauguuaggagcaca

SEQ ID NO: 4122028 - RNA, 17 nt, Streptococcus pyogenes MGAS315
ucaauuuucauuuuugg

SEQ ID NO: 4122029 - RNA, 18 nt, Streptococcus pyogenes MGAS315
ucaauuuuguugaguguu

SEQ ID NO: 4122030 - RNA, 19 nt, Streptococcus pyogenes MGAS315
ucaccguggacuugauggu

SEQ ID NO: 4122031 - RNA, 21 nt, Streptococcus pyogenes MGAS315
ucaccuuaggcagacaauuau

SEQ ID NO: 4122032 - RNA, 12 nt, Streptococcus pyogenes MGAS315
ucacuauaauuu

SEQ ID NO: 4122033 - RNA, 23 nt, Streptococcus pyogenes MGAS315
ucacuauaauuucaauaauacca

SEQ ID NO: 4122034 - RNA, 21 nt, Streptococcus pyogenes MGAS315
ucacugcagcaucaaaaccaa

SEQ ID NO: 4122035 - RNA, 23 nt, Streptococcus pyogenes MGAS315
ucacuuuagccguccuuaaaaga

SEQ ID NO: 4122036 - RNA, 20 nt, Streptococcus pyogenes MGAS315
ucagaagcuuuaucauacuc

SEQ ID NO: 4122037 - RNA, 15 nt, Streptococcus pyogenes MGAS315
ucagagacaauaagg

SEQ ID NO: 4122038 - RNA, 19 nt, Streptococcus pyogenes MGAS315
ucagagaugcuucuuucaa

SEQ ID NO: 4122039 - RNA, 13 nt, Streptococcus pyogenes MGAS315
ucagagcuuuuuu

SEQ ID NO: 4122040 - RNA, 19 nt, Streptococcus pyogenes MGAS315
ucuucaauuuuugccaaaa

SEQ ID NO: 4122041 - RNA, 21 nt, Streptococcus pyogenes MGAS315
ucuucauagcuuaaugucaua

SEQ ID NO: 4122042 - RNA, 15 nt, Streptococcus pyogenes MGAS315
ucuucugcauuauca

SEQ ID NO: 4122043 - RNA, 23 nt, Streptococcus pyogenes MGAS315
ucuucuuuuuauuauacucaaua

SEQ ID NO: 4122044 - RNA, 22 nt, Streptococcus pyogenes MGAS315
ucuugaggugauucuuuuuuac

SEQ ID NO: 4122045 - RNA, 19 nt, Streptococcus pyogenes MGAS315
ucuugucgcugaauaaaca

SEQ ID NO: 4122046 - RNA, 22 nt, Streptococcus pyogenes MGAS315
ucuugugccuacuccucucaca

SEQ ID NO: 4122047 - RNA, 13 nt, Streptococcus pyogenes MGAS315
ucuuguuuugguu

SEQ ID NO: 4122048 - RNA, 14 nt, Streptococcus pyogenes MGAS315
ucuuuaccauuuau

SEQ ID NO: 4122049 - RNA, 19 nt, Streptococcus pyogenes MGAS315
ucuuucaguuguuuuaacu

SEQ ID NO: 4122050 - RNA, 15 nt, Streptococcus pyogenes MGAS315
ucuuugacaauguca

SEQ ID NO: 4122051 - RNA, 20 nt, Streptococcus pyogenes MGAS315
ucuuugcaggguaucugcuc

SEQ ID NO: 4122052 - RNA, 16 nt, Streptococcus pyogenes MGAS315
ucuuuguccauucuuu

SEQ ID NO: 4122053 - RNA, 13 nt, Streptococcus pyogenes MGAS315
ucuuuuaguucag

SEQ ID NO: 4122054 - RNA, 12 nt, Streptococcus pyogenes MGAS315
ucuuuuauuaau

SEQ ID NO: 4122055 - RNA, 17 nt, Streptococcus pyogenes MGAS315
ucuuuuuuacuuuuaaa

SEQ ID NO: 4122056 - RNA, 18 nt, Streptococcus pyogenes MGAS315
ugaaaaaaucgcccugga

SEQ ID NO: 4122057 - RNA, 16 nt, Streptococcus pyogenes MGAS315
ugaaaacguguauucu

SEQ ID NO: 4122058 - RNA, 23 nt, Streptococcus pyogenes MGAS315
ugaaaagaugcacacaaaucuuc

SEQ ID NO: 4122059 - RNA, 13 nt, Streptococcus pyogenes MGAS315
ugaaaauaaaaua

SEQ ID NO: 4122060 - RNA, 14 nt, Streptococcus pyogenes MGAS315
ugaaaauaucuuuu

SEQ ID NO: 4122061 - RNA, 17 nt, Streptococcus pyogenes MGAS315
ugaaaauaucuuuuuua

SEQ ID NO: 4122062 - RNA, 16 nt, Streptococcus pyogenes MGAS315
ugaaaguuccuuagca

SEQ ID NO: 4122063 - RNA, 20 nt, Streptococcus pyogenes MGAS315
ugaaaugugguaagaagaaa

SEQ ID NO: 4122064 - RNA, 18 nt, Streptococcus pyogenes MGAS315
ugaaauuccuuaaauuau

SEQ ID NO: 4122065 - RNA, 20 nt, Streptococcus pyogenes MGAS315
ugaaauuccuuaaauuauau

SEQ ID NO: 4122066 - RNA, 21 nt, Streptococcus pyogenes MGAS315
ugaaauuccuuaaauuauauu

SEQ ID NO: 4122067 - RNA, 19 nt, Streptococcus pyogenes MGAS315
ugaacaaaguuucaagugc

SEQ ID NO: 4122068 - RNA, 14 nt, Streptococcus pyogenes MGAS315
ugaaccgcuaaaac

SEQ ID NO: 4122069 - RNA, 23 nt, Streptococcus pyogenes MGAS315
ugaacgaagucaagggaauugcc

SEQ ID NO: 4122070 - RNA, 17 nt, Streptococcus pyogenes MGAS315
ugaauuauuaguaacca

SEQ ID NO: 4122071 - RNA, 15 nt, Streptococcus pyogenes MGAS315
ugaauugaaaaaaga

SEQ ID NO: 4122072 - RNA, 17 nt, Streptococcus pyogenes MGAS315
ugacaauuggugauuaa

SEQ ID NO: 4122073 - RNA, 18 nt, Streptococcus pyogenes MGAS315
ugacacucccgcuuuuaa

SEQ ID NO: 4122074 - RNA, 19 nt, Streptococcus pyogenes MGAS315
ugacagacaccaaaaaaag

SEQ ID NO: 4122075 - RNA, 20 nt, Streptococcus pyogenes MGAS315
ugacagacaccaaaaaaagc

SEQ ID NO: 4122076 - RNA, 16 nt, Streptococcus pyogenes MGAS315
ugacaguuaaaaauaa

SEQ ID NO: 4122077 - RNA, 17 nt, Streptococcus pyogenes MGAS315
ugacaguuaaaaauaac

SEQ ID NO: 4122078 - RNA, 21 nt, Streptococcus pyogenes MGAS315
ugacaguuaaaaauaacuuua

SEQ ID NO: 4122079 - RNA, 22 nt, Streptococcus pyogenes MGAS315
ugacauaucuucacgggcugcc

SEQ ID NO: 4122080 - RNA, 20 nt, Streptococcus pyogenes MGAS315
ugaccacaccuaauaaaaua

SEQ ID NO: 4122081 - RNA, 17 nt, Streptococcus pyogenes MGAS315
ugaccauuuuuacugua

SEQ ID NO: 4122082 - RNA, 22 nt, Streptococcus pyogenes MGAS315
ugacuaaaccugucccuaacca

SEQ ID NO: 4122083 - RNA, 20 nt, Streptococcus pyogenes MGAS315
ugacucugauccgaguuuug

SEQ ID NO: 4122084 - RNA, 15 nt, Streptococcus pyogenes MGAS315
ugacuugguuuaaua

SEQ ID NO: 4122085 - RNA, 16 nt, Streptococcus pyogenes MGAS315
ugacuuguuacaaaaa

SEQ ID NO: 4122086 - RNA, 19 nt, Streptococcus pyogenes MGAS315
ugacuuguuacaaaaaaca

SEQ ID NO: 4122087 - RNA, 15 nt, Streptococcus pyogenes MGAS315
ugagacaaguugccu

SEQ ID NO: 4122088 - RNA, 14 nt, Streptococcus pyogenes MGAS315
ugagauuaacugac

SEQ ID NO: 4122089 - RNA, 17 nt, Streptococcus pyogenes MGAS315
ugagauuaacugacaaa

SEQ ID NO: 4122090 - RNA, 21 nt, Streptococcus pyogenes MGAS315
ugagauuaacugacaaaaaaa

SEQ ID NO: 4122091 - RNA, 16 nt, Streptococcus pyogenes MGAS315
ugagcaaggcaagagg

SEQ ID NO: 4122092 - RNA, 14 nt, Streptococcus pyogenes MGAS315
ugaggcucugcuga

SEQ ID NO: 4122093 - RNA, 22 nt, Streptococcus pyogenes MGAS315
ugagguaaucguaaugucuugu

SEQ ID NO: 4122094 - RNA, 15 nt, Streptococcus pyogenes MGAS315
ugaggugacacuccc

SEQ ID NO: 4122095 - RNA, 16 nt, Streptococcus pyogenes MGAS315
ugaggugauucuuuuu

SEQ ID NO: 4122096 - RNA, 23 nt, Streptococcus pyogenes MGAS315
ugagucuuuaucguaaacaaucu

SEQ ID NO: 4122097 - RNA, 19 nt, Streptococcus pyogenes MGAS315
ugaguuuggugucaaucau

SEQ ID NO: 4122098 - RNA, 20 nt, Streptococcus pyogenes MGAS315
ugaguuuuuucuaaaagaga

SEQ ID NO: 4122099 - RNA, 20 nt, Streptococcus pyogenes MGAS315
ugauaaaggccuguauuucu

SEQ ID NO: 4122100 - RNA, 17 nt, Streptococcus pyogenes MGAS315
ugauaaaugucguugua

SEQ ID NO: 4122101 - RNA, 21 nt, Streptococcus pyogenes MGAS315
ugauaaucccuugcuuugauu

SEQ ID NO: 4122102 - RNA, 13 nt, Streptococcus pyogenes MGAS315
ugauauaaaauug

SEQ ID NO: 4122103 - RNA, 14 nt, Streptococcus pyogenes MGAS315
ugauauaaaauugg

SEQ ID NO: 4122104 - RNA, 16 nt, Streptococcus pyogenes MGAS315
ugauauuccuuuucca

SEQ ID NO: 4122105 - RNA, 23 nt, Streptococcus pyogenes MGAS315
ugauauuuuuucucaaaaauaua

SEQ ID NO: 4122106 - RNA, 21 nt, Streptococcus pyogenes MGAS315
ugaucuguuuaaaaacaaauu

SEQ ID NO: 4122107 - RNA, 20 nt, Streptococcus pyogenes MGAS315
ugaugaguaggcgaacuuua

SEQ ID NO: 4122108 - RNA, 21 nt, Streptococcus pyogenes MGAS315
ugaugauaaaggccuguauuu

SEQ ID NO: 4122109 - RNA, 22 nt, Streptococcus pyogenes MGAS315
ugaugauauuuuucauuaguua

SEQ ID NO: 4122110 - RNA, 18 nt, Streptococcus pyogenes MGAS315
ugaugcucucauaaacaa

SEQ ID NO: 4122111 - RNA, 16 nt, Streptococcus pyogenes MGAS315
ugauguaccaauuuaa

SEQ ID NO: 4122112 - RNA, 19 nt, Streptococcus pyogenes MGAS315
ugauuacugauaaacuuga

SEQ ID NO: 4122113 - RNA, 18 nt, Streptococcus pyogenes MGAS315
ugauucaucuugccauca

SEQ ID NO: 4122114 - RNA, 22 nt, Streptococcus pyogenes MGAS315
ugauucaucuugccaucagcau

SEQ ID NO: 4122115 - RNA, 18 nt, Streptococcus pyogenes MGAS315
ugauugauacaaagacuu

SEQ ID NO: 4122116 - RNA, 15 nt, Streptococcus pyogenes MGAS315
ugauugauuugucuu

SEQ ID NO: 4122117 - RNA, 23 nt, Streptococcus pyogenes MGAS315
ugauuuuucuuguuuugguugau

SEQ ID NO: 4122118 - RNA, 18 nt, Streptococcus pyogenes MGAS315
ugcaaaauuuuaaauguu

SEQ ID NO: 4122119 - RNA, 20 nt, Streptococcus pyogenes MGAS315
ugcacacaaaucuucuagaa

SEQ ID NO: 4122120 - RNA, 17 nt, Streptococcus pyogenes MGAS315
ugcaggguaucugcuca

SEQ ID NO: 4122121 - RNA, 13 nt, Streptococcus pyogenes MGAS315
ugcagguaauuau

SEQ ID NO: 4122122 - RNA, 12 nt, Streptococcus pyogenes MGAS315
ugccaacuuuuc

SEQ ID NO: 4122123 - RNA, 17 nt, Streptococcus pyogenes MGAS315
ugccaauuguucauuaa

SEQ ID NO: 4122124 - RNA, 22 nt, Streptococcus pyogenes MGAS315
ugccaguaaggaaaucaauccu

SEQ ID NO: 4122125 - RNA, 22 nt, Streptococcus pyogenes MGAS315
ugccaucaggcuuaaacauauu

SEQ ID NO: 4122126 - RNA, 19 nt, Streptococcus pyogenes MGAS315
ugccauggguaaaaugacu

SEQ ID NO: 4122127 - RNA, 16 nt, Streptococcus pyogenes MGAS315
ugccauuaauaauauu

SEQ ID NO: 4122128 - RNA, 16 nt, Streptococcus pyogenes MGAS315
ugccauuuaaaagggc

SEQ ID NO: 4122129 - RNA, 17 nt, Streptococcus pyogenes MGAS315
ugccauuuaaaagggca

SEQ ID NO: 4122130 - RNA, 14 nt, Streptococcus pyogenes MGAS315
ugccuuuucuuuuu

SEQ ID NO: 4122131 - RNA, 21 nt, Streptococcus pyogenes MGAS315
ugcgacacagauaagauacug

SEQ ID NO: 4122132 - RNA, 18 nt, Streptococcus pyogenes MGAS315
ugcgcgacuaaaaucaug

SEQ ID NO: 4122133 - RNA, 21 nt, Streptococcus pyogenes MGAS315
ugcucaaaacuucggccacgu

SEQ ID NO: 4122134 - RNA, 15 nt, Streptococcus pyogenes MGAS315
ugcucuggcuuuuuc

SEQ ID NO: 4122135 - RNA, 17 nt, Streptococcus pyogenes MGAS315
ugcucuggcuuuuuccu

SEQ ID NO: 4122136 - RNA, 19 nt, Streptococcus pyogenes MGAS315
ugcuguuggauacagucca

SEQ ID NO: 4122137 - RNA, 17 nt, Streptococcus pyogenes MGAS315
ugcuguuugucauacuc

SEQ ID NO: 4122138 - RNA, 18 nt, Streptococcus pyogenes MGAS315
uuacucaauuaauguuag

SEQ ID NO: 4122139 - RNA, 19 nt, Streptococcus pyogenes MGAS315
uuacuguauaaacuuguug

SEQ ID NO: 4122140 - RNA, 13 nt, Streptococcus pyogenes MGAS315
uuacuuuuaaaau

SEQ ID NO: 4122141 - RNA, 13 nt, Streptococcus pyogenes MGAS315
uuagaauaagaaa

SEQ ID NO: 4122142 - RNA, 15 nt, Streptococcus pyogenes MGAS315
uuagagucucuuaau

SEQ ID NO: 4122143 - RNA, 17 nt, Streptococcus pyogenes MGAS315
uuagcagacaaaaggga

SEQ ID NO: 4122144 - RNA, 14 nt, Streptococcus pyogenes MGAS315
uuagcauauuuuga

SEQ ID NO: 4122145 - RNA, 17 nt, Streptococcus pyogenes MGAS315
uuagccguccuuaaaag

SEQ ID NO: 4122146 - RNA, 19 nt, Streptococcus pyogenes MGAS315
uuagcgccagcauuugcca

SEQ ID NO: 4122147 - RNA, 15 nt, Streptococcus pyogenes MGAS315
uuagcuuuuuaaaga

SEQ ID NO: 4122148 - RNA, 21 nt, Streptococcus pyogenes MGAS315
uuaggaauauuacuucucaaa

SEQ ID NO: 4122149 - RNA, 20 nt, Streptococcus pyogenes MGAS315
uuaggaucuguuaauuuaug

SEQ ID NO: 4122150 - RNA, 21 nt, Streptococcus pyogenes MGAS315
uuaguaaagccuuauccauuc

SEQ ID NO: 4122151 - RNA, 15 nt, Streptococcus pyogenes MGAS315
uuaguuaauaagaca

SEQ ID NO: 4122152 - RNA, 12 nt, Streptococcus pyogenes MGAS315
uuaguuuuuaaa

SEQ ID NO: 4122153 - RNA, 18 nt, Streptococcus pyogenes MGAS315
uuauaaagaaacaaaaau

SEQ ID NO: 4122154 - RNA, 23 nt, Streptococcus pyogenes MGAS315
uuauaaaguuuucucagagacaa

SEQ ID NO: 4122155 - RNA, 15 nt, Streptococcus pyogenes MGAS315
uuauaagagaaguaa

SEQ ID NO: 4122156 - RNA, 23 nt, Streptococcus pyogenes MGAS315
uuauaauuugacuucaaaaauac

SEQ ID NO: 4122157 - RNA, 20 nt, Streptococcus pyogenes MGAS315
uuauaugucaucaaaagacc

SEQ ID NO: 4122158 - RNA, 20 nt, Streptococcus pyogenes MGAS315
uuaucaacaaucuuaaaaua

SEQ ID NO: 4122159 - RNA, 22 nt, Streptococcus pyogenes MGAS315
uuaucaacaaucuuaaaauaau

SEQ ID NO: 4122160 - RNA, 12 nt, Streptococcus pyogenes MGAS315
uuaucaguauac

SEQ ID NO: 4122161 - RNA, 13 nt, Streptococcus pyogenes MGAS315
uuauccauucuua

SEQ ID NO: 4122162 - RNA, 15 nt, Streptococcus pyogenes MGAS315
uuauccuuuacugua

SEQ ID NO: 4122163 - RNA, 17 nt, Streptococcus pyogenes MGAS315
uuaucuaaaggagcuuu

SEQ ID NO: 4122164 - RNA, 18 nt, Streptococcus pyogenes MGAS315
uuaucugauauuucaucu

SEQ ID NO: 4122165 - RNA, 21 nt, Streptococcus pyogenes MGAS315
uuaugauuugucaaaaaguaa

SEQ ID NO: 4122166 - RNA, 17 nt, Streptococcus pyogenes MGAS315
uuauuaaagacaaaaaa

SEQ ID NO: 4122167 - RNA, 18 nt, Streptococcus pyogenes MGAS315
uuauuaaccaauuccucc

SEQ ID NO: 4122168 - RNA, 17 nt, Streptococcus pyogenes MGAS315
uuauuaagauaccaaau

SEQ ID NO: 4122169 - RNA, 14 nt, Streptococcus pyogenes MGAS315
uuauuuuugagaua

SEQ ID NO: 4122170 - RNA, 18 nt, Streptococcus pyogenes MGAS315
uucaaagggagauucuua

SEQ ID NO: 4122171 - RNA, 18 nt, Streptococcus pyogenes MGAS315
uucaagagucaaaccagu

SEQ ID NO: 4122172 - RNA, 14 nt, Streptococcus pyogenes MGAS315
uucaagugcuagau

SEQ ID NO: 4122173 - RNA, 19 nt, Streptococcus pyogenes MGAS315
uucaauaauaccauuuuua

SEQ ID NO: 4122174 - RNA, 15 nt, Streptococcus pyogenes MGAS315
uucaauauuuuauua

SEQ ID NO: 4122175 - RNA, 19 nt, Streptococcus pyogenes MGAS315
uucaauauuuuauuaauaa

SEQ ID NO: 4122176 - RNA, 21 nt, Streptococcus pyogenes MGAS315
uucaauauuuuauuaauaagu

SEQ ID NO: 4122177 - RNA, 19 nt, Streptococcus pyogenes MGAS315
uucacuauaauuucaauaa

SEQ ID NO: 4122178 - RNA, 21 nt, Streptococcus pyogenes MGAS315
uucacuauaauuucaauaaua

SEQ ID NO: 4122179 - RNA, 23 nt, Streptococcus pyogenes MGAS315
uucagauaaaaccuucaaaaaag

SEQ ID NO: 4122180 - RNA, 19 nt, Streptococcus pyogenes MGAS315
uucauauaagcaaucauca

SEQ ID NO: 4122181 - RNA, 15 nt, Streptococcus pyogenes MGAS315
uucaucuugcauuac

SEQ ID NO: 4122182 - RNA, 19 nt, Streptococcus pyogenes MGAS315
uucaugacgccuccaaaua

SEQ ID NO: 4122183 - RNA, 19 nt, Streptococcus pyogenes MGAS315
uucaugauguuauuaaaua

SEQ ID NO: 4122184 - RNA, 13 nt, Streptococcus pyogenes MGAS315
uucauuaguuaau

SEQ ID NO: 4122185 - RNA, 19 nt, Streptococcus pyogenes MGAS315
uucccaaugccccaaagua

SEQ ID NO: 4122186 - RNA, 14 nt, Streptococcus pyogenes MGAS315
uucccauguuuuau

SEQ ID NO: 4122187 - RNA, 13 nt, Streptococcus pyogenes MGAS315
uuccuacaaaaua

SEQ ID NO: 4122188 - RNA, 14 nt, Streptococcus pyogenes MGAS315
uuccuacaaaauaa

SEQ ID NO: 4122189 - RNA, 16 nt, Streptococcus pyogenes MGAS315
uuccuuguacaagagc

SEQ ID NO: 4122190 - RNA, 14 nt, Streptococcus pyogenes MGAS315
uuccuuuuccaacg

SEQ ID NO: 4122191 - RNA, 11 nt, Streptococcus pyogenes MGAS315
uucgcacagcg

SEQ ID NO: 4122192 - RNA, 19 nt, Streptococcus pyogenes MGAS315
uucguaaggguuauuauuu

SEQ ID NO: 4122193 - RNA, 17 nt, Streptococcus pyogenes MGAS315
uucgucaagcaccuuga

SEQ ID NO: 4122194 - RNA, 18 nt, Streptococcus pyogenes MGAS315
uucguugacaaagccauu

SEQ ID NO: 4122195 - RNA, 21 nt, Streptococcus pyogenes MGAS315
uucuagacccuagcauaaaag

SEQ ID NO: 4122196 - RNA, 19 nt, Streptococcus pyogenes MGAS315
uucuagguuaaaauagaag

SEQ ID NO: 4122197 - RNA, 12 nt, Streptococcus pyogenes MGAS315
uucucaaaaaua

SEQ ID NO: 4122198 - RNA, 18 nt, Streptococcus pyogenes MGAS315
uucucaaaaauauauucu

SEQ ID NO: 4122199 - RNA, 23 nt, Streptococcus pyogenes MGAS315
uucucucguuuuuuuagcgcuaa

SEQ ID NO: 4122200 - RNA, 19 nt, Streptococcus pyogenes MGAS315
uucucuuuggagaaauuca

SEQ ID NO: 4122201 - RNA, 16 nt, Streptococcus pyogenes MGAS315
uucugaaaauaaaaua

SEQ ID NO: 4122202 - RNA, 23 nt, Streptococcus pyogenes MGAS315
uucugaaaauaaaauauuuuucc

SEQ ID NO: 4122203 - RNA, 14 nt, Streptococcus pyogenes MGAS315
uucuggugcaaggc

SEQ ID NO: 4122204 - RNA, 22 nt, Streptococcus pyogenes MGAS315
uucuuaacgaucuauugacuug

SEQ ID NO: 4122205 - RNA, 14 nt, Streptococcus pyogenes MGAS315
uucuuauccauuau

SEQ ID NO: 4122206 - RNA, 16 nt, Streptococcus pyogenes MGAS315
uucuugaggugauucu

SEQ ID NO: 4122207 - RNA, 18 nt, Streptococcus pyogenes MGAS315
uucuugaggugauucuuu

SEQ ID NO: 4122208 - RNA, 20 nt, Streptococcus pyogenes MGAS315
uucuugaggugauucuuuuu

SEQ ID NO: 4122209 - RNA, 19 nt, Streptococcus pyogenes MGAS315
uucuugugcuaaucuaucu

SEQ ID NO: 4122210 - RNA, 23 nt, Streptococcus pyogenes MGAS315
uucuuuauuuugauauuuuuucu

SEQ ID NO: 4122211 - RNA, 13 nt, Streptococcus pyogenes MGAS315
uucuuuucagaga

SEQ ID NO: 4122212 - RNA, 13 nt, Streptococcus pyogenes MGAS315
uucuuuuuccguu

SEQ ID NO: 4122213 - RNA, 16 nt, Streptococcus pyogenes MGAS315
uucuuuuucguauacu

SEQ ID NO: 4122214 - RNA, 17 nt, Streptococcus pyogenes MGAS315
uugaauugaaaaaagac

SEQ ID NO: 4122215 - RNA, 18 nt, Streptococcus pyogenes MGAS315
uugacagacaccaaaaaa

SEQ ID NO: 4122216 - RNA, 15 nt, Streptococcus pyogenes MGAS315
uugaccacaccuaau

SEQ ID NO: 4122217 - RNA, 24 nt, Streptococcus pyogenes MGAS315
uugaccacaccuaauaaaauagca

SEQ ID NO: 4122218 - RNA, 14 nt, Streptococcus pyogenes MGAS315
uugacuauuuuucg

SEQ ID NO: 4122219 - RNA, 15 nt, Streptococcus pyogenes MGAS315
uugacuucaaaaaua

SEQ ID NO: 4122220 - RNA, 21 nt, Streptococcus pyogenes MGAS315
uugacuugguucugaaaauaa

SEQ ID NO: 4122221 - RNA, 19 nt, Streptococcus pyogenes MGAS315
uugagauaacucuucggua

SEQ ID NO: 4122222 - RNA, 13 nt, Streptococcus pyogenes MGAS315
uugauauaaaauu

SEQ ID NO: 4122223 - RNA, 23 nt, Streptococcus pyogenes MGAS315
uugauauuuuuucucaaaaauau

SEQ ID NO: 4122224 - RNA, 20 nt, Streptococcus pyogenes MGAS315
uugaugagcgguuuugucuu

SEQ ID NO: 4122225 - RNA, 17 nt, Streptococcus pyogenes MGAS315
uugauuacugauaaacu

SEQ ID NO: 4122226 - RNA, 18 nt, Streptococcus pyogenes MGAS315
uugauugccauuuaauug

SEQ ID NO: 4122227 - RNA, 14 nt, Streptococcus pyogenes MGAS315
uugcaagucucuug

SEQ ID NO: 4122228 - RNA, 22 nt, Streptococcus pyogenes MGAS315
uugcaauagagccaagauuuua

SEQ ID NO: 4122229 - RNA, 17 nt, Streptococcus pyogenes MGAS315
uugcauggguaugccug

SEQ ID NO: 4122230 - RNA, 20 nt, Streptococcus pyogenes MGAS315
uugccaucagcaucugaaaa

SEQ ID NO: 4122231 - RNA, 17 nt, Streptococcus pyogenes MGAS315
uugccauuaauaauauu

SEQ ID NO: 4122232 - RNA, 18 nt, Streptococcus pyogenes MGAS315
uugccugaaauauaaccu

SEQ ID NO: 4122233 - RNA, 15 nt, Streptococcus pyogenes MGAS315
uugcuuaaugaccuu

SEQ ID NO: 4122234 - RNA, 20 nt, Streptococcus pyogenes MGAS315
uugcuuaaugaccuuugaua

SEQ ID NO: 4122235 - RNA, 18 nt, Streptococcus pyogenes MGAS315
uugcuuuugauaccuuuu

SEQ ID NO: 4122236 - RNA, 17 nt, Streptococcus pyogenes MGAS315
uugcuuuuuucuaaccu

SEQ ID NO: 4122237 - RNA, 18 nt, Streptococcus pyogenes MGAS315
uuuuuggugucagcauaa

SEQ ID NO: 4122238 - RNA, 14 nt, Streptococcus pyogenes MGAS315
uuuuuguuuugccu

SEQ ID NO: 4122239 - RNA, 18 nt, Streptococcus pyogenes MGAS315
uuuuuuguauuacucaau

SEQ ID NO: 4122240 - RNA, 12 nt, Streptococcus pyogenes MGAS315
aaaaaaagcaau

SEQ ID NO: 4122241 - RNA, 11 nt, Streptococcus pyogenes MGAS315
aaaaaaccuuc

SEQ ID NO: 4122242 - RNA, 13 nt, Streptococcus pyogenes MGAS315
aaaaaagccagug

SEQ ID NO: 4122243 - RNA, 14 nt, Streptococcus pyogenes MGAS315
aaaaaauuaagaag

SEQ ID NO: 4122244 - RNA, 20 nt, Streptococcus pyogenes MGAS315
aaaaacaaauuguagggauu

SEQ ID NO: 4122245 - RNA, 18 nt, Streptococcus pyogenes MGAS315
aaaaacgaucaaaaaucu

SEQ ID NO: 4122246 - RNA, 19 nt, Streptococcus pyogenes MGAS315
aaaaacgaucaaaaaucuu

SEQ ID NO: 4122247 - RNA, 13 nt, Streptococcus pyogenes MGAS315
aaaaacucaaaaa

SEQ ID NO: 4122248 - RNA, 15 nt, Streptococcus pyogenes MGAS315
aaaaagcaaauugaa

SEQ ID NO: 4122249 - RNA, 12 nt, Streptococcus pyogenes MGAS315
aaaaagcaagca

SEQ ID NO: 4122250 - RNA, 17 nt, Streptococcus pyogenes MGAS315
aaaaaggcaaagaaagc

SEQ ID NO: 4122251 - RNA, 16 nt, Streptococcus pyogenes MGAS315
aaaaagggaagaagau

SEQ ID NO: 4122252 - RNA, 15 nt, Streptococcus pyogenes MGAS315
aaaaaguaaaaagca

SEQ ID NO: 4122253 - RNA, 18 nt, Streptococcus pyogenes MGAS315
aaaaaguaaaaucuuauu

SEQ ID NO: 4122254 - RNA, 15 nt, Streptococcus pyogenes MGAS315
aaaaauaacuuuaaa

SEQ ID NO: 4122255 - RNA, 22 nt, Streptococcus pyogenes MGAS315
aaaaauaaguauagcauaaaau

SEQ ID NO: 4122256 - RNA, 19 nt, Streptococcus pyogenes MGAS315
aaaaauacaauaaagcguu

SEQ ID NO: 4122257 - RNA, 14 nt, Streptococcus pyogenes MGAS315
aaaaauacuagaaa

SEQ ID NO: 4122258 - RNA, 17 nt, Streptococcus pyogenes MGAS315
aaaaauacuagaaaaag

SEQ ID NO: 4122259 - RNA, 18 nt, Streptococcus pyogenes MGAS315
aaaaauacuagaaaaagc

SEQ ID NO: 4122260 - RNA, 13 nt, Streptococcus pyogenes MGAS315
aaaaauauauucu

SEQ ID NO: 4122261 - RNA, 17 nt, Streptococcus pyogenes MGAS315
aaaacaauaacacagaa

SEQ ID NO: 4122262 - RNA, 20 nt, Streptococcus pyogenes MGAS315
aaaacaauaacacagaagcc

SEQ ID NO: 4122263 - RNA, 13 nt, Streptococcus pyogenes MGAS315
aaaacaccccaaa

SEQ ID NO: 4122264 - RNA, 15 nt, Streptococcus pyogenes MGAS315
aaaacaguuccaguu

SEQ ID NO: 4122265 - RNA, 15 nt, Streptococcus pyogenes MGAS315
aaaaccuucaaaaaa

SEQ ID NO: 4122266 - RNA, 21 nt, Streptococcus pyogenes MGAS315
aaaacgccacgcucaacuggc

SEQ ID NO: 4122267 - RNA, 14 nt, Streptococcus pyogenes MGAS315
aaaacucaaaaaau

SEQ ID NO: 4122268 - RNA, 15 nt, Streptococcus pyogenes MGAS315
aaaacuccagcugga

SEQ ID NO: 4122269 - RNA, 16 nt, Streptococcus pyogenes MGAS315
aaaacuucaaauuuca

SEQ ID NO: 4122270 - RNA, 22 nt, Streptococcus pyogenes MGAS315
aaaacuuuugacuugguuuaau

SEQ ID NO: 4122271 - RNA, 16 nt, Streptococcus pyogenes MGAS315
aaaagagagaaugaua

SEQ ID NO: 4122272 - RNA, 18 nt, Streptococcus pyogenes MGAS315
aaaagcaaauugaaaaaa

SEQ ID NO: 4122273 - RNA, 13 nt, Streptococcus pyogenes MGAS315
aaaagcaugggcu

SEQ ID NO: 4122274 - RNA, 18 nt, Streptococcus pyogenes MGAS315
aaaagcuaaguaaacuuc

SEQ ID NO: 4122275 - RNA, 15 nt, Streptococcus pyogenes MGAS315
aaaaguaaaaagcaa

SEQ ID NO: 4122276 - RNA, 18 nt, Streptococcus pyogenes MGAS315
aaaaguaaaaagcaaauu

SEQ ID NO: 4122277 - RNA, 18 nt, Streptococcus pyogenes MGAS315
aaaauaaacuuucaguua

SEQ ID NO: 4122278 - RNA, 14 nt, Streptococcus pyogenes MGAS315
aaaauaacuuuaaa

SEQ ID NO: 4122279 - RNA, 20 nt, Streptococcus pyogenes MGAS315
aaaauacaauaaagcguuga

SEQ ID NO: 4122280 - RNA, 16 nt, Streptococcus pyogenes MGAS315
aaaauacuagaaaaag

SEQ ID NO: 4122281 - RNA, 19 nt, Streptococcus pyogenes MGAS315
aaaauacuagaaaaagcaa

SEQ ID NO: 4122282 - RNA, 23 nt, Streptococcus pyogenes MGAS315
aaaauacuugcaucgcaaacaga

SEQ ID NO: 4122283 - RNA, 15 nt, Streptococcus pyogenes MGAS315
aaaaucauagacagg

SEQ ID NO: 4122284 - RNA, 14 nt, Streptococcus pyogenes MGAS315
aaaaucucgauugu

SEQ ID NO: 4122285 - RNA, 13 nt, Streptococcus pyogenes MGAS315
aaaaugaagcaaa

SEQ ID NO: 4122286 - RNA, 16 nt, Streptococcus pyogenes MGAS315
aaaaugccuccgacaa

SEQ ID NO: 4122287 - RNA, 17 nt, Streptococcus pyogenes MGAS315
aaaaugcuguuugucau

SEQ ID NO: 4122288 - RNA, 19 nt, Streptococcus pyogenes MGAS315
aaaauuuuuagacacaaaa

SEQ ID NO: 4122289 - RNA, 20 nt, Streptococcus pyogenes MGAS315
aaacaccaccaauaaugagc

SEQ ID NO: 4122290 - RNA, 20 nt, Streptococcus pyogenes MGAS315
aaacagaugcucaaacuaua

SEQ ID NO: 4122291 - RNA, 13 nt, Streptococcus pyogenes MGAS315
aaacauauuauag

SEQ ID NO: 4122292 - RNA, 22 nt, Streptococcus pyogenes MGAS315
aaaccaagugccaguaaggaaa

SEQ ID NO: 4122293 - RNA, 21 nt, Streptococcus pyogenes MGAS315
aaaccaguugauaccaugugc

SEQ ID NO: 4122294 - RNA, 16 nt, Streptococcus pyogenes MGAS315
aaaccuucaaaaaagg

SEQ ID NO: 4122295 - RNA, 16 nt, Streptococcus pyogenes MGAS315
aaacgccacgcucaac

SEQ ID NO: 4122296 - RNA, 20 nt, Streptococcus pyogenes MGAS315
aaacgcuauaccuaaaaaau

SEQ ID NO: 4122297 - RNA, 22 nt, Streptococcus pyogenes MGAS315
aaacguguauucuuaaaaaaau

SEQ ID NO: 4122298 - RNA, 22 nt, Streptococcus pyogenes MGAS315
aaacguuauuaaagacaaaaaa

SEQ ID NO: 4122299 - RNA, 13 nt, Streptococcus pyogenes MGAS315
aaacuauauuguu

SEQ ID NO: 4122300 - RNA, 18 nt, Streptococcus pyogenes MGAS315
aaacucaaaaaauacaau

SEQ ID NO: 4122301 - RNA, 21 nt, Streptococcus pyogenes MGAS315
aaacucaaaaaauacaauaaa

SEQ ID NO: 4122302 - RNA, 19 nt, Streptococcus pyogenes MGAS315
aaacucaaaccaaacaagc

SEQ ID NO: 4122303 - RNA, 16 nt, Streptococcus pyogenes MGAS315
aaacucuauacaaaaa

SEQ ID NO: 4122304 - RNA, 17 nt, Streptococcus pyogenes MGAS315
aaacucuauacaaaaag

SEQ ID NO: 4122305 - RNA, 14 nt, Streptococcus pyogenes MGAS315
aaacugagacaagu

SEQ ID NO: 4122306 - RNA, 16 nt, Streptococcus pyogenes MGAS315
aaacuggucaaaagcu

SEQ ID NO: 4122307 - RNA, 16 nt, Streptococcus pyogenes MGAS315
aaacuuucaguuaucu

SEQ ID NO: 4122308 - RNA, 13 nt, Streptococcus pyogenes MGAS315
aaacuuuugacuu

SEQ ID NO: 4122309 - RNA, 17 nt, Streptococcus pyogenes MGAS315
aaagacacacaacaccg

SEQ ID NO: 4122310 - RNA, 19 nt, Streptococcus pyogenes MGAS315
aaagaccccccuagacugu

SEQ ID NO: 4122311 - RNA, 14 nt, Streptococcus pyogenes MGAS315
aaagacuucuuccu

SEQ ID NO: 4122312 - RNA, 13 nt, Streptococcus pyogenes MGAS315
aaagauauuuuaa

SEQ ID NO: 4122313 - RNA, 14 nt, Streptococcus pyogenes MGAS315
aaagauuuuaaaua

SEQ ID NO: 4122314 - RNA, 22 nt, Streptococcus pyogenes MGAS315
aaagcaaaaaagccagugcugc

SEQ ID NO: 4122315 - RNA, 18 nt, Streptococcus pyogenes MGAS315
aaagcaaauugaaaaaau

SEQ ID NO: 4122316 - RNA, 23 nt, Streptococcus pyogenes MGAS315
aaagcaagcaacacgcuaucaac

SEQ ID NO: 4122317 - RNA, 23 nt, Streptococcus pyogenes MGAS315
aaagccuacaacagcagcaguug

SEQ ID NO: 4122318 - RNA, 15 nt, Streptococcus pyogenes MGAS315
aaagcuaaacuaggc

SEQ ID NO: 4122319 - RNA, 17 nt, Streptococcus pyogenes MGAS315
aaagcuaaguaaacuuc

SEQ ID NO: 4122320 - RNA, 23 nt, Streptococcus pyogenes MGAS315
aaaggcuuuuuuguauuacucaa

SEQ ID NO: 4122321 - RNA, 20 nt, Streptococcus pyogenes MGAS315
aaagggauugcaaaaguuag

SEQ ID NO: 4122322 - RNA, 14 nt, Streptococcus pyogenes MGAS315
aaaguaaaaagcaa

SEQ ID NO: 4122323 - RNA, 15 nt, Streptococcus pyogenes MGAS315
aaaguaaaaagcaaa

SEQ ID NO: 4122324 - RNA, 23 nt, Streptococcus pyogenes MGAS315
aaaguaaaaauacuagaaaaagc

SEQ ID NO: 4122325 - RNA, 12 nt, Streptococcus pyogenes MGAS315
aaaguaaaaucu

SEQ ID NO: 4122326 - RNA, 17 nt, Streptococcus pyogenes MGAS315
aaaguaaaaucuuauuu

SEQ ID NO: 4122327 - RNA, 17 nt, Streptococcus pyogenes MGAS315
aaagugcgcuuccagaa

SEQ ID NO: 4122328 - RNA, 16 nt, Streptococcus pyogenes MGAS315
aaaguuagauuuugga

SEQ ID NO: 4122329 - RNA, 15 nt, Streptococcus pyogenes MGAS315
aaaguuauaaagaaa

SEQ ID NO: 4122330 - RNA, 15 nt, Streptococcus pyogenes MGAS315
aaaguuggcuacucu

SEQ ID NO: 4122331 - RNA, 11 nt, Streptococcus pyogenes MGAS315
aaaguuuucuc

SEQ ID NO: 4122332 - RNA, 16 nt, Streptococcus pyogenes MGAS315
aaaguuuucucagaga

SEQ ID NO: 4122333 - RNA, 16 nt, Streptococcus pyogenes MGAS315
aagagagguugguaaa

SEQ ID NO: 4122334 - RNA, 23 nt, Streptococcus pyogenes MGAS315
aagagagguugguaaaaaggcag

SEQ ID NO: 4122335 - RNA, 22 nt, Streptococcus pyogenes MGAS315
aagagcuuaaaaguuagccaag

SEQ ID NO: 4122336 - RNA, 17 nt, Streptococcus pyogenes MGAS315
aagagucaaaccaguug

SEQ ID NO: 4122337 - RNA, 19 nt, Streptococcus pyogenes MGAS315
aagagucauuugacuacua

SEQ ID NO: 4122338 - RNA, 17 nt, Streptococcus pyogenes MGAS315
aagauaccaaaucaaaa

SEQ ID NO: 4122339 - RNA, 20 nt, Streptococcus pyogenes MGAS315
aagauaccaaaucaaaaagc

SEQ ID NO: 4122340 - RNA, 17 nt, Streptococcus pyogenes MGAS315
aagauauuuuaaaauag

SEQ ID NO: 4122341 - RNA, 16 nt, Streptococcus pyogenes MGAS315
aagauccuacaagagg

SEQ ID NO: 4122342 - RNA, 19 nt, Streptococcus pyogenes MGAS315
aagaucugcacacacuuuu

SEQ ID NO: 4122343 - RNA, 19 nt, Streptococcus pyogenes MGAS315
aagauuaaacuuacaaaaa

SEQ ID NO: 4122344 - RNA, 17 nt, Streptococcus pyogenes MGAS315
aagcaaucuaagaauug

SEQ ID NO: 4122345 - RNA, 21 nt, Streptococcus pyogenes MGAS315
aagcaguuucccauguuuuau

SEQ ID NO: 4122346 - RNA, 13 nt, Streptococcus pyogenes MGAS315
aagcauaaaaaua

SEQ ID NO: 4122347 - RNA, 12 nt, Streptococcus pyogenes MGAS315
aagcauuuugag

SEQ ID NO: 4122348 - RNA, 14 nt, Streptococcus pyogenes MGAS315
aagccagugcugcu

SEQ ID NO: 4122349 - RNA, 16 nt, Streptococcus pyogenes MGAS315
aagccuacaacagcag

SEQ ID NO: 4122350 - RNA, 21 nt, Streptococcus pyogenes MGAS315
aagcguugacaguuaaaaaua

SEQ ID NO: 4122351 - RNA, 17 nt, Streptococcus pyogenes MGAS315
aagcuaucauacaacug

SEQ ID NO: 4122352 - RNA, 22 nt, Streptococcus pyogenes MGAS315
aagcuuggauugccgccaugcu

SEQ ID NO: 4122353 - RNA, 18 nt, Streptococcus pyogenes MGAS315
aagcuuuuuuauaacugu

SEQ ID NO: 4122354 - RNA, 18 nt, Streptococcus pyogenes MGAS315
aaggaccaagauucauga

SEQ ID NO: 4122355 - RNA, 17 nt, Streptococcus pyogenes MGAS315
aaggagcuuuaccuccu

SEQ ID NO: 4122356 - RNA, 13 nt, Streptococcus pyogenes MGAS315
aaggauuuaguuc

SEQ ID NO: 4122357 - RNA, 13 nt, Streptococcus pyogenes MGAS315
aaggcaaagaaag

SEQ ID NO: 4122358 - RNA, 15 nt, Streptococcus pyogenes MGAS315
aaggcaaagaaagcc

SEQ ID NO: 4122359 - RNA, 21 nt, Streptococcus pyogenes MGAS315
aaggcaauccaaaucaacaug

SEQ ID NO: 4122360 - RNA, 16 nt, Streptococcus pyogenes MGAS315
aaggcugcgaugauuu

SEQ ID NO: 4122361 - RNA, 22 nt, Streptococcus pyogenes MGAS315
aaggcuuguucuuuauuuugau

SEQ ID NO: 4122362 - RNA, 14 nt, Streptococcus pyogenes MGAS315
aagggaagaagauc

SEQ ID NO: 4122363 - RNA, 23 nt, Streptococcus pyogenes MGAS315
aagggaagaagauccuacaagag

SEQ ID NO: 4122364 - RNA, 21 nt, Streptococcus pyogenes MGAS315
aagggugaaucguuacuccuu

SEQ ID NO: 4122365 - RNA, 14 nt, Streptococcus pyogenes MGAS315
aagguauuguucaa

SEQ ID NO: 4122366 - RNA, 17 nt, Streptococcus pyogenes MGAS315
aaggucauuagaauaag

SEQ ID NO: 4122367 - RNA, 16 nt, Streptococcus pyogenes MGAS315
aagguugcaagugaca

SEQ ID NO: 4122368 - RNA, 24 nt, Streptococcus pyogenes MGAS315
aaguaauaaguagcguacauggau

SEQ ID NO: 4122369 - RNA, 18 nt, Streptococcus pyogenes MGAS315
aaguaauguuuuuacauu

SEQ ID NO: 4122370 - RNA, 19 nt, Streptococcus pyogenes MGAS315
aaguagcguacauggaugc

SEQ ID NO: 4122371 - RNA, 18 nt, Streptococcus pyogenes MGAS315
aaguauuuuaugacaaau

SEQ ID NO: 4122372 - RNA, 18 nt, Streptococcus pyogenes MGAS315
aagucuaucugcagauuu

SEQ ID NO: 4122373 - RNA, 22 nt, Streptococcus pyogenes MGAS315
aagucuaucugcagauuuuaag

SEQ ID NO: 4122374 - RNA, 14 nt, Streptococcus pyogenes MGAS315
aagucucuugcaag

SEQ ID NO: 4122375 - RNA, 16 nt, Streptococcus pyogenes MGAS315
aagugagaacauguga

SEQ ID NO: 4122376 - RNA, 18 nt, Streptococcus pyogenes MGAS315
aagugccaguaaggaaau

SEQ ID NO: 4122377 - RNA, 22 nt, Streptococcus pyogenes MGAS315
aagugccaguaaggaaaucaau

SEQ ID NO: 4122378 - RNA, 11 nt, Streptococcus pyogenes MGAS315
aaguggauaca

SEQ ID NO: 4122379 - RNA, 23 nt, Streptococcus pyogenes MGAS315
aagugugacuaguuuauuacaaa

SEQ ID NO: 4122380 - RNA, 16 nt, Streptococcus pyogenes MGAS315
aaguuauaaagaaaca

SEQ ID NO: 4122381 - RNA, 20 nt, Streptococcus pyogenes MGAS315
aaguuauaaagaaacaaaaa

SEQ ID NO: 4122382 - RNA, 19 nt, Streptococcus pyogenes MGAS315
aaguuggcuacucuauuug

SEQ ID NO: 4122383 - RNA, 20 nt, Streptococcus pyogenes MGAS315
aaguuuucucagagacaaua

SEQ ID NO: 4122384 - RNA, 19 nt, Streptococcus pyogenes MGAS315
aauaaaaucguuauuaauu

SEQ ID NO: 4122385 - RNA, 17 nt, Streptococcus pyogenes MGAS315
aauaaagugcgcuucca

SEQ ID NO: 4122386 - RNA, 19 nt, Streptococcus pyogenes MGAS315
aauaaagugcgcuuccaga

SEQ ID NO: 4122387 - RNA, 18 nt, Streptococcus pyogenes MGAS315
aauaacagaaauuaauaa

SEQ ID NO: 4122388 - RNA, 20 nt, Streptococcus pyogenes MGAS315
aauaacaucuugauuguaag

SEQ ID NO: 4122389 - RNA, 24 nt, Streptococcus pyogenes MGAS315
aauaacccgucuuacaauuaauag

SEQ ID NO: 4122390 - RNA, 15 nt, Streptococcus pyogenes MGAS315
aauaacuuuaaaagg

SEQ ID NO: 4122391 - RNA, 23 nt, Streptococcus pyogenes MGAS315
aauaaguauagcauaaaauaguu

SEQ ID NO: 4122392 - RNA, 19 nt, Streptococcus pyogenes MGAS315
aauaaugccaucaaaaaaa

SEQ ID NO: 4122393 - RNA, 22 nt, Streptococcus pyogenes MGAS315
aauaaugccaucaaaaaaagac

SEQ ID NO: 4122394 - RNA, 13 nt, Streptococcus pyogenes MGAS315
aauaccauuuuua

SEQ ID NO: 4122395 - RNA, 19 nt, Streptococcus pyogenes MGAS315
aauacuagaaaaagcaaug

SEQ ID NO: 4122396 - RNA, 21 nt, Streptococcus pyogenes MGAS315
aauacuagaaaaagcaaugau

SEQ ID NO: 4122397 - RNA, 17 nt, Streptococcus pyogenes MGAS315
aauagaagacaagguga

SEQ ID NO: 4122398 - RNA, 16 nt, Streptococcus pyogenes MGAS315
aauagcaaugguuaaa

SEQ ID NO: 4122399 - RNA, 20 nt, Streptococcus pyogenes MGAS315
aauagcaaugguuaaaaaga

SEQ ID NO: 4122400 - RNA, 21 nt, Streptococcus pyogenes MGAS315
aauagcauugucaaauaaaau

SEQ ID NO: 4122401 - RNA, 24 nt, Streptococcus pyogenes MGAS315
aauagcgccagcaauuuucccauc

SEQ ID NO: 4122402 - RNA, 21 nt, Streptococcus pyogenes MGAS315
aauagcguaaagcaagggaaa

SEQ ID NO: 4122403 - RNA, 18 nt, Streptococcus pyogenes MGAS315
aauagguaaagauuuuaa

SEQ ID NO: 4122404 - RNA, 23 nt, Streptococcus pyogenes MGAS315
aauagguaaagauuuuaaauauc

SEQ ID NO: 4122405 - RNA, 20 nt, Streptococcus pyogenes MGAS315
aauaguucccuuaauaaacu

SEQ ID NO: 4122406 - RNA, 13 nt, Streptococcus pyogenes MGAS315
aauauaauaaaaa

SEQ ID NO: 4122407 - RNA, 16 nt, Streptococcus pyogenes MGAS315
aauauaauaaaaagca

SEQ ID NO: 4122408 - RNA, 18 nt, Streptococcus pyogenes MGAS315
aauaucgccaauaaaaaa

SEQ ID NO: 4122409 - RNA, 23 nt, Streptococcus pyogenes MGAS315
aauaucuuaccauuguagaguuu

SEQ ID NO: 4122410 - RNA, 12 nt, Streptococcus pyogenes MGAS315
aauaugauauaa

SEQ ID NO: 4122411 - RNA, 15 nt, Streptococcus pyogenes MGAS315
aauaugauauaaaaa

SEQ ID NO: 4122412 - RNA, 17 nt, Streptococcus pyogenes MGAS315
aauaugauauaaaaaug

SEQ ID NO: 4122413 - RNA, 21 nt, Streptococcus pyogenes MGAS315
aauauuauauuaaugauucaa

SEQ ID NO: 4122414 - RNA, 23 nt, Streptococcus pyogenes MGAS315
aauauugggacuguucagucuuc

SEQ ID NO: 4122415 - RNA, 14 nt, Streptococcus pyogenes MGAS315
aauauuuuauuaau

SEQ ID NO: 4122416 - RNA, 12 nt, Streptococcus pyogenes MGAS315
aaucaaaaaacu

SEQ ID NO: 4122417 - RNA, 22 nt, Streptococcus pyogenes MGAS315
aaucaaaaagcuaacaccauaa

SEQ ID NO: 4122418 - RNA, 20 nt, Streptococcus pyogenes MGAS315
aaucaacauggcuaaugaua

SEQ ID NO: 4122419 - RNA, 21 nt, Streptococcus pyogenes MGAS315
aaucccuugcuuugauuuuuc

SEQ ID NO: 4122420 - RNA, 17 nt, Streptococcus pyogenes MGAS315
aauccuuuugaaaaauu

SEQ ID NO: 4122421 - RNA, 22 nt, Streptococcus pyogenes MGAS315
aaucgugauugauugauacaaa

SEQ ID NO: 4122422 - RNA, 20 nt, Streptococcus pyogenes MGAS315
aaucguuacuccuuugacca

SEQ ID NO: 4122423 - RNA, 22 nt, Streptococcus pyogenes MGAS315
aaucuaagaauuggggcggcac

SEQ ID NO: 4122424 - RNA, 18 nt, Streptococcus pyogenes MGAS315
aaucuaucucguaauccu

SEQ ID NO: 4122425 - RNA, 20 nt, Streptococcus pyogenes MGAS315
aaucuaucucguaauccuug

SEQ ID NO: 4122426 - RNA, 17 nt, Streptococcus pyogenes MGAS315
aaucuucugcauuauca

SEQ ID NO: 4122427 - RNA, 22 nt, Streptococcus pyogenes MGAS315
aaucuuguggguuuugaacgaa

SEQ ID NO: 4122428 - RNA, 23 nt, Streptococcus pyogenes MGAS315
aaugaaacguuauuaaagacaaa

SEQ ID NO: 4122429 - RNA, 20 nt, Streptococcus pyogenes MGAS315
aaugaccugauuauuacaaa

SEQ ID NO: 4122430 - RNA, 19 nt, Streptococcus pyogenes MGAS315
accucucaugggcaaauaa

SEQ ID NO: 4122431 - RNA, 21 nt, Streptococcus pyogenes MGAS315
accuuaggcagacaauuauuu

SEQ ID NO: 4122432 - RNA, 22 nt, Streptococcus pyogenes MGAS315
accuuaggcagacaauuauuuu

SEQ ID NO: 4122433 - RNA, 23 nt, Streptococcus pyogenes MGAS315
accuuugauaagauauuguuaau

SEQ ID NO: 4122434 - RNA, 18 nt, Streptococcus pyogenes MGAS315
acgcauccguauuuuuua

SEQ ID NO: 4122435 - RNA, 16 nt, Streptococcus pyogenes MGAS315
acgccuccaaauacug

SEQ ID NO: 4122436 - RNA, 21 nt, Streptococcus pyogenes MGAS315
acgcgagcuauuggcagucca

SEQ ID NO: 4122437 - RNA, 14 nt, Streptococcus pyogenes MGAS315
acgcuguaauguug

SEQ ID NO: 4122438 - RNA, 20 nt, Streptococcus pyogenes MGAS315
acgggcugccauuugagcac

SEQ ID NO: 4122439 - RNA, 22 nt, Streptococcus pyogenes MGAS315
acggucauuaauaaaagauuuc

SEQ ID NO: 4122440 - RNA, 16 nt, Streptococcus pyogenes MGAS315
acguaaccaauuguug

SEQ ID NO: 4122441 - RNA, 12 nt, Streptococcus pyogenes MGAS315
acuaaaaucaug

SEQ ID NO: 4122442 - RNA, 16 nt, Streptococcus pyogenes MGAS315
acuaagguacggucau

SEQ ID NO: 4122443 - RNA, 13 nt, Streptococcus pyogenes MGAS315
acuagaaaaagca

SEQ ID NO: 4122444 - RNA, 15 nt, Streptococcus pyogenes MGAS315
acuagaaaaagcaau

SEQ ID NO: 4122445 - RNA, 17 nt, Streptococcus pyogenes MGAS315
acuagaaaaagcaauga

SEQ ID NO: 4122446 - RNA, 19 nt, Streptococcus pyogenes MGAS315
acuagaaaaagcaaugauu

SEQ ID NO: 4122447 - RNA, 17 nt, Streptococcus pyogenes MGAS315
acuagcacaaaaucauu

SEQ ID NO: 4122448 - RNA, 19 nt, Streptococcus pyogenes MGAS315
acuaggaaucgcuuuagga

SEQ ID NO: 4122449 - RNA, 22 nt, Streptococcus pyogenes MGAS315
acuauauuguuaguuuuauccc

SEQ ID NO: 4122450 - RNA, 19 nt, Streptococcus pyogenes MGAS315
acuauggcuucuaaaaaag

SEQ ID NO: 4122451 - RNA, 23 nt, Streptococcus pyogenes MGAS315
acuauggcuucuaaaaaaguuau

SEQ ID NO: 4122452 - RNA, 20 nt, Streptococcus pyogenes MGAS315
acuauugaaucuuguuuaac

SEQ ID NO: 4122453 - RNA, 12 nt, Streptococcus pyogenes MGAS315
acuauuuuguga

SEQ ID NO: 4122454 - RNA, 13 nt, Streptococcus pyogenes MGAS315
acuauuuugugac

SEQ ID NO: 4122455 - RNA, 14 nt, Streptococcus pyogenes MGAS315
acucaauugaaaga

SEQ ID NO: 4122456 - RNA, 14 nt, Streptococcus pyogenes MGAS315
acuccucucacaaa

SEQ ID NO: 4122457 - RNA, 18 nt, Streptococcus pyogenes MGAS315
acuccucucacaaauaca

SEQ ID NO: 4122458 - RNA, 13 nt, Streptococcus pyogenes MGAS315
acucguaagcauu

SEQ ID NO: 4122459 - RNA, 21 nt, Streptococcus pyogenes MGAS315
acucuaucaacucgacuccaa

SEQ ID NO: 4122460 - RNA, 15 nt, Streptococcus pyogenes MGAS315
acucuccaaaguucu

SEQ ID NO: 4122461 - RNA, 15 nt, Streptococcus pyogenes MGAS315
acucuucgguacuga

SEQ ID NO: 4122462 - RNA, 19 nt, Streptococcus pyogenes MGAS315
acugccauggguaaaauga

SEQ ID NO: 4122463 - RNA, 15 nt, Streptococcus pyogenes MGAS315
acuggcacaaacucu

SEQ ID NO: 4122464 - RNA, 18 nt, Streptococcus pyogenes MGAS315
acuggcauagaaauaguu

SEQ ID NO: 4122465 - RNA, 13 nt, Streptococcus pyogenes MGAS315
acuggucaaaagc

SEQ ID NO: 4122466 - RNA, 22 nt, Streptococcus pyogenes MGAS315
acuguaauauuuccuuuuaaag

SEQ ID NO: 4122467 - RNA, 15 nt, Streptococcus pyogenes MGAS315
acuuacaaaaagccu

SEQ ID NO: 4122468 - RNA, 15 nt, Streptococcus pyogenes MGAS315
acuuauuuuuuuaag

SEQ ID NO: 4122469 - RNA, 21 nt, Streptococcus pyogenes MGAS315
acuugaugguaauauugcuca

SEQ ID NO: 4122470 - RNA, 17 nt, Streptococcus pyogenes MGAS315
acuugcaucgcaaacag

SEQ ID NO: 4122471 - RNA, 22 nt, Streptococcus pyogenes MGAS315
acuugcaucgcaaacagaugcu

SEQ ID NO: 4122472 - RNA, 17 nt, Streptococcus pyogenes MGAS315
acuugguucugaaaaua

SEQ ID NO: 4122473 - RNA, 21 nt, Streptococcus pyogenes MGAS315
acuugguucugaaaauaaaau

SEQ ID NO: 4122474 - RNA, 14 nt, Streptococcus pyogenes MGAS315
acuuguaaaaugau

SEQ ID NO: 4122475 - RNA, 20 nt, Streptococcus pyogenes MGAS315
acuuguuaacaauaaguaua

SEQ ID NO: 4122476 - RNA, 15 nt, Streptococcus pyogenes MGAS315
acuuuaaacacuacc

SEQ ID NO: 4122477 - RNA, 17 nt, Streptococcus pyogenes MGAS315
acuuuauugaugauaaa

SEQ ID NO: 4122478 - RNA, 22 nt, Streptococcus pyogenes MGAS315
acuuuauugaugauaaaggccu

SEQ ID NO: 4122479 - RNA, 19 nt, Streptococcus pyogenes MGAS315
acuuugacagacaccaaaa

SEQ ID NO: 4122480 - RNA, 14 nt, Streptococcus pyogenes MGAS315
agaaaaagcaauga

SEQ ID NO: 4122481 - RNA, 14 nt, Streptococcus pyogenes MGAS315
agaaauuaauaaau

SEQ ID NO: 4122482 - RNA, 15 nt, Streptococcus pyogenes MGAS315
agaaauuaauaaauu

SEQ ID NO: 4122483 - RNA, 17 nt, Streptococcus pyogenes MGAS315
agaacagcugcuugaaa

SEQ ID NO: 4122484 - RNA, 17 nt, Streptococcus pyogenes MGAS315
agaacucuuauaauaaa

SEQ ID NO: 4122485 - RNA, 19 nt, Streptococcus pyogenes MGAS315
agaagacaaggugaauaua

SEQ ID NO: 4122486 - RNA, 20 nt, Streptococcus pyogenes MGAS315
agaagauccuacaagaggag

SEQ ID NO: 4122487 - RNA, 23 nt, Streptococcus pyogenes MGAS315
agaagauccuacaagaggaguug

SEQ ID NO: 4122488 - RNA, 14 nt, Streptococcus pyogenes MGAS315
agaagccaauuacu

SEQ ID NO: 4122489 - RNA, 14 nt, Streptococcus pyogenes MGAS315
agaagccucuucug

SEQ ID NO: 4122490 - RNA, 21 nt, Streptococcus pyogenes MGAS315
agaaugauaguaaacgaaaau

SEQ ID NO: 4122491 - RNA, 17 nt, Streptococcus pyogenes MGAS315
agacaaggugaauauaa

SEQ ID NO: 4122492 - RNA, 19 nt, Streptococcus pyogenes MGAS315
agacaaggugaauauaaga

SEQ ID NO: 4122493 - RNA, 14 nt, Streptococcus pyogenes MGAS315
agacaccaaaaaaa

SEQ ID NO: 4122494 - RNA, 15 nt, Streptococcus pyogenes MGAS315
agacaccaaaaaaag

SEQ ID NO: 4122495 - RNA, 19 nt, Streptococcus pyogenes MGAS315
agacaggagcuuguagcuu

SEQ ID NO: 4122496 - RNA, 23 nt, Streptococcus pyogenes MGAS315
agacaucgucgugccaccucuaa

SEQ ID NO: 4122497 - RNA, 23 nt, Streptococcus pyogenes MGAS315
agagaauuugaaacguuuaggau

SEQ ID NO: 4122498 - RNA, 22 nt, Streptococcus pyogenes MGAS315
agagacaauaaggucauuagaa

SEQ ID NO: 4122499 - RNA, 17 nt, Streptococcus pyogenes MGAS315
agagagguugguaaaaa

SEQ ID NO: 4122500 - RNA, 22 nt, Streptococcus pyogenes MGAS315
agagagguugguaaaaaggcag

SEQ ID NO: 4122501 - RNA, 18 nt, Streptococcus pyogenes MGAS315
agagauaaaaaguaaaau

SEQ ID NO: 4122502 - RNA, 17 nt, Streptococcus pyogenes MGAS315
agagguucgucaagcac

SEQ ID NO: 4122503 - RNA, 15 nt, Streptococcus pyogenes MGAS315
agagguugguaaaaa

SEQ ID NO: 4122504 - RNA, 19 nt, Streptococcus pyogenes MGAS315
agagguugguaaaaaggca

SEQ ID NO: 4122505 - RNA, 15 nt, Streptococcus pyogenes MGAS315
agaguacaaggcaau

SEQ ID NO: 4122506 - RNA, 16 nt, Streptococcus pyogenes MGAS315
agaguacaaggcaauc

SEQ ID NO: 4122507 - RNA, 19 nt, Streptococcus pyogenes MGAS315
agaguacaaggcaauccaa

SEQ ID NO: 4122508 - RNA, 13 nt, Streptococcus pyogenes MGAS315
agagucaaaccag

SEQ ID NO: 4122509 - RNA, 15 nt, Streptococcus pyogenes MGAS315
agagucaaaccaguu

SEQ ID NO: 4122510 - RNA, 16 nt, Streptococcus pyogenes MGAS315
agauaaacuacaccau

SEQ ID NO: 4122511 - RNA, 16 nt, Streptococcus pyogenes MGAS315
agauacgcuagcaucu

SEQ ID NO: 4122512 - RNA, 13 nt, Streptococcus pyogenes MGAS315
agauacuucugau

SEQ ID NO: 4122513 - RNA, 16 nt, Streptococcus pyogenes MGAS315
agauagucaaaaagac

SEQ ID NO: 4122514 - RNA, 20 nt, Streptococcus pyogenes MGAS315
agauauuguuaauauagucu

SEQ ID NO: 4122515 - RNA, 15 nt, Streptococcus pyogenes MGAS315
agaucugcacacacu

SEQ ID NO: 4122516 - RNA, 15 nt, Streptococcus pyogenes MGAS315
agaugacgguaaaua

SEQ ID NO: 4122517 - RNA, 18 nt, Streptococcus pyogenes MGAS315
agaugacgguaaauaaag

SEQ ID NO: 4122518 - RNA, 17 nt, Streptococcus pyogenes MGAS315
agauggguuagcucugu

SEQ ID NO: 4122519 - RNA, 18 nt, Streptococcus pyogenes MGAS315
agaugguuuugauuaaau

SEQ ID NO: 4122520 - RNA, 17 nt, Streptococcus pyogenes MGAS315
agauuaaacuuacaaaa

SEQ ID NO: 4122521 - RNA, 18 nt, Streptococcus pyogenes MGAS315
agauuaaacuuacaaaaa

SEQ ID NO: 4122522 - RNA, 19 nt, Streptococcus pyogenes MGAS315
agauuaaacuuacaaaaag

SEQ ID NO: 4122523 - RNA, 17 nt, Streptococcus pyogenes MGAS315
agauuaacugacaaaaa

SEQ ID NO: 4122524 - RNA, 16 nt, Streptococcus pyogenes MGAS315
agauucaauaugaaaa

SEQ ID NO: 4122525 - RNA, 13 nt, Streptococcus pyogenes MGAS315
agauuuuaaauau

SEQ ID NO: 4122526 - RNA, 14 nt, Streptococcus pyogenes MGAS315
agauuuuaagacaa

SEQ ID NO: 4122527 - RNA, 21 nt, Streptococcus pyogenes MGAS315
agcaaauagcaaugguuaaaa

SEQ ID NO: 4122528 - RNA, 19 nt, Streptococcus pyogenes MGAS315
agcaacacgcuaucaacag

SEQ ID NO: 4122529 - RNA, 15 nt, Streptococcus pyogenes MGAS315
auaacuguugucuca

SEQ ID NO: 4122530 - RNA, 23 nt, Streptococcus pyogenes MGAS315
auaagagaaguaauguuuuuaca

SEQ ID NO: 4122531 - RNA, 21 nt, Streptococcus pyogenes MGAS315
auaaguagcguacauggaugc

SEQ ID NO: 4122532 - RNA, 22 nt, Streptococcus pyogenes MGAS315
auaaguuuagaacuuuucaggu

SEQ ID NO: 4122533 - RNA, 13 nt, Streptococcus pyogenes MGAS315
auaauaaagugcg

SEQ ID NO: 4122534 - RNA, 18 nt, Streptococcus pyogenes MGAS315
auaaugccaucaaaaaaa

SEQ ID NO: 4122535 - RNA, 21 nt, Streptococcus pyogenes MGAS315
auaauuaguauauuguaauaa

SEQ ID NO: 4122536 - RNA, 15 nt, Streptococcus pyogenes MGAS315
auaauuuauuuuuca

SEQ ID NO: 4122537 - RNA, 16 nt, Streptococcus pyogenes MGAS315
auaauuuauuuuucau

SEQ ID NO: 4122538 - RNA, 18 nt, Streptococcus pyogenes MGAS315
auaauuugacuucaaaaa

SEQ ID NO: 4122539 - RNA, 22 nt, Streptococcus pyogenes MGAS315
auacaacuggcuagccaaaucu

SEQ ID NO: 4122540 - RNA, 12 nt, Streptococcus pyogenes MGAS315
auacagaaaaaa

SEQ ID NO: 4122541 - RNA, 20 nt, Streptococcus pyogenes MGAS315
auaccaaaucaaaaagcuaa

SEQ ID NO: 4122542 - RNA, 14 nt, Streptococcus pyogenes MGAS315
auacgguaaaaacu

SEQ ID NO: 4122543 - RNA, 14 nt, Streptococcus pyogenes MGAS315
auacuagaaaaagc

SEQ ID NO: 4122544 - RNA, 18 nt, Streptococcus pyogenes MGAS315
auacucaauauaauaaaa

SEQ ID NO: 4122545 - RNA, 23 nt, Streptococcus pyogenes MGAS315
auacugguacguugauugccauu

SEQ ID NO: 4122546 - RNA, 22 nt, Streptococcus pyogenes MGAS315
auacuggucaauggaaauuuua

SEQ ID NO: 4122547 - RNA, 21 nt, Streptococcus pyogenes MGAS315
auacuuuaaacacuaccuuaa

SEQ ID NO: 4122548 - RNA, 16 nt, Streptococcus pyogenes MGAS315
auacuuugguauucuu

SEQ ID NO: 4122549 - RNA, 20 nt, Streptococcus pyogenes MGAS315
auagaaacuuuuuauaagca

SEQ ID NO: 4122550 - RNA, 15 nt, Streptococcus pyogenes MGAS315
auagaauaaaaaaga

SEQ ID NO: 4122551 - RNA, 13 nt, Streptococcus pyogenes MGAS315
auagcauaaaaua

SEQ ID NO: 4122552 - RNA, 16 nt, Streptococcus pyogenes MGAS315
auagcauaaaauaguu

SEQ ID NO: 4122553 - RNA, 15 nt, Streptococcus pyogenes MGAS315
auagccuuuaucaac

SEQ ID NO: 4122554 - RNA, 23 nt, Streptococcus pyogenes MGAS315
auagccuuuaucaacuuguuaac

SEQ ID NO: 4122555 - RNA, 19 nt, Streptococcus pyogenes MGAS315
auagcguaaagcaagggaa

SEQ ID NO: 4122556 - RNA, 15 nt, Streptococcus pyogenes MGAS315
auagcugauuuguuu

SEQ ID NO: 4122557 - RNA, 22 nt, Streptococcus pyogenes MGAS315
auagcuuaaugucauacaaaaa

SEQ ID NO: 4122558 - RNA, 13 nt, Streptococcus pyogenes MGAS315
auagggguaauuu

SEQ ID NO: 4122559 - RNA, 17 nt, Streptococcus pyogenes MGAS315
auagguaaagauuuuaa

SEQ ID NO: 4122560 - RNA, 15 nt, Streptococcus pyogenes MGAS315
auaguaaacgaaaau

SEQ ID NO: 4122561 - RNA, 18 nt, Streptococcus pyogenes MGAS315
auaguaaccauugccauu

SEQ ID NO: 4122562 - RNA, 21 nt, Streptococcus pyogenes MGAS315
auaguuaacugguaaaguauu

SEQ ID NO: 4122563 - RNA, 15 nt, Streptococcus pyogenes MGAS315
auaguucccuuaaua

SEQ ID NO: 4122564 - RNA, 18 nt, Streptococcus pyogenes MGAS315
auauaaagucagacucaa

SEQ ID NO: 4122565 - RNA, 13 nt, Streptococcus pyogenes MGAS315
auauaaauuauua

SEQ ID NO: 4122566 - RNA, 19 nt, Streptococcus pyogenes MGAS315
auauaagcaaucaucauuu

SEQ ID NO: 4122567 - RNA, 23 nt, Streptococcus pyogenes MGAS315
auauaagcaaucaucauuuagcu

SEQ ID NO: 4122568 - RNA, 13 nt, Streptococcus pyogenes MGAS315
auauaauaaaaag

SEQ ID NO: 4122569 - RNA, 19 nt, Streptococcus pyogenes MGAS315
auauccauagaaauuguaa

SEQ ID NO: 4122570 - RNA, 19 nt, Streptococcus pyogenes MGAS315
auauccccuccuugcaaua

SEQ ID NO: 4122571 - RNA, 17 nt, Streptococcus pyogenes MGAS315
auaucgccaauaaaaaa

SEQ ID NO: 4122572 - RNA, 16 nt, Streptococcus pyogenes MGAS315
auaucuagaacagcug

SEQ ID NO: 4122573 - RNA, 16 nt, Streptococcus pyogenes MGAS315
auaucuuaccauugua

SEQ ID NO: 4122574 - RNA, 14 nt, Streptococcus pyogenes MGAS315
auaugauauaaaaa

SEQ ID NO: 4122575 - RNA, 14 nt, Streptococcus pyogenes MGAS315
auauuagcaaaaug

SEQ ID NO: 4122576 - RNA, 18 nt, Streptococcus pyogenes MGAS315
auauuaggauauggaaua

SEQ ID NO: 4122577 - RNA, 23 nt, Streptococcus pyogenes MGAS315
auauuauaguaaccauugccauu

SEQ ID NO: 4122578 - RNA, 22 nt, Streptococcus pyogenes MGAS315
auauugguugccugaaauauaa

SEQ ID NO: 4122579 - RNA, 23 nt, Streptococcus pyogenes MGAS315
auauuguuaauauagucugcaug

SEQ ID NO: 4122580 - RNA, 15 nt, Streptococcus pyogenes MGAS315
auauuuuaaaauagu

SEQ ID NO: 4122581 - RNA, 22 nt, Streptococcus pyogenes MGAS315
auauuuuaguugauauuuuuua

SEQ ID NO: 4122582 - RNA, 13 nt, Streptococcus pyogenes MGAS315
auauuuuauuaau

SEQ ID NO: 4122583 - RNA, 23 nt, Streptococcus pyogenes MGAS315
auauuuuggaucuucaacuacua

SEQ ID NO: 4122584 - RNA, 16 nt, Streptococcus pyogenes MGAS315
auauuuuuuaggaaua

SEQ ID NO: 4122585 - RNA, 16 nt, Streptococcus pyogenes MGAS315
auauuuuuucucaaaa

SEQ ID NO: 4122586 - RNA, 18 nt, Streptococcus pyogenes MGAS315
auauuuuuucucaaaaau

SEQ ID NO: 4122587 - RNA, 20 nt, Streptococcus pyogenes MGAS315
auauuuuuucucaaaaauau

SEQ ID NO: 4122588 - RNA, 19 nt, Streptococcus pyogenes MGAS315
aucaaaaaaagacacacaa

SEQ ID NO: 4122589 - RNA, 14 nt, Streptococcus pyogenes MGAS315
aucaaaaaaagcaa

SEQ ID NO: 4122590 - RNA, 15 nt, Streptococcus pyogenes MGAS315
aucaaaaaaagcaau

SEQ ID NO: 4122591 - RNA, 16 nt, Streptococcus pyogenes MGAS315
aucaaaaaaagcaaug

SEQ ID NO: 4122592 - RNA, 17 nt, Streptococcus pyogenes MGAS315
aucaaaaaaagcaauga

SEQ ID NO: 4122593 - RNA, 15 nt, Streptococcus pyogenes MGAS315
aucaaaagaccauaa

SEQ ID NO: 4122594 - RNA, 23 nt, Streptococcus pyogenes MGAS315
aucaaaccaagguauuuagccua

SEQ ID NO: 4122595 - RNA, 18 nt, Streptococcus pyogenes MGAS315
aucaaaggguguuuuuua

SEQ ID NO: 4122596 - RNA, 18 nt, Streptococcus pyogenes MGAS315
aucaacauggcuaaugau

SEQ ID NO: 4122597 - RNA, 18 nt, Streptococcus pyogenes MGAS315
aucaacuuguuaacaaua

SEQ ID NO: 4122598 - RNA, 17 nt, Streptococcus pyogenes MGAS315
aucaggcuuaaacauau

SEQ ID NO: 4122599 - RNA, 22 nt, Streptococcus pyogenes MGAS315
aucaguuaaugccaacuuuuca

SEQ ID NO: 4122600 - RNA, 22 nt, Streptococcus pyogenes MGAS315
aucauacaacuggcuagccaaa

SEQ ID NO: 4122601 - RNA, 16 nt, Streptococcus pyogenes MGAS315
aucauagacaggagcu

SEQ ID NO: 4122602 - RNA, 13 nt, Streptococcus pyogenes MGAS315
aucauauuuuaau

SEQ ID NO: 4122603 - RNA, 13 nt, Streptococcus pyogenes MGAS315
aucauuauccuuu

SEQ ID NO: 4122604 - RNA, 16 nt, Streptococcus pyogenes MGAS315
auccauuauaaaucuu

SEQ ID NO: 4122605 - RNA, 21 nt, Streptococcus pyogenes MGAS315
aucccuucauuuuacuauggc

SEQ ID NO: 4122606 - RNA, 13 nt, Streptococcus pyogenes MGAS315
auccguauuuuuu

SEQ ID NO: 4122607 - RNA, 11 nt, Streptococcus pyogenes MGAS315
auccuacugac

SEQ ID NO: 4122608 - RNA, 15 nt, Streptococcus pyogenes MGAS315
auccuccuaaauaua

SEQ ID NO: 4122609 - RNA, 12 nt, Streptococcus pyogenes MGAS315
auccucuuuuaa

SEQ ID NO: 4122610 - RNA, 22 nt, Streptococcus pyogenes MGAS315
auccuuuacuguaauauuuccu

SEQ ID NO: 4122611 - RNA, 14 nt, Streptococcus pyogenes MGAS315
aucgugauugauug

SEQ ID NO: 4122612 - RNA, 16 nt, Streptococcus pyogenes MGAS315
aucuagaacagcugcu

SEQ ID NO: 4122613 - RNA, 21 nt, Streptococcus pyogenes MGAS315
aucucaguuuuuuugauuuuc

SEQ ID NO: 4122614 - RNA, 13 nt, Streptococcus pyogenes MGAS315
aucugaauuauua

SEQ ID NO: 4122615 - RNA, 14 nt, Streptococcus pyogenes MGAS315
aucugcagauuuua

SEQ ID NO: 4122616 - RNA, 21 nt, Streptococcus pyogenes MGAS315
aucuguauauuuaauagcauu

SEQ ID NO: 4122617 - RNA, 23 nt, Streptococcus pyogenes MGAS315
aucuguuaauuuauguugaucac

SEQ ID NO: 4122618 - RNA, 15 nt, Streptococcus pyogenes MGAS315
aucuguuaugugaug

SEQ ID NO: 4122619 - RNA, 17 nt, Streptococcus pyogenes MGAS315
aucuguuuaaaaacaaa

SEQ ID NO: 4122620 - RNA, 13 nt, Streptococcus pyogenes MGAS315
aucuuauuuuaag

SEQ ID NO: 4122621 - RNA, 21 nt, Streptococcus pyogenes MGAS315
aucuuguggguuuugaacgaa

SEQ ID NO: 4122622 - RNA, 15 nt, Streptococcus pyogenes MGAS315
aucuuguuuaaccuc

SEQ ID NO: 4122623 - RNA, 18 nt, Streptococcus pyogenes MGAS315
augaaaacguguauucuu

SEQ ID NO: 4122624 - RNA, 23 nt, Streptococcus pyogenes MGAS315
augaaaacguguauucuuaaaaa

SEQ ID NO: 4122625 - RNA, 17 nt, Streptococcus pyogenes MGAS315
augaagcaaaauaaacu

SEQ ID NO: 4122626 - RNA, 18 nt, Streptococcus pyogenes MGAS315
augacgccuccaaauacu

SEQ ID NO: 4122627 - RNA, 16 nt, Streptococcus pyogenes MGAS315
auuuuacuauggcuuc

SEQ ID NO: 4122628 - RNA, 23 nt, Streptococcus pyogenes MGAS315
auuuuaguugauauuuuuuagga

SEQ ID NO: 4122629 - RNA, 22 nt, Streptococcus pyogenes MGAS315
auuuucuagguuaaaauagaag

SEQ ID NO: 4122630 - RNA, 11 nt, Streptococcus pyogenes MGAS315
auuuugguuga

SEQ ID NO: 4122631 - RNA, 17 nt, Streptococcus pyogenes MGAS315
auuuugguugauagaag

SEQ ID NO: 4122632 - RNA, 16 nt, Streptococcus pyogenes MGAS315
auuuuuucucaaaaau

SEQ ID NO: 4122633 - RNA, 13 nt, Streptococcus pyogenes MGAS315
caaaaaaagcaau

SEQ ID NO: 4122634 - RNA, 22 nt, Streptococcus pyogenes MGAS315
caaaaaacaagucuaucugcag

SEQ ID NO: 4122635 - RNA, 13 nt, Streptococcus pyogenes MGAS315
caaaaaagggaag

SEQ ID NO: 4122636 - RNA, 18 nt, Streptococcus pyogenes MGAS315
caaaaagccuauuuaaua

SEQ ID NO: 4122637 - RNA, 17 nt, Streptococcus pyogenes MGAS315
caaaaaggcuaagaugg

SEQ ID NO: 4122638 - RNA, 15 nt, Streptococcus pyogenes MGAS315
caaaaaguaaaaagc

SEQ ID NO: 4122639 - RNA, 16 nt, Streptococcus pyogenes MGAS315
caaaaaguaaaaagca

SEQ ID NO: 4122640 - RNA, 17 nt, Streptococcus pyogenes MGAS315
caaaaaguaaaaagcaa

SEQ ID NO: 4122641 - RNA, 23 nt, Streptococcus pyogenes MGAS315
caaaaauauauucuaauuuguga

SEQ ID NO: 4122642 - RNA, 18 nt, Streptococcus pyogenes MGAS315
caaaagaccauaaaaaac

SEQ ID NO: 4122643 - RNA, 21 nt, Streptococcus pyogenes MGAS315
caaaaucauagacaggagcuu

SEQ ID NO: 4122644 - RNA, 19 nt, Streptococcus pyogenes MGAS315
caaaauuauuauuuugcuu

SEQ ID NO: 4122645 - RNA, 15 nt, Streptococcus pyogenes MGAS315
caaacuauauuguua

SEQ ID NO: 4122646 - RNA, 20 nt, Streptococcus pyogenes MGAS315
caaacucugccaauuguuca

SEQ ID NO: 4122647 - RNA, 15 nt, Streptococcus pyogenes MGAS315
caaagacguuuuacu

SEQ ID NO: 4122648 - RNA, 23 nt, Streptococcus pyogenes MGAS315
caaagggagauucuuauccauua

SEQ ID NO: 4122649 - RNA, 16 nt, Streptococcus pyogenes MGAS315
caaauagcaaugguua

SEQ ID NO: 4122650 - RNA, 24 nt, Streptococcus pyogenes MGAS315
caaaucaacauggcuaaugauaag

SEQ ID NO: 4122651 - RNA, 14 nt, Streptococcus pyogenes MGAS315
caaauugaaaaaau

SEQ ID NO: 4122652 - RNA, 14 nt, Streptococcus pyogenes MGAS315
caaauuguuugauu

SEQ ID NO: 4122653 - RNA, 23 nt, Streptococcus pyogenes MGAS315
caaauuguuugauugauuugucu

SEQ ID NO: 4122654 - RNA, 15 nt, Streptococcus pyogenes MGAS315
caacaacccuugauu

SEQ ID NO: 4122655 - RNA, 19 nt, Streptococcus pyogenes MGAS315
caacaaguguuuugucuua

SEQ ID NO: 4122656 - RNA, 17 nt, Streptococcus pyogenes MGAS315
caacaaucuuaaaauaa

SEQ ID NO: 4122657 - RNA, 15 nt, Streptococcus pyogenes MGAS315
caacagcagcaguug

SEQ ID NO: 4122658 - RNA, 17 nt, Streptococcus pyogenes MGAS315
caacauggcuaaugaua

SEQ ID NO: 4122659 - RNA, 20 nt, Streptococcus pyogenes MGAS315
caacuguggguuaagagagg

SEQ ID NO: 4122660 - RNA, 16 nt, Streptococcus pyogenes MGAS315
caacuucuauaugugu

SEQ ID NO: 4122661 - RNA, 19 nt, Streptococcus pyogenes MGAS315
caacuucuauauguguaau

SEQ ID NO: 4122662 - RNA, 19 nt, Streptococcus pyogenes MGAS315
caacuuuucaauggucacu

SEQ ID NO: 4122663 - RNA, 16 nt, Streptococcus pyogenes MGAS315
caagacuaaagcauuu

SEQ ID NO: 4122664 - RNA, 20 nt, Streptococcus pyogenes MGAS315
caagagcaccgcgaauauga

SEQ ID NO: 4122665 - RNA, 19 nt, Streptococcus pyogenes MGAS315
caagagcuuaaaaguuagc

SEQ ID NO: 4122666 - RNA, 22 nt, Streptococcus pyogenes MGAS315
caagaggaggcaacuguggguu

SEQ ID NO: 4122667 - RNA, 15 nt, Streptococcus pyogenes MGAS315
caagaggaguugaac

SEQ ID NO: 4122668 - RNA, 19 nt, Streptococcus pyogenes MGAS315
caagagguucgucaagcac

SEQ ID NO: 4122669 - RNA, 21 nt, Streptococcus pyogenes MGAS315
caagagguucgucaagcaccu

SEQ ID NO: 4122670 - RNA, 16 nt, Streptococcus pyogenes MGAS315
caagagucaaaccagu

SEQ ID NO: 4122671 - RNA, 20 nt, Streptococcus pyogenes MGAS315
caaguccugcuuuugaugca

SEQ ID NO: 4122672 - RNA, 20 nt, Streptococcus pyogenes MGAS315
caagucguuuagcuuuuuca

SEQ ID NO: 4122673 - RNA, 22 nt, Streptococcus pyogenes MGAS315
caagugacaaccuuaaagaccc

SEQ ID NO: 4122674 - RNA, 16 nt, Streptococcus pyogenes MGAS315
caagugagaacaugug

SEQ ID NO: 4122675 - RNA, 23 nt, Streptococcus pyogenes MGAS315
caagugccaguaaggaaaucaau

SEQ ID NO: 4122676 - RNA, 22 nt, Streptococcus pyogenes MGAS315
caaguguuuugucuuauagaau

SEQ ID NO: 4122677 - RNA, 17 nt, Streptococcus pyogenes MGAS315
caauaaaaaagaagcaa

SEQ ID NO: 4122678 - RNA, 15 nt, Streptococcus pyogenes MGAS315
caauaacacagaagc

SEQ ID NO: 4122679 - RNA, 17 nt, Streptococcus pyogenes MGAS315
caauaauaccauuuuua

SEQ ID NO: 4122680 - RNA, 19 nt, Streptococcus pyogenes MGAS315
caauaauggcagagucauu

SEQ ID NO: 4122681 - RNA, 20 nt, Streptococcus pyogenes MGAS315
caauagcugcugcuaaagca

SEQ ID NO: 4122682 - RNA, 18 nt, Streptococcus pyogenes MGAS315
caauauaauaaaaagcag

SEQ ID NO: 4122683 - RNA, 16 nt, Streptococcus pyogenes MGAS315
caauauccauagaaau

SEQ ID NO: 4122684 - RNA, 22 nt, Streptococcus pyogenes MGAS315
caauauuuuauuaauaaguauu

SEQ ID NO: 4122685 - RNA, 21 nt, Streptococcus pyogenes MGAS315
caaucauacccgcguuaucuc

SEQ ID NO: 4122686 - RNA, 18 nt, Streptococcus pyogenes MGAS315
caaucaucauuuagcuga

SEQ ID NO: 4122687 - RNA, 14 nt, Streptococcus pyogenes MGAS315
caaucuuaaaauaa

SEQ ID NO: 4122688 - RNA, 17 nt, Streptococcus pyogenes MGAS315
caaucuuaaaauaauca

SEQ ID NO: 4122689 - RNA, 19 nt, Streptococcus pyogenes MGAS315
caaucuuaaguuagggucu

SEQ ID NO: 4122690 - RNA, 13 nt, Streptococcus pyogenes MGAS315
caaugccaucugc

SEQ ID NO: 4122691 - RNA, 13 nt, Streptococcus pyogenes MGAS315
caauggaaauuuu

SEQ ID NO: 4122692 - RNA, 15 nt, Streptococcus pyogenes MGAS315
caauggaaauuuuaa

SEQ ID NO: 4122693 - RNA, 21 nt, Streptococcus pyogenes MGAS315
caauggaaauuuuaaaugaca

SEQ ID NO: 4122694 - RNA, 16 nt, Streptococcus pyogenes MGAS315
caauggauauaacaac

SEQ ID NO: 4122695 - RNA, 15 nt, Streptococcus pyogenes MGAS315
caaugguuaaaaaga

SEQ ID NO: 4122696 - RNA, 20 nt, Streptococcus pyogenes MGAS315
caauuaauguuaggagcaca

SEQ ID NO: 4122697 - RNA, 21 nt, Streptococcus pyogenes MGAS315
cacaaauacagaaaaaagcuu

SEQ ID NO: 4122698 - RNA, 13 nt, Streptococcus pyogenes MGAS315
cacacaaaucuuc

SEQ ID NO: 4122699 - RNA, 17 nt, Streptococcus pyogenes MGAS315
cacacaaaucuucuaga

SEQ ID NO: 4122700 - RNA, 13 nt, Streptococcus pyogenes MGAS315
caccaagugcugc

SEQ ID NO: 4122701 - RNA, 14 nt, Streptococcus pyogenes MGAS315
caccaagugcugcc

SEQ ID NO: 4122702 - RNA, 10 nt, Streptococcus pyogenes MGAS315
caccaccaau

SEQ ID NO: 4122703 - RNA, 15 nt, Streptococcus pyogenes MGAS315
caccuacuaacaaca

SEQ ID NO: 4122704 - RNA, 20 nt, Streptococcus pyogenes MGAS315
caccuuagugguuugcaaau

SEQ ID NO: 4122705 - RNA, 19 nt, Streptococcus pyogenes MGAS315
cacgcucaacuggcacaaa

SEQ ID NO: 4122706 - RNA, 14 nt, Streptococcus pyogenes MGAS315
cacguuuuucaaug

SEQ ID NO: 4122707 - RNA, 13 nt, Streptococcus pyogenes MGAS315
cacuagaacucuu

SEQ ID NO: 4122708 - RNA, 20 nt, Streptococcus pyogenes MGAS315
cacuaggccuagcuuuuuac

SEQ ID NO: 4122709 - RNA, 15 nt, Streptococcus pyogenes MGAS315
cacugcagcaucaaa

SEQ ID NO: 4122710 - RNA, 15 nt, Streptococcus pyogenes MGAS315
cagaaaaaagcuugu

SEQ ID NO: 4122711 - RNA, 22 nt, Streptococcus pyogenes MGAS315
cagaaauuaauaaauuuuuguc

SEQ ID NO: 4122712 - RNA, 23 nt, Streptococcus pyogenes MGAS315
cagacaaaagggaagagagaagc

SEQ ID NO: 4122713 - RNA, 15 nt, Streptococcus pyogenes MGAS315
cagacaccaaaaaaa

SEQ ID NO: 4122714 - RNA, 13 nt, Streptococcus pyogenes MGAS315
cagacucgucuuu

SEQ ID NO: 4122715 - RNA, 16 nt, Streptococcus pyogenes MGAS315
cagacucgucuuuguc

SEQ ID NO: 4122716 - RNA, 19 nt, Streptococcus pyogenes MGAS315
cagaucauuaaauugauua

SEQ ID NO: 4122717 - RNA, 12 nt, Streptococcus pyogenes MGAS315
cagcaauuuguu

SEQ ID NO: 4122718 - RNA, 20 nt, Streptococcus pyogenes MGAS315
cagcaguugcgaucauaaau

SEQ ID NO: 4122719 - RNA, 14 nt, Streptococcus pyogenes MGAS315
cagcaucaaaacca

SEQ ID NO: 4122720 - RNA, 13 nt, Streptococcus pyogenes MGAS315
cagcuaaaagcau

SEQ ID NO: 4122721 - RNA, 15 nt, Streptococcus pyogenes MGAS315
cagcugcuugaaaag

SEQ ID NO: 4122722 - RNA, 16 nt, Streptococcus pyogenes MGAS315
cagcugcuugaaaaga

SEQ ID NO: 4122723 - RNA, 23 nt, Streptococcus pyogenes MGAS315
caggaggguuuuucuuuuggccu

SEQ ID NO: 4122724 - RNA, 14 nt, Streptococcus pyogenes MGAS315
cagguguuuaaaga

SEQ ID NO: 4122725 - RNA, 21 nt, Streptococcus pyogenes MGAS315
caguauaaccgccaucuaagc

SEQ ID NO: 4122726 - RNA, 21 nt, Streptococcus pyogenes MGAS315
cgauaauaaagugcgcuucca

SEQ ID NO: 4122727 - RNA, 17 nt, Streptococcus pyogenes MGAS315
cgauaaucuuugacaau

SEQ ID NO: 4122728 - RNA, 18 nt, Streptococcus pyogenes MGAS315
cgauuaaccguuccuguc

SEQ ID NO: 4122729 - RNA, 21 nt, Streptococcus pyogenes MGAS315
cgccaaaucuuguggguuuug

SEQ ID NO: 4122730 - RNA, 13 nt, Streptococcus pyogenes MGAS315
cgcccagaaauaa

SEQ ID NO: 4122731 - RNA, 18 nt, Streptococcus pyogenes MGAS315
cgccuaggaauaaaaugc

SEQ ID NO: 4122732 - RNA, 14 nt, Streptococcus pyogenes MGAS315
cgcuaaaacaguuc

SEQ ID NO: 4122733 - RNA, 19 nt, Streptococcus pyogenes MGAS315
cgcuauaccuaaaaaauaa

SEQ ID NO: 4122734 - RNA, 16 nt, Streptococcus pyogenes MGAS315
cgcuuuuaagcugagu

SEQ ID NO: 4122735 - RNA, 13 nt, Streptococcus pyogenes MGAS315
cgguaaaaacuca

SEQ ID NO: 4122736 - RNA, 21 nt, Streptococcus pyogenes MGAS315
cggucucuuuuuguuuugccu

SEQ ID NO: 4122737 - RNA, 17 nt, Streptococcus pyogenes MGAS315
cguaaagcaagggaaac

SEQ ID NO: 4122738 - RNA, 16 nt, Streptococcus pyogenes MGAS315
cguaacguaauagaau

SEQ ID NO: 4122739 - RNA, 12 nt, Streptococcus pyogenes MGAS315
cguaagccaaau

SEQ ID NO: 4122740 - RNA, 20 nt, Streptococcus pyogenes MGAS315
cguaaggguuauuauuuagg

SEQ ID NO: 4122741 - RNA, 19 nt, Streptococcus pyogenes MGAS315
cguaccagguuggguauuc

SEQ ID NO: 4122742 - RNA, 19 nt, Streptococcus pyogenes MGAS315
cguauaggugaguuuuuuc

SEQ ID NO: 4122743 - RNA, 23 nt, Streptococcus pyogenes MGAS315
cguauaggugaguuuuuucuaaa

SEQ ID NO: 4122744 - RNA, 13 nt, Streptococcus pyogenes MGAS315
cguauuuuuuaga

SEQ ID NO: 4122745 - RNA, 14 nt, Streptococcus pyogenes MGAS315
cgugacaaugugac

SEQ ID NO: 4122746 - RNA, 13 nt, Streptococcus pyogenes MGAS315
cguuaacaaaaau

SEQ ID NO: 4122747 - RNA, 12 nt, Streptococcus pyogenes MGAS315
cguuagcuuuuu

SEQ ID NO: 4122748 - RNA, 14 nt, Streptococcus pyogenes MGAS315
cguuauuaaagaca

SEQ ID NO: 4122749 - RNA, 17 nt, Streptococcus pyogenes MGAS315
cguuauuaaagacaaaa

SEQ ID NO: 4122750 - RNA, 19 nt, Streptococcus pyogenes MGAS315
cguuauuaaagacaaaaaa

SEQ ID NO: 4122751 - RNA, 17 nt, Streptococcus pyogenes MGAS315
cguucauauaagcaauc

SEQ ID NO: 4122752 - RNA, 16 nt, Streptococcus pyogenes MGAS315
cguucuguuuaaaaua

SEQ ID NO: 4122753 - RNA, 16 nt, Streptococcus pyogenes MGAS315
cguugauugccauuua

SEQ ID NO: 4122754 - RNA, 19 nt, Streptococcus pyogenes MGAS315
cguuuuguuguauuaugag

SEQ ID NO: 4122755 - RNA, 17 nt, Streptococcus pyogenes MGAS315
cuaaaagcauaaaaaua

SEQ ID NO: 4122756 - RNA, 23 nt, Streptococcus pyogenes MGAS315
cuaaaaucaugggaaaagcuaag

SEQ ID NO: 4122757 - RNA, 20 nt, Streptococcus pyogenes MGAS315
cuaaaccugucccuaaccac

SEQ ID NO: 4122758 - RNA, 12 nt, Streptococcus pyogenes MGAS315
cuaaaggagcuu

SEQ ID NO: 4122759 - RNA, 14 nt, Streptococcus pyogenes MGAS315
cuaaauauaaauua

SEQ ID NO: 4122760 - RNA, 20 nt, Streptococcus pyogenes MGAS315
cuaaauccuuuugaaaaauu

SEQ ID NO: 4122761 - RNA, 21 nt, Streptococcus pyogenes MGAS315
cuaaauccuuuugaaaaauua

SEQ ID NO: 4122762 - RNA, 23 nt, Streptococcus pyogenes MGAS315
cuaagaugguuuugauuaaaucu

SEQ ID NO: 4122763 - RNA, 22 nt, Streptococcus pyogenes MGAS315
cuaaucagacucgucuuugucc

SEQ ID NO: 4122764 - RNA, 20 nt, Streptococcus pyogenes MGAS315
cuaaugcugcaaaauuuuaa

SEQ ID NO: 4122765 - RNA, 12 nt, Streptococcus pyogenes MGAS315
cuacaaaauaac

SEQ ID NO: 4122766 - RNA, 12 nt, Streptococcus pyogenes MGAS315
cuagaaaaagca

SEQ ID NO: 4122767 - RNA, 16 nt, Streptococcus pyogenes MGAS315
cuagaaaaagcaauga

SEQ ID NO: 4122768 - RNA, 19 nt, Streptococcus pyogenes MGAS315
cuagaacucuuauaauaaa

SEQ ID NO: 4122769 - RNA, 20 nt, Streptococcus pyogenes MGAS315
cuagacccuagcauaaaaga

SEQ ID NO: 4122770 - RNA, 16 nt, Streptococcus pyogenes MGAS315
cuagauguuggaacuu

SEQ ID NO: 4122771 - RNA, 12 nt, Streptococcus pyogenes MGAS315
cuagcacaaaau

SEQ ID NO: 4122772 - RNA, 18 nt, Streptococcus pyogenes MGAS315
cuagcuuugucaacucga

SEQ ID NO: 4122773 - RNA, 21 nt, Streptococcus pyogenes MGAS315
cuagcuuuuuacaucaaaaaa

SEQ ID NO: 4122774 - RNA, 14 nt, Streptococcus pyogenes MGAS315
cuaggaauaaaaug

SEQ ID NO: 4122775 - RNA, 21 nt, Streptococcus pyogenes MGAS315
cuaggagggacugucaaaaaa

SEQ ID NO: 4122776 - RNA, 20 nt, Streptococcus pyogenes MGAS315
cuaggcguauaggugaguuu

SEQ ID NO: 4122777 - RNA, 15 nt, Streptococcus pyogenes MGAS315
cuagguuaaaauaga

SEQ ID NO: 4122778 - RNA, 13 nt, Streptococcus pyogenes MGAS315
cuagucuuuuuau

SEQ ID NO: 4122779 - RNA, 21 nt, Streptococcus pyogenes MGAS315
cuaguguguugucaaacauaa

SEQ ID NO: 4122780 - RNA, 18 nt, Streptococcus pyogenes MGAS315
cuauagaaaguaaaaaua

SEQ ID NO: 4122781 - RNA, 21 nt, Streptococcus pyogenes MGAS315
cuauagaaaguuauaaagaaa

SEQ ID NO: 4122782 - RNA, 16 nt, Streptococcus pyogenes MGAS315
cuaucauacaacuggc

SEQ ID NO: 4122783 - RNA, 19 nt, Streptococcus pyogenes MGAS315
cuaucucguaauccuugau

SEQ ID NO: 4122784 - RNA, 22 nt, Streptococcus pyogenes MGAS315
cuaucugcagauuuuaagacaa

SEQ ID NO: 4122785 - RNA, 20 nt, Streptococcus pyogenes MGAS315
cuaugauagccuuuaucaac

SEQ ID NO: 4122786 - RNA, 15 nt, Streptococcus pyogenes MGAS315
cuauggcuucuaaaa

SEQ ID NO: 4122787 - RNA, 17 nt, Streptococcus pyogenes MGAS315
cuauggcuucuaaaaaa

SEQ ID NO: 4122788 - RNA, 20 nt, Streptococcus pyogenes MGAS315
cuauguugcuuaaugaccuu

SEQ ID NO: 4122789 - RNA, 19 nt, Streptococcus pyogenes MGAS315
cuauucaauauuuuauuaa

SEQ ID NO: 4122790 - RNA, 21 nt, Streptococcus pyogenes MGAS315
cuauugaaucuuguuuaaccu

SEQ ID NO: 4122791 - RNA, 16 nt, Streptococcus pyogenes MGAS315
cuauugacuugguucu

SEQ ID NO: 4122792 - RNA, 16 nt, Streptococcus pyogenes MGAS315
cuauuuaacuuaucau

SEQ ID NO: 4122793 - RNA, 21 nt, Streptococcus pyogenes MGAS315
cuauuuaauaggcuuuuuuug

SEQ ID NO: 4122794 - RNA, 13 nt, Streptococcus pyogenes MGAS315
cucaauauaauaa

SEQ ID NO: 4122795 - RNA, 20 nt, Streptococcus pyogenes MGAS315
cucacuaggccuagcuuuuu

SEQ ID NO: 4122796 - RNA, 24 nt, Streptococcus pyogenes MGAS315
cucacuaggccuagcuuuuuacau

SEQ ID NO: 4122797 - RNA, 14 nt, Streptococcus pyogenes MGAS315
cucagagacaauaa

SEQ ID NO: 4122798 - RNA, 22 nt, Streptococcus pyogenes MGAS315
cucagagcuuuuuuuguuuugg

SEQ ID NO: 4122799 - RNA, 22 nt, Streptococcus pyogenes MGAS315
cucagucacugcagcaucaaaa

SEQ ID NO: 4122800 - RNA, 15 nt, Streptococcus pyogenes MGAS315
cucauaacaaauuua

SEQ ID NO: 4122801 - RNA, 19 nt, Streptococcus pyogenes MGAS315
cucauaacaaauuuauccu

SEQ ID NO: 4122802 - RNA, 20 nt, Streptococcus pyogenes MGAS315
cuccuaaauauaaauuauua

SEQ ID NO: 4122803 - RNA, 13 nt, Streptococcus pyogenes MGAS315
cuccuccaccaaa

SEQ ID NO: 4122804 - RNA, 21 nt, Streptococcus pyogenes MGAS315
cucgucuuuguccauucuuua

SEQ ID NO: 4122805 - RNA, 14 nt, Streptococcus pyogenes MGAS315
cucgugaauaauuu

SEQ ID NO: 4122806 - RNA, 17 nt, Streptococcus pyogenes MGAS315
cucuaacauguccaaau

SEQ ID NO: 4122807 - RNA, 14 nt, Streptococcus pyogenes MGAS315
cucuauacaaaaag

SEQ ID NO: 4122808 - RNA, 16 nt, Streptococcus pyogenes MGAS315
cucuauuugaaguaaa

SEQ ID NO: 4122809 - RNA, 13 nt, Streptococcus pyogenes MGAS315
cucucacaaauac

SEQ ID NO: 4122810 - RNA, 19 nt, Streptococcus pyogenes MGAS315
cucuggucuaccgcuagga

SEQ ID NO: 4122811 - RNA, 12 nt, Streptococcus pyogenes MGAS315
cucuuaauuuau

SEQ ID NO: 4122812 - RNA, 13 nt, Streptococcus pyogenes MGAS315
cucuuauaauaaa

SEQ ID NO: 4122813 - RNA, 14 nt, Streptococcus pyogenes MGAS315
cucuuauaauaaau

SEQ ID NO: 4122814 - RNA, 23 nt, Streptococcus pyogenes MGAS315
cucuucgguacugaacuuguccu

SEQ ID NO: 4122815 - RNA, 22 nt, Streptococcus pyogenes MGAS315
cucuugcaaggugcuuuuuuug

SEQ ID NO: 4122816 - RNA, 12 nt, Streptococcus pyogenes MGAS315
cugaaaauaaaa

SEQ ID NO: 4122817 - RNA, 14 nt, Streptococcus pyogenes MGAS315
cugaaaauaaaaua

SEQ ID NO: 4122818 - RNA, 15 nt, Streptococcus pyogenes MGAS315
cugaaauauaaccuc

SEQ ID NO: 4122819 - RNA, 21 nt, Streptococcus pyogenes MGAS315
cugaacugcucuggcuuuuuc

SEQ ID NO: 4122820 - RNA, 15 nt, Streptococcus pyogenes MGAS315
cugacaaaaaaagca

SEQ ID NO: 4122821 - RNA, 19 nt, Streptococcus pyogenes MGAS315
cugacaaaaaaagcaagca

SEQ ID NO: 4122822 - RNA, 23 nt, Streptococcus pyogenes MGAS315
cugacaaaacuucaaauuucaug

SEQ ID NO: 4122823 - RNA, 17 nt, Streptococcus pyogenes MGAS315
cugacuuaaauuuggag

SEQ ID NO: 4122824 - RNA, 14 nt, Streptococcus pyogenes MGAS315
cugaguaaaacaau

SEQ ID NO: 4122825 - RNA, 23 nt, Streptococcus pyogenes MGAS315
gaaaguuauagcuccuaaaacca

SEQ ID NO: 4122826 - RNA, 23 nt, Streptococcus pyogenes MGAS315
gaaauaucuuucaguuguuuuaa

SEQ ID NO: 4122827 - RNA, 22 nt, Streptococcus pyogenes MGAS315
gaaaugugguaagaagaaaaua

SEQ ID NO: 4122828 - RNA, 16 nt, Streptococcus pyogenes MGAS315
gaaauucaaauacuuc

SEQ ID NO: 4122829 - RNA, 17 nt, Streptococcus pyogenes MGAS315
gaaauuguaaccacagc

SEQ ID NO: 4122830 - RNA, 18 nt, Streptococcus pyogenes MGAS315
gaaauuguaaccacagca

SEQ ID NO: 4122831 - RNA, 16 nt, Streptococcus pyogenes MGAS315
gaaauuuuaaaugaca

SEQ ID NO: 4122832 - RNA, 12 nt, Streptococcus pyogenes MGAS315
gaacagcugcuu

SEQ ID NO: 4122833 - RNA, 21 nt, Streptococcus pyogenes MGAS315
gaaccaacuuggacgaaggcu

SEQ ID NO: 4122834 - RNA, 17 nt, Streptococcus pyogenes MGAS315
gaacuccuggauuaaau

SEQ ID NO: 4122835 - RNA, 12 nt, Streptococcus pyogenes MGAS315
gaacuuguccug

SEQ ID NO: 4122836 - RNA, 16 nt, Streptococcus pyogenes MGAS315
gaacuuuguucaucau

SEQ ID NO: 4122837 - RNA, 22 nt, Streptococcus pyogenes MGAS315
gaaggaacucuccaaaguucuu

SEQ ID NO: 4122838 - RNA, 15 nt, Streptococcus pyogenes MGAS315
gaaggcuuguucuuu

SEQ ID NO: 4122839 - RNA, 22 nt, Streptococcus pyogenes MGAS315
gaauagguaaagauuuuaaaua

SEQ ID NO: 4122840 - RNA, 23 nt, Streptococcus pyogenes MGAS315
gaaucgcuuuaggaauaucauga

SEQ ID NO: 4122841 - RNA, 20 nt, Streptococcus pyogenes MGAS315
gacaauaaggucauuagaau

SEQ ID NO: 4122842 - RNA, 23 nt, Streptococcus pyogenes MGAS315
gacaaucgaaaugauagcaccua

SEQ ID NO: 4122843 - RNA, 15 nt, Streptococcus pyogenes MGAS315
gacacagauaagaua

SEQ ID NO: 4122844 - RNA, 20 nt, Streptococcus pyogenes MGAS315
gacacucccgcuuuuaagcu

SEQ ID NO: 4122845 - RNA, 18 nt, Streptococcus pyogenes MGAS315
gacagacaccaaaaaaag

SEQ ID NO: 4122846 - RNA, 23 nt, Streptococcus pyogenes MGAS315
gacagacaccaaaaaaagcaugg

SEQ ID NO: 4122847 - RNA, 17 nt, Streptococcus pyogenes MGAS315
gacagcaaggaugaaau

SEQ ID NO: 4122848 - RNA, 20 nt, Streptococcus pyogenes MGAS315
gacauuucgugucuaaaaua

SEQ ID NO: 4122849 - RNA, 21 nt, Streptococcus pyogenes MGAS315
gaccucucaugggcaaauaaa

SEQ ID NO: 4122850 - RNA, 14 nt, Streptococcus pyogenes MGAS315
gaccuuugauaaga

SEQ ID NO: 4122851 - RNA, 19 nt, Streptococcus pyogenes MGAS315
gacuaaccugcauaucugc

SEQ ID NO: 4122852 - RNA, 13 nt, Streptococcus pyogenes MGAS315
gacuaaguccuuu

SEQ ID NO: 4122853 - RNA, 21 nt, Streptococcus pyogenes MGAS315
gacuaggaaucgcuuuaggaa

SEQ ID NO: 4122854 - RNA, 20 nt, Streptococcus pyogenes MGAS315
gacuauagaaaguaaaaaua

SEQ ID NO: 4122855 - RNA, 22 nt, Streptococcus pyogenes MGAS315
gacuguauccguaguaggcuga

SEQ ID NO: 4122856 - RNA, 17 nt, Streptococcus pyogenes MGAS315
gacuguauguaucaaga

SEQ ID NO: 4122857 - RNA, 14 nt, Streptococcus pyogenes MGAS315
gacuucaaaaauac

SEQ ID NO: 4122858 - RNA, 20 nt, Streptococcus pyogenes MGAS315
gacuugguucugaaaauaaa

SEQ ID NO: 4122859 - RNA, 16 nt, Streptococcus pyogenes MGAS315
gagaacaugugaauuc

SEQ ID NO: 4122860 - RNA, 17 nt, Streptococcus pyogenes MGAS315
gagaaguaauguuuuua

SEQ ID NO: 4122861 - RNA, 22 nt, Streptococcus pyogenes MGAS315
gagaaguaauguuuuuacauuu

SEQ ID NO: 4122862 - RNA, 22 nt, Streptococcus pyogenes MGAS315
gagacaaguugccuuaucucag

SEQ ID NO: 4122863 - RNA, 14 nt, Streptococcus pyogenes MGAS315
gagacaauaagguc

SEQ ID NO: 4122864 - RNA, 18 nt, Streptococcus pyogenes MGAS315
gagaccuuguagucuucg

SEQ ID NO: 4122865 - RNA, 16 nt, Streptococcus pyogenes MGAS315
gagagcuuaucaaggu

SEQ ID NO: 4122866 - RNA, 14 nt, Streptococcus pyogenes MGAS315
gagagguugguaaa

SEQ ID NO: 4122867 - RNA, 21 nt, Streptococcus pyogenes MGAS315
gagagguugguaaaaaggcag

SEQ ID NO: 4122868 - RNA, 17 nt, Streptococcus pyogenes MGAS315
gagcaaggcaagaggag

SEQ ID NO: 4122869 - RNA, 18 nt, Streptococcus pyogenes MGAS315
gagcacguuuucugguuu

SEQ ID NO: 4122870 - RNA, 14 nt, Streptococcus pyogenes MGAS315
gagcuauuggcagu

SEQ ID NO: 4122871 - RNA, 12 nt, Streptococcus pyogenes MGAS315
gagcucuuugag

SEQ ID NO: 4122872 - RNA, 21 nt, Streptococcus pyogenes MGAS315
gagcuuuaccuccuaaugcug

SEQ ID NO: 4122873 - RNA, 19 nt, Streptococcus pyogenes MGAS315
gagcuuuuuuuguuuuggc

SEQ ID NO: 4122874 - RNA, 21 nt, Streptococcus pyogenes MGAS315
gaggaguugaaccgcuaaaac

SEQ ID NO: 4122875 - RNA, 22 nt, Streptococcus pyogenes MGAS315
gaggugauacccgagcaacaaa

SEQ ID NO: 4122876 - RNA, 21 nt, Streptococcus pyogenes MGAS315
gaguaaaacaauaacacagaa

SEQ ID NO: 4122877 - RNA, 22 nt, Streptococcus pyogenes MGAS315
gaguagcuacugccucauuugc

SEQ ID NO: 4122878 - RNA, 19 nt, Streptococcus pyogenes MGAS315
gagucauuuaguuuagaua

SEQ ID NO: 4122879 - RNA, 14 nt, Streptococcus pyogenes MGAS315
gagucucuagucuu

SEQ ID NO: 4122880 - RNA, 22 nt, Streptococcus pyogenes MGAS315
gagucuuuaucguaaacaaucu

SEQ ID NO: 4122881 - RNA, 11 nt, Streptococcus pyogenes MGAS315
gaguuuugcug

SEQ ID NO: 4122882 - RNA, 12 nt, Streptococcus pyogenes MGAS315
gauaaaaaguaa

SEQ ID NO: 4122883 - RNA, 14 nt, Streptococcus pyogenes MGAS315
gauaaaacaaauaa

SEQ ID NO: 4122884 - RNA, 21 nt, Streptococcus pyogenes MGAS315
gauaaaaccuucaaaaaaggg

SEQ ID NO: 4122885 - RNA, 19 nt, Streptococcus pyogenes MGAS315
gauaaaggccuguauuucu

SEQ ID NO: 4122886 - RNA, 20 nt, Streptococcus pyogenes MGAS315
gauaagauacugcccuugau

SEQ ID NO: 4122887 - RNA, 14 nt, Streptococcus pyogenes MGAS315
gauaagugccauca

SEQ ID NO: 4122888 - RNA, 15 nt, Streptococcus pyogenes MGAS315
gauaauuuauuuuuc

SEQ ID NO: 4122889 - RNA, 21 nt, Streptococcus pyogenes MGAS315
gauaauuuauuuuucauuuga

SEQ ID NO: 4122890 - RNA, 20 nt, Streptococcus pyogenes MGAS315
gauacaguccaaacucaaac

SEQ ID NO: 4122891 - RNA, 14 nt, Streptococcus pyogenes MGAS315
gauaccuucauaga

SEQ ID NO: 4122892 - RNA, 13 nt, Streptococcus pyogenes MGAS315
gauaccuuuuuug

SEQ ID NO: 4122893 - RNA, 17 nt, Streptococcus pyogenes MGAS315
gauagcaagugagaaca

SEQ ID NO: 4122894 - RNA, 20 nt, Streptococcus pyogenes MGAS315
gauagucaaaaagacuucuu

SEQ ID NO: 4122895 - RNA, 21 nt, Streptococcus pyogenes MGAS315
gauauggaauagguaaagauu

SEQ ID NO: 4122896 - RNA, 23 nt, Streptococcus pyogenes MGAS315
gauauuuuuucucaaaaauauau

SEQ ID NO: 4122897 - RNA, 15 nt, Streptococcus pyogenes MGAS315
gaucugcacacacuu

SEQ ID NO: 4122898 - RNA, 18 nt, Streptococcus pyogenes MGAS315
gaugaaaugauuguuauu

SEQ ID NO: 4122899 - RNA, 23 nt, Streptococcus pyogenes MGAS315
gaugacuuguaaaaugauacuuu

SEQ ID NO: 4122900 - RNA, 17 nt, Streptococcus pyogenes MGAS315
gaugagacuaaccugca

SEQ ID NO: 4122901 - RNA, 15 nt, Streptococcus pyogenes MGAS315
gaugcacacaaaucu

SEQ ID NO: 4122902 - RNA, 18 nt, Streptococcus pyogenes MGAS315
gaugccauuuaaaagggc

SEQ ID NO: 4122903 - RNA, 20 nt, Streptococcus pyogenes MGAS315
gaugcugcuuaucucuugag

SEQ ID NO: 4122904 - RNA, 19 nt, Streptococcus pyogenes MGAS315
gauggacgucuucuuuuua

SEQ ID NO: 4122905 - RNA, 21 nt, Streptococcus pyogenes MGAS315
gaugguaauauugcucaagac

SEQ ID NO: 4122906 - RNA, 20 nt, Streptococcus pyogenes MGAS315
gauguaccaauuuaagguau

SEQ ID NO: 4122907 - RNA, 16 nt, Streptococcus pyogenes MGAS315
gauuacaagcauuuug

SEQ ID NO: 4122908 - RNA, 13 nt, Streptococcus pyogenes MGAS315
gauucaauaugaa

SEQ ID NO: 4122909 - RNA, 22 nt, Streptococcus pyogenes MGAS315
gauuuccucuaacauguccaaa

SEQ ID NO: 4122910 - RNA, 22 nt, Streptococcus pyogenes MGAS315
gauuugaccacaccuaauaaaa

SEQ ID NO: 4122911 - RNA, 18 nt, Streptococcus pyogenes MGAS315
gauuugccgcuacaccac

SEQ ID NO: 4122912 - RNA, 16 nt, Streptococcus pyogenes MGAS315
gauuugucaaaaagua

SEQ ID NO: 4122913 - RNA, 20 nt, Streptococcus pyogenes MGAS315
gauuuuaaauaucuuaccau

SEQ ID NO: 4122914 - RNA, 23 nt, Streptococcus pyogenes MGAS315
gauuuuuccuagcgggaacacuc

SEQ ID NO: 4122915 - RNA, 17 nt, Streptococcus pyogenes MGAS315
gcaaaaaagccagugcu

SEQ ID NO: 4122916 - RNA, 21 nt, Streptococcus pyogenes MGAS315
gcaaaaaagccagugcugcug

SEQ ID NO: 4122917 - RNA, 23 nt, Streptococcus pyogenes MGAS315
gcaaaaaagccagugcugcugaa

SEQ ID NO: 4122918 - RNA, 21 nt, Streptococcus pyogenes MGAS315
gcaaccuuaccuacugcugga

SEQ ID NO: 4122919 - RNA, 22 nt, Streptococcus pyogenes MGAS315
gcaacugcuaguugugccuuuu

SEQ ID NO: 4122920 - RNA, 16 nt, Streptococcus pyogenes MGAS315
gcaaggcuaaagccua

SEQ ID NO: 4122921 - RNA, 17 nt, Streptococcus pyogenes MGAS315
gcaagugagaacaugug

SEQ ID NO: 4122922 - RNA, 20 nt, Streptococcus pyogenes MGAS315
guauuuacugggucaacucc

SEQ ID NO: 4122923 - RNA, 13 nt, Streptococcus pyogenes MGAS315
guauuuuuuagag

SEQ ID NO: 4122924 - RNA, 19 nt, Streptococcus pyogenes MGAS315
gucaaaaaauuaagaagga

SEQ ID NO: 4122925 - RNA, 22 nt, Streptococcus pyogenes MGAS315
gucaaaaaauuaagaaggaacu

SEQ ID NO: 4122926 - RNA, 17 nt, Streptococcus pyogenes MGAS315
gucaaaagcuaaacuag

SEQ ID NO: 4122927 - RNA, 15 nt, Streptococcus pyogenes MGAS315
gucaacgaagauaau

SEQ ID NO: 4122928 - RNA, 23 nt, Streptococcus pyogenes MGAS315
gucaggggaauuuccuaauguaa

SEQ ID NO: 4122929 - RNA, 20 nt, Streptococcus pyogenes MGAS315
gucauacucaauagcugcug

SEQ ID NO: 4122930 - RNA, 22 nt, Streptococcus pyogenes MGAS315
gucaucaaaagaccauaaaaaa

SEQ ID NO: 4122931 - RNA, 22 nt, Streptococcus pyogenes MGAS315
gucaugaugccauuuaaaaggg

SEQ ID NO: 4122932 - RNA, 18 nt, Streptococcus pyogenes MGAS315
guccuaaccuuuuggcug

SEQ ID NO: 4122933 - RNA, 19 nt, Streptococcus pyogenes MGAS315
guccuaaccuuuuggcugu

SEQ ID NO: 4122934 - RNA, 21 nt, Streptococcus pyogenes MGAS315
guccuaaccuuuuggcuguau

SEQ ID NO: 4122935 - RNA, 18 nt, Streptococcus pyogenes MGAS315
guccuuaaaagaaaaucu

SEQ ID NO: 4122936 - RNA, 20 nt, Streptococcus pyogenes MGAS315
gucgaaauugguccucugaa

SEQ ID NO: 4122937 - RNA, 12 nt, Streptococcus pyogenes MGAS315
gucgacuucaac

SEQ ID NO: 4122938 - RNA, 21 nt, Streptococcus pyogenes MGAS315
gucgcagaguacaaggcaauc

SEQ ID NO: 4122939 - RNA, 15 nt, Streptococcus pyogenes MGAS315
gucgccaaaucuugu

SEQ ID NO: 4122940 - RNA, 16 nt, Streptococcus pyogenes MGAS315
gucguuuagcuuuuuc

SEQ ID NO: 4122941 - RNA, 17 nt, Streptococcus pyogenes MGAS315
gucguuuagcuuuuuca

SEQ ID NO: 4122942 - RNA, 14 nt, Streptococcus pyogenes MGAS315
gucuaccgcuagga

SEQ ID NO: 4122943 - RNA, 14 nt, Streptococcus pyogenes MGAS315
gucugagugacuaa

SEQ ID NO: 4122944 - RNA, 17 nt, Streptococcus pyogenes MGAS315
gucugcaugaagugguu

SEQ ID NO: 4122945 - RNA, 18 nt, Streptococcus pyogenes MGAS315
gucugcgcgacuaaaauc

SEQ ID NO: 4122946 - RNA, 15 nt, Streptococcus pyogenes MGAS315
gucuuauagaauaac

SEQ ID NO: 4122947 - RNA, 18 nt, Streptococcus pyogenes MGAS315
gucuucuccgacugcagu

SEQ ID NO: 4122948 - RNA, 19 nt, Streptococcus pyogenes MGAS315
gugacacucccgcuuuuaa

SEQ ID NO: 4122949 - RNA, 15 nt, Streptococcus pyogenes MGAS315
gugagaacaugugaa

SEQ ID NO: 4122950 - RNA, 21 nt, Streptococcus pyogenes MGAS315
gugaugaguaggcgaacuuua

SEQ ID NO: 4122951 - RNA, 20 nt, Streptococcus pyogenes MGAS315
gugaugcucucauaaacaau

SEQ ID NO: 4122952 - RNA, 19 nt, Streptococcus pyogenes MGAS315
gugcaacugcuaguugugc

SEQ ID NO: 4122953 - RNA, 21 nt, Streptococcus pyogenes MGAS315
gugccaguaaggaaaucaauc

SEQ ID NO: 4122954 - RNA, 14 nt, Streptococcus pyogenes MGAS315
gugcuacugaugua

SEQ ID NO: 4122955 - RNA, 13 nt, Streptococcus pyogenes MGAS315
gugguaagaagaa

SEQ ID NO: 4122956 - RNA, 17 nt, Streptococcus pyogenes MGAS315
gugugaccagauacuuc

SEQ ID NO: 4122957 - RNA, 11 nt, Streptococcus pyogenes MGAS315
guguuauccuc

SEQ ID NO: 4122958 - RNA, 16 nt, Streptococcus pyogenes MGAS315
guguugucaaacauaa

SEQ ID NO: 4122959 - RNA, 22 nt, Streptococcus pyogenes MGAS315
guguuuuuuaguguauuacuuc

SEQ ID NO: 4122960 - RNA, 14 nt, Streptococcus pyogenes MGAS315
guuaaaauagaaga

SEQ ID NO: 4122961 - RNA, 18 nt, Streptococcus pyogenes MGAS315
guuaacaaaaauaaguau

SEQ ID NO: 4122962 - RNA, 20 nt, Streptococcus pyogenes MGAS315
guuaacaaaaauaaguauag

SEQ ID NO: 4122963 - RNA, 15 nt, Streptococcus pyogenes MGAS315
guuaacaauaaguau

SEQ ID NO: 4122964 - RNA, 17 nt, Streptococcus pyogenes MGAS315
guuaacugguaaaguau

SEQ ID NO: 4122965 - RNA, 22 nt, Streptococcus pyogenes MGAS315
guuaauauagucugcaugaagu

SEQ ID NO: 4122966 - RNA, 19 nt, Streptococcus pyogenes MGAS315
guuaaugccaacuuuucaa

SEQ ID NO: 4122967 - RNA, 19 nt, Streptococcus pyogenes MGAS315
guuaccguguucgauaaau

SEQ ID NO: 4122968 - RNA, 22 nt, Streptococcus pyogenes MGAS315
guuaguuuuauccccuauucaa

SEQ ID NO: 4122969 - RNA, 17 nt, Streptococcus pyogenes MGAS315
guuauagcuccuaaaac

SEQ ID NO: 4122970 - RNA, 16 nt, Streptococcus pyogenes MGAS315
guuaucugauauuuca

SEQ ID NO: 4122971 - RNA, 16 nt, Streptococcus pyogenes MGAS315
guucaauacucccuuc

SEQ ID NO: 4122972 - RNA, 16 nt, Streptococcus pyogenes MGAS315
guucauauaagcaauc

SEQ ID NO: 4122973 - RNA, 21 nt, Streptococcus pyogenes MGAS315
guuccuuagcaguuauaauua

SEQ ID NO: 4122974 - RNA, 19 nt, Streptococcus pyogenes MGAS315
guucgucaagcaccuugau

SEQ ID NO: 4122975 - RNA, 14 nt, Streptococcus pyogenes MGAS315
guucugaaaauaaa

SEQ ID NO: 4122976 - RNA, 15 nt, Streptococcus pyogenes MGAS315
guucugaaaauaaaa

SEQ ID NO: 4122977 - RNA, 21 nt, Streptococcus pyogenes MGAS315
guucugaaaauaaaauauuuu

SEQ ID NO: 4122978 - RNA, 16 nt, Streptococcus pyogenes MGAS315
guucuguuuaaaauau

SEQ ID NO: 4122979 - RNA, 23 nt, Streptococcus pyogenes MGAS315
guucuguuucuaagcaaauagca

SEQ ID NO: 4122980 - RNA, 14 nt, Streptococcus pyogenes MGAS315
guugaaauguggua

SEQ ID NO: 4122981 - RNA, 14 nt, Streptococcus pyogenes MGAS315
guugauauaaaauu

SEQ ID NO: 4122982 - RNA, 13 nt, Streptococcus pyogenes MGAS315
guugauauuuuuu

SEQ ID NO: 4122983 - RNA, 15 nt, Streptococcus pyogenes MGAS315
guuggaacuuuguuc

SEQ ID NO: 4122984 - RNA, 15 nt, Streptococcus pyogenes MGAS315
guuguauuaugaggu

SEQ ID NO: 4122985 - RNA, 15 nt, Streptococcus pyogenes MGAS315
guugugccuuuucuu

SEQ ID NO: 4122986 - RNA, 20 nt, Streptococcus pyogenes MGAS315
guuuaggaaucacaacuucu

SEQ ID NO: 4122987 - RNA, 23 nt, Streptococcus pyogenes MGAS315
guuuaucauuuugguugauagaa

SEQ ID NO: 4122988 - RNA, 16 nt, Streptococcus pyogenes MGAS315
guuucaagugcuagau

SEQ ID NO: 4122989 - RNA, 20 nt, Streptococcus pyogenes MGAS315
guuucggaaaacuuuugacu

SEQ ID NO: 4122990 - RNA, 18 nt, Streptococcus pyogenes MGAS315
guuugauugauuugucuu

SEQ ID NO: 4122991 - RNA, 22 nt, Streptococcus pyogenes MGAS315
guuugauugauuugucuucucc

SEQ ID NO: 4122992 - RNA, 22 nt, Streptococcus pyogenes MGAS315
guuuggugucaaucauuuuuaa

SEQ ID NO: 4122993 - RNA, 18 nt, Streptococcus pyogenes MGAS315
guuuucucagagacaaua

SEQ ID NO: 4122994 - RNA, 20 nt, Streptococcus pyogenes MGAS315
guuuucucagagacaauaag

SEQ ID NO: 4122995 - RNA, 16 nt, Streptococcus pyogenes MGAS315
guuuugucuuaucuaa

SEQ ID NO: 4122996 - RNA, 22 nt, Streptococcus pyogenes MGAS315
guuuuuacauuuuuacaauacg

SEQ ID NO: 4122997 - RNA, 22 nt, Streptococcus pyogenes MGAS315
guuuuucaaugcgcucaagcau

SEQ ID NO: 4122998 - RNA, 15 nt, Streptococcus pyogenes MGAS315
guuuuuugucuucuu

SEQ ID NO: 4122999 - RNA, 20 nt, Streptococcus pyogenes MGAS315
guuuuuuuagcgcuaaaugu

SEQ ID NO: 4123000 - RNA, 18 nt, Streptococcus pyogenes MGAS315
uaaaaaaccuuaucaaac

SEQ ID NO: 4123001 - RNA, 19 nt, Streptococcus pyogenes MGAS315
uaaaaagcaaaaaagccag

SEQ ID NO: 4123002 - RNA, 20 nt, Streptococcus pyogenes MGAS315
uaaaaagcaaaaaagccagu

SEQ ID NO: 4123003 - RNA, 18 nt, Streptococcus pyogenes MGAS315
uaaaaagcaaauugaaaa

SEQ ID NO: 4123004 - RNA, 20 nt, Streptococcus pyogenes MGAS315
uaaaaauacuagaaaaagca

SEQ ID NO: 4123005 - RNA, 17 nt, Streptococcus pyogenes MGAS315
uaaaacaauaacacaga

SEQ ID NO: 4123006 - RNA, 20 nt, Streptococcus pyogenes MGAS315
uaaaacaauaacacagaagc

SEQ ID NO: 4123007 - RNA, 14 nt, Streptococcus pyogenes MGAS315
uaaaaccauaccua

SEQ ID NO: 4123008 - RNA, 19 nt, Streptococcus pyogenes MGAS315
uaaaaccuucaaaaaaggg

SEQ ID NO: 4123009 - RNA, 18 nt, Streptococcus pyogenes MGAS315
uaaaagauauuuuaaaau

SEQ ID NO: 4123010 - RNA, 18 nt, Streptococcus pyogenes MGAS315
uaaaaguuagccaagcaa

SEQ ID NO: 4123011 - RNA, 18 nt, Streptococcus pyogenes MGAS315
uaaaauaaucaaccugcu

SEQ ID NO: 4123012 - RNA, 16 nt, Streptococcus pyogenes MGAS315
uaaaauauauuuugga

SEQ ID NO: 4123013 - RNA, 14 nt, Streptococcus pyogenes MGAS315
uaaaauaucuagaa

SEQ ID NO: 4123014 - RNA, 21 nt, Streptococcus pyogenes MGAS315
uaaaauaucuagaacagcugc

SEQ ID NO: 4123015 - RNA, 23 nt, Streptococcus pyogenes MGAS315
uaaaaucaugggaaaagcuaagu

SEQ ID NO: 4123016 - RNA, 18 nt, Streptococcus pyogenes MGAS315
uaaaauccucuuuuaauu

SEQ ID NO: 4123017 - RNA, 19 nt, Streptococcus pyogenes MGAS315
uaaaauccucuuuuaauuu

SEQ ID NO: 4123018 - RNA, 21 nt, Streptococcus pyogenes MGAS315
uaaacacuaccuuaaauguau

SEQ ID NO: 4123019 - RNA, 14 nt, Streptococcus pyogenes MGAS315
uaaacuaauaagau

SEQ ID NO: 4123020 - RNA, 15 nt, Streptococcus pyogenes MGAS315
uacccgagcaacaaa

SEQ ID NO: 4123021 - RNA, 17 nt, Streptococcus pyogenes MGAS315
uaccuaaaaaauaacuu

SEQ ID NO: 4123022 - RNA, 21 nt, Streptococcus pyogenes MGAS315
uaccuauagaaaguuauaaag

SEQ ID NO: 4123023 - RNA, 16 nt, Streptococcus pyogenes MGAS315
uacgaguaugaacaaa

SEQ ID NO: 4123024 - RNA, 16 nt, Streptococcus pyogenes MGAS315
uacgggauuuaguucu

SEQ ID NO: 4123025 - RNA, 16 nt, Streptococcus pyogenes MGAS315
uacgguaaaaacucaa

SEQ ID NO: 4123026 - RNA, 23 nt, Streptococcus pyogenes MGAS315
uacgguaaaaacucaaaaaauac

SEQ ID NO: 4123027 - RNA, 14 nt, Streptococcus pyogenes MGAS315
uacguuuauuuagu

SEQ ID NO: 4123028 - RNA, 14 nt, Streptococcus pyogenes MGAS315
uacguuuugguggg

SEQ ID NO: 4123029 - RNA, 15 nt, Streptococcus pyogenes MGAS315
uacuaauauuauauu

SEQ ID NO: 4123030 - RNA, 18 nt, Streptococcus pyogenes MGAS315
uacuaauauuauauuaau

SEQ ID NO: 4123031 - RNA, 22 nt, Streptococcus pyogenes MGAS315
uacuaauauuauauuaaugauu

SEQ ID NO: 4123032 - RNA, 18 nt, Streptococcus pyogenes MGAS315
uacuagcacaaaaucauu

SEQ ID NO: 4123033 - RNA, 24 nt, Streptococcus pyogenes MGAS315
uacuaguguguugucaaacauaac

SEQ ID NO: 4123034 - RNA, 21 nt, Streptococcus pyogenes MGAS315
uacucaauuaauguuaggagc

SEQ ID NO: 4123035 - RNA, 13 nt, Streptococcus pyogenes MGAS315
uacugaaauauau

SEQ ID NO: 4123036 - RNA, 20 nt, Streptococcus pyogenes MGAS315
uacugaaauauaugaugagg

SEQ ID NO: 4123037 - RNA, 13 nt, Streptococcus pyogenes MGAS315
uacugauaaacuu

SEQ ID NO: 4123038 - RNA, 20 nt, Streptococcus pyogenes MGAS315
uacugggucaacuccaaucu

SEQ ID NO: 4123039 - RNA, 16 nt, Streptococcus pyogenes MGAS315
uacuguauaaacuugu

SEQ ID NO: 4123040 - RNA, 14 nt, Streptococcus pyogenes MGAS315
uacuucaaggaagg

SEQ ID NO: 4123041 - RNA, 22 nt, Streptococcus pyogenes MGAS315
uacuucaaggaaggcuuguucu

SEQ ID NO: 4123042 - RNA, 20 nt, Streptococcus pyogenes MGAS315
uacuucugauaaaaauaaaa

SEQ ID NO: 4123043 - RNA, 22 nt, Streptococcus pyogenes MGAS315
uacuugcaucgcaaacagaugc

SEQ ID NO: 4123044 - RNA, 19 nt, Streptococcus pyogenes MGAS315
uacuuugguauucuuuuuc

SEQ ID NO: 4123045 - RNA, 15 nt, Streptococcus pyogenes MGAS315
uagaaaaagcaauga

SEQ ID NO: 4123046 - RNA, 18 nt, Streptococcus pyogenes MGAS315
uagaaacuuuuuauaagc

SEQ ID NO: 4123047 - RNA, 15 nt, Streptococcus pyogenes MGAS315
uagaaaguuauaaag

SEQ ID NO: 4123048 - RNA, 21 nt, Streptococcus pyogenes MGAS315
uagaaauuguaaccacagcaa

SEQ ID NO: 4123049 - RNA, 12 nt, Streptococcus pyogenes MGAS315
uagaacuuuuca

SEQ ID NO: 4123050 - RNA, 13 nt, Streptococcus pyogenes MGAS315
uagaauaaaaaag

SEQ ID NO: 4123051 - RNA, 14 nt, Streptococcus pyogenes MGAS315
uagacaggagcuug

SEQ ID NO: 4123052 - RNA, 19 nt, Streptococcus pyogenes MGAS315
uagacugauucaucuugcc

SEQ ID NO: 4123053 - RNA, 20 nt, Streptococcus pyogenes MGAS315
uagagaacagauaagugcca

SEQ ID NO: 4123054 - RNA, 15 nt, Streptococcus pyogenes MGAS315
uagauaaacugguua

SEQ ID NO: 4123055 - RNA, 14 nt, Streptococcus pyogenes MGAS315
uagaugauuauauu

SEQ ID NO: 4123056 - RNA, 13 nt, Streptococcus pyogenes MGAS315
uagauuuuggaua

SEQ ID NO: 4123057 - RNA, 17 nt, Streptococcus pyogenes MGAS315
uagcaaguccugcuuuu

SEQ ID NO: 4123058 - RNA, 21 nt, Streptococcus pyogenes MGAS315
uagcaaguccugcuuuugaug

SEQ ID NO: 4123059 - RNA, 17 nt, Streptococcus pyogenes MGAS315
uagcaaugguuaaaaag

SEQ ID NO: 4123060 - RNA, 19 nt, Streptococcus pyogenes MGAS315
uagcaaugguuaaaaagag

SEQ ID NO: 4123061 - RNA, 13 nt, Streptococcus pyogenes MGAS315
uagcagacaaaag

SEQ ID NO: 4123062 - RNA, 12 nt, Streptococcus pyogenes MGAS315
uagcauaaaaua

SEQ ID NO: 4123063 - RNA, 14 nt, Streptococcus pyogenes MGAS315
uagcauauuuugau

SEQ ID NO: 4123064 - RNA, 18 nt, Streptococcus pyogenes MGAS315
uagccaagcaaucuaaga

SEQ ID NO: 4123065 - RNA, 15 nt, Streptococcus pyogenes MGAS315
uagcuuuuuaaagag

SEQ ID NO: 4123066 - RNA, 19 nt, Streptococcus pyogenes MGAS315
uagcuuuuuacaucaaaaa

SEQ ID NO: 4123067 - RNA, 16 nt, Streptococcus pyogenes MGAS315
uaggaauaucaugaag

SEQ ID NO: 4123068 - RNA, 18 nt, Streptococcus pyogenes MGAS315
uaggaauaucaugaagua

SEQ ID NO: 4123069 - RNA, 21 nt, Streptococcus pyogenes MGAS315
uaggauauggaauagguaaag

SEQ ID NO: 4123070 - RNA, 20 nt, Streptococcus pyogenes MGAS315
uaggcuuuuuuuguaucuca

SEQ ID NO: 4123071 - RNA, 14 nt, Streptococcus pyogenes MGAS315
uagguuaaaauaga

SEQ ID NO: 4123072 - RNA, 15 nt, Streptococcus pyogenes MGAS315
uaguaaccauugcca

SEQ ID NO: 4123073 - RNA, 15 nt, Streptococcus pyogenes MGAS315
uagucaaaaagacuu

SEQ ID NO: 4123074 - RNA, 20 nt, Streptococcus pyogenes MGAS315
uagucuaggcguauagguga

SEQ ID NO: 4123075 - RNA, 14 nt, Streptococcus pyogenes MGAS315
uaguuaauaagaca

SEQ ID NO: 4123076 - RNA, 18 nt, Streptococcus pyogenes MGAS315
uaguuauguuauaagaga

SEQ ID NO: 4123077 - RNA, 16 nt, Streptococcus pyogenes MGAS315
uaguuauuuuugagau

SEQ ID NO: 4123078 - RNA, 13 nt, Streptococcus pyogenes MGAS315
uaguugauauuuu

SEQ ID NO: 4123079 - RNA, 22 nt, Streptococcus pyogenes MGAS315
uaguuuaggaaucacaacuucu

SEQ ID NO: 4123080 - RNA, 21 nt, Streptococcus pyogenes MGAS315
uaguuuauuacaaaacugucu

SEQ ID NO: 4123081 - RNA, 14 nt, Streptococcus pyogenes MGAS315
uauaaagaaacaaa

SEQ ID NO: 4123082 - RNA, 15 nt, Streptococcus pyogenes MGAS315
uauaaagaaacaaaa

SEQ ID NO: 4123083 - RNA, 17 nt, Streptococcus pyogenes MGAS315
uauaaagaaacaaaaau

SEQ ID NO: 4123084 - RNA, 19 nt, Streptococcus pyogenes MGAS315
uauaaaucuuacuaacuag

SEQ ID NO: 4123085 - RNA, 14 nt, Streptococcus pyogenes MGAS315
uauaacaacucccu

SEQ ID NO: 4123086 - RNA, 20 nt, Streptococcus pyogenes MGAS315
uauaaccucuagcuugugag

SEQ ID NO: 4123087 - RNA, 13 nt, Streptococcus pyogenes MGAS315
uauaaugguuuuu

SEQ ID NO: 4123088 - RNA, 17 nt, Streptococcus pyogenes MGAS315
uauaauuugacuucaaa

SEQ ID NO: 4123089 - RNA, 18 nt, Streptococcus pyogenes MGAS315
uauaauuugacuucaaaa

SEQ ID NO: 4123090 - RNA, 21 nt, Streptococcus pyogenes MGAS315
uauacgguaaaaacucaaaaa

SEQ ID NO: 4123091 - RNA, 12 nt, Streptococcus pyogenes MGAS315
uauagaaaguaa

SEQ ID NO: 4123092 - RNA, 14 nt, Streptococcus pyogenes MGAS315
uauagaaaguaaaa

SEQ ID NO: 4123093 - RNA, 13 nt, Streptococcus pyogenes MGAS315
uauagcauaaaau

SEQ ID NO: 4123094 - RNA, 21 nt, Streptococcus pyogenes MGAS315
uauaugucaucaaaagaccau

SEQ ID NO: 4123095 - RNA, 16 nt, Streptococcus pyogenes MGAS315
uauauguguaauuucu

SEQ ID NO: 4123096 - RNA, 13 nt, Streptococcus pyogenes MGAS315
uauauuuuggauc

SEQ ID NO: 4123097 - RNA, 19 nt, Streptococcus pyogenes MGAS315
uauauuuuggaucuucaac

SEQ ID NO: 4123098 - RNA, 13 nt, Streptococcus pyogenes MGAS315
uaucaagagucau

SEQ ID NO: 4123099 - RNA, 20 nt, Streptococcus pyogenes MGAS315
uaucaauaacagaaauuaau

SEQ ID NO: 4123100 - RNA, 22 nt, Streptococcus pyogenes MGAS315
uaucaauaacagaaauuaauaa

SEQ ID NO: 4123101 - RNA, 15 nt, Streptococcus pyogenes MGAS315
uaucaguuaaugcca

SEQ ID NO: 4123102 - RNA, 19 nt, Streptococcus pyogenes MGAS315
uaucaugaaguauaguuau

SEQ ID NO: 4123103 - RNA, 16 nt, Streptococcus pyogenes MGAS315
uauccaaugaaaacuc

SEQ ID NO: 4123104 - RNA, 18 nt, Streptococcus pyogenes MGAS315
uauccaaugaaaacucca

SEQ ID NO: 4123105 - RNA, 16 nt, Streptococcus pyogenes MGAS315
uauccauagaaauugu

SEQ ID NO: 4123106 - RNA, 14 nt, Streptococcus pyogenes MGAS315
uauccuccuaaaua

SEQ ID NO: 4123107 - RNA, 19 nt, Streptococcus pyogenes MGAS315
uauccuccuaaauauaaau

SEQ ID NO: 4123108 - RNA, 20 nt, Streptococcus pyogenes MGAS315
uauccuccuaaauauaaauu

SEQ ID NO: 4123109 - RNA, 17 nt, Streptococcus pyogenes MGAS315
uauccucuuuuaguuca

SEQ ID NO: 4123110 - RNA, 16 nt, Streptococcus pyogenes MGAS315
uaucgccaauaaaaaa

SEQ ID NO: 4123111 - RNA, 16 nt, Streptococcus pyogenes MGAS315
uaucuaaaggagcuuu

SEQ ID NO: 4123112 - RNA, 17 nt, Streptococcus pyogenes MGAS315
uaucuaagcuauagaaa

SEQ ID NO: 4123113 - RNA, 18 nt, Streptococcus pyogenes MGAS315
uaucuagaacagcugcuu

SEQ ID NO: 4123114 - RNA, 18 nt, Streptococcus pyogenes MGAS315
uaucucauaacaaauuua

SEQ ID NO: 4123115 - RNA, 14 nt, Streptococcus pyogenes MGAS315
uaucucguaauccu

SEQ ID NO: 4123116 - RNA, 23 nt, Streptococcus pyogenes MGAS315
uaucugcagauuuuaagacaaca

SEQ ID NO: 4123117 - RNA, 16 nt, Streptococcus pyogenes MGAS315
uaugacaaauucuuuu

SEQ ID NO: 4123118 - RNA, 13 nt, Streptococcus pyogenes MGAS315
uaugauauaaaaa

SEQ ID NO: 4123119 - RNA, 18 nt, Streptococcus pyogenes MGAS315
ucguuuugcaauuaagua

SEQ ID NO: 4123120 - RNA, 11 nt, Streptococcus pyogenes MGAS315
ucuaaaauaua

SEQ ID NO: 4123121 - RNA, 14 nt, Streptococcus pyogenes MGAS315
ucuaagcaaauagc

SEQ ID NO: 4123122 - RNA, 14 nt, Streptococcus pyogenes MGAS315
ucuaauuugugaaa

SEQ ID NO: 4123123 - RNA, 16 nt, Streptococcus pyogenes MGAS315
ucuagaacagcugcuu

SEQ ID NO: 4123124 - RNA, 23 nt, Streptococcus pyogenes MGAS315
ucuagacccuagcauaaaagaua

SEQ ID NO: 4123125 - RNA, 14 nt, Streptococcus pyogenes MGAS315
ucuagcuugugagg

SEQ ID NO: 4123126 - RNA, 20 nt, Streptococcus pyogenes MGAS315
ucuagucagaucauuaaauu

SEQ ID NO: 4123127 - RNA, 13 nt, Streptococcus pyogenes MGAS315
ucuauacaaaaag

SEQ ID NO: 4123128 - RNA, 15 nt, Streptococcus pyogenes MGAS315
ucuauacaaaaaggc

SEQ ID NO: 4123129 - RNA, 16 nt, Streptococcus pyogenes MGAS315
ucuauuuuugguguua

SEQ ID NO: 4123130 - RNA, 20 nt, Streptococcus pyogenes MGAS315
ucucaaaaauauauucuaau

SEQ ID NO: 4123131 - RNA, 19 nt, Streptococcus pyogenes MGAS315
ucucacaaauacagaaaaa

SEQ ID NO: 4123132 - RNA, 20 nt, Streptococcus pyogenes MGAS315
ucucacaaauacagaaaaaa

SEQ ID NO: 4123133 - RNA, 15 nt, Streptococcus pyogenes MGAS315
ucucagagacaauaa

SEQ ID NO: 4123134 - RNA, 15 nt, Streptococcus pyogenes MGAS315
ucucauaaacaauga

SEQ ID NO: 4123135 - RNA, 14 nt, Streptococcus pyogenes MGAS315
ucucuuuggagaaa

SEQ ID NO: 4123136 - RNA, 14 nt, Streptococcus pyogenes MGAS315
ucugaaaauaaaau

SEQ ID NO: 4123137 - RNA, 19 nt, Streptococcus pyogenes MGAS315
ucugaaaauaaaauauuuu

SEQ ID NO: 4123138 - RNA, 20 nt, Streptococcus pyogenes MGAS315
ucugaugcguuuauaaaguu

SEQ ID NO: 4123139 - RNA, 22 nt, Streptococcus pyogenes MGAS315
ucugaugcguuuauaaaguuuu

SEQ ID NO: 4123140 - RNA, 19 nt, Streptococcus pyogenes MGAS315
ucugcaauauccauagaaa

SEQ ID NO: 4123141 - RNA, 15 nt, Streptococcus pyogenes MGAS315
ucugcauuaucaucu

SEQ ID NO: 4123142 - RNA, 12 nt, Streptococcus pyogenes MGAS315
ucugcugauuga

SEQ ID NO: 4123143 - RNA, 16 nt, Streptococcus pyogenes MGAS315
ucugcugauugagacc

SEQ ID NO: 4123144 - RNA, 20 nt, Streptococcus pyogenes MGAS315
ucuggaaacuggucaaaagc

SEQ ID NO: 4123145 - RNA, 21 nt, Streptococcus pyogenes MGAS315
ucuggcuuuuuccuaucagau

SEQ ID NO: 4123146 - RNA, 15 nt, Streptococcus pyogenes MGAS315
ucuggucccacaccu

SEQ ID NO: 4123147 - RNA, 19 nt, Streptococcus pyogenes MGAS315
ucugucgguauaguuugga

SEQ ID NO: 4123148 - RNA, 18 nt, Streptococcus pyogenes MGAS315
ucuguuuaaaauauauuu

SEQ ID NO: 4123149 - RNA, 19 nt, Streptococcus pyogenes MGAS315
ucuguuuaaaauauauuuu

SEQ ID NO: 4123150 - RNA, 11 nt, Streptococcus pyogenes MGAS315
ucuuaaaauaa

SEQ ID NO: 4123151 - RNA, 14 nt, Streptococcus pyogenes MGAS315
ucuuaaaauaauca

SEQ ID NO: 4123152 - RNA, 19 nt, Streptococcus pyogenes MGAS315
ucuuaaaauaaucaaccug

SEQ ID NO: 4123153 - RNA, 16 nt, Streptococcus pyogenes MGAS315
ucuuaauuuauauuuu

SEQ ID NO: 4123154 - RNA, 14 nt, Streptococcus pyogenes MGAS315
ucuuacaauuaaua

SEQ ID NO: 4123155 - RNA, 17 nt, Streptococcus pyogenes MGAS315
ucuuauagaauaaccag

SEQ ID NO: 4123156 - RNA, 19 nt, Streptococcus pyogenes MGAS315
ucuucauagcuuaauguca

SEQ ID NO: 4123157 - RNA, 12 nt, Streptococcus pyogenes MGAS315
ucuucaucuguu

SEQ ID NO: 4123158 - RNA, 22 nt, Streptococcus pyogenes MGAS315
ucuucuaaaacgaugagauuaa

SEQ ID NO: 4123159 - RNA, 14 nt, Streptococcus pyogenes MGAS315
ucuucuaaacguuu

SEQ ID NO: 4123160 - RNA, 22 nt, Streptococcus pyogenes MGAS315
ucuucugaugcguuuauaaagu

SEQ ID NO: 4123161 - RNA, 19 nt, Streptococcus pyogenes MGAS315
ucuucuuuuuauuauacuc

SEQ ID NO: 4123162 - RNA, 13 nt, Streptococcus pyogenes MGAS315
ucuugcauuaccu

SEQ ID NO: 4123163 - RNA, 17 nt, Streptococcus pyogenes MGAS315
ucuugcauuaccuuauu

SEQ ID NO: 4123164 - RNA, 18 nt, Streptococcus pyogenes MGAS315
ucuugccaucagcaucug

SEQ ID NO: 4123165 - RNA, 23 nt, Streptococcus pyogenes MGAS315
ucuuggauagacugauucaucuu

SEQ ID NO: 4123166 - RNA, 23 nt, Streptococcus pyogenes MGAS315
ucuuguuuaaccuccuaaacuaa

SEQ ID NO: 4123167 - RNA, 20 nt, Streptococcus pyogenes MGAS315
ucuuguuuugguugauauaa

SEQ ID NO: 4123168 - RNA, 23 nt, Streptococcus pyogenes MGAS315
ucuuguuuugguugauauaaaau

SEQ ID NO: 4123169 - RNA, 22 nt, Streptococcus pyogenes MGAS315
ucuuuauaaugguuuuuugucu

SEQ ID NO: 4123170 - RNA, 21 nt, Streptococcus pyogenes MGAS315
ucuuuauuuugauauuuuuuc

SEQ ID NO: 4123171 - RNA, 23 nt, Streptococcus pyogenes MGAS315
ucuuuauuuugauauuuuuucuc

SEQ ID NO: 4123172 - RNA, 18 nt, Streptococcus pyogenes MGAS315
ucuuuggagaaauucaaa

SEQ ID NO: 4123173 - RNA, 17 nt, Streptococcus pyogenes MGAS315
ucuuuguccauucuuua

SEQ ID NO: 4123174 - RNA, 16 nt, Streptococcus pyogenes MGAS315
ucuuuuauuaauguaa

SEQ ID NO: 4123175 - RNA, 20 nt, Streptococcus pyogenes MGAS315
ucuuuuucguauacuuuaaa

SEQ ID NO: 4123176 - RNA, 13 nt, Streptococcus pyogenes MGAS315
ucuuuuuggcuga

SEQ ID NO: 4123177 - RNA, 17 nt, Streptococcus pyogenes MGAS315
ucuuuuuguugcuagcu

SEQ ID NO: 4123178 - RNA, 13 nt, Streptococcus pyogenes MGAS315
ucuuuuuuaccuu

SEQ ID NO: 4123179 - RNA, 19 nt, Streptococcus pyogenes MGAS315
ucuuuuuuacuuuuaaaau

SEQ ID NO: 4123180 - RNA, 16 nt, Streptococcus pyogenes MGAS315
ugaaaaagccuuuaca

SEQ ID NO: 4123181 - RNA, 17 nt, Streptococcus pyogenes MGAS315
ugaaaacguguauucuu

SEQ ID NO: 4123182 - RNA, 22 nt, Streptococcus pyogenes MGAS315
ugaaaagaugcacacaaaucuu

SEQ ID NO: 4123183 - RNA, 21 nt, Streptococcus pyogenes MGAS315
ugaaaauaucuuuuuuacuuu

SEQ ID NO: 4123184 - RNA, 23 nt, Streptococcus pyogenes MGAS315
ugaaacguuauuaaagacaaaaa

SEQ ID NO: 4123185 - RNA, 15 nt, Streptococcus pyogenes MGAS315
ugaaaguaucuagga

SEQ ID NO: 4123186 - RNA, 12 nt, Streptococcus pyogenes MGAS315
ugaaaugauugu

SEQ ID NO: 4123187 - RNA, 17 nt, Streptococcus pyogenes MGAS315
ugaaauuccuuaaauua

SEQ ID NO: 4123188 - RNA, 14 nt, Streptococcus pyogenes MGAS315
ugaacaaaguuuca

SEQ ID NO: 4123189 - RNA, 23 nt, Streptococcus pyogenes MGAS315
ugaacguucuguuuaaaauauau

SEQ ID NO: 4123190 - RNA, 14 nt, Streptococcus pyogenes MGAS315
ugaagcaaaauaaa

SEQ ID NO: 4123191 - RNA, 21 nt, Streptococcus pyogenes MGAS315
ugaaguauaguuauguuauaa

SEQ ID NO: 4123192 - RNA, 13 nt, Streptococcus pyogenes MGAS315
ugaauaauuuuca

SEQ ID NO: 4123193 - RNA, 13 nt, Streptococcus pyogenes MGAS315
ugaauuauuagua

SEQ ID NO: 4123194 - RNA, 15 nt, Streptococcus pyogenes MGAS315
ugacaaauucuuuuu

SEQ ID NO: 4123195 - RNA, 17 nt, Streptococcus pyogenes MGAS315
ugacaaccuuaaagacc

SEQ ID NO: 4123196 - RNA, 11 nt, Streptococcus pyogenes MGAS315
ugacaauguga

SEQ ID NO: 4123197 - RNA, 13 nt, Streptococcus pyogenes MGAS315
ugacauaguguuu

SEQ ID NO: 4123198 - RNA, 23 nt, Streptococcus pyogenes MGAS315
ugacauuucgugucuaaaauaau

SEQ ID NO: 4123199 - RNA, 14 nt, Streptococcus pyogenes MGAS315
ugaccagauacuuc

SEQ ID NO: 4123200 - RNA, 21 nt, Streptococcus pyogenes MGAS315
ugaccgaaaaaggcaaagaaa

SEQ ID NO: 4123201 - RNA, 14 nt, Streptococcus pyogenes MGAS315
ugacuaguuuauua

SEQ ID NO: 4123202 - RNA, 22 nt, Streptococcus pyogenes MGAS315
ugacucugauccgaguuuugcu

SEQ ID NO: 4123203 - RNA, 12 nt, Streptococcus pyogenes MGAS315
ugacuucaaaaa

SEQ ID NO: 4123204 - RNA, 21 nt, Streptococcus pyogenes MGAS315
ugacuugguucugaaaauaaa

SEQ ID NO: 4123205 - RNA, 18 nt, Streptococcus pyogenes MGAS315
ugagaacaugugaauucc

SEQ ID NO: 4123206 - RNA, 16 nt, Streptococcus pyogenes MGAS315
ugagauaccuucauag

SEQ ID NO: 4123207 - RNA, 19 nt, Streptococcus pyogenes MGAS315
ugagauaccuucauagaca

SEQ ID NO: 4123208 - RNA, 16 nt, Streptococcus pyogenes MGAS315
ugagauuaacugacaa

SEQ ID NO: 4123209 - RNA, 16 nt, Streptococcus pyogenes MGAS315
ugagccccaaaaguug

SEQ ID NO: 4123210 - RNA, 18 nt, Streptococcus pyogenes MGAS315
ugagccccaaaaguuggc

SEQ ID NO: 4123211 - RNA, 15 nt, Streptococcus pyogenes MGAS315
ugaguaaaacaauaa

SEQ ID NO: 4123212 - RNA, 13 nt, Streptococcus pyogenes MGAS315
ugaguugauuuau

SEQ ID NO: 4123213 - RNA, 18 nt, Streptococcus pyogenes MGAS315
ugaguuuuuucuaaaaga

SEQ ID NO: 4123214 - RNA, 23 nt, Streptococcus pyogenes MGAS315
ugauaaaaauaaaaaaacaccuu

SEQ ID NO: 4123215 - RNA, 19 nt, Streptococcus pyogenes MGAS315
ugauaaaugucguuguaag

SEQ ID NO: 4123216 - RNA, 18 nt, Streptococcus pyogenes MGAS315
ugauaagguuuuuuuaag

SEQ ID NO: 4123217 - RNA, 13 nt, Streptococcus pyogenes MGAS315
ugauauaaaaaug

SEQ ID NO: 4123218 - RNA, 20 nt, Streptococcus pyogenes MGAS315
ugugaugauauuuuucauua

SEQ ID NO: 4123219 - RNA, 12 nt, Streptococcus pyogenes MGAS315
ugugugugaugu

SEQ ID NO: 4123220 - RNA, 21 nt, Streptococcus pyogenes MGAS315
uguuaucccuggaccauuauc

SEQ ID NO: 4123221 - RNA, 22 nt, Streptococcus pyogenes MGAS315
uguuauuggaaaguaaggguua

SEQ ID NO: 4123222 - RNA, 16 nt, Streptococcus pyogenes MGAS315
uguucuuuauuuugau

SEQ ID NO: 4123223 - RNA, 17 nt, Streptococcus pyogenes MGAS315
uguucuuuauuuugaua

SEQ ID NO: 4123224 - RNA, 20 nt, Streptococcus pyogenes MGAS315
uguugacucugauccgaguu

SEQ ID NO: 4123225 - RNA, 19 nt, Streptococcus pyogenes MGAS315
uguugcaaggcuaaagccu

SEQ ID NO: 4123226 - RNA, 15 nt, Streptococcus pyogenes MGAS315
uguugucaaacauaa

SEQ ID NO: 4123227 - RNA, 21 nt, Streptococcus pyogenes MGAS315
uguuuaaaauauauuuuggau

SEQ ID NO: 4123228 - RNA, 22 nt, Streptococcus pyogenes MGAS315
uguuuugccugauauuccuuuu

SEQ ID NO: 4123229 - RNA, 12 nt, Streptococcus pyogenes MGAS315
uuaaaagaaaau

SEQ ID NO: 4123230 - RNA, 15 nt, Streptococcus pyogenes MGAS315
uuaaaauagaagaca

SEQ ID NO: 4123231 - RNA, 16 nt, Streptococcus pyogenes MGAS315
uuaaaauauauuuugg

SEQ ID NO: 4123232 - RNA, 14 nt, Streptococcus pyogenes MGAS315
uuaaagacaaaaaa

SEQ ID NO: 4123233 - RNA, 20 nt, Streptococcus pyogenes MGAS315
uuaaagacaaaaaacuggaa

SEQ ID NO: 4123234 - RNA, 21 nt, Streptococcus pyogenes MGAS315
uuaaauuuggagagauaaaaa

SEQ ID NO: 4123235 - RNA, 24 nt, Streptococcus pyogenes MGAS315
uuaaauuuggagagauaaaaagua

SEQ ID NO: 4123236 - RNA, 18 nt, Streptococcus pyogenes MGAS315
uuaaccggcucuaaaaua

SEQ ID NO: 4123237 - RNA, 18 nt, Streptococcus pyogenes MGAS315
uuaacguuaacaaaaaua

SEQ ID NO: 4123238 - RNA, 15 nt, Streptococcus pyogenes MGAS315
uuaacuauuuaacuu

SEQ ID NO: 4123239 - RNA, 22 nt, Streptococcus pyogenes MGAS315
uuaacuauuuaacuuaucauuu

SEQ ID NO: 4123240 - RNA, 15 nt, Streptococcus pyogenes MGAS315
uuaacugacaaaaaa

SEQ ID NO: 4123241 - RNA, 17 nt, Streptococcus pyogenes MGAS315
uuaacugguaaaguauu

SEQ ID NO: 4123242 - RNA, 17 nt, Streptococcus pyogenes MGAS315
uuaacuuaucauuuugg

SEQ ID NO: 4123243 - RNA, 20 nt, Streptococcus pyogenes MGAS315
uuaagaaggaacucuccaaa

SEQ ID NO: 4123244 - RNA, 18 nt, Streptococcus pyogenes MGAS315
uuaagagggccaaggucu

SEQ ID NO: 4123245 - RNA, 20 nt, Streptococcus pyogenes MGAS315
uuaagauaccaaaucaaaaa

SEQ ID NO: 4123246 - RNA, 21 nt, Streptococcus pyogenes MGAS315
uuaagauuaaacuuacaaaaa

SEQ ID NO: 4123247 - RNA, 22 nt, Streptococcus pyogenes MGAS315
uuaagggcaaugccaucugcuu

SEQ ID NO: 4123248 - RNA, 20 nt, Streptococcus pyogenes MGAS315
uuaauaaacucuauacaaaa

SEQ ID NO: 4123249 - RNA, 18 nt, Streptococcus pyogenes MGAS315
uuaauaaguauuuuaaaa

SEQ ID NO: 4123250 - RNA, 20 nt, Streptococcus pyogenes MGAS315
uuaauagcauugucaaauaa

SEQ ID NO: 4123251 - RNA, 21 nt, Streptococcus pyogenes MGAS315
uuaauagcauugucaaauaaa

SEQ ID NO: 4123252 - RNA, 22 nt, Streptococcus pyogenes MGAS315
uuaauaggcuuuuuuuguaucu

SEQ ID NO: 4123253 - RNA, 15 nt, Streptococcus pyogenes MGAS315
uuaaucaaaaaacug

SEQ ID NO: 4123254 - RNA, 22 nt, Streptococcus pyogenes MGAS315
uuaaucugucgguauaguuugg

SEQ ID NO: 4123255 - RNA, 21 nt, Streptococcus pyogenes MGAS315
uuaaucuuuuugugauauguu

SEQ ID NO: 4123256 - RNA, 23 nt, Streptococcus pyogenes MGAS315
uuaaugaccuuugauaagauauu

SEQ ID NO: 4123257 - RNA, 12 nt, Streptococcus pyogenes MGAS315
uuacaucaaaaa

SEQ ID NO: 4123258 - RNA, 14 nt, Streptococcus pyogenes MGAS315
uuacaucaaaaaaa

SEQ ID NO: 4123259 - RNA, 18 nt, Streptococcus pyogenes MGAS315
uuacaucaaaaaaagcaa

SEQ ID NO: 4123260 - RNA, 19 nt, Streptococcus pyogenes MGAS315
uuacaucaaaaaaagcaau

SEQ ID NO: 4123261 - RNA, 14 nt, Streptococcus pyogenes MGAS315
uuacuauggcuucu

SEQ ID NO: 4123262 - RNA, 14 nt, Streptococcus pyogenes MGAS315
uuacuuaucaucau

SEQ ID NO: 4123263 - RNA, 12 nt, Streptococcus pyogenes MGAS315
uuagaacuuuuc

SEQ ID NO: 4123264 - RNA, 14 nt, Streptococcus pyogenes MGAS315
uuagaauaagaaaa

SEQ ID NO: 4123265 - RNA, 20 nt, Streptococcus pyogenes MGAS315
uuagagucucuuaauuuaua

SEQ ID NO: 4123266 - RNA, 19 nt, Streptococcus pyogenes MGAS315
uuagcaaaaugcuguuugu

SEQ ID NO: 4123267 - RNA, 18 nt, Streptococcus pyogenes MGAS315
uuagcaauccaacuuuga

SEQ ID NO: 4123268 - RNA, 15 nt, Streptococcus pyogenes MGAS315
uuagcagacaaaagg

SEQ ID NO: 4123269 - RNA, 12 nt, Streptococcus pyogenes MGAS315
uuagccuuuuuu

SEQ ID NO: 4123270 - RNA, 19 nt, Streptococcus pyogenes MGAS315
uuagcugauaaucuucaau

SEQ ID NO: 4123271 - RNA, 13 nt, Streptococcus pyogenes MGAS315
uuaggaaucacaa

SEQ ID NO: 4123272 - RNA, 20 nt, Streptococcus pyogenes MGAS315
uuaggauauggaauagguaa

SEQ ID NO: 4123273 - RNA, 15 nt, Streptococcus pyogenes MGAS315
uuaggaucuguuaau

SEQ ID NO: 4123274 - RNA, 21 nt, Streptococcus pyogenes MGAS315
uuaguaccguuagcagacaaa

SEQ ID NO: 4123275 - RNA, 21 nt, Streptococcus pyogenes MGAS315
uuaguauauuguaauaacaaa

SEQ ID NO: 4123276 - RNA, 16 nt, Streptococcus pyogenes MGAS315
uuaguguagauaaacu

SEQ ID NO: 4123277 - RNA, 19 nt, Streptococcus pyogenes MGAS315
uuaguuuaggaaucacaac

SEQ ID NO: 4123278 - RNA, 21 nt, Streptococcus pyogenes MGAS315
uuauaauuugacuucaaaaau

SEQ ID NO: 4123279 - RNA, 22 nt, Streptococcus pyogenes MGAS315
uuauaauuugacuucaaaaaua

SEQ ID NO: 4123280 - RNA, 14 nt, Streptococcus pyogenes MGAS315
uuauagcuccuaaa

SEQ ID NO: 4123281 - RNA, 15 nt, Streptococcus pyogenes MGAS315
uuaucaaaccaaggu

SEQ ID NO: 4123282 - RNA, 17 nt, Streptococcus pyogenes MGAS315
uuauccuccuaaauaua

SEQ ID NO: 4123283 - RNA, 17 nt, Streptococcus pyogenes MGAS315
uuaucuucauagcuuaa

SEQ ID NO: 4123284 - RNA, 14 nt, Streptococcus pyogenes MGAS315
uuaugauuugucaa

SEQ ID NO: 4123285 - RNA, 16 nt, Streptococcus pyogenes MGAS315
uuauguuauaagagaa

SEQ ID NO: 4123286 - RNA, 20 nt, Streptococcus pyogenes MGAS315
uuauguuauaagagaaguaa

SEQ ID NO: 4123287 - RNA, 22 nt, Streptococcus pyogenes MGAS315
uuauuaaccaauuccucccuau

SEQ ID NO: 4123288 - RNA, 23 nt, Streptococcus pyogenes MGAS315
uuauuaaccaauuccucccuauu

SEQ ID NO: 4123289 - RNA, 18 nt, Streptococcus pyogenes MGAS315
uuauuaacguuaacaaaa

SEQ ID NO: 4123290 - RNA, 20 nt, Streptococcus pyogenes MGAS315
uuauuaacguuaacaaaaau

SEQ ID NO: 4123291 - RNA, 15 nt, Streptococcus pyogenes MGAS315
uuauuaauaaguauu

SEQ ID NO: 4123292 - RNA, 19 nt, Streptococcus pyogenes MGAS315
uuauuaguaaccauagaag

SEQ ID NO: 4123293 - RNA, 20 nt, Streptococcus pyogenes MGAS315
uuauuuucuagguuaaaaua

SEQ ID NO: 4123294 - RNA, 21 nt, Streptococcus pyogenes MGAS315
uuauuuugcagguaauuaucu

SEQ ID NO: 4123295 - RNA, 19 nt, Streptococcus pyogenes MGAS315
uucaaaaaagggaagaaga

SEQ ID NO: 4123296 - RNA, 17 nt, Streptococcus pyogenes MGAS315
uucaaaaauacuaccuu

SEQ ID NO: 4123297 - RNA, 16 nt, Streptococcus pyogenes MGAS315
uucaaacggaguucuc

SEQ ID NO: 4123298 - RNA, 17 nt, Streptococcus pyogenes MGAS315
uucaagagucaaaccag

SEQ ID NO: 4123299 - RNA, 18 nt, Streptococcus pyogenes MGAS315
uucaauaugaaaacgugu

SEQ ID NO: 4123300 - RNA, 23 nt, Streptococcus pyogenes MGAS315
uucaaugcgcucaagcauuuugu

SEQ ID NO: 4123301 - RNA, 17 nt, Streptococcus pyogenes MGAS315
uucaccguggacuugau

SEQ ID NO: 4123302 - RNA, 23 nt, Streptococcus pyogenes MGAS315
uucagagcacguuuucugguuuu

SEQ ID NO: 4123303 - RNA, 19 nt, Streptococcus pyogenes MGAS315
uucagauaaaaccuucaaa

SEQ ID NO: 4123304 - RNA, 14 nt, Streptococcus pyogenes MGAS315
uucagguugcaaca

SEQ ID NO: 4123305 - RNA, 13 nt, Streptococcus pyogenes MGAS315
uucauagcuuaau

SEQ ID NO: 4123306 - RNA, 21 nt, Streptococcus pyogenes MGAS315
uucaugauguuauuaaauaau

SEQ ID NO: 4123307 - RNA, 16 nt, Streptococcus pyogenes MGAS315
uuccagaacaugggag

SEQ ID NO: 4123308 - RNA, 21 nt, Streptococcus pyogenes MGAS315
uuccagaacaugggagcgcac

SEQ ID NO: 4123309 - RNA, 22 nt, Streptococcus pyogenes MGAS315
uucccuuaauaaacucuauaca

SEQ ID NO: 4123310 - RNA, 14 nt, Streptococcus pyogenes MGAS315
uucgauaaauucag

SEQ ID NO: 4123311 - RNA, 20 nt, Streptococcus pyogenes MGAS315
uucgcacagcguaagccaaa

SEQ ID NO: 4123312 - RNA, 18 nt, Streptococcus pyogenes MGAS315
uucgccuaggaauaaaau

SEQ ID NO: 4123313 - RNA, 20 nt, Streptococcus pyogenes MGAS315
uucgccuaggaauaaaaugc

SEQ ID NO: 4123314 - RNA, 21 nt, Streptococcus pyogenes MGAS315
uucgccuaggaauaaaaugcc

SEQ ID NO: 4123315 - RNA, 16 nt, Streptococcus pyogenes MGAS315
uucuaaaacgaugaga

SEQ ID NO: 4123316 - RNA, 21 nt, Streptococcus pyogenes MGAS315
uuuguguugaagaaggucaug

SEQ ID NO: 4123317 - RNA, 13 nt, Streptococcus pyogenes MGAS315
uuuguuaacaggu

SEQ ID NO: 4123318 - RNA, 19 nt, Streptococcus pyogenes MGAS315
uuuuaaauaucuuaccauu

SEQ ID NO: 4123319 - RNA, 16 nt, Streptococcus pyogenes MGAS315
uuuuaacuauuuaacu

SEQ ID NO: 4123320 - RNA, 17 nt, Streptococcus pyogenes MGAS315
uuuuacauuuuuacaau

SEQ ID NO: 4123321 - RNA, 19 nt, Streptococcus pyogenes MGAS315
uuuuaguaaagccuuaucc

SEQ ID NO: 4123322 - RNA, 19 nt, Streptococcus pyogenes MGAS315
uuuuaguugauauuuuuua

SEQ ID NO: 4123323 - RNA, 18 nt, Streptococcus pyogenes MGAS315
uuuuauaugucaucaaaa

SEQ ID NO: 4123324 - RNA, 22 nt, Streptococcus pyogenes MGAS315
uuuuauccccuauucaauauuu

SEQ ID NO: 4123325 - RNA, 16 nt, Streptococcus pyogenes MGAS315
uuuuauuauacucaau

SEQ ID NO: 4123326 - RNA, 19 nt, Streptococcus pyogenes MGAS315
uuuucaaugcgcucaagca

SEQ ID NO: 4123327 - RNA, 17 nt, Streptococcus pyogenes MGAS315
uuuucagagaugcuucu

SEQ ID NO: 4123328 - RNA, 21 nt, Streptococcus pyogenes MGAS315
uuuucagagcacguuuucugg

SEQ ID NO: 4123329 - RNA, 13 nt, Streptococcus pyogenes MGAS315
uuuuccuaucaga

SEQ ID NO: 4123330 - RNA, 17 nt, Streptococcus pyogenes MGAS315
uuuuccuaucagauacu

SEQ ID NO: 4123331 - RNA, 23 nt, Streptococcus pyogenes MGAS315
uuuucucaaaaauauauucuaau

SEQ ID NO: 4123332 - RNA, 16 nt, Streptococcus pyogenes MGAS315
uuuucuuuuggccuac

SEQ ID NO: 4123333 - RNA, 16 nt, Streptococcus pyogenes MGAS315
uuuugauuuucucagu

SEQ ID NO: 4123334 - RNA, 16 nt, Streptococcus pyogenes MGAS315
uuuugguugauauaaa

SEQ ID NO: 4123335 - RNA, 18 nt, Streptococcus pyogenes MGAS315
uuuugguugauauaaaau

SEQ ID NO: 4123336 - RNA, 17 nt, Streptococcus pyogenes MGAS315
uuuugucugacuuaaau

SEQ ID NO: 4123337 - RNA, 15 nt, Streptococcus pyogenes MGAS315
uuuugugauauguuu

SEQ ID NO: 4123338 - RNA, 18 nt, Streptococcus pyogenes MGAS315
uuuuguuguauuaugagg

SEQ ID NO: 4123339 - RNA, 20 nt, Streptococcus pyogenes MGAS315
uuuuuagcgcuaaaugucua

SEQ ID NO: 4123340 - RNA, 12 nt, Streptococcus pyogenes MGAS315
uuuuuaucugua

SEQ ID NO: 4123341 - RNA, 23 nt, Streptococcus pyogenes MGAS315
uuuuugguuaucaguauacucag

SEQ ID NO: 4123342 - RNA, 14 nt, Streptococcus pyogenes MGAS315
uuuuuguauuacuc

SEQ ID NO: 4123343 - RNA, 15 nt, Streptococcus pyogenes MGAS315
uuuuuguauuacuca

SEQ ID NO: 4123344 - RNA, 22 nt, Streptococcus pyogenes MGAS315
uuuuuuaagacuauguugcuua

SEQ ID NO: 4123345 - RNA, 14 nt, Streptococcus pyogenes MGAS315
uuuuuuauacggua

SEQ ID NO: 4123346 - RNA, 12 nt, Streptococcus pyogenes MGAS8232
aaaaaagcuuuu

SEQ ID NO: 4123347 - RNA, 14 nt, Streptococcus pyogenes MGAS8232
aaaaaauuaagaag

SEQ ID NO: 4123348 - RNA, 19 nt, Streptococcus pyogenes MGAS8232
aaaaacgaucaaaaaucuu

SEQ ID NO: 4123349 - RNA, 17 nt, Streptococcus pyogenes MGAS8232
aaaaacugugaacaaaa

SEQ ID NO: 4123350 - RNA, 18 nt, Streptococcus pyogenes MGAS8232
aaaaacugugaacaaaac

SEQ ID NO: 4123351 - RNA, 15 nt, Streptococcus pyogenes MGAS8232
aaaaagccagagcag

SEQ ID NO: 4123352 - RNA, 23 nt, Streptococcus pyogenes MGAS8232
aaaaagccuauuuaauaggcuuu

SEQ ID NO: 4123353 - RNA, 15 nt, Streptococcus pyogenes MGAS8232
aaaaagcucuuagaa

SEQ ID NO: 4123354 - RNA, 23 nt, Streptococcus pyogenes MGAS8232
aaaaaggcagucgcagaguacaa

SEQ ID NO: 4123355 - RNA, 16 nt, Streptococcus pyogenes MGAS8232
aaaaagggaagaagau

SEQ ID NO: 4123356 - RNA, 15 nt, Streptococcus pyogenes MGAS8232
aaaaauaacuuuaaa

SEQ ID NO: 4123357 - RNA, 13 nt, Streptococcus pyogenes MGAS8232
aaaaauauauucu

SEQ ID NO: 4123358 - RNA, 18 nt, Streptococcus pyogenes MGAS8232
aaaaauuaguuaucucau

SEQ ID NO: 4123359 - RNA, 14 nt, Streptococcus pyogenes MGAS8232
aaaacaaaaagaga

SEQ ID NO: 4123360 - RNA, 17 nt, Streptococcus pyogenes MGAS8232
aaaacaaaaagagaccg

SEQ ID NO: 4123361 - RNA, 16 nt, Streptococcus pyogenes MGAS8232
aaaacaaaacaaaaca

SEQ ID NO: 4123362 - RNA, 15 nt, Streptococcus pyogenes MGAS8232
aaaacaaaacauagc

SEQ ID NO: 4123363 - RNA, 20 nt, Streptococcus pyogenes MGAS8232
aaaacaauaacacagaagcc

SEQ ID NO: 4123364 - RNA, 13 nt, Streptococcus pyogenes MGAS8232
aaaaccgcccaga

SEQ ID NO: 4123365 - RNA, 18 nt, Streptococcus pyogenes MGAS8232
aaaacugugaacaaaaca

SEQ ID NO: 4123366 - RNA, 16 nt, Streptococcus pyogenes MGAS8232
aaaacuucaaauuuca

SEQ ID NO: 4123367 - RNA, 22 nt, Streptococcus pyogenes MGAS8232
aaaacuugcaucgcaaacagau

SEQ ID NO: 4123368 - RNA, 22 nt, Streptococcus pyogenes MGAS8232
aaaacuuuugacuugguuuaau

SEQ ID NO: 4123369 - RNA, 17 nt, Streptococcus pyogenes MGAS8232
aaaagaaaaucuaauca

SEQ ID NO: 4123370 - RNA, 15 nt, Streptococcus pyogenes MGAS8232
aaaagauauuuuaaa

SEQ ID NO: 4123371 - RNA, 20 nt, Streptococcus pyogenes MGAS8232
aaaagccuauuuaauaggcu

SEQ ID NO: 4123372 - RNA, 22 nt, Streptococcus pyogenes MGAS8232
aaaagccuauuuaauaggcuuu

SEQ ID NO: 4123373 - RNA, 19 nt, Streptococcus pyogenes MGAS8232
aaaagcgauaauaaagugc

SEQ ID NO: 4123374 - RNA, 20 nt, Streptococcus pyogenes MGAS8232
aaaagcucuaucaucuuugu

SEQ ID NO: 4123375 - RNA, 21 nt, Streptococcus pyogenes MGAS8232
aaaagcucuaucaucuuugua

SEQ ID NO: 4123376 - RNA, 15 nt, Streptococcus pyogenes MGAS8232
aaaagggcugaccuu

SEQ ID NO: 4123377 - RNA, 21 nt, Streptococcus pyogenes MGAS8232
aaaaguugauauccccuccuu

SEQ ID NO: 4123378 - RNA, 14 nt, Streptococcus pyogenes MGAS8232
aaaaguuggcuacu

SEQ ID NO: 4123379 - RNA, 19 nt, Streptococcus pyogenes MGAS8232
aaaauaaacuuucaguuau

SEQ ID NO: 4123380 - RNA, 13 nt, Streptococcus pyogenes MGAS8232
aaaauaacaaucu

SEQ ID NO: 4123381 - RNA, 14 nt, Streptococcus pyogenes MGAS8232
aaaauaacuuuaaa

SEQ ID NO: 4123382 - RNA, 20 nt, Streptococcus pyogenes MGAS8232
aaaauacaauaaagcguuga

SEQ ID NO: 4123383 - RNA, 23 nt, Streptococcus pyogenes MGAS8232
aaaauauauuguuuuucuuuguc

SEQ ID NO: 4123384 - RNA, 19 nt, Streptococcus pyogenes MGAS8232
aaaauaucuuuuuuacuuu

SEQ ID NO: 4123385 - RNA, 20 nt, Streptococcus pyogenes MGAS8232
aaaaucacaccauuaaaaaa

SEQ ID NO: 4123386 - RNA, 19 nt, Streptococcus pyogenes MGAS8232
aaaaucaugggaaaagcua

SEQ ID NO: 4123387 - RNA, 21 nt, Streptococcus pyogenes MGAS8232
aaaauccucuuuuaauuugga

SEQ ID NO: 4123388 - RNA, 19 nt, Streptococcus pyogenes MGAS8232
aaaaucuuuucuauuuaac

SEQ ID NO: 4123389 - RNA, 13 nt, Streptococcus pyogenes MGAS8232
aaaaugaagcaaa

SEQ ID NO: 4123390 - RNA, 15 nt, Streptococcus pyogenes MGAS8232
aaaaugacugacaaa

SEQ ID NO: 4123391 - RNA, 19 nt, Streptococcus pyogenes MGAS8232
aaaauuccccacaaaagac

SEQ ID NO: 4123392 - RNA, 12 nt, Streptococcus pyogenes MGAS8232
aaacaaaaagag

SEQ ID NO: 4123393 - RNA, 16 nt, Streptococcus pyogenes MGAS8232
aaacaaaacaaaacaa

SEQ ID NO: 4123394 - RNA, 14 nt, Streptococcus pyogenes MGAS8232
aaacaagugauacu

SEQ ID NO: 4123395 - RNA, 17 nt, Streptococcus pyogenes MGAS8232
aaacaccaccaauaaug

SEQ ID NO: 4123396 - RNA, 20 nt, Streptococcus pyogenes MGAS8232
aaacaccaccaauaaugagc

SEQ ID NO: 4123397 - RNA, 18 nt, Streptococcus pyogenes MGAS8232
aaacacuaccuuaaaugu

SEQ ID NO: 4123398 - RNA, 21 nt, Streptococcus pyogenes MGAS8232
aaacacuaccuuaaauguaug

SEQ ID NO: 4123399 - RNA, 13 nt, Streptococcus pyogenes MGAS8232
aaacauauuauag

SEQ ID NO: 4123400 - RNA, 15 nt, Streptococcus pyogenes MGAS8232
aaacauuuaaucaug

SEQ ID NO: 4123401 - RNA, 20 nt, Streptococcus pyogenes MGAS8232
aaacauuuaaucauguccaa

SEQ ID NO: 4123402 - RNA, 23 nt, Streptococcus pyogenes MGAS8232
aaaccaagugccaguaaggaaau

SEQ ID NO: 4123403 - RNA, 12 nt, Streptococcus pyogenes MGAS8232
aaaccauuuuau

SEQ ID NO: 4123404 - RNA, 18 nt, Streptococcus pyogenes MGAS8232
aaaccauuuuaugagaaa

SEQ ID NO: 4123405 - RNA, 21 nt, Streptococcus pyogenes MGAS8232
aaaccauuuuaugagaaaaau

SEQ ID NO: 4123406 - RNA, 22 nt, Streptococcus pyogenes MGAS8232
aaaccauuuuaugagaaaaaua

SEQ ID NO: 4123407 - RNA, 19 nt, Streptococcus pyogenes MGAS8232
aaacguaacguaauagaau

SEQ ID NO: 4123408 - RNA, 12 nt, Streptococcus pyogenes MGAS8232
aaacgugagaaa

SEQ ID NO: 4123409 - RNA, 14 nt, Streptococcus pyogenes MGAS8232
aaacgugagaaaau

SEQ ID NO: 4123410 - RNA, 22 nt, Streptococcus pyogenes MGAS8232
aaacguguauucuuaaaaaaau

SEQ ID NO: 4123411 - RNA, 13 nt, Streptococcus pyogenes MGAS8232
aaacuauauuguu

SEQ ID NO: 4123412 - RNA, 16 nt, Streptococcus pyogenes MGAS8232
aaacucaaaaaauaca

SEQ ID NO: 4123413 - RNA, 21 nt, Streptococcus pyogenes MGAS8232
aaacucaaaaaauacaauaaa

SEQ ID NO: 4123414 - RNA, 20 nt, Streptococcus pyogenes MGAS8232
aaccauuuuaugagaaaaau

SEQ ID NO: 4123415 - RNA, 15 nt, Streptococcus pyogenes MGAS8232
aaccgcuaaaacagu

SEQ ID NO: 4123416 - RNA, 22 nt, Streptococcus pyogenes MGAS8232
aaccguuccugucgcagauggg

SEQ ID NO: 4123417 - RNA, 17 nt, Streptococcus pyogenes MGAS8232
aaccuaucacgccagua

SEQ ID NO: 4123418 - RNA, 11 nt, Streptococcus pyogenes MGAS8232
aaccuuaaaga

SEQ ID NO: 4123419 - RNA, 17 nt, Streptococcus pyogenes MGAS8232
aaccuuuagagaaucaa

SEQ ID NO: 4123420 - RNA, 13 nt, Streptococcus pyogenes MGAS8232
aaccuuugccauu

SEQ ID NO: 4123421 - RNA, 13 nt, Streptococcus pyogenes MGAS8232
aacggaguuccuc

SEQ ID NO: 4123422 - RNA, 17 nt, Streptococcus pyogenes MGAS8232
aacguaauagaauaaaa

SEQ ID NO: 4123423 - RNA, 20 nt, Streptococcus pyogenes MGAS8232
aacgucagcggcugcucuuu

SEQ ID NO: 4123424 - RNA, 13 nt, Streptococcus pyogenes MGAS8232
aacgugagaaaau

SEQ ID NO: 4123425 - RNA, 15 nt, Streptococcus pyogenes MGAS8232
aacguuaacaaaaau

SEQ ID NO: 4123426 - RNA, 20 nt, Streptococcus pyogenes MGAS8232
aacuauauuguuaguuuuau

SEQ ID NO: 4123427 - RNA, 21 nt, Streptococcus pyogenes MGAS8232
aacuauauuguuaguuuuauc

SEQ ID NO: 4123428 - RNA, 18 nt, Streptococcus pyogenes MGAS8232
aacuaucaaguaugcuuu

SEQ ID NO: 4123429 - RNA, 14 nt, Streptococcus pyogenes MGAS8232
aacuauuuaacuua

SEQ ID NO: 4123430 - RNA, 18 nt, Streptococcus pyogenes MGAS8232
aacucaaaaaauacaaua

SEQ ID NO: 4123431 - RNA, 16 nt, Streptococcus pyogenes MGAS8232
aacucaaacuaaacaa

SEQ ID NO: 4123432 - RNA, 19 nt, Streptococcus pyogenes MGAS8232
aacucaagaggucuggcca

SEQ ID NO: 4123433 - RNA, 20 nt, Streptococcus pyogenes MGAS8232
aacuccuggauuaaaugccc

SEQ ID NO: 4123434 - RNA, 15 nt, Streptococcus pyogenes MGAS8232
aacucgauaaaaacg

SEQ ID NO: 4123435 - RNA, 19 nt, Streptococcus pyogenes MGAS8232
aacucgauaaaaacgauca

SEQ ID NO: 4123436 - RNA, 22 nt, Streptococcus pyogenes MGAS8232
aacucuaaucuuuauaaagcuu

SEQ ID NO: 4123437 - RNA, 19 nt, Streptococcus pyogenes MGAS8232
aacucuccaaaguucuucu

SEQ ID NO: 4123438 - RNA, 21 nt, Streptococcus pyogenes MGAS8232
aacugcacugagccccaaaag

SEQ ID NO: 4123439 - RNA, 14 nt, Streptococcus pyogenes MGAS8232
aacuuacaaaaagc

SEQ ID NO: 4123440 - RNA, 22 nt, Streptococcus pyogenes MGAS8232
aacuugaauaucgccaauaaaa

SEQ ID NO: 4123441 - RNA, 16 nt, Streptococcus pyogenes MGAS8232
aacuugucaagccaua

SEQ ID NO: 4123442 - RNA, 14 nt, Streptococcus pyogenes MGAS8232
aacuuuuaucacua

SEQ ID NO: 4123443 - RNA, 11 nt, Streptococcus pyogenes MGAS8232
aagaaaaccuu

SEQ ID NO: 4123444 - RNA, 16 nt, Streptococcus pyogenes MGAS8232
aagaaagacuuaagga

SEQ ID NO: 4123445 - RNA, 23 nt, Streptococcus pyogenes MGAS8232
aagaacuccuggauuaaaugccc

SEQ ID NO: 4123446 - RNA, 14 nt, Streptococcus pyogenes MGAS8232
aagaaggucaugau

SEQ ID NO: 4123447 - RNA, 15 nt, Streptococcus pyogenes MGAS8232
aagaaggucaugaug

SEQ ID NO: 4123448 - RNA, 15 nt, Streptococcus pyogenes MGAS8232
aagaaguugagacua

SEQ ID NO: 4123449 - RNA, 14 nt, Streptococcus pyogenes MGAS8232
aagacaaaaaaacu

SEQ ID NO: 4123450 - RNA, 17 nt, Streptococcus pyogenes MGAS8232
aagacaaaaaaacugga

SEQ ID NO: 4123451 - RNA, 14 nt, Streptococcus pyogenes MGAS8232
aagaccauaaaaaa

SEQ ID NO: 4123452 - RNA, 17 nt, Streptococcus pyogenes MGAS8232
aagaccauaaaaaaccu

SEQ ID NO: 4123453 - RNA, 17 nt, Streptococcus pyogenes MGAS8232
aagaccuucaaaaaagg

SEQ ID NO: 4123454 - RNA, 19 nt, Streptococcus pyogenes MGAS8232
aagaccuucaaaaaaggga

SEQ ID NO: 4123455 - RNA, 15 nt, Streptococcus pyogenes MGAS8232
aagacggaguauuuu

SEQ ID NO: 4123456 - RNA, 15 nt, Streptococcus pyogenes MGAS8232
aagacuagagucucu

SEQ ID NO: 4123457 - RNA, 18 nt, Streptococcus pyogenes MGAS8232
aagacuauguugcuuaau

SEQ ID NO: 4123458 - RNA, 20 nt, Streptococcus pyogenes MGAS8232
aagacuuauaugaaagaacu

SEQ ID NO: 4123459 - RNA, 15 nt, Streptococcus pyogenes MGAS8232
aagagagcuugguuu

SEQ ID NO: 4123460 - RNA, 17 nt, Streptococcus pyogenes MGAS8232
aagagcacacauaauga

SEQ ID NO: 4123461 - RNA, 20 nt, Streptococcus pyogenes MGAS8232
aagagccaucagcucucaag

SEQ ID NO: 4123462 - RNA, 14 nt, Streptococcus pyogenes MGAS8232
aagaggaaacaaaa

SEQ ID NO: 4123463 - RNA, 15 nt, Streptococcus pyogenes MGAS8232
aagaggaaacaaaaa

SEQ ID NO: 4123464 - RNA, 21 nt, Streptococcus pyogenes MGAS8232
aagauaccggguuguuuuuuc

SEQ ID NO: 4123465 - RNA, 17 nt, Streptococcus pyogenes MGAS8232
aagauauuuuaaaauag

SEQ ID NO: 4123466 - RNA, 16 nt, Streptococcus pyogenes MGAS8232
aagauccuacaagagg

SEQ ID NO: 4123467 - RNA, 18 nt, Streptococcus pyogenes MGAS8232
aagauuaaacuuacaaaa

SEQ ID NO: 4123468 - RNA, 19 nt, Streptococcus pyogenes MGAS8232
aagauuaaacuuacaaaaa

SEQ ID NO: 4123469 - RNA, 20 nt, Streptococcus pyogenes MGAS8232
aagcaaaauuauuauuuugc

SEQ ID NO: 4123470 - RNA, 17 nt, Streptococcus pyogenes MGAS8232
aagcaaucuaagaauug

SEQ ID NO: 4123471 - RNA, 13 nt, Streptococcus pyogenes MGAS8232
aagcauaaaaaua

SEQ ID NO: 4123472 - RNA, 15 nt, Streptococcus pyogenes MGAS8232
aagcauaaaaauauu

SEQ ID NO: 4123473 - RNA, 17 nt, Streptococcus pyogenes MGAS8232
aagcauaauaaaaagag

SEQ ID NO: 4123474 - RNA, 14 nt, Streptococcus pyogenes MGAS8232
aagcauuuuugcag

SEQ ID NO: 4123475 - RNA, 17 nt, Streptococcus pyogenes MGAS8232
aagccagagcaguucag

SEQ ID NO: 4123476 - RNA, 20 nt, Streptococcus pyogenes MGAS8232
aagcccuuauguauuuuuca

SEQ ID NO: 4123477 - RNA, 15 nt, Streptococcus pyogenes MGAS8232
aagccgugaggacuu

SEQ ID NO: 4123478 - RNA, 16 nt, Streptococcus pyogenes MGAS8232
aagcggaagaacagca

SEQ ID NO: 4123479 - RNA, 14 nt, Streptococcus pyogenes MGAS8232
aagcucuaucaucu

SEQ ID NO: 4123480 - RNA, 16 nt, Streptococcus pyogenes MGAS8232
aagcucuaucaucuuu

SEQ ID NO: 4123481 - RNA, 16 nt, Streptococcus pyogenes MGAS8232
aagcucuuagaagccu

SEQ ID NO: 4123482 - RNA, 17 nt, Streptococcus pyogenes MGAS8232
aagcucuuagaagccuu

SEQ ID NO: 4123483 - RNA, 21 nt, Streptococcus pyogenes MGAS8232
aagcugaagcuagagcuaaag

SEQ ID NO: 4123484 - RNA, 17 nt, Streptococcus pyogenes MGAS8232
aagcugagcaaaacaau

SEQ ID NO: 4123485 - RNA, 22 nt, Streptococcus pyogenes MGAS8232
aagcuuggauugccgccaugcu

SEQ ID NO: 4123486 - RNA, 15 nt, Streptococcus pyogenes MGAS8232
aagcuuuaagcuuug

SEQ ID NO: 4123487 - RNA, 21 nt, Streptococcus pyogenes MGAS8232
aaggaauugcagcuaaaaaca

SEQ ID NO: 4123488 - RNA, 18 nt, Streptococcus pyogenes MGAS8232
aaggaccaagauucauga

SEQ ID NO: 4123489 - RNA, 17 nt, Streptococcus pyogenes MGAS8232
aaggagcuuuaccuccu

SEQ ID NO: 4123490 - RNA, 15 nt, Streptococcus pyogenes MGAS8232
aaggaugaaaugauu

SEQ ID NO: 4123491 - RNA, 16 nt, Streptococcus pyogenes MGAS8232
aaggauuaugaaaaag

SEQ ID NO: 4123492 - RNA, 17 nt, Streptococcus pyogenes MGAS8232
aaggauuaugaaaaaga

SEQ ID NO: 4123493 - RNA, 15 nt, Streptococcus pyogenes MGAS8232
aaggauuuagcuguu

SEQ ID NO: 4123494 - RNA, 13 nt, Streptococcus pyogenes MGAS8232
aaggcaaagaaag

SEQ ID NO: 4123495 - RNA, 14 nt, Streptococcus pyogenes MGAS8232
aaggcaagaggagg

SEQ ID NO: 4123496 - RNA, 18 nt, Streptococcus pyogenes MGAS8232
aaggcaauccaaaucaac

SEQ ID NO: 4123497 - RNA, 21 nt, Streptococcus pyogenes MGAS8232
aaggcagucgcagaguacaag

SEQ ID NO: 4123498 - RNA, 19 nt, Streptococcus pyogenes MGAS8232
aaggcuaaggcuuacgaca

SEQ ID NO: 4123499 - RNA, 23 nt, Streptococcus pyogenes MGAS8232
aagggaagaagauccuacaagag

SEQ ID NO: 4123500 - RNA, 14 nt, Streptococcus pyogenes MGAS8232
aagggcaaugccau

SEQ ID NO: 4123501 - RNA, 22 nt, Streptococcus pyogenes MGAS8232
aagguacacgugauaaaugccg

SEQ ID NO: 4123502 - RNA, 17 nt, Streptococcus pyogenes MGAS8232
aaggucaucagaauaag

SEQ ID NO: 4123503 - RNA, 14 nt, Streptococcus pyogenes MGAS8232
aaguagauacuucg

SEQ ID NO: 4123504 - RNA, 19 nt, Streptococcus pyogenes MGAS8232
aaguagcguacauggaugc

SEQ ID NO: 4123505 - RNA, 16 nt, Streptococcus pyogenes MGAS8232
aaguauaguuauguua

SEQ ID NO: 4123506 - RNA, 22 nt, Streptococcus pyogenes MGAS8232
aagucacaccguugauguuaau

SEQ ID NO: 4123507 - RNA, 13 nt, Streptococcus pyogenes MGAS8232
aagucucuugcaa

SEQ ID NO: 4123508 - RNA, 23 nt, Streptococcus pyogenes MGAS8232
aagucuuagcaccgcuuacccua

SEQ ID NO: 4123509 - RNA, 16 nt, Streptococcus pyogenes MGAS8232
aagugauacuugguau

SEQ ID NO: 4123510 - RNA, 23 nt, Streptococcus pyogenes MGAS8232
aagugugacuaguuuauuacaaa

SEQ ID NO: 4123511 - RNA, 15 nt, Streptococcus pyogenes MGAS8232
aaguguuuugucuua

SEQ ID NO: 4123512 - RNA, 13 nt, Streptococcus pyogenes MGAS8232
acaaauccuuuug

SEQ ID NO: 4123513 - RNA, 13 nt, Streptococcus pyogenes MGAS8232
acaaauucuuuuu

SEQ ID NO: 4123514 - RNA, 16 nt, Streptococcus pyogenes MGAS8232
acaacgcuauuuuuaa

SEQ ID NO: 4123515 - RNA, 21 nt, Streptococcus pyogenes MGAS8232
acaagaccuuauuaaagcccu

SEQ ID NO: 4123516 - RNA, 14 nt, Streptococcus pyogenes MGAS8232
acaagagcuuaaaa

SEQ ID NO: 4123517 - RNA, 15 nt, Streptococcus pyogenes MGAS8232
acaagagcuuaaaag

SEQ ID NO: 4123518 - RNA, 18 nt, Streptococcus pyogenes MGAS8232
acaagcauuuuugcaggg

SEQ ID NO: 4123519 - RNA, 20 nt, Streptococcus pyogenes MGAS8232
acaaggcaauccaaaucaac

SEQ ID NO: 4123520 - RNA, 19 nt, Streptococcus pyogenes MGAS8232
acaaguaaucgaaaaugcu

SEQ ID NO: 4123521 - RNA, 19 nt, Streptococcus pyogenes MGAS8232
acaauaaggucaucagaau

SEQ ID NO: 4123522 - RNA, 20 nt, Streptococcus pyogenes MGAS8232
acaaucuuaaguuagggucu

SEQ ID NO: 4123523 - RNA, 14 nt, Streptococcus pyogenes MGAS8232
acaaugaaacguua

SEQ ID NO: 4123524 - RNA, 19 nt, Streptococcus pyogenes MGAS8232
acaaugagaucuucuuuug

SEQ ID NO: 4123525 - RNA, 21 nt, Streptococcus pyogenes MGAS8232
acaaugcucuuaacucucaua

SEQ ID NO: 4123526 - RNA, 12 nt, Streptococcus pyogenes MGAS8232
acaauuaaaaaa

SEQ ID NO: 4123527 - RNA, 13 nt, Streptococcus pyogenes MGAS8232
acaauuaaaaaag

SEQ ID NO: 4123528 - RNA, 17 nt, Streptococcus pyogenes MGAS8232
acaauuauuuugcaggu

SEQ ID NO: 4123529 - RNA, 18 nt, Streptococcus pyogenes MGAS8232
acacauaaugauuuuuaa

SEQ ID NO: 4123530 - RNA, 14 nt, Streptococcus pyogenes MGAS8232
acaccuaauaaaau

SEQ ID NO: 4123531 - RNA, 21 nt, Streptococcus pyogenes MGAS8232
acacgguuuucugucuacuua

SEQ ID NO: 4123532 - RNA, 16 nt, Streptococcus pyogenes MGAS8232
acacuuaaaugcaaaa

SEQ ID NO: 4123533 - RNA, 13 nt, Streptococcus pyogenes MGAS8232
acagaaagcggaa

SEQ ID NO: 4123534 - RNA, 11 nt, Streptococcus pyogenes MGAS8232
acagagucuua

SEQ ID NO: 4123535 - RNA, 23 nt, Streptococcus pyogenes MGAS8232
acagagucuuaguuuaggaauca

SEQ ID NO: 4123536 - RNA, 19 nt, Streptococcus pyogenes MGAS8232
acagaugaaaaucuguauu

SEQ ID NO: 4123537 - RNA, 17 nt, Streptococcus pyogenes MGAS8232
acagcaauuuguuccau

SEQ ID NO: 4123538 - RNA, 18 nt, Streptococcus pyogenes MGAS8232
acagcaccuucaaccgcu

SEQ ID NO: 4123539 - RNA, 19 nt, Streptococcus pyogenes MGAS8232
acagccguucuuaaaagaa

SEQ ID NO: 4123540 - RNA, 14 nt, Streptococcus pyogenes MGAS8232
acagucaagagcac

SEQ ID NO: 4123541 - RNA, 18 nt, Streptococcus pyogenes MGAS8232
acaguccaaacucaaacu

SEQ ID NO: 4123542 - RNA, 16 nt, Streptococcus pyogenes MGAS8232
acauacucuauuuacu

SEQ ID NO: 4123543 - RNA, 19 nt, Streptococcus pyogenes MGAS8232
acauacucuauuuacucau

SEQ ID NO: 4123544 - RNA, 13 nt, Streptococcus pyogenes MGAS8232
acauaguguuuug

SEQ ID NO: 4123545 - RNA, 22 nt, Streptococcus pyogenes MGAS8232
acauaguguuuugaauguugua

SEQ ID NO: 4123546 - RNA, 20 nt, Streptococcus pyogenes MGAS8232
acaucaaaggcuuuuuugua

SEQ ID NO: 4123547 - RNA, 18 nt, Streptococcus pyogenes MGAS8232
acaucaacuaucaaguau

SEQ ID NO: 4123548 - RNA, 15 nt, Streptococcus pyogenes MGAS8232
acaucacguaaccaa

SEQ ID NO: 4123549 - RNA, 15 nt, Streptococcus pyogenes MGAS8232
acaugaccaaaaaau

SEQ ID NO: 4123550 - RNA, 22 nt, Streptococcus pyogenes MGAS8232
acauggucgaccuuaaaggccu

SEQ ID NO: 4123551 - RNA, 15 nt, Streptococcus pyogenes MGAS8232
acauuaguccaaaau

SEQ ID NO: 4123552 - RNA, 20 nt, Streptococcus pyogenes MGAS8232
acauuuaugcugauuuugga

SEQ ID NO: 4123553 - RNA, 14 nt, Streptococcus pyogenes MGAS8232
acauuuuuacaaua

SEQ ID NO: 4123554 - RNA, 15 nt, Streptococcus pyogenes MGAS8232
accaaaaccaagugc

SEQ ID NO: 4123555 - RNA, 12 nt, Streptococcus pyogenes MGAS8232
accaagauucau

SEQ ID NO: 4123556 - RNA, 18 nt, Streptococcus pyogenes MGAS8232
accaauaaugagcaaggc

SEQ ID NO: 4123557 - RNA, 18 nt, Streptococcus pyogenes MGAS8232
accaauauagcaaucuuc

SEQ ID NO: 4123558 - RNA, 16 nt, Streptococcus pyogenes MGAS8232
accaauuguugaauaa

SEQ ID NO: 4123559 - RNA, 22 nt, Streptococcus pyogenes MGAS8232
accaauuugcaguuagcauucc

SEQ ID NO: 4123560 - RNA, 16 nt, Streptococcus pyogenes MGAS8232
accauaucacaaaacc

SEQ ID NO: 4123561 - RNA, 16 nt, Streptococcus pyogenes MGAS8232
accauaucgacauuua

SEQ ID NO: 4123562 - RNA, 13 nt, Streptococcus pyogenes MGAS8232
accauugccauua

SEQ ID NO: 4123563 - RNA, 14 nt, Streptococcus pyogenes MGAS8232
accccaaaggcuga

SEQ ID NO: 4123564 - RNA, 19 nt, Streptococcus pyogenes MGAS8232
acccgucuuacaauuaaua

SEQ ID NO: 4123565 - RNA, 16 nt, Streptococcus pyogenes MGAS8232
accgaagucucuuuug

SEQ ID NO: 4123566 - RNA, 14 nt, Streptococcus pyogenes MGAS8232
accgcuaaaacagu

SEQ ID NO: 4123567 - RNA, 17 nt, Streptococcus pyogenes MGAS8232
accgcuaggauuuuucc

SEQ ID NO: 4123568 - RNA, 15 nt, Streptococcus pyogenes MGAS8232
accguaacuugcuuu

SEQ ID NO: 4123569 - RNA, 15 nt, Streptococcus pyogenes MGAS8232
accuaaaagaacgag

SEQ ID NO: 4123570 - RNA, 13 nt, Streptococcus pyogenes MGAS8232
accuaauaaaaua

SEQ ID NO: 4123571 - RNA, 19 nt, Streptococcus pyogenes MGAS8232
accuaauugugagaaacua

SEQ ID NO: 4123572 - RNA, 16 nt, Streptococcus pyogenes MGAS8232
accuacgauaaaacaa

SEQ ID NO: 4123573 - RNA, 23 nt, Streptococcus pyogenes MGAS8232
accuacugccauggguaaaauga

SEQ ID NO: 4123574 - RNA, 14 nt, Streptococcus pyogenes MGAS8232
accuauagaaaguu

SEQ ID NO: 4123575 - RNA, 16 nt, Streptococcus pyogenes MGAS8232
accuauugagucuuuu

SEQ ID NO: 4123576 - RNA, 19 nt, Streptococcus pyogenes MGAS8232
accuccuaaacuaauaaga

SEQ ID NO: 4123577 - RNA, 19 nt, Streptococcus pyogenes MGAS8232
accucucaugggcaaauaa

SEQ ID NO: 4123578 - RNA, 15 nt, Streptococcus pyogenes MGAS8232
accucuuuuucugga

SEQ ID NO: 4123579 - RNA, 18 nt, Streptococcus pyogenes MGAS8232
accugagccgccaacaua

SEQ ID NO: 4123580 - RNA, 19 nt, Streptococcus pyogenes MGAS8232
accugagccgccaacauag

SEQ ID NO: 4123581 - RNA, 18 nt, Streptococcus pyogenes MGAS8232
accuuagugguuugcaaa

SEQ ID NO: 4123582 - RNA, 20 nt, Streptococcus pyogenes MGAS8232
accuuaugcagguguuuaaa

SEQ ID NO: 4123583 - RNA, 13 nt, Streptococcus pyogenes MGAS8232
accuuugccauuu

SEQ ID NO: 4123584 - RNA, 12 nt, Streptococcus pyogenes MGAS8232
acgacagcagca

SEQ ID NO: 4123585 - RNA, 23 nt, Streptococcus pyogenes MGAS8232
acgagguaacuagccuacagucu

SEQ ID NO: 4123586 - RNA, 14 nt, Streptococcus pyogenes MGAS8232
acgauagcaaucac

SEQ ID NO: 4123587 - RNA, 22 nt, Streptococcus pyogenes MGAS8232
acgcuagcauaaugcauguaau

SEQ ID NO: 4123588 - RNA, 16 nt, Streptococcus pyogenes MGAS8232
acguaagcaucauuau

SEQ ID NO: 4123589 - RNA, 12 nt, Streptococcus pyogenes MGAS8232
acgugagaaaau

SEQ ID NO: 4123590 - RNA, 18 nt, Streptococcus pyogenes MGAS8232
acguguauucuuaaaaaa

SEQ ID NO: 4123591 - RNA, 12 nt, Streptococcus pyogenes MGAS8232
acuaaaaucaug

SEQ ID NO: 4123592 - RNA, 13 nt, Streptococcus pyogenes MGAS8232
acuaaguccuuuu

SEQ ID NO: 4123593 - RNA, 15 nt, Streptococcus pyogenes MGAS8232
acuaauauaaggcaa

SEQ ID NO: 4123594 - RNA, 19 nt, Streptococcus pyogenes MGAS8232
acuagauaagucauuuuaa

SEQ ID NO: 4123595 - RNA, 17 nt, Streptococcus pyogenes MGAS8232
acuagcacaaaaucauu

SEQ ID NO: 4123596 - RNA, 19 nt, Streptococcus pyogenes MGAS8232
acuaguuuauuacaaaacu

SEQ ID NO: 4123597 - RNA, 21 nt, Streptococcus pyogenes MGAS8232
acuaguuuauuacaaaacugu

SEQ ID NO: 4123598 - RNA, 22 nt, Streptococcus pyogenes MGAS8232
acuauauuguuaguuuuauccc

SEQ ID NO: 4123599 - RNA, 12 nt, Streptococcus pyogenes MGAS8232
acuaugaaaaaa

SEQ ID NO: 4123600 - RNA, 15 nt, Streptococcus pyogenes MGAS8232
acuaugaaaaaagaa

SEQ ID NO: 4123601 - RNA, 16 nt, Streptococcus pyogenes MGAS8232
acuaugaaaaaagaac

SEQ ID NO: 4123602 - RNA, 21 nt, Streptococcus pyogenes MGAS8232
acuauggcuucuaaaaaaaag

SEQ ID NO: 4123603 - RNA, 20 nt, Streptococcus pyogenes MGAS8232
acuauugaaucuuguuuaac

SEQ ID NO: 4123604 - RNA, 23 nt, Streptococcus pyogenes MGAS8232
acuauugcaugaggcaaaugaaa

SEQ ID NO: 4123605 - RNA, 19 nt, Streptococcus pyogenes MGAS8232
acuauuguagaggugauga

SEQ ID NO: 4123606 - RNA, 13 nt, Streptococcus pyogenes MGAS8232
acuauuuugugac

SEQ ID NO: 4123607 - RNA, 16 nt, Streptococcus pyogenes MGAS8232
acucaaaaaauacaau

SEQ ID NO: 4123608 - RNA, 23 nt, Streptococcus pyogenes MGAS8232
acucaagaggucuggccagcuac

SEQ ID NO: 4123609 - RNA, 17 nt, Streptococcus pyogenes MGAS8232
acucaauagcugcugcu

SEQ ID NO: 4123610 - RNA, 15 nt, Streptococcus pyogenes MGAS8232
agcaaucauguuguc

SEQ ID NO: 4123611 - RNA, 17 nt, Streptococcus pyogenes MGAS8232
agcaaugguuaaaaaga

SEQ ID NO: 4123612 - RNA, 19 nt, Streptococcus pyogenes MGAS8232
agcaaugguuaaaaagaga

SEQ ID NO: 4123613 - RNA, 15 nt, Streptococcus pyogenes MGAS8232
agcaauuguuuuuuc

SEQ ID NO: 4123614 - RNA, 16 nt, Streptococcus pyogenes MGAS8232
agcaauuguuuuuuca

SEQ ID NO: 4123615 - RNA, 15 nt, Streptococcus pyogenes MGAS8232
agcacaaaagaggca

SEQ ID NO: 4123616 - RNA, 11 nt, Streptococcus pyogenes MGAS8232
agcagcagaag

SEQ ID NO: 4123617 - RNA, 16 nt, Streptococcus pyogenes MGAS8232
agcagcagaagcaaau

SEQ ID NO: 4123618 - RNA, 20 nt, Streptococcus pyogenes MGAS8232
agcagcagaagcaaauucuu

SEQ ID NO: 4123619 - RNA, 12 nt, Streptococcus pyogenes MGAS8232
agcagcaucacg

SEQ ID NO: 4123620 - RNA, 22 nt, Streptococcus pyogenes MGAS8232
agcagcaucacguacagaaaug

SEQ ID NO: 4123621 - RNA, 15 nt, Streptococcus pyogenes MGAS8232
agcaguuauaauuag

SEQ ID NO: 4123622 - RNA, 17 nt, Streptococcus pyogenes MGAS8232
agcaguuauaauuagua

SEQ ID NO: 4123623 - RNA, 17 nt, Streptococcus pyogenes MGAS8232
agcaguucagcagcacu

SEQ ID NO: 4123624 - RNA, 23 nt, Streptococcus pyogenes MGAS8232
agcaguugcgaucauaaauaaag

SEQ ID NO: 4123625 - RNA, 23 nt, Streptococcus pyogenes MGAS8232
agcauaaaagauauuuuaaaaua

SEQ ID NO: 4123626 - RNA, 14 nt, Streptococcus pyogenes MGAS8232
agcauaauaaaaag

SEQ ID NO: 4123627 - RNA, 15 nt, Streptococcus pyogenes MGAS8232
agcauaauaaaaaga

SEQ ID NO: 4123628 - RNA, 21 nt, Streptococcus pyogenes MGAS8232
agcauaauaaaaagagucuga

SEQ ID NO: 4123629 - RNA, 16 nt, Streptococcus pyogenes MGAS8232
agcauaccuaaaagaa

SEQ ID NO: 4123630 - RNA, 19 nt, Streptococcus pyogenes MGAS8232
agcauauuuugauuacuga

SEQ ID NO: 4123631 - RNA, 17 nt, Streptococcus pyogenes MGAS8232
agcaucacguacagaaa

SEQ ID NO: 4123632 - RNA, 18 nt, Streptococcus pyogenes MGAS8232
agcaucacguacagaaau

SEQ ID NO: 4123633 - RNA, 23 nt, Streptococcus pyogenes MGAS8232
agcaucaggauugccaucaaugu

SEQ ID NO: 4123634 - RNA, 22 nt, Streptococcus pyogenes MGAS8232
agcauuaaggauuaugaaaaag

SEQ ID NO: 4123635 - RNA, 15 nt, Streptococcus pyogenes MGAS8232
agcauuuucaucauc

SEQ ID NO: 4123636 - RNA, 19 nt, Streptococcus pyogenes MGAS8232
agcauuuucaucaucaaga

SEQ ID NO: 4123637 - RNA, 13 nt, Streptococcus pyogenes MGAS8232
agccaaaauaaca

SEQ ID NO: 4123638 - RNA, 14 nt, Streptococcus pyogenes MGAS8232
agccaaauccaccu

SEQ ID NO: 4123639 - RNA, 12 nt, Streptococcus pyogenes MGAS8232
agccaauuacuu

SEQ ID NO: 4123640 - RNA, 15 nt, Streptococcus pyogenes MGAS8232
agccagagcaguuca

SEQ ID NO: 4123641 - RNA, 14 nt, Streptococcus pyogenes MGAS8232
agccaucaauagca

SEQ ID NO: 4123642 - RNA, 18 nt, Streptococcus pyogenes MGAS8232
agccgcucuaauuuaguc

SEQ ID NO: 4123643 - RNA, 22 nt, Streptococcus pyogenes MGAS8232
agccuuuucuuuuuggcugaug

SEQ ID NO: 4123644 - RNA, 21 nt, Streptococcus pyogenes MGAS8232
agcgcacuuuauuaugccaaa

SEQ ID NO: 4123645 - RNA, 22 nt, Streptococcus pyogenes MGAS8232
agcgccagcauuugccauggca

SEQ ID NO: 4123646 - RNA, 21 nt, Streptococcus pyogenes MGAS8232
agcgggaacacucaucauauu

SEQ ID NO: 4123647 - RNA, 16 nt, Streptococcus pyogenes MGAS8232
agcgguuuugucuuau

SEQ ID NO: 4123648 - RNA, 18 nt, Streptococcus pyogenes MGAS8232
agcguugacaguuaaaaa

SEQ ID NO: 4123649 - RNA, 22 nt, Streptococcus pyogenes MGAS8232
agcguugacaguuaaaaauaac

SEQ ID NO: 4123650 - RNA, 17 nt, Streptococcus pyogenes MGAS8232
agcuaaaagcauaaaaa

SEQ ID NO: 4123651 - RNA, 14 nt, Streptococcus pyogenes MGAS8232
agcuccuaaaacca

SEQ ID NO: 4123652 - RNA, 22 nt, Streptococcus pyogenes MGAS8232
agcucgucuuuguccauuuuuu

SEQ ID NO: 4123653 - RNA, 15 nt, Streptococcus pyogenes MGAS8232
agcucuaucaucuuu

SEQ ID NO: 4123654 - RNA, 18 nt, Streptococcus pyogenes MGAS8232
agcucuaucaucuuugua

SEQ ID NO: 4123655 - RNA, 16 nt, Streptococcus pyogenes MGAS8232
agcucugucagcaaua

SEQ ID NO: 4123656 - RNA, 14 nt, Streptococcus pyogenes MGAS8232
agcucuuuaucacc

SEQ ID NO: 4123657 - RNA, 18 nt, Streptococcus pyogenes MGAS8232
agcugagcaaaacaauaa

SEQ ID NO: 4123658 - RNA, 20 nt, Streptococcus pyogenes MGAS8232
agcugcugcuaaagcaauca

SEQ ID NO: 4123659 - RNA, 14 nt, Streptococcus pyogenes MGAS8232
agcuggaguuuuuu

SEQ ID NO: 4123660 - RNA, 20 nt, Streptococcus pyogenes MGAS8232
agcugucaauaacaacguca

SEQ ID NO: 4123661 - RNA, 22 nt, Streptococcus pyogenes MGAS8232
agcugucgcguuucgaaaaagg

SEQ ID NO: 4123662 - RNA, 15 nt, Streptococcus pyogenes MGAS8232
agcuguucucuuugg

SEQ ID NO: 4123663 - RNA, 22 nt, Streptococcus pyogenes MGAS8232
agcuuacuucuaagagccaaaa

SEQ ID NO: 4123664 - RNA, 22 nt, Streptococcus pyogenes MGAS8232
agcuuauaguuugacuucaaaa

SEQ ID NO: 4123665 - RNA, 13 nt, Streptococcus pyogenes MGAS8232
agcuuaucaaggu

SEQ ID NO: 4123666 - RNA, 15 nt, Streptococcus pyogenes MGAS8232
agcuuaucaagguug

SEQ ID NO: 4123667 - RNA, 12 nt, Streptococcus pyogenes MGAS8232
agcuuuaaaaaa

SEQ ID NO: 4123668 - RNA, 23 nt, Streptococcus pyogenes MGAS8232
agcuuuuuuuguuuuggccaaua

SEQ ID NO: 4123669 - RNA, 16 nt, Streptococcus pyogenes MGAS8232
aggaaaaagccagagc

SEQ ID NO: 4123670 - RNA, 20 nt, Streptococcus pyogenes MGAS8232
aggaauaucaggcaaaacaa

SEQ ID NO: 4123671 - RNA, 19 nt, Streptococcus pyogenes MGAS8232
aggaauaucaugaaguaua

SEQ ID NO: 4123672 - RNA, 21 nt, Streptococcus pyogenes MGAS8232
aggaauugcagcuaaaaacaa

SEQ ID NO: 4123673 - RNA, 22 nt, Streptococcus pyogenes MGAS8232
aggaauugcagcuaaaaacaau

SEQ ID NO: 4123674 - RNA, 14 nt, Streptococcus pyogenes MGAS8232
aggagcuuuaccuc

SEQ ID NO: 4123675 - RNA, 14 nt, Streptococcus pyogenes MGAS8232
aggaggcaacugug

SEQ ID NO: 4123676 - RNA, 18 nt, Streptococcus pyogenes MGAS8232
aggauauugagaagaaaa

SEQ ID NO: 4123677 - RNA, 20 nt, Streptococcus pyogenes MGAS8232
aggauauugagaagaaaaaa

SEQ ID NO: 4123678 - RNA, 17 nt, Streptococcus pyogenes MGAS8232
aggauuaugaaaaagaa

SEQ ID NO: 4123679 - RNA, 20 nt, Streptococcus pyogenes MGAS8232
aggcaauccaaaucaacaug

SEQ ID NO: 4123680 - RNA, 17 nt, Streptococcus pyogenes MGAS8232
aggcaguucgauuauua

SEQ ID NO: 4123681 - RNA, 15 nt, Streptococcus pyogenes MGAS8232
aggccuguauuucuu

SEQ ID NO: 4123682 - RNA, 13 nt, Streptococcus pyogenes MGAS8232
aggccuugugccu

SEQ ID NO: 4123683 - RNA, 16 nt, Streptococcus pyogenes MGAS8232
aggcuuacgacagcag

SEQ ID NO: 4123684 - RNA, 23 nt, Streptococcus pyogenes MGAS8232
agggguaauuugguggaagagua

SEQ ID NO: 4123685 - RNA, 21 nt, Streptococcus pyogenes MGAS8232
aggguaucugcucagagcuuu

SEQ ID NO: 4123686 - RNA, 20 nt, Streptococcus pyogenes MGAS8232
agguaauagcguaaagcaag

SEQ ID NO: 4123687 - RNA, 15 nt, Streptococcus pyogenes MGAS8232
agguauuuauaaaua

SEQ ID NO: 4123688 - RNA, 22 nt, Streptococcus pyogenes MGAS8232
aggucugcaauauccauagaaa

SEQ ID NO: 4123689 - RNA, 16 nt, Streptococcus pyogenes MGAS8232
aggucugcuucuuacu

SEQ ID NO: 4123690 - RNA, 18 nt, Streptococcus pyogenes MGAS8232
aggucugugaugaaucau

SEQ ID NO: 4123691 - RNA, 23 nt, Streptococcus pyogenes MGAS8232
aggugaaaauaucuuuuuuacuu

SEQ ID NO: 4123692 - RNA, 16 nt, Streptococcus pyogenes MGAS8232
aggugauugacuugug

SEQ ID NO: 4123693 - RNA, 22 nt, Streptococcus pyogenes MGAS8232
agguggagcuuuaguugcuucu

SEQ ID NO: 4123694 - RNA, 15 nt, Streptococcus pyogenes MGAS8232
agguuaaguaaaagc

SEQ ID NO: 4123695 - RNA, 20 nt, Streptococcus pyogenes MGAS8232
agguugguaaaaaggcaguc

SEQ ID NO: 4123696 - RNA, 16 nt, Streptococcus pyogenes MGAS8232
aguaaaaucuuauuuu

SEQ ID NO: 4123697 - RNA, 18 nt, Streptococcus pyogenes MGAS8232
aguaaagccuuauccauu

SEQ ID NO: 4123698 - RNA, 13 nt, Streptococcus pyogenes MGAS8232
aguaaaggauuua

SEQ ID NO: 4123699 - RNA, 16 nt, Streptococcus pyogenes MGAS8232
aguaaaggauuuaguu

SEQ ID NO: 4123700 - RNA, 23 nt, Streptococcus pyogenes MGAS8232
aguaagauggugcuuuaaaaagu

SEQ ID NO: 4123701 - RNA, 15 nt, Streptococcus pyogenes MGAS8232
aguaaggaaaucaau

SEQ ID NO: 4123702 - RNA, 19 nt, Streptococcus pyogenes MGAS8232
aguaaggaaaucaauccug

SEQ ID NO: 4123703 - RNA, 16 nt, Streptococcus pyogenes MGAS8232
aguaaggaccaagauu

SEQ ID NO: 4123704 - RNA, 18 nt, Streptococcus pyogenes MGAS8232
aguagagacgucuggauu

SEQ ID NO: 4123705 - RNA, 14 nt, Streptococcus pyogenes MGAS8232
aguagcaaauaaca

SEQ ID NO: 4123706 - RNA, 13 nt, Streptococcus pyogenes MGAS8232
aguagcaccuuuu

SEQ ID NO: 4123707 - RNA, 19 nt, Streptococcus pyogenes MGAS8232
auagaagacggaguauuuu

SEQ ID NO: 4123708 - RNA, 14 nt, Streptococcus pyogenes MGAS8232
auagacaagcuuuu

SEQ ID NO: 4123709 - RNA, 23 nt, Streptococcus pyogenes MGAS8232
auagauaguugguauauagcuca

SEQ ID NO: 4123710 - RNA, 17 nt, Streptococcus pyogenes MGAS8232
auagcaaugguuaaaaa

SEQ ID NO: 4123711 - RNA, 19 nt, Streptococcus pyogenes MGAS8232
auagcaaugguuaaaaaga

SEQ ID NO: 4123712 - RNA, 21 nt, Streptococcus pyogenes MGAS8232
auagcaccuacgauaaaacaa

SEQ ID NO: 4123713 - RNA, 13 nt, Streptococcus pyogenes MGAS8232
auagcauaaaaua

SEQ ID NO: 4123714 - RNA, 18 nt, Streptococcus pyogenes MGAS8232
auagcauugucaaauaaa

SEQ ID NO: 4123715 - RNA, 16 nt, Streptococcus pyogenes MGAS8232
auagcgaaaaaggguc

SEQ ID NO: 4123716 - RNA, 12 nt, Streptococcus pyogenes MGAS8232
auagcugcugcu

SEQ ID NO: 4123717 - RNA, 21 nt, Streptococcus pyogenes MGAS8232
auagcugcugcuaaagcaauc

SEQ ID NO: 4123718 - RNA, 12 nt, Streptococcus pyogenes MGAS8232
auaggcuuuuuu

SEQ ID NO: 4123719 - RNA, 13 nt, Streptococcus pyogenes MGAS8232
auagggguaauuu

SEQ ID NO: 4123720 - RNA, 19 nt, Streptococcus pyogenes MGAS8232
auagguaaagauuuuaaau

SEQ ID NO: 4123721 - RNA, 18 nt, Streptococcus pyogenes MGAS8232
auaguaaccauugccauu

SEQ ID NO: 4123722 - RNA, 15 nt, Streptococcus pyogenes MGAS8232
auaguauaccuauau

SEQ ID NO: 4123723 - RNA, 16 nt, Streptococcus pyogenes MGAS8232
auaguauuaucucauu

SEQ ID NO: 4123724 - RNA, 13 nt, Streptococcus pyogenes MGAS8232
auaguucccuuaa

SEQ ID NO: 4123725 - RNA, 15 nt, Streptococcus pyogenes MGAS8232
auaguucccuuaaua

SEQ ID NO: 4123726 - RNA, 22 nt, Streptococcus pyogenes MGAS8232
auaguuugacuucaaaaauacu

SEQ ID NO: 4123727 - RNA, 10 nt, Streptococcus pyogenes MGAS8232
auauaaaauu

SEQ ID NO: 4123728 - RNA, 18 nt, Streptococcus pyogenes MGAS8232
auauaaagucagacucaa

SEQ ID NO: 4123729 - RNA, 13 nt, Streptococcus pyogenes MGAS8232
auauaaauuauua

SEQ ID NO: 4123730 - RNA, 20 nt, Streptococcus pyogenes MGAS8232
auauagaauagguaaagauu

SEQ ID NO: 4123731 - RNA, 21 nt, Streptococcus pyogenes MGAS8232
auaucauaaguuaccaauuca

SEQ ID NO: 4123732 - RNA, 20 nt, Streptococcus pyogenes MGAS8232
auauccauagaaauuguaac

SEQ ID NO: 4123733 - RNA, 19 nt, Streptococcus pyogenes MGAS8232
auauccccuccuugcaaua

SEQ ID NO: 4123734 - RNA, 14 nt, Streptococcus pyogenes MGAS8232
auaucgacauuuau

SEQ ID NO: 4123735 - RNA, 17 nt, Streptococcus pyogenes MGAS8232
auaucgccaauaaaaaa

SEQ ID NO: 4123736 - RNA, 12 nt, Streptococcus pyogenes MGAS8232
auaucuagaaca

SEQ ID NO: 4123737 - RNA, 18 nt, Streptococcus pyogenes MGAS8232
auaucuagaacagcugcu

SEQ ID NO: 4123738 - RNA, 20 nt, Streptococcus pyogenes MGAS8232
auaucuuucaguuguuuuaa

SEQ ID NO: 4123739 - RNA, 21 nt, Streptococcus pyogenes MGAS8232
auaucuuuuuuacuuuuaaaa

SEQ ID NO: 4123740 - RNA, 15 nt, Streptococcus pyogenes MGAS8232
auaugaaagaacuau

SEQ ID NO: 4123741 - RNA, 12 nt, Streptococcus pyogenes MGAS8232
auaugauauaaa

SEQ ID NO: 4123742 - RNA, 14 nt, Streptococcus pyogenes MGAS8232
auaugauauaaaaa

SEQ ID NO: 4123743 - RNA, 18 nt, Streptococcus pyogenes MGAS8232
auaugguggguaaaacca

SEQ ID NO: 4123744 - RNA, 14 nt, Streptococcus pyogenes MGAS8232
auaugucaucaaaa

SEQ ID NO: 4123745 - RNA, 21 nt, Streptococcus pyogenes MGAS8232
auauuaaccggcucuaaaaua

SEQ ID NO: 4123746 - RNA, 15 nt, Streptococcus pyogenes MGAS8232
auauuagcaaaaugc

SEQ ID NO: 4123747 - RNA, 16 nt, Streptococcus pyogenes MGAS8232
auauuauauuaaauua

SEQ ID NO: 4123748 - RNA, 17 nt, Streptococcus pyogenes MGAS8232
auauuauguucuaaaaa

SEQ ID NO: 4123749 - RNA, 18 nt, Streptococcus pyogenes MGAS8232
auauuauguucuaaaaaa

SEQ ID NO: 4123750 - RNA, 19 nt, Streptococcus pyogenes MGAS8232
auauuauguucuaaaaaag

SEQ ID NO: 4123751 - RNA, 13 nt, Streptococcus pyogenes MGAS8232
auauucauuuucu

SEQ ID NO: 4123752 - RNA, 15 nt, Streptococcus pyogenes MGAS8232
auauugagaagaaaa

SEQ ID NO: 4123753 - RNA, 17 nt, Streptococcus pyogenes MGAS8232
auauugagaagaaaaaa

SEQ ID NO: 4123754 - RNA, 16 nt, Streptococcus pyogenes MGAS8232
auauugggacuuuuca

SEQ ID NO: 4123755 - RNA, 22 nt, Streptococcus pyogenes MGAS8232
auauugguugccugaaauauaa

SEQ ID NO: 4123756 - RNA, 23 nt, Streptococcus pyogenes MGAS8232
auauuguuaauauagucugcaug

SEQ ID NO: 4123757 - RNA, 18 nt, Streptococcus pyogenes MGAS8232
auauuguuuuucuuuguc

SEQ ID NO: 4123758 - RNA, 13 nt, Streptococcus pyogenes MGAS8232
auauuuuauauua

SEQ ID NO: 4123759 - RNA, 18 nt, Streptococcus pyogenes MGAS8232
auauuuuauauuauguuc

SEQ ID NO: 4123760 - RNA, 13 nt, Streptococcus pyogenes MGAS8232
auauuuuauuaau

SEQ ID NO: 4123761 - RNA, 15 nt, Streptococcus pyogenes MGAS8232
aucaaaagaccauaa

SEQ ID NO: 4123762 - RNA, 18 nt, Streptococcus pyogenes MGAS8232
aucaaaagaccauaaaaa

SEQ ID NO: 4123763 - RNA, 19 nt, Streptococcus pyogenes MGAS8232
aucaaaagaccauaaaaaa

SEQ ID NO: 4123764 - RNA, 18 nt, Streptococcus pyogenes MGAS8232
aucaaaccaagguauuua

SEQ ID NO: 4123765 - RNA, 18 nt, Streptococcus pyogenes MGAS8232
aucaaaggguguuuuuua

SEQ ID NO: 4123766 - RNA, 17 nt, Streptococcus pyogenes MGAS8232
aucaaccucucagcugu

SEQ ID NO: 4123767 - RNA, 14 nt, Streptococcus pyogenes MGAS8232
aucaaguaugcuuu

SEQ ID NO: 4123768 - RNA, 19 nt, Streptococcus pyogenes MGAS8232
aucaauaacagaaauuaau

SEQ ID NO: 4123769 - RNA, 20 nt, Streptococcus pyogenes MGAS8232
aucaaugacuugaccaaaua

SEQ ID NO: 4123770 - RNA, 21 nt, Streptococcus pyogenes MGAS8232
aucagcauaaccuuugccauu

SEQ ID NO: 4123771 - RNA, 17 nt, Streptococcus pyogenes MGAS8232
aucaggcuuaaacauau

SEQ ID NO: 4123772 - RNA, 16 nt, Streptococcus pyogenes MGAS8232
aucaguccuccucuuu

SEQ ID NO: 4123773 - RNA, 22 nt, Streptococcus pyogenes MGAS8232
aucauaaauaaagauaauuucu

SEQ ID NO: 4123774 - RNA, 18 nt, Streptococcus pyogenes MGAS8232
aucauauuguuaauaugu

SEQ ID NO: 4123775 - RNA, 21 nt, Streptococcus pyogenes MGAS8232
aucaucgaguggauacaaggu

SEQ ID NO: 4123776 - RNA, 22 nt, Streptococcus pyogenes MGAS8232
aucaucuuuguaguaggugaca

SEQ ID NO: 4123777 - RNA, 20 nt, Streptococcus pyogenes MGAS8232
aucauggagucaaugaaaag

SEQ ID NO: 4123778 - RNA, 22 nt, Streptococcus pyogenes MGAS8232
aucauguccaaggggugucuga

SEQ ID NO: 4123779 - RNA, 14 nt, Streptococcus pyogenes MGAS8232
aucauuauugacaa

SEQ ID NO: 4123780 - RNA, 19 nt, Streptococcus pyogenes MGAS8232
aucauuauugacaaaucca

SEQ ID NO: 4123781 - RNA, 21 nt, Streptococcus pyogenes MGAS8232
aucauuuuggagagauuuuua

SEQ ID NO: 4123782 - RNA, 23 nt, Streptococcus pyogenes MGAS8232
aucauuuuggagagauuuuuaaa

SEQ ID NO: 4123783 - RNA, 20 nt, Streptococcus pyogenes MGAS8232
auccaaucaccuuucuauau

SEQ ID NO: 4123784 - RNA, 16 nt, Streptococcus pyogenes MGAS8232
auccauuauaaaucuu

SEQ ID NO: 4123785 - RNA, 13 nt, Streptococcus pyogenes MGAS8232
aucccaucuuugu

SEQ ID NO: 4123786 - RNA, 18 nt, Streptococcus pyogenes MGAS8232
auccccucguuuaaaugu

SEQ ID NO: 4123787 - RNA, 18 nt, Streptococcus pyogenes MGAS8232
aucccuaugaucuguuua

SEQ ID NO: 4123788 - RNA, 16 nt, Streptococcus pyogenes MGAS8232
auccgaguuuugcuga

SEQ ID NO: 4123789 - RNA, 15 nt, Streptococcus pyogenes MGAS8232
auccuccuaaauaua

SEQ ID NO: 4123790 - RNA, 16 nt, Streptococcus pyogenes MGAS8232
auccuuuugaaaaauu

SEQ ID NO: 4123791 - RNA, 16 nt, Streptococcus pyogenes MGAS8232
aucgccaauaaaaaag

SEQ ID NO: 4123792 - RNA, 17 nt, Streptococcus pyogenes MGAS8232
aucguaaugucuuguuc

SEQ ID NO: 4123793 - RNA, 16 nt, Streptococcus pyogenes MGAS8232
aucuaaagcaucagca

SEQ ID NO: 4123794 - RNA, 17 nt, Streptococcus pyogenes MGAS8232
aucuaaucgaacaauaa

SEQ ID NO: 4123795 - RNA, 15 nt, Streptococcus pyogenes MGAS8232
aucuacagcaccuuc

SEQ ID NO: 4123796 - RNA, 17 nt, Streptococcus pyogenes MGAS8232
aucuacucuauuuugag

SEQ ID NO: 4123797 - RNA, 19 nt, Streptococcus pyogenes MGAS8232
aucuacucuauuuugaguu

SEQ ID NO: 4123798 - RNA, 13 nt, Streptococcus pyogenes MGAS8232
aucucauaaaaaa

SEQ ID NO: 4123799 - RNA, 17 nt, Streptococcus pyogenes MGAS8232
aucucauaaaaaagaac

SEQ ID NO: 4123800 - RNA, 19 nt, Streptococcus pyogenes MGAS8232
aucucguaauccuugauuu

SEQ ID NO: 4123801 - RNA, 13 nt, Streptococcus pyogenes MGAS8232
aucugaauuauua

SEQ ID NO: 4123802 - RNA, 16 nt, Streptococcus pyogenes MGAS8232
aucugcacaugcuuga

SEQ ID NO: 4123803 - RNA, 14 nt, Streptococcus pyogenes MGAS8232
aucugcagauuuua

SEQ ID NO: 4123804 - RNA, 21 nt, Streptococcus pyogenes MGAS8232
aucugcagauuuuaagacaac

SEQ ID NO: 4123805 - RNA, 17 nt, Streptococcus pyogenes MGAS8232
auuaugaggugaacacc

SEQ ID NO: 4123806 - RNA, 19 nt, Streptococcus pyogenes MGAS8232
auuaugccaaauuucagau

SEQ ID NO: 4123807 - RNA, 21 nt, Streptococcus pyogenes MGAS8232
auuauuaacguuaacaaaaau

SEQ ID NO: 4123808 - RNA, 18 nt, Streptococcus pyogenes MGAS8232
auuauugucacugaaaaa

SEQ ID NO: 4123809 - RNA, 18 nt, Streptococcus pyogenes MGAS8232
auuauuuuaauuuuuccu

SEQ ID NO: 4123810 - RNA, 20 nt, Streptococcus pyogenes MGAS8232
auuauuuugggacuaggaau

SEQ ID NO: 4123811 - RNA, 13 nt, Streptococcus pyogenes MGAS8232
auucaaaugaagc

SEQ ID NO: 4123812 - RNA, 20 nt, Streptococcus pyogenes MGAS8232
auucaauaucacauuuuaau

SEQ ID NO: 4123813 - RNA, 14 nt, Streptococcus pyogenes MGAS8232
auucauguuuaaaa

SEQ ID NO: 4123814 - RNA, 15 nt, Streptococcus pyogenes MGAS8232
auuccaaacauccaa

SEQ ID NO: 4123815 - RNA, 14 nt, Streptococcus pyogenes MGAS8232
auuccauacuucca

SEQ ID NO: 4123816 - RNA, 15 nt, Streptococcus pyogenes MGAS8232
auuccuucuuuuucc

SEQ ID NO: 4123817 - RNA, 17 nt, Streptococcus pyogenes MGAS8232
auucuuauccauuauaa

SEQ ID NO: 4123818 - RNA, 10 nt, Streptococcus pyogenes MGAS8232
auucuugcag

SEQ ID NO: 4123819 - RNA, 20 nt, Streptococcus pyogenes MGAS8232
auucuuuuauuaauguaaaa

SEQ ID NO: 4123820 - RNA, 12 nt, Streptococcus pyogenes MGAS8232
auucuuuuuccg

SEQ ID NO: 4123821 - RNA, 22 nt, Streptococcus pyogenes MGAS8232
auucuuuuuccguuugagauaa

SEQ ID NO: 4123822 - RNA, 13 nt, Streptococcus pyogenes MGAS8232
auucuuuuuuacc

SEQ ID NO: 4123823 - RNA, 14 nt, Streptococcus pyogenes MGAS8232
auucuuuuuuaccu

SEQ ID NO: 4123824 - RNA, 19 nt, Streptococcus pyogenes MGAS8232
auugacaaauccaaugacu

SEQ ID NO: 4123825 - RNA, 21 nt, Streptococcus pyogenes MGAS8232
auugacaaauccaaugacuaa

SEQ ID NO: 4123826 - RNA, 22 nt, Streptococcus pyogenes MGAS8232
auugagguaaucguaaugucuu

SEQ ID NO: 4123827 - RNA, 15 nt, Streptococcus pyogenes MGAS8232
auugaguaagcagca

SEQ ID NO: 4123828 - RNA, 22 nt, Streptococcus pyogenes MGAS8232
auugaucucugcaacaucaagg

SEQ ID NO: 4123829 - RNA, 21 nt, Streptococcus pyogenes MGAS8232
auugaugaguuuauguaugcu

SEQ ID NO: 4123830 - RNA, 19 nt, Streptococcus pyogenes MGAS8232
auugcaugaggcaaaugaa

SEQ ID NO: 4123831 - RNA, 20 nt, Streptococcus pyogenes MGAS8232
auugcaugaggcaaaugaaa

SEQ ID NO: 4123832 - RNA, 15 nt, Streptococcus pyogenes MGAS8232
auuggaaaauauauu

SEQ ID NO: 4123833 - RNA, 22 nt, Streptococcus pyogenes MGAS8232
auuggccuucuuggaaaacaga

SEQ ID NO: 4123834 - RNA, 18 nt, Streptococcus pyogenes MGAS8232
auuggggcggcacuucca

SEQ ID NO: 4123835 - RNA, 15 nt, Streptococcus pyogenes MGAS8232
auuguaaccacagca

SEQ ID NO: 4123836 - RNA, 19 nt, Streptococcus pyogenes MGAS8232
auuguaauaacaaaaugaa

SEQ ID NO: 4123837 - RNA, 15 nt, Streptococcus pyogenes MGAS8232
auugucaaauaaaau

SEQ ID NO: 4123838 - RNA, 17 nt, Streptococcus pyogenes MGAS8232
auugucacugaaaaagc

SEQ ID NO: 4123839 - RNA, 18 nt, Streptococcus pyogenes MGAS8232
auuguuuuaguaaagccu

SEQ ID NO: 4123840 - RNA, 18 nt, Streptococcus pyogenes MGAS8232
auuuaagguauuguucaa

SEQ ID NO: 4123841 - RNA, 16 nt, Streptococcus pyogenes MGAS8232
auuuaaucauguccaa

SEQ ID NO: 4123842 - RNA, 13 nt, Streptococcus pyogenes MGAS8232
auuuaaucuuauu

SEQ ID NO: 4123843 - RNA, 17 nt, Streptococcus pyogenes MGAS8232
auuuagaaauuuuauug

SEQ ID NO: 4123844 - RNA, 23 nt, Streptococcus pyogenes MGAS8232
auuuagguacucguaagcauuuu

SEQ ID NO: 4123845 - RNA, 16 nt, Streptococcus pyogenes MGAS8232
auuuaguuauuuuuga

SEQ ID NO: 4123846 - RNA, 18 nt, Streptococcus pyogenes MGAS8232
auuucaauaauaccauuu

SEQ ID NO: 4123847 - RNA, 22 nt, Streptococcus pyogenes MGAS8232
auuucaauaauaccauuuuuau

SEQ ID NO: 4123848 - RNA, 17 nt, Streptococcus pyogenes MGAS8232
auuucagauaagaccuu

SEQ ID NO: 4123849 - RNA, 14 nt, Streptococcus pyogenes MGAS8232
auuucguugacaaa

SEQ ID NO: 4123850 - RNA, 16 nt, Streptococcus pyogenes MGAS8232
auuucguugacaaagc

SEQ ID NO: 4123851 - RNA, 14 nt, Streptococcus pyogenes MGAS8232
auuucuucagguuu

SEQ ID NO: 4123852 - RNA, 17 nt, Streptococcus pyogenes MGAS8232
auuugacauuaguccaa

SEQ ID NO: 4123853 - RNA, 22 nt, Streptococcus pyogenes MGAS8232
auuugaccacaccuaauaaaau

SEQ ID NO: 4123854 - RNA, 20 nt, Streptococcus pyogenes MGAS8232
auuugacuuguuacaaaaaa

SEQ ID NO: 4123855 - RNA, 20 nt, Streptococcus pyogenes MGAS8232
auuugcagaggcuugcauuu

SEQ ID NO: 4123856 - RNA, 22 nt, Streptococcus pyogenes MGAS8232
auuugcagaggcuugcauuuuu

SEQ ID NO: 4123857 - RNA, 19 nt, Streptococcus pyogenes MGAS8232
auuugccauggcaagagca

SEQ ID NO: 4123858 - RNA, 20 nt, Streptococcus pyogenes MGAS8232
auuuguaacuccuuaaauua

SEQ ID NO: 4123859 - RNA, 22 nt, Streptococcus pyogenes MGAS8232
auuuguaacuccuuaaauuaua

SEQ ID NO: 4123860 - RNA, 14 nt, Streptococcus pyogenes MGAS8232
auuuuaaaauaguu

SEQ ID NO: 4123861 - RNA, 20 nt, Streptococcus pyogenes MGAS8232
auuuuaaauaucuuaccauu

SEQ ID NO: 4123862 - RNA, 18 nt, Streptococcus pyogenes MGAS8232
auuuuaaucuuuuuguga

SEQ ID NO: 4123863 - RNA, 19 nt, Streptococcus pyogenes MGAS8232
auuuuaaucuuuuugugau

SEQ ID NO: 4123864 - RNA, 13 nt, Streptococcus pyogenes MGAS8232
auuuuaauuuuuc

SEQ ID NO: 4123865 - RNA, 14 nt, Streptococcus pyogenes MGAS8232
auuuuaauuuuucu

SEQ ID NO: 4123866 - RNA, 16 nt, Streptococcus pyogenes MGAS8232
auuuuacuauggcuuc

SEQ ID NO: 4123867 - RNA, 23 nt, Streptococcus pyogenes MGAS8232
auuuuacuauggcuucuaaaaaa

SEQ ID NO: 4123868 - RNA, 15 nt, Streptococcus pyogenes MGAS8232
auuuuaugagaaaaa

SEQ ID NO: 4123869 - RNA, 13 nt, Streptococcus pyogenes MGAS8232
auuuucaucauca

SEQ ID NO: 4123870 - RNA, 18 nt, Streptococcus pyogenes MGAS8232
auuuugcaagucucuugc

SEQ ID NO: 4123871 - RNA, 11 nt, Streptococcus pyogenes MGAS8232
auuuugguuga

SEQ ID NO: 4123872 - RNA, 17 nt, Streptococcus pyogenes MGAS8232
auuuugguugauagaag

SEQ ID NO: 4123873 - RNA, 15 nt, Streptococcus pyogenes MGAS8232
auuuugucuaaaaua

SEQ ID NO: 4123874 - RNA, 16 nt, Streptococcus pyogenes MGAS8232
auuuugucuaaaauaa

SEQ ID NO: 4123875 - RNA, 13 nt, Streptococcus pyogenes MGAS8232
auuuuuaauucuu

SEQ ID NO: 4123876 - RNA, 15 nt, Streptococcus pyogenes MGAS8232
auuuuuacauuuuua

SEQ ID NO: 4123877 - RNA, 18 nt, Streptococcus pyogenes MGAS8232
auuuuuacauuuuuacaa

SEQ ID NO: 4123878 - RNA, 15 nt, Streptococcus pyogenes MGAS8232
auuuuucaaaaucuu

SEQ ID NO: 4123879 - RNA, 21 nt, Streptococcus pyogenes MGAS8232
auuuuucgaccaauucuaaaa

SEQ ID NO: 4123880 - RNA, 12 nt, Streptococcus pyogenes MGAS8232
auuuuuuaaagc

SEQ ID NO: 4123881 - RNA, 15 nt, Streptococcus pyogenes MGAS8232
auuuuuuauaauggu

SEQ ID NO: 4123882 - RNA, 16 nt, Streptococcus pyogenes MGAS8232
auuuuuucucaaaaau

SEQ ID NO: 4123883 - RNA, 20 nt, Streptococcus pyogenes MGAS8232
auuuuuugcaauucagcauc

SEQ ID NO: 4123884 - RNA, 13 nt, Streptococcus pyogenes MGAS8232
auuuuuuucauga

SEQ ID NO: 4123885 - RNA, 20 nt, Streptococcus pyogenes MGAS8232
auuuuuuucaugauguuuau

SEQ ID NO: 4123886 - RNA, 13 nt, Streptococcus pyogenes MGAS8232
caaaaaaagcaug

SEQ ID NO: 4123887 - RNA, 21 nt, Streptococcus pyogenes MGAS8232
caaaaacugugaacaaaacaa

SEQ ID NO: 4123888 - RNA, 16 nt, Streptococcus pyogenes MGAS8232
caaaaagccuauuuaa

SEQ ID NO: 4123889 - RNA, 17 nt, Streptococcus pyogenes MGAS8232
caaaaaggcuaagaugg

SEQ ID NO: 4123890 - RNA, 18 nt, Streptococcus pyogenes MGAS8232
caaaaaggcuaagaugga

SEQ ID NO: 4123891 - RNA, 18 nt, Streptococcus pyogenes MGAS8232
caaaaagucgucaacgcu

SEQ ID NO: 4123892 - RNA, 15 nt, Streptococcus pyogenes MGAS8232
caaaacaaaacaaaa

SEQ ID NO: 4123893 - RNA, 17 nt, Streptococcus pyogenes MGAS8232
caaaacaaaacaaaaca

SEQ ID NO: 4123894 - RNA, 18 nt, Streptococcus pyogenes MGAS8232
caaaacaaaacaaaacaa

SEQ ID NO: 4123895 - RNA, 14 nt, Streptococcus pyogenes MGAS8232
caaaacaaaacaua

SEQ ID NO: 4123896 - RNA, 15 nt, Streptococcus pyogenes MGAS8232
caaaacccuuucgua

SEQ ID NO: 4123897 - RNA, 23 nt, Streptococcus pyogenes MGAS8232
caaaacccuuucguaagaaagac

SEQ ID NO: 4123898 - RNA, 16 nt, Streptococcus pyogenes MGAS8232
caaaacugucuggaaa

SEQ ID NO: 4123899 - RNA, 16 nt, Streptococcus pyogenes MGAS8232
caaaacuucaaauuuc

SEQ ID NO: 4123900 - RNA, 18 nt, Streptococcus pyogenes MGAS8232
caaaagaccauaaaaaac

SEQ ID NO: 4123901 - RNA, 13 nt, Streptococcus pyogenes MGAS8232
caaaagcuaaacu

SEQ ID NO: 4123902 - RNA, 21 nt, Streptococcus pyogenes MGAS8232
caaaaguuggcuacucuauuu

SEQ ID NO: 4123903 - RNA, 15 nt, Streptococcus pyogenes MGAS8232
cagacaccaaaaaaa

SEQ ID NO: 4123904 - RNA, 16 nt, Streptococcus pyogenes MGAS8232
cagagcaguucagcag

SEQ ID NO: 4123905 - RNA, 16 nt, Streptococcus pyogenes MGAS8232
cagagccuuaaaaagu

SEQ ID NO: 4123906 - RNA, 21 nt, Streptococcus pyogenes MGAS8232
cagagcucgucuuuguccauu

SEQ ID NO: 4123907 - RNA, 14 nt, Streptococcus pyogenes MGAS8232
cagauaagaccuuc

SEQ ID NO: 4123908 - RNA, 17 nt, Streptococcus pyogenes MGAS8232
cagauaagaccuucaaa

SEQ ID NO: 4123909 - RNA, 17 nt, Streptococcus pyogenes MGAS8232
cagauagucaaaaagac

SEQ ID NO: 4123910 - RNA, 19 nt, Streptococcus pyogenes MGAS8232
cagaucauuaaauugauua

SEQ ID NO: 4123911 - RNA, 23 nt, Streptococcus pyogenes MGAS8232
cagcaccuucaaccgcuucuuuu

SEQ ID NO: 4123912 - RNA, 21 nt, Streptococcus pyogenes MGAS8232
cagcacuggcuuuuuugcuuu

SEQ ID NO: 4123913 - RNA, 19 nt, Streptococcus pyogenes MGAS8232
cagcagcacuggcuuuuuu

SEQ ID NO: 4123914 - RNA, 20 nt, Streptococcus pyogenes MGAS8232
cagcaguugcgaucauaaau

SEQ ID NO: 4123915 - RNA, 20 nt, Streptococcus pyogenes MGAS8232
cagcauaaccuuugccauuu

SEQ ID NO: 4123916 - RNA, 16 nt, Streptococcus pyogenes MGAS8232
cagccauaccaacaau

SEQ ID NO: 4123917 - RNA, 16 nt, Streptococcus pyogenes MGAS8232
cagcgucugauauuga

SEQ ID NO: 4123918 - RNA, 16 nt, Streptococcus pyogenes MGAS8232
cagcuaaaaacaaugc

SEQ ID NO: 4123919 - RNA, 15 nt, Streptococcus pyogenes MGAS8232
cagcugcuugaaaag

SEQ ID NO: 4123920 - RNA, 16 nt, Streptococcus pyogenes MGAS8232
cagcugcuugaaaaga

SEQ ID NO: 4123921 - RNA, 23 nt, Streptococcus pyogenes MGAS8232
caggaggguuuuucuuuuggccu

SEQ ID NO: 4123922 - RNA, 23 nt, Streptococcus pyogenes MGAS8232
caggauauugagaagaaaaaauu

SEQ ID NO: 4123923 - RNA, 16 nt, Streptococcus pyogenes MGAS8232
caggauugccaucaau

SEQ ID NO: 4123924 - RNA, 14 nt, Streptococcus pyogenes MGAS8232
cagguguuuaaaga

SEQ ID NO: 4123925 - RNA, 16 nt, Streptococcus pyogenes MGAS8232
cagguuucuuuugguu

SEQ ID NO: 4123926 - RNA, 16 nt, Streptococcus pyogenes MGAS8232
caguaaggaaaucaau

SEQ ID NO: 4123927 - RNA, 20 nt, Streptococcus pyogenes MGAS8232
caguaguaaccguuggcaua

SEQ ID NO: 4123928 - RNA, 21 nt, Streptococcus pyogenes MGAS8232
caguauaaccgccaucuaagc

SEQ ID NO: 4123929 - RNA, 18 nt, Streptococcus pyogenes MGAS8232
caguauaacuguuuuucu

SEQ ID NO: 4123930 - RNA, 21 nt, Streptococcus pyogenes MGAS8232
cagucaagagcacacauaaug

SEQ ID NO: 4123931 - RNA, 16 nt, Streptococcus pyogenes MGAS8232
caguccuccucuuuag

SEQ ID NO: 4123932 - RNA, 14 nt, Streptococcus pyogenes MGAS8232
cagugcuuuaacaa

SEQ ID NO: 4123933 - RNA, 20 nt, Streptococcus pyogenes MGAS8232
caguucugagauauucauuu

SEQ ID NO: 4123934 - RNA, 22 nt, Streptococcus pyogenes MGAS8232
caguucugagauauucauuuuc

SEQ ID NO: 4123935 - RNA, 20 nt, Streptococcus pyogenes MGAS8232
caguugcgaucauaaauaaa

SEQ ID NO: 4123936 - RNA, 21 nt, Streptococcus pyogenes MGAS8232
caguugcgaucauaaauaaag

SEQ ID NO: 4123937 - RNA, 20 nt, Streptococcus pyogenes MGAS8232
cauaaaaaaccuuaucaaac

SEQ ID NO: 4123938 - RNA, 15 nt, Streptococcus pyogenes MGAS8232
cauaaaaaagaacuu

SEQ ID NO: 4123939 - RNA, 18 nt, Streptococcus pyogenes MGAS8232
cauaaaagauauuuuaaa

SEQ ID NO: 4123940 - RNA, 15 nt, Streptococcus pyogenes MGAS8232
cauaacauacucuau

SEQ ID NO: 4123941 - RNA, 20 nt, Streptococcus pyogenes MGAS8232
cauaacauacucuauuuacu

SEQ ID NO: 4123942 - RNA, 16 nt, Streptococcus pyogenes MGAS8232
cauaaccuuugccauu

SEQ ID NO: 4123943 - RNA, 14 nt, Streptococcus pyogenes MGAS8232
cauaccaucaauga

SEQ ID NO: 4123944 - RNA, 22 nt, Streptococcus pyogenes MGAS8232
cauacccgcguuaucuccacag

SEQ ID NO: 4123945 - RNA, 16 nt, Streptococcus pyogenes MGAS8232
cauaccugagccgcca

SEQ ID NO: 4123946 - RNA, 14 nt, Streptococcus pyogenes MGAS8232
cauacucuauuuac

SEQ ID NO: 4123947 - RNA, 21 nt, Streptococcus pyogenes MGAS8232
cauacuuuauuaaucaaaaaa

SEQ ID NO: 4123948 - RNA, 22 nt, Streptococcus pyogenes MGAS8232
cauacuuuauuaaucaaaaaac

SEQ ID NO: 4123949 - RNA, 21 nt, Streptococcus pyogenes MGAS8232
cauagaagacggaguauuuuu

SEQ ID NO: 4123950 - RNA, 19 nt, Streptococcus pyogenes MGAS8232
cauagaucgucacuaucug

SEQ ID NO: 4123951 - RNA, 17 nt, Streptococcus pyogenes MGAS8232
cauagguugcaccacca

SEQ ID NO: 4123952 - RNA, 19 nt, Streptococcus pyogenes MGAS8232
cauauuagcaaaaugcugu

SEQ ID NO: 4123953 - RNA, 14 nt, Streptococcus pyogenes MGAS8232
cauauuuuugaaaa

SEQ ID NO: 4123954 - RNA, 16 nt, Streptococcus pyogenes MGAS8232
cauauuuuugaaaaaa

SEQ ID NO: 4123955 - RNA, 19 nt, Streptococcus pyogenes MGAS8232
cauauuuuugaaaaaaaug

SEQ ID NO: 4123956 - RNA, 17 nt, Streptococcus pyogenes MGAS8232
caucaaaagaccauaaa

SEQ ID NO: 4123957 - RNA, 21 nt, Streptococcus pyogenes MGAS8232
caucaaaagaccauaaaaaac

SEQ ID NO: 4123958 - RNA, 19 nt, Streptococcus pyogenes MGAS8232
caucaaaggguguuuuuua

SEQ ID NO: 4123959 - RNA, 22 nt, Streptococcus pyogenes MGAS8232
caucaacaaguguuuugucuua

SEQ ID NO: 4123960 - RNA, 20 nt, Streptococcus pyogenes MGAS8232
caucaagaauagcuuuugua

SEQ ID NO: 4123961 - RNA, 16 nt, Streptococcus pyogenes MGAS8232
caucacguacagaaau

SEQ ID NO: 4123962 - RNA, 18 nt, Streptococcus pyogenes MGAS8232
caucagaauaagaaaacc

SEQ ID NO: 4123963 - RNA, 12 nt, Streptococcus pyogenes MGAS8232
caucauauuguu

SEQ ID NO: 4123964 - RNA, 21 nt, Streptococcus pyogenes MGAS8232
caucaucaagaauagcuuuug

SEQ ID NO: 4123965 - RNA, 17 nt, Streptococcus pyogenes MGAS8232
caucuacagcaccuuca

SEQ ID NO: 4123966 - RNA, 22 nt, Streptococcus pyogenes MGAS8232
caugaaguauaguuauguuaua

SEQ ID NO: 4123967 - RNA, 15 nt, Streptococcus pyogenes MGAS8232
caugaagugguucaa

SEQ ID NO: 4123968 - RNA, 21 nt, Streptococcus pyogenes MGAS8232
caugaugccauuuaaaagggc

SEQ ID NO: 4123969 - RNA, 18 nt, Streptococcus pyogenes MGAS8232
caugauguuauuaaauaa

SEQ ID NO: 4123970 - RNA, 17 nt, Streptococcus pyogenes MGAS8232
caugauguuuauuccaa

SEQ ID NO: 4123971 - RNA, 18 nt, Streptococcus pyogenes MGAS8232
cauggagucaaugaaaag

SEQ ID NO: 4123972 - RNA, 21 nt, Streptococcus pyogenes MGAS8232
cauggcuaaugauaaggcugc

SEQ ID NO: 4123973 - RNA, 16 nt, Streptococcus pyogenes MGAS8232
cauggguaaaaugacu

SEQ ID NO: 4123974 - RNA, 16 nt, Streptococcus pyogenes MGAS8232
cauguaaugaccaccc

SEQ ID NO: 4123975 - RNA, 17 nt, Streptococcus pyogenes MGAS8232
cauuaccuuauuuucua

SEQ ID NO: 4123976 - RNA, 21 nt, Streptococcus pyogenes MGAS8232
cauuauugacaaauccaauga

SEQ ID NO: 4123977 - RNA, 21 nt, Streptococcus pyogenes MGAS8232
cauugccauuaauaauauuaa

SEQ ID NO: 4123978 - RNA, 16 nt, Streptococcus pyogenes MGAS8232
cauuuaaucaugucca

SEQ ID NO: 4123979 - RNA, 16 nt, Streptococcus pyogenes MGAS8232
cauuuccuacaaaaua

SEQ ID NO: 4123980 - RNA, 17 nt, Streptococcus pyogenes MGAS8232
cauuucuucagguuucu

SEQ ID NO: 4123981 - RNA, 13 nt, Streptococcus pyogenes MGAS8232
cauuucuugaggu

SEQ ID NO: 4123982 - RNA, 18 nt, Streptococcus pyogenes MGAS8232
cauuucuuugcaaaagaa

SEQ ID NO: 4123983 - RNA, 14 nt, Streptococcus pyogenes MGAS8232
cauuugccauggca

SEQ ID NO: 4123984 - RNA, 22 nt, Streptococcus pyogenes MGAS8232
cauuuguaacuccuuaaauuau

SEQ ID NO: 4123985 - RNA, 23 nt, Streptococcus pyogenes MGAS8232
cauuuuacuauggcuucuaaaaa

SEQ ID NO: 4123986 - RNA, 17 nt, Streptococcus pyogenes MGAS8232
cauuuuuaucuguauau

SEQ ID NO: 4123987 - RNA, 21 nt, Streptococcus pyogenes MGAS8232
cauuuuuuauaaugguuuuuu

SEQ ID NO: 4123988 - RNA, 20 nt, Streptococcus pyogenes MGAS8232
cauuuuuugcaauucagcau

SEQ ID NO: 4123989 - RNA, 19 nt, Streptococcus pyogenes MGAS8232
ccaaauuucagauaagacc

SEQ ID NO: 4123990 - RNA, 19 nt, Streptococcus pyogenes MGAS8232
ccaaccuaucacgccagua

SEQ ID NO: 4123991 - RNA, 22 nt, Streptococcus pyogenes MGAS8232
ccaaucaccuuucuauauaacu

SEQ ID NO: 4123992 - RNA, 13 nt, Streptococcus pyogenes MGAS8232
ccaaugacuaagg

SEQ ID NO: 4123993 - RNA, 12 nt, Streptococcus pyogenes MGAS8232
ccaauucuaaaa

SEQ ID NO: 4123994 - RNA, 15 nt, Streptococcus pyogenes MGAS8232
ccaauuguugaauaa

SEQ ID NO: 4123995 - RNA, 18 nt, Streptococcus pyogenes MGAS8232
ccaccaucaaaggucacc

SEQ ID NO: 4123996 - RNA, 16 nt, Streptococcus pyogenes MGAS8232
ccagaugcuugcucaa

SEQ ID NO: 4123997 - RNA, 16 nt, Streptococcus pyogenes MGAS8232
ccagccacuacaagca

SEQ ID NO: 4123998 - RNA, 19 nt, Streptococcus pyogenes MGAS8232
ccagccaucaauagcagca

SEQ ID NO: 4123999 - RNA, 12 nt, Streptococcus pyogenes MGAS8232
ccagcuuacagc

SEQ ID NO: 4124000 - RNA, 14 nt, Streptococcus pyogenes MGAS8232
cuaaauauaaauua

SEQ ID NO: 4124001 - RNA, 20 nt, Streptococcus pyogenes MGAS8232
cuaaauccuuuugaaaaauu

SEQ ID NO: 4124002 - RNA, 21 nt, Streptococcus pyogenes MGAS8232
cuaaauccuuuugaaaaauua

SEQ ID NO: 4124003 - RNA, 19 nt, Streptococcus pyogenes MGAS8232
cuaagagccaaaauaacaa

SEQ ID NO: 4124004 - RNA, 23 nt, Streptococcus pyogenes MGAS8232
cuaagagccaaaauaacaaucug

SEQ ID NO: 4124005 - RNA, 21 nt, Streptococcus pyogenes MGAS8232
cuaagaugguuuugauuaaau

SEQ ID NO: 4124006 - RNA, 18 nt, Streptococcus pyogenes MGAS8232
cuaauaaaauagcaccua

SEQ ID NO: 4124007 - RNA, 12 nt, Streptococcus pyogenes MGAS8232
cuaauaagauuc

SEQ ID NO: 4124008 - RNA, 14 nt, Streptococcus pyogenes MGAS8232
cuaauauuauauua

SEQ ID NO: 4124009 - RNA, 17 nt, Streptococcus pyogenes MGAS8232
cuaaucgaacaauaaua

SEQ ID NO: 4124010 - RNA, 18 nt, Streptococcus pyogenes MGAS8232
cuaaucgaacaauaauau

SEQ ID NO: 4124011 - RNA, 16 nt, Streptococcus pyogenes MGAS8232
cuaauugugagaaacu

SEQ ID NO: 4124012 - RNA, 23 nt, Streptococcus pyogenes MGAS8232
cuacaggauauugagaagaaaaa

SEQ ID NO: 4124013 - RNA, 15 nt, Streptococcus pyogenes MGAS8232
cuaccuacuacuuca

SEQ ID NO: 4124014 - RNA, 18 nt, Streptococcus pyogenes MGAS8232
cuacgguuauuaccuauu

SEQ ID NO: 4124015 - RNA, 20 nt, Streptococcus pyogenes MGAS8232
cuacuagccuguccuagucu

SEQ ID NO: 4124016 - RNA, 15 nt, Streptococcus pyogenes MGAS8232
cuacuaggcuuucau

SEQ ID NO: 4124017 - RNA, 13 nt, Streptococcus pyogenes MGAS8232
cuacuucacuggc

SEQ ID NO: 4124018 - RNA, 20 nt, Streptococcus pyogenes MGAS8232
cuagacucuagcauaaaaga

SEQ ID NO: 4124019 - RNA, 16 nt, Streptococcus pyogenes MGAS8232
cuagacugugaaagua

SEQ ID NO: 4124020 - RNA, 12 nt, Streptococcus pyogenes MGAS8232
cuagcacaaaau

SEQ ID NO: 4124021 - RNA, 18 nt, Streptococcus pyogenes MGAS8232
cuagcauaaugcauguaa

SEQ ID NO: 4124022 - RNA, 21 nt, Streptococcus pyogenes MGAS8232
cuagcucuuuaucaccuguca

SEQ ID NO: 4124023 - RNA, 22 nt, Streptococcus pyogenes MGAS8232
cuagcucuuuaucaccugucaa

SEQ ID NO: 4124024 - RNA, 18 nt, Streptococcus pyogenes MGAS8232
cuagcuuugucaacucga

SEQ ID NO: 4124025 - RNA, 22 nt, Streptococcus pyogenes MGAS8232
cuaggcuuucauuauaggcuau

SEQ ID NO: 4124026 - RNA, 13 nt, Streptococcus pyogenes MGAS8232
cuagucuuuuuau

SEQ ID NO: 4124027 - RNA, 14 nt, Streptococcus pyogenes MGAS8232
cuaguuuaggauau

SEQ ID NO: 4124028 - RNA, 14 nt, Streptococcus pyogenes MGAS8232
cuauaccuaaaaaa

SEQ ID NO: 4124029 - RNA, 15 nt, Streptococcus pyogenes MGAS8232
cuauaccuaaaaaau

SEQ ID NO: 4124030 - RNA, 16 nt, Streptococcus pyogenes MGAS8232
cuauaccuaaaaaaua

SEQ ID NO: 4124031 - RNA, 21 nt, Streptococcus pyogenes MGAS8232
cuauagaaaguuauaaagaaa

SEQ ID NO: 4124032 - RNA, 16 nt, Streptococcus pyogenes MGAS8232
cuaucacgccaguaaa

SEQ ID NO: 4124033 - RNA, 20 nt, Streptococcus pyogenes MGAS8232
cuaucauggagucaaugaaa

SEQ ID NO: 4124034 - RNA, 22 nt, Streptococcus pyogenes MGAS8232
cuaucauggagucaaugaaaag

SEQ ID NO: 4124035 - RNA, 19 nt, Streptococcus pyogenes MGAS8232
cuaucucguaauccuugau

SEQ ID NO: 4124036 - RNA, 14 nt, Streptococcus pyogenes MGAS8232
cuaucugauacaga

SEQ ID NO: 4124037 - RNA, 22 nt, Streptococcus pyogenes MGAS8232
cuaucugcagauuuuaagacaa

SEQ ID NO: 4124038 - RNA, 21 nt, Streptococcus pyogenes MGAS8232
cuaugaaaaaagaacaaagau

SEQ ID NO: 4124039 - RNA, 20 nt, Streptococcus pyogenes MGAS8232
cuaugaucuguuuaaaaaca

SEQ ID NO: 4124040 - RNA, 17 nt, Streptococcus pyogenes MGAS8232
cuauggcuucuaaaaaa

SEQ ID NO: 4124041 - RNA, 19 nt, Streptococcus pyogenes MGAS8232
cuauuaccuauagaaaguu

SEQ ID NO: 4124042 - RNA, 20 nt, Streptococcus pyogenes MGAS8232
cuauuagcauaccuaaaaga

SEQ ID NO: 4124043 - RNA, 22 nt, Streptococcus pyogenes MGAS8232
cuauuagcauaccuaaaagaac

SEQ ID NO: 4124044 - RNA, 19 nt, Streptococcus pyogenes MGAS8232
cuauucaauauuuuauuaa

SEQ ID NO: 4124045 - RNA, 16 nt, Streptococcus pyogenes MGAS8232
cuauugacuugguucu

SEQ ID NO: 4124046 - RNA, 16 nt, Streptococcus pyogenes MGAS8232
cuauugagucuuuuuc

SEQ ID NO: 4124047 - RNA, 18 nt, Streptococcus pyogenes MGAS8232
cuauugagucuuuuucua

SEQ ID NO: 4124048 - RNA, 20 nt, Streptococcus pyogenes MGAS8232
cuauuguagaggugaugaag

SEQ ID NO: 4124049 - RNA, 11 nt, Streptococcus pyogenes MGAS8232
cuauuuaaccu

SEQ ID NO: 4124050 - RNA, 20 nt, Streptococcus pyogenes MGAS8232
cuauuuuaaguaaaggauuu

SEQ ID NO: 4124051 - RNA, 17 nt, Streptococcus pyogenes MGAS8232
cuauuuugugacuauau

SEQ ID NO: 4124052 - RNA, 12 nt, Streptococcus pyogenes MGAS8232
cucaaaaaauac

SEQ ID NO: 4124053 - RNA, 20 nt, Streptococcus pyogenes MGAS8232
cucaaaaauauauucuaauu

SEQ ID NO: 4124054 - RNA, 15 nt, Streptococcus pyogenes MGAS8232
cucaaauuuuuuuca

SEQ ID NO: 4124055 - RNA, 12 nt, Streptococcus pyogenes MGAS8232
cucaagaggucu

SEQ ID NO: 4124056 - RNA, 19 nt, Streptococcus pyogenes MGAS8232
cucaauauaauaaaaagua

SEQ ID NO: 4124057 - RNA, 21 nt, Streptococcus pyogenes MGAS8232
cucacaaauacagaagaaagc

SEQ ID NO: 4124058 - RNA, 13 nt, Streptococcus pyogenes MGAS8232
cucaguaaucuaa

SEQ ID NO: 4124059 - RNA, 14 nt, Streptococcus pyogenes MGAS8232
cucauaaaaaagaa

SEQ ID NO: 4124060 - RNA, 15 nt, Streptococcus pyogenes MGAS8232
cucauaaaaaagaac

SEQ ID NO: 4124061 - RNA, 15 nt, Streptococcus pyogenes MGAS8232
cucauaacaaauuua

SEQ ID NO: 4124062 - RNA, 19 nt, Streptococcus pyogenes MGAS8232
cucauaacaaauuuauccu

SEQ ID NO: 4124063 - RNA, 21 nt, Streptococcus pyogenes MGAS8232
cucauugucaaagcugacagu

SEQ ID NO: 4124064 - RNA, 14 nt, Streptococcus pyogenes MGAS8232
cucccuuuaauucu

SEQ ID NO: 4124065 - RNA, 17 nt, Streptococcus pyogenes MGAS8232
cuccguuucuaguuuca

SEQ ID NO: 4124066 - RNA, 22 nt, Streptococcus pyogenes MGAS8232
cuccuaaggaguaguugcuggu

SEQ ID NO: 4124067 - RNA, 19 nt, Streptococcus pyogenes MGAS8232
cuccuaggacgaaacauuu

SEQ ID NO: 4124068 - RNA, 13 nt, Streptococcus pyogenes MGAS8232
cuccuccaccaaa

SEQ ID NO: 4124069 - RNA, 19 nt, Streptococcus pyogenes MGAS8232
cuccuucuuugcagagaug

SEQ ID NO: 4124070 - RNA, 21 nt, Streptococcus pyogenes MGAS8232
cucuaacauguccaaaucgua

SEQ ID NO: 4124071 - RNA, 18 nt, Streptococcus pyogenes MGAS8232
cucuauuuacucaucuac

SEQ ID NO: 4124072 - RNA, 22 nt, Streptococcus pyogenes MGAS8232
cucuauuugaaguaaaggauuu

SEQ ID NO: 4124073 - RNA, 15 nt, Streptococcus pyogenes MGAS8232
cucuuagaagccuua

SEQ ID NO: 4124074 - RNA, 23 nt, Streptococcus pyogenes MGAS8232
cucuucggugcggaacuuguccu

SEQ ID NO: 4124075 - RNA, 14 nt, Streptococcus pyogenes MGAS8232
cugaaaauaaaaua

SEQ ID NO: 4124076 - RNA, 15 nt, Streptococcus pyogenes MGAS8232
cugaaauauaaccuc

SEQ ID NO: 4124077 - RNA, 13 nt, Streptococcus pyogenes MGAS8232
cugacuguaauua

SEQ ID NO: 4124078 - RNA, 17 nt, Streptococcus pyogenes MGAS8232
cugacuuacauuuggag

SEQ ID NO: 4124079 - RNA, 18 nt, Streptococcus pyogenes MGAS8232
cugagauauucauuuucu

SEQ ID NO: 4124080 - RNA, 20 nt, Streptococcus pyogenes MGAS8232
cugagauauucauuuucuuc

SEQ ID NO: 4124081 - RNA, 22 nt, Streptococcus pyogenes MGAS8232
cugagcaaucauguugucucag

SEQ ID NO: 4124082 - RNA, 20 nt, Streptococcus pyogenes MGAS8232
cugagcuaaagccaacccca

SEQ ID NO: 4124083 - RNA, 14 nt, Streptococcus pyogenes MGAS8232
cugaguucuuuuuc

SEQ ID NO: 4124084 - RNA, 18 nt, Streptococcus pyogenes MGAS8232
cugaucccuucauuuuac

SEQ ID NO: 4124085 - RNA, 15 nt, Streptococcus pyogenes MGAS8232
cugaugcguuuauaa

SEQ ID NO: 4124086 - RNA, 17 nt, Streptococcus pyogenes MGAS8232
cugcaauagcaugacug

SEQ ID NO: 4124087 - RNA, 15 nt, Streptococcus pyogenes MGAS8232
cugcaauauccauag

SEQ ID NO: 4124088 - RNA, 18 nt, Streptococcus pyogenes MGAS8232
cugcaauauccauagaaa

SEQ ID NO: 4124089 - RNA, 23 nt, Streptococcus pyogenes MGAS8232
cugcaauauccauagaaauugua

SEQ ID NO: 4124090 - RNA, 23 nt, Streptococcus pyogenes MGAS8232
cugccaguugagccuuuucuuuu

SEQ ID NO: 4124091 - RNA, 15 nt, Streptococcus pyogenes MGAS8232
cugcuguuggauaca

SEQ ID NO: 4124092 - RNA, 21 nt, Streptococcus pyogenes MGAS8232
cuggaaacuggucaaaagcua

SEQ ID NO: 4124093 - RNA, 24 nt, Streptococcus pyogenes MGAS8232
cuggaaagcgucaucuuaacgaaa

SEQ ID NO: 4124094 - RNA, 19 nt, Streptococcus pyogenes MGAS8232
cuggaaucgaucgucucgg

SEQ ID NO: 4124095 - RNA, 19 nt, Streptococcus pyogenes MGAS8232
cuggcauuugucuguggcu

SEQ ID NO: 4124096 - RNA, 23 nt, Streptococcus pyogenes MGAS8232
cugguguugcaaggcuaaggcuu

SEQ ID NO: 4124097 - RNA, 11 nt, Streptococcus pyogenes MGAS8232
cuuuuuaauug

SEQ ID NO: 4124098 - RNA, 17 nt, Streptococcus pyogenes MGAS8232
cuuuuuccguuugagau

SEQ ID NO: 4124099 - RNA, 13 nt, Streptococcus pyogenes MGAS8232
cuuuuucuuuucu

SEQ ID NO: 4124100 - RNA, 18 nt, Streptococcus pyogenes MGAS8232
cuuuuugccuuuaacaug

SEQ ID NO: 4124101 - RNA, 17 nt, Streptococcus pyogenes MGAS8232
cuuuuuuacuuuuaaaa

SEQ ID NO: 4124102 - RNA, 13 nt, Streptococcus pyogenes MGAS8232
gaaaaaauuucca

SEQ ID NO: 4124103 - RNA, 19 nt, Streptococcus pyogenes MGAS8232
gaaaaaggcaaagaaagcc

SEQ ID NO: 4124104 - RNA, 21 nt, Streptococcus pyogenes MGAS8232
gaaaacguguauucuuaaaaa

SEQ ID NO: 4124105 - RNA, 20 nt, Streptococcus pyogenes MGAS8232
gaaaagaugcacacaaaucu

SEQ ID NO: 4124106 - RNA, 16 nt, Streptococcus pyogenes MGAS8232
gaaaaguugauauccc

SEQ ID NO: 4124107 - RNA, 22 nt, Streptococcus pyogenes MGAS8232
gaaaaugcuuuuucguuaacgu

SEQ ID NO: 4124108 - RNA, 13 nt, Streptococcus pyogenes MGAS8232
gaaacuaaaggca

SEQ ID NO: 4124109 - RNA, 19 nt, Streptococcus pyogenes MGAS8232
gaaacuaaaggcaauagca

SEQ ID NO: 4124110 - RNA, 17 nt, Streptococcus pyogenes MGAS8232
gaaacuggucaaaagcu

SEQ ID NO: 4124111 - RNA, 22 nt, Streptococcus pyogenes MGAS8232
gaaacuugcugccauauuuuug

SEQ ID NO: 4124112 - RNA, 15 nt, Streptococcus pyogenes MGAS8232
gaaagcggaagaaca

SEQ ID NO: 4124113 - RNA, 17 nt, Streptococcus pyogenes MGAS8232
gaaagcuucaucgauga

SEQ ID NO: 4124114 - RNA, 13 nt, Streptococcus pyogenes MGAS8232
gaaaguagcaccu

SEQ ID NO: 4124115 - RNA, 23 nt, Streptococcus pyogenes MGAS8232
gaaauaucuuucaguuguuuuaa

SEQ ID NO: 4124116 - RNA, 17 nt, Streptococcus pyogenes MGAS8232
gaaaucgauuaauugca

SEQ ID NO: 4124117 - RNA, 15 nt, Streptococcus pyogenes MGAS8232
gaaaugauagcaccu

SEQ ID NO: 4124118 - RNA, 18 nt, Streptococcus pyogenes MGAS8232
gaaauuguaaccacagca

SEQ ID NO: 4124119 - RNA, 16 nt, Streptococcus pyogenes MGAS8232
gaaauuuuaaaugaca

SEQ ID NO: 4124120 - RNA, 21 nt, Streptococcus pyogenes MGAS8232
gaaccaacuuggacgaaggcu

SEQ ID NO: 4124121 - RNA, 19 nt, Streptococcus pyogenes MGAS8232
gaacuccuggauuaaaugc

SEQ ID NO: 4124122 - RNA, 12 nt, Streptococcus pyogenes MGAS8232
gaacuuguccug

SEQ ID NO: 4124123 - RNA, 22 nt, Streptococcus pyogenes MGAS8232
gaagaaaaaauuuccaauucaa

SEQ ID NO: 4124124 - RNA, 18 nt, Streptococcus pyogenes MGAS8232
gaagaacagcauuuucau

SEQ ID NO: 4124125 - RNA, 23 nt, Streptococcus pyogenes MGAS8232
gaagaacagcauuuucaucauca

SEQ ID NO: 4124126 - RNA, 15 nt, Streptococcus pyogenes MGAS8232
gaagagagaagcugu

SEQ ID NO: 4124127 - RNA, 15 nt, Streptococcus pyogenes MGAS8232
gaagcaaauucuucc

SEQ ID NO: 4124128 - RNA, 15 nt, Streptococcus pyogenes MGAS8232
gaagcuguucucuuu

SEQ ID NO: 4124129 - RNA, 22 nt, Streptococcus pyogenes MGAS8232
gaaguuugcggcucggugcuga

SEQ ID NO: 4124130 - RNA, 19 nt, Streptococcus pyogenes MGAS8232
gaauaucaggcaaaacaaa

SEQ ID NO: 4124131 - RNA, 17 nt, Streptococcus pyogenes MGAS8232
gaauccuccucuuuuuu

SEQ ID NO: 4124132 - RNA, 23 nt, Streptococcus pyogenes MGAS8232
gaaucgcuuuaggaauaucauga

SEQ ID NO: 4124133 - RNA, 21 nt, Streptococcus pyogenes MGAS8232
gaauuuugucuaaaauaaaga

SEQ ID NO: 4124134 - RNA, 14 nt, Streptococcus pyogenes MGAS8232
gacaacccaacgca

SEQ ID NO: 4124135 - RNA, 13 nt, Streptococcus pyogenes MGAS8232
gacaaugugacaa

SEQ ID NO: 4124136 - RNA, 19 nt, Streptococcus pyogenes MGAS8232
gacaauuauuuugcaggua

SEQ ID NO: 4124137 - RNA, 18 nt, Streptococcus pyogenes MGAS8232
gacagacaccaaaaaaag

SEQ ID NO: 4124138 - RNA, 20 nt, Streptococcus pyogenes MGAS8232
gacagacaccaaaaaaagca

SEQ ID NO: 4124139 - RNA, 23 nt, Streptococcus pyogenes MGAS8232
gacagacaccaaaaaaagcaugg

SEQ ID NO: 4124140 - RNA, 21 nt, Streptococcus pyogenes MGAS8232
gacauuaguccaaaauguaca

SEQ ID NO: 4124141 - RNA, 13 nt, Streptococcus pyogenes MGAS8232
gacauucguucua

SEQ ID NO: 4124142 - RNA, 19 nt, Streptococcus pyogenes MGAS8232
gacauuuaugcugauuuug

SEQ ID NO: 4124143 - RNA, 21 nt, Streptococcus pyogenes MGAS8232
gacauuuaugcugauuuugga

SEQ ID NO: 4124144 - RNA, 16 nt, Streptococcus pyogenes MGAS8232
gaccaccggugccuca

SEQ ID NO: 4124145 - RNA, 14 nt, Streptococcus pyogenes MGAS8232
gaccauuaucaaua

SEQ ID NO: 4124146 - RNA, 22 nt, Streptococcus pyogenes MGAS8232
gaccgaaaaaggcaaagaaagc

SEQ ID NO: 4124147 - RNA, 21 nt, Streptococcus pyogenes MGAS8232
gaccucucaugggcaaauaaa

SEQ ID NO: 4124148 - RNA, 16 nt, Streptococcus pyogenes MGAS8232
gaccuucaaaaaaggg

SEQ ID NO: 4124149 - RNA, 15 nt, Streptococcus pyogenes MGAS8232
gacggaguauuuuuu

SEQ ID NO: 4124150 - RNA, 14 nt, Streptococcus pyogenes MGAS8232
gacgguaaauaaag

SEQ ID NO: 4124151 - RNA, 19 nt, Streptococcus pyogenes MGAS8232
gacucaauugaaagaggug

SEQ ID NO: 4124152 - RNA, 19 nt, Streptococcus pyogenes MGAS8232
gacugacaaaacuucaaau

SEQ ID NO: 4124153 - RNA, 14 nt, Streptococcus pyogenes MGAS8232
gacuucaaaaauac

SEQ ID NO: 4124154 - RNA, 20 nt, Streptococcus pyogenes MGAS8232
gacuugguucugaaaauaaa

SEQ ID NO: 4124155 - RNA, 21 nt, Streptococcus pyogenes MGAS8232
gacuugguucugaaaauaaaa

SEQ ID NO: 4124156 - RNA, 23 nt, Streptococcus pyogenes MGAS8232
gacuugguucugaaaauaaaaua

SEQ ID NO: 4124157 - RNA, 13 nt, Streptococcus pyogenes MGAS8232
gacuuucuacuau

SEQ ID NO: 4124158 - RNA, 20 nt, Streptococcus pyogenes MGAS8232
gacuuucuacuauugcauga

SEQ ID NO: 4124159 - RNA, 23 nt, Streptococcus pyogenes MGAS8232
gagaaacuaaaggcaauagcaag

SEQ ID NO: 4124160 - RNA, 14 nt, Streptococcus pyogenes MGAS8232
gagacaauaagguc

SEQ ID NO: 4124161 - RNA, 21 nt, Streptococcus pyogenes MGAS8232
gagagguugguaaaaaggcag

SEQ ID NO: 4124162 - RNA, 19 nt, Streptococcus pyogenes MGAS8232
gagauaccuucauagacaa

SEQ ID NO: 4124163 - RNA, 17 nt, Streptococcus pyogenes MGAS8232
gagaugacgguaaauaa

SEQ ID NO: 4124164 - RNA, 12 nt, Streptococcus pyogenes MGAS8232
gagcaaggcaag

SEQ ID NO: 4124165 - RNA, 17 nt, Streptococcus pyogenes MGAS8232
gagcaaggcaagaggag

SEQ ID NO: 4124166 - RNA, 18 nt, Streptococcus pyogenes MGAS8232
gagcaaggcaagaggagg

SEQ ID NO: 4124167 - RNA, 17 nt, Streptococcus pyogenes MGAS8232
gagccgccaacauagcu

SEQ ID NO: 4124168 - RNA, 15 nt, Streptococcus pyogenes MGAS8232
gagccuuaaaaaguu

SEQ ID NO: 4124169 - RNA, 14 nt, Streptococcus pyogenes MGAS8232
gaggaaacaaaaac

SEQ ID NO: 4124170 - RNA, 17 nt, Streptococcus pyogenes MGAS8232
gagggacugucaaaaaa

SEQ ID NO: 4124171 - RNA, 17 nt, Streptococcus pyogenes MGAS8232
gaggucuggccagcuac

SEQ ID NO: 4124172 - RNA, 17 nt, Streptococcus pyogenes MGAS8232
gagguugguaaaaaggc

SEQ ID NO: 4124173 - RNA, 18 nt, Streptococcus pyogenes MGAS8232
gagguugguaaaaaggca

SEQ ID NO: 4124174 - RNA, 15 nt, Streptococcus pyogenes MGAS8232
gaguaagcagcauca

SEQ ID NO: 4124175 - RNA, 14 nt, Streptococcus pyogenes MGAS8232
gaguacaaggcaau

SEQ ID NO: 4124176 - RNA, 22 nt, Streptococcus pyogenes MGAS8232
gaguagcuacugccucauuugc

SEQ ID NO: 4124177 - RNA, 14 nt, Streptococcus pyogenes MGAS8232
gagucaaugaaaag

SEQ ID NO: 4124178 - RNA, 14 nt, Streptococcus pyogenes MGAS8232
gagucucuagucuu

SEQ ID NO: 4124179 - RNA, 11 nt, Streptococcus pyogenes MGAS8232
gaguggauaca

SEQ ID NO: 4124180 - RNA, 15 nt, Streptococcus pyogenes MGAS8232
gaguuccucgguuuu

SEQ ID NO: 4124181 - RNA, 21 nt, Streptococcus pyogenes MGAS8232
gaguugaaccgcuaaaacagu

SEQ ID NO: 4124182 - RNA, 15 nt, Streptococcus pyogenes MGAS8232
gauaaaacaaauaau

SEQ ID NO: 4124183 - RNA, 12 nt, Streptococcus pyogenes MGAS8232
gauaaaggccug

SEQ ID NO: 4124184 - RNA, 18 nt, Streptococcus pyogenes MGAS8232
gauaagaccuucaaaaaa

SEQ ID NO: 4124185 - RNA, 22 nt, Streptococcus pyogenes MGAS8232
gauaagaccuucaaaaaaggga

SEQ ID NO: 4124186 - RNA, 20 nt, Streptococcus pyogenes MGAS8232
gauaagcuuacuucuaagag

SEQ ID NO: 4124187 - RNA, 22 nt, Streptococcus pyogenes MGAS8232
gauaagcuuacuucuaagagcc

SEQ ID NO: 4124188 - RNA, 21 nt, Streptococcus pyogenes MGAS8232
gauaauaguagguagaacgag

SEQ ID NO: 4124189 - RNA, 14 nt, Streptococcus pyogenes MGAS8232
gauaccuucauaga

SEQ ID NO: 4124190 - RNA, 13 nt, Streptococcus pyogenes MGAS8232
gauaccuuuuuug

SEQ ID NO: 4124191 - RNA, 16 nt, Streptococcus pyogenes MGAS8232
gauacguuuauuguug

SEQ ID NO: 4124192 - RNA, 13 nt, Streptococcus pyogenes MGAS8232
gauagcaccuaau

SEQ ID NO: 4124193 - RNA, 23 nt, Streptococcus pyogenes MGAS8232
gauaggucugcaauauccauaga

SEQ ID NO: 4124194 - RNA, 19 nt, Streptococcus pyogenes MGAS8232
gcuuugauuuuucuuguuu

SEQ ID NO: 4124195 - RNA, 21 nt, Streptococcus pyogenes MGAS8232
gcuuuuggcaaccuuaccuac

SEQ ID NO: 4124196 - RNA, 20 nt, Streptococcus pyogenes MGAS8232
gcuuuuuaauuguugcaacc

SEQ ID NO: 4124197 - RNA, 23 nt, Streptococcus pyogenes MGAS8232
gcuuuuuuauaacuguugucuca

SEQ ID NO: 4124198 - RNA, 13 nt, Streptococcus pyogenes MGAS8232
ggaaaacagaaag

SEQ ID NO: 4124199 - RNA, 15 nt, Streptococcus pyogenes MGAS8232
ggaaaacagaaagcg

SEQ ID NO: 4124200 - RNA, 22 nt, Streptococcus pyogenes MGAS8232
ggaaaacagaaagcggaagaac

SEQ ID NO: 4124201 - RNA, 22 nt, Streptococcus pyogenes MGAS8232
ggaaaguaaggguuaacaauga

SEQ ID NO: 4124202 - RNA, 17 nt, Streptococcus pyogenes MGAS8232
ggaaauuuuaaaugaca

SEQ ID NO: 4124203 - RNA, 22 nt, Streptococcus pyogenes MGAS8232
ggacacuuugaaaguuccuuag

SEQ ID NO: 4124204 - RNA, 20 nt, Streptococcus pyogenes MGAS8232
ggaccaugccuaaaucccau

SEQ ID NO: 4124205 - RNA, 22 nt, Streptococcus pyogenes MGAS8232
ggaccaugccuaaaucccaucg

SEQ ID NO: 4124206 - RNA, 19 nt, Streptococcus pyogenes MGAS8232
ggagggacugucaaaaaau

SEQ ID NO: 4124207 - RNA, 23 nt, Streptococcus pyogenes MGAS8232
ggauauaacaacucccuccuaag

SEQ ID NO: 4124208 - RNA, 16 nt, Streptococcus pyogenes MGAS8232
ggaugauucaaaugaa

SEQ ID NO: 4124209 - RNA, 17 nt, Streptococcus pyogenes MGAS8232
ggaugauucaaaugaag

SEQ ID NO: 4124210 - RNA, 16 nt, Streptococcus pyogenes MGAS8232
ggcaaaacaaaaagag

SEQ ID NO: 4124211 - RNA, 11 nt, Streptococcus pyogenes MGAS8232
ggcaaccuuac

SEQ ID NO: 4124212 - RNA, 15 nt, Streptococcus pyogenes MGAS8232
ggcauaacccucauu

SEQ ID NO: 4124213 - RNA, 15 nt, Streptococcus pyogenes MGAS8232
ggcuucuaaaaaaaa

SEQ ID NO: 4124214 - RNA, 17 nt, Streptococcus pyogenes MGAS8232
ggcuugcauuuuuugca

SEQ ID NO: 4124215 - RNA, 17 nt, Streptococcus pyogenes MGAS8232
ggcuuuccauucuugca

SEQ ID NO: 4124216 - RNA, 12 nt, Streptococcus pyogenes MGAS8232
ggcuuuuuugcu

SEQ ID NO: 4124217 - RNA, 15 nt, Streptococcus pyogenes MGAS8232
gggagacggauuuaa

SEQ ID NO: 4124218 - RNA, 16 nt, Streptococcus pyogenes MGAS8232
gggauagacaaaaggg

SEQ ID NO: 4124219 - RNA, 17 nt, Streptococcus pyogenes MGAS8232
gggauagacaaaaggga

SEQ ID NO: 4124220 - RNA, 18 nt, Streptococcus pyogenes MGAS8232
gggcuaaguagauacuuc

SEQ ID NO: 4124221 - RNA, 18 nt, Streptococcus pyogenes MGAS8232
ggggauagacaaaaggga

SEQ ID NO: 4124222 - RNA, 16 nt, Streptococcus pyogenes MGAS8232
ggggauuacgauuaaa

SEQ ID NO: 4124223 - RNA, 20 nt, Streptococcus pyogenes MGAS8232
gguaaaaacucaaaaaauac

SEQ ID NO: 4124224 - RNA, 16 nt, Streptococcus pyogenes MGAS8232
gguaaagauuuuaaau

SEQ ID NO: 4124225 - RNA, 15 nt, Streptococcus pyogenes MGAS8232
gguauuuuucgacca

SEQ ID NO: 4124226 - RNA, 14 nt, Streptococcus pyogenes MGAS8232
ggucaacuccaauc

SEQ ID NO: 4124227 - RNA, 13 nt, Streptococcus pyogenes MGAS8232
gguuaaaaagaga

SEQ ID NO: 4124228 - RNA, 20 nt, Streptococcus pyogenes MGAS8232
gguuucgccuaggaauaaaa

SEQ ID NO: 4124229 - RNA, 14 nt, Streptococcus pyogenes MGAS8232
gguuuuuuuaagua

SEQ ID NO: 4124230 - RNA, 21 nt, Streptococcus pyogenes MGAS8232
guaaaggauuuaguucuguau

SEQ ID NO: 4124231 - RNA, 20 nt, Streptococcus pyogenes MGAS8232
guaacguaauagaauaaaaa

SEQ ID NO: 4124232 - RNA, 14 nt, Streptococcus pyogenes MGAS8232
guaagcaucauuau

SEQ ID NO: 4124233 - RNA, 20 nt, Streptococcus pyogenes MGAS8232
guaaggaaaucaauccugua

SEQ ID NO: 4124234 - RNA, 14 nt, Streptococcus pyogenes MGAS8232
guaauagaauaaaa

SEQ ID NO: 4124235 - RNA, 19 nt, Streptococcus pyogenes MGAS8232
guaauuuauuccauuuauc

SEQ ID NO: 4124236 - RNA, 21 nt, Streptococcus pyogenes MGAS8232
guagaacgagucaauuuagcc

SEQ ID NO: 4124237 - RNA, 14 nt, Streptococcus pyogenes MGAS8232
guagauagcaagga

SEQ ID NO: 4124238 - RNA, 22 nt, Streptococcus pyogenes MGAS8232
guagcaccuuuuuuauugauga

SEQ ID NO: 4124239 - RNA, 22 nt, Streptococcus pyogenes MGAS8232
guagcguuuguguugaagaagg

SEQ ID NO: 4124240 - RNA, 16 nt, Streptococcus pyogenes MGAS8232
guaguaggugacacua

SEQ ID NO: 4124241 - RNA, 21 nt, Streptococcus pyogenes MGAS8232
guauagacaaacagaaauacu

SEQ ID NO: 4124242 - RNA, 14 nt, Streptococcus pyogenes MGAS8232
guauagcauaaaau

SEQ ID NO: 4124243 - RNA, 16 nt, Streptococcus pyogenes MGAS8232
guauagcauaaaauag

SEQ ID NO: 4124244 - RNA, 20 nt, Streptococcus pyogenes MGAS8232
guauauagcucaucccuacu

SEQ ID NO: 4124245 - RNA, 15 nt, Streptococcus pyogenes MGAS8232
guaugccugaagccg

SEQ ID NO: 4124246 - RNA, 16 nt, Streptococcus pyogenes MGAS8232
guauggguaugccuga

SEQ ID NO: 4124247 - RNA, 13 nt, Streptococcus pyogenes MGAS8232
guauguaaauaua

SEQ ID NO: 4124248 - RNA, 12 nt, Streptococcus pyogenes MGAS8232
guauuccauacu

SEQ ID NO: 4124249 - RNA, 19 nt, Streptococcus pyogenes MGAS8232
guauuccauacuuccaucu

SEQ ID NO: 4124250 - RNA, 14 nt, Streptococcus pyogenes MGAS8232
guauucuuaaaaaa

SEQ ID NO: 4124251 - RNA, 23 nt, Streptococcus pyogenes MGAS8232
guauucuuuuuccguuugagaua

SEQ ID NO: 4124252 - RNA, 20 nt, Streptococcus pyogenes MGAS8232
guauuggccuucuuggaaaa

SEQ ID NO: 4124253 - RNA, 14 nt, Streptococcus pyogenes MGAS8232
guauuguagaggac

SEQ ID NO: 4124254 - RNA, 20 nt, Streptococcus pyogenes MGAS8232
guauuguagaggacuaaguc

SEQ ID NO: 4124255 - RNA, 20 nt, Streptococcus pyogenes MGAS8232
guauuuuucaaaaucuuuuc

SEQ ID NO: 4124256 - RNA, 19 nt, Streptococcus pyogenes MGAS8232
gucaaaaaauuaagaagga

SEQ ID NO: 4124257 - RNA, 22 nt, Streptococcus pyogenes MGAS8232
gucaaaaaauuaagaaggaacu

SEQ ID NO: 4124258 - RNA, 19 nt, Streptococcus pyogenes MGAS8232
gucaacuuaccagcaccuu

SEQ ID NO: 4124259 - RNA, 20 nt, Streptococcus pyogenes MGAS8232
gucaacuuaccagcaccuuc

SEQ ID NO: 4124260 - RNA, 20 nt, Streptococcus pyogenes MGAS8232
gucaauuuagccguccuuaa

SEQ ID NO: 4124261 - RNA, 13 nt, Streptococcus pyogenes MGAS8232
gugagaaaauuuu

SEQ ID NO: 4124262 - RNA, 15 nt, Streptococcus pyogenes MGAS8232
gugcaccgacauaca

SEQ ID NO: 4124263 - RNA, 16 nt, Streptococcus pyogenes MGAS8232
gugcaccgacauacaa

SEQ ID NO: 4124264 - RNA, 21 nt, Streptococcus pyogenes MGAS8232
gugccaguaaggaaaucaauc

SEQ ID NO: 4124265 - RNA, 22 nt, Streptococcus pyogenes MGAS8232
gugccuaauccucucacaaaua

SEQ ID NO: 4124266 - RNA, 22 nt, Streptococcus pyogenes MGAS8232
guggaggucugugaugaaucau

SEQ ID NO: 4124267 - RNA, 14 nt, Streptococcus pyogenes MGAS8232
gugucuacuaaaac

SEQ ID NO: 4124268 - RNA, 11 nt, Streptococcus pyogenes MGAS8232
guguuauccuc

SEQ ID NO: 4124269 - RNA, 16 nt, Streptococcus pyogenes MGAS8232
guguugucaaacauaa

SEQ ID NO: 4124270 - RNA, 20 nt, Streptococcus pyogenes MGAS8232
guguuuaaagaccucucaug

SEQ ID NO: 4124271 - RNA, 14 nt, Streptococcus pyogenes MGAS8232
guuaaaauagaaga

SEQ ID NO: 4124272 - RNA, 20 nt, Streptococcus pyogenes MGAS8232
guuaacaaaaauaaguauag

SEQ ID NO: 4124273 - RNA, 20 nt, Streptococcus pyogenes MGAS8232
guuaagagagguugguaaaa

SEQ ID NO: 4124274 - RNA, 19 nt, Streptococcus pyogenes MGAS8232
guuaggagcacaaaagagg

SEQ ID NO: 4124275 - RNA, 17 nt, Streptococcus pyogenes MGAS8232
guuauagcuccuaaaac

SEQ ID NO: 4124276 - RNA, 22 nt, Streptococcus pyogenes MGAS8232
guuauccucccagccaucaaua

SEQ ID NO: 4124277 - RNA, 14 nt, Streptococcus pyogenes MGAS8232
guuauuaaagacaa

SEQ ID NO: 4124278 - RNA, 12 nt, Streptococcus pyogenes MGAS8232
guucauuuagug

SEQ ID NO: 4124279 - RNA, 18 nt, Streptococcus pyogenes MGAS8232
guuccaucugcacaugcu

SEQ ID NO: 4124280 - RNA, 19 nt, Streptococcus pyogenes MGAS8232
guucgucaagcaccuugau

SEQ ID NO: 4124281 - RNA, 18 nt, Streptococcus pyogenes MGAS8232
guucuaaacuuauguuua

SEQ ID NO: 4124282 - RNA, 20 nt, Streptococcus pyogenes MGAS8232
guucuaguuuaggauauaag

SEQ ID NO: 4124283 - RNA, 14 nt, Streptococcus pyogenes MGAS8232
guucugaaaauaaa

SEQ ID NO: 4124284 - RNA, 21 nt, Streptococcus pyogenes MGAS8232
guucugaaaauaaaauauuuu

SEQ ID NO: 4124285 - RNA, 22 nt, Streptococcus pyogenes MGAS8232
guucugagauauucauuuucuu

SEQ ID NO: 4124286 - RNA, 18 nt, Streptococcus pyogenes MGAS8232
guucuuaaaagaaaaucu

SEQ ID NO: 4124287 - RNA, 14 nt, Streptococcus pyogenes MGAS8232
guugauauaaaauu

SEQ ID NO: 4124288 - RNA, 17 nt, Streptococcus pyogenes MGAS8232
guuggucguacuuggca

SEQ ID NO: 4124289 - RNA, 15 nt, Streptococcus pyogenes MGAS8232
guuguauuaugaggu

SEQ ID NO: 4124290 - RNA, 21 nt, Streptococcus pyogenes MGAS8232
guuuaaauguccgaaaaaaac

SEQ ID NO: 4124291 - RNA, 20 nt, Streptococcus pyogenes MGAS8232
guuuaggaaucacaacuucu

SEQ ID NO: 4124292 - RNA, 16 nt, Streptococcus pyogenes MGAS8232
guuucauagaagacgg

SEQ ID NO: 4124293 - RNA, 14 nt, Streptococcus pyogenes MGAS8232
guuucgaaaaaggg

SEQ ID NO: 4124294 - RNA, 20 nt, Streptococcus pyogenes MGAS8232
guuucggaaaacuuuugacu

SEQ ID NO: 4124295 - RNA, 14 nt, Streptococcus pyogenes MGAS8232
guuucuaguuucau

SEQ ID NO: 4124296 - RNA, 20 nt, Streptococcus pyogenes MGAS8232
guuucuugcaaugccagcag

SEQ ID NO: 4124297 - RNA, 16 nt, Streptococcus pyogenes MGAS8232
guuugauugauuuguc

SEQ ID NO: 4124298 - RNA, 22 nt, Streptococcus pyogenes MGAS8232
guuugauugauuugucuucucc

SEQ ID NO: 4124299 - RNA, 14 nt, Streptococcus pyogenes MGAS8232
guuuguaaaauuua

SEQ ID NO: 4124300 - RNA, 13 nt, Streptococcus pyogenes MGAS8232
guuuuauuuugau

SEQ ID NO: 4124301 - RNA, 18 nt, Streptococcus pyogenes MGAS8232
guuuucucaacaguauaa

SEQ ID NO: 4124302 - RNA, 18 nt, Streptococcus pyogenes MGAS8232
guuuucucagagacaaua

SEQ ID NO: 4124303 - RNA, 15 nt, Streptococcus pyogenes MGAS8232
guuuuuaaagcgaua

SEQ ID NO: 4124304 - RNA, 15 nt, Streptococcus pyogenes MGAS8232
guuuuuugucuucuu

SEQ ID NO: 4124305 - RNA, 19 nt, Streptococcus pyogenes MGAS8232
guuuuuuugucuccuucuu

SEQ ID NO: 4124306 - RNA, 21 nt, Streptococcus pyogenes MGAS8232
guuuuuuugucuccuucuuug

SEQ ID NO: 4124307 - RNA, 16 nt, Streptococcus pyogenes MGAS8232
guuuuuuuuauuucac

SEQ ID NO: 4124308 - RNA, 18 nt, Streptococcus pyogenes MGAS8232
uaaaaaaccuuaucaaac

SEQ ID NO: 4124309 - RNA, 21 nt, Streptococcus pyogenes MGAS8232
uaaaaaagaagcaaaauuauu

SEQ ID NO: 4124310 - RNA, 17 nt, Streptococcus pyogenes MGAS8232
uaaaaaagcucuaucau

SEQ ID NO: 4124311 - RNA, 12 nt, Streptococcus pyogenes MGAS8232
uaaaaacaaugc

SEQ ID NO: 4124312 - RNA, 19 nt, Streptococcus pyogenes MGAS8232
uaaaaacaaugcucuuaac

SEQ ID NO: 4124313 - RNA, 17 nt, Streptococcus pyogenes MGAS8232
uaaaaacucaaaaaaua

SEQ ID NO: 4124314 - RNA, 16 nt, Streptococcus pyogenes MGAS8232
uaaaaaguaaaaucuu

SEQ ID NO: 4124315 - RNA, 16 nt, Streptococcus pyogenes MGAS8232
uaaaagaaaaucuaau

SEQ ID NO: 4124316 - RNA, 20 nt, Streptococcus pyogenes MGAS8232
uaaaagauauuuuaaaauag

SEQ ID NO: 4124317 - RNA, 19 nt, Streptococcus pyogenes MGAS8232
uaaaaguuagccaagcaau

SEQ ID NO: 4124318 - RNA, 13 nt, Streptococcus pyogenes MGAS8232
uaaaauagcaccu

SEQ ID NO: 4124319 - RNA, 21 nt, Streptococcus pyogenes MGAS8232
uaaaauagcaccuacgauaaa

SEQ ID NO: 4124320 - RNA, 14 nt, Streptococcus pyogenes MGAS8232
uaaaauaucuagaa

SEQ ID NO: 4124321 - RNA, 22 nt, Streptococcus pyogenes MGAS8232
uaaaauaucuagaacagcugcu

SEQ ID NO: 4124322 - RNA, 23 nt, Streptococcus pyogenes MGAS8232
uaaaauaucuagaacagcugcuu

SEQ ID NO: 4124323 - RNA, 16 nt, Streptococcus pyogenes MGAS8232
uaaaauauuuuuccau

SEQ ID NO: 4124324 - RNA, 23 nt, Streptococcus pyogenes MGAS8232
uaaaaucaugggaaaagcuaagu

SEQ ID NO: 4124325 - RNA, 15 nt, Streptococcus pyogenes MGAS8232
uaaaaugacugacaa

SEQ ID NO: 4124326 - RNA, 17 nt, Streptococcus pyogenes MGAS8232
uaaaauuccccacaaaa

SEQ ID NO: 4124327 - RNA, 23 nt, Streptococcus pyogenes MGAS8232
uaaaauuccccacaaaagacaac

SEQ ID NO: 4124328 - RNA, 13 nt, Streptococcus pyogenes MGAS8232
uaaacaauugguu

SEQ ID NO: 4124329 - RNA, 19 nt, Streptococcus pyogenes MGAS8232
uaaacaauugguuuacaug

SEQ ID NO: 4124330 - RNA, 23 nt, Streptococcus pyogenes MGAS8232
uaaacauauuauaguaaccauug

SEQ ID NO: 4124331 - RNA, 15 nt, Streptococcus pyogenes MGAS8232
uaaacaugccuuuca

SEQ ID NO: 4124332 - RNA, 19 nt, Streptococcus pyogenes MGAS8232
uaaacuguauacaaaaagg

SEQ ID NO: 4124333 - RNA, 16 nt, Streptococcus pyogenes MGAS8232
uaaacuuccaaaccau

SEQ ID NO: 4124334 - RNA, 14 nt, Streptococcus pyogenes MGAS8232
uaaagacaaaaaaa

SEQ ID NO: 4124335 - RNA, 21 nt, Streptococcus pyogenes MGAS8232
uaaagagaaagaggaaacaaa

SEQ ID NO: 4124336 - RNA, 22 nt, Streptococcus pyogenes MGAS8232
uaaagagaaagaggaaacaaaa

SEQ ID NO: 4124337 - RNA, 22 nt, Streptococcus pyogenes MGAS8232
uaaagaugagaguaaacgaaaa

SEQ ID NO: 4124338 - RNA, 16 nt, Streptococcus pyogenes MGAS8232
uaaagauuuuaaauau

SEQ ID NO: 4124339 - RNA, 18 nt, Streptococcus pyogenes MGAS8232
uaaagauuuuaaauaucu

SEQ ID NO: 4124340 - RNA, 13 nt, Streptococcus pyogenes MGAS8232
uaaagcaagggaa

SEQ ID NO: 4124341 - RNA, 16 nt, Streptococcus pyogenes MGAS8232
uaaagcaucagcauaa

SEQ ID NO: 4124342 - RNA, 16 nt, Streptococcus pyogenes MGAS8232
uaaagccaaccccaag

SEQ ID NO: 4124343 - RNA, 23 nt, Streptococcus pyogenes MGAS8232
uaaagcguugacaguuaaaaaua

SEQ ID NO: 4124344 - RNA, 14 nt, Streptococcus pyogenes MGAS8232
uaaagcuacagaug

SEQ ID NO: 4124345 - RNA, 12 nt, Streptococcus pyogenes MGAS8232
uaaaggauuuag

SEQ ID NO: 4124346 - RNA, 16 nt, Streptococcus pyogenes MGAS8232
uaaauaaagauaauuu

SEQ ID NO: 4124347 - RNA, 14 nt, Streptococcus pyogenes MGAS8232
uaaauauaaauuau

SEQ ID NO: 4124348 - RNA, 21 nt, Streptococcus pyogenes MGAS8232
uaaauauccaaugaaaacucc

SEQ ID NO: 4124349 - RNA, 22 nt, Streptococcus pyogenes MGAS8232
uaaauuaaugauucaauaucac

SEQ ID NO: 4124350 - RNA, 22 nt, Streptococcus pyogenes MGAS8232
uaaauuauuaacguuaacaaaa

SEQ ID NO: 4124351 - RNA, 18 nt, Streptococcus pyogenes MGAS8232
uaaauugauuauucucua

SEQ ID NO: 4124352 - RNA, 13 nt, Streptococcus pyogenes MGAS8232
uaacaaaaauaag

SEQ ID NO: 4124353 - RNA, 23 nt, Streptococcus pyogenes MGAS8232
uaacaaaaugaagcaaaauaaac

SEQ ID NO: 4124354 - RNA, 12 nt, Streptococcus pyogenes MGAS8232
uaacaaauuuau

SEQ ID NO: 4124355 - RNA, 15 nt, Streptococcus pyogenes MGAS8232
uaacacgguuuucug

SEQ ID NO: 4124356 - RNA, 19 nt, Streptococcus pyogenes MGAS8232
uaacacgguuuucugucua

SEQ ID NO: 4124357 - RNA, 17 nt, Streptococcus pyogenes MGAS8232
uaacagaaauuaauaaa

SEQ ID NO: 4124358 - RNA, 11 nt, Streptococcus pyogenes MGAS8232
aaaaaagaacu

SEQ ID NO: 4124359 - RNA, 22 nt, Streptococcus pyogenes MGAS8232
aaaaaagaagcaaaauuauuau

SEQ ID NO: 4124360 - RNA, 15 nt, Streptococcus pyogenes MGAS8232
aaaaaauauuguaaa

SEQ ID NO: 4124361 - RNA, 22 nt, Streptococcus pyogenes MGAS8232
aaaaaauuuccaauucaaggua

SEQ ID NO: 4124362 - RNA, 15 nt, Streptococcus pyogenes MGAS8232
aaaaacaaauuguag

SEQ ID NO: 4124363 - RNA, 20 nt, Streptococcus pyogenes MGAS8232
aaaaacaaauuguagggauu

SEQ ID NO: 4124364 - RNA, 11 nt, Streptococcus pyogenes MGAS8232
aaaaacaaugc

SEQ ID NO: 4124365 - RNA, 18 nt, Streptococcus pyogenes MGAS8232
aaaaaccgcucauuugau

SEQ ID NO: 4124366 - RNA, 18 nt, Streptococcus pyogenes MGAS8232
aaaaacgaucaaaaaucu

SEQ ID NO: 4124367 - RNA, 13 nt, Streptococcus pyogenes MGAS8232
aaaaacucaaaaa

SEQ ID NO: 4124368 - RNA, 18 nt, Streptococcus pyogenes MGAS8232
aaaaacucaaaaaauaca

SEQ ID NO: 4124369 - RNA, 14 nt, Streptococcus pyogenes MGAS8232
aaaaagaacaaaga

SEQ ID NO: 4124370 - RNA, 17 nt, Streptococcus pyogenes MGAS8232
aaaaagaacaaagauug

SEQ ID NO: 4124371 - RNA, 22 nt, Streptococcus pyogenes MGAS8232
aaaaagagaccgaagucucuuu

SEQ ID NO: 4124372 - RNA, 17 nt, Streptococcus pyogenes MGAS8232
aaaaagccagagcaguu

SEQ ID NO: 4124373 - RNA, 13 nt, Streptococcus pyogenes MGAS8232
aaaaagccuauuu

SEQ ID NO: 4124374 - RNA, 14 nt, Streptococcus pyogenes MGAS8232
aaaaagccuuuaca

SEQ ID NO: 4124375 - RNA, 11 nt, Streptococcus pyogenes MGAS8232
aaaaagcuuuu

SEQ ID NO: 4124376 - RNA, 17 nt, Streptococcus pyogenes MGAS8232
aaaaaggcaaagaaagc

SEQ ID NO: 4124377 - RNA, 15 nt, Streptococcus pyogenes MGAS8232
aaaaaguaaaaucuu

SEQ ID NO: 4124378 - RNA, 18 nt, Streptococcus pyogenes MGAS8232
aaaaaguaaaaucuuauu

SEQ ID NO: 4124379 - RNA, 22 nt, Streptococcus pyogenes MGAS8232
aaaaauaaguauagcauaaaau

SEQ ID NO: 4124380 - RNA, 19 nt, Streptococcus pyogenes MGAS8232
aaaaauacaauaaagcguu

SEQ ID NO: 4124381 - RNA, 18 nt, Streptococcus pyogenes MGAS8232
aaaaauauauucuaauuu

SEQ ID NO: 4124382 - RNA, 21 nt, Streptococcus pyogenes MGAS8232
aaaaaucccuaugaucuguuu

SEQ ID NO: 4124383 - RNA, 12 nt, Streptococcus pyogenes MGAS8232
aaaaauuaagaa

SEQ ID NO: 4124384 - RNA, 13 nt, Streptococcus pyogenes MGAS8232
aaaacaaaaagag

SEQ ID NO: 4124385 - RNA, 12 nt, Streptococcus pyogenes MGAS8232
aaaacaaaacaa

SEQ ID NO: 4124386 - RNA, 14 nt, Streptococcus pyogenes MGAS8232
aaaacaaaacaaaa

SEQ ID NO: 4124387 - RNA, 15 nt, Streptococcus pyogenes MGAS8232
aaaacaaaacaaaac

SEQ ID NO: 4124388 - RNA, 17 nt, Streptococcus pyogenes MGAS8232
aaaacaaaacaaaacaa

SEQ ID NO: 4124389 - RNA, 12 nt, Streptococcus pyogenes MGAS8232
aaaacaaaacau

SEQ ID NO: 4124390 - RNA, 16 nt, Streptococcus pyogenes MGAS8232
aaaacaauaacacaga

SEQ ID NO: 4124391 - RNA, 17 nt, Streptococcus pyogenes MGAS8232
aaaacaauaacacagaa

SEQ ID NO: 4124392 - RNA, 11 nt, Streptococcus pyogenes MGAS8232
aaaacagaaag

SEQ ID NO: 4124393 - RNA, 22 nt, Streptococcus pyogenes MGAS8232
aaaacagaaagcggaagaacag

SEQ ID NO: 4124394 - RNA, 18 nt, Streptococcus pyogenes MGAS8232
aaaaccauaccuacugcc

SEQ ID NO: 4124395 - RNA, 20 nt, Streptococcus pyogenes MGAS8232
aaaacgagcuggugcaccga

SEQ ID NO: 4124396 - RNA, 14 nt, Streptococcus pyogenes MGAS8232
aaaacgaucaaaaa

SEQ ID NO: 4124397 - RNA, 22 nt, Streptococcus pyogenes MGAS8232
aaaacguguauucuuaaaaaaa

SEQ ID NO: 4124398 - RNA, 14 nt, Streptococcus pyogenes MGAS8232
aaaacucaaaaaau

SEQ ID NO: 4124399 - RNA, 15 nt, Streptococcus pyogenes MGAS8232
aaaacuccagcugga

SEQ ID NO: 4124400 - RNA, 19 nt, Streptococcus pyogenes MGAS8232
aaaacugugaacaaaacaa

SEQ ID NO: 4124401 - RNA, 15 nt, Streptococcus pyogenes MGAS8232
aaaagaacaaagauu

SEQ ID NO: 4124402 - RNA, 20 nt, Streptococcus pyogenes MGAS8232
aaaagaacuuuacaaucauu

SEQ ID NO: 4124403 - RNA, 20 nt, Streptococcus pyogenes MGAS8232
aaaagaagcaaaauuauuau

SEQ ID NO: 4124404 - RNA, 19 nt, Streptococcus pyogenes MGAS8232
aaaagaugcacacaaaucu

SEQ ID NO: 4124405 - RNA, 13 nt, Streptococcus pyogenes MGAS8232
aaaagcaugggcu

SEQ ID NO: 4124406 - RNA, 16 nt, Streptococcus pyogenes MGAS8232
aaaagccagagcaguu

SEQ ID NO: 4124407 - RNA, 20 nt, Streptococcus pyogenes MGAS8232
aaaagcuaaguaagcuucug

SEQ ID NO: 4124408 - RNA, 18 nt, Streptococcus pyogenes MGAS8232
aaaagcucuuagaagccu

SEQ ID NO: 4124409 - RNA, 15 nt, Streptococcus pyogenes MGAS8232
aaaaggggagacgga

SEQ ID NO: 4124410 - RNA, 15 nt, Streptococcus pyogenes MGAS8232
aaaauaaaauauuuu

SEQ ID NO: 4124411 - RNA, 18 nt, Streptococcus pyogenes MGAS8232
aaaauaaacuuucaguua

SEQ ID NO: 4124412 - RNA, 18 nt, Streptococcus pyogenes MGAS8232
aaaauccucuuuuaauuu

SEQ ID NO: 4124413 - RNA, 21 nt, Streptococcus pyogenes MGAS8232
aaaaugacacauuucgguuau

SEQ ID NO: 4124414 - RNA, 17 nt, Streptococcus pyogenes MGAS8232
aaaaugcuguuugucau

SEQ ID NO: 4124415 - RNA, 18 nt, Streptococcus pyogenes MGAS8232
aaaaugcuuuuucguuaa

SEQ ID NO: 4124416 - RNA, 16 nt, Streptococcus pyogenes MGAS8232
aaaauguacauccuaa

SEQ ID NO: 4124417 - RNA, 23 nt, Streptococcus pyogenes MGAS8232
aaacaaaaacugugaacaaaaca

SEQ ID NO: 4124418 - RNA, 12 nt, Streptococcus pyogenes MGAS8232
aaacaaaacaaa

SEQ ID NO: 4124419 - RNA, 14 nt, Streptococcus pyogenes MGAS8232
aaacaaaacaaaac

SEQ ID NO: 4124420 - RNA, 15 nt, Streptococcus pyogenes MGAS8232
aaacaaaacaaaaca

SEQ ID NO: 4124421 - RNA, 18 nt, Streptococcus pyogenes MGAS8232
aaacaagucuaucugcag

SEQ ID NO: 4124422 - RNA, 20 nt, Streptococcus pyogenes MGAS8232
aaacagaugcucaaacuaua

SEQ ID NO: 4124423 - RNA, 16 nt, Streptococcus pyogenes MGAS8232
aaacauagccuucuuu

SEQ ID NO: 4124424 - RNA, 14 nt, Streptococcus pyogenes MGAS8232
aaacauuuaaucau

SEQ ID NO: 4124425 - RNA, 22 nt, Streptococcus pyogenes MGAS8232
aaaccaagugccaguaaggaaa

SEQ ID NO: 4124426 - RNA, 20 nt, Streptococcus pyogenes MGAS8232
aaacgcuauaccuaaaaaau

SEQ ID NO: 4124427 - RNA, 18 nt, Streptococcus pyogenes MGAS8232
aaacguguauucuuaaaa

SEQ ID NO: 4124428 - RNA, 20 nt, Streptococcus pyogenes MGAS8232
aaacguguauucuuaaaaaa

SEQ ID NO: 4124429 - RNA, 17 nt, Streptococcus pyogenes MGAS8232
aaacguuauuaaagaca

SEQ ID NO: 4124430 - RNA, 22 nt, Streptococcus pyogenes MGAS8232
aaacguuauuaaagacaaaaaa

SEQ ID NO: 4124431 - RNA, 18 nt, Streptococcus pyogenes MGAS8232
aaacucaaaaaauacaau

SEQ ID NO: 4124432 - RNA, 18 nt, Streptococcus pyogenes MGAS8232
aaacucaaacuaaacaaa

SEQ ID NO: 4124433 - RNA, 14 nt, Streptococcus pyogenes MGAS8232
aaacugagacaagu

SEQ ID NO: 4124434 - RNA, 16 nt, Streptococcus pyogenes MGAS8232
aaacuggucaaaagcu

SEQ ID NO: 4124435 - RNA, 14 nt, Streptococcus pyogenes MGAS8232
aaacuuacaaaaag

SEQ ID NO: 4124436 - RNA, 16 nt, Streptococcus pyogenes MGAS8232
aaacuuucaguuaucu

SEQ ID NO: 4124437 - RNA, 17 nt, Streptococcus pyogenes MGAS8232
aaagaccauaaaaaacc

SEQ ID NO: 4124438 - RNA, 18 nt, Streptococcus pyogenes MGAS8232
aaagacccccuagacugu

SEQ ID NO: 4124439 - RNA, 17 nt, Streptococcus pyogenes MGAS8232
aaagaggaaacaaaaac

SEQ ID NO: 4124440 - RNA, 19 nt, Streptococcus pyogenes MGAS8232
aaagagucugagcaaucau

SEQ ID NO: 4124441 - RNA, 13 nt, Streptococcus pyogenes MGAS8232
aaagauauuuuaa

SEQ ID NO: 4124442 - RNA, 14 nt, Streptococcus pyogenes MGAS8232
aaagauauuuuaaa

SEQ ID NO: 4124443 - RNA, 14 nt, Streptococcus pyogenes MGAS8232
aaagauuuuaaaua

SEQ ID NO: 4124444 - RNA, 16 nt, Streptococcus pyogenes MGAS8232
aaagcauaaaaauauu

SEQ ID NO: 4124445 - RNA, 19 nt, Streptococcus pyogenes MGAS8232
aaagcaucaggauugccau

SEQ ID NO: 4124446 - RNA, 23 nt, Streptococcus pyogenes MGAS8232
aaagcauuuuaugacaaauucuu

SEQ ID NO: 4124447 - RNA, 20 nt, Streptococcus pyogenes MGAS8232
aaagcggaagaacagcauuu

SEQ ID NO: 4124448 - RNA, 20 nt, Streptococcus pyogenes MGAS8232
aaagcguugacaguuaaaaa

SEQ ID NO: 4124449 - RNA, 15 nt, Streptococcus pyogenes MGAS8232
aaagcuaaacuaggc

SEQ ID NO: 4124450 - RNA, 16 nt, Streptococcus pyogenes MGAS8232
aaagcuguaguuagaa

SEQ ID NO: 4124451 - RNA, 22 nt, Streptococcus pyogenes MGAS8232
aaagcuucaucgaugauagcuu

SEQ ID NO: 4124452 - RNA, 22 nt, Streptococcus pyogenes MGAS8232
aaaggaauaucaggcaaaacaa

SEQ ID NO: 4124453 - RNA, 20 nt, Streptococcus pyogenes MGAS8232
aacguguauucuuaaaaaaa

SEQ ID NO: 4124454 - RNA, 17 nt, Streptococcus pyogenes MGAS8232
aacguuauuaaagacaa

SEQ ID NO: 4124455 - RNA, 16 nt, Streptococcus pyogenes MGAS8232
aacuccuuaaauuaua

SEQ ID NO: 4124456 - RNA, 15 nt, Streptococcus pyogenes MGAS8232
aacucucauaaaauu

SEQ ID NO: 4124457 - RNA, 18 nt, Streptococcus pyogenes MGAS8232
aacugccaguugagccuu

SEQ ID NO: 4124458 - RNA, 17 nt, Streptococcus pyogenes MGAS8232
aacuguuuuucuuauau

SEQ ID NO: 4124459 - RNA, 21 nt, Streptococcus pyogenes MGAS8232
aacuguuuuucuuauauugug

SEQ ID NO: 4124460 - RNA, 22 nt, Streptococcus pyogenes MGAS8232
aacuguuuuucuuauauugugc

SEQ ID NO: 4124461 - RNA, 17 nt, Streptococcus pyogenes MGAS8232
aacuucaaauuucauga

SEQ ID NO: 4124462 - RNA, 22 nt, Streptococcus pyogenes MGAS8232
aacuugcaucgcaaacagaugc

SEQ ID NO: 4124463 - RNA, 17 nt, Streptococcus pyogenes MGAS8232
aacuugggaaugaugcu

SEQ ID NO: 4124464 - RNA, 18 nt, Streptococcus pyogenes MGAS8232
aacuugggagaguuccug

SEQ ID NO: 4124465 - RNA, 21 nt, Streptococcus pyogenes MGAS8232
aacuugggagaguuccugcau

SEQ ID NO: 4124466 - RNA, 13 nt, Streptococcus pyogenes MGAS8232
aacuuucaguuau

SEQ ID NO: 4124467 - RNA, 13 nt, Streptococcus pyogenes MGAS8232
aagaacagcauuu

SEQ ID NO: 4124468 - RNA, 12 nt, Streptococcus pyogenes MGAS8232
aagaagcaaaau

SEQ ID NO: 4124469 - RNA, 22 nt, Streptococcus pyogenes MGAS8232
aagaaggaacucuccaaaguuc

SEQ ID NO: 4124470 - RNA, 15 nt, Streptococcus pyogenes MGAS8232
aagaaggucucaaau

SEQ ID NO: 4124471 - RNA, 20 nt, Streptococcus pyogenes MGAS8232
aagaaggucucaaauuuuuu

SEQ ID NO: 4124472 - RNA, 22 nt, Streptococcus pyogenes MGAS8232
aagaauuggggcggcacuucca

SEQ ID NO: 4124473 - RNA, 12 nt, Streptococcus pyogenes MGAS8232
aagacaaaaaaa

SEQ ID NO: 4124474 - RNA, 16 nt, Streptococcus pyogenes MGAS8232
aagaccauaaaaaacc

SEQ ID NO: 4124475 - RNA, 16 nt, Streptococcus pyogenes MGAS8232
aagacuuaaggauuua

SEQ ID NO: 4124476 - RNA, 23 nt, Streptococcus pyogenes MGAS8232
aagagagguugguaaaaaggcag

SEQ ID NO: 4124477 - RNA, 21 nt, Streptococcus pyogenes MGAS8232
aagagcacacauaaugauuuu

SEQ ID NO: 4124478 - RNA, 16 nt, Streptococcus pyogenes MGAS8232
aagagccaaaauaaca

SEQ ID NO: 4124479 - RNA, 15 nt, Streptococcus pyogenes MGAS8232
aagagccaucagcuc

SEQ ID NO: 4124480 - RNA, 22 nt, Streptococcus pyogenes MGAS8232
aagagcuuaaaaguuagccaag

SEQ ID NO: 4124481 - RNA, 16 nt, Streptococcus pyogenes MGAS8232
aagauaaguaauauuu

SEQ ID NO: 4124482 - RNA, 22 nt, Streptococcus pyogenes MGAS8232
aagauagugauggcuugaagua

SEQ ID NO: 4124483 - RNA, 21 nt, Streptococcus pyogenes MGAS8232
aagauggugcuuuaaaaaguu

SEQ ID NO: 4124484 - RNA, 18 nt, Streptococcus pyogenes MGAS8232
aagaugguuuugauuaaa

SEQ ID NO: 4124485 - RNA, 12 nt, Streptococcus pyogenes MGAS8232
aagauuggauuu

SEQ ID NO: 4124486 - RNA, 24 nt, Streptococcus pyogenes MGAS8232
aagauuuccacuugguccaucagu

SEQ ID NO: 4124487 - RNA, 13 nt, Streptococcus pyogenes MGAS8232
aagcaaaauuauu

SEQ ID NO: 4124488 - RNA, 13 nt, Streptococcus pyogenes MGAS8232
aagcaaucuaaga

SEQ ID NO: 4124489 - RNA, 16 nt, Streptococcus pyogenes MGAS8232
aagcagugcuuuaaca

SEQ ID NO: 4124490 - RNA, 19 nt, Streptococcus pyogenes MGAS8232
aagcagugcuuuaacaaug

SEQ ID NO: 4124491 - RNA, 16 nt, Streptococcus pyogenes MGAS8232
aagcaugggcuaagua

SEQ ID NO: 4124492 - RNA, 12 nt, Streptococcus pyogenes MGAS8232
aagcauuuugag

SEQ ID NO: 4124493 - RNA, 22 nt, Streptococcus pyogenes MGAS8232
aagccagagcaguucagcagca

SEQ ID NO: 4124494 - RNA, 16 nt, Streptococcus pyogenes MGAS8232
aagccauaaacaagug

SEQ ID NO: 4124495 - RNA, 22 nt, Streptococcus pyogenes MGAS8232
aagccgugaggacuuauuuuuu

SEQ ID NO: 4124496 - RNA, 21 nt, Streptococcus pyogenes MGAS8232
aagcguugacaguuaaaaaua

SEQ ID NO: 4124497 - RNA, 15 nt, Streptococcus pyogenes MGAS8232
aagcugagcaaaaca

SEQ ID NO: 4124498 - RNA, 22 nt, Streptococcus pyogenes MGAS8232
aagcuugucuaugagauaccuu

SEQ ID NO: 4124499 - RNA, 13 nt, Streptococcus pyogenes MGAS8232
aagcuuuaaaaaa

SEQ ID NO: 4124500 - RNA, 15 nt, Streptococcus pyogenes MGAS8232
aagcuuuaaaaaaua

SEQ ID NO: 4124501 - RNA, 18 nt, Streptococcus pyogenes MGAS8232
aagcuuuuuuauaacugu

SEQ ID NO: 4124502 - RNA, 21 nt, Streptococcus pyogenes MGAS8232
aaggaaggcuuguucuuuauu

SEQ ID NO: 4124503 - RNA, 23 nt, Streptococcus pyogenes MGAS8232
aaggaauugcagcuaaaaacaau

SEQ ID NO: 4124504 - RNA, 15 nt, Streptococcus pyogenes MGAS8232
aaggcaaagaaagcc

SEQ ID NO: 4124505 - RNA, 20 nt, Streptococcus pyogenes MGAS8232
aaggcaaucacccauguaaa

SEQ ID NO: 4124506 - RNA, 21 nt, Streptococcus pyogenes MGAS8232
aaggcaauccaaaucaacaug

SEQ ID NO: 4124507 - RNA, 16 nt, Streptococcus pyogenes MGAS8232
aaggcugcgaugauuu

SEQ ID NO: 4124508 - RNA, 22 nt, Streptococcus pyogenes MGAS8232
aaggcuuguucuuuauuuugau

SEQ ID NO: 4124509 - RNA, 14 nt, Streptococcus pyogenes MGAS8232
aagggaagaagauc

SEQ ID NO: 4124510 - RNA, 16 nt, Streptococcus pyogenes MGAS8232
aagggugaaucauuac

SEQ ID NO: 4124511 - RNA, 21 nt, Streptococcus pyogenes MGAS8232
aagggugaaucauuacuccuu

SEQ ID NO: 4124512 - RNA, 15 nt, Streptococcus pyogenes MGAS8232
aaggucucaaauuuu

SEQ ID NO: 4124513 - RNA, 19 nt, Streptococcus pyogenes MGAS8232
aagguuuuuuuaagcauga

SEQ ID NO: 4124514 - RNA, 22 nt, Streptococcus pyogenes MGAS8232
aagguuuuuuuaagcaugauuu

SEQ ID NO: 4124515 - RNA, 14 nt, Streptococcus pyogenes MGAS8232
aaguaaaggauuua

SEQ ID NO: 4124516 - RNA, 16 nt, Streptococcus pyogenes MGAS8232
aaguaagauggugcuu

SEQ ID NO: 4124517 - RNA, 24 nt, Streptococcus pyogenes MGAS8232
aaguaauaaguagcguacauggau

SEQ ID NO: 4124518 - RNA, 17 nt, Streptococcus pyogenes MGAS8232
aaguagcguacauggau

SEQ ID NO: 4124519 - RNA, 16 nt, Streptococcus pyogenes MGAS8232
aaguagucaaaauagg

SEQ ID NO: 4124520 - RNA, 17 nt, Streptococcus pyogenes MGAS8232
aaguauagcauaaaaua

SEQ ID NO: 4124521 - RNA, 23 nt, Streptococcus pyogenes MGAS8232
aaguauuuuaaaauccucuuuua

SEQ ID NO: 4124522 - RNA, 20 nt, Streptococcus pyogenes MGAS8232
aagucagacucaauugaaag

SEQ ID NO: 4124523 - RNA, 18 nt, Streptococcus pyogenes MGAS8232
aagucuaucugcagauuu

SEQ ID NO: 4124524 - RNA, 22 nt, Streptococcus pyogenes MGAS8232
aagucuaucugcagauuuuaag

SEQ ID NO: 4124525 - RNA, 14 nt, Streptococcus pyogenes MGAS8232
aagucucuugcaag

SEQ ID NO: 4124526 - RNA, 18 nt, Streptococcus pyogenes MGAS8232
aagucuuagaaauagucu

SEQ ID NO: 4124527 - RNA, 18 nt, Streptococcus pyogenes MGAS8232
aagugccaguaaggaaau

SEQ ID NO: 4124528 - RNA, 22 nt, Streptococcus pyogenes MGAS8232
aagugccaguaaggaaaucaau

SEQ ID NO: 4124529 - RNA, 21 nt, Streptococcus pyogenes MGAS8232
aagugugacuaguuuauuaca

SEQ ID NO: 4124530 - RNA, 22 nt, Streptococcus pyogenes MGAS8232
aaguguuuugucuuauagaaua

SEQ ID NO: 4124531 - RNA, 15 nt, Streptococcus pyogenes MGAS8232
aaguucuuugccuuu

SEQ ID NO: 4124532 - RNA, 20 nt, Streptococcus pyogenes MGAS8232
aaguugccuuaucucaguuu

SEQ ID NO: 4124533 - RNA, 16 nt, Streptococcus pyogenes MGAS8232
aaguuggcuacucuau

SEQ ID NO: 4124534 - RNA, 19 nt, Streptococcus pyogenes MGAS8232
aaguuggcuacucuauuug

SEQ ID NO: 4124535 - RNA, 19 nt, Streptococcus pyogenes MGAS8232
aaguuggcuacucuauuuu

SEQ ID NO: 4124536 - RNA, 21 nt, Streptococcus pyogenes MGAS8232
aaguuugcggcucggugcuga

SEQ ID NO: 4124537 - RNA, 21 nt, Streptococcus pyogenes MGAS8232
aaguuuucucagagacaauaa

SEQ ID NO: 4124538 - RNA, 13 nt, Streptococcus pyogenes MGAS8232
aauaaagaugaga

SEQ ID NO: 4124539 - RNA, 18 nt, Streptococcus pyogenes MGAS8232
aauaacagaaauuaauaa

SEQ ID NO: 4124540 - RNA, 13 nt, Streptococcus pyogenes MGAS8232
aauaacuuuaaaa

SEQ ID NO: 4124541 - RNA, 15 nt, Streptococcus pyogenes MGAS8232
aauaacuuuaaaagg

SEQ ID NO: 4124542 - RNA, 13 nt, Streptococcus pyogenes MGAS8232
aauaagaaaaccu

SEQ ID NO: 4124543 - RNA, 11 nt, Streptococcus pyogenes MGAS8232
aauaagauuca

SEQ ID NO: 4124544 - RNA, 19 nt, Streptococcus pyogenes MGAS8232
aauaagauucaauaugaaa

SEQ ID NO: 4124545 - RNA, 21 nt, Streptococcus pyogenes MGAS8232
aauaaguauagcauaaaauag

SEQ ID NO: 4124546 - RNA, 23 nt, Streptococcus pyogenes MGAS8232
aauaaguauagcauaaaauaguu

SEQ ID NO: 4124547 - RNA, 15 nt, Streptococcus pyogenes MGAS8232
aauaaguauuuuaaa

SEQ ID NO: 4124548 - RNA, 18 nt, Streptococcus pyogenes MGAS8232
aauaaguauuuuaaaauc

SEQ ID NO: 4124549 - RNA, 23 nt, Streptococcus pyogenes MGAS8232
aauaauauuauaguauuaucuca

SEQ ID NO: 4124550 - RNA, 19 nt, Streptococcus pyogenes MGAS8232
acaauacaaaaaaccuucc

SEQ ID NO: 4124551 - RNA, 21 nt, Streptococcus pyogenes MGAS8232
acaaucgaaaugauagcaccu

SEQ ID NO: 4124552 - RNA, 22 nt, Streptococcus pyogenes MGAS8232
acaaugagaucuucuuuugguu

SEQ ID NO: 4124553 - RNA, 13 nt, Streptococcus pyogenes MGAS8232
acaaugcucuuaa

SEQ ID NO: 4124554 - RNA, 18 nt, Streptococcus pyogenes MGAS8232
acaauguagcuaucaaau

SEQ ID NO: 4124555 - RNA, 16 nt, Streptococcus pyogenes MGAS8232
acaauuaaaaaagcuu

SEQ ID NO: 4124556 - RNA, 14 nt, Streptococcus pyogenes MGAS8232
acacaaaagcuuua

SEQ ID NO: 4124557 - RNA, 15 nt, Streptococcus pyogenes MGAS8232
acacagaagccucuu

SEQ ID NO: 4124558 - RNA, 19 nt, Streptococcus pyogenes MGAS8232
acacauaaugauuuuuaau

SEQ ID NO: 4124559 - RNA, 14 nt, Streptococcus pyogenes MGAS8232
acaccaaaaaaagc

SEQ ID NO: 4124560 - RNA, 15 nt, Streptococcus pyogenes MGAS8232
acaccaaaaaaagca

SEQ ID NO: 4124561 - RNA, 21 nt, Streptococcus pyogenes MGAS8232
acaccauuaaaaaaaccagcu

SEQ ID NO: 4124562 - RNA, 21 nt, Streptococcus pyogenes MGAS8232
acaccuaauaaaauagcaccu

SEQ ID NO: 4124563 - RNA, 13 nt, Streptococcus pyogenes MGAS8232
acacguauuuuuc

SEQ ID NO: 4124564 - RNA, 17 nt, Streptococcus pyogenes MGAS8232
acacgugauaaaugccg

SEQ ID NO: 4124565 - RNA, 15 nt, Streptococcus pyogenes MGAS8232
acacuuaaaugcaaa

SEQ ID NO: 4124566 - RNA, 12 nt, Streptococcus pyogenes MGAS8232
acagaaagcgga

SEQ ID NO: 4124567 - RNA, 18 nt, Streptococcus pyogenes MGAS8232
acagaaagcggaagaaca

SEQ ID NO: 4124568 - RNA, 16 nt, Streptococcus pyogenes MGAS8232
acagaagccucuucug

SEQ ID NO: 4124569 - RNA, 14 nt, Streptococcus pyogenes MGAS8232
acagacaccaaaaa

SEQ ID NO: 4124570 - RNA, 17 nt, Streptococcus pyogenes MGAS8232
acagacaccaaaaaaag

SEQ ID NO: 4124571 - RNA, 17 nt, Streptococcus pyogenes MGAS8232
acagauagucaaaaaga

SEQ ID NO: 4124572 - RNA, 20 nt, Streptococcus pyogenes MGAS8232
acagaugcucaaacuauauu

SEQ ID NO: 4124573 - RNA, 24 nt, Streptococcus pyogenes MGAS8232
acagcaauuuguuccaucugcaca

SEQ ID NO: 4124574 - RNA, 15 nt, Streptococcus pyogenes MGAS8232
acagcauauugaaac

SEQ ID NO: 4124575 - RNA, 16 nt, Streptococcus pyogenes MGAS8232
acaguauguaaauaua

SEQ ID NO: 4124576 - RNA, 14 nt, Streptococcus pyogenes MGAS8232
acaguuaaaaauaa

SEQ ID NO: 4124577 - RNA, 15 nt, Streptococcus pyogenes MGAS8232
acaguuaaaaauaac

SEQ ID NO: 4124578 - RNA, 18 nt, Streptococcus pyogenes MGAS8232
acauaaaaugacuucaaa

SEQ ID NO: 4124579 - RNA, 18 nt, Streptococcus pyogenes MGAS8232
acauaauguuauaauaau

SEQ ID NO: 4124580 - RNA, 19 nt, Streptococcus pyogenes MGAS8232
acauaauguuauaauaaua

SEQ ID NO: 4124581 - RNA, 23 nt, Streptococcus pyogenes MGAS8232
acauacucuauuuacucaucuac

SEQ ID NO: 4124582 - RNA, 21 nt, Streptococcus pyogenes MGAS8232
acauacuuuauuaaucaaaaa

SEQ ID NO: 4124583 - RNA, 17 nt, Streptococcus pyogenes MGAS8232
acauagccuucuuuguc

SEQ ID NO: 4124584 - RNA, 21 nt, Streptococcus pyogenes MGAS8232
acaucaaaggcuuuuuuguau

SEQ ID NO: 4124585 - RNA, 13 nt, Streptococcus pyogenes MGAS8232
acauguccaaauc

SEQ ID NO: 4124586 - RNA, 18 nt, Streptococcus pyogenes MGAS8232
acauguccauugaugagu

SEQ ID NO: 4124587 - RNA, 16 nt, Streptococcus pyogenes MGAS8232
acauucguucuaguuu

SEQ ID NO: 4124588 - RNA, 17 nt, Streptococcus pyogenes MGAS8232
acauuuaaucaugucca

SEQ ID NO: 4124589 - RNA, 14 nt, Streptococcus pyogenes MGAS8232
acauuuaugcugau

SEQ ID NO: 4124590 - RNA, 18 nt, Streptococcus pyogenes MGAS8232
accaacuuggacgaaggc

SEQ ID NO: 4124591 - RNA, 16 nt, Streptococcus pyogenes MGAS8232
accaauauagcaaucu

SEQ ID NO: 4124592 - RNA, 17 nt, Streptococcus pyogenes MGAS8232
accaauuuaagguauug

SEQ ID NO: 4124593 - RNA, 21 nt, Streptococcus pyogenes MGAS8232
accaauuuaagguauuguuca

SEQ ID NO: 4124594 - RNA, 15 nt, Streptococcus pyogenes MGAS8232
accacaccuaauaaa

SEQ ID NO: 4124595 - RNA, 18 nt, Streptococcus pyogenes MGAS8232
accacaccuaauaaaaua

SEQ ID NO: 4124596 - RNA, 20 nt, Streptococcus pyogenes MGAS8232
accacacgauuaaccguucc

SEQ ID NO: 4124597 - RNA, 14 nt, Streptococcus pyogenes MGAS8232
accaccaaccuuaa

SEQ ID NO: 4124598 - RNA, 15 nt, Streptococcus pyogenes MGAS8232
accagaugcuugcuc

SEQ ID NO: 4124599 - RNA, 13 nt, Streptococcus pyogenes MGAS8232
accagcaccuucu

SEQ ID NO: 4124600 - RNA, 14 nt, Streptococcus pyogenes MGAS8232
accagccacuacaa

SEQ ID NO: 4124601 - RNA, 21 nt, Streptococcus pyogenes MGAS8232
accaucaaugacuugaccaaa

SEQ ID NO: 4124602 - RNA, 13 nt, Streptococcus pyogenes MGAS8232
accaugccuaaau

SEQ ID NO: 4124603 - RNA, 19 nt, Streptococcus pyogenes MGAS8232
accaugccuaaaucccauc

SEQ ID NO: 4124604 - RNA, 13 nt, Streptococcus pyogenes MGAS8232
accauucuaaaca

SEQ ID NO: 4124605 - RNA, 12 nt, Streptococcus pyogenes MGAS8232
accauugccauu

SEQ ID NO: 4124606 - RNA, 22 nt, Streptococcus pyogenes MGAS8232
accauugccauuaauaauauua

SEQ ID NO: 4124607 - RNA, 15 nt, Streptococcus pyogenes MGAS8232
accauuguagaguuu

SEQ ID NO: 4124608 - RNA, 19 nt, Streptococcus pyogenes MGAS8232
accauuuuaugagaaaaau

SEQ ID NO: 4124609 - RNA, 20 nt, Streptococcus pyogenes MGAS8232
accccaaaggcugaugcgau

SEQ ID NO: 4124610 - RNA, 18 nt, Streptococcus pyogenes MGAS8232
acccccuagacugugaaa

SEQ ID NO: 4124611 - RNA, 15 nt, Streptococcus pyogenes MGAS8232
acccgucuuacaauu

SEQ ID NO: 4124612 - RNA, 19 nt, Streptococcus pyogenes MGAS8232
accgaaaaaggcaaagaaa

SEQ ID NO: 4124613 - RNA, 19 nt, Streptococcus pyogenes MGAS8232
accgcaauuaaaccauucu

SEQ ID NO: 4124614 - RNA, 15 nt, Streptococcus pyogenes MGAS8232
accgcgaauaugaua

SEQ ID NO: 4124615 - RNA, 15 nt, Streptococcus pyogenes MGAS8232
accgucacuauugaa

SEQ ID NO: 4124616 - RNA, 18 nt, Streptococcus pyogenes MGAS8232
accguuccugucgcagau

SEQ ID NO: 4124617 - RNA, 22 nt, Streptococcus pyogenes MGAS8232
accuacgauaaaacaaauaauu

SEQ ID NO: 4124618 - RNA, 17 nt, Streptococcus pyogenes MGAS8232
accuccuaaacuaauaa

SEQ ID NO: 4124619 - RNA, 18 nt, Streptococcus pyogenes MGAS8232
accuccuaaauugguuuu

SEQ ID NO: 4124620 - RNA, 14 nt, Streptococcus pyogenes MGAS8232
accuuaaaggccuc

SEQ ID NO: 4124621 - RNA, 21 nt, Streptococcus pyogenes MGAS8232
accuuaggcagacaauuauuu

SEQ ID NO: 4124622 - RNA, 22 nt, Streptococcus pyogenes MGAS8232
accuuaggcagacaauuauuuu

SEQ ID NO: 4124623 - RNA, 15 nt, Streptococcus pyogenes MGAS8232
accuucaacauuucg

SEQ ID NO: 4124624 - RNA, 18 nt, Streptococcus pyogenes MGAS8232
accuucaaccgcuucuuu

SEQ ID NO: 4124625 - RNA, 23 nt, Streptococcus pyogenes MGAS8232
accuuugauaagauauuguuaau

SEQ ID NO: 4124626 - RNA, 12 nt, Streptococcus pyogenes MGAS8232
accuuugccauu

SEQ ID NO: 4124627 - RNA, 15 nt, Streptococcus pyogenes MGAS8232
acgauagcaaucaca

SEQ ID NO: 4124628 - RNA, 16 nt, Streptococcus pyogenes MGAS8232
acgcauuucuuuuuug

SEQ ID NO: 4124629 - RNA, 14 nt, Streptococcus pyogenes MGAS8232
acgcuuaccgcaua

SEQ ID NO: 4124630 - RNA, 18 nt, Streptococcus pyogenes MGAS8232
acggcuucuacacaaaag

SEQ ID NO: 4124631 - RNA, 18 nt, Streptococcus pyogenes MGAS8232
acgggucucuuugggaaa

SEQ ID NO: 4124632 - RNA, 22 nt, Streptococcus pyogenes MGAS8232
acggucauuaauaaaagauuuc

SEQ ID NO: 4124633 - RNA, 23 nt, Streptococcus pyogenes MGAS8232
acgguguaauccccucguuuaaa

SEQ ID NO: 4124634 - RNA, 16 nt, Streptococcus pyogenes MGAS8232
acguaaccaauuguug

SEQ ID NO: 4124635 - RNA, 12 nt, Streptococcus pyogenes MGAS8232
acguacagaaau

SEQ ID NO: 4124636 - RNA, 22 nt, Streptococcus pyogenes MGAS8232
acguauuuuucgacaauuaaaa

SEQ ID NO: 4124637 - RNA, 23 nt, Streptococcus pyogenes MGAS8232
acgucagcggcugcucuuuuguu

SEQ ID NO: 4124638 - RNA, 19 nt, Streptococcus pyogenes MGAS8232
acgucuaccgcaauuaaac

SEQ ID NO: 4124639 - RNA, 23 nt, Streptococcus pyogenes MGAS8232
acgucuaccgcaauuaaaccauu

SEQ ID NO: 4124640 - RNA, 19 nt, Streptococcus pyogenes MGAS8232
acguguauucuuaaaaaaa

SEQ ID NO: 4124641 - RNA, 20 nt, Streptococcus pyogenes MGAS8232
acguguauucuuaaaaaaau

SEQ ID NO: 4124642 - RNA, 22 nt, Streptococcus pyogenes MGAS8232
acguuauuaaagacaaaaaaac

SEQ ID NO: 4124643 - RNA, 13 nt, Streptococcus pyogenes MGAS8232
acuaaacaaacgg

SEQ ID NO: 4124644 - RNA, 16 nt, Streptococcus pyogenes MGAS8232
acuaagguacggucau

SEQ ID NO: 4124645 - RNA, 13 nt, Streptococcus pyogenes MGAS8232
acuaauauaaggc

SEQ ID NO: 4124646 - RNA, 16 nt, Streptococcus pyogenes MGAS8232
acuacaagcauuuuug

SEQ ID NO: 4124647 - RNA, 16 nt, Streptococcus pyogenes MGAS8232
agaugagaguaaacga

SEQ ID NO: 4124648 - RNA, 23 nt, Streptococcus pyogenes MGAS8232
agaugcuugcucaauuuuugauu

SEQ ID NO: 4124649 - RNA, 15 nt, Streptococcus pyogenes MGAS8232
agaugguagcaagaa

SEQ ID NO: 4124650 - RNA, 18 nt, Streptococcus pyogenes MGAS8232
agaugguuuugauuaaau

SEQ ID NO: 4124651 - RNA, 17 nt, Streptococcus pyogenes MGAS8232
agauuaaacuuacaaaa

SEQ ID NO: 4124652 - RNA, 18 nt, Streptococcus pyogenes MGAS8232
agauuaaacuuacaaaaa

SEQ ID NO: 4124653 - RNA, 16 nt, Streptococcus pyogenes MGAS8232
agauucaauaugaaaa

SEQ ID NO: 4124654 - RNA, 22 nt, Streptococcus pyogenes MGAS8232
agauuggauuucgacucaugau

SEQ ID NO: 4124655 - RNA, 14 nt, Streptococcus pyogenes MGAS8232
agauuuuaagacaa

SEQ ID NO: 4124656 - RNA, 22 nt, Streptococcus pyogenes MGAS8232
agcaaaacaauaacacagaagc

SEQ ID NO: 4124657 - RNA, 16 nt, Streptococcus pyogenes MGAS8232
agcaaauuguuugauu

SEQ ID NO: 4124658 - RNA, 16 nt, Streptococcus pyogenes MGAS8232
agcaaccucaguucug

SEQ ID NO: 4124659 - RNA, 21 nt, Streptococcus pyogenes MGAS8232
agcaagaaguuuuauagcuga

SEQ ID NO: 4124660 - RNA, 21 nt, Streptococcus pyogenes MGAS8232
agcaagugugacuaguuuauu

SEQ ID NO: 4124661 - RNA, 22 nt, Streptococcus pyogenes MGAS8232
agcaaucauacccgcguuaucu

SEQ ID NO: 4124662 - RNA, 14 nt, Streptococcus pyogenes MGAS8232
agcaaucuucaaca

SEQ ID NO: 4124663 - RNA, 21 nt, Streptococcus pyogenes MGAS8232
agcaaucuucaacaccuucgu

SEQ ID NO: 4124664 - RNA, 18 nt, Streptococcus pyogenes MGAS8232
agcaaugguuaaaaagag

SEQ ID NO: 4124665 - RNA, 19 nt, Streptococcus pyogenes MGAS8232
agcaauuguuuuuucaaca

SEQ ID NO: 4124666 - RNA, 18 nt, Streptococcus pyogenes MGAS8232
agcaccuacgauaaaaca

SEQ ID NO: 4124667 - RNA, 13 nt, Streptococcus pyogenes MGAS8232
agcaccuucaacc

SEQ ID NO: 4124668 - RNA, 22 nt, Streptococcus pyogenes MGAS8232
agcacuggcuuuuuugcuuuuu

SEQ ID NO: 4124669 - RNA, 23 nt, Streptococcus pyogenes MGAS8232
agcagacaaaagggaagagagaa

SEQ ID NO: 4124670 - RNA, 18 nt, Streptococcus pyogenes MGAS8232
agcagcaacaauacuaug

SEQ ID NO: 4124671 - RNA, 18 nt, Streptococcus pyogenes MGAS8232
agcagcagaagcaaauuc

SEQ ID NO: 4124672 - RNA, 20 nt, Streptococcus pyogenes MGAS8232
agcagcaucacguacagaaa

SEQ ID NO: 4124673 - RNA, 18 nt, Streptococcus pyogenes MGAS8232
agcagccugucaagcccu

SEQ ID NO: 4124674 - RNA, 15 nt, Streptococcus pyogenes MGAS8232
agcaggcguuuuguu

SEQ ID NO: 4124675 - RNA, 15 nt, Streptococcus pyogenes MGAS8232
agcagugcuuuaaca

SEQ ID NO: 4124676 - RNA, 15 nt, Streptococcus pyogenes MGAS8232
agcaguucagcagca

SEQ ID NO: 4124677 - RNA, 18 nt, Streptococcus pyogenes MGAS8232
agcaguucagcagcacug

SEQ ID NO: 4124678 - RNA, 24 nt, Streptococcus pyogenes MGAS8232
agcauaaaagauauuuuaaaauag

SEQ ID NO: 4124679 - RNA, 18 nt, Streptococcus pyogenes MGAS8232
agcauaaccuuugccauu

SEQ ID NO: 4124680 - RNA, 21 nt, Streptococcus pyogenes MGAS8232
agcauauugaaacuugcugcc

SEQ ID NO: 4124681 - RNA, 19 nt, Streptococcus pyogenes MGAS8232
agcaucacguacagaaaug

SEQ ID NO: 4124682 - RNA, 16 nt, Streptococcus pyogenes MGAS8232
agcaucguuaagugga

SEQ ID NO: 4124683 - RNA, 18 nt, Streptococcus pyogenes MGAS8232
agcaugauuuaguuuuua

SEQ ID NO: 4124684 - RNA, 16 nt, Streptococcus pyogenes MGAS8232
agcauuugccauggca

SEQ ID NO: 4124685 - RNA, 13 nt, Streptococcus pyogenes MGAS8232
agcauuuucauca

SEQ ID NO: 4124686 - RNA, 17 nt, Streptococcus pyogenes MGAS8232
agcauuuugagaacgaa

SEQ ID NO: 4124687 - RNA, 23 nt, Streptococcus pyogenes MGAS8232
agccagauggugcuacugaugua

SEQ ID NO: 4124688 - RNA, 20 nt, Streptococcus pyogenes MGAS8232
agcccuuauguauuuuucaa

SEQ ID NO: 4124689 - RNA, 22 nt, Streptococcus pyogenes MGAS8232
agcccuuuuugccuuuaacaug

SEQ ID NO: 4124690 - RNA, 16 nt, Streptococcus pyogenes MGAS8232
agccuauuuaauaggc

SEQ ID NO: 4124691 - RNA, 15 nt, Streptococcus pyogenes MGAS8232
agccugucaagcccu

SEQ ID NO: 4124692 - RNA, 16 nt, Streptococcus pyogenes MGAS8232
agccugucaagcccug

SEQ ID NO: 4124693 - RNA, 13 nt, Streptococcus pyogenes MGAS8232
agccuuauccauu

SEQ ID NO: 4124694 - RNA, 14 nt, Streptococcus pyogenes MGAS8232
agcgaaagcuucau

SEQ ID NO: 4124695 - RNA, 13 nt, Streptococcus pyogenes MGAS8232
agcuaaaaacaau

SEQ ID NO: 4124696 - RNA, 22 nt, Streptococcus pyogenes MGAS8232
agcuaaagcuguaguuagaaau

SEQ ID NO: 4124697 - RNA, 16 nt, Streptococcus pyogenes MGAS8232
agcuagggcaacugca

SEQ ID NO: 4124698 - RNA, 14 nt, Streptococcus pyogenes MGAS8232
agcuauagaaacuu

SEQ ID NO: 4124699 - RNA, 22 nt, Streptococcus pyogenes MGAS8232
agcuauuaaugguaaaggccuu

SEQ ID NO: 4124700 - RNA, 23 nt, Streptococcus pyogenes MGAS8232
agcuauuaaugguaaaggccuua

SEQ ID NO: 4124701 - RNA, 15 nt, Streptococcus pyogenes MGAS8232
agcucaucccuacua

SEQ ID NO: 4124702 - RNA, 13 nt, Streptococcus pyogenes MGAS8232
agcucuaucaucu

SEQ ID NO: 4124703 - RNA, 14 nt, Streptococcus pyogenes MGAS8232
agcucuaucaucuu

SEQ ID NO: 4124704 - RNA, 15 nt, Streptococcus pyogenes MGAS8232
agcugagcaaaacaa

SEQ ID NO: 4124705 - RNA, 15 nt, Streptococcus pyogenes MGAS8232
agcugauaggucugc

SEQ ID NO: 4124706 - RNA, 20 nt, Streptococcus pyogenes MGAS8232
agcugguugaccaauauagc

SEQ ID NO: 4124707 - RNA, 22 nt, Streptococcus pyogenes MGAS8232
agcugguugaccaauauagcaa

SEQ ID NO: 4124708 - RNA, 18 nt, Streptococcus pyogenes MGAS8232
agcugucaauaacaacgu

SEQ ID NO: 4124709 - RNA, 14 nt, Streptococcus pyogenes MGAS8232
agcuuaucaagguu

SEQ ID NO: 4124710 - RNA, 13 nt, Streptococcus pyogenes MGAS8232
agcuucauuuacu

SEQ ID NO: 4124711 - RNA, 17 nt, Streptococcus pyogenes MGAS8232
agcuuuaguugcuucuu

SEQ ID NO: 4124712 - RNA, 16 nt, Streptococcus pyogenes MGAS8232
aggaaggcuuguucuu

SEQ ID NO: 4124713 - RNA, 11 nt, Streptococcus pyogenes MGAS8232
aggaauaaaau

SEQ ID NO: 4124714 - RNA, 13 nt, Streptococcus pyogenes MGAS8232
aggaauaaaaugc

SEQ ID NO: 4124715 - RNA, 20 nt, Streptococcus pyogenes MGAS8232
aggaauugcagcuaaaaaca

SEQ ID NO: 4124716 - RNA, 16 nt, Streptococcus pyogenes MGAS8232
aggauauugagaagaa

SEQ ID NO: 4124717 - RNA, 16 nt, Streptococcus pyogenes MGAS8232
aggaucauuauccuuu

SEQ ID NO: 4124718 - RNA, 13 nt, Streptococcus pyogenes MGAS8232
aggauuaugaaaa

SEQ ID NO: 4124719 - RNA, 15 nt, Streptococcus pyogenes MGAS8232
aggauuuagcuguua

SEQ ID NO: 4124720 - RNA, 17 nt, Streptococcus pyogenes MGAS8232
aggauuuagcuguuauu

SEQ ID NO: 4124721 - RNA, 14 nt, Streptococcus pyogenes MGAS8232
aggauuuaguuuug

SEQ ID NO: 4124722 - RNA, 18 nt, Streptococcus pyogenes MGAS8232
aggcaaaacaaaaagaga

SEQ ID NO: 4124723 - RNA, 22 nt, Streptococcus pyogenes MGAS8232
aggcaaauagcaaugguuaaaa

SEQ ID NO: 4124724 - RNA, 20 nt, Streptococcus pyogenes MGAS8232
aggcaaaugaaaaaacucaa

SEQ ID NO: 4124725 - RNA, 22 nt, Streptococcus pyogenes MGAS8232
aggcaacucuaaucuuuauaaa

SEQ ID NO: 4124726 - RNA, 17 nt, Streptococcus pyogenes MGAS8232
aggcaauccaaaucaac

SEQ ID NO: 4124727 - RNA, 17 nt, Streptococcus pyogenes MGAS8232
aggcagacaauuauuuu

SEQ ID NO: 4124728 - RNA, 19 nt, Streptococcus pyogenes MGAS8232
aggcagagccuuaaaaagu

SEQ ID NO: 4124729 - RNA, 13 nt, Streptococcus pyogenes MGAS8232
aggcucauauuag

SEQ ID NO: 4124730 - RNA, 17 nt, Streptococcus pyogenes MGAS8232
aggcuuacgacagcagc

SEQ ID NO: 4124731 - RNA, 20 nt, Streptococcus pyogenes MGAS8232
aggcuuggccagcgucugau

SEQ ID NO: 4124732 - RNA, 21 nt, Streptococcus pyogenes MGAS8232
aggcuuguucuuuauuuugau

SEQ ID NO: 4124733 - RNA, 20 nt, Streptococcus pyogenes MGAS8232
agggaaacaccaccaauaau

SEQ ID NO: 4124734 - RNA, 15 nt, Streptococcus pyogenes MGAS8232
agggcaaugccaucu

SEQ ID NO: 4124735 - RNA, 21 nt, Streptococcus pyogenes MGAS8232
aggggaauuuccuaaugcaac

SEQ ID NO: 4124736 - RNA, 21 nt, Streptococcus pyogenes MGAS8232
aggggagacggauuuaaccau

SEQ ID NO: 4124737 - RNA, 19 nt, Streptococcus pyogenes MGAS8232
aggguguuuuuuauauguc

SEQ ID NO: 4124738 - RNA, 16 nt, Streptococcus pyogenes MGAS8232
agguaaagauuuuaaa

SEQ ID NO: 4124739 - RNA, 19 nt, Streptococcus pyogenes MGAS8232
agguaauagcguaaagcaa

SEQ ID NO: 4124740 - RNA, 21 nt, Streptococcus pyogenes MGAS8232
agguagaugauuauauuagga

SEQ ID NO: 4124741 - RNA, 15 nt, Streptococcus pyogenes MGAS8232
agguauuguucaacc

SEQ ID NO: 4124742 - RNA, 18 nt, Streptococcus pyogenes MGAS8232
aggucaaccucuaggcca

SEQ ID NO: 4124743 - RNA, 15 nt, Streptococcus pyogenes MGAS8232
aggucaucagaauaa

SEQ ID NO: 4124744 - RNA, 22 nt, Streptococcus pyogenes MGAS8232
auacuucgguauucuuuuuccg

SEQ ID NO: 4124745 - RNA, 21 nt, Streptococcus pyogenes MGAS8232
auacuuuaaacacuaccuuaa

SEQ ID NO: 4124746 - RNA, 20 nt, Streptococcus pyogenes MGAS8232
auagaaacuuuuuauaagca

SEQ ID NO: 4124747 - RNA, 21 nt, Streptococcus pyogenes MGAS8232
auagaagacggaguauuuuuu

SEQ ID NO: 4124748 - RNA, 14 nt, Streptococcus pyogenes MGAS8232
auagaauaaaaaga

SEQ ID NO: 4124749 - RNA, 14 nt, Streptococcus pyogenes MGAS8232
auagaauaaccagc

SEQ ID NO: 4124750 - RNA, 23 nt, Streptococcus pyogenes MGAS8232
auagacaagcuuuuuuauaacug

SEQ ID NO: 4124751 - RNA, 22 nt, Streptococcus pyogenes MGAS8232
auagaccccuuaguucaaugga

SEQ ID NO: 4124752 - RNA, 20 nt, Streptococcus pyogenes MGAS8232
auagagccaagauuuuaagg

SEQ ID NO: 4124753 - RNA, 19 nt, Streptococcus pyogenes MGAS8232
auagauaguugguauauag

SEQ ID NO: 4124754 - RNA, 18 nt, Streptococcus pyogenes MGAS8232
auagcacguuggaaaagg

SEQ ID NO: 4124755 - RNA, 16 nt, Streptococcus pyogenes MGAS8232
auagcauaaaauaguu

SEQ ID NO: 4124756 - RNA, 23 nt, Streptococcus pyogenes MGAS8232
auagcauuaaggauuaugaaaaa

SEQ ID NO: 4124757 - RNA, 19 nt, Streptococcus pyogenes MGAS8232
auagcguaaagcaagggaa

SEQ ID NO: 4124758 - RNA, 20 nt, Streptococcus pyogenes MGAS8232
auagcguaaagcaagggaaa

SEQ ID NO: 4124759 - RNA, 15 nt, Streptococcus pyogenes MGAS8232
auagcugauuuguuu

SEQ ID NO: 4124760 - RNA, 17 nt, Streptococcus pyogenes MGAS8232
auagguaaagauuuuaa

SEQ ID NO: 4124761 - RNA, 13 nt, Streptococcus pyogenes MGAS8232
auaguauaccuau

SEQ ID NO: 4124762 - RNA, 19 nt, Streptococcus pyogenes MGAS8232
auaguuauguuauaagaua

SEQ ID NO: 4124763 - RNA, 21 nt, Streptococcus pyogenes MGAS8232
auaguuugacuucaaaaauac

SEQ ID NO: 4124764 - RNA, 22 nt, Streptococcus pyogenes MGAS8232
auauaagaaggucucaaauuuu

SEQ ID NO: 4124765 - RNA, 16 nt, Streptococcus pyogenes MGAS8232
auauaaggcaaucacc

SEQ ID NO: 4124766 - RNA, 13 nt, Streptococcus pyogenes MGAS8232
auauaauaaaaag

SEQ ID NO: 4124767 - RNA, 15 nt, Streptococcus pyogenes MGAS8232
auaucacauuuuaau

SEQ ID NO: 4124768 - RNA, 17 nt, Streptococcus pyogenes MGAS8232
auaucgacauuuaugcu

SEQ ID NO: 4124769 - RNA, 16 nt, Streptococcus pyogenes MGAS8232
auaucuagaacagcug

SEQ ID NO: 4124770 - RNA, 19 nt, Streptococcus pyogenes MGAS8232
auaucuagaacagcugcuu

SEQ ID NO: 4124771 - RNA, 16 nt, Streptococcus pyogenes MGAS8232
auaucuuaccauugua

SEQ ID NO: 4124772 - RNA, 14 nt, Streptococcus pyogenes MGAS8232
auaugaaagaacua

SEQ ID NO: 4124773 - RNA, 17 nt, Streptococcus pyogenes MGAS8232
auaugugauuauuauuc

SEQ ID NO: 4124774 - RNA, 14 nt, Streptococcus pyogenes MGAS8232
auauuagcaaaaug

SEQ ID NO: 4124775 - RNA, 17 nt, Streptococcus pyogenes MGAS8232
auauuagcaaaaugcug

SEQ ID NO: 4124776 - RNA, 23 nt, Streptococcus pyogenes MGAS8232
auauuauaguaaccauugccauu

SEQ ID NO: 4124777 - RNA, 18 nt, Streptococcus pyogenes MGAS8232
auauugagaagaaaaaau

SEQ ID NO: 4124778 - RNA, 16 nt, Streptococcus pyogenes MGAS8232
auauugaucucugcaa

SEQ ID NO: 4124779 - RNA, 14 nt, Streptococcus pyogenes MGAS8232
auauuguuaauaua

SEQ ID NO: 4124780 - RNA, 22 nt, Streptococcus pyogenes MGAS8232
auauuguuuuucuuugucaugu

SEQ ID NO: 4124781 - RNA, 15 nt, Streptococcus pyogenes MGAS8232
auauuugaccgaaaa

SEQ ID NO: 4124782 - RNA, 15 nt, Streptococcus pyogenes MGAS8232
auauuuuaaaauagu

SEQ ID NO: 4124783 - RNA, 17 nt, Streptococcus pyogenes MGAS8232
auauuuuauauuauguu

SEQ ID NO: 4124784 - RNA, 16 nt, Streptococcus pyogenes MGAS8232
auauuuuuucucaaaa

SEQ ID NO: 4124785 - RNA, 18 nt, Streptococcus pyogenes MGAS8232
auauuuuuucucaaaaau

SEQ ID NO: 4124786 - RNA, 20 nt, Streptococcus pyogenes MGAS8232
auauuuuuucucaaaaauau

SEQ ID NO: 4124787 - RNA, 18 nt, Streptococcus pyogenes MGAS8232
aucaacauggcuaaugau

SEQ ID NO: 4124788 - RNA, 17 nt, Streptococcus pyogenes MGAS8232
aucaagaauagcuuuug

SEQ ID NO: 4124789 - RNA, 14 nt, Streptococcus pyogenes MGAS8232
aucaaggaauugca

SEQ ID NO: 4124790 - RNA, 12 nt, Streptococcus pyogenes MGAS8232
aucaauguuuug

SEQ ID NO: 4124791 - RNA, 16 nt, Streptococcus pyogenes MGAS8232
aucacauuuuaaucuu

SEQ ID NO: 4124792 - RNA, 19 nt, Streptococcus pyogenes MGAS8232
aucaccguaacuugcuuug

SEQ ID NO: 4124793 - RNA, 16 nt, Streptococcus pyogenes MGAS8232
aucaggcaaaacaaaa

SEQ ID NO: 4124794 - RNA, 17 nt, Streptococcus pyogenes MGAS8232
aucauggagucaaugaa

SEQ ID NO: 4124795 - RNA, 13 nt, Streptococcus pyogenes MGAS8232
aucauuauccuuu

SEQ ID NO: 4124796 - RNA, 17 nt, Streptococcus pyogenes MGAS8232
auccaacuuuuaucacu

SEQ ID NO: 4124797 - RNA, 21 nt, Streptococcus pyogenes MGAS8232
aucccuucauuuuacuauggc

SEQ ID NO: 4124798 - RNA, 11 nt, Streptococcus pyogenes MGAS8232
auccuacugac

SEQ ID NO: 4124799 - RNA, 14 nt, Streptococcus pyogenes MGAS8232
auccucccagccau

SEQ ID NO: 4124800 - RNA, 17 nt, Streptococcus pyogenes MGAS8232
auccucucacaaauaca

SEQ ID NO: 4124801 - RNA, 19 nt, Streptococcus pyogenes MGAS8232
auccucucacaaauacaga

SEQ ID NO: 4124802 - RNA, 23 nt, Streptococcus pyogenes MGAS8232
auccucucacaaauacagaagaa

SEQ ID NO: 4124803 - RNA, 22 nt, Streptococcus pyogenes MGAS8232
auccuuuacuguaauauuuccu

SEQ ID NO: 4124804 - RNA, 20 nt, Streptococcus pyogenes MGAS8232
auccuuuaucuuauuuuaag

SEQ ID NO: 4124805 - RNA, 13 nt, Streptococcus pyogenes MGAS8232
auccuuuugcuuc

SEQ ID NO: 4124806 - RNA, 13 nt, Streptococcus pyogenes MGAS8232
aucgaaaaugcuu

SEQ ID NO: 4124807 - RNA, 22 nt, Streptococcus pyogenes MGAS8232
aucgaaaugauagcaccuaauu

SEQ ID NO: 4124808 - RNA, 19 nt, Streptococcus pyogenes MGAS8232
aucgacaacauccauacca

SEQ ID NO: 4124809 - RNA, 14 nt, Streptococcus pyogenes MGAS8232
aucgacauuuaugc

SEQ ID NO: 4124810 - RNA, 22 nt, Streptococcus pyogenes MGAS8232
aucgacauuuaugcugauuuug

SEQ ID NO: 4124811 - RNA, 15 nt, Streptococcus pyogenes MGAS8232
aucgcaaacagaugc

SEQ ID NO: 4124812 - RNA, 14 nt, Streptococcus pyogenes MGAS8232
aucgucaugacaac

SEQ ID NO: 4124813 - RNA, 15 nt, Streptococcus pyogenes MGAS8232
aucuaaucagagcuc

SEQ ID NO: 4124814 - RNA, 16 nt, Streptococcus pyogenes MGAS8232
aucuagaacagcugcu

SEQ ID NO: 4124815 - RNA, 21 nt, Streptococcus pyogenes MGAS8232
aucucaguuuuuuugauuuuc

SEQ ID NO: 4124816 - RNA, 16 nt, Streptococcus pyogenes MGAS8232
aucucccaucaacaag

SEQ ID NO: 4124817 - RNA, 24 nt, Streptococcus pyogenes MGAS8232
aucugcuuggauuuccucuaacau

SEQ ID NO: 4124818 - RNA, 17 nt, Streptococcus pyogenes MGAS8232
aucuguuuaaaaacaaa

SEQ ID NO: 4124819 - RNA, 15 nt, Streptococcus pyogenes MGAS8232
aucuucaacaccuuc

SEQ ID NO: 4124820 - RNA, 16 nt, Streptococcus pyogenes MGAS8232
aucuuguugggcacuu

SEQ ID NO: 4124821 - RNA, 18 nt, Streptococcus pyogenes MGAS8232
aucuuuuccgagaugacg

SEQ ID NO: 4124822 - RNA, 14 nt, Streptococcus pyogenes MGAS8232
augaaaaaagaaca

SEQ ID NO: 4124823 - RNA, 18 nt, Streptococcus pyogenes MGAS8232
augaaaaaagaacaaaga

SEQ ID NO: 4124824 - RNA, 15 nt, Streptococcus pyogenes MGAS8232
augaaaaucuguauu

SEQ ID NO: 4124825 - RNA, 21 nt, Streptococcus pyogenes MGAS8232
augaaaugauuguuauuuguu

SEQ ID NO: 4124826 - RNA, 12 nt, Streptococcus pyogenes MGAS8232
augaaucauuuu

SEQ ID NO: 4124827 - RNA, 22 nt, Streptococcus pyogenes MGAS8232
augaaucauuuuggagagauuu

SEQ ID NO: 4124828 - RNA, 21 nt, Streptococcus pyogenes MGAS8232
augaauuuugucuaaaauaaa

SEQ ID NO: 4124829 - RNA, 21 nt, Streptococcus pyogenes MGAS8232
augacacauuucgguuauugu

SEQ ID NO: 4124830 - RNA, 20 nt, Streptococcus pyogenes MGAS8232
augacacuuaaaugcaaaaa

SEQ ID NO: 4124831 - RNA, 22 nt, Streptococcus pyogenes MGAS8232
augacgccuccaaauacuggua

SEQ ID NO: 4124832 - RNA, 15 nt, Streptococcus pyogenes MGAS8232
augacgguaaauaaa

SEQ ID NO: 4124833 - RNA, 18 nt, Streptococcus pyogenes MGAS8232
augacugacaaaacuuca

SEQ ID NO: 4124834 - RNA, 15 nt, Streptococcus pyogenes MGAS8232
augagaaaaauaagu

SEQ ID NO: 4124835 - RNA, 18 nt, Streptococcus pyogenes MGAS8232
augagaguaaacgaaaau

SEQ ID NO: 4124836 - RNA, 14 nt, Streptococcus pyogenes MGAS8232
augaggcaaaugaa

SEQ ID NO: 4124837 - RNA, 13 nt, Streptococcus pyogenes MGAS8232
augagguauuuau

SEQ ID NO: 4124838 - RNA, 16 nt, Streptococcus pyogenes MGAS8232
augaguuuauguaugc

SEQ ID NO: 4124839 - RNA, 13 nt, Streptococcus pyogenes MGAS8232
augauauaaaaau

SEQ ID NO: 4124840 - RNA, 14 nt, Streptococcus pyogenes MGAS8232
augaugucucgaau

SEQ ID NO: 4124841 - RNA, 21 nt, Streptococcus pyogenes MGAS8232
auuucaauaauaccauuuuua

SEQ ID NO: 4124842 - RNA, 18 nt, Streptococcus pyogenes MGAS8232
auuucacuagacauucgu

SEQ ID NO: 4124843 - RNA, 18 nt, Streptococcus pyogenes MGAS8232
auuucagauaagaccuuc

SEQ ID NO: 4124844 - RNA, 15 nt, Streptococcus pyogenes MGAS8232
auuuccaagcuguca

SEQ ID NO: 4124845 - RNA, 16 nt, Streptococcus pyogenes MGAS8232
auuuccuacaaaauaa

SEQ ID NO: 4124846 - RNA, 20 nt, Streptococcus pyogenes MGAS8232
auuuccucuaacauguccaa

SEQ ID NO: 4124847 - RNA, 15 nt, Streptococcus pyogenes MGAS8232
auuucguugacaaag

SEQ ID NO: 4124848 - RNA, 14 nt, Streptococcus pyogenes MGAS8232
auuucguuuuacgg

SEQ ID NO: 4124849 - RNA, 19 nt, Streptococcus pyogenes MGAS8232
auuucuugaggugauucuu

SEQ ID NO: 4124850 - RNA, 20 nt, Streptococcus pyogenes MGAS8232
auuucuugaggugauucuuu

SEQ ID NO: 4124851 - RNA, 14 nt, Streptococcus pyogenes MGAS8232
auuucuuugcaaaa

SEQ ID NO: 4124852 - RNA, 15 nt, Streptococcus pyogenes MGAS8232
auuucuuugcaaaag

SEQ ID NO: 4124853 - RNA, 20 nt, Streptococcus pyogenes MGAS8232
auuucuuuuucauuuguaac

SEQ ID NO: 4124854 - RNA, 14 nt, Streptococcus pyogenes MGAS8232
auuugacauuaguc

SEQ ID NO: 4124855 - RNA, 19 nt, Streptococcus pyogenes MGAS8232
auuugacuuguuacaaaaa

SEQ ID NO: 4124856 - RNA, 22 nt, Streptococcus pyogenes MGAS8232
auuugcugaaaccguuugguuu

SEQ ID NO: 4124857 - RNA, 13 nt, Streptococcus pyogenes MGAS8232
auuuggaggugaa

SEQ ID NO: 4124858 - RNA, 14 nt, Streptococcus pyogenes MGAS8232
auuuguuuucuuua

SEQ ID NO: 4124859 - RNA, 21 nt, Streptococcus pyogenes MGAS8232
auuuuaaaauccucuuuuaau

SEQ ID NO: 4124860 - RNA, 13 nt, Streptococcus pyogenes MGAS8232
auuuuaagacaac

SEQ ID NO: 4124861 - RNA, 14 nt, Streptococcus pyogenes MGAS8232
auuuuaauuuuucc

SEQ ID NO: 4124862 - RNA, 22 nt, Streptococcus pyogenes MGAS8232
auuuuacuauggcuucuaaaaa

SEQ ID NO: 4124863 - RNA, 19 nt, Streptococcus pyogenes MGAS8232
auuuuaugagaaaaauaag

SEQ ID NO: 4124864 - RNA, 22 nt, Streptococcus pyogenes MGAS8232
auuuucuagguuaaaauagaag

SEQ ID NO: 4124865 - RNA, 18 nt, Streptococcus pyogenes MGAS8232
auuuugcagguaauuauc

SEQ ID NO: 4124866 - RNA, 19 nt, Streptococcus pyogenes MGAS8232
auuuugcagguaauuaucu

SEQ ID NO: 4124867 - RNA, 17 nt, Streptococcus pyogenes MGAS8232
auuuuggagagauuuuu

SEQ ID NO: 4124868 - RNA, 18 nt, Streptococcus pyogenes MGAS8232
auuuugucuaaaauaaag

SEQ ID NO: 4124869 - RNA, 22 nt, Streptococcus pyogenes MGAS8232
auuuugucuaaaauaaagauga

SEQ ID NO: 4124870 - RNA, 20 nt, Streptococcus pyogenes MGAS8232
auuuuucgaccaauucuaaa

SEQ ID NO: 4124871 - RNA, 21 nt, Streptococcus pyogenes MGAS8232
auuuuugauuuuaauuuuucu

SEQ ID NO: 4124872 - RNA, 20 nt, Streptococcus pyogenes MGAS8232
auuuuuuaccguaacguuug

SEQ ID NO: 4124873 - RNA, 22 nt, Streptococcus pyogenes MGAS8232
caaaaaacaagucuaucugcag

SEQ ID NO: 4124874 - RNA, 13 nt, Streptococcus pyogenes MGAS8232
caaaaaagggaag

SEQ ID NO: 4124875 - RNA, 20 nt, Streptococcus pyogenes MGAS8232
caaaaaauuaagaaggaacu

SEQ ID NO: 4124876 - RNA, 19 nt, Streptococcus pyogenes MGAS8232
caaaaacugugaacaaaac

SEQ ID NO: 4124877 - RNA, 20 nt, Streptococcus pyogenes MGAS8232
caaaaacugugaacaaaaca

SEQ ID NO: 4124878 - RNA, 22 nt, Streptococcus pyogenes MGAS8232
caaaaacugugaacaaaacaaa

SEQ ID NO: 4124879 - RNA, 12 nt, Streptococcus pyogenes MGAS8232
caaaaagacuuc

SEQ ID NO: 4124880 - RNA, 18 nt, Streptococcus pyogenes MGAS8232
caaaaagccuauuuaaua

SEQ ID NO: 4124881 - RNA, 23 nt, Streptococcus pyogenes MGAS8232
caaaaagucgucaacgcuagcau

SEQ ID NO: 4124882 - RNA, 17 nt, Streptococcus pyogenes MGAS8232
caaaaauaaguauagca

SEQ ID NO: 4124883 - RNA, 23 nt, Streptococcus pyogenes MGAS8232
caaaaauauauucuaauuuguga

SEQ ID NO: 4124884 - RNA, 11 nt, Streptococcus pyogenes MGAS8232
caaaacaaaac

SEQ ID NO: 4124885 - RNA, 13 nt, Streptococcus pyogenes MGAS8232
caaaacaaaacaa

SEQ ID NO: 4124886 - RNA, 14 nt, Streptococcus pyogenes MGAS8232
caaaacaaaacaaa

SEQ ID NO: 4124887 - RNA, 16 nt, Streptococcus pyogenes MGAS8232
caaaacaaaacaaaac

SEQ ID NO: 4124888 - RNA, 18 nt, Streptococcus pyogenes MGAS8232
caaaauuauuauuuugcu

SEQ ID NO: 4124889 - RNA, 20 nt, Streptococcus pyogenes MGAS8232
caaaccauuuuaugagaaaa

SEQ ID NO: 4124890 - RNA, 15 nt, Streptococcus pyogenes MGAS8232
caaacggaguuccuc

SEQ ID NO: 4124891 - RNA, 16 nt, Streptococcus pyogenes MGAS8232
caaacuaaacaaacgg

SEQ ID NO: 4124892 - RNA, 15 nt, Streptococcus pyogenes MGAS8232
caaacuauauuguua

SEQ ID NO: 4124893 - RNA, 15 nt, Streptococcus pyogenes MGAS8232
caaacucaaacuaaa

SEQ ID NO: 4124894 - RNA, 18 nt, Streptococcus pyogenes MGAS8232
caaauacagaagaaagcu

SEQ ID NO: 4124895 - RNA, 18 nt, Streptococcus pyogenes MGAS8232
caaauaguagcaaauaac

SEQ ID NO: 4124896 - RNA, 21 nt, Streptococcus pyogenes MGAS8232
caaauccgcuugcagcauaau

SEQ ID NO: 4124897 - RNA, 14 nt, Streptococcus pyogenes MGAS8232
caaauucuuuuuga

SEQ ID NO: 4124898 - RNA, 22 nt, Streptococcus pyogenes MGAS8232
caaauuuauccugaucccuuca

SEQ ID NO: 4124899 - RNA, 21 nt, Streptococcus pyogenes MGAS8232
caacaauacuaugaucuccaa

SEQ ID NO: 4124900 - RNA, 14 nt, Streptococcus pyogenes MGAS8232
caacauacuuuauu

SEQ ID NO: 4124901 - RNA, 12 nt, Streptococcus pyogenes MGAS8232
caacauagcuaa

SEQ ID NO: 4124902 - RNA, 11 nt, Streptococcus pyogenes MGAS8232
caacaucaagg

SEQ ID NO: 4124903 - RNA, 14 nt, Streptococcus pyogenes MGAS8232
caaccgcuucuuuu

SEQ ID NO: 4124904 - RNA, 15 nt, Streptococcus pyogenes MGAS8232
caaccgcuucuuuug

SEQ ID NO: 4124905 - RNA, 13 nt, Streptococcus pyogenes MGAS8232
caaccugaaaagu

SEQ ID NO: 4124906 - RNA, 23 nt, Streptococcus pyogenes MGAS8232
caacuaucaaguaugcuuuuaau

SEQ ID NO: 4124907 - RNA, 22 nt, Streptococcus pyogenes MGAS8232
caacugcaauaccguagaaagu

SEQ ID NO: 4124908 - RNA, 20 nt, Streptococcus pyogenes MGAS8232
caacuguggguuaagagagg

SEQ ID NO: 4124909 - RNA, 17 nt, Streptococcus pyogenes MGAS8232
caacuuaccagcaccuu

SEQ ID NO: 4124910 - RNA, 19 nt, Streptococcus pyogenes MGAS8232
caacuucuauauguguaau

SEQ ID NO: 4124911 - RNA, 19 nt, Streptococcus pyogenes MGAS8232
caacuugggagaguuccug

SEQ ID NO: 4124912 - RNA, 17 nt, Streptococcus pyogenes MGAS8232
caagaaguuuuauagcu

SEQ ID NO: 4124913 - RNA, 20 nt, Streptococcus pyogenes MGAS8232
caagaauagcuuuuguaaua

SEQ ID NO: 4124914 - RNA, 13 nt, Streptococcus pyogenes MGAS8232
caagagcuuaaaa

SEQ ID NO: 4124915 - RNA, 19 nt, Streptococcus pyogenes MGAS8232
caagagcuuaaaaguuagc

SEQ ID NO: 4124916 - RNA, 14 nt, Streptococcus pyogenes MGAS8232
caagaggaguugaa

SEQ ID NO: 4124917 - RNA, 21 nt, Streptococcus pyogenes MGAS8232
caagagguucgucaagcaccu

SEQ ID NO: 4124918 - RNA, 23 nt, Streptococcus pyogenes MGAS8232
caagcauuuugcaagucucuugc

SEQ ID NO: 4124919 - RNA, 13 nt, Streptococcus pyogenes MGAS8232
caagcguccauau

SEQ ID NO: 4124920 - RNA, 21 nt, Streptococcus pyogenes MGAS8232
caagcguccauauaguaagua

SEQ ID NO: 4124921 - RNA, 19 nt, Streptococcus pyogenes MGAS8232
caagguuaaguaaaagcga

SEQ ID NO: 4124922 - RNA, 15 nt, Streptococcus pyogenes MGAS8232
caagucuuagaaaua

SEQ ID NO: 4124923 - RNA, 22 nt, Streptococcus pyogenes MGAS8232
caagugacccguuuuccugcuc

SEQ ID NO: 4124924 - RNA, 17 nt, Streptococcus pyogenes MGAS8232
caagugauacuugguau

SEQ ID NO: 4124925 - RNA, 19 nt, Streptococcus pyogenes MGAS8232
caagugauacuugguauug

SEQ ID NO: 4124926 - RNA, 23 nt, Streptococcus pyogenes MGAS8232
caagugccaguaaggaaaucaau

SEQ ID NO: 4124927 - RNA, 22 nt, Streptococcus pyogenes MGAS8232
caaguguuuugucuuauagaau

SEQ ID NO: 4124928 - RNA, 18 nt, Streptococcus pyogenes MGAS8232
caauaaaauaucuagaac

SEQ ID NO: 4124929 - RNA, 15 nt, Streptococcus pyogenes MGAS8232
caauaacacagaagc

SEQ ID NO: 4124930 - RNA, 17 nt, Streptococcus pyogenes MGAS8232
caauaauaccauuuuua

SEQ ID NO: 4124931 - RNA, 22 nt, Streptococcus pyogenes MGAS8232
caauacgauagugugugugaug

SEQ ID NO: 4124932 - RNA, 16 nt, Streptococcus pyogenes MGAS8232
caauacucccuucucu

SEQ ID NO: 4124933 - RNA, 19 nt, Streptococcus pyogenes MGAS8232
caauacucccuucucuagu

SEQ ID NO: 4124934 - RNA, 15 nt, Streptococcus pyogenes MGAS8232
caauagcagcaacaa

SEQ ID NO: 4124935 - RNA, 19 nt, Streptococcus pyogenes MGAS8232
caauagcgaaaaagggucc

SEQ ID NO: 4124936 - RNA, 15 nt, Streptococcus pyogenes MGAS8232
caauagcugcugcua

SEQ ID NO: 4124937 - RNA, 20 nt, Streptococcus pyogenes MGAS8232
caauagcugcugcuaaagca

SEQ ID NO: 4124938 - RNA, 20 nt, Streptococcus pyogenes MGAS8232
cauggguguuuaaucuuugu

SEQ ID NO: 4124939 - RNA, 22 nt, Streptococcus pyogenes MGAS8232
cauguaaacaauugguuuacau

SEQ ID NO: 4124940 - RNA, 19 nt, Streptococcus pyogenes MGAS8232
cauguaaugaccacccuca

SEQ ID NO: 4124941 - RNA, 22 nt, Streptococcus pyogenes MGAS8232
cauguccaaggggugucugaca

SEQ ID NO: 4124942 - RNA, 21 nt, Streptococcus pyogenes MGAS8232
cauguccauugaugaguuuau

SEQ ID NO: 4124943 - RNA, 13 nt, Streptococcus pyogenes MGAS8232
cauguuuaaaaaa

SEQ ID NO: 4124944 - RNA, 16 nt, Streptococcus pyogenes MGAS8232
cauuaaaaaaaccagc

SEQ ID NO: 4124945 - RNA, 18 nt, Streptococcus pyogenes MGAS8232
cauuaaggauuaugaaaa

SEQ ID NO: 4124946 - RNA, 19 nt, Streptococcus pyogenes MGAS8232
cauuaaggauuaugaaaaa

SEQ ID NO: 4124947 - RNA, 23 nt, Streptococcus pyogenes MGAS8232
cauuaaggauuaugaaaaagaag

SEQ ID NO: 4124948 - RNA, 15 nt, Streptococcus pyogenes MGAS8232
cauuaauaauauuaa

SEQ ID NO: 4124949 - RNA, 14 nt, Streptococcus pyogenes MGAS8232
cauuacuccuuuga

SEQ ID NO: 4124950 - RNA, 14 nt, Streptococcus pyogenes MGAS8232
cauuauugacaaau

SEQ ID NO: 4124951 - RNA, 15 nt, Streptococcus pyogenes MGAS8232
cauugccauuaauaa

SEQ ID NO: 4124952 - RNA, 17 nt, Streptococcus pyogenes MGAS8232
cauugucaaagcugaca

SEQ ID NO: 4124953 - RNA, 15 nt, Streptococcus pyogenes MGAS8232
cauugucaaauaaaa

SEQ ID NO: 4124954 - RNA, 17 nt, Streptococcus pyogenes MGAS8232
cauugucaaauaaaauc

SEQ ID NO: 4124955 - RNA, 15 nt, Streptococcus pyogenes MGAS8232
cauuuccuacaaaau

SEQ ID NO: 4124956 - RNA, 19 nt, Streptococcus pyogenes MGAS8232
cauuucuucagguuucuuu

SEQ ID NO: 4124957 - RNA, 22 nt, Streptococcus pyogenes MGAS8232
cauuucuugaggugauucuuuu

SEQ ID NO: 4124958 - RNA, 23 nt, Streptococcus pyogenes MGAS8232
cauuucuugaggugauucuuuuu

SEQ ID NO: 4124959 - RNA, 15 nt, Streptococcus pyogenes MGAS8232
cauuucuuugcaaaa

SEQ ID NO: 4124960 - RNA, 18 nt, Streptococcus pyogenes MGAS8232
cauuugcacauaauguua

SEQ ID NO: 4124961 - RNA, 16 nt, Streptococcus pyogenes MGAS8232
cauuuuaugagaaaaa

SEQ ID NO: 4124962 - RNA, 17 nt, Streptococcus pyogenes MGAS8232
cauuuuaugagaaaaau

SEQ ID NO: 4124963 - RNA, 21 nt, Streptococcus pyogenes MGAS8232
cauuuuggagagauuuuuaaa

SEQ ID NO: 4124964 - RNA, 14 nt, Streptococcus pyogenes MGAS8232
cauuuuuugcaauu

SEQ ID NO: 4124965 - RNA, 20 nt, Streptococcus pyogenes MGAS8232
ccaaggucugcgcgacuaaa

SEQ ID NO: 4124966 - RNA, 22 nt, Streptococcus pyogenes MGAS8232
ccaaggucugcgcgacuaaaau

SEQ ID NO: 4124967 - RNA, 16 nt, Streptococcus pyogenes MGAS8232
ccaagugccaguaagg

SEQ ID NO: 4124968 - RNA, 20 nt, Streptococcus pyogenes MGAS8232
ccaagugccaguaaggaaau

SEQ ID NO: 4124969 - RNA, 16 nt, Streptococcus pyogenes MGAS8232
ccaauaaugagcaagg

SEQ ID NO: 4124970 - RNA, 21 nt, Streptococcus pyogenes MGAS8232
ccaauauagcaaucuucaaca

SEQ ID NO: 4124971 - RNA, 12 nt, Streptococcus pyogenes MGAS8232
ccaaucuuugug

SEQ ID NO: 4124972 - RNA, 22 nt, Streptococcus pyogenes MGAS8232
ccacaaaagacaacgacgcuua

SEQ ID NO: 4124973 - RNA, 17 nt, Streptococcus pyogenes MGAS8232
ccacaccaccagccacu

SEQ ID NO: 4124974 - RNA, 15 nt, Streptococcus pyogenes MGAS8232
ccacaccuaauaaaa

SEQ ID NO: 4124975 - RNA, 15 nt, Streptococcus pyogenes MGAS8232
ccacugcacgugcuc

SEQ ID NO: 4124976 - RNA, 12 nt, Streptococcus pyogenes MGAS8232
ccacuucaagca

SEQ ID NO: 4124977 - RNA, 16 nt, Streptococcus pyogenes MGAS8232
ccacuucaagcauaau

SEQ ID NO: 4124978 - RNA, 23 nt, Streptococcus pyogenes MGAS8232
ccagaugcuugcucaauuuuuga

SEQ ID NO: 4124979 - RNA, 15 nt, Streptococcus pyogenes MGAS8232
ccagcaccuucuuuu

SEQ ID NO: 4124980 - RNA, 15 nt, Streptococcus pyogenes MGAS8232
ccagcauuugccaug

SEQ ID NO: 4124981 - RNA, 22 nt, Streptococcus pyogenes MGAS8232
ccagcgucugauauugaucucu

SEQ ID NO: 4124982 - RNA, 20 nt, Streptococcus pyogenes MGAS8232
ccaguugagccuuuucuuuu

SEQ ID NO: 4124983 - RNA, 15 nt, Streptococcus pyogenes MGAS8232
ccauacgcuccaacg

SEQ ID NO: 4124984 - RNA, 11 nt, Streptococcus pyogenes MGAS8232
ccauauaugcg

SEQ ID NO: 4124985 - RNA, 22 nt, Streptococcus pyogenes MGAS8232
ccaucaacaaguguuuugucuu

SEQ ID NO: 4124986 - RNA, 19 nt, Streptococcus pyogenes MGAS8232
ccaucaggcuuaaacauau

SEQ ID NO: 4124987 - RNA, 13 nt, Streptococcus pyogenes MGAS8232
ccauuaaaaaaac

SEQ ID NO: 4124988 - RNA, 15 nt, Streptococcus pyogenes MGAS8232
ccauuauaaaucuua

SEQ ID NO: 4124989 - RNA, 16 nt, Streptococcus pyogenes MGAS8232
ccauuauaaaucuuac

SEQ ID NO: 4124990 - RNA, 16 nt, Streptococcus pyogenes MGAS8232
ccauuuccuacaaaau

SEQ ID NO: 4124991 - RNA, 14 nt, Streptococcus pyogenes MGAS8232
ccauuuuuuauaau

SEQ ID NO: 4124992 - RNA, 18 nt, Streptococcus pyogenes MGAS8232
ccccuauucaauauuuua

SEQ ID NO: 4124993 - RNA, 15 nt, Streptococcus pyogenes MGAS8232
cccugcuggcuuuuu

SEQ ID NO: 4124994 - RNA, 20 nt, Streptococcus pyogenes MGAS8232
ccgaaaaaggcaaagaaagc

SEQ ID NO: 4124995 - RNA, 20 nt, Streptococcus pyogenes MGAS8232
ccgcgaauaugauauaaaaa

SEQ ID NO: 4124996 - RNA, 17 nt, Streptococcus pyogenes MGAS8232
ccgcuaaaacaguucca

SEQ ID NO: 4124997 - RNA, 15 nt, Streptococcus pyogenes MGAS8232
ccggcucuaaaauau

SEQ ID NO: 4124998 - RNA, 15 nt, Streptococcus pyogenes MGAS8232
ccguaacuugcuuug

SEQ ID NO: 4124999 - RNA, 12 nt, Streptococcus pyogenes MGAS8232
ccgugaggacuu

SEQ ID NO: 4125000 - RNA, 18 nt, Streptococcus pyogenes MGAS8232
ccgugaggacuuauuuuu

SEQ ID NO: 4125001 - RNA, 19 nt, Streptococcus pyogenes MGAS8232
ccuaauaaaauagcaccua

SEQ ID NO: 4125002 - RNA, 18 nt, Streptococcus pyogenes MGAS8232
ccuaauuuaauuuacccc

SEQ ID NO: 4125003 - RNA, 16 nt, Streptococcus pyogenes MGAS8232
ccuacuagcacaaaau

SEQ ID NO: 4125004 - RNA, 20 nt, Streptococcus pyogenes MGAS8232
ccuacuagcacaaaaucauu

SEQ ID NO: 4125005 - RNA, 13 nt, Streptococcus pyogenes MGAS8232
ccuaggaauaaaa

SEQ ID NO: 4125006 - RNA, 21 nt, Streptococcus pyogenes MGAS8232
ccuauagaaaguuauaaagaa

SEQ ID NO: 4125007 - RNA, 17 nt, Streptococcus pyogenes MGAS8232
ccucauugucaaagcug

SEQ ID NO: 4125008 - RNA, 16 nt, Streptococcus pyogenes MGAS8232
ccucuuuagaauucuu

SEQ ID NO: 4125009 - RNA, 17 nt, Streptococcus pyogenes MGAS8232
ccugcucaauugcuuuu

SEQ ID NO: 4125010 - RNA, 14 nt, Streptococcus pyogenes MGAS8232
ccuguauuucuuug

SEQ ID NO: 4125011 - RNA, 23 nt, Streptococcus pyogenes MGAS8232
ccugucaacuuaccagcaccuuc

SEQ ID NO: 4125012 - RNA, 15 nt, Streptococcus pyogenes MGAS8232
ccugucaagcccugc

SEQ ID NO: 4125013 - RNA, 16 nt, Streptococcus pyogenes MGAS8232
ccugucaagcccugcu

SEQ ID NO: 4125014 - RNA, 13 nt, Streptococcus pyogenes MGAS8232
ccuguuuuugcug

SEQ ID NO: 4125015 - RNA, 13 nt, Streptococcus pyogenes MGAS8232
ccuuaaaaaguuu

SEQ ID NO: 4125016 - RNA, 15 nt, Streptococcus pyogenes MGAS8232
ccuuaaaggccuccu

SEQ ID NO: 4125017 - RNA, 17 nt, Streptococcus pyogenes MGAS8232
ccuucaaaaaagggaag

SEQ ID NO: 4125018 - RNA, 17 nt, Streptococcus pyogenes MGAS8232
ccuucauagacaagcuu

SEQ ID NO: 4125019 - RNA, 13 nt, Streptococcus pyogenes MGAS8232
ccuucuucaagcu

SEQ ID NO: 4125020 - RNA, 13 nt, Streptococcus pyogenes MGAS8232
ccuucuuggaaaa

SEQ ID NO: 4125021 - RNA, 23 nt, Streptococcus pyogenes MGAS8232
ccuuuagcaauccaacuuugaca

SEQ ID NO: 4125022 - RNA, 19 nt, Streptococcus pyogenes MGAS8232
ccuuuaucuuauuuuaaga

SEQ ID NO: 4125023 - RNA, 14 nt, Streptococcus pyogenes MGAS8232
ccuuuugcuucuag

SEQ ID NO: 4125024 - RNA, 17 nt, Streptococcus pyogenes MGAS8232
ccuuuuugccuuuaaca

SEQ ID NO: 4125025 - RNA, 20 nt, Streptococcus pyogenes MGAS8232
ccuuuuugccuuuaacauga

SEQ ID NO: 4125026 - RNA, 18 nt, Streptococcus pyogenes MGAS8232
ccuuuuuuauugaugauu

SEQ ID NO: 4125027 - RNA, 18 nt, Streptococcus pyogenes MGAS8232
ccuuuuuugauaccguuu

SEQ ID NO: 4125028 - RNA, 16 nt, Streptococcus pyogenes MGAS8232
cgaauaugauauaaaa

SEQ ID NO: 4125029 - RNA, 20 nt, Streptococcus pyogenes MGAS8232
cgaauugugucauuucuuga

SEQ ID NO: 4125030 - RNA, 19 nt, Streptococcus pyogenes MGAS8232
cgagaugacgguaaauaaa

SEQ ID NO: 4125031 - RNA, 18 nt, Streptococcus pyogenes MGAS8232
cgagauuccuucuuuuuc

SEQ ID NO: 4125032 - RNA, 19 nt, Streptococcus pyogenes MGAS8232
cgauaaaaacgaucaaaaa

SEQ ID NO: 4125033 - RNA, 14 nt, Streptococcus pyogenes MGAS8232
cgauaaaacaaaua

SEQ ID NO: 4125034 - RNA, 21 nt, Streptococcus pyogenes MGAS8232
cgauaauaaagugcgcuucca

SEQ ID NO: 4125035 - RNA, 18 nt, Streptococcus pyogenes MGAS8232
cgauaaucuuugacaaug

SEQ ID NO: 4125036 - RNA, 13 nt, Streptococcus pyogenes MGAS8232
cucuuuugugauu

SEQ ID NO: 4125037 - RNA, 13 nt, Streptococcus pyogenes MGAS8232
cucuuuuuuuuau

SEQ ID NO: 4125038 - RNA, 20 nt, Streptococcus pyogenes MGAS8232
cucuuuuuuuuauuauucua

SEQ ID NO: 4125039 - RNA, 12 nt, Streptococcus pyogenes MGAS8232
cugaaaauaaaa

SEQ ID NO: 4125040 - RNA, 20 nt, Streptococcus pyogenes MGAS8232
cugaaaauaaaauauuuuuc

SEQ ID NO: 4125041 - RNA, 23 nt, Streptococcus pyogenes MGAS8232
cugacaaaacuucaaauuucaug

SEQ ID NO: 4125042 - RNA, 22 nt, Streptococcus pyogenes MGAS8232
cugacgauaagucaguuuuuuc

SEQ ID NO: 4125043 - RNA, 16 nt, Streptococcus pyogenes MGAS8232
cugagauauucauuuu

SEQ ID NO: 4125044 - RNA, 17 nt, Streptococcus pyogenes MGAS8232
cugagauauucauuuuc

SEQ ID NO: 4125045 - RNA, 17 nt, Streptococcus pyogenes MGAS8232
cugagcaaucauguugu

SEQ ID NO: 4125046 - RNA, 22 nt, Streptococcus pyogenes MGAS8232
cugagcgguuuugucuuaucuc

SEQ ID NO: 4125047 - RNA, 15 nt, Streptococcus pyogenes MGAS8232
cugaguucuuuuucg

SEQ ID NO: 4125048 - RNA, 19 nt, Streptococcus pyogenes MGAS8232
cugauaagguuuuuuuaag

SEQ ID NO: 4125049 - RNA, 15 nt, Streptococcus pyogenes MGAS8232
cugaugacuuguaaa

SEQ ID NO: 4125050 - RNA, 23 nt, Streptococcus pyogenes MGAS8232
cugaugcgauucccaucuuuauc

SEQ ID NO: 4125051 - RNA, 14 nt, Streptococcus pyogenes MGAS8232
cugauuuuggauga

SEQ ID NO: 4125052 - RNA, 15 nt, Streptococcus pyogenes MGAS8232
cugccagccauacca

SEQ ID NO: 4125053 - RNA, 13 nt, Streptococcus pyogenes MGAS8232
cugccauauuuuu

SEQ ID NO: 4125054 - RNA, 12 nt, Streptococcus pyogenes MGAS8232
cugccuuuuuaa

SEQ ID NO: 4125055 - RNA, 14 nt, Streptococcus pyogenes MGAS8232
cugcugcuaaagca

SEQ ID NO: 4125056 - RNA, 18 nt, Streptococcus pyogenes MGAS8232
cuggaccauuaucaauaa

SEQ ID NO: 4125057 - RNA, 16 nt, Streptococcus pyogenes MGAS8232
cuggcaauaagugacg

SEQ ID NO: 4125058 - RNA, 15 nt, Streptococcus pyogenes MGAS8232
cuggcagcuucauuu

SEQ ID NO: 4125059 - RNA, 14 nt, Streptococcus pyogenes MGAS8232
cuggccagcuacaa

SEQ ID NO: 4125060 - RNA, 19 nt, Streptococcus pyogenes MGAS8232
cuggcuuuuuugcuuuuua

SEQ ID NO: 4125061 - RNA, 21 nt, Streptococcus pyogenes MGAS8232
cuggguaucaguccuccucuu

SEQ ID NO: 4125062 - RNA, 19 nt, Streptococcus pyogenes MGAS8232
cugguuuuaauauugggac

SEQ ID NO: 4125063 - RNA, 14 nt, Streptococcus pyogenes MGAS8232
cugguuuuuuuaau

SEQ ID NO: 4125064 - RNA, 19 nt, Streptococcus pyogenes MGAS8232
cuguaaaucaguagugaug

SEQ ID NO: 4125065 - RNA, 23 nt, Streptococcus pyogenes MGAS8232
cuguagcguuuguguugaagaag

SEQ ID NO: 4125066 - RNA, 14 nt, Streptococcus pyogenes MGAS8232
cuguauacaaaaag

SEQ ID NO: 4125067 - RNA, 18 nt, Streptococcus pyogenes MGAS8232
cuguauuccauacuucca

SEQ ID NO: 4125068 - RNA, 19 nt, Streptococcus pyogenes MGAS8232
cugucaaaaaauuaagaag

SEQ ID NO: 4125069 - RNA, 23 nt, Streptococcus pyogenes MGAS8232
cugucaacuuaccagcaccuucu

SEQ ID NO: 4125070 - RNA, 21 nt, Streptococcus pyogenes MGAS8232
cuguccaauaccuagguaguu

SEQ ID NO: 4125071 - RNA, 23 nt, Streptococcus pyogenes MGAS8232
cugucuacuuauuugacauuagu

SEQ ID NO: 4125072 - RNA, 22 nt, Streptococcus pyogenes MGAS8232
cugucuggaaacuggucaaaag

SEQ ID NO: 4125073 - RNA, 15 nt, Streptococcus pyogenes MGAS8232
cugugaacaaaacaa

SEQ ID NO: 4125074 - RNA, 13 nt, Streptococcus pyogenes MGAS8232
cugugaugaauca

SEQ ID NO: 4125075 - RNA, 19 nt, Streptococcus pyogenes MGAS8232
cuguggcuuucucaucuac

SEQ ID NO: 4125076 - RNA, 14 nt, Streptococcus pyogenes MGAS8232
cuguggguuaagag

SEQ ID NO: 4125077 - RNA, 22 nt, Streptococcus pyogenes MGAS8232
cuguucucuuuggagaaauuca

SEQ ID NO: 4125078 - RNA, 16 nt, Streptococcus pyogenes MGAS8232
cuguuugccguguucu

SEQ ID NO: 4125079 - RNA, 10 nt, Streptococcus pyogenes MGAS8232
cuuaaaaagu

SEQ ID NO: 4125080 - RNA, 19 nt, Streptococcus pyogenes MGAS8232
cuuaaacaugccuuucaca

SEQ ID NO: 4125081 - RNA, 22 nt, Streptococcus pyogenes MGAS8232
cuuaaacaugccuuucacagcc

SEQ ID NO: 4125082 - RNA, 15 nt, Streptococcus pyogenes MGAS8232
cuuaacggcaucuac

SEQ ID NO: 4125083 - RNA, 11 nt, Streptococcus pyogenes MGAS8232
cuuacaaaaag

SEQ ID NO: 4125084 - RNA, 13 nt, Streptococcus pyogenes MGAS8232
cuuacaaaaagcc

SEQ ID NO: 4125085 - RNA, 18 nt, Streptococcus pyogenes MGAS8232
cuuacagcugguuuuuuu

SEQ ID NO: 4125086 - RNA, 15 nt, Streptococcus pyogenes MGAS8232
cuuacuaacuagcaa

SEQ ID NO: 4125087 - RNA, 17 nt, Streptococcus pyogenes MGAS8232
cuuacuagugaagacau

SEQ ID NO: 4125088 - RNA, 14 nt, Streptococcus pyogenes MGAS8232
cuuacuaugaaaaa

SEQ ID NO: 4125089 - RNA, 22 nt, Streptococcus pyogenes MGAS8232
cuuagcgauagggguaauuugg

SEQ ID NO: 4125090 - RNA, 19 nt, Streptococcus pyogenes MGAS8232
cuuaggcagacaauuauuu

SEQ ID NO: 4125091 - RNA, 21 nt, Streptococcus pyogenes MGAS8232
cuuaggcagacaauuauuuug

SEQ ID NO: 4125092 - RNA, 15 nt, Streptococcus pyogenes MGAS8232
cuuagugguuugcaa

SEQ ID NO: 4125093 - RNA, 17 nt, Streptococcus pyogenes MGAS8232
cuuaguguagauaaacu

SEQ ID NO: 4125094 - RNA, 14 nt, Streptococcus pyogenes MGAS8232
cuuauaugaaagaa

SEQ ID NO: 4125095 - RNA, 17 nt, Streptococcus pyogenes MGAS8232
cuuauaugaaagaacua

SEQ ID NO: 4125096 - RNA, 21 nt, Streptococcus pyogenes MGAS8232
cuuaucucggagcuuuaccuc

SEQ ID NO: 4125097 - RNA, 18 nt, Streptococcus pyogenes MGAS8232
cuuauuugacauuagucc

SEQ ID NO: 4125098 - RNA, 15 nt, Streptococcus pyogenes MGAS8232
cuuauuuuaagaagc

SEQ ID NO: 4125099 - RNA, 11 nt, Streptococcus pyogenes MGAS8232
cuuauuuuuuu

SEQ ID NO: 4125100 - RNA, 12 nt, Streptococcus pyogenes MGAS8232
cuucaaaaauac

SEQ ID NO: 4125101 - RNA, 21 nt, Streptococcus pyogenes MGAS8232
cuucaaaaauacuaccuuuag

SEQ ID NO: 4125102 - RNA, 18 nt, Streptococcus pyogenes MGAS8232
cuucaagcucgguuuuaa

SEQ ID NO: 4125103 - RNA, 20 nt, Streptococcus pyogenes MGAS8232
cuucaaggaaggcuuguucu

SEQ ID NO: 4125104 - RNA, 18 nt, Streptococcus pyogenes MGAS8232
cuucaccuuaggcagaca

SEQ ID NO: 4125105 - RNA, 17 nt, Streptococcus pyogenes MGAS8232
cuucagguuucuuuugg

SEQ ID NO: 4125106 - RNA, 15 nt, Streptococcus pyogenes MGAS8232
cuucuacacaaaagc

SEQ ID NO: 4125107 - RNA, 19 nt, Streptococcus pyogenes MGAS8232
cuucugaugcguuuauaaa

SEQ ID NO: 4125108 - RNA, 15 nt, Streptococcus pyogenes MGAS8232
cuucuggcaauaagu

SEQ ID NO: 4125109 - RNA, 15 nt, Streptococcus pyogenes MGAS8232
cuucuuacuaugaaa

SEQ ID NO: 4125110 - RNA, 22 nt, Streptococcus pyogenes MGAS8232
cuucuuacuaugaaaaaagaac

SEQ ID NO: 4125111 - RNA, 19 nt, Streptococcus pyogenes MGAS8232
cuucuuggaaaacagaaag

SEQ ID NO: 4125112 - RNA, 19 nt, Streptococcus pyogenes MGAS8232
cuugaagccgcucuaauuu

SEQ ID NO: 4125113 - RNA, 22 nt, Streptococcus pyogenes MGAS8232
cuugaauaucgccaauaaaaaa

SEQ ID NO: 4125114 - RNA, 13 nt, Streptococcus pyogenes MGAS8232
cuugacuuucuac

SEQ ID NO: 4125115 - RNA, 15 nt, Streptococcus pyogenes MGAS8232
cuugacuuucuacua

SEQ ID NO: 4125116 - RNA, 17 nt, Streptococcus pyogenes MGAS8232
cuugaggugauucuuuu

SEQ ID NO: 4125117 - RNA, 19 nt, Streptococcus pyogenes MGAS8232
cuugcguagauagcaagga

SEQ ID NO: 4125118 - RNA, 13 nt, Streptococcus pyogenes MGAS8232
cuuggaaaacaga

SEQ ID NO: 4125119 - RNA, 16 nt, Streptococcus pyogenes MGAS8232
cuugggagaguuccug

SEQ ID NO: 4125120 - RNA, 19 nt, Streptococcus pyogenes MGAS8232
cuugguucugaaaauaaaa

SEQ ID NO: 4125121 - RNA, 14 nt, Streptococcus pyogenes MGAS8232
cuugucuaugagau

SEQ ID NO: 4125122 - RNA, 13 nt, Streptococcus pyogenes MGAS8232
cuuguuacaaaaa

SEQ ID NO: 4125123 - RNA, 21 nt, Streptococcus pyogenes MGAS8232
cuuguuauccucccagccauc

SEQ ID NO: 4125124 - RNA, 12 nt, Streptococcus pyogenes MGAS8232
cuuguucugguu

SEQ ID NO: 4125125 - RNA, 21 nt, Streptococcus pyogenes MGAS8232
cuuguuuugguugauauaaaa

SEQ ID NO: 4125126 - RNA, 22 nt, Streptococcus pyogenes MGAS8232
cuuguuuugguugauauaaaau

SEQ ID NO: 4125127 - RNA, 16 nt, Streptococcus pyogenes MGAS8232
cuuuaaaaaauauugu

SEQ ID NO: 4125128 - RNA, 11 nt, Streptococcus pyogenes MGAS8232
cuuuaaaaagu

SEQ ID NO: 4125129 - RNA, 12 nt, Streptococcus pyogenes MGAS8232
cuuuaaaaaguu

SEQ ID NO: 4125130 - RNA, 20 nt, Streptococcus pyogenes MGAS8232
cuuuaaaaaguuucugaguu

SEQ ID NO: 4125131 - RNA, 17 nt, Streptococcus pyogenes MGAS8232
cuuuaccuccuaauuua

SEQ ID NO: 4125132 - RNA, 17 nt, Streptococcus pyogenes MGAS8232
cuuuacuguaauauuuc

SEQ ID NO: 4125133 - RNA, 19 nt, Streptococcus pyogenes MGAS8232
cuuuagcaauuguuuuuuc

SEQ ID NO: 4125134 - RNA, 18 nt, Streptococcus pyogenes MGAS8232
gagcacguuuucugguuu

SEQ ID NO: 4125135 - RNA, 13 nt, Streptococcus pyogenes MGAS8232
gagcccauucuua

SEQ ID NO: 4125136 - RNA, 21 nt, Streptococcus pyogenes MGAS8232
gagccuuuucuuuuuggcuga

SEQ ID NO: 4125137 - RNA, 19 nt, Streptococcus pyogenes MGAS8232
gagcuuuuuuuguuuuggc

SEQ ID NO: 4125138 - RNA, 21 nt, Streptococcus pyogenes MGAS8232
gaggaguugaaccgcuaaaac

SEQ ID NO: 4125139 - RNA, 18 nt, Streptococcus pyogenes MGAS8232
gaggcuugcauuuuuugc

SEQ ID NO: 4125140 - RNA, 19 nt, Streptococcus pyogenes MGAS8232
gaggucuggccagcuacaa

SEQ ID NO: 4125141 - RNA, 23 nt, Streptococcus pyogenes MGAS8232
gaggucuggccagcuacaaggca

SEQ ID NO: 4125142 - RNA, 19 nt, Streptococcus pyogenes MGAS8232
gaguaaggaccaagauuca

SEQ ID NO: 4125143 - RNA, 13 nt, Streptococcus pyogenes MGAS8232
gagucuuuuucua

SEQ ID NO: 4125144 - RNA, 11 nt, Streptococcus pyogenes MGAS8232
gaguuuugcug

SEQ ID NO: 4125145 - RNA, 14 nt, Streptococcus pyogenes MGAS8232
gauaaaacaaauaa

SEQ ID NO: 4125146 - RNA, 19 nt, Streptococcus pyogenes MGAS8232
gauaaaggccuguauuucu

SEQ ID NO: 4125147 - RNA, 23 nt, Streptococcus pyogenes MGAS8232
gauaaaggccuguauuucuuugg

SEQ ID NO: 4125148 - RNA, 21 nt, Streptococcus pyogenes MGAS8232
gauaagaccuucaaaaaaggg

SEQ ID NO: 4125149 - RNA, 22 nt, Streptococcus pyogenes MGAS8232
gauaagacuuauaugaaagaac

SEQ ID NO: 4125150 - RNA, 14 nt, Streptococcus pyogenes MGAS8232
gauaagugccauca

SEQ ID NO: 4125151 - RNA, 21 nt, Streptococcus pyogenes MGAS8232
gauaauuucuuuuucauuugu

SEQ ID NO: 4125152 - RNA, 20 nt, Streptococcus pyogenes MGAS8232
gauacaguccaaacucaaac

SEQ ID NO: 4125153 - RNA, 24 nt, Streptococcus pyogenes MGAS8232
gauacaguccaaacucaaacuaaa

SEQ ID NO: 4125154 - RNA, 17 nt, Streptococcus pyogenes MGAS8232
gauacguuuauuguugc

SEQ ID NO: 4125155 - RNA, 20 nt, Streptococcus pyogenes MGAS8232
gauacuucgguauucuuuuu

SEQ ID NO: 4125156 - RNA, 17 nt, Streptococcus pyogenes MGAS8232
gauagcaaggaugaaau

SEQ ID NO: 4125157 - RNA, 20 nt, Streptococcus pyogenes MGAS8232
gauagucaaaaagacuucuu

SEQ ID NO: 4125158 - RNA, 13 nt, Streptococcus pyogenes MGAS8232
gauagugugugug

SEQ ID NO: 4125159 - RNA, 13 nt, Streptococcus pyogenes MGAS8232
gauauaaaauugg

SEQ ID NO: 4125160 - RNA, 12 nt, Streptococcus pyogenes MGAS8232
gauauaagaagg

SEQ ID NO: 4125161 - RNA, 21 nt, Streptococcus pyogenes MGAS8232
gauauugaucucugcaacauc

SEQ ID NO: 4125162 - RNA, 21 nt, Streptococcus pyogenes MGAS8232
gauauuuuuucucaaaaauau

SEQ ID NO: 4125163 - RNA, 19 nt, Streptococcus pyogenes MGAS8232
gaucaaaaaucuuuuucuu

SEQ ID NO: 4125164 - RNA, 15 nt, Streptococcus pyogenes MGAS8232
gaucuccaaagacau

SEQ ID NO: 4125165 - RNA, 22 nt, Streptococcus pyogenes MGAS8232
gaugacuuguaaaaugauccuu

SEQ ID NO: 4125166 - RNA, 17 nt, Streptococcus pyogenes MGAS8232
gaugauugaguaagcag

SEQ ID NO: 4125167 - RNA, 15 nt, Streptococcus pyogenes MGAS8232
gaugcguuuauaaag

SEQ ID NO: 4125168 - RNA, 20 nt, Streptococcus pyogenes MGAS8232
gaugcugcuuaucucuugag

SEQ ID NO: 4125169 - RNA, 14 nt, Streptococcus pyogenes MGAS8232
gaugcuucuuucaa

SEQ ID NO: 4125170 - RNA, 21 nt, Streptococcus pyogenes MGAS8232
gauggucuugcucauguuuuc

SEQ ID NO: 4125171 - RNA, 15 nt, Streptococcus pyogenes MGAS8232
gauuacgauuaaaag

SEQ ID NO: 4125172 - RNA, 17 nt, Streptococcus pyogenes MGAS8232
gauuacgauuaaaagau

SEQ ID NO: 4125173 - RNA, 18 nt, Streptococcus pyogenes MGAS8232
gauuaguuuuuagcagca

SEQ ID NO: 4125174 - RNA, 19 nt, Streptococcus pyogenes MGAS8232
gauuaguuuuuagcagcag

SEQ ID NO: 4125175 - RNA, 12 nt, Streptococcus pyogenes MGAS8232
gauuaugaaaaa

SEQ ID NO: 4125176 - RNA, 15 nt, Streptococcus pyogenes MGAS8232
gauuaugaaaaagaa

SEQ ID NO: 4125177 - RNA, 15 nt, Streptococcus pyogenes MGAS8232
gauuauuauucuaaa

SEQ ID NO: 4125178 - RNA, 19 nt, Streptococcus pyogenes MGAS8232
gauuauuauucuaaaugac

SEQ ID NO: 4125179 - RNA, 13 nt, Streptococcus pyogenes MGAS8232
gauucaauaugaa

SEQ ID NO: 4125180 - RNA, 19 nt, Streptococcus pyogenes MGAS8232
gauugccauuuaauuggua

SEQ ID NO: 4125181 - RNA, 22 nt, Streptococcus pyogenes MGAS8232
gauuugaccacaccuaauaaaa

SEQ ID NO: 4125182 - RNA, 20 nt, Streptococcus pyogenes MGAS8232
gauuugcugagcuaaagcca

SEQ ID NO: 4125183 - RNA, 13 nt, Streptococcus pyogenes MGAS8232
gauuuuaaauauc

SEQ ID NO: 4125184 - RNA, 15 nt, Streptococcus pyogenes MGAS8232
gauuuuggaugaaag

SEQ ID NO: 4125185 - RNA, 17 nt, Streptococcus pyogenes MGAS8232
gauuuuggaugaaagua

SEQ ID NO: 4125186 - RNA, 16 nt, Streptococcus pyogenes MGAS8232
gcaacucuaaucuuua

SEQ ID NO: 4125187 - RNA, 20 nt, Streptococcus pyogenes MGAS8232
gcaauaacaucuugauugua

SEQ ID NO: 4125188 - RNA, 19 nt, Streptococcus pyogenes MGAS8232
gcaauaaucgaugauaaua

SEQ ID NO: 4125189 - RNA, 15 nt, Streptococcus pyogenes MGAS8232
gcaauagagccaaga

SEQ ID NO: 4125190 - RNA, 14 nt, Streptococcus pyogenes MGAS8232
gcaaucauguuguc

SEQ ID NO: 4125191 - RNA, 14 nt, Streptococcus pyogenes MGAS8232
gcaauccaaaucaa

SEQ ID NO: 4125192 - RNA, 16 nt, Streptococcus pyogenes MGAS8232
gcaaugguuaaaaaga

SEQ ID NO: 4125193 - RNA, 18 nt, Streptococcus pyogenes MGAS8232
gcaaugguuaaaaagaga

SEQ ID NO: 4125194 - RNA, 13 nt, Streptococcus pyogenes MGAS8232
gcaauucagcauc

SEQ ID NO: 4125195 - RNA, 19 nt, Streptococcus pyogenes MGAS8232
gcaauucuuuuauuaaugu

SEQ ID NO: 4125196 - RNA, 20 nt, Streptococcus pyogenes MGAS8232
gcaccgacauacaaagcauc

SEQ ID NO: 4125197 - RNA, 13 nt, Streptococcus pyogenes MGAS8232
gcaccuucuuuua

SEQ ID NO: 4125198 - RNA, 14 nt, Streptococcus pyogenes MGAS8232
gcaccuucuuuuag

SEQ ID NO: 4125199 - RNA, 23 nt, Streptococcus pyogenes MGAS8232
gcagaggcuugcauuuuuugcaa

SEQ ID NO: 4125200 - RNA, 22 nt, Streptococcus pyogenes MGAS8232
gcagauggggugucaggggaau

SEQ ID NO: 4125201 - RNA, 19 nt, Streptococcus pyogenes MGAS8232
gcagcacuggcuuuuuugc

SEQ ID NO: 4125202 - RNA, 24 nt, Streptococcus pyogenes MGAS8232
gcagccugucaagcccugcuggcu

SEQ ID NO: 4125203 - RNA, 17 nt, Streptococcus pyogenes MGAS8232
gcagcuaaaaacaaugc

SEQ ID NO: 4125204 - RNA, 17 nt, Streptococcus pyogenes MGAS8232
gcaggguaucugcucag

SEQ ID NO: 4125205 - RNA, 19 nt, Streptococcus pyogenes MGAS8232
gcaguuauaauuaguauau

SEQ ID NO: 4125206 - RNA, 13 nt, Streptococcus pyogenes MGAS8232
gcaguucgauuau

SEQ ID NO: 4125207 - RNA, 23 nt, Streptococcus pyogenes MGAS8232
gcaguugcgaucauaaauaaaga

SEQ ID NO: 4125208 - RNA, 14 nt, Streptococcus pyogenes MGAS8232
gcauaauaaaaaga

SEQ ID NO: 4125209 - RNA, 14 nt, Streptococcus pyogenes MGAS8232
gcauaccuaaaaga

SEQ ID NO: 4125210 - RNA, 17 nt, Streptococcus pyogenes MGAS8232
gcaucacguacagaaau

SEQ ID NO: 4125211 - RNA, 17 nt, Streptococcus pyogenes MGAS8232
gcaucgcaaacagaugc

SEQ ID NO: 4125212 - RNA, 15 nt, Streptococcus pyogenes MGAS8232
gcaucuacagcaccu

SEQ ID NO: 4125213 - RNA, 17 nt, Streptococcus pyogenes MGAS8232
gcaucuacagcaccuuc

SEQ ID NO: 4125214 - RNA, 21 nt, Streptococcus pyogenes MGAS8232
gcaucuacagcaccuucaacc

SEQ ID NO: 4125215 - RNA, 14 nt, Streptococcus pyogenes MGAS8232
gcauguaacaagcc

SEQ ID NO: 4125216 - RNA, 16 nt, Streptococcus pyogenes MGAS8232
gcauugucaaauaaaa

SEQ ID NO: 4125217 - RNA, 16 nt, Streptococcus pyogenes MGAS8232
gcauuuucaucaucaa

SEQ ID NO: 4125218 - RNA, 17 nt, Streptococcus pyogenes MGAS8232
gcauuuugcaagucucu

SEQ ID NO: 4125219 - RNA, 15 nt, Streptococcus pyogenes MGAS8232
gcauuuuugcagggu

SEQ ID NO: 4125220 - RNA, 17 nt, Streptococcus pyogenes MGAS8232
gcauuuuuugcaauuca

SEQ ID NO: 4125221 - RNA, 21 nt, Streptococcus pyogenes MGAS8232
gccaaauuucagauaagaccu

SEQ ID NO: 4125222 - RNA, 22 nt, Streptococcus pyogenes MGAS8232
gccaaauuucagauaagaccuu

SEQ ID NO: 4125223 - RNA, 17 nt, Streptococcus pyogenes MGAS8232
gccaguaaggaaaucaa

SEQ ID NO: 4125224 - RNA, 20 nt, Streptococcus pyogenes MGAS8232
gccaucugcuuggauuuccu

SEQ ID NO: 4125225 - RNA, 14 nt, Streptococcus pyogenes MGAS8232
gccauuuaaaaggg

SEQ ID NO: 4125226 - RNA, 13 nt, Streptococcus pyogenes MGAS8232
gcccugcuggcuu

SEQ ID NO: 4125227 - RNA, 14 nt, Streptococcus pyogenes MGAS8232
gccguccuuaaaag

SEQ ID NO: 4125228 - RNA, 17 nt, Streptococcus pyogenes MGAS8232
gccguccuuaaaagaaa

SEQ ID NO: 4125229 - RNA, 19 nt, Streptococcus pyogenes MGAS8232
gccguccuuaaaagaaaau

SEQ ID NO: 4125230 - RNA, 13 nt, Streptococcus pyogenes MGAS8232
gccucauuugcug

SEQ ID NO: 4125231 - RNA, 20 nt, Streptococcus pyogenes MGAS8232
guaguaggcugaucucccau

SEQ ID NO: 4125232 - RNA, 16 nt, Streptococcus pyogenes MGAS8232
guaguuacgcauaccu

SEQ ID NO: 4125233 - RNA, 18 nt, Streptococcus pyogenes MGAS8232
guauaacuguuuuucuua

SEQ ID NO: 4125234 - RNA, 14 nt, Streptococcus pyogenes MGAS8232
guauacaaaaaggc

SEQ ID NO: 4125235 - RNA, 22 nt, Streptococcus pyogenes MGAS8232
guauaccuauauuauacuaaua

SEQ ID NO: 4125236 - RNA, 15 nt, Streptococcus pyogenes MGAS8232
guauagcauaaaaua

SEQ ID NO: 4125237 - RNA, 14 nt, Streptococcus pyogenes MGAS8232
guaucuaagcuaua

SEQ ID NO: 4125238 - RNA, 16 nt, Streptococcus pyogenes MGAS8232
guaucuaagcuauaga

SEQ ID NO: 4125239 - RNA, 17 nt, Streptococcus pyogenes MGAS8232
guaucuaagcuauagaa

SEQ ID NO: 4125240 - RNA, 20 nt, Streptococcus pyogenes MGAS8232
guaucuaagcuauagaaacu

SEQ ID NO: 4125241 - RNA, 23 nt, Streptococcus pyogenes MGAS8232
guaugcuuuuaauuuuauuuuuu

SEQ ID NO: 4125242 - RNA, 21 nt, Streptococcus pyogenes MGAS8232
guauuccauacuuccaucuaa

SEQ ID NO: 4125243 - RNA, 20 nt, Streptococcus pyogenes MGAS8232
guauuuacugggucaacucc

SEQ ID NO: 4125244 - RNA, 12 nt, Streptococcus pyogenes MGAS8232
guauuucuuugg

SEQ ID NO: 4125245 - RNA, 17 nt, Streptococcus pyogenes MGAS8232
gucaaaagcuaaacuag

SEQ ID NO: 4125246 - RNA, 21 nt, Streptococcus pyogenes MGAS8232
gucaaccucuaggccauaaug

SEQ ID NO: 4125247 - RNA, 13 nt, Streptococcus pyogenes MGAS8232
gucaacuccaauc

SEQ ID NO: 4125248 - RNA, 19 nt, Streptococcus pyogenes MGAS8232
gucaauacagccguucuua

SEQ ID NO: 4125249 - RNA, 20 nt, Streptococcus pyogenes MGAS8232
gucaauuuuaucagacugac

SEQ ID NO: 4125250 - RNA, 20 nt, Streptococcus pyogenes MGAS8232
gucauacucaauagcugcug

SEQ ID NO: 4125251 - RNA, 22 nt, Streptococcus pyogenes MGAS8232
gucaucaaaagaccauaaaaaa

SEQ ID NO: 4125252 - RNA, 22 nt, Streptococcus pyogenes MGAS8232
gucaugaugccauuuaaaaggg

SEQ ID NO: 4125253 - RNA, 21 nt, Streptococcus pyogenes MGAS8232
gucaugugcuaucauggaguc

SEQ ID NO: 4125254 - RNA, 21 nt, Streptococcus pyogenes MGAS8232
gucauuucuucagguuucuuu

SEQ ID NO: 4125255 - RNA, 22 nt, Streptococcus pyogenes MGAS8232
guccaaacucaaacuaaacaaa

SEQ ID NO: 4125256 - RNA, 17 nt, Streptococcus pyogenes MGAS8232
guccauugaugaguuua

SEQ ID NO: 4125257 - RNA, 13 nt, Streptococcus pyogenes MGAS8232
guccgaaaaaaac

SEQ ID NO: 4125258 - RNA, 21 nt, Streptococcus pyogenes MGAS8232
guccuagucuuuuggcuguau

SEQ ID NO: 4125259 - RNA, 18 nt, Streptococcus pyogenes MGAS8232
guccuuaaaagaaaaucu

SEQ ID NO: 4125260 - RNA, 19 nt, Streptococcus pyogenes MGAS8232
gucgaccuuaaaggccucc

SEQ ID NO: 4125261 - RNA, 17 nt, Streptococcus pyogenes MGAS8232
gucgcagaguacaaggc

SEQ ID NO: 4125262 - RNA, 13 nt, Streptococcus pyogenes MGAS8232
gucguuuuuugcu

SEQ ID NO: 4125263 - RNA, 21 nt, Streptococcus pyogenes MGAS8232
gucguuuuuugcuuuugauac

SEQ ID NO: 4125264 - RNA, 14 nt, Streptococcus pyogenes MGAS8232
gucuaccgcuagga

SEQ ID NO: 4125265 - RNA, 20 nt, Streptococcus pyogenes MGAS8232
gucuaugcauguagaugaau

SEQ ID NO: 4125266 - RNA, 21 nt, Streptococcus pyogenes MGAS8232
gucuccuucuuugcagagaug

SEQ ID NO: 4125267 - RNA, 12 nt, Streptococcus pyogenes MGAS8232
gucucuuuugug

SEQ ID NO: 4125268 - RNA, 22 nt, Streptococcus pyogenes MGAS8232
gucugacaccacccgaagcuaa

SEQ ID NO: 4125269 - RNA, 17 nt, Streptococcus pyogenes MGAS8232
gucuggaaacuggucaa

SEQ ID NO: 4125270 - RNA, 13 nt, Streptococcus pyogenes MGAS8232
gucugugaugaau

SEQ ID NO: 4125271 - RNA, 18 nt, Streptococcus pyogenes MGAS8232
gucuguggcuuucucauc

SEQ ID NO: 4125272 - RNA, 16 nt, Streptococcus pyogenes MGAS8232
gucuucuucuuuucag

SEQ ID NO: 4125273 - RNA, 16 nt, Streptococcus pyogenes MGAS8232
gucuuuguccauucuu

SEQ ID NO: 4125274 - RNA, 17 nt, Streptococcus pyogenes MGAS8232
gugaggacuuauuuuuu

SEQ ID NO: 4125275 - RNA, 21 nt, Streptococcus pyogenes MGAS8232
gugaugaguaggcgaacuuua

SEQ ID NO: 4125276 - RNA, 20 nt, Streptococcus pyogenes MGAS8232
gugauguucucauaaacaau

SEQ ID NO: 4125277 - RNA, 20 nt, Streptococcus pyogenes MGAS8232
gugcaccgacauacaaagca

SEQ ID NO: 4125278 - RNA, 20 nt, Streptococcus pyogenes MGAS8232
gugccaguaaggaaaucaau

SEQ ID NO: 4125279 - RNA, 14 nt, Streptococcus pyogenes MGAS8232
gugcuacugaugua

SEQ ID NO: 4125280 - RNA, 16 nt, Streptococcus pyogenes MGAS8232
gugggauauuuagaug

SEQ ID NO: 4125281 - RNA, 21 nt, Streptococcus pyogenes MGAS8232
guguaauccccucguuuaaau

SEQ ID NO: 4125282 - RNA, 18 nt, Streptococcus pyogenes MGAS8232
guguauucuuaaaaaaau

SEQ ID NO: 4125283 - RNA, 17 nt, Streptococcus pyogenes MGAS8232
guuaaguggaauguuua

SEQ ID NO: 4125284 - RNA, 16 nt, Streptococcus pyogenes MGAS8232
guuagagcccauucuu

SEQ ID NO: 4125285 - RNA, 19 nt, Streptococcus pyogenes MGAS8232
guuauccucuuuuaguuca

SEQ ID NO: 4125286 - RNA, 16 nt, Streptococcus pyogenes MGAS8232
guuaucugauauuuca

SEQ ID NO: 4125287 - RNA, 14 nt, Streptococcus pyogenes MGAS8232
guuauguuauaaga

SEQ ID NO: 4125288 - RNA, 20 nt, Streptococcus pyogenes MGAS8232
guuauuaaagacaaaaaaac

SEQ ID NO: 4125289 - RNA, 16 nt, Streptococcus pyogenes MGAS8232
guucaauacucccuuc

SEQ ID NO: 4125290 - RNA, 19 nt, Streptococcus pyogenes MGAS8232
guucaauggauauaacaac

SEQ ID NO: 4125291 - RNA, 19 nt, Streptococcus pyogenes MGAS8232
guucauuuagugguauaga

SEQ ID NO: 4125292 - RNA, 21 nt, Streptococcus pyogenes MGAS8232
guuccuuagcaguuauaauua

SEQ ID NO: 4125293 - RNA, 17 nt, Streptococcus pyogenes MGAS8232
guucuaaaaaagcucua

SEQ ID NO: 4125294 - RNA, 18 nt, Streptococcus pyogenes MGAS8232
guucuaaaaaagcucuau

SEQ ID NO: 4125295 - RNA, 21 nt, Streptococcus pyogenes MGAS8232
guucuaguuuaggauauaaga

SEQ ID NO: 4125296 - RNA, 15 nt, Streptococcus pyogenes MGAS8232
guucugaaaauaaaa

SEQ ID NO: 4125297 - RNA, 23 nt, Streptococcus pyogenes MGAS8232
guucuguuucuaggcaaauagca

SEQ ID NO: 4125298 - RNA, 14 nt, Streptococcus pyogenes MGAS8232
guugacaacaauau

SEQ ID NO: 4125299 - RNA, 18 nt, Streptococcus pyogenes MGAS8232
guugacaguuaaaaauaa

SEQ ID NO: 4125300 - RNA, 13 nt, Streptococcus pyogenes MGAS8232
guugagccuuuuc

SEQ ID NO: 4125301 - RNA, 13 nt, Streptococcus pyogenes MGAS8232
guugcaauaaucg

SEQ ID NO: 4125302 - RNA, 18 nt, Streptococcus pyogenes MGAS8232
guugcaccaccaaccuua

SEQ ID NO: 4125303 - RNA, 19 nt, Streptococcus pyogenes MGAS8232
guugcuacaauuuuuucaa

SEQ ID NO: 4125304 - RNA, 13 nt, Streptococcus pyogenes MGAS8232
guuggcauaaccc

SEQ ID NO: 4125305 - RNA, 18 nt, Streptococcus pyogenes MGAS8232
guuuauguaugcugucca

SEQ ID NO: 4125306 - RNA, 12 nt, Streptococcus pyogenes MGAS8232
guuuauuuaguu

SEQ ID NO: 4125307 - RNA, 23 nt, Streptococcus pyogenes MGAS8232
guuuauuuguugaagugucuuga

SEQ ID NO: 4125308 - RNA, 13 nt, Streptococcus pyogenes MGAS8232
guuucgaaaaagg

SEQ ID NO: 4125309 - RNA, 18 nt, Streptococcus pyogenes MGAS8232
guuugauugauuugucuu

SEQ ID NO: 4125310 - RNA, 20 nt, Streptococcus pyogenes MGAS8232
guuuucucagagacaauaag

SEQ ID NO: 4125311 - RNA, 21 nt, Streptococcus pyogenes MGAS8232
guuuucugguguugcaaggcu

SEQ ID NO: 4125312 - RNA, 17 nt, Streptococcus pyogenes MGAS8232
guuuugauuaaaucuuc

SEQ ID NO: 4125313 - RNA, 16 nt, Streptococcus pyogenes MGAS8232
guuuugucuuaucuaa

SEQ ID NO: 4125314 - RNA, 19 nt, Streptococcus pyogenes MGAS8232
uaaaaaaaaguuaucacua

SEQ ID NO: 4125315 - RNA, 13 nt, Streptococcus pyogenes MGAS8232
uaaaaaaaucccu

SEQ ID NO: 4125316 - RNA, 16 nt, Streptococcus pyogenes MGAS8232
uaaaaaauauuguaaa

SEQ ID NO: 4125317 - RNA, 19 nt, Streptococcus pyogenes MGAS8232
uaaaaaccgcucauuugau

SEQ ID NO: 4125318 - RNA, 20 nt, Streptococcus pyogenes MGAS8232
uaaaaacgaucaaaaaucuu

SEQ ID NO: 4125319 - RNA, 21 nt, Streptococcus pyogenes MGAS8232
uaaaaaguuucugaguugauu

SEQ ID NO: 4125320 - RNA, 14 nt, Streptococcus pyogenes MGAS8232
uaaaaccauaccua

SEQ ID NO: 4125321 - RNA, 15 nt, Streptococcus pyogenes MGAS8232
uaaaacgugagaaaa

SEQ ID NO: 4125322 - RNA, 18 nt, Streptococcus pyogenes MGAS8232
uaaaagauauuuuaaaau

SEQ ID NO: 4125323 - RNA, 18 nt, Streptococcus pyogenes MGAS8232
uaaaaguuagccaagcaa

SEQ ID NO: 4125324 - RNA, 21 nt, Streptococcus pyogenes MGAS8232
uaaaauaucuagaacagcugc

SEQ ID NO: 4125325 - RNA, 18 nt, Streptococcus pyogenes MGAS8232
uaaaauccucuuuuaauu

SEQ ID NO: 4125326 - RNA, 19 nt, Streptococcus pyogenes MGAS8232
uaaaauccucuuuuaauuu

SEQ ID NO: 4125327 - RNA, 16 nt, Streptococcus pyogenes MGAS8232
uaaaaucguuauuaau

SEQ ID NO: 4125328 - RNA, 11 nt, Streptococcus pyogenes MGAS8232
uacaaaaaaca

SEQ ID NO: 4125329 - RNA, 21 nt, Streptococcus pyogenes MGAS8232
uacaaaacugucuggaaacug

SEQ ID NO: 4125330 - RNA, 16 nt, Streptococcus pyogenes MGAS8232
uacaagagcuuaaaag

SEQ ID NO: 4125331 - RNA, 18 nt, Streptococcus pyogenes MGAS8232
uacaagagcuuaaaaguu

SEQ ID NO: 4125332 - RNA, 16 nt, Streptococcus pyogenes MGAS8232
uacagaaaugaaaaga

SEQ ID NO: 4125333 - RNA, 21 nt, Streptococcus pyogenes MGAS8232
uacagaagaaagcuugucuau

SEQ ID NO: 4125334 - RNA, 22 nt, Streptococcus pyogenes MGAS8232
uacaggauauugagaagaaaaa

SEQ ID NO: 4125335 - RNA, 16 nt, Streptococcus pyogenes MGAS8232
uacaguauguaaauau

SEQ ID NO: 4125336 - RNA, 14 nt, Streptococcus pyogenes MGAS8232
uacaugaccaaaaa

SEQ ID NO: 4125337 - RNA, 16 nt, Streptococcus pyogenes MGAS8232
uacaugaccaaaaaau

SEQ ID NO: 4125338 - RNA, 21 nt, Streptococcus pyogenes MGAS8232
uacauuuggagagauaaaaag

SEQ ID NO: 4125339 - RNA, 23 nt, Streptococcus pyogenes MGAS8232
uacauuuggagagauaaaaagua

SEQ ID NO: 4125340 - RNA, 13 nt, Streptococcus pyogenes MGAS8232
uaccccaaaggcu

SEQ ID NO: 4125341 - RNA, 21 nt, Streptococcus pyogenes MGAS8232
uaccuauagaaaguuauaaag

SEQ ID NO: 4125342 - RNA, 19 nt, Streptococcus pyogenes MGAS8232
uaccuauugagucuuuuuc

SEQ ID NO: 4125343 - RNA, 20 nt, Streptococcus pyogenes MGAS8232
uacgcuccaacgauagcugg

SEQ ID NO: 4125344 - RNA, 23 nt, Streptococcus pyogenes MGAS8232
uacgguaaaaacucaaaaaauac

SEQ ID NO: 4125345 - RNA, 15 nt, Streptococcus pyogenes MGAS8232
uacuaauauuauauu

SEQ ID NO: 4125346 - RNA, 18 nt, Streptococcus pyogenes MGAS8232
uacuagcacaaaaucauu

SEQ ID NO: 4125347 - RNA, 16 nt, Streptococcus pyogenes MGAS8232
uacuaggcuuucauua

SEQ ID NO: 4125348 - RNA, 15 nt, Streptococcus pyogenes MGAS8232
uacuagugaagacau

SEQ ID NO: 4125349 - RNA, 24 nt, Streptococcus pyogenes MGAS8232
uacuaguguguugucaaacauaac

SEQ ID NO: 4125350 - RNA, 13 nt, Streptococcus pyogenes MGAS8232
uacuaugaaaaaa

SEQ ID NO: 4125351 - RNA, 21 nt, Streptococcus pyogenes MGAS8232
uacuaugaucuccaaagacau

SEQ ID NO: 4125352 - RNA, 21 nt, Streptococcus pyogenes MGAS8232
uacucaccgaacuccccuuua

SEQ ID NO: 4125353 - RNA, 18 nt, Streptococcus pyogenes MGAS8232
uacucaucuacucuauuu

SEQ ID NO: 4125354 - RNA, 17 nt, Streptococcus pyogenes MGAS8232
uacuccguuucuaguuu

SEQ ID NO: 4125355 - RNA, 13 nt, Streptococcus pyogenes MGAS8232
uacugauaaacuu

SEQ ID NO: 4125356 - RNA, 15 nt, Streptococcus pyogenes MGAS8232
uacugauaaacuuga

SEQ ID NO: 4125357 - RNA, 14 nt, Streptococcus pyogenes MGAS8232
uacuguauaaacuu

SEQ ID NO: 4125358 - RNA, 16 nt, Streptococcus pyogenes MGAS8232
uacuguauaaacuugu

SEQ ID NO: 4125359 - RNA, 22 nt, Streptococcus pyogenes MGAS8232
uacuucaaggaaggcuuguucu

SEQ ID NO: 4125360 - RNA, 21 nt, Streptococcus pyogenes MGAS8232
uacuucgguauucuuuuuccg

SEQ ID NO: 4125361 - RNA, 12 nt, Streptococcus pyogenes MGAS8232
uacuuuuaaaau

SEQ ID NO: 4125362 - RNA, 18 nt, Streptococcus pyogenes MGAS8232
uagaaacuuuuuauaagc

SEQ ID NO: 4125363 - RNA, 12 nt, Streptococcus pyogenes MGAS8232
uagaaaguuaua

SEQ ID NO: 4125364 - RNA, 15 nt, Streptococcus pyogenes MGAS8232
uagaaaguuauaaag

SEQ ID NO: 4125365 - RNA, 21 nt, Streptococcus pyogenes MGAS8232
uagaaauuguaaccacagcaa

SEQ ID NO: 4125366 - RNA, 14 nt, Streptococcus pyogenes MGAS8232
uagaauaaaaagac

SEQ ID NO: 4125367 - RNA, 15 nt, Streptococcus pyogenes MGAS8232
uagaauaaaaagacu

SEQ ID NO: 4125368 - RNA, 20 nt, Streptococcus pyogenes MGAS8232
uagagaacagauaagugcca

SEQ ID NO: 4125369 - RNA, 15 nt, Streptococcus pyogenes MGAS8232
uagagucucuagucu

SEQ ID NO: 4125370 - RNA, 14 nt, Streptococcus pyogenes MGAS8232
uagaugaauuuugu

SEQ ID NO: 4125371 - RNA, 15 nt, Streptococcus pyogenes MGAS8232
uagcaagaaguuuua

SEQ ID NO: 4125372 - RNA, 17 nt, Streptococcus pyogenes MGAS8232
uagcaaguccugcuuuu

SEQ ID NO: 4125373 - RNA, 17 nt, Streptococcus pyogenes MGAS8232
uagcaaugguuaaaaag

SEQ ID NO: 4125374 - RNA, 15 nt, Streptococcus pyogenes MGAS8232
uagcacguuggaaaa

SEQ ID NO: 4125375 - RNA, 18 nt, Streptococcus pyogenes MGAS8232
uagcacguuggaaaagga

SEQ ID NO: 4125376 - RNA, 19 nt, Streptococcus pyogenes MGAS8232
uagcacguuggaaaaggaa

SEQ ID NO: 4125377 - RNA, 13 nt, Streptococcus pyogenes MGAS8232
uagcagacaaaag

SEQ ID NO: 4125378 - RNA, 12 nt, Streptococcus pyogenes MGAS8232
uagcauaaaaua

SEQ ID NO: 4125379 - RNA, 18 nt, Streptococcus pyogenes MGAS8232
uagccaagcaaucuaaga

SEQ ID NO: 4125380 - RNA, 21 nt, Streptococcus pyogenes MGAS8232
uagccagauggugcuacugau

SEQ ID NO: 4125381 - RNA, 13 nt, Streptococcus pyogenes MGAS8232
uagccugccagcc

SEQ ID NO: 4125382 - RNA, 17 nt, Streptococcus pyogenes MGAS8232
uagcguaaagcaaggga

SEQ ID NO: 4125383 - RNA, 15 nt, Streptococcus pyogenes MGAS8232
uagcugguugaccaa

SEQ ID NO: 4125384 - RNA, 14 nt, Streptococcus pyogenes MGAS8232
uagcuuuuguaaua

SEQ ID NO: 4125385 - RNA, 16 nt, Streptococcus pyogenes MGAS8232
uaggaauaucaugaag

SEQ ID NO: 4125386 - RNA, 18 nt, Streptococcus pyogenes MGAS8232
uaggaauaucaugaagua

SEQ ID NO: 4125387 - RNA, 18 nt, Streptococcus pyogenes MGAS8232
uaggcagagccuuaaaaa

SEQ ID NO: 4125388 - RNA, 19 nt, Streptococcus pyogenes MGAS8232
uaggcagagccuuaaaaag

SEQ ID NO: 4125389 - RNA, 22 nt, Streptococcus pyogenes MGAS8232
uagguaaagauuuuaaauaucu

SEQ ID NO: 4125390 - RNA, 22 nt, Streptococcus pyogenes MGAS8232
uaggucuaauuagcauauuuug

SEQ ID NO: 4125391 - RNA, 14 nt, Streptococcus pyogenes MGAS8232
uagguuaaaauaga

SEQ ID NO: 4125392 - RNA, 22 nt, Streptococcus pyogenes MGAS8232
uagguugcaccaccaaccuuaa

SEQ ID NO: 4125393 - RNA, 15 nt, Streptococcus pyogenes MGAS8232
uaguaaccauugcca

SEQ ID NO: 4125394 - RNA, 20 nt, Streptococcus pyogenes MGAS8232
uagucagaucauuaaauuga

SEQ ID NO: 4125395 - RNA, 22 nt, Streptococcus pyogenes MGAS8232
uagucuccauaacauacucuau

SEQ ID NO: 4125396 - RNA, 15 nt, Streptococcus pyogenes MGAS8232
uagucuuuuggcugu

SEQ ID NO: 4125397 - RNA, 18 nt, Streptococcus pyogenes MGAS8232
uagugguauagacaaaca

SEQ ID NO: 4125398 - RNA, 17 nt, Streptococcus pyogenes MGAS8232
uagugugugugauguaa

SEQ ID NO: 4125399 - RNA, 13 nt, Streptococcus pyogenes MGAS8232
uaguuaucucaua

SEQ ID NO: 4125400 - RNA, 22 nt, Streptococcus pyogenes MGAS8232
uaguuauguuauaagauaagua

SEQ ID NO: 4125401 - RNA, 16 nt, Streptococcus pyogenes MGAS8232
uaguuauuuuugagau

SEQ ID NO: 4125402 - RNA, 14 nt, Streptococcus pyogenes MGAS8232
uaguucagaaguug

SEQ ID NO: 4125403 - RNA, 19 nt, Streptococcus pyogenes MGAS8232
uaguugauuagaauagucu

SEQ ID NO: 4125404 - RNA, 17 nt, Streptococcus pyogenes MGAS8232
uaguuggauccuuuauc

SEQ ID NO: 4125405 - RNA, 15 nt, Streptococcus pyogenes MGAS8232
uaguugguauauagc

SEQ ID NO: 4125406 - RNA, 14 nt, Streptococcus pyogenes MGAS8232
uaguuuauuacaaa

SEQ ID NO: 4125407 - RNA, 16 nt, Streptococcus pyogenes MGAS8232
uaguuucucauguuuu

SEQ ID NO: 4125408 - RNA, 18 nt, Streptococcus pyogenes MGAS8232
uaguuucucauguuuuau

SEQ ID NO: 4125409 - RNA, 16 nt, Streptococcus pyogenes MGAS8232
uaguuuuauuuugaua

SEQ ID NO: 4125410 - RNA, 14 nt, Streptococcus pyogenes MGAS8232
uauaaagaaacaaa

SEQ ID NO: 4125411 - RNA, 19 nt, Streptococcus pyogenes MGAS8232
uauaaaucuuacuaacuag

SEQ ID NO: 4125412 - RNA, 14 nt, Streptococcus pyogenes MGAS8232
uauaacaacucccu

SEQ ID NO: 4125413 - RNA, 20 nt, Streptococcus pyogenes MGAS8232
uauaaccucuagcuugugag

SEQ ID NO: 4125414 - RNA, 15 nt, Streptococcus pyogenes MGAS8232
uauaacuguuuuucu

SEQ ID NO: 4125415 - RNA, 13 nt, Streptococcus pyogenes MGAS8232
uauaaggcaauca

SEQ ID NO: 4125416 - RNA, 14 nt, Streptococcus pyogenes MGAS8232
uauaauaauauuau

SEQ ID NO: 4125417 - RNA, 18 nt, Streptococcus pyogenes MGAS8232
uauaaugaugucucgaau

SEQ ID NO: 4125418 - RNA, 13 nt, Streptococcus pyogenes MGAS8232
uauaaugguuuuu

SEQ ID NO: 4125419 - RNA, 18 nt, Streptococcus pyogenes MGAS8232
uauaaugguuuuuugucu

SEQ ID NO: 4125420 - RNA, 14 nt, Streptococcus pyogenes MGAS8232
uauaauuucaauaa

SEQ ID NO: 4125421 - RNA, 21 nt, Streptococcus pyogenes MGAS8232
uauacgguaaaaacucaaaaa

SEQ ID NO: 4125422 - RNA, 22 nt, Streptococcus pyogenes MGAS8232
uauacuaauauuauauuaaauu

SEQ ID NO: 4125423 - RNA, 13 nt, Streptococcus pyogenes MGAS8232
uauagcauaaaau

SEQ ID NO: 4125424 - RNA, 23 nt, Streptococcus pyogenes MGAS8232
uauaguaaccauugccauuaaua

SEQ ID NO: 4125425 - RNA, 16 nt, Streptococcus pyogenes MGAS8232
uauaguauaccuauau

SEQ ID NO: 4125426 - RNA, 20 nt, Streptococcus pyogenes MGAS8232
ucacuagauaagucauuuua

SEQ ID NO: 4125427 - RNA, 23 nt, Streptococcus pyogenes MGAS8232
ucacuauaauuucaauaauacca

SEQ ID NO: 4125428 - RNA, 19 nt, Streptococcus pyogenes MGAS8232
ucacuaucugauacagagc

SEQ ID NO: 4125429 - RNA, 14 nt, Streptococcus pyogenes MGAS8232
ucagaauaagaaaa

SEQ ID NO: 4125430 - RNA, 15 nt, Streptococcus pyogenes MGAS8232
ucagaauaagaaaac

SEQ ID NO: 4125431 - RNA, 19 nt, Streptococcus pyogenes MGAS8232
ucagaauaagaaaaccuua

SEQ ID NO: 4125432 - RNA, 19 nt, Streptococcus pyogenes MGAS8232
ucagagaugcuucuuucaa

SEQ ID NO: 4125433 - RNA, 13 nt, Streptococcus pyogenes MGAS8232
ucagagcuuuuuu

SEQ ID NO: 4125434 - RNA, 20 nt, Streptococcus pyogenes MGAS8232
ucagagcuuuuuuuguuuug

SEQ ID NO: 4125435 - RNA, 19 nt, Streptococcus pyogenes MGAS8232
ucagauaagaccuucaaaa

SEQ ID NO: 4125436 - RNA, 19 nt, Streptococcus pyogenes MGAS8232
ucagaucauuaaauugauu

SEQ ID NO: 4125437 - RNA, 19 nt, Streptococcus pyogenes MGAS8232
ucagcaucguuaaguggaa

SEQ ID NO: 4125438 - RNA, 23 nt, Streptococcus pyogenes MGAS8232
ucaguccuccucuuuagaauucu

SEQ ID NO: 4125439 - RNA, 20 nt, Streptococcus pyogenes MGAS8232
ucaguucugagauauucauu

SEQ ID NO: 4125440 - RNA, 23 nt, Streptococcus pyogenes MGAS8232
ucaguucugagauauucauuuuc

SEQ ID NO: 4125441 - RNA, 15 nt, Streptococcus pyogenes MGAS8232
ucaguuuuuuugauu

SEQ ID NO: 4125442 - RNA, 13 nt, Streptococcus pyogenes MGAS8232
ucauaaaaaagaa

SEQ ID NO: 4125443 - RNA, 15 nt, Streptococcus pyogenes MGAS8232
ucauaaauaaagaua

SEQ ID NO: 4125444 - RNA, 15 nt, Streptococcus pyogenes MGAS8232
ucauaacuugucaag

SEQ ID NO: 4125445 - RNA, 21 nt, Streptococcus pyogenes MGAS8232
ucauacucaauagcugcugcu

SEQ ID NO: 4125446 - RNA, 16 nt, Streptococcus pyogenes MGAS8232
ucaucaaaagaccaua

SEQ ID NO: 4125447 - RNA, 17 nt, Streptococcus pyogenes MGAS8232
ucaucaagaauagcuuu

SEQ ID NO: 4125448 - RNA, 22 nt, Streptococcus pyogenes MGAS8232
ucaugacgccuccaaauacugg

SEQ ID NO: 4125449 - RNA, 19 nt, Streptococcus pyogenes MGAS8232
ucaugugcuaucauggagu

SEQ ID NO: 4125450 - RNA, 19 nt, Streptococcus pyogenes MGAS8232
ucauuugacuacuagccug

SEQ ID NO: 4125451 - RNA, 22 nt, Streptococcus pyogenes MGAS8232
ucauuuuggagagauuuuuaaa

SEQ ID NO: 4125452 - RNA, 22 nt, Streptococcus pyogenes MGAS8232
uccaaaccauuuuaugagaaaa

SEQ ID NO: 4125453 - RNA, 23 nt, Streptococcus pyogenes MGAS8232
uccaaaccauuuuaugagaaaaa

SEQ ID NO: 4125454 - RNA, 17 nt, Streptococcus pyogenes MGAS8232
uccaaaguucuucuaaa

SEQ ID NO: 4125455 - RNA, 17 nt, Streptococcus pyogenes MGAS8232
uccaaugaaaacuccag

SEQ ID NO: 4125456 - RNA, 13 nt, Streptococcus pyogenes MGAS8232
uccaaugacuaag

SEQ ID NO: 4125457 - RNA, 17 nt, Streptococcus pyogenes MGAS8232
uccacuugguccaucag

SEQ ID NO: 4125458 - RNA, 12 nt, Streptococcus pyogenes MGAS8232
uccaugauuuuc

SEQ ID NO: 4125459 - RNA, 23 nt, Streptococcus pyogenes MGAS8232
uccauuauaaaucuuacuaacua

SEQ ID NO: 4125460 - RNA, 22 nt, Streptococcus pyogenes MGAS8232
ucccaucuuuguuuuuuuuagu

SEQ ID NO: 4125461 - RNA, 16 nt, Streptococcus pyogenes MGAS8232
ucccuacuaggcuuuc

SEQ ID NO: 4125462 - RNA, 16 nt, Streptococcus pyogenes MGAS8232
ucccuucauuuuacua

SEQ ID NO: 4125463 - RNA, 21 nt, Streptococcus pyogenes MGAS8232
uccggcaggggucauuauugu

SEQ ID NO: 4125464 - RNA, 16 nt, Streptococcus pyogenes MGAS8232
uccuaaaaccauaccu

SEQ ID NO: 4125465 - RNA, 18 nt, Streptococcus pyogenes MGAS8232
uccuaggacgaaacauuu

SEQ ID NO: 4125466 - RNA, 22 nt, Streptococcus pyogenes MGAS8232
uccuaggacgaaacauuuaauc

SEQ ID NO: 4125467 - RNA, 18 nt, Streptococcus pyogenes MGAS8232
uccuagucuuuuggcugu

SEQ ID NO: 4125468 - RNA, 19 nt, Streptococcus pyogenes MGAS8232
uccucgguuuuuuuaagua

SEQ ID NO: 4125469 - RNA, 17 nt, Streptococcus pyogenes MGAS8232
uccucuaacauguccaa

SEQ ID NO: 4125470 - RNA, 14 nt, Streptococcus pyogenes MGAS8232
uccucugaaaaguu

SEQ ID NO: 4125471 - RNA, 15 nt, Streptococcus pyogenes MGAS8232
uccuuaaaagaaaau

SEQ ID NO: 4125472 - RNA, 18 nt, Streptococcus pyogenes MGAS8232
ucgaaaaugcuuuuucgu

SEQ ID NO: 4125473 - RNA, 15 nt, Streptococcus pyogenes MGAS8232
ucgacaauuaaaaaa

SEQ ID NO: 4125474 - RNA, 21 nt, Streptococcus pyogenes MGAS8232
ucgacauuuaugcugauuuug

SEQ ID NO: 4125475 - RNA, 23 nt, Streptococcus pyogenes MGAS8232
ucgacauuuaugcugauuuugga

SEQ ID NO: 4125476 - RNA, 17 nt, Streptococcus pyogenes MGAS8232
ucgaccaauucuaaaac

SEQ ID NO: 4125477 - RNA, 20 nt, Streptococcus pyogenes MGAS8232
ucgaugauagcuuuuaauug

SEQ ID NO: 4125478 - RNA, 17 nt, Streptococcus pyogenes MGAS8232
ucgcagaguacaaggca

SEQ ID NO: 4125479 - RNA, 15 nt, Streptococcus pyogenes MGAS8232
ucgccaauaaaaaag

SEQ ID NO: 4125480 - RNA, 17 nt, Streptococcus pyogenes MGAS8232
ucgccuaggaauaaaau

SEQ ID NO: 4125481 - RNA, 21 nt, Streptococcus pyogenes MGAS8232
ucgcguuucgaaaaaggggag

SEQ ID NO: 4125482 - RNA, 21 nt, Streptococcus pyogenes MGAS8232
ucggaccaugccuaaauccca

SEQ ID NO: 4125483 - RNA, 18 nt, Streptococcus pyogenes MGAS8232
ucgguuuuuuuaaguaag

SEQ ID NO: 4125484 - RNA, 20 nt, Streptococcus pyogenes MGAS8232
ucguaaggguuacuauuuag

SEQ ID NO: 4125485 - RNA, 15 nt, Streptococcus pyogenes MGAS8232
ucguauacuuuaaac

SEQ ID NO: 4125486 - RNA, 18 nt, Streptococcus pyogenes MGAS8232
ucgugaauaaucuucaga

SEQ ID NO: 4125487 - RNA, 21 nt, Streptococcus pyogenes MGAS8232
ucguuuuacggcuucuacaca

SEQ ID NO: 4125488 - RNA, 19 nt, Streptococcus pyogenes MGAS8232
ucguuuuuuaguuuguaaa

SEQ ID NO: 4125489 - RNA, 21 nt, Streptococcus pyogenes MGAS8232
ucguuuuuuaguuuguaaaau

SEQ ID NO: 4125490 - RNA, 18 nt, Streptococcus pyogenes MGAS8232
ucguuuuuugcuuuugau

SEQ ID NO: 4125491 - RNA, 11 nt, Streptococcus pyogenes MGAS8232
ucuaaaauaua

SEQ ID NO: 4125492 - RNA, 14 nt, Streptococcus pyogenes MGAS8232
ucuaaacuuauguu

SEQ ID NO: 4125493 - RNA, 22 nt, Streptococcus pyogenes MGAS8232
ucuaaaugacaguauacaucaa

SEQ ID NO: 4125494 - RNA, 19 nt, Streptococcus pyogenes MGAS8232
ucuaagcuauagaaacuuu

SEQ ID NO: 4125495 - RNA, 12 nt, Streptococcus pyogenes MGAS8232
ucuaaucagaac

SEQ ID NO: 4125496 - RNA, 14 nt, Streptococcus pyogenes MGAS8232
ucuaaucagagcuc

SEQ ID NO: 4125497 - RNA, 18 nt, Streptococcus pyogenes MGAS8232
ucuaauuuagucauuucu

SEQ ID NO: 4125498 - RNA, 15 nt, Streptococcus pyogenes MGAS8232
ucuacacaaaagcuu

SEQ ID NO: 4125499 - RNA, 15 nt, Streptococcus pyogenes MGAS8232
ucuacagcaccuuca

SEQ ID NO: 4125500 - RNA, 19 nt, Streptococcus pyogenes MGAS8232
ucuacuaaaacgugagaaa

SEQ ID NO: 4125501 - RNA, 21 nt, Streptococcus pyogenes MGAS8232
ucuacuaaaacgugagaaaau

SEQ ID NO: 4125502 - RNA, 20 nt, Streptococcus pyogenes MGAS8232
ucuagacucuagcauaaaag

SEQ ID NO: 4125503 - RNA, 14 nt, Streptococcus pyogenes MGAS8232
ucuagcuugugagg

SEQ ID NO: 4125504 - RNA, 20 nt, Streptococcus pyogenes MGAS8232
ucuagucagaucauuaaauu

SEQ ID NO: 4125505 - RNA, 16 nt, Streptococcus pyogenes MGAS8232
ucuagucuuuuuaugu

SEQ ID NO: 4125506 - RNA, 12 nt, Streptococcus pyogenes MGAS8232
ucuaucaaaacg

SEQ ID NO: 4125507 - RNA, 13 nt, Streptococcus pyogenes MGAS8232
ucuaucaaaacgu

SEQ ID NO: 4125508 - RNA, 12 nt, Streptococcus pyogenes MGAS8232
ucuaucugcaga

SEQ ID NO: 4125509 - RNA, 11 nt, Streptococcus pyogenes MGAS8232
ucuauuaccua

SEQ ID NO: 4125510 - RNA, 22 nt, Streptococcus pyogenes MGAS8232
ucuauuugaaguaaaggauuua

SEQ ID NO: 4125511 - RNA, 16 nt, Streptococcus pyogenes MGAS8232
ucuauuuuugguguua

SEQ ID NO: 4125512 - RNA, 14 nt, Streptococcus pyogenes MGAS8232
ucucauaacaaauu

SEQ ID NO: 4125513 - RNA, 15 nt, Streptococcus pyogenes MGAS8232
ucucauguuuuauua

SEQ ID NO: 4125514 - RNA, 21 nt, Streptococcus pyogenes MGAS8232
ucucauguuuuauuaccagua

SEQ ID NO: 4125515 - RNA, 21 nt, Streptococcus pyogenes MGAS8232
ucuccaaaguucuucuaaacg

SEQ ID NO: 4125516 - RNA, 19 nt, Streptococcus pyogenes MGAS8232
ucucuuuugugauuaguuu

SEQ ID NO: 4125517 - RNA, 19 nt, Streptococcus pyogenes MGAS8232
ucugaaaauaaaauauuuu

SEQ ID NO: 4125518 - RNA, 12 nt, Streptococcus pyogenes MGAS8232
ucugaauuauua

SEQ ID NO: 4125519 - RNA, 20 nt, Streptococcus pyogenes MGAS8232
ucugacaccacccgaagcua

SEQ ID NO: 4125520 - RNA, 15 nt, Streptococcus pyogenes MGAS8232
ucugagauauucauu

SEQ ID NO: 4125521 - RNA, 18 nt, Streptococcus pyogenes MGAS8232
ucugagcgguuuugucuu

SEQ ID NO: 4125522 - RNA, 22 nt, Streptococcus pyogenes MGAS8232
ucugaugcguuuauaaaguuuu

SEQ ID NO: 4125523 - RNA, 22 nt, Streptococcus pyogenes MGAS8232
ugaugagguauuuauaaauauu

SEQ ID NO: 4125524 - RNA, 20 nt, Streptococcus pyogenes MGAS8232
ugaugaguaggcgaacuuua

SEQ ID NO: 4125525 - RNA, 21 nt, Streptococcus pyogenes MGAS8232
ugaugaguaggcgaacuuuau

SEQ ID NO: 4125526 - RNA, 21 nt, Streptococcus pyogenes MGAS8232
ugaugauaaaggccuguauuu

SEQ ID NO: 4125527 - RNA, 12 nt, Streptococcus pyogenes MGAS8232
ugaugauggagu

SEQ ID NO: 4125528 - RNA, 14 nt, Streptococcus pyogenes MGAS8232
ugaugcguuuauaa

SEQ ID NO: 4125529 - RNA, 17 nt, Streptococcus pyogenes MGAS8232
ugauggcuuuccauucu

SEQ ID NO: 4125530 - RNA, 16 nt, Streptococcus pyogenes MGAS8232
ugauguaccaauuuaa

SEQ ID NO: 4125531 - RNA, 14 nt, Streptococcus pyogenes MGAS8232
ugauguuauuaaau

SEQ ID NO: 4125532 - RNA, 19 nt, Streptococcus pyogenes MGAS8232
ugauuacugauaaacuuga

SEQ ID NO: 4125533 - RNA, 17 nt, Streptococcus pyogenes MGAS8232
ugauuauuauucuaaau

SEQ ID NO: 4125534 - RNA, 12 nt, Streptococcus pyogenes MGAS8232
ugauucuuuuuu

SEQ ID NO: 4125535 - RNA, 13 nt, Streptococcus pyogenes MGAS8232
ugauugccauuua

SEQ ID NO: 4125536 - RNA, 21 nt, Streptococcus pyogenes MGAS8232
ugauuuaugaccauuuuuacu

SEQ ID NO: 4125537 - RNA, 14 nt, Streptococcus pyogenes MGAS8232
ugauuuguuuucuu

SEQ ID NO: 4125538 - RNA, 17 nt, Streptococcus pyogenes MGAS8232
ugauuuuaauuuuucuu

SEQ ID NO: 4125539 - RNA, 16 nt, Streptococcus pyogenes MGAS8232
ugauuuuuaauucuuc

SEQ ID NO: 4125540 - RNA, 17 nt, Streptococcus pyogenes MGAS8232
ugauuuuuaauucuucu

SEQ ID NO: 4125541 - RNA, 23 nt, Streptococcus pyogenes MGAS8232
ugauuuuucuuguuuugguugau

SEQ ID NO: 4125542 - RNA, 15 nt, Streptococcus pyogenes MGAS8232
ugcaaaaaagcucuu

SEQ ID NO: 4125543 - RNA, 19 nt, Streptococcus pyogenes MGAS8232
ugcaacaucaaggguaaag

SEQ ID NO: 4125544 - RNA, 22 nt, Streptococcus pyogenes MGAS8232
ugcaacugccaguugagccuuu

SEQ ID NO: 4125545 - RNA, 17 nt, Streptococcus pyogenes MGAS8232
ugcaauauccauagaaa

SEQ ID NO: 4125546 - RNA, 21 nt, Streptococcus pyogenes MGAS8232
ugcacacaaaucuucuagaau

SEQ ID NO: 4125547 - RNA, 14 nt, Streptococcus pyogenes MGAS8232
ugcaccaccaaccu

SEQ ID NO: 4125548 - RNA, 18 nt, Streptococcus pyogenes MGAS8232
ugcagagaugcuucuuuc

SEQ ID NO: 4125549 - RNA, 14 nt, Streptococcus pyogenes MGAS8232
ugcagcauaaucau

SEQ ID NO: 4125550 - RNA, 15 nt, Streptococcus pyogenes MGAS8232
ugcagcuaaaaacaa

SEQ ID NO: 4125551 - RNA, 14 nt, Streptococcus pyogenes MGAS8232
ugcaugaagugguu

SEQ ID NO: 4125552 - RNA, 22 nt, Streptococcus pyogenes MGAS8232
ugcauuuaaucuuauuaaagag

SEQ ID NO: 4125553 - RNA, 14 nt, Streptococcus pyogenes MGAS8232
ugccagccauacca

SEQ ID NO: 4125554 - RNA, 15 nt, Streptococcus pyogenes MGAS8232
ugccaguaaggaaau

SEQ ID NO: 4125555 - RNA, 22 nt, Streptococcus pyogenes MGAS8232
ugccaguaaggaaaucaauccu

SEQ ID NO: 4125556 - RNA, 22 nt, Streptococcus pyogenes MGAS8232
ugccaucaggcuuaaacauauu

SEQ ID NO: 4125557 - RNA, 21 nt, Streptococcus pyogenes MGAS8232
ugccaucugcuuggauuuccu

SEQ ID NO: 4125558 - RNA, 17 nt, Streptococcus pyogenes MGAS8232
ugccauggguaaaauga

SEQ ID NO: 4125559 - RNA, 16 nt, Streptococcus pyogenes MGAS8232
ugccauuaauaauauu

SEQ ID NO: 4125560 - RNA, 16 nt, Streptococcus pyogenes MGAS8232
ugccauuuaaaagggc

SEQ ID NO: 4125561 - RNA, 17 nt, Streptococcus pyogenes MGAS8232
ugccauuuaaaagggca

SEQ ID NO: 4125562 - RNA, 18 nt, Streptococcus pyogenes MGAS8232
ugccauuuccuacaaaau

SEQ ID NO: 4125563 - RNA, 23 nt, Streptococcus pyogenes MGAS8232
ugccucaccaccaucaaagguca

SEQ ID NO: 4125564 - RNA, 14 nt, Streptococcus pyogenes MGAS8232
ugccuuucacagcc

SEQ ID NO: 4125565 - RNA, 13 nt, Streptococcus pyogenes MGAS8232
ugccuuuuuaauc

SEQ ID NO: 4125566 - RNA, 15 nt, Streptococcus pyogenes MGAS8232
ugccuuuuuaaucuu

SEQ ID NO: 4125567 - RNA, 19 nt, Streptococcus pyogenes MGAS8232
ugcgaugauuuugaaccaa

SEQ ID NO: 4125568 - RNA, 16 nt, Streptococcus pyogenes MGAS8232
ugcgugguggaggucu

SEQ ID NO: 4125569 - RNA, 17 nt, Streptococcus pyogenes MGAS8232
ugcuaauggguuguuuu

SEQ ID NO: 4125570 - RNA, 16 nt, Streptococcus pyogenes MGAS8232
ugcuaucauggaguca

SEQ ID NO: 4125571 - RNA, 16 nt, Streptococcus pyogenes MGAS8232
ugcucaauugcuuuua

SEQ ID NO: 4125572 - RNA, 17 nt, Streptococcus pyogenes MGAS8232
ugcucauguuuucucaa

SEQ ID NO: 4125573 - RNA, 21 nt, Streptococcus pyogenes MGAS8232
ugcugccauauuuuugaaaaa

SEQ ID NO: 4125574 - RNA, 17 nt, Streptococcus pyogenes MGAS8232
ugcuguuugucauacuc

SEQ ID NO: 4125575 - RNA, 23 nt, Streptococcus pyogenes MGAS8232
ugcuguuugucauacucaauagc

SEQ ID NO: 4125576 - RNA, 14 nt, Streptococcus pyogenes MGAS8232
ugcuucaaaggaaa

SEQ ID NO: 4125577 - RNA, 16 nt, Streptococcus pyogenes MGAS8232
ugcuucuagcucuuua

SEQ ID NO: 4125578 - RNA, 13 nt, Streptococcus pyogenes MGAS8232
ugcuucuagucag

SEQ ID NO: 4125579 - RNA, 21 nt, Streptococcus pyogenes MGAS8232
ugcuuugacaaagcagugcuu

SEQ ID NO: 4125580 - RNA, 23 nt, Streptococcus pyogenes MGAS8232
ugcuuuuuuugucguuuuuugcu

SEQ ID NO: 4125581 - RNA, 22 nt, Streptococcus pyogenes MGAS8232
uggaaacugcacugagccccaa

SEQ ID NO: 4125582 - RNA, 23 nt, Streptococcus pyogenes MGAS8232
uggaaaguaaggguuaacaauga

SEQ ID NO: 4125583 - RNA, 14 nt, Streptococcus pyogenes MGAS8232
uggaaauuuuaaau

SEQ ID NO: 4125584 - RNA, 12 nt, Streptococcus pyogenes MGAS8232
uggacgaaggcu

SEQ ID NO: 4125585 - RNA, 20 nt, Streptococcus pyogenes MGAS8232
uggacgucuucuuuuuauua

SEQ ID NO: 4125586 - RNA, 21 nt, Streptococcus pyogenes MGAS8232
uggacgucuucuuuuuauuau

SEQ ID NO: 4125587 - RNA, 18 nt, Streptococcus pyogenes MGAS8232
uggagcuuuaguugcuuc

SEQ ID NO: 4125588 - RNA, 19 nt, Streptococcus pyogenes MGAS8232
uggagcuuuaguugcuucu

SEQ ID NO: 4125589 - RNA, 22 nt, Streptococcus pyogenes MGAS8232
uggagcuuuaguugcuucuuuu

SEQ ID NO: 4125590 - RNA, 16 nt, Streptococcus pyogenes MGAS8232
uggaggucugugauga

SEQ ID NO: 4125591 - RNA, 16 nt, Streptococcus pyogenes MGAS8232
uggauaccauuucuuu

SEQ ID NO: 4125592 - RNA, 21 nt, Streptococcus pyogenes MGAS8232
uggauaccauuucuuugcaaa

SEQ ID NO: 4125593 - RNA, 20 nt, Streptococcus pyogenes MGAS8232
uggauauaacaacucccucc

SEQ ID NO: 4125594 - RNA, 22 nt, Streptococcus pyogenes MGAS8232
uggauuaaaugcccaagauggg

SEQ ID NO: 4125595 - RNA, 15 nt, Streptococcus pyogenes MGAS8232
uggcaaccuuaccua

SEQ ID NO: 4125596 - RNA, 20 nt, Streptococcus pyogenes MGAS8232
uggcuacucuauuuuaagua

SEQ ID NO: 4125597 - RNA, 23 nt, Streptococcus pyogenes MGAS8232
uggcuauaaauggacaaucuuaa

SEQ ID NO: 4125598 - RNA, 15 nt, Streptococcus pyogenes MGAS8232
uggcuucuaaaaaaa

SEQ ID NO: 4125599 - RNA, 21 nt, Streptococcus pyogenes MGAS8232
uggcuuuuuugcuuuuuaauu

SEQ ID NO: 4125600 - RNA, 14 nt, Streptococcus pyogenes MGAS8232
uggguaaaaugacu

SEQ ID NO: 4125601 - RNA, 15 nt, Streptococcus pyogenes MGAS8232
uggguguuuaaucuu

SEQ ID NO: 4125602 - RNA, 23 nt, Streptococcus pyogenes MGAS8232
uggucaauggaaauuuuaaauga

SEQ ID NO: 4125603 - RNA, 20 nt, Streptococcus pyogenes MGAS8232
uggucguacuuggcaaguga

SEQ ID NO: 4125604 - RNA, 12 nt, Streptococcus pyogenes MGAS8232
ugguuaaaaaga

SEQ ID NO: 4125605 - RNA, 13 nt, Streptococcus pyogenes MGAS8232
ugguuaaaaagag

SEQ ID NO: 4125606 - RNA, 14 nt, Streptococcus pyogenes MGAS8232
ugguuaaaaagaga

SEQ ID NO: 4125607 - RNA, 18 nt, Streptococcus pyogenes MGAS8232
ugguugccugaaauauaa

SEQ ID NO: 4125608 - RNA, 14 nt, Streptococcus pyogenes MGAS8232
ugguuuuuuugucu

SEQ ID NO: 4125609 - RNA, 12 nt, Streptococcus pyogenes MGAS8232
uguaaaauuuau

SEQ ID NO: 4125610 - RNA, 19 nt, Streptococcus pyogenes MGAS8232
uguaacgcuuguuuaugaa

SEQ ID NO: 4125611 - RNA, 20 nt, Streptococcus pyogenes MGAS8232
uguaacgcuuguuuaugaaa

SEQ ID NO: 4125612 - RNA, 22 nt, Streptococcus pyogenes MGAS8232
uguaacuccuuaaauuauagua

SEQ ID NO: 4125613 - RNA, 12 nt, Streptococcus pyogenes MGAS8232
uguaauaacaaa

SEQ ID NO: 4125614 - RNA, 14 nt, Streptococcus pyogenes MGAS8232
uguaauuaugcaaa

SEQ ID NO: 4125615 - RNA, 13 nt, Streptococcus pyogenes MGAS8232
uguaauugucucu

SEQ ID NO: 4125616 - RNA, 13 nt, Streptococcus pyogenes MGAS8232
uguacaagagcuu

SEQ ID NO: 4125617 - RNA, 21 nt, Streptococcus pyogenes MGAS8232
uguagguaauagcguaaagca

SEQ ID NO: 4125618 - RNA, 18 nt, Streptococcus pyogenes MGAS8232
uguauacaaaaaggcuaa

SEQ ID NO: 4125619 - RNA, 13 nt, Streptococcus pyogenes MGAS8232
uguauagguagau

SEQ ID NO: 4125620 - RNA, 18 nt, Streptococcus pyogenes MGAS8232
uuauauuauguucuaaaa

SEQ ID NO: 4125621 - RNA, 16 nt, Streptococcus pyogenes MGAS8232
uuauauugugcuauuc

SEQ ID NO: 4125622 - RNA, 12 nt, Streptococcus pyogenes MGAS8232
uuauccucccag

SEQ ID NO: 4125623 - RNA, 15 nt, Streptococcus pyogenes MGAS8232
uuauccuuuacugua

SEQ ID NO: 4125624 - RNA, 16 nt, Streptococcus pyogenes MGAS8232
uuaugcugauuuugga

SEQ ID NO: 4125625 - RNA, 16 nt, Streptococcus pyogenes MGAS8232
uuaugcuucaaaggaa

SEQ ID NO: 4125626 - RNA, 16 nt, Streptococcus pyogenes MGAS8232
uuauguuauaagauaa

SEQ ID NO: 4125627 - RNA, 17 nt, Streptococcus pyogenes MGAS8232
uuauuaaagagaaagag

SEQ ID NO: 4125628 - RNA, 20 nt, Streptococcus pyogenes MGAS8232
uuauuaaagagaaagaggaa

SEQ ID NO: 4125629 - RNA, 18 nt, Streptococcus pyogenes MGAS8232
uuauuaaccaauuccucc

SEQ ID NO: 4125630 - RNA, 22 nt, Streptococcus pyogenes MGAS8232
uuauuaaccaauuccucccuau

SEQ ID NO: 4125631 - RNA, 15 nt, Streptococcus pyogenes MGAS8232
uuauuccauuuaucu

SEQ ID NO: 4125632 - RNA, 21 nt, Streptococcus pyogenes MGAS8232
uuauuuugcagguaauuaucu

SEQ ID NO: 4125633 - RNA, 14 nt, Streptococcus pyogenes MGAS8232
uuauuuuugagaua

SEQ ID NO: 4125634 - RNA, 16 nt, Streptococcus pyogenes MGAS8232
uuauuuuuuaaagcua

SEQ ID NO: 4125635 - RNA, 14 nt, Streptococcus pyogenes MGAS8232
uucaaaaauacuac

SEQ ID NO: 4125636 - RNA, 17 nt, Streptococcus pyogenes MGAS8232
uucaaaaauacuaccuu

SEQ ID NO: 4125637 - RNA, 19 nt, Streptococcus pyogenes MGAS8232
uucaacaaauccuuuugcu

SEQ ID NO: 4125638 - RNA, 22 nt, Streptococcus pyogenes MGAS8232
uucaacuugggagaguuccugc

SEQ ID NO: 4125639 - RNA, 19 nt, Streptococcus pyogenes MGAS8232
uucaauaauaccauuuuua

SEQ ID NO: 4125640 - RNA, 18 nt, Streptococcus pyogenes MGAS8232
uucaauaugaaaacgugu

SEQ ID NO: 4125641 - RNA, 15 nt, Streptococcus pyogenes MGAS8232
uucaauauuuuauua

SEQ ID NO: 4125642 - RNA, 19 nt, Streptococcus pyogenes MGAS8232
uucaauauuuuauuaauaa

SEQ ID NO: 4125643 - RNA, 21 nt, Streptococcus pyogenes MGAS8232
uucaauauuuuauuaauaagu

SEQ ID NO: 4125644 - RNA, 19 nt, Streptococcus pyogenes MGAS8232
uucacuauaauuucaauaa

SEQ ID NO: 4125645 - RNA, 16 nt, Streptococcus pyogenes MGAS8232
uucagagaugcuucuu

SEQ ID NO: 4125646 - RNA, 11 nt, Streptococcus pyogenes MGAS8232
uucagcagcac

SEQ ID NO: 4125647 - RNA, 19 nt, Streptococcus pyogenes MGAS8232
uucagcagcacuggcuuuu

SEQ ID NO: 4125648 - RNA, 21 nt, Streptococcus pyogenes MGAS8232
uucagcagcacuggcuuuuuu

SEQ ID NO: 4125649 - RNA, 15 nt, Streptococcus pyogenes MGAS8232
uucauagaagacgga

SEQ ID NO: 4125650 - RNA, 21 nt, Streptococcus pyogenes MGAS8232
uucaucaucaagaauagcuuu

SEQ ID NO: 4125651 - RNA, 13 nt, Streptococcus pyogenes MGAS8232
uucauguuuaaaa

SEQ ID NO: 4125652 - RNA, 13 nt, Streptococcus pyogenes MGAS8232
uucauuuucuucu

SEQ ID NO: 4125653 - RNA, 15 nt, Streptococcus pyogenes MGAS8232
uuccaaaccauuuua

SEQ ID NO: 4125654 - RNA, 23 nt, Streptococcus pyogenes MGAS8232
uuccaaaccauuuuaugagaaaa

SEQ ID NO: 4125655 - RNA, 15 nt, Streptococcus pyogenes MGAS8232
uuccaagcugucaau

SEQ ID NO: 4125656 - RNA, 16 nt, Streptococcus pyogenes MGAS8232
uuccagaacaugggag

SEQ ID NO: 4125657 - RNA, 18 nt, Streptococcus pyogenes MGAS8232
uucccuuaauaaacugua

SEQ ID NO: 4125658 - RNA, 20 nt, Streptococcus pyogenes MGAS8232
uuccucaaacacguauuuuu

SEQ ID NO: 4125659 - RNA, 16 nt, Streptococcus pyogenes MGAS8232
uuccuuguacaagagc

SEQ ID NO: 4125660 - RNA, 15 nt, Streptococcus pyogenes MGAS8232
uucgaaaaaggggag

SEQ ID NO: 4125661 - RNA, 19 nt, Streptococcus pyogenes MGAS8232
uucgacucaugauauccca

SEQ ID NO: 4125662 - RNA, 18 nt, Streptococcus pyogenes MGAS8232
uucgccuaggaauaaaau

SEQ ID NO: 4125663 - RNA, 20 nt, Streptococcus pyogenes MGAS8232
uucgccuaggaauaaaaugc

SEQ ID NO: 4125664 - RNA, 18 nt, Streptococcus pyogenes MGAS8232
uucguaaggguuacuauu

SEQ ID NO: 4125665 - RNA, 13 nt, Streptococcus pyogenes MGAS8232
uucguucuaguuu

SEQ ID NO: 4125666 - RNA, 18 nt, Streptococcus pyogenes MGAS8232
uucguugacaaagccauu

SEQ ID NO: 4125667 - RNA, 21 nt, Streptococcus pyogenes MGAS8232
uucguugacaacaauauguga

SEQ ID NO: 4125668 - RNA, 19 nt, Streptococcus pyogenes MGAS8232
uucuaaaugacaguauaca

SEQ ID NO: 4125669 - RNA, 18 nt, Streptococcus pyogenes MGAS8232
uucuaagagccaaaauaa

SEQ ID NO: 4125670 - RNA, 15 nt, Streptococcus pyogenes MGAS8232
uucuacuauugcaug

SEQ ID NO: 4125671 - RNA, 19 nt, Streptococcus pyogenes MGAS8232
uucuagguuaaaauagaag

SEQ ID NO: 4125672 - RNA, 23 nt, Streptococcus pyogenes MGAS8232
uucuaguuuaggauauaagaagg

SEQ ID NO: 4125673 - RNA, 18 nt, Streptococcus pyogenes MGAS8232
uucuaguuucauagaaga

SEQ ID NO: 4125674 - RNA, 19 nt, Streptococcus pyogenes MGAS8232
uucuaguuucauagaagac

SEQ ID NO: 4125675 - RNA, 17 nt, Streptococcus pyogenes MGAS8232
uucuaucaaaacguuau

SEQ ID NO: 4125676 - RNA, 12 nt, Streptococcus pyogenes MGAS8232
uucucaaaaaua

SEQ ID NO: 4125677 - RNA, 20 nt, Streptococcus pyogenes MGAS8232
uucucauaaacaaugaguca

SEQ ID NO: 4125678 - RNA, 15 nt, Streptococcus pyogenes MGAS8232
uucucauguuuuauu

SEQ ID NO: 4125679 - RNA, 23 nt, Streptococcus pyogenes MGAS8232
uucugaaaauaaaauauuuuucc

SEQ ID NO: 4125680 - RNA, 22 nt, Streptococcus pyogenes MGAS8232
uucugagauauucauuuucuuc

SEQ ID NO: 4125681 - RNA, 14 nt, Streptococcus pyogenes MGAS8232
uucuggugcaaggc

SEQ ID NO: 4125682 - RNA, 18 nt, Streptococcus pyogenes MGAS8232
uucugucuacuuauuuga

SEQ ID NO: 4125683 - RNA, 22 nt, Streptococcus pyogenes MGAS8232
uucuuaacgaucuauugacuug

SEQ ID NO: 4125684 - RNA, 16 nt, Streptococcus pyogenes MGAS8232
uucuugaggugauucu

SEQ ID NO: 4125685 - RNA, 20 nt, Streptococcus pyogenes MGAS8232
uucuugaggugauucuuuuu

SEQ ID NO: 4125686 - RNA, 23 nt, Streptococcus pyogenes MGAS8232
uucuuuauuuugauauuuuuucu

SEQ ID NO: 4125687 - RNA, 20 nt, Streptococcus pyogenes MGAS8232
uucuuuuaggccaccagaug

SEQ ID NO: 4125688 - RNA, 20 nt, Streptococcus pyogenes MGAS8232
uucuuuucagagaugcuucu

SEQ ID NO: 4125689 - RNA, 12 nt, Streptococcus pyogenes MGAS8232
uucuuuuuuacc

SEQ ID NO: 4125690 - RNA, 15 nt, Streptococcus pyogenes MGAS8232
uucuuuuuuaccuuu

SEQ ID NO: 4125691 - RNA, 18 nt, Streptococcus pyogenes MGAS8232
uugaaagaggugcaacug

SEQ ID NO: 4125692 - RNA, 21 nt, Streptococcus pyogenes MGAS8232
uugaauaucgccaauaaaaaa

SEQ ID NO: 4125693 - RNA, 13 nt, Streptococcus pyogenes MGAS8232
uugacaaagccau

SEQ ID NO: 4125694 - RNA, 18 nt, Streptococcus pyogenes MGAS8232
uugacagacaccaaaaaa

SEQ ID NO: 4125695 - RNA, 22 nt, Streptococcus pyogenes MGAS8232
uugacagacaccaaaaaaagca

SEQ ID NO: 4125696 - RNA, 16 nt, Streptococcus pyogenes MGAS8232
uugacaguuaaaaaua

SEQ ID NO: 4125697 - RNA, 15 nt, Streptococcus pyogenes MGAS8232
uugaccacaccuaau

SEQ ID NO: 4125698 - RNA, 24 nt, Streptococcus pyogenes MGAS8232
uugaccacaccuaauaaaauagca

SEQ ID NO: 4125699 - RNA, 21 nt, Streptococcus pyogenes MGAS8232
uugacuugguucugaaaauaa

SEQ ID NO: 4125700 - RNA, 18 nt, Streptococcus pyogenes MGAS8232
uugacuuguuacaaaaaa

SEQ ID NO: 4125701 - RNA, 13 nt, Streptococcus pyogenes MGAS8232
uugauacguuuau

SEQ ID NO: 4125702 - RNA, 16 nt, Streptococcus pyogenes MGAS8232
uugauacguuuauugu

SEQ ID NO: 4125703 - RNA, 13 nt, Streptococcus pyogenes MGAS8232
uugauauaaaauu

SEQ ID NO: 4125704 - RNA, 20 nt, Streptococcus pyogenes MGAS8232
uugauaucauaaguuaccaa

SEQ ID NO: 4125705 - RNA, 15 nt, Streptococcus pyogenes MGAS8232
uugauauuuuuucuc

SEQ ID NO: 4125706 - RNA, 22 nt, Streptococcus pyogenes MGAS8232
uugauauuuuuucucaaaaaua

SEQ ID NO: 4125707 - RNA, 22 nt, Streptococcus pyogenes MGAS8232
uugaugagguauuuauaaauau

SEQ ID NO: 4125708 - RNA, 15 nt, Streptococcus pyogenes MGAS8232
uugaugauugaguaa

SEQ ID NO: 4125709 - RNA, 21 nt, Streptococcus pyogenes MGAS8232
uugaugauugaguaagcagca

SEQ ID NO: 4125710 - RNA, 22 nt, Streptococcus pyogenes MGAS8232
uugaugauugaguaagcagcau

SEQ ID NO: 4125711 - RNA, 12 nt, Streptococcus pyogenes MGAS8232
uugcaccaccaa

SEQ ID NO: 4125712 - RNA, 16 nt, Streptococcus pyogenes MGAS8232
uugcagcuaaaaacaa

SEQ ID NO: 4125713 - RNA, 20 nt, Streptococcus pyogenes MGAS8232
uugcagguaauuaucugaau

SEQ ID NO: 4125714 - RNA, 17 nt, Streptococcus pyogenes MGAS8232
uugccauuaauaauauu

SEQ ID NO: 4125715 - RNA, 13 nt, Streptococcus pyogenes MGAS8232
uugccauuuaauu

SEQ ID NO: 4125716 - RNA, 18 nt, Streptococcus pyogenes MGAS8232
uugccugaaauauaaccu

SEQ ID NO: 4125717 - RNA, 14 nt, Streptococcus pyogenes MGAS8232
uuuuaugagaaaaa

SEQ ID NO: 4125718 - RNA, 23 nt, Streptococcus pyogenes MGAS8232
uuuuauuaauaaguauuuuaaaa

SEQ ID NO: 4125719 - RNA, 15 nt, Streptococcus pyogenes MGAS8232
uuuucaaaaucuuuu

SEQ ID NO: 4125720 - RNA, 17 nt, Streptococcus pyogenes MGAS8232
uuuucagagaugcuucu

SEQ ID NO: 4125721 - RNA, 23 nt, Streptococcus pyogenes MGAS8232
uuuucucaaaaauauauucuaau

SEQ ID NO: 4125722 - RNA, 15 nt, Streptococcus pyogenes MGAS8232
uuuucugguuuuaau

SEQ ID NO: 4125723 - RNA, 14 nt, Streptococcus pyogenes MGAS8232
uuuucuuuuuggcu

SEQ ID NO: 4125724 - RNA, 16 nt, Streptococcus pyogenes MGAS8232
uuuugaguuugaugag

SEQ ID NO: 4125725 - RNA, 20 nt, Streptococcus pyogenes MGAS8232
uuuugaugcagcuaaaagca

SEQ ID NO: 4125726 - RNA, 19 nt, Streptococcus pyogenes MGAS8232
uuuugcaggguaucugcuc

SEQ ID NO: 4125727 - RNA, 18 nt, Streptococcus pyogenes MGAS8232
uuuugguugauauaaaau

SEQ ID NO: 4125728 - RNA, 16 nt, Streptococcus pyogenes MGAS8232
uuuuguaucucauaac

SEQ ID NO: 4125729 - RNA, 15 nt, Streptococcus pyogenes MGAS8232
uuuugucuucuucuu

SEQ ID NO: 4125730 - RNA, 14 nt, Streptococcus pyogenes MGAS8232
uuuuuaauuauuuu

SEQ ID NO: 4125731 - RNA, 23 nt, Streptococcus pyogenes MGAS8232
uuuuucucaaaaauauauucuaa

SEQ ID NO: 4125732 - RNA, 15 nt, Streptococcus pyogenes MGAS8232
uuuuuguauuacuca

SEQ ID NO: 4125733 - RNA, 15 nt, Streptococcus pyogenes MGAS8232
uuuuugucuccuucu

SEQ ID NO: 4125734 - RNA, 22 nt, Streptococcus pyogenes MGAS8232
uuuuuuaagacuauguugcuua

SEQ ID NO: 4125735 - RNA, 17 nt, Streptococcus pyogenes MGAS8232
aaacuguauacaaaaag

SEQ ID NO: 4125736 - RNA, 15 nt, Streptococcus pyogenes MGAS8232
aaacugugaacaaaa

SEQ ID NO: 4125737 - RNA, 18 nt, Streptococcus pyogenes MGAS8232
aaacugugaacaaaacaa

SEQ ID NO: 4125738 - RNA, 21 nt, Streptococcus pyogenes MGAS8232
aaacuuauguuuauccucuua

SEQ ID NO: 4125739 - RNA, 13 nt, Streptococcus pyogenes MGAS8232
aaacuuuugacuu

SEQ ID NO: 4125740 - RNA, 14 nt, Streptococcus pyogenes MGAS8232
aaagacaaaaaaac

SEQ ID NO: 4125741 - RNA, 14 nt, Streptococcus pyogenes MGAS8232
aaagaccucucaug

SEQ ID NO: 4125742 - RNA, 14 nt, Streptococcus pyogenes MGAS8232
aaagacuucuuccu

SEQ ID NO: 4125743 - RNA, 18 nt, Streptococcus pyogenes MGAS8232
aaagagaaagaggaaaca

SEQ ID NO: 4125744 - RNA, 18 nt, Streptococcus pyogenes MGAS8232
aaagaggaaacaaaaacu

SEQ ID NO: 4125745 - RNA, 15 nt, Streptococcus pyogenes MGAS8232
aaagagucugagcaa

SEQ ID NO: 4125746 - RNA, 17 nt, Streptococcus pyogenes MGAS8232
aaagauaauuucuuuuu

SEQ ID NO: 4125747 - RNA, 16 nt, Streptococcus pyogenes MGAS8232
aaagauauuuuaaaau

SEQ ID NO: 4125748 - RNA, 20 nt, Streptococcus pyogenes MGAS8232
aaagauauuuuaaaauaguu

SEQ ID NO: 4125749 - RNA, 19 nt, Streptococcus pyogenes MGAS8232
aaagcaagggaaacaccac

SEQ ID NO: 4125750 - RNA, 15 nt, Streptococcus pyogenes MGAS8232
aaagccagagcaguu

SEQ ID NO: 4125751 - RNA, 20 nt, Streptococcus pyogenes MGAS8232
aaagcccuuauguauuuuuc

SEQ ID NO: 4125752 - RNA, 17 nt, Streptococcus pyogenes MGAS8232
aaagcuaaguaagcuuc

SEQ ID NO: 4125753 - RNA, 15 nt, Streptococcus pyogenes MGAS8232
aaagcuucaucgaug

SEQ ID NO: 4125754 - RNA, 15 nt, Streptococcus pyogenes MGAS8232
aaagcuuuaaaaaau

SEQ ID NO: 4125755 - RNA, 15 nt, Streptococcus pyogenes MGAS8232
aaaggcaaagaaagc

SEQ ID NO: 4125756 - RNA, 23 nt, Streptococcus pyogenes MGAS8232
aaaggcuuuuuuguauuacucaa

SEQ ID NO: 4125757 - RNA, 13 nt, Streptococcus pyogenes MGAS8232
aaagggaagaaga

SEQ ID NO: 4125758 - RNA, 12 nt, Streptococcus pyogenes MGAS8232
aaaguaaaaucu

SEQ ID NO: 4125759 - RNA, 20 nt, Streptococcus pyogenes MGAS8232
aaaguaaggguuaacaauga

SEQ ID NO: 4125760 - RNA, 22 nt, Streptococcus pyogenes MGAS8232
aaaguaauaaguagcguacaug

SEQ ID NO: 4125761 - RNA, 15 nt, Streptococcus pyogenes MGAS8232
aaaguaguuucucau

SEQ ID NO: 4125762 - RNA, 20 nt, Streptococcus pyogenes MGAS8232
aaaguuauucccauauaugc

SEQ ID NO: 4125763 - RNA, 15 nt, Streptococcus pyogenes MGAS8232
aaaguuggcuacucu

SEQ ID NO: 4125764 - RNA, 11 nt, Streptococcus pyogenes MGAS8232
aaaguuuucuc

SEQ ID NO: 4125765 - RNA, 16 nt, Streptococcus pyogenes MGAS8232
aaaguuuucucagaga

SEQ ID NO: 4125766 - RNA, 14 nt, Streptococcus pyogenes MGAS8232
aaauaaaauauuuu

SEQ ID NO: 4125767 - RNA, 13 nt, Streptococcus pyogenes MGAS8232
aaauaaaaucguu

SEQ ID NO: 4125768 - RNA, 13 nt, Streptococcus pyogenes MGAS8232
aaauaaacuuuca

SEQ ID NO: 4125769 - RNA, 20 nt, Streptococcus pyogenes MGAS8232
aaauaacaucaaaggguguu

SEQ ID NO: 4125770 - RNA, 14 nt, Streptococcus pyogenes MGAS8232
aaauaacuuuaaaa

SEQ ID NO: 4125771 - RNA, 15 nt, Streptococcus pyogenes MGAS8232
aaauaacuuuaaaag

SEQ ID NO: 4125772 - RNA, 16 nt, Streptococcus pyogenes MGAS8232
aaauacagaagaaagc

SEQ ID NO: 4125773 - RNA, 19 nt, Streptococcus pyogenes MGAS8232
aaauacagaagaaagcuug

SEQ ID NO: 4125774 - RNA, 19 nt, Streptococcus pyogenes MGAS8232
aaauagcaaugguuaaaaa

SEQ ID NO: 4125775 - RNA, 18 nt, Streptococcus pyogenes MGAS8232
aaauauaaccucuagcuu

SEQ ID NO: 4125776 - RNA, 12 nt, Streptococcus pyogenes MGAS8232
aaauaucuagaa

SEQ ID NO: 4125777 - RNA, 15 nt, Streptococcus pyogenes MGAS8232
aaauaucuuaccauu

SEQ ID NO: 4125778 - RNA, 18 nt, Streptococcus pyogenes MGAS8232
aaauaucuuuuuuacuuu

SEQ ID NO: 4125779 - RNA, 21 nt, Streptococcus pyogenes MGAS8232
aaaucaugggaaaagcuaagu

SEQ ID NO: 4125780 - RNA, 20 nt, Streptococcus pyogenes MGAS8232
aaauccuuuugaaaaauuau

SEQ ID NO: 4125781 - RNA, 14 nt, Streptococcus pyogenes MGAS8232
aaauccuuuugcuu

SEQ ID NO: 4125782 - RNA, 17 nt, Streptococcus pyogenes MGAS8232
aaaucuguauuccauac

SEQ ID NO: 4125783 - RNA, 17 nt, Streptococcus pyogenes MGAS8232
aaaugaagcugaagcua

SEQ ID NO: 4125784 - RNA, 14 nt, Streptococcus pyogenes MGAS8232
aaaugacuucaaaa

SEQ ID NO: 4125785 - RNA, 13 nt, Streptococcus pyogenes MGAS8232
aaaugauagcacc

SEQ ID NO: 4125786 - RNA, 13 nt, Streptococcus pyogenes MGAS8232
aaaugauccuuuc

SEQ ID NO: 4125787 - RNA, 16 nt, Streptococcus pyogenes MGAS8232
aaaugccaaucuuugu

SEQ ID NO: 4125788 - RNA, 17 nt, Streptococcus pyogenes MGAS8232
aaaugccaaucuuugug

SEQ ID NO: 4125789 - RNA, 19 nt, Streptococcus pyogenes MGAS8232
aaauguacauccuaauggu

SEQ ID NO: 4125790 - RNA, 18 nt, Streptococcus pyogenes MGAS8232
aaauguccgaaaaaaacu

SEQ ID NO: 4125791 - RNA, 16 nt, Streptococcus pyogenes MGAS8232
aaauuaauaaauuuuu

SEQ ID NO: 4125792 - RNA, 15 nt, Streptococcus pyogenes MGAS8232
aaauuaguuaucuca

SEQ ID NO: 4125793 - RNA, 16 nt, Streptococcus pyogenes MGAS8232
aaauuaguuaucucau

SEQ ID NO: 4125794 - RNA, 16 nt, Streptococcus pyogenes MGAS8232
aaauuauaguauaccu

SEQ ID NO: 4125795 - RNA, 13 nt, Streptococcus pyogenes MGAS8232
aaauucaaauacu

SEQ ID NO: 4125796 - RNA, 14 nt, Streptococcus pyogenes MGAS8232
aaauuccccacaaa

SEQ ID NO: 4125797 - RNA, 17 nt, Streptococcus pyogenes MGAS8232
aaauuccccacaaaaga

SEQ ID NO: 4125798 - RNA, 18 nt, Streptococcus pyogenes MGAS8232
aaauuccccacaaaagac

SEQ ID NO: 4125799 - RNA, 19 nt, Streptococcus pyogenes MGAS8232
aaauuccccacaaaagaca

SEQ ID NO: 4125800 - RNA, 20 nt, Streptococcus pyogenes MGAS8232
aaauuccccacaaaagacaa

SEQ ID NO: 4125801 - RNA, 23 nt, Streptococcus pyogenes MGAS8232
aaauucuuuuugaauugaaaaaa

SEQ ID NO: 4125802 - RNA, 17 nt, Streptococcus pyogenes MGAS8232
aaauuguaaccacagca

SEQ ID NO: 4125803 - RNA, 14 nt, Streptococcus pyogenes MGAS8232
aaauuguuugauug

SEQ ID NO: 4125804 - RNA, 12 nt, Streptococcus pyogenes MGAS8232
aaauuuuaaaug

SEQ ID NO: 4125805 - RNA, 13 nt, Streptococcus pyogenes MGAS8232
aaauuuuauugca

SEQ ID NO: 4125806 - RNA, 22 nt, Streptococcus pyogenes MGAS8232
aaauuuuuuucaugauguuuau

SEQ ID NO: 4125807 - RNA, 13 nt, Streptococcus pyogenes MGAS8232
aacaaaacaaaac

SEQ ID NO: 4125808 - RNA, 16 nt, Streptococcus pyogenes MGAS8232
aacaaaacaaaacaaa

SEQ ID NO: 4125809 - RNA, 12 nt, Streptococcus pyogenes MGAS8232
aacaaaaucaca

SEQ ID NO: 4125810 - RNA, 14 nt, Streptococcus pyogenes MGAS8232
aacaaaaugaagca

SEQ ID NO: 4125811 - RNA, 14 nt, Streptococcus pyogenes MGAS8232
aacaaauaauuccu

SEQ ID NO: 4125812 - RNA, 15 nt, Streptococcus pyogenes MGAS8232
aacaauaacacagaa

SEQ ID NO: 4125813 - RNA, 20 nt, Streptococcus pyogenes MGAS8232
aacaccccccccgcuuuuaa

SEQ ID NO: 4125814 - RNA, 13 nt, Streptococcus pyogenes MGAS8232
aacacucaucaua

SEQ ID NO: 4125815 - RNA, 18 nt, Streptococcus pyogenes MGAS8232
aacacucaucauauuguu

SEQ ID NO: 4125816 - RNA, 22 nt, Streptococcus pyogenes MGAS8232
aacagauaagugccaucaggcu

SEQ ID NO: 4125817 - RNA, 18 nt, Streptococcus pyogenes MGAS8232
aacagcauuuucaucauc

SEQ ID NO: 4125818 - RNA, 22 nt, Streptococcus pyogenes MGAS8232
aacagcugcuugaaaagaugca

SEQ ID NO: 4125819 - RNA, 17 nt, Streptococcus pyogenes MGAS8232
aacaguuccaguucugu

SEQ ID NO: 4125820 - RNA, 15 nt, Streptococcus pyogenes MGAS8232
aacaucuugauugua

SEQ ID NO: 4125821 - RNA, 17 nt, Streptococcus pyogenes MGAS8232
aacaucuugauuguaag

SEQ ID NO: 4125822 - RNA, 17 nt, Streptococcus pyogenes MGAS8232
aacaugccuuucacagc

SEQ ID NO: 4125823 - RNA, 22 nt, Streptococcus pyogenes MGAS8232
aaccaagugccaguaaggaaau

SEQ ID NO: 4125824 - RNA, 19 nt, Streptococcus pyogenes MGAS8232
aaccaauuguugaauaagu

SEQ ID NO: 4125825 - RNA, 17 nt, Streptococcus pyogenes MGAS8232
aaccacagcaauuuguu

SEQ ID NO: 4125826 - RNA, 17 nt, Streptococcus pyogenes MGAS8232
aaccauagaagccaauu

SEQ ID NO: 4125827 - RNA, 16 nt, Streptococcus pyogenes MGAS8232
aaccauaucacaaaac

SEQ ID NO: 4125828 - RNA, 19 nt, Streptococcus pyogenes MGAS8232
aaccauaucacaaaacccu

SEQ ID NO: 4125829 - RNA, 20 nt, Streptococcus pyogenes MGAS8232
aaccauaucacaaaacccuu

SEQ ID NO: 4125830 - RNA, 18 nt, Streptococcus pyogenes MGAS8232
aaccauaucgacauuuau

SEQ ID NO: 4125831 - RNA, 13 nt, Streptococcus pyogenes MGAS8232
aaccauugccauu

SEQ ID NO: 4125832 - RNA, 17 nt, Streptococcus pyogenes MGAS8232
aaccauuuuaugagaaa

SEQ ID NO: 4125833 - RNA, 12 nt, Streptococcus pyogenes MGAS8232
aaguuaccaauu

SEQ ID NO: 4125834 - RNA, 23 nt, Streptococcus pyogenes MGAS8232
aaguuagggucugagugacuaaa

SEQ ID NO: 4125835 - RNA, 20 nt, Streptococcus pyogenes MGAS8232
aaguuauaaagaaacaaaaa

SEQ ID NO: 4125836 - RNA, 18 nt, Streptococcus pyogenes MGAS8232
aaguuccuuagcaguuau

SEQ ID NO: 4125837 - RNA, 11 nt, Streptococcus pyogenes MGAS8232
aaguucuuugc

SEQ ID NO: 4125838 - RNA, 12 nt, Streptococcus pyogenes MGAS8232
aaguucuuugcc

SEQ ID NO: 4125839 - RNA, 20 nt, Streptococcus pyogenes MGAS8232
aaguugagacuaaaggucug

SEQ ID NO: 4125840 - RNA, 17 nt, Streptococcus pyogenes MGAS8232
aaguuggcuacucuauu

SEQ ID NO: 4125841 - RNA, 14 nt, Streptococcus pyogenes MGAS8232
aauaaaauagcacc

SEQ ID NO: 4125842 - RNA, 15 nt, Streptococcus pyogenes MGAS8232
aauaaaauagcaccu

SEQ ID NO: 4125843 - RNA, 19 nt, Streptococcus pyogenes MGAS8232
aauaaaaucguuauuaauu

SEQ ID NO: 4125844 - RNA, 17 nt, Streptococcus pyogenes MGAS8232
aauaaagauaauuucuu

SEQ ID NO: 4125845 - RNA, 22 nt, Streptococcus pyogenes MGAS8232
aauaaagcguugacaguuaaaa

SEQ ID NO: 4125846 - RNA, 17 nt, Streptococcus pyogenes MGAS8232
aauaaagugcgcuucca

SEQ ID NO: 4125847 - RNA, 22 nt, Streptococcus pyogenes MGAS8232
aauaacagaaauuaauaaauuu

SEQ ID NO: 4125848 - RNA, 12 nt, Streptococcus pyogenes MGAS8232
aauaacaucaaa

SEQ ID NO: 4125849 - RNA, 13 nt, Streptococcus pyogenes MGAS8232
aauaacaucaaag

SEQ ID NO: 4125850 - RNA, 20 nt, Streptococcus pyogenes MGAS8232
aauaacaucuugauuguaag

SEQ ID NO: 4125851 - RNA, 24 nt, Streptococcus pyogenes MGAS8232
aauaacccgucuuacaauuaauag

SEQ ID NO: 4125852 - RNA, 16 nt, Streptococcus pyogenes MGAS8232
aauaaggucaucagaa

SEQ ID NO: 4125853 - RNA, 19 nt, Streptococcus pyogenes MGAS8232
aauaauacagcauacauca

SEQ ID NO: 4125854 - RNA, 22 nt, Streptococcus pyogenes MGAS8232
aauaaugagcaaggcaagagga

SEQ ID NO: 4125855 - RNA, 15 nt, Streptococcus pyogenes MGAS8232
aauacagaagaaagc

SEQ ID NO: 4125856 - RNA, 20 nt, Streptococcus pyogenes MGAS8232
aauacagccguucuuaaaag

SEQ ID NO: 4125857 - RNA, 14 nt, Streptococcus pyogenes MGAS8232
aauaccauuuuuau

SEQ ID NO: 4125858 - RNA, 15 nt, Streptococcus pyogenes MGAS8232
aauagaauaaaaaga

SEQ ID NO: 4125859 - RNA, 17 nt, Streptococcus pyogenes MGAS8232
aauagcaaugguuaaaa

SEQ ID NO: 4125860 - RNA, 22 nt, Streptococcus pyogenes MGAS8232
aauagcauugucaaauaaaauc

SEQ ID NO: 4125861 - RNA, 19 nt, Streptococcus pyogenes MGAS8232
aauagcugcugcuaaagca

SEQ ID NO: 4125862 - RNA, 18 nt, Streptococcus pyogenes MGAS8232
aauagguaaagauuuuaa

SEQ ID NO: 4125863 - RNA, 20 nt, Streptococcus pyogenes MGAS8232
aauaguucccuuaauaaacu

SEQ ID NO: 4125864 - RNA, 16 nt, Streptococcus pyogenes MGAS8232
aauauaaggcaaucac

SEQ ID NO: 4125865 - RNA, 15 nt, Streptococcus pyogenes MGAS8232
aauauaauaaaaagu

SEQ ID NO: 4125866 - RNA, 19 nt, Streptococcus pyogenes MGAS8232
aauauaauucauguuuaaa

SEQ ID NO: 4125867 - RNA, 11 nt, Streptococcus pyogenes MGAS8232
aauauagcaau

SEQ ID NO: 4125868 - RNA, 15 nt, Streptococcus pyogenes MGAS8232
aauaucacauuuuaa

SEQ ID NO: 4125869 - RNA, 17 nt, Streptococcus pyogenes MGAS8232
aauaucaggcaaaacaa

SEQ ID NO: 4125870 - RNA, 14 nt, Streptococcus pyogenes MGAS8232
aauaucaugaagua

SEQ ID NO: 4125871 - RNA, 17 nt, Streptococcus pyogenes MGAS8232
aauaucgccaauaaaaa

SEQ ID NO: 4125872 - RNA, 21 nt, Streptococcus pyogenes MGAS8232
aauaucgccaauaaaaaagaa

SEQ ID NO: 4125873 - RNA, 24 nt, Streptococcus pyogenes MGAS8232
aauaugaaaacguguauucuuaaa

SEQ ID NO: 4125874 - RNA, 15 nt, Streptococcus pyogenes MGAS8232
aauaugauauaaaaa

SEQ ID NO: 4125875 - RNA, 17 nt, Streptococcus pyogenes MGAS8232
aauaugauauaaaaaug

SEQ ID NO: 4125876 - RNA, 13 nt, Streptococcus pyogenes MGAS8232
aauaugugauuau

SEQ ID NO: 4125877 - RNA, 21 nt, Streptococcus pyogenes MGAS8232
aauauuauaguauuaucucau

SEQ ID NO: 4125878 - RNA, 17 nt, Streptococcus pyogenes MGAS8232
aauauuauauuaaauua

SEQ ID NO: 4125879 - RNA, 12 nt, Streptococcus pyogenes MGAS8232
aauauuuccuuu

SEQ ID NO: 4125880 - RNA, 20 nt, Streptococcus pyogenes MGAS8232
aauauuuccuuuuaaagaca

SEQ ID NO: 4125881 - RNA, 14 nt, Streptococcus pyogenes MGAS8232
aauauuuuauuaau

SEQ ID NO: 4125882 - RNA, 12 nt, Streptococcus pyogenes MGAS8232
aaucagaacucg

SEQ ID NO: 4125883 - RNA, 13 nt, Streptococcus pyogenes MGAS8232
aaucgaaaugaua

SEQ ID NO: 4125884 - RNA, 18 nt, Streptococcus pyogenes MGAS8232
aaucgaacaauaauauaa

SEQ ID NO: 4125885 - RNA, 18 nt, Streptococcus pyogenes MGAS8232
aaucgcuuuaggaauauc

SEQ ID NO: 4125886 - RNA, 22 nt, Streptococcus pyogenes MGAS8232
aaucuaagaauuggggcggcac

SEQ ID NO: 4125887 - RNA, 16 nt, Streptococcus pyogenes MGAS8232
aaucuucaacaccuuc

SEQ ID NO: 4125888 - RNA, 14 nt, Streptococcus pyogenes MGAS8232
aaucuuguuuaacc

SEQ ID NO: 4125889 - RNA, 18 nt, Streptococcus pyogenes MGAS8232
aaucuuuauaaagcuuua

SEQ ID NO: 4125890 - RNA, 12 nt, Streptococcus pyogenes MGAS8232
aaucuuuucuau

SEQ ID NO: 4125891 - RNA, 14 nt, Streptococcus pyogenes MGAS8232
aaugaaaaaacuca

SEQ ID NO: 4125892 - RNA, 23 nt, Streptococcus pyogenes MGAS8232
aaugaaacguuauuaaagacaaa

SEQ ID NO: 4125893 - RNA, 15 nt, Streptococcus pyogenes MGAS8232
aaugaccuuugauaa

SEQ ID NO: 4125894 - RNA, 16 nt, Streptococcus pyogenes MGAS8232
aaugagaucuucuuuu

SEQ ID NO: 4125895 - RNA, 13 nt, Streptococcus pyogenes MGAS8232
aaugagcaaggca

SEQ ID NO: 4125896 - RNA, 14 nt, Streptococcus pyogenes MGAS8232
aaugauaaggcugc

SEQ ID NO: 4125897 - RNA, 19 nt, Streptococcus pyogenes MGAS8232
aaugauuuuuaauucuucu

SEQ ID NO: 4125898 - RNA, 16 nt, Streptococcus pyogenes MGAS8232
aaugcaaaaaagcucu

SEQ ID NO: 4125899 - RNA, 15 nt, Streptococcus pyogenes MGAS8232
aaugccaaucuuugu

SEQ ID NO: 4125900 - RNA, 24 nt, Streptococcus pyogenes MGAS8232
aaugcuguuugucauacucaauag

SEQ ID NO: 4125901 - RNA, 20 nt, Streptococcus pyogenes MGAS8232
aauggaaauuuuaaaugaca

SEQ ID NO: 4125902 - RNA, 14 nt, Streptococcus pyogenes MGAS8232
aaugguaaaggccu

SEQ ID NO: 4125903 - RNA, 16 nt, Streptococcus pyogenes MGAS8232
aauguccgaaaaaaac

SEQ ID NO: 4125904 - RNA, 12 nt, Streptococcus pyogenes MGAS8232
aaugucuuguuc

SEQ ID NO: 4125905 - RNA, 21 nt, Streptococcus pyogenes MGAS8232
aaugugacaauuggugauuaa

SEQ ID NO: 4125906 - RNA, 12 nt, Streptococcus pyogenes MGAS8232
aauguuuugcuc

SEQ ID NO: 4125907 - RNA, 16 nt, Streptococcus pyogenes MGAS8232
aauuaaaccauucuaa

SEQ ID NO: 4125908 - RNA, 16 nt, Streptococcus pyogenes MGAS8232
aauuaauaaauuuuug

SEQ ID NO: 4125909 - RNA, 19 nt, Streptococcus pyogenes MGAS8232
aauuagcauauuuugauua

SEQ ID NO: 4125910 - RNA, 22 nt, Streptococcus pyogenes MGAS8232
aauuaguuaucucauaaaaaag

SEQ ID NO: 4125911 - RNA, 15 nt, Streptococcus pyogenes MGAS8232
aauuaugcaaaagau

SEQ ID NO: 4125912 - RNA, 14 nt, Streptococcus pyogenes MGAS8232
aauuauuaguaacc

SEQ ID NO: 4125913 - RNA, 18 nt, Streptococcus pyogenes MGAS8232
aauuccccacaaaagaca

SEQ ID NO: 4125914 - RNA, 19 nt, Streptococcus pyogenes MGAS8232
aauucuuuuauuaauguaa

SEQ ID NO: 4125915 - RNA, 20 nt, Streptococcus pyogenes MGAS8232
aauucuuuuauuaauguaaa

SEQ ID NO: 4125916 - RNA, 13 nt, Streptococcus pyogenes MGAS8232
aauuguugaauaa

SEQ ID NO: 4125917 - RNA, 15 nt, Streptococcus pyogenes MGAS8232
aauuuagucauuucu

SEQ ID NO: 4125918 - RNA, 15 nt, Streptococcus pyogenes MGAS8232
aauuuauuccauuua

SEQ ID NO: 4125919 - RNA, 16 nt, Streptococcus pyogenes MGAS8232
aauuuauuccauuuau

SEQ ID NO: 4125920 - RNA, 17 nt, Streptococcus pyogenes MGAS8232
aauuucaauaauaccau

SEQ ID NO: 4125921 - RNA, 20 nt, Streptococcus pyogenes MGAS8232
aauuucuuuuucauuuguaa

SEQ ID NO: 4125922 - RNA, 12 nt, Streptococcus pyogenes MGAS8232
aauuuuuccuua

SEQ ID NO: 4125923 - RNA, 10 nt, Streptococcus pyogenes MGAS8232
aauuuuucuu

SEQ ID NO: 4125924 - RNA, 14 nt, Streptococcus pyogenes MGAS8232
acaaaacaaaacaa

SEQ ID NO: 4125925 - RNA, 16 nt, Streptococcus pyogenes MGAS8232
acaaaacaaaacaaaa

SEQ ID NO: 4125926 - RNA, 15 nt, Streptococcus pyogenes MGAS8232
acaaaacaaaacaua

SEQ ID NO: 4125927 - RNA, 16 nt, Streptococcus pyogenes MGAS8232
acaaaacccuuucgua

SEQ ID NO: 4125928 - RNA, 20 nt, Streptococcus pyogenes MGAS8232
acaaaaugaagcaaaauaaa

SEQ ID NO: 4125929 - RNA, 14 nt, Streptococcus pyogenes MGAS8232
acaaagcaucagga

SEQ ID NO: 4125930 - RNA, 19 nt, Streptococcus pyogenes MGAS8232
acaaauacagaagaaagcu

SEQ ID NO: 4125931 - RNA, 14 nt, Streptococcus pyogenes MGAS8232
acucaauugaaaga

SEQ ID NO: 4125932 - RNA, 18 nt, Streptococcus pyogenes MGAS8232
acucaucauauuguuaau

SEQ ID NO: 4125933 - RNA, 20 nt, Streptococcus pyogenes MGAS8232
acucccuuuaauucuuuaau

SEQ ID NO: 4125934 - RNA, 19 nt, Streptococcus pyogenes MGAS8232
acuccuggauuaaaugccc

SEQ ID NO: 4125935 - RNA, 13 nt, Streptococcus pyogenes MGAS8232
acucuauuuacuc

SEQ ID NO: 4125936 - RNA, 20 nt, Streptococcus pyogenes MGAS8232
acucuauuuuaaguaaagga

SEQ ID NO: 4125937 - RNA, 15 nt, Streptococcus pyogenes MGAS8232
acucuccaaaguucu

SEQ ID NO: 4125938 - RNA, 18 nt, Streptococcus pyogenes MGAS8232
acugagccccaaaaguug

SEQ ID NO: 4125939 - RNA, 18 nt, Streptococcus pyogenes MGAS8232
acuggcauagaaauaguu

SEQ ID NO: 4125940 - RNA, 13 nt, Streptococcus pyogenes MGAS8232
acuggucaaaagc

SEQ ID NO: 4125941 - RNA, 13 nt, Streptococcus pyogenes MGAS8232
acuguaauauuuc

SEQ ID NO: 4125942 - RNA, 21 nt, Streptococcus pyogenes MGAS8232
acuguaauauuuccuuuuaaa

SEQ ID NO: 4125943 - RNA, 17 nt, Streptococcus pyogenes MGAS8232
acugugaacaaaacaaa

SEQ ID NO: 4125944 - RNA, 15 nt, Streptococcus pyogenes MGAS8232
acuuacaaaaagccu

SEQ ID NO: 4125945 - RNA, 21 nt, Streptococcus pyogenes MGAS8232
acuuaccagcaccuucuuuua

SEQ ID NO: 4125946 - RNA, 23 nt, Streptococcus pyogenes MGAS8232
acuuauuauuuugggacuaggaa

SEQ ID NO: 4125947 - RNA, 15 nt, Streptococcus pyogenes MGAS8232
acuuauuuuuuuaag

SEQ ID NO: 4125948 - RNA, 16 nt, Streptococcus pyogenes MGAS8232
acuuauuuuuuuaaga

SEQ ID NO: 4125949 - RNA, 22 nt, Streptococcus pyogenes MGAS8232
acuucaagcauaauaaaaagag

SEQ ID NO: 4125950 - RNA, 16 nt, Streptococcus pyogenes MGAS8232
acuucaaggaaggcuu

SEQ ID NO: 4125951 - RNA, 21 nt, Streptococcus pyogenes MGAS8232
acuucaaggaaggcuuguucu

SEQ ID NO: 4125952 - RNA, 22 nt, Streptococcus pyogenes MGAS8232
acuuccaaaccauuuuaugaga

SEQ ID NO: 4125953 - RNA, 23 nt, Streptococcus pyogenes MGAS8232
acuuccaucaucgaguggauaca

SEQ ID NO: 4125954 - RNA, 17 nt, Streptococcus pyogenes MGAS8232
acuugcaucgcaaacag

SEQ ID NO: 4125955 - RNA, 16 nt, Streptococcus pyogenes MGAS8232
acuugcuuugacaaag

SEQ ID NO: 4125956 - RNA, 14 nt, Streptococcus pyogenes MGAS8232
acuugggagaguuc

SEQ ID NO: 4125957 - RNA, 21 nt, Streptococcus pyogenes MGAS8232
acuugguucugaaaauaaaau

SEQ ID NO: 4125958 - RNA, 19 nt, Streptococcus pyogenes MGAS8232
acuuguuacaaaaaacaag

SEQ ID NO: 4125959 - RNA, 21 nt, Streptococcus pyogenes MGAS8232
acuuuaaacacuaccuuaaau

SEQ ID NO: 4125960 - RNA, 17 nt, Streptococcus pyogenes MGAS8232
acuuuauugaugauaaa

SEQ ID NO: 4125961 - RNA, 22 nt, Streptococcus pyogenes MGAS8232
acuuuauugaugauaaaggccu

SEQ ID NO: 4125962 - RNA, 22 nt, Streptococcus pyogenes MGAS8232
acuuucaguuaucugauauuuc

SEQ ID NO: 4125963 - RNA, 14 nt, Streptococcus pyogenes MGAS8232
acuuucuacuauug

SEQ ID NO: 4125964 - RNA, 23 nt, Streptococcus pyogenes MGAS8232
acuuucuauuaccuauagaaagu

SEQ ID NO: 4125965 - RNA, 19 nt, Streptococcus pyogenes MGAS8232
acuuugacagacaccaaaa

SEQ ID NO: 4125966 - RNA, 21 nt, Streptococcus pyogenes MGAS8232
acuuugacagacaccaaaaaa

SEQ ID NO: 4125967 - RNA, 12 nt, Streptococcus pyogenes MGAS8232
acuuuuaaaauc

SEQ ID NO: 4125968 - RNA, 18 nt, Streptococcus pyogenes MGAS8232
agaaaaauaaguguguga

SEQ ID NO: 4125969 - RNA, 22 nt, Streptococcus pyogenes MGAS8232
agaaaauuuuccgucguuuuuu

SEQ ID NO: 4125970 - RNA, 14 nt, Streptococcus pyogenes MGAS8232
agaaacaaaaauga

SEQ ID NO: 4125971 - RNA, 15 nt, Streptococcus pyogenes MGAS8232
agaaacuaaaggcaa

SEQ ID NO: 4125972 - RNA, 16 nt, Streptococcus pyogenes MGAS8232
agaaagaggaaacaaa

SEQ ID NO: 4125973 - RNA, 17 nt, Streptococcus pyogenes MGAS8232
agaaagaggaaacaaaa

SEQ ID NO: 4125974 - RNA, 13 nt, Streptococcus pyogenes MGAS8232
agaaauagucucc

SEQ ID NO: 4125975 - RNA, 14 nt, Streptococcus pyogenes MGAS8232
agaaauuaauaaau

SEQ ID NO: 4125976 - RNA, 15 nt, Streptococcus pyogenes MGAS8232
agaacagcauuuuca

SEQ ID NO: 4125977 - RNA, 22 nt, Streptococcus pyogenes MGAS8232
agaacgaauugugucauuucuu

SEQ ID NO: 4125978 - RNA, 17 nt, Streptococcus pyogenes MGAS8232
agaacuuuacaaucauu

SEQ ID NO: 4125979 - RNA, 14 nt, Streptococcus pyogenes MGAS8232
agaagcaaaauuau

SEQ ID NO: 4125980 - RNA, 14 nt, Streptococcus pyogenes MGAS8232
agaagccaauuacu

SEQ ID NO: 4125981 - RNA, 23 nt, Streptococcus pyogenes MGAS8232
agaaggucucaaauuuuuuucau

SEQ ID NO: 4125982 - RNA, 22 nt, Streptococcus pyogenes MGAS8232
agaaguugagacuaaaggucug

SEQ ID NO: 4125983 - RNA, 16 nt, Streptococcus pyogenes MGAS8232
agaauagguaaagauu

SEQ ID NO: 4125984 - RNA, 14 nt, Streptococcus pyogenes MGAS8232
agaaucaaggggau

SEQ ID NO: 4125985 - RNA, 15 nt, Streptococcus pyogenes MGAS8232
agaauccuccucuuu

SEQ ID NO: 4125986 - RNA, 22 nt, Streptococcus pyogenes MGAS8232
agaauucuuagguggagcuuua

SEQ ID NO: 4125987 - RNA, 21 nt, Streptococcus pyogenes MGAS8232
agaauuggggcggcacuucca

SEQ ID NO: 4125988 - RNA, 19 nt, Streptococcus pyogenes MGAS8232
agacaaggugaauauaaga

SEQ ID NO: 4125989 - RNA, 21 nt, Streptococcus pyogenes MGAS8232
agacaauaaggucaucagaau

SEQ ID NO: 4125990 - RNA, 20 nt, Streptococcus pyogenes MGAS8232
agacaucacgauuugcugag

SEQ ID NO: 4125991 - RNA, 18 nt, Streptococcus pyogenes MGAS8232
agaccuuauuaaagcccu

SEQ ID NO: 4125992 - RNA, 13 nt, Streptococcus pyogenes MGAS8232
agaccuucaaaaa

SEQ ID NO: 4125993 - RNA, 15 nt, Streptococcus pyogenes MGAS8232
agaccuucaaaaaag

SEQ ID NO: 4125994 - RNA, 23 nt, Streptococcus pyogenes MGAS8232
agacucaauugaaagaggugcaa

SEQ ID NO: 4125995 - RNA, 14 nt, Streptococcus pyogenes MGAS8232
agacuuaaggauuu

SEQ ID NO: 4125996 - RNA, 22 nt, Streptococcus pyogenes MGAS8232
agacuuauaugaaagaacuauu

SEQ ID NO: 4125997 - RNA, 15 nt, Streptococcus pyogenes MGAS8232
agacuuuuaauguau

SEQ ID NO: 4125998 - RNA, 13 nt, Streptococcus pyogenes MGAS8232
agagaaagaggaa

SEQ ID NO: 4125999 - RNA, 17 nt, Streptococcus pyogenes MGAS8232
agagagguugguaaaaa

SEQ ID NO: 4126000 - RNA, 22 nt, Streptococcus pyogenes MGAS8232
agagagguugguaaaaaggcag

SEQ ID NO: 4126001 - RNA, 18 nt, Streptococcus pyogenes MGAS8232
agagauaaaaaguaaaau

SEQ ID NO: 4126002 - RNA, 16 nt, Streptococcus pyogenes MGAS8232
agagaugauagguuuu

SEQ ID NO: 4126003 - RNA, 17 nt, Streptococcus pyogenes MGAS8232
agagcaguucagcagca

SEQ ID NO: 4126004 - RNA, 19 nt, Streptococcus pyogenes MGAS8232
agagcaguucagcagcacu

SEQ ID NO: 4126005 - RNA, 20 nt, Streptococcus pyogenes MGAS8232
agagcaguucagcagcacug

SEQ ID NO: 4126006 - RNA, 14 nt, Streptococcus pyogenes MGAS8232
agagccaaaauaac

SEQ ID NO: 4126007 - RNA, 15 nt, Streptococcus pyogenes MGAS8232
agaguacaaggcaau

SEQ ID NO: 4126008 - RNA, 16 nt, Streptococcus pyogenes MGAS8232
agaguacaaggcaauc

SEQ ID NO: 4126009 - RNA, 19 nt, Streptococcus pyogenes MGAS8232
agaguacaaggcaauccaa

SEQ ID NO: 4126010 - RNA, 21 nt, Streptococcus pyogenes MGAS8232
agagucuuaguuuaggaauca

SEQ ID NO: 4126011 - RNA, 20 nt, Streptococcus pyogenes MGAS8232
agauaagaccuucaaaaaag

SEQ ID NO: 4126012 - RNA, 21 nt, Streptococcus pyogenes MGAS8232
agauaagaccuucaaaaaagg

SEQ ID NO: 4126013 - RNA, 13 nt, Streptococcus pyogenes MGAS8232
agauacuucggua

SEQ ID NO: 4126014 - RNA, 21 nt, Streptococcus pyogenes MGAS8232
agauacuucgguauucuuuuu

SEQ ID NO: 4126015 - RNA, 23 nt, Streptococcus pyogenes MGAS8232
agauacuucgguauucuuuuucc

SEQ ID NO: 4126016 - RNA, 20 nt, Streptococcus pyogenes MGAS8232
agauauuguuaauauagucu

SEQ ID NO: 4126017 - RNA, 15 nt, Streptococcus pyogenes MGAS8232
agaugacgguaaaua

SEQ ID NO: 4126018 - RNA, 23 nt, Streptococcus pyogenes MGAS8232
agaugauuauauuaggauauaga

SEQ ID NO: 4126019 - RNA, 20 nt, Streptococcus pyogenes MGAS8232
agaugcuugcucaauuuuug

SEQ ID NO: 4126020 - RNA, 17 nt, Streptococcus pyogenes MGAS8232
agauggguuagcucugu

SEQ ID NO: 4126021 - RNA, 16 nt, Streptococcus pyogenes MGAS8232
agaugucgcaaaggcu

SEQ ID NO: 4126022 - RNA, 16 nt, Streptococcus pyogenes MGAS8232
agauuaaacuuacaaa

SEQ ID NO: 4126023 - RNA, 16 nt, Streptococcus pyogenes MGAS8232
agauuggauuucgacu

SEQ ID NO: 4126024 - RNA, 13 nt, Streptococcus pyogenes MGAS8232
agauuuuaaauau

SEQ ID NO: 4126025 - RNA, 20 nt, Streptococcus pyogenes MGAS8232
agcaaaacaauaacacagaa

SEQ ID NO: 4126026 - RNA, 16 nt, Streptococcus pyogenes MGAS8232
agcaaaaugcuguuug

SEQ ID NO: 4126027 - RNA, 17 nt, Streptococcus pyogenes MGAS8232
agcaaggaugaaaugau

SEQ ID NO: 4126028 - RNA, 13 nt, Streptococcus pyogenes MGAS8232
aguaguuucucau

SEQ ID NO: 4126029 - RNA, 19 nt, Streptococcus pyogenes MGAS8232
aguaguuucucauguuuua

SEQ ID NO: 4126030 - RNA, 20 nt, Streptococcus pyogenes MGAS8232
aguaguuucucauguuuuau

SEQ ID NO: 4126031 - RNA, 18 nt, Streptococcus pyogenes MGAS8232
aguauauuguaauaacaa

SEQ ID NO: 4126032 - RNA, 20 nt, Streptococcus pyogenes MGAS8232
aguauauuguaauaacaaaa

SEQ ID NO: 4126033 - RNA, 19 nt, Streptococcus pyogenes MGAS8232
aguaugcuuuuaauuuuau

SEQ ID NO: 4126034 - RNA, 14 nt, Streptococcus pyogenes MGAS8232
aguauuaucucauu

SEQ ID NO: 4126035 - RNA, 13 nt, Streptococcus pyogenes MGAS8232
aguauuuuuuagu

SEQ ID NO: 4126036 - RNA, 16 nt, Streptococcus pyogenes MGAS8232
agucaauuuagccguc

SEQ ID NO: 4126037 - RNA, 13 nt, Streptococcus pyogenes MGAS8232
agucacaccguug

SEQ ID NO: 4126038 - RNA, 14 nt, Streptococcus pyogenes MGAS8232
agucagaucauuaa

SEQ ID NO: 4126039 - RNA, 22 nt, Streptococcus pyogenes MGAS8232
agucagaucauuaaauugauua

SEQ ID NO: 4126040 - RNA, 20 nt, Streptococcus pyogenes MGAS8232
aguccaaaauguacauccua

SEQ ID NO: 4126041 - RNA, 21 nt, Streptococcus pyogenes MGAS8232
aguccuccucuuuagaauucu

SEQ ID NO: 4126042 - RNA, 20 nt, Streptococcus pyogenes MGAS8232
agucuaugcauguagaugaa

SEQ ID NO: 4126043 - RNA, 18 nt, Streptococcus pyogenes MGAS8232
agucuccauaacauacuc

SEQ ID NO: 4126044 - RNA, 21 nt, Streptococcus pyogenes MGAS8232
agucuccauaacauacucuau

SEQ ID NO: 4126045 - RNA, 15 nt, Streptococcus pyogenes MGAS8232
agucugagcaaucau

SEQ ID NO: 4126046 - RNA, 15 nt, Streptococcus pyogenes MGAS8232
agucugcaugaagug

SEQ ID NO: 4126047 - RNA, 13 nt, Streptococcus pyogenes MGAS8232
agucuuagaaaua

SEQ ID NO: 4126048 - RNA, 17 nt, Streptococcus pyogenes MGAS8232
agugccaguaaggaaau

SEQ ID NO: 4126049 - RNA, 13 nt, Streptococcus pyogenes MGAS8232
aguguuuugaaug

SEQ ID NO: 4126050 - RNA, 23 nt, Streptococcus pyogenes MGAS8232
aguuagccaagcaaucuaagaau

SEQ ID NO: 4126051 - RNA, 20 nt, Streptococcus pyogenes MGAS8232
aguuauaaagaaacaaaaau

SEQ ID NO: 4126052 - RNA, 23 nt, Streptococcus pyogenes MGAS8232
aguuauaaagaaacaaaaaugaa

SEQ ID NO: 4126053 - RNA, 17 nt, Streptococcus pyogenes MGAS8232
aguuaucacuaaggcug

SEQ ID NO: 4126054 - RNA, 18 nt, Streptococcus pyogenes MGAS8232
aguuauucccauauaugc

SEQ ID NO: 4126055 - RNA, 13 nt, Streptococcus pyogenes MGAS8232
aguucagaaguug

SEQ ID NO: 4126056 - RNA, 13 nt, Streptococcus pyogenes MGAS8232
aguucagcagcac

SEQ ID NO: 4126057 - RNA, 16 nt, Streptococcus pyogenes MGAS8232
aguuccucgguuuuuu

SEQ ID NO: 4126058 - RNA, 17 nt, Streptococcus pyogenes MGAS8232
aguuccucgguuuuuuu

SEQ ID NO: 4126059 - RNA, 19 nt, Streptococcus pyogenes MGAS8232
aguuccugcauguaacaag

SEQ ID NO: 4126060 - RNA, 14 nt, Streptococcus pyogenes MGAS8232
aguucgauuauuaa

SEQ ID NO: 4126061 - RNA, 14 nt, Streptococcus pyogenes MGAS8232
aguucuucuaaacg

SEQ ID NO: 4126062 - RNA, 18 nt, Streptococcus pyogenes MGAS8232
aguugagacuaaaggucu

SEQ ID NO: 4126063 - RNA, 16 nt, Streptococcus pyogenes MGAS8232
aguugguauauagcuc

SEQ ID NO: 4126064 - RNA, 17 nt, Streptococcus pyogenes MGAS8232
aguugugauauaaaaug

SEQ ID NO: 4126065 - RNA, 17 nt, Streptococcus pyogenes MGAS8232
aguuuaggauauaagaa

SEQ ID NO: 4126066 - RNA, 16 nt, Streptococcus pyogenes MGAS8232
aguuuauguaugcugu

SEQ ID NO: 4126067 - RNA, 15 nt, Streptococcus pyogenes MGAS8232
aguuuguaaaauuua

SEQ ID NO: 4126068 - RNA, 16 nt, Streptococcus pyogenes MGAS8232
aguuuucucagagaca

SEQ ID NO: 4126069 - RNA, 23 nt, Streptococcus pyogenes MGAS8232
aguuuucucagagacaauaaggu

SEQ ID NO: 4126070 - RNA, 23 nt, Streptococcus pyogenes MGAS8232
aguuuuuagcagcagaagcaaau

SEQ ID NO: 4126071 - RNA, 18 nt, Streptococcus pyogenes MGAS8232
auaaaaaagaagcaaaau

SEQ ID NO: 4126072 - RNA, 23 nt, Streptococcus pyogenes MGAS8232
auaaaaacgaucaaaaaucuuuu

SEQ ID NO: 4126073 - RNA, 22 nt, Streptococcus pyogenes MGAS8232
auaaaaauauucccaaugcccc

SEQ ID NO: 4126074 - RNA, 16 nt, Streptococcus pyogenes MGAS8232
auaaaauauuuuucca

SEQ ID NO: 4126075 - RNA, 18 nt, Streptococcus pyogenes MGAS8232
auaaaaucguuauuaauu

SEQ ID NO: 4126076 - RNA, 12 nt, Streptococcus pyogenes MGAS8232
auaaaaugccuc

SEQ ID NO: 4126077 - RNA, 20 nt, Streptococcus pyogenes MGAS8232
auaaaauuccccacaaaaga

SEQ ID NO: 4126078 - RNA, 19 nt, Streptococcus pyogenes MGAS8232
auaaacuguauacaaaaag

SEQ ID NO: 4126079 - RNA, 17 nt, Streptococcus pyogenes MGAS8232
auaaagauaauuucuuu

SEQ ID NO: 4126080 - RNA, 23 nt, Streptococcus pyogenes MGAS8232
auaaagcguugacaguuaaaaau

SEQ ID NO: 4126081 - RNA, 15 nt, Streptococcus pyogenes MGAS8232
auaaagcuuuaaaaa

SEQ ID NO: 4126082 - RNA, 18 nt, Streptococcus pyogenes MGAS8232
auaaagcuuuaaaaaaua

SEQ ID NO: 4126083 - RNA, 19 nt, Streptococcus pyogenes MGAS8232
auaaagcuuuaaaaaauau

SEQ ID NO: 4126084 - RNA, 19 nt, Streptococcus pyogenes MGAS8232
auaaauaaagauaauuucu

SEQ ID NO: 4126085 - RNA, 16 nt, Streptococcus pyogenes MGAS8232
auaaaucuuacuaacu

SEQ ID NO: 4126086 - RNA, 21 nt, Streptococcus pyogenes MGAS8232
auaacaacgucaauuuuauca

SEQ ID NO: 4126087 - RNA, 15 nt, Streptococcus pyogenes MGAS8232
auaacuguugucuca

SEQ ID NO: 4126088 - RNA, 15 nt, Streptococcus pyogenes MGAS8232
auaagaccuucaaaa

SEQ ID NO: 4126089 - RNA, 17 nt, Streptococcus pyogenes MGAS8232
auaagaccuucaaaaaa

SEQ ID NO: 4126090 - RNA, 18 nt, Streptococcus pyogenes MGAS8232
auaagacuuauaugaaag

SEQ ID NO: 4126091 - RNA, 20 nt, Streptococcus pyogenes MGAS8232
auaagacuuauaugaaagaa

SEQ ID NO: 4126092 - RNA, 12 nt, Streptococcus pyogenes MGAS8232
auaagguuuuuu

SEQ ID NO: 4126093 - RNA, 13 nt, Streptococcus pyogenes MGAS8232
auaagguuuuuuu

SEQ ID NO: 4126094 - RNA, 21 nt, Streptococcus pyogenes MGAS8232
auaaguauagcauaaaauagu

SEQ ID NO: 4126095 - RNA, 15 nt, Streptococcus pyogenes MGAS8232
auaaguauuuuaaaa

SEQ ID NO: 4126096 - RNA, 19 nt, Streptococcus pyogenes MGAS8232
auaaguauuuuaaaauccu

SEQ ID NO: 4126097 - RNA, 20 nt, Streptococcus pyogenes MGAS8232
auaagucauuuuaaguaguc

SEQ ID NO: 4126098 - RNA, 13 nt, Streptococcus pyogenes MGAS8232
auaauaaagugcg

SEQ ID NO: 4126099 - RNA, 13 nt, Streptococcus pyogenes MGAS8232
auaauauaaugau

SEQ ID NO: 4126100 - RNA, 18 nt, Streptococcus pyogenes MGAS8232
auaaucgaugauaauagu

SEQ ID NO: 4126101 - RNA, 15 nt, Streptococcus pyogenes MGAS8232
auaaucugagcgguu

SEQ ID NO: 4126102 - RNA, 15 nt, Streptococcus pyogenes MGAS8232
auaauuucaauaaua

SEQ ID NO: 4126103 - RNA, 16 nt, Streptococcus pyogenes MGAS8232
auaauuucuuuuucau

SEQ ID NO: 4126104 - RNA, 18 nt, Streptococcus pyogenes MGAS8232
auaauuucuuuuucauuu

SEQ ID NO: 4126105 - RNA, 23 nt, Streptococcus pyogenes MGAS8232
auacaaagcaucaggauugccau

SEQ ID NO: 4126106 - RNA, 16 nt, Streptococcus pyogenes MGAS8232
auacaagucuuagaaa

SEQ ID NO: 4126107 - RNA, 19 nt, Streptococcus pyogenes MGAS8232
auacaagucuuagaaauag

SEQ ID NO: 4126108 - RNA, 18 nt, Streptococcus pyogenes MGAS8232
auacagaagaaagcuugu

SEQ ID NO: 4126109 - RNA, 23 nt, Streptococcus pyogenes MGAS8232
auacaguccaaacucaaacuaaa

SEQ ID NO: 4126110 - RNA, 13 nt, Streptococcus pyogenes MGAS8232
auaccaacaaugu

SEQ ID NO: 4126111 - RNA, 23 nt, Streptococcus pyogenes MGAS8232
auaccaacaauguagcuaucaaa

SEQ ID NO: 4126112 - RNA, 12 nt, Streptococcus pyogenes MGAS8232
auaccauuucuu

SEQ ID NO: 4126113 - RNA, 15 nt, Streptococcus pyogenes MGAS8232
auaccauuucuuugc

SEQ ID NO: 4126114 - RNA, 16 nt, Streptococcus pyogenes MGAS8232
auaccauuucuuugca

SEQ ID NO: 4126115 - RNA, 23 nt, Streptococcus pyogenes MGAS8232
auaccguagaaaguagcaccuuu

SEQ ID NO: 4126116 - RNA, 14 nt, Streptococcus pyogenes MGAS8232
auaccuaaaaaaua

SEQ ID NO: 4126117 - RNA, 12 nt, Streptococcus pyogenes MGAS8232
auacgguaaaaa

SEQ ID NO: 4126118 - RNA, 22 nt, Streptococcus pyogenes MGAS8232
auacguuuauuguugcaauaau

SEQ ID NO: 4126119 - RNA, 23 nt, Streptococcus pyogenes MGAS8232
auacguuuauuuaguuauuuuug

SEQ ID NO: 4126120 - RNA, 19 nt, Streptococcus pyogenes MGAS8232
auacucuauuuacucaucu

SEQ ID NO: 4126121 - RNA, 23 nt, Streptococcus pyogenes MGAS8232
auacugguauguugauugccauu

SEQ ID NO: 4126122 - RNA, 21 nt, Streptococcus pyogenes MGAS8232
auacuuccaucuaaucgaaca

SEQ ID NO: 4126123 - RNA, 18 nt, Streptococcus pyogenes MGAS8232
auagaaacuuuuuauaag

SEQ ID NO: 4126124 - RNA, 17 nt, Streptococcus pyogenes MGAS8232
auagaagacaaggugaa

SEQ ID NO: 4126125 - RNA, 21 nt, Streptococcus pyogenes MGAS8232
aucuguauauuuaauagcauu

SEQ ID NO: 4126126 - RNA, 15 nt, Streptococcus pyogenes MGAS8232
aucuguuuaaaaaca

SEQ ID NO: 4126127 - RNA, 16 nt, Streptococcus pyogenes MGAS8232
aucuguuuaaaaacaa

SEQ ID NO: 4126128 - RNA, 13 nt, Streptococcus pyogenes MGAS8232
aucuuauuuuaag

SEQ ID NO: 4126129 - RNA, 13 nt, Streptococcus pyogenes MGAS8232
aucuuauuuuuua

SEQ ID NO: 4126130 - RNA, 15 nt, Streptococcus pyogenes MGAS8232
aucuuguuuaaccuc

SEQ ID NO: 4126131 - RNA, 15 nt, Streptococcus pyogenes MGAS8232
aucuuuauaaagcuu

SEQ ID NO: 4126132 - RNA, 20 nt, Streptococcus pyogenes MGAS8232
aucuuuaucagucuguccaa

SEQ ID NO: 4126133 - RNA, 14 nt, Streptococcus pyogenes MGAS8232
aucuuugacaaugu

SEQ ID NO: 4126134 - RNA, 19 nt, Streptococcus pyogenes MGAS8232
aucuuuguuucuauacaua

SEQ ID NO: 4126135 - RNA, 18 nt, Streptococcus pyogenes MGAS8232
aucuuuguuuuuuuuagu

SEQ ID NO: 4126136 - RNA, 13 nt, Streptococcus pyogenes MGAS8232
augaaaaagaagu

SEQ ID NO: 4126137 - RNA, 14 nt, Streptococcus pyogenes MGAS8232
augaaaacguguau

SEQ ID NO: 4126138 - RNA, 18 nt, Streptococcus pyogenes MGAS8232
augaaaacguguauucuu

SEQ ID NO: 4126139 - RNA, 23 nt, Streptococcus pyogenes MGAS8232
augaaaacguguauucuuaaaaa

SEQ ID NO: 4126140 - RNA, 20 nt, Streptococcus pyogenes MGAS8232
augaaacguuauuaaagaca

SEQ ID NO: 4126141 - RNA, 21 nt, Streptococcus pyogenes MGAS8232
augaaacguuauuaaagacaa

SEQ ID NO: 4126142 - RNA, 17 nt, Streptococcus pyogenes MGAS8232
augaagcaaaauaaacu

SEQ ID NO: 4126143 - RNA, 12 nt, Streptococcus pyogenes MGAS8232
augaauuuuguc

SEQ ID NO: 4126144 - RNA, 22 nt, Streptococcus pyogenes MGAS8232
augaauuuugucuaaaauaaag

SEQ ID NO: 4126145 - RNA, 13 nt, Streptococcus pyogenes MGAS8232
augacacauuucg

SEQ ID NO: 4126146 - RNA, 21 nt, Streptococcus pyogenes MGAS8232
augacacuuaaaugcaaaaaa

SEQ ID NO: 4126147 - RNA, 17 nt, Streptococcus pyogenes MGAS8232
augacaguauacaucaa

SEQ ID NO: 4126148 - RNA, 20 nt, Streptococcus pyogenes MGAS8232
augaccuuugauaagauauu

SEQ ID NO: 4126149 - RNA, 18 nt, Streptococcus pyogenes MGAS8232
augacgccuccaaauacu

SEQ ID NO: 4126150 - RNA, 16 nt, Streptococcus pyogenes MGAS8232
augacgguaaauaaag

SEQ ID NO: 4126151 - RNA, 17 nt, Streptococcus pyogenes MGAS8232
augacuucaaaaucacc

SEQ ID NO: 4126152 - RNA, 14 nt, Streptococcus pyogenes MGAS8232
augacuugaccaaa

SEQ ID NO: 4126153 - RNA, 14 nt, Streptococcus pyogenes MGAS8232
augagaguaaacga

SEQ ID NO: 4126154 - RNA, 15 nt, Streptococcus pyogenes MGAS8232
augagaguaaacgaa

SEQ ID NO: 4126155 - RNA, 17 nt, Streptococcus pyogenes MGAS8232
augagaguaaacgaaaa

SEQ ID NO: 4126156 - RNA, 23 nt, Streptococcus pyogenes MGAS8232
augagauaccuucauagacaagc

SEQ ID NO: 4126157 - RNA, 13 nt, Streptococcus pyogenes MGAS8232
augagcaaggcaa

SEQ ID NO: 4126158 - RNA, 14 nt, Streptococcus pyogenes MGAS8232
augagcaaggcaag

SEQ ID NO: 4126159 - RNA, 18 nt, Streptococcus pyogenes MGAS8232
augagguauuuauaaaua

SEQ ID NO: 4126160 - RNA, 22 nt, Streptococcus pyogenes MGAS8232
augagguauuuauaaauauuuu

SEQ ID NO: 4126161 - RNA, 14 nt, Streptococcus pyogenes MGAS8232
augauauaaaaaug

SEQ ID NO: 4126162 - RNA, 19 nt, Streptococcus pyogenes MGAS8232
augauaucccaucuuuguu

SEQ ID NO: 4126163 - RNA, 16 nt, Streptococcus pyogenes MGAS8232
augaucuguuuaaaaa

SEQ ID NO: 4126164 - RNA, 17 nt, Streptococcus pyogenes MGAS8232
augaucuguuuaaaaac

SEQ ID NO: 4126165 - RNA, 21 nt, Streptococcus pyogenes MGAS8232
augaucuguuuaaaaacaaau

SEQ ID NO: 4126166 - RNA, 22 nt, Streptococcus pyogenes MGAS8232
augaugccauuuaaaagggcaa

SEQ ID NO: 4126167 - RNA, 18 nt, Streptococcus pyogenes MGAS8232
augauuauauuaggauau

SEQ ID NO: 4126168 - RNA, 17 nt, Streptococcus pyogenes MGAS8232
augauuuaguuuuuaaa

SEQ ID NO: 4126169 - RNA, 16 nt, Streptococcus pyogenes MGAS8232
augauuuuaacguuuu

SEQ ID NO: 4126170 - RNA, 14 nt, Streptococcus pyogenes MGAS8232
augauuuuuaauuc

SEQ ID NO: 4126171 - RNA, 23 nt, Streptococcus pyogenes MGAS8232
augauuuuuaauucuucuuucca

SEQ ID NO: 4126172 - RNA, 22 nt, Streptococcus pyogenes MGAS8232
augcauguaaugaccacccuca

SEQ ID NO: 4126173 - RNA, 13 nt, Streptococcus pyogenes MGAS8232
augcauguagaug

SEQ ID NO: 4126174 - RNA, 19 nt, Streptococcus pyogenes MGAS8232
augccccaaaguaauccaa

SEQ ID NO: 4126175 - RNA, 22 nt, Streptococcus pyogenes MGAS8232
augcuccuccaccaaaaccaag

SEQ ID NO: 4126176 - RNA, 16 nt, Streptococcus pyogenes MGAS8232
augcuucuuucaaacg

SEQ ID NO: 4126177 - RNA, 18 nt, Streptococcus pyogenes MGAS8232
augcuucuuucaaacgga

SEQ ID NO: 4126178 - RNA, 21 nt, Streptococcus pyogenes MGAS8232
augcuugaguagcuacugccu

SEQ ID NO: 4126179 - RNA, 19 nt, Streptococcus pyogenes MGAS8232
augcuugcucaauuuuuga

SEQ ID NO: 4126180 - RNA, 11 nt, Streptococcus pyogenes MGAS8232
augcuuuuucg

SEQ ID NO: 4126181 - RNA, 21 nt, Streptococcus pyogenes MGAS8232
auggacuggcagcuucauuua

SEQ ID NO: 4126182 - RNA, 16 nt, Streptococcus pyogenes MGAS8232
auggagucaaugaaaa

SEQ ID NO: 4126183 - RNA, 22 nt, Streptococcus pyogenes MGAS8232
auggauaccauuucuuugcaaa

SEQ ID NO: 4126184 - RNA, 22 nt, Streptococcus pyogenes MGAS8232
auggaugcuccuccaccaaaac

SEQ ID NO: 4126185 - RNA, 16 nt, Streptococcus pyogenes MGAS8232
auggguaaaaugacug

SEQ ID NO: 4126186 - RNA, 23 nt, Streptococcus pyogenes MGAS8232
auggguguuuaaucuuuguuucu

SEQ ID NO: 4126187 - RNA, 17 nt, Streptococcus pyogenes MGAS8232
augguuaaaaagagagc

SEQ ID NO: 4126188 - RNA, 22 nt, Streptococcus pyogenes MGAS8232
auguaaacaauugguuuacaug

SEQ ID NO: 4126189 - RNA, 22 nt, Streptococcus pyogenes MGAS8232
auguccauugaugaguuuaugu

SEQ ID NO: 4126190 - RNA, 17 nt, Streptococcus pyogenes MGAS8232
auguccgaaaaaaacuu

SEQ ID NO: 4126191 - RNA, 15 nt, Streptococcus pyogenes MGAS8232
augucucgaauauaa

SEQ ID NO: 4126192 - RNA, 16 nt, Streptococcus pyogenes MGAS8232
auguuauuaaauaaua

SEQ ID NO: 4126193 - RNA, 19 nt, Streptococcus pyogenes MGAS8232
auguucucauaaacaauga

SEQ ID NO: 4126194 - RNA, 23 nt, Streptococcus pyogenes MGAS8232
auguugcuuaaugaccuuugaua

SEQ ID NO: 4126195 - RNA, 17 nt, Streptococcus pyogenes MGAS8232
auguuuauuccaaacau

SEQ ID NO: 4126196 - RNA, 21 nt, Streptococcus pyogenes MGAS8232
auguuuauuccaaacauccaa

SEQ ID NO: 4126197 - RNA, 22 nt, Streptococcus pyogenes MGAS8232
auuaaaagaugucgcaaaggcu

SEQ ID NO: 4126198 - RNA, 17 nt, Streptococcus pyogenes MGAS8232
auuaaacuuacaaaaag

SEQ ID NO: 4126199 - RNA, 21 nt, Streptococcus pyogenes MGAS8232
auuaaagcccuuauguauuuu

SEQ ID NO: 4126200 - RNA, 23 nt, Streptococcus pyogenes MGAS8232
auuaaauaauacagcauacauca

SEQ ID NO: 4126201 - RNA, 18 nt, Streptococcus pyogenes MGAS8232
auuaacguuaacaaaaau

SEQ ID NO: 4126202 - RNA, 19 nt, Streptococcus pyogenes MGAS8232
auuaaggauuaugaaaaag

SEQ ID NO: 4126203 - RNA, 14 nt, Streptococcus pyogenes MGAS8232
auuaauaauauuaa

SEQ ID NO: 4126204 - RNA, 12 nt, Streptococcus pyogenes MGAS8232
auuaauguaaaa

SEQ ID NO: 4126205 - RNA, 14 nt, Streptococcus pyogenes MGAS8232
auuacgauuaaaag

SEQ ID NO: 4126206 - RNA, 15 nt, Streptococcus pyogenes MGAS8232
auuagcaaaaugcug

SEQ ID NO: 4126207 - RNA, 19 nt, Streptococcus pyogenes MGAS8232
auuagcauaccuaaaagaa

SEQ ID NO: 4126208 - RNA, 20 nt, Streptococcus pyogenes MGAS8232
auuagcauaccuaaaagaac

SEQ ID NO: 4126209 - RNA, 14 nt, Streptococcus pyogenes MGAS8232
auuaguaaccauag

SEQ ID NO: 4126210 - RNA, 17 nt, Streptococcus pyogenes MGAS8232
auuaguccaaaauguac

SEQ ID NO: 4126211 - RNA, 17 nt, Streptococcus pyogenes MGAS8232
auuaguuuuuagcagca

SEQ ID NO: 4126212 - RNA, 18 nt, Streptococcus pyogenes MGAS8232
auuaguuuuuagcagcag

SEQ ID NO: 4126213 - RNA, 19 nt, Streptococcus pyogenes MGAS8232
auuauacucaauauaauaa

SEQ ID NO: 4126214 - RNA, 13 nt, Streptococcus pyogenes MGAS8232
auuauauuaaauu

SEQ ID NO: 4126215 - RNA, 16 nt, Streptococcus pyogenes MGAS8232
auuauauuaaauuaau

SEQ ID NO: 4126216 - RNA, 13 nt, Streptococcus pyogenes MGAS8232
auuaucaauaaca

SEQ ID NO: 4126217 - RNA, 23 nt, Streptococcus pyogenes MGAS8232
auuaucugaauuauuaguaacca

SEQ ID NO: 4126218 - RNA, 15 nt, Streptococcus pyogenes MGAS8232
auuaucugauaaggu

SEQ ID NO: 4126219 - RNA, 15 nt, Streptococcus pyogenes MGAS8232
auuaugaaaaagaag

SEQ ID NO: 4126220 - RNA, 20 nt, Streptococcus pyogenes MGAS8232
auuaugaaggugauugacuu

SEQ ID NO: 4126221 - RNA, 13 nt, Streptococcus pyogenes MGAS8232
auuaugaggugaa

SEQ ID NO: 4126222 - RNA, 11 nt, Streptococcus pyogenes MGAS8232
caaaauuauua

SEQ ID NO: 4126223 - RNA, 19 nt, Streptococcus pyogenes MGAS8232
caaaauuauuauuuugcuu

SEQ ID NO: 4126224 - RNA, 14 nt, Streptococcus pyogenes MGAS8232
caaacagaaauacu

SEQ ID NO: 4126225 - RNA, 16 nt, Streptococcus pyogenes MGAS8232
caaacagaaauacucc

SEQ ID NO: 4126226 - RNA, 13 nt, Streptococcus pyogenes MGAS8232
caaacauccaauc

SEQ ID NO: 4126227 - RNA, 16 nt, Streptococcus pyogenes MGAS8232
caaacauccaaucacc

SEQ ID NO: 4126228 - RNA, 13 nt, Streptococcus pyogenes MGAS8232
caaaccauuuuau

SEQ ID NO: 4126229 - RNA, 19 nt, Streptococcus pyogenes MGAS8232
caaaccauuuuaugagaaa

SEQ ID NO: 4126230 - RNA, 14 nt, Streptococcus pyogenes MGAS8232
caaacggaguucuc

SEQ ID NO: 4126231 - RNA, 14 nt, Streptococcus pyogenes MGAS8232
caaacuauauuguu

SEQ ID NO: 4126232 - RNA, 13 nt, Streptococcus pyogenes MGAS8232
caaaggcuuuuuu

SEQ ID NO: 4126233 - RNA, 13 nt, Streptococcus pyogenes MGAS8232
caaaguaauccaa

SEQ ID NO: 4126234 - RNA, 16 nt, Streptococcus pyogenes MGAS8232
caaauacagaagaaag

SEQ ID NO: 4126235 - RNA, 19 nt, Streptococcus pyogenes MGAS8232
caaauacugguauguugau

SEQ ID NO: 4126236 - RNA, 20 nt, Streptococcus pyogenes MGAS8232
caaauacugguauguugauu

SEQ ID NO: 4126237 - RNA, 16 nt, Streptococcus pyogenes MGAS8232
caaauagcaaugguua

SEQ ID NO: 4126238 - RNA, 14 nt, Streptococcus pyogenes MGAS8232
caaaucaacauggc

SEQ ID NO: 4126239 - RNA, 24 nt, Streptococcus pyogenes MGAS8232
caaaucaacauggcuaaugauaag

SEQ ID NO: 4126240 - RNA, 23 nt, Streptococcus pyogenes MGAS8232
caaauccgcuugcagcauaauca

SEQ ID NO: 4126241 - RNA, 16 nt, Streptococcus pyogenes MGAS8232
caaaugaaaaaacuca

SEQ ID NO: 4126242 - RNA, 14 nt, Streptococcus pyogenes MGAS8232
caaauucuuccuua

SEQ ID NO: 4126243 - RNA, 13 nt, Streptococcus pyogenes MGAS8232
caaauucuuuuug

SEQ ID NO: 4126244 - RNA, 14 nt, Streptococcus pyogenes MGAS8232
caaauuguuugauu

SEQ ID NO: 4126245 - RNA, 23 nt, Streptococcus pyogenes MGAS8232
caaauuguuugauugauuugucu

SEQ ID NO: 4126246 - RNA, 14 nt, Streptococcus pyogenes MGAS8232
caaauuuauccuga

SEQ ID NO: 4126247 - RNA, 15 nt, Streptococcus pyogenes MGAS8232
caaauuuauccugau

SEQ ID NO: 4126248 - RNA, 17 nt, Streptococcus pyogenes MGAS8232
caaauuucagauaagac

SEQ ID NO: 4126249 - RNA, 22 nt, Streptococcus pyogenes MGAS8232
caacaaguguuuugucuuauag

SEQ ID NO: 4126250 - RNA, 18 nt, Streptococcus pyogenes MGAS8232
caacauccauaccaucaa

SEQ ID NO: 4126251 - RNA, 18 nt, Streptococcus pyogenes MGAS8232
caaccuuaaacaugccuu

SEQ ID NO: 4126252 - RNA, 21 nt, Streptococcus pyogenes MGAS8232
caacgcauuucuuuuuugguu

SEQ ID NO: 4126253 - RNA, 13 nt, Streptococcus pyogenes MGAS8232
caacucccuccua

SEQ ID NO: 4126254 - RNA, 16 nt, Streptococcus pyogenes MGAS8232
caacucgauaaaaacg

SEQ ID NO: 4126255 - RNA, 16 nt, Streptococcus pyogenes MGAS8232
caacuucuauaugugu

SEQ ID NO: 4126256 - RNA, 15 nt, Streptococcus pyogenes MGAS8232
caagaaguuuuauag

SEQ ID NO: 4126257 - RNA, 20 nt, Streptococcus pyogenes MGAS8232
caagagcaccgcgaauauga

SEQ ID NO: 4126258 - RNA, 15 nt, Streptococcus pyogenes MGAS8232
caagagcuuaaaagu

SEQ ID NO: 4126259 - RNA, 15 nt, Streptococcus pyogenes MGAS8232
caagaggaguugaac

SEQ ID NO: 4126260 - RNA, 17 nt, Streptococcus pyogenes MGAS8232
caagcauaauaaaaaga

SEQ ID NO: 4126261 - RNA, 21 nt, Streptococcus pyogenes MGAS8232
caagcauaauaaaaagagucu

SEQ ID NO: 4126262 - RNA, 18 nt, Streptococcus pyogenes MGAS8232
caagcucgguuuuaaacu

SEQ ID NO: 4126263 - RNA, 14 nt, Streptococcus pyogenes MGAS8232
caaggcaagaggag

SEQ ID NO: 4126264 - RNA, 16 nt, Streptococcus pyogenes MGAS8232
caaguaugcuuuuaau

SEQ ID NO: 4126265 - RNA, 20 nt, Streptococcus pyogenes MGAS8232
caaguccugcuuuugaugca

SEQ ID NO: 4126266 - RNA, 22 nt, Streptococcus pyogenes MGAS8232
caagugauaaccuuaaagaccc

SEQ ID NO: 4126267 - RNA, 23 nt, Streptococcus pyogenes MGAS8232
caauaaaauaucuagaacagcug

SEQ ID NO: 4126268 - RNA, 17 nt, Streptococcus pyogenes MGAS8232
caauaacagaaauuaau

SEQ ID NO: 4126269 - RNA, 16 nt, Streptococcus pyogenes MGAS8232
caauaaggucaucaga

SEQ ID NO: 4126270 - RNA, 12 nt, Streptococcus pyogenes MGAS8232
caauaauauaau

SEQ ID NO: 4126271 - RNA, 13 nt, Streptococcus pyogenes MGAS8232
caauaaugagcaa

SEQ ID NO: 4126272 - RNA, 20 nt, Streptococcus pyogenes MGAS8232
caauaauuccuuugccagcc

SEQ ID NO: 4126273 - RNA, 22 nt, Streptococcus pyogenes MGAS8232
caauacaaaaaaccuuccugua

SEQ ID NO: 4126274 - RNA, 18 nt, Streptococcus pyogenes MGAS8232
caauacgauagugugugu

SEQ ID NO: 4126275 - RNA, 23 nt, Streptococcus pyogenes MGAS8232
caauagcaaguccugcuuuugau

SEQ ID NO: 4126276 - RNA, 15 nt, Streptococcus pyogenes MGAS8232
caauagcgaaaaagg

SEQ ID NO: 4126277 - RNA, 23 nt, Streptococcus pyogenes MGAS8232
caauagcugcugcuaaagcaauc

SEQ ID NO: 4126278 - RNA, 17 nt, Streptococcus pyogenes MGAS8232
caauauaauaaaaagua

SEQ ID NO: 4126279 - RNA, 13 nt, Streptococcus pyogenes MGAS8232
caauauagcaauc

SEQ ID NO: 4126280 - RNA, 12 nt, Streptococcus pyogenes MGAS8232
caauauccauag

SEQ ID NO: 4126281 - RNA, 16 nt, Streptococcus pyogenes MGAS8232
caauauccauagaaau

SEQ ID NO: 4126282 - RNA, 21 nt, Streptococcus pyogenes MGAS8232
caauaugugauuauuauucua

SEQ ID NO: 4126283 - RNA, 15 nt, Streptococcus pyogenes MGAS8232
caaucaccuuucuau

SEQ ID NO: 4126284 - RNA, 21 nt, Streptococcus pyogenes MGAS8232
caaucauacccgcguuaucuc

SEQ ID NO: 4126285 - RNA, 13 nt, Streptococcus pyogenes MGAS8232
caaucgaaaugau

SEQ ID NO: 4126286 - RNA, 19 nt, Streptococcus pyogenes MGAS8232
caaucuuaaguuagggucu

SEQ ID NO: 4126287 - RNA, 14 nt, Streptococcus pyogenes MGAS8232
caaugaaaaguuau

SEQ ID NO: 4126288 - RNA, 20 nt, Streptococcus pyogenes MGAS8232
caaugaaaaguuauucccau

SEQ ID NO: 4126289 - RNA, 13 nt, Streptococcus pyogenes MGAS8232
caauggaaauuuu

SEQ ID NO: 4126290 - RNA, 21 nt, Streptococcus pyogenes MGAS8232
caauggaaauuuuaaaugaca

SEQ ID NO: 4126291 - RNA, 18 nt, Streptococcus pyogenes MGAS8232
caauuaaaccauucuaaa

SEQ ID NO: 4126292 - RNA, 20 nt, Streptococcus pyogenes MGAS8232
caauuaauguuaggagcaca

SEQ ID NO: 4126293 - RNA, 20 nt, Streptococcus pyogenes MGAS8232
caauugcuuuuagccugcca

SEQ ID NO: 4126294 - RNA, 21 nt, Streptococcus pyogenes MGAS8232
caauuguuuuuucaacaaauc

SEQ ID NO: 4126295 - RNA, 19 nt, Streptococcus pyogenes MGAS8232
cacaaauacagaagaaagc

SEQ ID NO: 4126296 - RNA, 22 nt, Streptococcus pyogenes MGAS8232
cacaaggagaucucgauuaucu

SEQ ID NO: 4126297 - RNA, 20 nt, Streptococcus pyogenes MGAS8232
cacacauaaugauuuuuaau

SEQ ID NO: 4126298 - RNA, 21 nt, Streptococcus pyogenes MGAS8232
cacagcaauuuguuccaucug

SEQ ID NO: 4126299 - RNA, 13 nt, Streptococcus pyogenes MGAS8232
cacauaaugauuu

SEQ ID NO: 4126300 - RNA, 21 nt, Streptococcus pyogenes MGAS8232
cacauaaugauuuuuaauucu

SEQ ID NO: 4126301 - RNA, 23 nt, Streptococcus pyogenes MGAS8232
cacauuuuaaucuuuuugugaua

SEQ ID NO: 4126302 - RNA, 12 nt, Streptococcus pyogenes MGAS8232
caccaccaaccu

SEQ ID NO: 4126303 - RNA, 21 nt, Streptococcus pyogenes MGAS8232
caccacccgaagcuaagauuu

SEQ ID NO: 4126304 - RNA, 15 nt, Streptococcus pyogenes MGAS8232
caccagccacuacaa

SEQ ID NO: 4126305 - RNA, 21 nt, Streptococcus pyogenes MGAS8232
caccauuaaaaaaaccagcuu

SEQ ID NO: 4126306 - RNA, 21 nt, Streptococcus pyogenes MGAS8232
caccuuaggcagacaauuauu

SEQ ID NO: 4126307 - RNA, 13 nt, Streptococcus pyogenes MGAS8232
cacuacaagcauu

SEQ ID NO: 4126308 - RNA, 18 nt, Streptococcus pyogenes MGAS8232
cacuacaagcauuuuugc

SEQ ID NO: 4126309 - RNA, 16 nt, Streptococcus pyogenes MGAS8232
cacuacucguuacaua

SEQ ID NO: 4126310 - RNA, 14 nt, Streptococcus pyogenes MGAS8232
cacuuaaaugcaaa

SEQ ID NO: 4126311 - RNA, 15 nt, Streptococcus pyogenes MGAS8232
cacuucaagcauaau

SEQ ID NO: 4126312 - RNA, 18 nt, Streptococcus pyogenes MGAS8232
cacuucaagcauaauaaa

SEQ ID NO: 4126313 - RNA, 22 nt, Streptococcus pyogenes MGAS8232
cacuucaagcauaauaaaaaga

SEQ ID NO: 4126314 - RNA, 14 nt, Streptococcus pyogenes MGAS8232
cagaaaugaaaaga

SEQ ID NO: 4126315 - RNA, 22 nt, Streptococcus pyogenes MGAS8232
cagaaauuaauaaauuuuuguc

SEQ ID NO: 4126316 - RNA, 20 nt, Streptococcus pyogenes MGAS8232
cagaagcaaauucuuccuua

SEQ ID NO: 4126317 - RNA, 17 nt, Streptococcus pyogenes MGAS8232
cagaauaagaaaaccuu

SEQ ID NO: 4126318 - RNA, 23 nt, Streptococcus pyogenes MGAS8232
cagacaaaagggaagagagaagc

SEQ ID NO: 4126319 - RNA, 11 nt, Streptococcus pyogenes MGAS8232
ccauagaagcc

SEQ ID NO: 4126320 - RNA, 15 nt, Streptococcus pyogenes MGAS8232
ccauagaagccaauu

SEQ ID NO: 4126321 - RNA, 20 nt, Streptococcus pyogenes MGAS8232
ccauauuuuugaaaaaaaug

SEQ ID NO: 4126322 - RNA, 16 nt, Streptococcus pyogenes MGAS8232
ccaucaucgaguggau

SEQ ID NO: 4126323 - RNA, 16 nt, Streptococcus pyogenes MGAS8232
ccaucugcacaugcuu

SEQ ID NO: 4126324 - RNA, 11 nt, Streptococcus pyogenes MGAS8232
ccaugauuuuc

SEQ ID NO: 4126325 - RNA, 20 nt, Streptococcus pyogenes MGAS8232
ccaugccuaaaucccaucga

SEQ ID NO: 4126326 - RNA, 15 nt, Streptococcus pyogenes MGAS8232
ccaugcucauaggca

SEQ ID NO: 4126327 - RNA, 15 nt, Streptococcus pyogenes MGAS8232
ccauuaauaauauua

SEQ ID NO: 4126328 - RNA, 12 nt, Streptococcus pyogenes MGAS8232
ccauucuaaaca

SEQ ID NO: 4126329 - RNA, 18 nt, Streptococcus pyogenes MGAS8232
ccauucuaaacaagaccu

SEQ ID NO: 4126330 - RNA, 13 nt, Streptococcus pyogenes MGAS8232
ccauucuuaaacg

SEQ ID NO: 4126331 - RNA, 22 nt, Streptococcus pyogenes MGAS8232
ccauuucuuugcaaaagaaaac

SEQ ID NO: 4126332 - RNA, 11 nt, Streptococcus pyogenes MGAS8232
ccccacaaaag

SEQ ID NO: 4126333 - RNA, 18 nt, Streptococcus pyogenes MGAS8232
cccgucuuacaauuaaua

SEQ ID NO: 4126334 - RNA, 13 nt, Streptococcus pyogenes MGAS8232
ccgaaaaaaacuu

SEQ ID NO: 4126335 - RNA, 13 nt, Streptococcus pyogenes MGAS8232
ccgaguuuugcug

SEQ ID NO: 4126336 - RNA, 23 nt, Streptococcus pyogenes MGAS8232
ccgccaacauagcuaauccagua

SEQ ID NO: 4126337 - RNA, 13 nt, Streptococcus pyogenes MGAS8232
ccggcagggguca

SEQ ID NO: 4126338 - RNA, 21 nt, Streptococcus pyogenes MGAS8232
ccguuugagauaacucuucgg

SEQ ID NO: 4126339 - RNA, 14 nt, Streptococcus pyogenes MGAS8232
ccuaaaaaauaacu

SEQ ID NO: 4126340 - RNA, 11 nt, Streptococcus pyogenes MGAS8232
ccuaaaagaac

SEQ ID NO: 4126341 - RNA, 22 nt, Streptococcus pyogenes MGAS8232
ccuaaauccuuuugaaaaauua

SEQ ID NO: 4126342 - RNA, 19 nt, Streptococcus pyogenes MGAS8232
ccuaaauugguuuuuuagu

SEQ ID NO: 4126343 - RNA, 19 nt, Streptococcus pyogenes MGAS8232
ccuacgauaaaacaaauaa

SEQ ID NO: 4126344 - RNA, 20 nt, Streptococcus pyogenes MGAS8232
ccuacgauaaaacaaauaau

SEQ ID NO: 4126345 - RNA, 16 nt, Streptococcus pyogenes MGAS8232
ccuaugaucuguuuaa

SEQ ID NO: 4126346 - RNA, 22 nt, Streptococcus pyogenes MGAS8232
ccuauuugacuuguuacaaaaa

SEQ ID NO: 4126347 - RNA, 21 nt, Streptococcus pyogenes MGAS8232
ccucaaacacguauuuuucga

SEQ ID NO: 4126348 - RNA, 13 nt, Streptococcus pyogenes MGAS8232
ccuccaccaaaac

SEQ ID NO: 4126349 - RNA, 23 nt, Streptococcus pyogenes MGAS8232
ccuccuaaacuaauaagauucaa

SEQ ID NO: 4126350 - RNA, 17 nt, Streptococcus pyogenes MGAS8232
ccuccuugcaauagagc

SEQ ID NO: 4126351 - RNA, 17 nt, Streptococcus pyogenes MGAS8232
ccugaucccuucauuuu

SEQ ID NO: 4126352 - RNA, 21 nt, Streptococcus pyogenes MGAS8232
ccugcuauaaacgguaauuua

SEQ ID NO: 4126353 - RNA, 16 nt, Streptococcus pyogenes MGAS8232
ccuguccuagucuuuu

SEQ ID NO: 4126354 - RNA, 14 nt, Streptococcus pyogenes MGAS8232
ccuuaaaggccucc

SEQ ID NO: 4126355 - RNA, 20 nt, Streptococcus pyogenes MGAS8232
ccuuaggcagacaauuauuu

SEQ ID NO: 4126356 - RNA, 13 nt, Streptococcus pyogenes MGAS8232
ccuuaucucaguu

SEQ ID NO: 4126357 - RNA, 18 nt, Streptococcus pyogenes MGAS8232
ccuuaugcagguguuuaa

SEQ ID NO: 4126358 - RNA, 17 nt, Streptococcus pyogenes MGAS8232
ccuuauguauuuuucaa

SEQ ID NO: 4126359 - RNA, 22 nt, Streptococcus pyogenes MGAS8232
ccuucaaaaaagggaagaagau

SEQ ID NO: 4126360 - RNA, 20 nt, Streptococcus pyogenes MGAS8232
ccuucguauuggccuucuug

SEQ ID NO: 4126361 - RNA, 22 nt, Streptococcus pyogenes MGAS8232
ccuucuuugucgcuauggcuua

SEQ ID NO: 4126362 - RNA, 21 nt, Streptococcus pyogenes MGAS8232
ccuugcaauagagccaagauu

SEQ ID NO: 4126363 - RNA, 22 nt, Streptococcus pyogenes MGAS8232
ccuuguacaagagcuuaaaagu

SEQ ID NO: 4126364 - RNA, 17 nt, Streptococcus pyogenes MGAS8232
ccuuuaauucuuuaaua

SEQ ID NO: 4126365 - RNA, 21 nt, Streptococcus pyogenes MGAS8232
ccuuuagagaaucaaggggau

SEQ ID NO: 4126366 - RNA, 21 nt, Streptococcus pyogenes MGAS8232
ccuuuagcaauuguuuuuuca

SEQ ID NO: 4126367 - RNA, 14 nt, Streptococcus pyogenes MGAS8232
ccuuuaucuuauuu

SEQ ID NO: 4126368 - RNA, 17 nt, Streptococcus pyogenes MGAS8232
ccuuucuauauaacugu

SEQ ID NO: 4126369 - RNA, 17 nt, Streptococcus pyogenes MGAS8232
ccuuugaccacacgauu

SEQ ID NO: 4126370 - RNA, 12 nt, Streptococcus pyogenes MGAS8232
cgaaaaaaacuu

SEQ ID NO: 4126371 - RNA, 23 nt, Streptococcus pyogenes MGAS8232
cgaaaaaggggagacggauuuaa

SEQ ID NO: 4126372 - RNA, 16 nt, Streptococcus pyogenes MGAS8232
cgaacaauaauauaau

SEQ ID NO: 4126373 - RNA, 16 nt, Streptococcus pyogenes MGAS8232
cgaagcuaagauuucc

SEQ ID NO: 4126374 - RNA, 13 nt, Streptococcus pyogenes MGAS8232
cgaagucucuuuu

SEQ ID NO: 4126375 - RNA, 20 nt, Streptococcus pyogenes MGAS8232
cgaauaugauauaaaaaugg

SEQ ID NO: 4126376 - RNA, 15 nt, Streptococcus pyogenes MGAS8232
cgacauuuaugcuga

SEQ ID NO: 4126377 - RNA, 18 nt, Streptococcus pyogenes MGAS8232
cgacucaugauaucccau

SEQ ID NO: 4126378 - RNA, 21 nt, Streptococcus pyogenes MGAS8232
cgacugcaauagcaugacugu

SEQ ID NO: 4126379 - RNA, 17 nt, Streptococcus pyogenes MGAS8232
cgauaaucuuugacaau

SEQ ID NO: 4126380 - RNA, 14 nt, Streptococcus pyogenes MGAS8232
cgauuaucuuuuuu

SEQ ID NO: 4126381 - RNA, 21 nt, Streptococcus pyogenes MGAS8232
cgauuugcugagcuaaagcca

SEQ ID NO: 4126382 - RNA, 16 nt, Streptococcus pyogenes MGAS8232
cgcagaguacaaggca

SEQ ID NO: 4126383 - RNA, 18 nt, Streptococcus pyogenes MGAS8232
cgccuaggaauaaaaugc

SEQ ID NO: 4126384 - RNA, 14 nt, Streptococcus pyogenes MGAS8232
cgcuaaaacaguuc

SEQ ID NO: 4126385 - RNA, 14 nt, Streptococcus pyogenes MGAS8232
cgcuagcauaaugc

SEQ ID NO: 4126386 - RNA, 19 nt, Streptococcus pyogenes MGAS8232
cgcuauaccuaaaaaauaa

SEQ ID NO: 4126387 - RNA, 18 nt, Streptococcus pyogenes MGAS8232
cgcucuaauuuagucauu

SEQ ID NO: 4126388 - RNA, 22 nt, Streptococcus pyogenes MGAS8232
cgcugaaagucuuagcaccgcu

SEQ ID NO: 4126389 - RNA, 20 nt, Streptococcus pyogenes MGAS8232
cgcugaccaccggugccuca

SEQ ID NO: 4126390 - RNA, 13 nt, Streptococcus pyogenes MGAS8232
cgcuuccagaaca

SEQ ID NO: 4126391 - RNA, 16 nt, Streptococcus pyogenes MGAS8232
cgcuugcagcauaauc

SEQ ID NO: 4126392 - RNA, 23 nt, Streptococcus pyogenes MGAS8232
cgcuuuaggaauaucaugaagua

SEQ ID NO: 4126393 - RNA, 14 nt, Streptococcus pyogenes MGAS8232
cggaguauuuuuua

SEQ ID NO: 4126394 - RNA, 17 nt, Streptococcus pyogenes MGAS8232
cggcaucuacagcaccu

SEQ ID NO: 4126395 - RNA, 18 nt, Streptococcus pyogenes MGAS8232
cgguaauuuauuccauuu

SEQ ID NO: 4126396 - RNA, 12 nt, Streptococcus pyogenes MGAS8232
cgguauucuuuu

SEQ ID NO: 4126397 - RNA, 17 nt, Streptococcus pyogenes MGAS8232
cguaaagcaagggaaac

SEQ ID NO: 4126398 - RNA, 14 nt, Streptococcus pyogenes MGAS8232
cguaacuugcuuug

SEQ ID NO: 4126399 - RNA, 15 nt, Streptococcus pyogenes MGAS8232
cguaagcauuuugag

SEQ ID NO: 4126400 - RNA, 20 nt, Streptococcus pyogenes MGAS8232
cguaaggguuacuauuuagg

SEQ ID NO: 4126401 - RNA, 13 nt, Streptococcus pyogenes MGAS8232
cguauacuuuaaa

SEQ ID NO: 4126402 - RNA, 18 nt, Streptococcus pyogenes MGAS8232
cgucaacgcuagcauaau

SEQ ID NO: 4126403 - RNA, 17 nt, Streptococcus pyogenes MGAS8232
cgucuuuguccauucuu

SEQ ID NO: 4126404 - RNA, 20 nt, Streptococcus pyogenes MGAS8232
cguuaaguggaauguuuacu

SEQ ID NO: 4126405 - RNA, 17 nt, Streptococcus pyogenes MGAS8232
cguuagcagacaaaagg

SEQ ID NO: 4126406 - RNA, 21 nt, Streptococcus pyogenes MGAS8232
cguuuaaauguccgaaaaaaa

SEQ ID NO: 4126407 - RNA, 19 nt, Streptococcus pyogenes MGAS8232
cguuuuguuguauuaugag

SEQ ID NO: 4126408 - RNA, 19 nt, Streptococcus pyogenes MGAS8232
cguuuuuuaguuuguaaaa

SEQ ID NO: 4126409 - RNA, 13 nt, Streptococcus pyogenes MGAS8232
cuaaaaaaaaguu

SEQ ID NO: 4126410 - RNA, 24 nt, Streptococcus pyogenes MGAS8232
cuaaaaaagcucuaucaucuuugu

SEQ ID NO: 4126411 - RNA, 12 nt, Streptococcus pyogenes MGAS8232
cuaaaaaauaac

SEQ ID NO: 4126412 - RNA, 19 nt, Streptococcus pyogenes MGAS8232
cuaaaacgugagaaaauuu

SEQ ID NO: 4126413 - RNA, 17 nt, Streptococcus pyogenes MGAS8232
cuaaaagcauaaaaaua

SEQ ID NO: 4126414 - RNA, 18 nt, Streptococcus pyogenes MGAS8232
cuaaaagcauaaaaauau

SEQ ID NO: 4126415 - RNA, 15 nt, Streptococcus pyogenes MGAS8232
cuaaaauaaagauga

SEQ ID NO: 4126416 - RNA, 21 nt, Streptococcus pyogenes MGAS8232
cuaaagcaucagcauaaccuu

SEQ ID NO: 4126417 - RNA, 15 nt, Streptococcus pyogenes MGAS8232
cugguuuaucauuuu

SEQ ID NO: 4126418 - RNA, 13 nt, Streptococcus pyogenes MGAS8232
cuguauaaacuug

SEQ ID NO: 4126419 - RNA, 14 nt, Streptococcus pyogenes MGAS8232
cuguauauuuaaua

SEQ ID NO: 4126420 - RNA, 19 nt, Streptococcus pyogenes MGAS8232
cuguauccccuugauaugg

SEQ ID NO: 4126421 - RNA, 21 nt, Streptococcus pyogenes MGAS8232
cugucaaaaaauuaagaagga

SEQ ID NO: 4126422 - RNA, 20 nt, Streptococcus pyogenes MGAS8232
cugucaacuuaccagcaccu

SEQ ID NO: 4126423 - RNA, 13 nt, Streptococcus pyogenes MGAS8232
cugucaagcccug

SEQ ID NO: 4126424 - RNA, 20 nt, Streptococcus pyogenes MGAS8232
cugucaagcccugcuggcuu

SEQ ID NO: 4126425 - RNA, 13 nt, Streptococcus pyogenes MGAS8232
cugugaacaaaac

SEQ ID NO: 4126426 - RNA, 16 nt, Streptococcus pyogenes MGAS8232
cugugaacaaaacaaa

SEQ ID NO: 4126427 - RNA, 16 nt, Streptococcus pyogenes MGAS8232
cugugaugaaucauuu

SEQ ID NO: 4126428 - RNA, 22 nt, Streptococcus pyogenes MGAS8232
cuguuaucccuggaccauuauc

SEQ ID NO: 4126429 - RNA, 23 nt, Streptococcus pyogenes MGAS8232
cuguucauuuagugguauagaca

SEQ ID NO: 4126430 - RNA, 13 nt, Streptococcus pyogenes MGAS8232
cuguucucuuugg

SEQ ID NO: 4126431 - RNA, 21 nt, Streptococcus pyogenes MGAS8232
cuguuggauacaguccaaacu

SEQ ID NO: 4126432 - RNA, 17 nt, Streptococcus pyogenes MGAS8232
cuguuucuugcaaugcc

SEQ ID NO: 4126433 - RNA, 14 nt, Streptococcus pyogenes MGAS8232
cuguuuuugcuguc

SEQ ID NO: 4126434 - RNA, 15 nt, Streptococcus pyogenes MGAS8232
cuuaaacauauuaua

SEQ ID NO: 4126435 - RNA, 20 nt, Streptococcus pyogenes MGAS8232
cuuaaaugcaaaaaagcucu

SEQ ID NO: 4126436 - RNA, 14 nt, Streptococcus pyogenes MGAS8232
cuuaacgaaaagca

SEQ ID NO: 4126437 - RNA, 17 nt, Streptococcus pyogenes MGAS8232
cuuaacggcaucuacag

SEQ ID NO: 4126438 - RNA, 13 nt, Streptococcus pyogenes MGAS8232
cuuaaggauuuag

SEQ ID NO: 4126439 - RNA, 22 nt, Streptococcus pyogenes MGAS8232
cuuaauaaacuguauacaaaaa

SEQ ID NO: 4126440 - RNA, 23 nt, Streptococcus pyogenes MGAS8232
cuuaauaaacuguauacaaaaag

SEQ ID NO: 4126441 - RNA, 14 nt, Streptococcus pyogenes MGAS8232
cuuacaaaaagccu

SEQ ID NO: 4126442 - RNA, 19 nt, Streptococcus pyogenes MGAS8232
cuuacaaaaagccuauuua

SEQ ID NO: 4126443 - RNA, 21 nt, Streptococcus pyogenes MGAS8232
cuuacaaaaagccuauuuaau

SEQ ID NO: 4126444 - RNA, 20 nt, Streptococcus pyogenes MGAS8232
cuuacagcugguuuuuuuaa

SEQ ID NO: 4126445 - RNA, 15 nt, Streptococcus pyogenes MGAS8232
cuuacgaaaguauuu

SEQ ID NO: 4126446 - RNA, 19 nt, Streptococcus pyogenes MGAS8232
cuuacgacagcagcaguug

SEQ ID NO: 4126447 - RNA, 16 nt, Streptococcus pyogenes MGAS8232
cuuacuagugaagaca

SEQ ID NO: 4126448 - RNA, 13 nt, Streptococcus pyogenes MGAS8232
cuuagaagccuua

SEQ ID NO: 4126449 - RNA, 17 nt, Streptococcus pyogenes MGAS8232
cuuagcgaaagcuucau

SEQ ID NO: 4126450 - RNA, 19 nt, Streptococcus pyogenes MGAS8232
cuuagguggagcuuuaguu

SEQ ID NO: 4126451 - RNA, 21 nt, Streptococcus pyogenes MGAS8232
cuuauaguuugacuucaaaaa

SEQ ID NO: 4126452 - RNA, 18 nt, Streptococcus pyogenes MGAS8232
cuuaucaagguugcaagu

SEQ ID NO: 4126453 - RNA, 17 nt, Streptococcus pyogenes MGAS8232
cuuaucucuugaggccu

SEQ ID NO: 4126454 - RNA, 17 nt, Streptococcus pyogenes MGAS8232
cuuauguauuuuucaaa

SEQ ID NO: 4126455 - RNA, 13 nt, Streptococcus pyogenes MGAS8232
cuucaacauuucg

SEQ ID NO: 4126456 - RNA, 17 nt, Streptococcus pyogenes MGAS8232
cuucaaccgcuucuuuu

SEQ ID NO: 4126457 - RNA, 20 nt, Streptococcus pyogenes MGAS8232
cuucaaccgcuucuuuugca

SEQ ID NO: 4126458 - RNA, 23 nt, Streptococcus pyogenes MGAS8232
cuucaaggaaggcuuguucuuua

SEQ ID NO: 4126459 - RNA, 19 nt, Streptococcus pyogenes MGAS8232
cuucaucgaugauagcuuu

SEQ ID NO: 4126460 - RNA, 20 nt, Streptococcus pyogenes MGAS8232
cuucaucgaugauagcuuuu

SEQ ID NO: 4126461 - RNA, 21 nt, Streptococcus pyogenes MGAS8232
cuucaucgaugauagcuuuua

SEQ ID NO: 4126462 - RNA, 14 nt, Streptococcus pyogenes MGAS8232
cuucauuuuacuau

SEQ ID NO: 4126463 - RNA, 18 nt, Streptococcus pyogenes MGAS8232
cuuccaaaccauuuuaug

SEQ ID NO: 4126464 - RNA, 12 nt, Streptococcus pyogenes MGAS8232
cuucuaaaaaaa

SEQ ID NO: 4126465 - RNA, 17 nt, Streptococcus pyogenes MGAS8232
cuucuaaaaaaaaguua

SEQ ID NO: 4126466 - RNA, 13 nt, Streptococcus pyogenes MGAS8232
cuucugacaugau

SEQ ID NO: 4126467 - RNA, 16 nt, Streptococcus pyogenes MGAS8232
cuucuuacuaugaaaa

SEQ ID NO: 4126468 - RNA, 23 nt, Streptococcus pyogenes MGAS8232
cuucuucaagcucgguuuuaaac

SEQ ID NO: 4126469 - RNA, 12 nt, Streptococcus pyogenes MGAS8232
cuucuucuuuuc

SEQ ID NO: 4126470 - RNA, 13 nt, Streptococcus pyogenes MGAS8232
cuucuucuuuuca

SEQ ID NO: 4126471 - RNA, 23 nt, Streptococcus pyogenes MGAS8232
cuucuugaagccgcucuaauuua

SEQ ID NO: 4126472 - RNA, 12 nt, Streptococcus pyogenes MGAS8232
cuucuuuccagc

SEQ ID NO: 4126473 - RNA, 22 nt, Streptococcus pyogenes MGAS8232
cuucuuugcagagaugcuucuu

SEQ ID NO: 4126474 - RNA, 22 nt, Streptococcus pyogenes MGAS8232
cuucuuuucagagaugcuucuu

SEQ ID NO: 4126475 - RNA, 13 nt, Streptococcus pyogenes MGAS8232
cuucuuuuuauua

SEQ ID NO: 4126476 - RNA, 12 nt, Streptococcus pyogenes MGAS8232
cuugacuuucua

SEQ ID NO: 4126477 - RNA, 17 nt, Streptococcus pyogenes MGAS8232
cuugcaaugccagcagc

SEQ ID NO: 4126478 - RNA, 16 nt, Streptococcus pyogenes MGAS8232
cuugcagcauaaucau

SEQ ID NO: 4126479 - RNA, 22 nt, Streptococcus pyogenes MGAS8232
cuugcguagauagcaaggauga

SEQ ID NO: 4126480 - RNA, 20 nt, Streptococcus pyogenes MGAS8232
cuugcucauguuuucucaac

SEQ ID NO: 4126481 - RNA, 14 nt, Streptococcus pyogenes MGAS8232
cuugcuuugacaaa

SEQ ID NO: 4126482 - RNA, 18 nt, Streptococcus pyogenes MGAS8232
cuugguucugaaaauaaa

SEQ ID NO: 4126483 - RNA, 21 nt, Streptococcus pyogenes MGAS8232
cuugguucugaaaauaaaaua

SEQ ID NO: 4126484 - RNA, 16 nt, Streptococcus pyogenes MGAS8232
cuuguccuguaaauca

SEQ ID NO: 4126485 - RNA, 14 nt, Streptococcus pyogenes MGAS8232
cuuguuacaaaaaa

SEQ ID NO: 4126486 - RNA, 17 nt, Streptococcus pyogenes MGAS8232
cuuguucuuuauuuuga

SEQ ID NO: 4126487 - RNA, 14 nt, Streptococcus pyogenes MGAS8232
cuuguuuugguuga

SEQ ID NO: 4126488 - RNA, 22 nt, Streptococcus pyogenes MGAS8232
cuuuaaaaaguuucugaguuga

SEQ ID NO: 4126489 - RNA, 19 nt, Streptococcus pyogenes MGAS8232
cuuuaacaaugagaucuuc

SEQ ID NO: 4126490 - RNA, 23 nt, Streptococcus pyogenes MGAS8232
cuuuaacaaugagaucuucuuuu

SEQ ID NO: 4126491 - RNA, 15 nt, Streptococcus pyogenes MGAS8232
cuuuaacaugaugua

SEQ ID NO: 4126492 - RNA, 16 nt, Streptococcus pyogenes MGAS8232
cuuuaauaguuuuaca

SEQ ID NO: 4126493 - RNA, 13 nt, Streptococcus pyogenes MGAS8232
cuuuagagaauca

SEQ ID NO: 4126494 - RNA, 15 nt, Streptococcus pyogenes MGAS8232
cuuuaguugcuucuu

SEQ ID NO: 4126495 - RNA, 17 nt, Streptococcus pyogenes MGAS8232
cuuuaguugcuucuuuu

SEQ ID NO: 4126496 - RNA, 18 nt, Streptococcus pyogenes MGAS8232
cuuuaguugcuucuuuua

SEQ ID NO: 4126497 - RNA, 22 nt, Streptococcus pyogenes MGAS8232
cuuuauaaugguuuuuugucuu

SEQ ID NO: 4126498 - RNA, 19 nt, Streptococcus pyogenes MGAS8232
cuuuaucuuauuuuaagaa

SEQ ID NO: 4126499 - RNA, 13 nt, Streptococcus pyogenes MGAS8232
cuuuauugaugau

SEQ ID NO: 4126500 - RNA, 19 nt, Streptococcus pyogenes MGAS8232
cuuucaaacggaguuccuc

SEQ ID NO: 4126501 - RNA, 19 nt, Streptococcus pyogenes MGAS8232
cuuugacaaugucaauuga

SEQ ID NO: 4126502 - RNA, 14 nt, Streptococcus pyogenes MGAS8232
cuuugauuuuucuu

SEQ ID NO: 4126503 - RNA, 16 nt, Streptococcus pyogenes MGAS8232
cuuuguccauucuuua

SEQ ID NO: 4126504 - RNA, 13 nt, Streptococcus pyogenes MGAS8232
cuuuguugcauug

SEQ ID NO: 4126505 - RNA, 21 nt, Streptococcus pyogenes MGAS8232
cuuuuaagcugagcaaaacaa

SEQ ID NO: 4126506 - RNA, 22 nt, Streptococcus pyogenes MGAS8232
cuuuuaagcugagcaaaacaau

SEQ ID NO: 4126507 - RNA, 20 nt, Streptococcus pyogenes MGAS8232
cuuuuaauuuuauuuuuuaa

SEQ ID NO: 4126508 - RNA, 21 nt, Streptococcus pyogenes MGAS8232
cuuuuaauuuuauuuuuuaaa

SEQ ID NO: 4126509 - RNA, 15 nt, Streptococcus pyogenes MGAS8232
cuuuuauuaauguaa

SEQ ID NO: 4126510 - RNA, 17 nt, Streptococcus pyogenes MGAS8232
cuuuucagagaugcuuc

SEQ ID NO: 4126511 - RNA, 18 nt, Streptococcus pyogenes MGAS8232
cuuuugauaccuuuuuug

SEQ ID NO: 4126512 - RNA, 19 nt, Streptococcus pyogenes MGAS8232
cuuuuggccuacuagcaca

SEQ ID NO: 4126513 - RNA, 22 nt, Streptococcus pyogenes MGAS8232
cuuuuggccuacuagcacaaaa

SEQ ID NO: 4126514 - RNA, 18 nt, Streptococcus pyogenes MGAS8232
gauagucaaaaagacuuc

SEQ ID NO: 4126515 - RNA, 19 nt, Streptococcus pyogenes MGAS8232
gauauagaauagguaaaga

SEQ ID NO: 4126516 - RNA, 21 nt, Streptococcus pyogenes MGAS8232
gauauagaauagguaaagauu

SEQ ID NO: 4126517 - RNA, 22 nt, Streptococcus pyogenes MGAS8232
gaucauuaaauugauuauucuc

SEQ ID NO: 4126518 - RNA, 18 nt, Streptococcus pyogenes MGAS8232
gaucucgauuaucuuuuu

SEQ ID NO: 4126519 - RNA, 14 nt, Streptococcus pyogenes MGAS8232
gaugaaaugauugu

SEQ ID NO: 4126520 - RNA, 18 nt, Streptococcus pyogenes MGAS8232
gaugaaaugauuguuauu

SEQ ID NO: 4126521 - RNA, 16 nt, Streptococcus pyogenes MGAS8232
gaugaaucauuuugga

SEQ ID NO: 4126522 - RNA, 22 nt, Streptococcus pyogenes MGAS8232
gaugaauuuugucuaaaauaaa

SEQ ID NO: 4126523 - RNA, 16 nt, Streptococcus pyogenes MGAS8232
gaugacgguaaauaaa

SEQ ID NO: 4126524 - RNA, 19 nt, Streptococcus pyogenes MGAS8232
gaugauugaguaagcagca

SEQ ID NO: 4126525 - RNA, 12 nt, Streptococcus pyogenes MGAS8232
gaugauuuugaa

SEQ ID NO: 4126526 - RNA, 15 nt, Streptococcus pyogenes MGAS8232
gaugcacacaaaucu

SEQ ID NO: 4126527 - RNA, 18 nt, Streptococcus pyogenes MGAS8232
gaugccauuuaaaagggc

SEQ ID NO: 4126528 - RNA, 20 nt, Streptococcus pyogenes MGAS8232
gauguaccaauuuaagguau

SEQ ID NO: 4126529 - RNA, 14 nt, Streptococcus pyogenes MGAS8232
gauguuuauuccaa

SEQ ID NO: 4126530 - RNA, 16 nt, Streptococcus pyogenes MGAS8232
gauuacaagcauuuug

SEQ ID NO: 4126531 - RNA, 20 nt, Streptococcus pyogenes MGAS8232
gauuauuauucuaaaugaca

SEQ ID NO: 4126532 - RNA, 22 nt, Streptococcus pyogenes MGAS8232
gauuuccucuaacauguccaaa

SEQ ID NO: 4126533 - RNA, 20 nt, Streptococcus pyogenes MGAS8232
gauuucggaccaugccuaaa

SEQ ID NO: 4126534 - RNA, 21 nt, Streptococcus pyogenes MGAS8232
gauuugaccacaccuaauaaa

SEQ ID NO: 4126535 - RNA, 22 nt, Streptococcus pyogenes MGAS8232
gauuugucuucuccgacugcaa

SEQ ID NO: 4126536 - RNA, 23 nt, Streptococcus pyogenes MGAS8232
gauuuuuccuagcgggaacacuc

SEQ ID NO: 4126537 - RNA, 13 nt, Streptococcus pyogenes MGAS8232
gcaaaacaauaac

SEQ ID NO: 4126538 - RNA, 18 nt, Streptococcus pyogenes MGAS8232
gcaaaagaugauggacug

SEQ ID NO: 4126539 - RNA, 21 nt, Streptococcus pyogenes MGAS8232
gcaaauagcaaugguuaaaaa

SEQ ID NO: 4126540 - RNA, 17 nt, Streptococcus pyogenes MGAS8232
gcaaauaguagcaaaua

SEQ ID NO: 4126541 - RNA, 16 nt, Streptococcus pyogenes MGAS8232
gcaaauucuuccuuag

SEQ ID NO: 4126542 - RNA, 21 nt, Streptococcus pyogenes MGAS8232
gcaaccuuaccuacugcugga

SEQ ID NO: 4126543 - RNA, 18 nt, Streptococcus pyogenes MGAS8232
gcaauauccauagaaauu

SEQ ID NO: 4126544 - RNA, 15 nt, Streptococcus pyogenes MGAS8232
gcaauccaaaucaac

SEQ ID NO: 4126545 - RNA, 14 nt, Streptococcus pyogenes MGAS8232
gcaaucuucaacac

SEQ ID NO: 4126546 - RNA, 17 nt, Streptococcus pyogenes MGAS8232
gcaaugguuaaaaagag

SEQ ID NO: 4126547 - RNA, 19 nt, Streptococcus pyogenes MGAS8232
gcaauuguuuuuucaacaa

SEQ ID NO: 4126548 - RNA, 16 nt, Streptococcus pyogenes MGAS8232
gcaccaccaaccuuaa

SEQ ID NO: 4126549 - RNA, 15 nt, Streptococcus pyogenes MGAS8232
gcaccgcuuacccua

SEQ ID NO: 4126550 - RNA, 13 nt, Streptococcus pyogenes MGAS8232
gcaccuucaaccg

SEQ ID NO: 4126551 - RNA, 12 nt, Streptococcus pyogenes MGAS8232
gcacguuuucug

SEQ ID NO: 4126552 - RNA, 24 nt, Streptococcus pyogenes MGAS8232
gcacugagccccaaaaguuggcua

SEQ ID NO: 4126553 - RNA, 20 nt, Streptococcus pyogenes MGAS8232
gcagauggggugucagggga

SEQ ID NO: 4126554 - RNA, 14 nt, Streptococcus pyogenes MGAS8232
gcagcagaagcaaa

SEQ ID NO: 4126555 - RNA, 13 nt, Streptococcus pyogenes MGAS8232
gcaggcguuuugu

SEQ ID NO: 4126556 - RNA, 15 nt, Streptococcus pyogenes MGAS8232
gcaggguaucugcuc

SEQ ID NO: 4126557 - RNA, 20 nt, Streptococcus pyogenes MGAS8232
gcagguaauuaucugaauua

SEQ ID NO: 4126558 - RNA, 22 nt, Streptococcus pyogenes MGAS8232
gcauaaaagauauuuuaaaaua

SEQ ID NO: 4126559 - RNA, 16 nt, Streptococcus pyogenes MGAS8232
gcauaauaaaaagagu

SEQ ID NO: 4126560 - RNA, 18 nt, Streptococcus pyogenes MGAS8232
gcauaaugcauguaauga

SEQ ID NO: 4126561 - RNA, 20 nt, Streptococcus pyogenes MGAS8232
gcauauugaaacuugcugcc

SEQ ID NO: 4126562 - RNA, 16 nt, Streptococcus pyogenes MGAS8232
gcaucuacagcaccuu

SEQ ID NO: 4126563 - RNA, 17 nt, Streptococcus pyogenes MGAS8232
gcauguaaugaccaccc

SEQ ID NO: 4126564 - RNA, 23 nt, Streptococcus pyogenes MGAS8232
gcauuccucaaacacguauuuuu

SEQ ID NO: 4126565 - RNA, 15 nt, Streptococcus pyogenes MGAS8232
gcauugucaaauaaa

SEQ ID NO: 4126566 - RNA, 23 nt, Streptococcus pyogenes MGAS8232
gccacuucaagcauaauaaaaag

SEQ ID NO: 4126567 - RNA, 21 nt, Streptococcus pyogenes MGAS8232
gccagagcaguucagcagcac

SEQ ID NO: 4126568 - RNA, 13 nt, Streptococcus pyogenes MGAS8232
gccauaauggucg

SEQ ID NO: 4126569 - RNA, 16 nt, Streptococcus pyogenes MGAS8232
gcccuuauguauuuuu

SEQ ID NO: 4126570 - RNA, 21 nt, Streptococcus pyogenes MGAS8232
gccucgcugaaagucuuagca

SEQ ID NO: 4126571 - RNA, 18 nt, Streptococcus pyogenes MGAS8232
gccuguauuucuuuggua

SEQ ID NO: 4126572 - RNA, 14 nt, Streptococcus pyogenes MGAS8232
gccugucaagcccu

SEQ ID NO: 4126573 - RNA, 16 nt, Streptococcus pyogenes MGAS8232
gccugucaagcccugc

SEQ ID NO: 4126574 - RNA, 15 nt, Streptococcus pyogenes MGAS8232
gccuucuaucaaaac

SEQ ID NO: 4126575 - RNA, 21 nt, Streptococcus pyogenes MGAS8232
gccuugugccuaauccucuca

SEQ ID NO: 4126576 - RNA, 20 nt, Streptococcus pyogenes MGAS8232
gccuuuaacaugauguacca

SEQ ID NO: 4126577 - RNA, 17 nt, Streptococcus pyogenes MGAS8232
gccuuuuuaaucuuguu

SEQ ID NO: 4126578 - RNA, 13 nt, Streptococcus pyogenes MGAS8232
gcgaaagcuucau

SEQ ID NO: 4126579 - RNA, 13 nt, Streptococcus pyogenes MGAS8232
gcgauaauaaagu

SEQ ID NO: 4126580 - RNA, 22 nt, Streptococcus pyogenes MGAS8232
gcgaucauaaauaaagauaauu

SEQ ID NO: 4126581 - RNA, 20 nt, Streptococcus pyogenes MGAS8232
gcgcgacuaaaaucauggga

SEQ ID NO: 4126582 - RNA, 23 nt, Streptococcus pyogenes MGAS8232
gcguagauagcaaggaugaaaug

SEQ ID NO: 4126583 - RNA, 14 nt, Streptococcus pyogenes MGAS8232
gcgugguggagguc

SEQ ID NO: 4126584 - RNA, 20 nt, Streptococcus pyogenes MGAS8232
gcguuaucuccacagagucu

SEQ ID NO: 4126585 - RNA, 15 nt, Streptococcus pyogenes MGAS8232
gcuaaaacaguucca

SEQ ID NO: 4126586 - RNA, 18 nt, Streptococcus pyogenes MGAS8232
gcuaaaacaguuccaguu

SEQ ID NO: 4126587 - RNA, 13 nt, Streptococcus pyogenes MGAS8232
gcuacaaggcacc

SEQ ID NO: 4126588 - RNA, 14 nt, Streptococcus pyogenes MGAS8232
gcuacaaggcacca

SEQ ID NO: 4126589 - RNA, 17 nt, Streptococcus pyogenes MGAS8232
gcuagggcaacugcaau

SEQ ID NO: 4126590 - RNA, 17 nt, Streptococcus pyogenes MGAS8232
gcuauaccuaaaaaaua

SEQ ID NO: 4126591 - RNA, 22 nt, Streptococcus pyogenes MGAS8232
gcucaauugcuuuuagccugcc

SEQ ID NO: 4126592 - RNA, 12 nt, Streptococcus pyogenes MGAS8232
gcucauuugaug

SEQ ID NO: 4126593 - RNA, 17 nt, Streptococcus pyogenes MGAS8232
gcucggugcugacuggu

SEQ ID NO: 4126594 - RNA, 20 nt, Streptococcus pyogenes MGAS8232
gcucuaauuuagucauuucu

SEQ ID NO: 4126595 - RNA, 21 nt, Streptococcus pyogenes MGAS8232
gcucuaauuuagucauuucuu

SEQ ID NO: 4126596 - RNA, 22 nt, Streptococcus pyogenes MGAS8232
gcucuaauuuagucauuucuuc

SEQ ID NO: 4126597 - RNA, 18 nt, Streptococcus pyogenes MGAS8232
gcucuuaacucucauaaa

SEQ ID NO: 4126598 - RNA, 13 nt, Streptococcus pyogenes MGAS8232
gcucuuuaucacc

SEQ ID NO: 4126599 - RNA, 15 nt, Streptococcus pyogenes MGAS8232
gcucuuuaucaccug

SEQ ID NO: 4126600 - RNA, 17 nt, Streptococcus pyogenes MGAS8232
gcugaccaccggugccu

SEQ ID NO: 4126601 - RNA, 14 nt, Streptococcus pyogenes MGAS8232
gcugguuuuuuuaa

SEQ ID NO: 4126602 - RNA, 15 nt, Streptococcus pyogenes MGAS8232
gcuguuauuggaaag

SEQ ID NO: 4126603 - RNA, 13 nt, Streptococcus pyogenes MGAS8232
gcuguuggauaca

SEQ ID NO: 4126604 - RNA, 14 nt, Streptococcus pyogenes MGAS8232
gcuucuaaaaaaaa

SEQ ID NO: 4126605 - RNA, 20 nt, Streptococcus pyogenes MGAS8232
gcuucuaaaaaaaaguuauc

SEQ ID NO: 4126606 - RNA, 16 nt, Streptococcus pyogenes MGAS8232
gcuucuggcaauaagu

SEQ ID NO: 4126607 - RNA, 14 nt, Streptococcus pyogenes MGAS8232
gcuugacuuucuac

SEQ ID NO: 4126608 - RNA, 13 nt, Streptococcus pyogenes MGAS8232
gcuugucuaugag

SEQ ID NO: 4126609 - RNA, 14 nt, Streptococcus pyogenes MGAS8232
gcuuguucuuuauu

SEQ ID NO: 4126610 - RNA, 20 nt, Streptococcus pyogenes MGAS8232
gcuuucucaucuacucauga

SEQ ID NO: 4126611 - RNA, 15 nt, Streptococcus pyogenes MGAS8232
gucaauuuuaucaga

SEQ ID NO: 4126612 - RNA, 15 nt, Streptococcus pyogenes MGAS8232
gucacaccguugaug

SEQ ID NO: 4126613 - RNA, 18 nt, Streptococcus pyogenes MGAS8232
gucacaccguugauguua

SEQ ID NO: 4126614 - RNA, 19 nt, Streptococcus pyogenes MGAS8232
gucacugaaaaagccuuua

SEQ ID NO: 4126615 - RNA, 23 nt, Streptococcus pyogenes MGAS8232
gucauuucuucagguuucuuuug

SEQ ID NO: 4126616 - RNA, 16 nt, Streptococcus pyogenes MGAS8232
gucauuuuaaguaguc

SEQ ID NO: 4126617 - RNA, 13 nt, Streptococcus pyogenes MGAS8232
guccaugauuuuc

SEQ ID NO: 4126618 - RNA, 22 nt, Streptococcus pyogenes MGAS8232
guccauuuuuuauaaugguuuu

SEQ ID NO: 4126619 - RNA, 18 nt, Streptococcus pyogenes MGAS8232
guccuagucuuuuggcug

SEQ ID NO: 4126620 - RNA, 14 nt, Streptococcus pyogenes MGAS8232
guccuccucuuuag

SEQ ID NO: 4126621 - RNA, 17 nt, Streptococcus pyogenes MGAS8232
guccuuaaaagaaaauc

SEQ ID NO: 4126622 - RNA, 20 nt, Streptococcus pyogenes MGAS8232
gucgaaauugguccucugaa

SEQ ID NO: 4126623 - RNA, 18 nt, Streptococcus pyogenes MGAS8232
gucgaccuuaaaggccuc

SEQ ID NO: 4126624 - RNA, 21 nt, Streptococcus pyogenes MGAS8232
gucgcagaguacaaggcaauc

SEQ ID NO: 4126625 - RNA, 17 nt, Streptococcus pyogenes MGAS8232
gucgcugaccaccggug

SEQ ID NO: 4126626 - RNA, 13 nt, Streptococcus pyogenes MGAS8232
gucuaaaauaaag

SEQ ID NO: 4126627 - RNA, 18 nt, Streptococcus pyogenes MGAS8232
gucuaucugcagauuuua

SEQ ID NO: 4126628 - RNA, 20 nt, Streptococcus pyogenes MGAS8232
gucuccauaacauacucuau

SEQ ID NO: 4126629 - RNA, 20 nt, Streptococcus pyogenes MGAS8232
gucucgaauauaauucaugu

SEQ ID NO: 4126630 - RNA, 14 nt, Streptococcus pyogenes MGAS8232
gucugagugacuaa

SEQ ID NO: 4126631 - RNA, 17 nt, Streptococcus pyogenes MGAS8232
gucugcaaguucuuugc

SEQ ID NO: 4126632 - RNA, 17 nt, Streptococcus pyogenes MGAS8232
gucugcaugaagugguu

SEQ ID NO: 4126633 - RNA, 18 nt, Streptococcus pyogenes MGAS8232
gucugcgcgacuaaaauc

SEQ ID NO: 4126634 - RNA, 22 nt, Streptococcus pyogenes MGAS8232
gucuggcauuugucuguggcuu

SEQ ID NO: 4126635 - RNA, 21 nt, Streptococcus pyogenes MGAS8232
gucuugcucauguuuucucaa

SEQ ID NO: 4126636 - RNA, 22 nt, Streptococcus pyogenes MGAS8232
gugaaaguaucuaggagggacu

SEQ ID NO: 4126637 - RNA, 14 nt, Streptococcus pyogenes MGAS8232
gugaauaaucuuca

SEQ ID NO: 4126638 - RNA, 16 nt, Streptococcus pyogenes MGAS8232
gugacgacacaacuca

SEQ ID NO: 4126639 - RNA, 20 nt, Streptococcus pyogenes MGAS8232
uaacagaaauuaauaaauuu

SEQ ID NO: 4126640 - RNA, 13 nt, Streptococcus pyogenes MGAS8232
uaacaucuugauu

SEQ ID NO: 4126641 - RNA, 16 nt, Streptococcus pyogenes MGAS8232
uaacaucuugauugua

SEQ ID NO: 4126642 - RNA, 17 nt, Streptococcus pyogenes MGAS8232
uaaccaauuccucccua

SEQ ID NO: 4126643 - RNA, 16 nt, Streptococcus pyogenes MGAS8232
uaaccauaucacaaaa

SEQ ID NO: 4126644 - RNA, 14 nt, Streptococcus pyogenes MGAS8232
uaaccauugccauu

SEQ ID NO: 4126645 - RNA, 22 nt, Streptococcus pyogenes MGAS8232
uaacccgucuuacaauuaauag

SEQ ID NO: 4126646 - RNA, 23 nt, Streptococcus pyogenes MGAS8232
uaacccucauugucaaagcugac

SEQ ID NO: 4126647 - RNA, 15 nt, Streptococcus pyogenes MGAS8232
uaaccuucaacauuu

SEQ ID NO: 4126648 - RNA, 14 nt, Streptococcus pyogenes MGAS8232
uaaccuuugccauu

SEQ ID NO: 4126649 - RNA, 15 nt, Streptococcus pyogenes MGAS8232
uaacgauagcaauca

SEQ ID NO: 4126650 - RNA, 17 nt, Streptococcus pyogenes MGAS8232
uaacgauagcaaucaca

SEQ ID NO: 4126651 - RNA, 16 nt, Streptococcus pyogenes MGAS8232
uaacuagccuacaguc

SEQ ID NO: 4126652 - RNA, 15 nt, Streptococcus pyogenes MGAS8232
uaacuccuuaaauua

SEQ ID NO: 4126653 - RNA, 19 nt, Streptococcus pyogenes MGAS8232
uaacuccuuaaauuauagu

SEQ ID NO: 4126654 - RNA, 22 nt, Streptococcus pyogenes MGAS8232
uaacuccuuaaauuauaguaua

SEQ ID NO: 4126655 - RNA, 15 nt, Streptococcus pyogenes MGAS8232
uaagaaggucucaaa

SEQ ID NO: 4126656 - RNA, 18 nt, Streptococcus pyogenes MGAS8232
uaagaccuucaaaaaagg

SEQ ID NO: 4126657 - RNA, 23 nt, Streptococcus pyogenes MGAS8232
uaagagagguugguaaaaaggca

SEQ ID NO: 4126658 - RNA, 15 nt, Streptococcus pyogenes MGAS8232
uaagagccaucagcu

SEQ ID NO: 4126659 - RNA, 22 nt, Streptococcus pyogenes MGAS8232
uaagagccaucagcucucaaga

SEQ ID NO: 4126660 - RNA, 16 nt, Streptococcus pyogenes MGAS8232
uaagauggugcuuuaa

SEQ ID NO: 4126661 - RNA, 13 nt, Streptococcus pyogenes MGAS8232
uaagauucaauau

SEQ ID NO: 4126662 - RNA, 20 nt, Streptococcus pyogenes MGAS8232
uaagauuugaccacaccuaa

SEQ ID NO: 4126663 - RNA, 21 nt, Streptococcus pyogenes MGAS8232
uaagcaucauuauugacaaau

SEQ ID NO: 4126664 - RNA, 23 nt, Streptococcus pyogenes MGAS8232
uaagcaucauuauugacaaaucc

SEQ ID NO: 4126665 - RNA, 21 nt, Streptococcus pyogenes MGAS8232
uaagcuuacuucuaagagcca

SEQ ID NO: 4126666 - RNA, 15 nt, Streptococcus pyogenes MGAS8232
uaaggaccaagauuc

SEQ ID NO: 4126667 - RNA, 13 nt, Streptococcus pyogenes MGAS8232
uaaggauuuagcu

SEQ ID NO: 4126668 - RNA, 17 nt, Streptococcus pyogenes MGAS8232
uaaggcugcgaugauuu

SEQ ID NO: 4126669 - RNA, 17 nt, Streptococcus pyogenes MGAS8232
uaaggcuuacgacagca

SEQ ID NO: 4126670 - RNA, 14 nt, Streptococcus pyogenes MGAS8232
uaaggguuaacaau

SEQ ID NO: 4126671 - RNA, 21 nt, Streptococcus pyogenes MGAS8232
uaagguacacgugauaaaugc

SEQ ID NO: 4126672 - RNA, 13 nt, Streptococcus pyogenes MGAS8232
uaaguaaaagcga

SEQ ID NO: 4126673 - RNA, 18 nt, Streptococcus pyogenes MGAS8232
uaaguaaaggauuuaguu

SEQ ID NO: 4126674 - RNA, 14 nt, Streptococcus pyogenes MGAS8232
uaaguaauguguug

SEQ ID NO: 4126675 - RNA, 17 nt, Streptococcus pyogenes MGAS8232
uaaguagucaaaauagg

SEQ ID NO: 4126676 - RNA, 17 nt, Streptococcus pyogenes MGAS8232
uaaguauuuuaaaaucc

SEQ ID NO: 4126677 - RNA, 16 nt, Streptococcus pyogenes MGAS8232
uaagucacaccguuga

SEQ ID NO: 4126678 - RNA, 15 nt, Streptococcus pyogenes MGAS8232
uaagucauuuuaagu

SEQ ID NO: 4126679 - RNA, 17 nt, Streptococcus pyogenes MGAS8232
uaagugagcgcccuaaa

SEQ ID NO: 4126680 - RNA, 12 nt, Streptococcus pyogenes MGAS8232
uaauaaaaagua

SEQ ID NO: 4126681 - RNA, 15 nt, Streptococcus pyogenes MGAS8232
uaauaaacuguauac

SEQ ID NO: 4126682 - RNA, 19 nt, Streptococcus pyogenes MGAS8232
uaauaaacuguauacaaaa

SEQ ID NO: 4126683 - RNA, 15 nt, Streptococcus pyogenes MGAS8232
uaauaacaaaaugaa

SEQ ID NO: 4126684 - RNA, 12 nt, Streptococcus pyogenes MGAS8232
uaauaagauuca

SEQ ID NO: 4126685 - RNA, 18 nt, Streptococcus pyogenes MGAS8232
uaauaagauucaauauga

SEQ ID NO: 4126686 - RNA, 22 nt, Streptococcus pyogenes MGAS8232
uaauaagauucaauaugaaaac

SEQ ID NO: 4126687 - RNA, 19 nt, Streptococcus pyogenes MGAS8232
uaauaaguauuuuaaaauc

SEQ ID NO: 4126688 - RNA, 20 nt, Streptococcus pyogenes MGAS8232
uaauaaguauuuuaaaaucc

SEQ ID NO: 4126689 - RNA, 16 nt, Streptococcus pyogenes MGAS8232
uaauacgagcuagggc

SEQ ID NO: 4126690 - RNA, 13 nt, Streptococcus pyogenes MGAS8232
uaauagaauaaaa

SEQ ID NO: 4126691 - RNA, 11 nt, Streptococcus pyogenes MGAS8232
uaauaguuuua

SEQ ID NO: 4126692 - RNA, 14 nt, Streptococcus pyogenes MGAS8232
uaauauuuuuacau

SEQ ID NO: 4126693 - RNA, 13 nt, Streptococcus pyogenes MGAS8232
uaaucaaaaaacu

SEQ ID NO: 4126694 - RNA, 20 nt, Streptococcus pyogenes MGAS8232
uaaucaaaaaacugagacaa

SEQ ID NO: 4126695 - RNA, 16 nt, Streptococcus pyogenes MGAS8232
uaaucagagcucgucu

SEQ ID NO: 4126696 - RNA, 15 nt, Streptococcus pyogenes MGAS8232
uaaucgaaaaugcuu

SEQ ID NO: 4126697 - RNA, 15 nt, Streptococcus pyogenes MGAS8232
uaaucguaaugucuu

SEQ ID NO: 4126698 - RNA, 20 nt, Streptococcus pyogenes MGAS8232
uaaucguaaugucuuguucu

SEQ ID NO: 4126699 - RNA, 20 nt, Streptococcus pyogenes MGAS8232
uaaucuuguugggcacuuac

SEQ ID NO: 4126700 - RNA, 11 nt, Streptococcus pyogenes MGAS8232
uaaucuuuguu

SEQ ID NO: 4126701 - RNA, 11 nt, Streptococcus pyogenes MGAS8232
uaaucuuuuug

SEQ ID NO: 4126702 - RNA, 20 nt, Streptococcus pyogenes MGAS8232
uaaucuuuuugugauauauu

SEQ ID NO: 4126703 - RNA, 20 nt, Streptococcus pyogenes MGAS8232
uaaugagcaaggcaagagga

SEQ ID NO: 4126704 - RNA, 15 nt, Streptococcus pyogenes MGAS8232
uaaugauaaggcugc

SEQ ID NO: 4126705 - RNA, 16 nt, Streptococcus pyogenes MGAS8232
uaaugauuuuuaauuc

SEQ ID NO: 4126706 - RNA, 18 nt, Streptococcus pyogenes MGAS8232
uaaugauuuuuaauucuu

SEQ ID NO: 4126707 - RNA, 18 nt, Streptococcus pyogenes MGAS8232
uaauguaaaaaccgcuca

SEQ ID NO: 4126708 - RNA, 23 nt, Streptococcus pyogenes MGAS8232
uaauguuaggagcacaaaagagg

SEQ ID NO: 4126709 - RNA, 21 nt, Streptococcus pyogenes MGAS8232
uaauguuauaauaauauuaua

SEQ ID NO: 4126710 - RNA, 11 nt, Streptococcus pyogenes MGAS8232
uaauuagcaua

SEQ ID NO: 4126711 - RNA, 11 nt, Streptococcus pyogenes MGAS8232
uaauuaucuga

SEQ ID NO: 4126712 - RNA, 13 nt, Streptococcus pyogenes MGAS8232
uaauuaucugaau

SEQ ID NO: 4126713 - RNA, 18 nt, Streptococcus pyogenes MGAS8232
uaauuaugcaaaagauga

SEQ ID NO: 4126714 - RNA, 21 nt, Streptococcus pyogenes MGAS8232
uaauuauuuuaauuuuuccuu

SEQ ID NO: 4126715 - RNA, 12 nt, Streptococcus pyogenes MGAS8232
uaauucuucuuu

SEQ ID NO: 4126716 - RNA, 16 nt, Streptococcus pyogenes MGAS8232
uaauucuuuaauaguu

SEQ ID NO: 4126717 - RNA, 19 nt, Streptococcus pyogenes MGAS8232
uaauuuaccccaaaggcug

SEQ ID NO: 4126718 - RNA, 20 nt, Streptococcus pyogenes MGAS8232
uaauuuauuccauuuaucuu

SEQ ID NO: 4126719 - RNA, 16 nt, Streptococcus pyogenes MGAS8232
uaauuuuauuuuuuaa

SEQ ID NO: 4126720 - RNA, 12 nt, Streptococcus pyogenes MGAS8232
uacaaaaaacaa

SEQ ID NO: 4126721 - RNA, 19 nt, Streptococcus pyogenes MGAS8232
uacaaaaaaccuuccugua

SEQ ID NO: 4126722 - RNA, 13 nt, Streptococcus pyogenes MGAS8232
uacaaaauaaccc

SEQ ID NO: 4126723 - RNA, 15 nt, Streptococcus pyogenes MGAS8232
uacaagagcuuaaaa

SEQ ID NO: 4126724 - RNA, 15 nt, Streptococcus pyogenes MGAS8232
uacaagcauuuugca

SEQ ID NO: 4126725 - RNA, 22 nt, Streptococcus pyogenes MGAS8232
uacaauacgauaguguguguga

SEQ ID NO: 4126726 - RNA, 18 nt, Streptococcus pyogenes MGAS8232
uacacgugauaaaugccg

SEQ ID NO: 4126727 - RNA, 19 nt, Streptococcus pyogenes MGAS8232
uacauaaaaugacuucaaa

SEQ ID NO: 4126728 - RNA, 20 nt, Streptococcus pyogenes MGAS8232
uacauggguguuuaaucuuu

SEQ ID NO: 4126729 - RNA, 21 nt, Streptococcus pyogenes MGAS8232
uaccaacaauguagcuaucaa

SEQ ID NO: 4126730 - RNA, 14 nt, Streptococcus pyogenes MGAS8232
uaccagcaccuucu

SEQ ID NO: 4126731 - RNA, 14 nt, Streptococcus pyogenes MGAS8232
uaccauuucuuugc

SEQ ID NO: 4126732 - RNA, 17 nt, Streptococcus pyogenes MGAS8232
uaccauuuuuaucugua

SEQ ID NO: 4126733 - RNA, 18 nt, Streptococcus pyogenes MGAS8232
uaccccaaaggcugaugc

SEQ ID NO: 4126734 - RNA, 17 nt, Streptococcus pyogenes MGAS8232
uaccuaaaaaauaacuu

SEQ ID NO: 4126735 - RNA, 13 nt, Streptococcus pyogenes MGAS8232
uaccuaaaagaac

SEQ ID NO: 4126736 - RNA, 15 nt, Streptococcus pyogenes MGAS8232
uaccuauauuauacu

SEQ ID NO: 4126737 - RNA, 18 nt, Streptococcus pyogenes MGAS8232
uaccuauugagucuuuuu

SEQ ID NO: 4126738 - RNA, 20 nt, Streptococcus pyogenes MGAS8232
uaccuccuaaauugguuuuu

SEQ ID NO: 4126739 - RNA, 17 nt, Streptococcus pyogenes MGAS8232
uaccuuauuuucuaggu

SEQ ID NO: 4126740 - RNA, 14 nt, Streptococcus pyogenes MGAS8232
uaccuucauagaca

SEQ ID NO: 4126741 - RNA, 13 nt, Streptococcus pyogenes MGAS8232
uacgacagcagca

SEQ ID NO: 4126742 - RNA, 17 nt, Streptococcus pyogenes MGAS8232
uacgacagcagcaguug

SEQ ID NO: 4126743 - RNA, 19 nt, Streptococcus pyogenes MGAS8232
uacggcuucuacacaaaag

SEQ ID NO: 4126744 - RNA, 16 nt, Streptococcus pyogenes MGAS8232
uacgggauuuaguucu

SEQ ID NO: 4126745 - RNA, 16 nt, Streptococcus pyogenes MGAS8232
uacgguaaaaacucaa

SEQ ID NO: 4126746 - RNA, 14 nt, Streptococcus pyogenes MGAS8232
uacguuuauuuagu

SEQ ID NO: 4126747 - RNA, 15 nt, Streptococcus pyogenes MGAS8232
uacuaugaaaaaaga

SEQ ID NO: 4126748 - RNA, 18 nt, Streptococcus pyogenes MGAS8232
uacuauggcuucuaaaaa

SEQ ID NO: 4126749 - RNA, 17 nt, Streptococcus pyogenes MGAS8232
uacucaauauaauaaaa

SEQ ID NO: 4126750 - RNA, 16 nt, Streptococcus pyogenes MGAS8232
uacucaucuacucuau

SEQ ID NO: 4126751 - RNA, 20 nt, Streptococcus pyogenes MGAS8232
uacuccguuucuaguuucau

SEQ ID NO: 4126752 - RNA, 16 nt, Streptococcus pyogenes MGAS8232
uacucuauuuuaagua

SEQ ID NO: 4126753 - RNA, 18 nt, Streptococcus pyogenes MGAS8232
uacucuauuuuaaguaaa

SEQ ID NO: 4126754 - RNA, 20 nt, Streptococcus pyogenes MGAS8232
uacugggucaacuccaaucu

SEQ ID NO: 4126755 - RNA, 18 nt, Streptococcus pyogenes MGAS8232
uacuggucaauggaaauu

SEQ ID NO: 4126756 - RNA, 20 nt, Streptococcus pyogenes MGAS8232
uacuguaauauuuccuuuua

SEQ ID NO: 4126757 - RNA, 14 nt, Streptococcus pyogenes MGAS8232
uacuucaaggaagg

SEQ ID NO: 4126758 - RNA, 16 nt, Streptococcus pyogenes MGAS8232
uacuucgguauucuuu

SEQ ID NO: 4126759 - RNA, 12 nt, Streptococcus pyogenes MGAS8232
uagaaauagucu

SEQ ID NO: 4126760 - RNA, 22 nt, Streptococcus pyogenes MGAS8232
uagaaauagucuccauaacaua

SEQ ID NO: 4126761 - RNA, 23 nt, Streptococcus pyogenes MGAS8232
uagaaauagucuccauaacauac

SEQ ID NO: 4126762 - RNA, 16 nt, Streptococcus pyogenes MGAS8232
uagaaauuguaaccac

SEQ ID NO: 4126763 - RNA, 13 nt, Streptococcus pyogenes MGAS8232
uagaauaaaaaga

SEQ ID NO: 4126764 - RNA, 23 nt, Streptococcus pyogenes MGAS8232
uagaauagguaaagauuuuaaau

SEQ ID NO: 4126765 - RNA, 15 nt, Streptococcus pyogenes MGAS8232
uagauaaacugguua

SEQ ID NO: 4126766 - RNA, 23 nt, Streptococcus pyogenes MGAS8232
uagaugaauuuugucuaaaauaa

SEQ ID NO: 4126767 - RNA, 13 nt, Streptococcus pyogenes MGAS8232
uagcaagaaguuu

SEQ ID NO: 4126768 - RNA, 14 nt, Streptococcus pyogenes MGAS8232
uagcaagaaguuuu

SEQ ID NO: 4126769 - RNA, 21 nt, Streptococcus pyogenes MGAS8232
uagcaaguccugcuuuugaug

SEQ ID NO: 4126770 - RNA, 19 nt, Streptococcus pyogenes MGAS8232
uagcaaugguuaaaaagag

SEQ ID NO: 4126771 - RNA, 16 nt, Streptococcus pyogenes MGAS8232
uagcagcagaagcaaa

SEQ ID NO: 4126772 - RNA, 19 nt, Streptococcus pyogenes MGAS8232
uagcaguuauaauuaguau

SEQ ID NO: 4126773 - RNA, 16 nt, Streptococcus pyogenes MGAS8232
uagcauaaugcaugua

SEQ ID NO: 4126774 - RNA, 14 nt, Streptococcus pyogenes MGAS8232
uagcauauuuugau

SEQ ID NO: 4126775 - RNA, 23 nt, Streptococcus pyogenes MGAS8232
uagcauuaaggauuaugaaaaag

SEQ ID NO: 4126776 - RNA, 20 nt, Streptococcus pyogenes MGAS8232
uagcauugucaaauaaaauc

SEQ ID NO: 4126777 - RNA, 21 nt, Streptococcus pyogenes MGAS8232
uagcucaucccuacuaggcuu

SEQ ID NO: 4126778 - RNA, 17 nt, Streptococcus pyogenes MGAS8232
uagcugauuuguuuucu

SEQ ID NO: 4126779 - RNA, 20 nt, Streptococcus pyogenes MGAS8232
uagcugcugcuaaagcaauc

SEQ ID NO: 4126780 - RNA, 12 nt, Streptococcus pyogenes MGAS8232
uagcuuuuaauu

SEQ ID NO: 4126781 - RNA, 13 nt, Streptococcus pyogenes MGAS8232
uagcuuuuaauug

SEQ ID NO: 4126782 - RNA, 13 nt, Streptococcus pyogenes MGAS8232
uaggaauaaaaug

SEQ ID NO: 4126783 - RNA, 16 nt, Streptococcus pyogenes MGAS8232
uaggaaucacaacuuc

SEQ ID NO: 4126784 - RNA, 22 nt, Streptococcus pyogenes MGAS8232
uaggauauaagaaggucucaaa

SEQ ID NO: 4126785 - RNA, 21 nt, Streptococcus pyogenes MGAS8232
uaggauauagaauagguaaag

SEQ ID NO: 4126786 - RNA, 16 nt, Streptococcus pyogenes MGAS8232
uaggcagacaauuauu

SEQ ID NO: 4126787 - RNA, 20 nt, Streptococcus pyogenes MGAS8232
uaggcuuuuuuuguaucuca

SEQ ID NO: 4126788 - RNA, 18 nt, Streptococcus pyogenes MGAS8232
uagggauuuuuuuaacua

SEQ ID NO: 4126789 - RNA, 23 nt, Streptococcus pyogenes MGAS8232
uagggcggaugauucaaaugaag

SEQ ID NO: 4126790 - RNA, 23 nt, Streptococcus pyogenes MGAS8232
uagguacucguaagcauuuugag

SEQ ID NO: 4126791 - RNA, 17 nt, Streptococcus pyogenes MGAS8232
uaguaaagccuuaucca

SEQ ID NO: 4126792 - RNA, 17 nt, Streptococcus pyogenes MGAS8232
uaguaaccauugccauu

SEQ ID NO: 4126793 - RNA, 20 nt, Streptococcus pyogenes MGAS8232
uaguaaccguuggcauaacc

SEQ ID NO: 4126794 - RNA, 15 nt, Streptococcus pyogenes MGAS8232
uaguagcaaauaaca

SEQ ID NO: 4126795 - RNA, 21 nt, Streptococcus pyogenes MGAS8232
uagucaaaauaggcagagccu

SEQ ID NO: 4126796 - RNA, 20 nt, Streptococcus pyogenes MGAS8232
uaguccaaaauguacauccu

SEQ ID NO: 4126797 - RNA, 22 nt, Streptococcus pyogenes MGAS8232
uagucgacucccuuuaauucuu

SEQ ID NO: 4126798 - RNA, 14 nt, Streptococcus pyogenes MGAS8232
uagugguauagaca

SEQ ID NO: 4126799 - RNA, 19 nt, Streptococcus pyogenes MGAS8232
uaguuaucucauaaaaaag

SEQ ID NO: 4126800 - RNA, 17 nt, Streptococcus pyogenes MGAS8232
uaguuauguuauaagau

SEQ ID NO: 4126801 - RNA, 15 nt, Streptococcus pyogenes MGAS8232
uaguugcuucuuuua

SEQ ID NO: 4126802 - RNA, 18 nt, Streptococcus pyogenes MGAS8232
uaguugguauauagcuca

SEQ ID NO: 4126803 - RNA, 16 nt, Streptococcus pyogenes MGAS8232
uaguugugauauaaaa

SEQ ID NO: 4126804 - RNA, 22 nt, Streptococcus pyogenes MGAS8232
uaguuuaggaaucacaacuucu

SEQ ID NO: 4126805 - RNA, 15 nt, Streptococcus pyogenes MGAS8232
uaguuuauuacaaaa

SEQ ID NO: 4126806 - RNA, 21 nt, Streptococcus pyogenes MGAS8232
uaguuuauuacaaaacugucu

SEQ ID NO: 4126807 - RNA, 17 nt, Streptococcus pyogenes MGAS8232
uaguuuuuagcagcaga

SEQ ID NO: 4126808 - RNA, 20 nt, Streptococcus pyogenes MGAS8232
uauaaacuuguugacucuga

SEQ ID NO: 4126809 - RNA, 15 nt, Streptococcus pyogenes MGAS8232
uauaaagaaacaaaa

SEQ ID NO: 4126810 - RNA, 17 nt, Streptococcus pyogenes MGAS8232
uauaaagaaacaaaaau

SEQ ID NO: 4126811 - RNA, 23 nt, Streptococcus pyogenes MGAS8232
uauaaauuauuaacguuaacaaa

SEQ ID NO: 4126812 - RNA, 15 nt, Streptococcus pyogenes MGAS8232
uauaacuguucauuu

SEQ ID NO: 4126813 - RNA, 16 nt, Streptococcus pyogenes MGAS8232
uauaacuguuuuucuu

SEQ ID NO: 4126814 - RNA, 17 nt, Streptococcus pyogenes MGAS8232
uauaacuguuuuucuua

SEQ ID NO: 4126815 - RNA, 13 nt, Streptococcus pyogenes MGAS8232
uauaagagccauc

SEQ ID NO: 4126816 - RNA, 20 nt, Streptococcus pyogenes MGAS8232
uauaagauaaguaauauuuu

SEQ ID NO: 4126817 - RNA, 15 nt, Streptococcus pyogenes MGAS8232
uauaccuaaaaaaua

SEQ ID NO: 4126818 - RNA, 22 nt, Streptococcus pyogenes MGAS8232
uauacgguaaaaacucaaaaaa

SEQ ID NO: 4126819 - RNA, 14 nt, Streptococcus pyogenes MGAS8232
uauacuuuaaacac

SEQ ID NO: 4126820 - RNA, 14 nt, Streptococcus pyogenes MGAS8232
uauagaauagguaa

SEQ ID NO: 4126821 - RNA, 23 nt, Streptococcus pyogenes MGAS8232
uauagcuccuaaaaccauaccua

SEQ ID NO: 4126822 - RNA, 19 nt, Streptococcus pyogenes MGAS8232
uauaguauaccuauauuau

SEQ ID NO: 4126823 - RNA, 17 nt, Streptococcus pyogenes MGAS8232
uauaguauuaucucauu

SEQ ID NO: 4126824 - RNA, 18 nt, Streptococcus pyogenes MGAS8232
uauaugcgugguggaggu

SEQ ID NO: 4126825 - RNA, 21 nt, Streptococcus pyogenes MGAS8232
uauaugucaucaaaagaccau

SEQ ID NO: 4126826 - RNA, 16 nt, Streptococcus pyogenes MGAS8232
uauauguguaauuucu

SEQ ID NO: 4126827 - RNA, 13 nt, Streptococcus pyogenes MGAS8232
uaucaagagucau

SEQ ID NO: 4126828 - RNA, 22 nt, Streptococcus pyogenes MGAS8232
uaucaauaacagaaauuaauaa

SEQ ID NO: 4126829 - RNA, 18 nt, Streptococcus pyogenes MGAS8232
uaucaggcaaaacaaaaa

SEQ ID NO: 4126830 - RNA, 19 nt, Streptococcus pyogenes MGAS8232
uaucaugaaguauaguuau

SEQ ID NO: 4126831 - RNA, 16 nt, Streptococcus pyogenes MGAS8232
uauccaacuuuuauca

SEQ ID NO: 4126832 - RNA, 18 nt, Streptococcus pyogenes MGAS8232
uauccaaugaaaacucca

SEQ ID NO: 4126833 - RNA, 13 nt, Streptococcus pyogenes MGAS8232
uauccauuauaaa

SEQ ID NO: 4126834 - RNA, 15 nt, Streptococcus pyogenes MGAS8232
uauccauuauaaauc

SEQ ID NO: 4126835 - RNA, 19 nt, Streptococcus pyogenes MGAS8232
uauccuccuaaauauaaau

SEQ ID NO: 4126836 - RNA, 17 nt, Streptococcus pyogenes MGAS8232
uauccucuuuuaguuca

SEQ ID NO: 4126837 - RNA, 17 nt, Streptococcus pyogenes MGAS8232
uaucuaagcuauagaaa

SEQ ID NO: 4126838 - RNA, 18 nt, Streptococcus pyogenes MGAS8232
uaucuagaacagcugcuu

SEQ ID NO: 4126839 - RNA, 18 nt, Streptococcus pyogenes MGAS8232
uaucucauaacaaauuua

SEQ ID NO: 4126840 - RNA, 21 nt, Streptococcus pyogenes MGAS8232
uaucucggagcuuuaccuccu

SEQ ID NO: 4126841 - RNA, 23 nt, Streptococcus pyogenes MGAS8232
uaucugcagauuuuaagacaaca

SEQ ID NO: 4126842 - RNA, 21 nt, Streptococcus pyogenes MGAS8232
uaucuuuguuaccuucuucaa

SEQ ID NO: 4126843 - RNA, 18 nt, Streptococcus pyogenes MGAS8232
uaugaaaaaagaacaaag

SEQ ID NO: 4126844 - RNA, 13 nt, Streptococcus pyogenes MGAS8232
uaugaaaaagaag

SEQ ID NO: 4126845 - RNA, 13 nt, Streptococcus pyogenes MGAS8232
uaugauauaaaaa

SEQ ID NO: 4126846 - RNA, 14 nt, Streptococcus pyogenes MGAS8232
uaugauauaaaaau

SEQ ID NO: 4126847 - RNA, 18 nt, Streptococcus pyogenes MGAS8232
uaugcagguguuuaaaga

SEQ ID NO: 4126848 - RNA, 14 nt, Streptococcus pyogenes MGAS8232
uaugcauguagaug

SEQ ID NO: 4126849 - RNA, 16 nt, Streptococcus pyogenes MGAS8232
uauggcuauaaaugga

SEQ ID NO: 4126850 - RNA, 20 nt, Streptococcus pyogenes MGAS8232
uauggcuucuaaaaaaaagu

SEQ ID NO: 4126851 - RNA, 19 nt, Streptococcus pyogenes MGAS8232
uauguaacgcuuguuuaug

SEQ ID NO: 4126852 - RNA, 19 nt, Streptococcus pyogenes MGAS8232
uauguauuuuucaaaaucu

SEQ ID NO: 4126853 - RNA, 18 nt, Streptococcus pyogenes MGAS8232
uaugugauuauuauucua

SEQ ID NO: 4126854 - RNA, 13 nt, Streptococcus pyogenes MGAS8232
uauguucuaaaaa

SEQ ID NO: 4126855 - RNA, 20 nt, Streptococcus pyogenes MGAS8232
uauguugcuuaaugaccuuu

SEQ ID NO: 4126856 - RNA, 12 nt, Streptococcus pyogenes MGAS8232
uauuaaagagaa

SEQ ID NO: 4126857 - RNA, 14 nt, Streptococcus pyogenes MGAS8232
uauuaaagagaaag

SEQ ID NO: 4126858 - RNA, 15 nt, Streptococcus pyogenes MGAS8232
uauuaaccaauuccu

SEQ ID NO: 4126859 - RNA, 19 nt, Streptococcus pyogenes MGAS8232
uauuaauaaguauuuuaaa

SEQ ID NO: 4126860 - RNA, 20 nt, Streptococcus pyogenes MGAS8232
uauuaauaaguauuuuaaaa

SEQ ID NO: 4126861 - RNA, 22 nt, Streptococcus pyogenes MGAS8232
uauuauacucaauauaauaaaa

SEQ ID NO: 4126862 - RNA, 17 nt, Streptococcus pyogenes MGAS8232
uauuauauuaaauuaau

SEQ ID NO: 4126863 - RNA, 13 nt, Streptococcus pyogenes MGAS8232
uauuauucuaaau

SEQ ID NO: 4126864 - RNA, 14 nt, Streptococcus pyogenes MGAS8232
uauuauucuaacau

SEQ ID NO: 4126865 - RNA, 13 nt, Streptococcus pyogenes MGAS8232
uauucauuuucuu

SEQ ID NO: 4126866 - RNA, 19 nt, Streptococcus pyogenes MGAS8232
uauuccaaacauccaauca

SEQ ID NO: 4126867 - RNA, 16 nt, Streptococcus pyogenes MGAS8232
uauucucuauuuuugg

SEQ ID NO: 4126868 - RNA, 16 nt, Streptococcus pyogenes MGAS8232
uauucuuaaaaaaauc

SEQ ID NO: 4126869 - RNA, 16 nt, Streptococcus pyogenes MGAS8232
uauuggaaaauauauu

SEQ ID NO: 4126870 - RNA, 22 nt, Streptococcus pyogenes MGAS8232
uauuggccuucuuggaaaacag

SEQ ID NO: 4126871 - RNA, 21 nt, Streptococcus pyogenes MGAS8232
uauugguugccugaaauauaa

SEQ ID NO: 4126872 - RNA, 14 nt, Streptococcus pyogenes MGAS8232
uauugugcuauuca

SEQ ID NO: 4126873 - RNA, 22 nt, Streptococcus pyogenes MGAS8232
uauuguggcgggccuucuauca

SEQ ID NO: 4126874 - RNA, 15 nt, Streptococcus pyogenes MGAS8232
uauuguuaauauagu

SEQ ID NO: 4126875 - RNA, 14 nt, Streptococcus pyogenes MGAS8232
uauuuaauagcauu

SEQ ID NO: 4126876 - RNA, 23 nt, Streptococcus pyogenes MGAS8232
uauuucacuagacauucguucua

SEQ ID NO: 4126877 - RNA, 14 nt, Streptococcus pyogenes MGAS8232
uauuucggccacuu

SEQ ID NO: 4126878 - RNA, 19 nt, Streptococcus pyogenes MGAS8232
uauuucggccacuucaagc

SEQ ID NO: 4126879 - RNA, 20 nt, Streptococcus pyogenes MGAS8232
uauuucggccacuucaagca

SEQ ID NO: 4126880 - RNA, 17 nt, Streptococcus pyogenes MGAS8232
uauuugaaguaaaggau

SEQ ID NO: 4126881 - RNA, 20 nt, Streptococcus pyogenes MGAS8232
uauuuuaaaauccucuuuua

SEQ ID NO: 4126882 - RNA, 22 nt, Streptococcus pyogenes MGAS8232
uauuuuaaaauccucuuuuaau

SEQ ID NO: 4126883 - RNA, 23 nt, Streptococcus pyogenes MGAS8232
uauuuuauauuauguucuaaaaa

SEQ ID NO: 4126884 - RNA, 21 nt, Streptococcus pyogenes MGAS8232
uauuuucuagguuaaaauaga

SEQ ID NO: 4126885 - RNA, 15 nt, Streptococcus pyogenes MGAS8232
uauuuugauauuuuu

SEQ ID NO: 4126886 - RNA, 13 nt, Streptococcus pyogenes MGAS8232
uauuuugcuucua

SEQ ID NO: 4126887 - RNA, 16 nt, Streptococcus pyogenes MGAS8232
uauuuugugacuauau

SEQ ID NO: 4126888 - RNA, 20 nt, Streptococcus pyogenes MGAS8232
uauuuuucgaccaauucuaa

SEQ ID NO: 4126889 - RNA, 11 nt, Streptococcus pyogenes MGAS8232
uauuuuuuagu

SEQ ID NO: 4126890 - RNA, 17 nt, Streptococcus pyogenes MGAS8232
uauuuuuucucaaaaau

SEQ ID NO: 4126891 - RNA, 13 nt, Streptococcus pyogenes MGAS8232
ucaaaaaagggaa

SEQ ID NO: 4126892 - RNA, 19 nt, Streptococcus pyogenes MGAS8232
ucaaaaaauuaagaaggaa

SEQ ID NO: 4126893 - RNA, 20 nt, Streptococcus pyogenes MGAS8232
ucaaaaagucgucaacgcua

SEQ ID NO: 4126894 - RNA, 16 nt, Streptococcus pyogenes MGAS8232
ucaaaaauacuaccuu

SEQ ID NO: 4126895 - RNA, 15 nt, Streptococcus pyogenes MGAS8232
ucaaacacguauuuu

SEQ ID NO: 4126896 - RNA, 19 nt, Streptococcus pyogenes MGAS8232
ucaaacacguauuuuucga

SEQ ID NO: 4126897 - RNA, 22 nt, Streptococcus pyogenes MGAS8232
ucaaauaaaaucguuauuaauu

SEQ ID NO: 4126898 - RNA, 19 nt, Streptococcus pyogenes MGAS8232
ucaaauccgcuugcagcau

SEQ ID NO: 4126899 - RNA, 21 nt, Streptococcus pyogenes MGAS8232
ucaacagauagucaaaaagac

SEQ ID NO: 4126900 - RNA, 21 nt, Streptococcus pyogenes MGAS8232
ucaacaguauaacuguuuuuc

SEQ ID NO: 4126901 - RNA, 20 nt, Streptococcus pyogenes MGAS8232
ucaacgcuagcauaaugcau

SEQ ID NO: 4126902 - RNA, 19 nt, Streptococcus pyogenes MGAS8232
ucaacuaucaaguaugcuu

SEQ ID NO: 4126903 - RNA, 22 nt, Streptococcus pyogenes MGAS8232
ucaacuaucaaguaugcuuuua

SEQ ID NO: 4126904 - RNA, 17 nt, Streptococcus pyogenes MGAS8232
ucaacuuaccagcaccu

SEQ ID NO: 4126905 - RNA, 23 nt, Streptococcus pyogenes MGAS8232
ucaaggggauuacgauuaaaaga

SEQ ID NO: 4126906 - RNA, 17 nt, Streptococcus pyogenes MGAS8232
ucaauaacagaaauuaa

SEQ ID NO: 4126907 - RNA, 20 nt, Streptococcus pyogenes MGAS8232
ucaauaacagaaauuaauaa

SEQ ID NO: 4126908 - RNA, 20 nt, Streptococcus pyogenes MGAS8232
ucaauacucccuucucuagu

SEQ ID NO: 4126909 - RNA, 13 nt, Streptococcus pyogenes MGAS8232
ucaauagcugcug

SEQ ID NO: 4126910 - RNA, 14 nt, Streptococcus pyogenes MGAS8232
ucaauauaauaaaa

SEQ ID NO: 4126911 - RNA, 13 nt, Streptococcus pyogenes MGAS8232
ucaauaucacauu

SEQ ID NO: 4126912 - RNA, 14 nt, Streptococcus pyogenes MGAS8232
ucaauaucacauuu

SEQ ID NO: 4126913 - RNA, 18 nt, Streptococcus pyogenes MGAS8232
ucaauaucacauuuuaau

SEQ ID NO: 4126914 - RNA, 22 nt, Streptococcus pyogenes MGAS8232
ucaauauuuuauuaauaaguau

SEQ ID NO: 4126915 - RNA, 14 nt, Streptococcus pyogenes MGAS8232
ucaaugaaaaguua

SEQ ID NO: 4126916 - RNA, 20 nt, Streptococcus pyogenes MGAS8232
ucaaugaaaaguuauuccca

SEQ ID NO: 4126917 - RNA, 22 nt, Streptococcus pyogenes MGAS8232
ucaauuaauguuaggagcacaa

SEQ ID NO: 4126918 - RNA, 19 nt, Streptococcus pyogenes MGAS8232
ucaauuuagccguccuuaa

SEQ ID NO: 4126919 - RNA, 17 nt, Streptococcus pyogenes MGAS8232
ucaccuuucuauauaac

SEQ ID NO: 4126920 - RNA, 18 nt, Streptococcus pyogenes MGAS8232
ucaccuuucuauauaacu

SEQ ID NO: 4126921 - RNA, 17 nt, Streptococcus pyogenes MGAS8232
ucacuagauaagucauu

SEQ ID NO: 4126922 - RNA, 12 nt, Streptococcus pyogenes MGAS8232
ucacuauaauuu

SEQ ID NO: 4126923 - RNA, 15 nt, Streptococcus pyogenes MGAS8232
ucacuauaauuucaa

SEQ ID NO: 4126924 - RNA, 16 nt, Streptococcus pyogenes MGAS8232
ucagaauaagaaaacc

SEQ ID NO: 4126925 - RNA, 15 nt, Streptococcus pyogenes MGAS8232
ucagagacaauaagg

SEQ ID NO: 4126926 - RNA, 13 nt, Streptococcus pyogenes MGAS8232
ucagagaugcuuc

SEQ ID NO: 4126927 - RNA, 20 nt, Streptococcus pyogenes MGAS8232
ucagcauaaccuuugccauu

SEQ ID NO: 4126928 - RNA, 13 nt, Streptococcus pyogenes MGAS8232
ucagcucucaaga

SEQ ID NO: 4126929 - RNA, 20 nt, Streptococcus pyogenes MGAS8232
ucaggauugccaucaauguu

SEQ ID NO: 4126930 - RNA, 14 nt, Streptococcus pyogenes MGAS8232
ucaggcaaaacaaa

SEQ ID NO: 4126931 - RNA, 23 nt, Streptococcus pyogenes MGAS8232
ucaggguuguauggguaugccug

SEQ ID NO: 4126932 - RNA, 23 nt, Streptococcus pyogenes MGAS8232
ucaguaaucuaaagcaucagcau

SEQ ID NO: 4126933 - RNA, 18 nt, Streptococcus pyogenes MGAS8232
ucaguuuuuuugauuuuc

SEQ ID NO: 4126934 - RNA, 16 nt, Streptococcus pyogenes MGAS8232
ucauaaacaaugaguc

SEQ ID NO: 4126935 - RNA, 21 nt, Streptococcus pyogenes MGAS8232
ucauaaacaaugagucaccug

SEQ ID NO: 4126936 - RNA, 17 nt, Streptococcus pyogenes MGAS8232
ucauaacaaauuuaucc

SEQ ID NO: 4126937 - RNA, 17 nt, Streptococcus pyogenes MGAS8232
ucauacacaaaaaaccg

SEQ ID NO: 4126938 - RNA, 19 nt, Streptococcus pyogenes MGAS8232
ucauacucaauagcugcug

SEQ ID NO: 4126939 - RNA, 21 nt, Streptococcus pyogenes MGAS8232
ucaucaaaagaccauaaaaaa

SEQ ID NO: 4126940 - RNA, 21 nt, Streptococcus pyogenes MGAS8232
ucaucaagaauagcuuuugua

SEQ ID NO: 4126941 - RNA, 16 nt, Streptococcus pyogenes MGAS8232
ucaucagaauaagaaa

SEQ ID NO: 4126942 - RNA, 17 nt, Streptococcus pyogenes MGAS8232
ucaucccuacuaggcuu

SEQ ID NO: 4126943 - RNA, 13 nt, Streptococcus pyogenes MGAS8232
ucaucuacucuau

SEQ ID NO: 4126944 - RNA, 16 nt, Streptococcus pyogenes MGAS8232
ucaucuacucuauuuu

SEQ ID NO: 4126945 - RNA, 20 nt, Streptococcus pyogenes MGAS8232
ucaugacgccuccaaauacu

SEQ ID NO: 4126946 - RNA, 21 nt, Streptococcus pyogenes MGAS8232
ucaugauguuauuaaauaaua

SEQ ID NO: 4126947 - RNA, 13 nt, Streptococcus pyogenes MGAS8232
ucaugauguuuau

SEQ ID NO: 4126948 - RNA, 19 nt, Streptococcus pyogenes MGAS8232
ucaugauguuuauuccaaa

SEQ ID NO: 4126949 - RNA, 21 nt, Streptococcus pyogenes MGAS8232
ucauggagucaaugaaaaguu

SEQ ID NO: 4126950 - RNA, 16 nt, Streptococcus pyogenes MGAS8232
ucauguuuuauuacca

SEQ ID NO: 4126951 - RNA, 19 nt, Streptococcus pyogenes MGAS8232
ucauuacuccuuugaccac

SEQ ID NO: 4126952 - RNA, 15 nt, Streptococcus pyogenes MGAS8232
ucauugucaaagcug

SEQ ID NO: 4126953 - RNA, 22 nt, Streptococcus pyogenes MGAS8232
ucauuuguaacuccuuaaauua

SEQ ID NO: 4126954 - RNA, 20 nt, Streptococcus pyogenes MGAS8232
ucauuuuaaguagucaaaau

SEQ ID NO: 4126955 - RNA, 23 nt, Streptococcus pyogenes MGAS8232
ucauuuuggagagauuuuuaaaa

SEQ ID NO: 4126956 - RNA, 11 nt, Streptococcus pyogenes MGAS8232
ucauuuugguu

SEQ ID NO: 4126957 - RNA, 14 nt, Streptococcus pyogenes MGAS8232
ucauuuugguugau

SEQ ID NO: 4126958 - RNA, 21 nt, Streptococcus pyogenes MGAS8232
uccaaaccauuuuaugagaaa

SEQ ID NO: 4126959 - RNA, 12 nt, Streptococcus pyogenes MGAS8232
uccaacaacgcu

SEQ ID NO: 4126960 - RNA, 18 nt, Streptococcus pyogenes MGAS8232
uccaacaacgcuauuuuu

SEQ ID NO: 4126961 - RNA, 16 nt, Streptococcus pyogenes MGAS8232
uccaacuuuuaucacu

SEQ ID NO: 4126962 - RNA, 16 nt, Streptococcus pyogenes MGAS8232
uccauacuuccaucua

SEQ ID NO: 4126963 - RNA, 23 nt, Streptococcus pyogenes MGAS8232
uccaucuaaucgaacaauaauau

SEQ ID NO: 4126964 - RNA, 13 nt, Streptococcus pyogenes MGAS8232
uccauuauaaauc

SEQ ID NO: 4126965 - RNA, 15 nt, Streptococcus pyogenes MGAS8232
uccauuauaaaucuu

SEQ ID NO: 4126966 - RNA, 18 nt, Streptococcus pyogenes MGAS8232
uccauuauaaaucuuacu

SEQ ID NO: 4126967 - RNA, 15 nt, Streptococcus pyogenes MGAS8232
uccauucuuuauaau

SEQ ID NO: 4126968 - RNA, 15 nt, Streptococcus pyogenes MGAS8232
uccauuuuuuauaau

SEQ ID NO: 4126969 - RNA, 21 nt, Streptococcus pyogenes MGAS8232
ucccagccaucaauagcagca

SEQ ID NO: 4126970 - RNA, 18 nt, Streptococcus pyogenes MGAS8232
uccccuccuugcaauaga

SEQ ID NO: 4126971 - RNA, 18 nt, Streptococcus pyogenes MGAS8232
ucccuuuaauucuuuaau

SEQ ID NO: 4126972 - RNA, 19 nt, Streptococcus pyogenes MGAS8232
ucccuuuaauucuuuaaua

SEQ ID NO: 4126973 - RNA, 16 nt, Streptococcus pyogenes MGAS8232
uccgaaaaaaacuugc

SEQ ID NO: 4126974 - RNA, 16 nt, Streptococcus pyogenes MGAS8232
uccgucguuuuuuagu

SEQ ID NO: 4126975 - RNA, 12 nt, Streptococcus pyogenes MGAS8232
uccguuugagau

SEQ ID NO: 4126976 - RNA, 16 nt, Streptococcus pyogenes MGAS8232
uccuaaacuaauaaga

SEQ ID NO: 4126977 - RNA, 23 nt, Streptococcus pyogenes MGAS8232
uccucaaacacguauuuuucgac

SEQ ID NO: 4126978 - RNA, 15 nt, Streptococcus pyogenes MGAS8232
uccuccuaaauauaa

SEQ ID NO: 4126979 - RNA, 13 nt, Streptococcus pyogenes MGAS8232
uccuccucuuuuu

SEQ ID NO: 4126980 - RNA, 16 nt, Streptococcus pyogenes MGAS8232
uccucgguuuuuuuaa

SEQ ID NO: 4126981 - RNA, 13 nt, Streptococcus pyogenes MGAS8232
uccucugaaaagu

SEQ ID NO: 4126982 - RNA, 23 nt, Streptococcus pyogenes MGAS8232
uccucuuauagcacguuggaaaa

SEQ ID NO: 4126983 - RNA, 23 nt, Streptococcus pyogenes MGAS8232
uccucuuuuaauuuggaggugaa

SEQ ID NO: 4126984 - RNA, 17 nt, Streptococcus pyogenes MGAS8232
uccuggauuaaaugccc

SEQ ID NO: 4126985 - RNA, 19 nt, Streptococcus pyogenes MGAS8232
uccuuagcgaaagcuucau

SEQ ID NO: 4126986 - RNA, 13 nt, Streptococcus pyogenes MGAS8232
uccuucuuuuucc

SEQ ID NO: 4126987 - RNA, 17 nt, Streptococcus pyogenes MGAS8232
uccuugcguagauagca

SEQ ID NO: 4126988 - RNA, 22 nt, Streptococcus pyogenes MGAS8232
uccuuguacaagagcuuaaaag

SEQ ID NO: 4126989 - RNA, 13 nt, Streptococcus pyogenes MGAS8232
uccuuugaccaca

SEQ ID NO: 4126990 - RNA, 14 nt, Streptococcus pyogenes MGAS8232
uccuuuuaaagaca

SEQ ID NO: 4126991 - RNA, 13 nt, Streptococcus pyogenes MGAS8232
uccuuuugcuucu

SEQ ID NO: 4126992 - RNA, 17 nt, Streptococcus pyogenes MGAS8232
ucgaaaugauagcaccu

SEQ ID NO: 4126993 - RNA, 18 nt, Streptococcus pyogenes MGAS8232
ucgaaauugguccucuga

SEQ ID NO: 4126994 - RNA, 21 nt, Streptococcus pyogenes MGAS8232
ucgaauauaauucauguuuaa

SEQ ID NO: 4126995 - RNA, 14 nt, Streptococcus pyogenes MGAS8232
ucgacaauuaaaaa

SEQ ID NO: 4126996 - RNA, 20 nt, Streptococcus pyogenes MGAS8232
ucgacaauuaaaaaagcuuu

SEQ ID NO: 4126997 - RNA, 17 nt, Streptococcus pyogenes MGAS8232
ucgacucccuuuaauuc

SEQ ID NO: 4126998 - RNA, 20 nt, Streptococcus pyogenes MGAS8232
ucgacucccuuuaauucuuu

SEQ ID NO: 4126999 - RNA, 15 nt, Streptococcus pyogenes MGAS8232
ucgaucgucucgguu

SEQ ID NO: 4127000 - RNA, 14 nt, Streptococcus pyogenes MGAS8232
ucgauuauuaacca

SEQ ID NO: 4127001 - RNA, 20 nt, Streptococcus pyogenes MGAS8232
ucgcguuuaggcucauauua

SEQ ID NO: 4127002 - RNA, 15 nt, Streptococcus pyogenes MGAS8232
ucgcugaaagucuua

SEQ ID NO: 4127003 - RNA, 14 nt, Streptococcus pyogenes MGAS8232
ucgguauucuuuuu

SEQ ID NO: 4127004 - RNA, 23 nt, Streptococcus pyogenes MGAS8232
ucgucaacgcuagcauaaugcau

SEQ ID NO: 4127005 - RNA, 20 nt, Streptococcus pyogenes MGAS8232
ucgucaucgagauuccuucu

SEQ ID NO: 4127006 - RNA, 19 nt, Streptococcus pyogenes MGAS8232
ucgucugcaaguucuuugc

SEQ ID NO: 4127007 - RNA, 17 nt, Streptococcus pyogenes MGAS8232
ucgucuuuguccauuuu

SEQ ID NO: 4127008 - RNA, 19 nt, Streptococcus pyogenes MGAS8232
ucguuuuuugcuuuugaua

SEQ ID NO: 4127009 - RNA, 16 nt, Streptococcus pyogenes MGAS8232
ucuaaaaaagcucuau

SEQ ID NO: 4127010 - RNA, 22 nt, Streptococcus pyogenes MGAS8232
ucuaaaaaagcucuaucaucuu

SEQ ID NO: 4127011 - RNA, 18 nt, Streptococcus pyogenes MGAS8232
ucuaaaauaaagaugaga

SEQ ID NO: 4127012 - RNA, 14 nt, Streptococcus pyogenes MGAS8232
ucuaaaauauauug

SEQ ID NO: 4127013 - RNA, 21 nt, Streptococcus pyogenes MGAS8232
ucuaaaugacaguauacauca

SEQ ID NO: 4127014 - RNA, 18 nt, Streptococcus pyogenes MGAS8232
ucuaacauguccaaaucg

SEQ ID NO: 4127015 - RNA, 17 nt, Streptococcus pyogenes MGAS8232
ucuaaucgaacaauaau

SEQ ID NO: 4127016 - RNA, 19 nt, Streptococcus pyogenes MGAS8232
ucuaauuagcauauuuuga

SEQ ID NO: 4127017 - RNA, 16 nt, Streptococcus pyogenes MGAS8232
ucuagaacagcugcuu

SEQ ID NO: 4127018 - RNA, 17 nt, Streptococcus pyogenes MGAS8232
ucuagcucuuuaucacc

SEQ ID NO: 4127019 - RNA, 23 nt, Streptococcus pyogenes MGAS8232
ucuaggagggacugucaaaaaau

SEQ ID NO: 4127020 - RNA, 22 nt, Streptococcus pyogenes MGAS8232
ucuauagcauuaaggauuauga

SEQ ID NO: 4127021 - RNA, 18 nt, Streptococcus pyogenes MGAS8232
ucuauauguguaauuucu

SEQ ID NO: 4127022 - RNA, 15 nt, Streptococcus pyogenes MGAS8232
ucuaucaaaacguua

SEQ ID NO: 4127023 - RNA, 13 nt, Streptococcus pyogenes MGAS8232
ucuauuuuaagua

SEQ ID NO: 4127024 - RNA, 15 nt, Streptococcus pyogenes MGAS8232
ucuauuuuaaguaaa

SEQ ID NO: 4127025 - RNA, 12 nt, Streptococcus pyogenes MGAS8232
ucucaaaaauau

SEQ ID NO: 4127026 - RNA, 20 nt, Streptococcus pyogenes MGAS8232
ucucaaaaauauauucuaau

SEQ ID NO: 4127027 - RNA, 14 nt, Streptococcus pyogenes MGAS8232
ucucaaauuuuuuu

SEQ ID NO: 4127028 - RNA, 21 nt, Streptococcus pyogenes MGAS8232
ucucagagacaauaaggucau

SEQ ID NO: 4127029 - RNA, 15 nt, Streptococcus pyogenes MGAS8232
ucucauaaacaauga

SEQ ID NO: 4127030 - RNA, 16 nt, Streptococcus pyogenes MGAS8232
ucucauaacaaauuua

SEQ ID NO: 4127031 - RNA, 12 nt, Streptococcus pyogenes MGAS8232
ucucauguuuua

SEQ ID NO: 4127032 - RNA, 19 nt, Streptococcus pyogenes MGAS8232
ucuccauaacauacucuau

SEQ ID NO: 4127033 - RNA, 21 nt, Streptococcus pyogenes MGAS8232
ucuccauaacauacucuauuu

SEQ ID NO: 4127034 - RNA, 20 nt, Streptococcus pyogenes MGAS8232
ucugaaaaguugauaucccc

SEQ ID NO: 4127035 - RNA, 14 nt, Streptococcus pyogenes MGAS8232
ucugaaaauaaaau

SEQ ID NO: 4127036 - RNA, 23 nt, Streptococcus pyogenes MGAS8232
ucugaaaauaaaauauuuuucca

SEQ ID NO: 4127037 - RNA, 16 nt, Streptococcus pyogenes MGAS8232
ucugacguaagcauca

SEQ ID NO: 4127038 - RNA, 13 nt, Streptococcus pyogenes MGAS8232
ucugagauauuca

SEQ ID NO: 4127039 - RNA, 15 nt, Streptococcus pyogenes MGAS8232
ucugagcgguuuugu

SEQ ID NO: 4127040 - RNA, 20 nt, Streptococcus pyogenes MGAS8232
ucugaugcguuuauaaaguu

SEQ ID NO: 4127041 - RNA, 13 nt, Streptococcus pyogenes MGAS8232
ucugcaacaucaa

SEQ ID NO: 4127042 - RNA, 19 nt, Streptococcus pyogenes MGAS8232
ucugcaaguucuuugccuu

SEQ ID NO: 4127043 - RNA, 14 nt, Streptococcus pyogenes MGAS8232
ucugccuuuuuaau

SEQ ID NO: 4127044 - RNA, 20 nt, Streptococcus pyogenes MGAS8232
ucugcuucuuacuaugaaaa

SEQ ID NO: 4127045 - RNA, 21 nt, Streptococcus pyogenes MGAS8232
ucuggcauuugucuguggcuu

SEQ ID NO: 4127046 - RNA, 22 nt, Streptococcus pyogenes MGAS8232
ucugguguugcaaggcuaaggc

SEQ ID NO: 4127047 - RNA, 14 nt, Streptococcus pyogenes MGAS8232
ucugguuuaucauu

SEQ ID NO: 4127048 - RNA, 13 nt, Streptococcus pyogenes MGAS8232
ucuguauuccaua

SEQ ID NO: 4127049 - RNA, 14 nt, Streptococcus pyogenes MGAS8232
ucuuacaauuaaua

SEQ ID NO: 4127050 - RNA, 14 nt, Streptococcus pyogenes MGAS8232
ucuuacuaugaaaa

SEQ ID NO: 4127051 - RNA, 15 nt, Streptococcus pyogenes MGAS8232
ucuuacuaugaaaaa

SEQ ID NO: 4127052 - RNA, 15 nt, Streptococcus pyogenes MGAS8232
ucuuagcaccgcuua

SEQ ID NO: 4127053 - RNA, 16 nt, Streptococcus pyogenes MGAS8232
ucuucaacaccuucgu

SEQ ID NO: 4127054 - RNA, 12 nt, Streptococcus pyogenes MGAS8232
ucuucaucuguu

SEQ ID NO: 4127055 - RNA, 19 nt, Streptococcus pyogenes MGAS8232
ucuucuuuuuauuauacuc

SEQ ID NO: 4127056 - RNA, 22 nt, Streptococcus pyogenes MGAS8232
ucuugaggugauucuuuuuuac

SEQ ID NO: 4127057 - RNA, 13 nt, Streptococcus pyogenes MGAS8232
ucuugcauuaccu

SEQ ID NO: 4127058 - RNA, 22 nt, Streptococcus pyogenes MGAS8232
ucuuuaauaguuuuacagucaa

SEQ ID NO: 4127059 - RNA, 22 nt, Streptococcus pyogenes MGAS8232
ucuuuauaaugguuuuuugucu

SEQ ID NO: 4127060 - RNA, 21 nt, Streptococcus pyogenes MGAS8232
ucuuuauuuugauauuuuuuc

SEQ ID NO: 4127061 - RNA, 16 nt, Streptococcus pyogenes MGAS8232
ucuuuguccauucuuu

SEQ ID NO: 4127062 - RNA, 20 nt, Streptococcus pyogenes MGAS8232
ucuuuuaaccauaucacaaa

SEQ ID NO: 4127063 - RNA, 22 nt, Streptococcus pyogenes MGAS8232
ucuuuuaggccaccagaugcuu

SEQ ID NO: 4127064 - RNA, 23 nt, Streptococcus pyogenes MGAS8232
ucuuuucuauuuaaccuucaaca

SEQ ID NO: 4127065 - RNA, 20 nt, Streptococcus pyogenes MGAS8232
ucuuuuucguauacuuuaaa

SEQ ID NO: 4127066 - RNA, 13 nt, Streptococcus pyogenes MGAS8232
ucuuuuuggcuga

SEQ ID NO: 4127067 - RNA, 15 nt, Streptococcus pyogenes MGAS8232
ucuuuuuggcugaug

SEQ ID NO: 4127068 - RNA, 16 nt, Streptococcus pyogenes MGAS8232
ugaaaaagccuuuaca

SEQ ID NO: 4127069 - RNA, 16 nt, Streptococcus pyogenes MGAS8232
ugaaaacguguauucu

SEQ ID NO: 4127070 - RNA, 22 nt, Streptococcus pyogenes MGAS8232
ugaaaagaugcacacaaaucuu

SEQ ID NO: 4127071 - RNA, 23 nt, Streptococcus pyogenes MGAS8232
ugaaaagaugcacacaaaucuuc

SEQ ID NO: 4127072 - RNA, 14 nt, Streptococcus pyogenes MGAS8232
ugaaaauaucuuuu

SEQ ID NO: 4127073 - RNA, 17 nt, Streptococcus pyogenes MGAS8232
ugaaaauaucuuuuuua

SEQ ID NO: 4127074 - RNA, 21 nt, Streptococcus pyogenes MGAS8232
ugaaaauaucuuuuuuacuuu

SEQ ID NO: 4127075 - RNA, 20 nt, Streptococcus pyogenes MGAS8232
ugaaacguuauuaaagacaa

SEQ ID NO: 4127076 - RNA, 19 nt, Streptococcus pyogenes MGAS8232
ugaaacuugcugccauauu

SEQ ID NO: 4127077 - RNA, 17 nt, Streptococcus pyogenes MGAS8232
ugaaagaggugcaacug

SEQ ID NO: 4127078 - RNA, 20 nt, Streptococcus pyogenes MGAS8232
ugaaaguaacauguccauug

SEQ ID NO: 4127079 - RNA, 15 nt, Streptococcus pyogenes MGAS8232
ugaaaguaucuagga

SEQ ID NO: 4127080 - RNA, 13 nt, Streptococcus pyogenes MGAS8232
ugaacaaaacaaa

SEQ ID NO: 4127081 - RNA, 14 nt, Streptococcus pyogenes MGAS8232
ugaaccgcuaaaac

SEQ ID NO: 4127082 - RNA, 14 nt, Streptococcus pyogenes MGAS8232
ugaaucauuuugga

SEQ ID NO: 4127083 - RNA, 15 nt, Streptococcus pyogenes MGAS8232
ugaauugaaaaaaga

SEQ ID NO: 4127084 - RNA, 19 nt, Streptococcus pyogenes MGAS8232
ugaauuuugucuaaaauaa

SEQ ID NO: 4127085 - RNA, 20 nt, Streptococcus pyogenes MGAS8232
ugaauuuugucuaaaauaaa

SEQ ID NO: 4127086 - RNA, 12 nt, Streptococcus pyogenes MGAS8232
ugacaacaauau

SEQ ID NO: 4127087 - RNA, 17 nt, Streptococcus pyogenes MGAS8232
ugacaauagcgaaaaag

SEQ ID NO: 4127088 - RNA, 20 nt, Streptococcus pyogenes MGAS8232
ugacaauagcgaaaaagggu

SEQ ID NO: 4127089 - RNA, 11 nt, Streptococcus pyogenes MGAS8232
ugacaauguga

SEQ ID NO: 4127090 - RNA, 17 nt, Streptococcus pyogenes MGAS8232
ugacaauuggugauuaa

SEQ ID NO: 4127091 - RNA, 12 nt, Streptococcus pyogenes MGAS8232
ugacacauuucg

SEQ ID NO: 4127092 - RNA, 18 nt, Streptococcus pyogenes MGAS8232
ugacagacaccaaaaaaa

SEQ ID NO: 4127093 - RNA, 16 nt, Streptococcus pyogenes MGAS8232
ugacaguuaaaaauaa

SEQ ID NO: 4127094 - RNA, 13 nt, Streptococcus pyogenes MGAS8232
ugacauaguguuu

SEQ ID NO: 4127095 - RNA, 19 nt, Streptococcus pyogenes MGAS8232
ugacauuaguccaaaaugu

SEQ ID NO: 4127096 - RNA, 19 nt, Streptococcus pyogenes MGAS8232
ugaccaauauagcaaucuu

SEQ ID NO: 4127097 - RNA, 20 nt, Streptococcus pyogenes MGAS8232
ugaccacaccuaauaaaaua

SEQ ID NO: 4127098 - RNA, 15 nt, Streptococcus pyogenes MGAS8232
ugaccccaaaaguug

SEQ ID NO: 4127099 - RNA, 21 nt, Streptococcus pyogenes MGAS8232
ugaccgaaaaaggcaaagaaa

SEQ ID NO: 4127100 - RNA, 22 nt, Streptococcus pyogenes MGAS8232
ugacucugauccgaguuuugcu

SEQ ID NO: 4127101 - RNA, 12 nt, Streptococcus pyogenes MGAS8232
ugacuucaaaaa

SEQ ID NO: 4127102 - RNA, 21 nt, Streptococcus pyogenes MGAS8232
ugacuugguucugaaaauaaa

SEQ ID NO: 4127103 - RNA, 16 nt, Streptococcus pyogenes MGAS8232
ugacuuguuacaaaaa

SEQ ID NO: 4127104 - RNA, 12 nt, Streptococcus pyogenes MGAS8232
ugagaaaauuuu

SEQ ID NO: 4127105 - RNA, 13 nt, Streptococcus pyogenes MGAS8232
ugagaguaaacga

SEQ ID NO: 4127106 - RNA, 16 nt, Streptococcus pyogenes MGAS8232
ugagauaccuucauag

SEQ ID NO: 4127107 - RNA, 14 nt, Streptococcus pyogenes MGAS8232
ugagaucuucuuuu

SEQ ID NO: 4127108 - RNA, 15 nt, Streptococcus pyogenes MGAS8232
ugagaucuucuuuug

SEQ ID NO: 4127109 - RNA, 23 nt, Streptococcus pyogenes MGAS8232
ugagccgccaacauagcuaaucc

SEQ ID NO: 4127110 - RNA, 22 nt, Streptococcus pyogenes MGAS8232
ugagccuuuucuuuuuggcuga

SEQ ID NO: 4127111 - RNA, 19 nt, Streptococcus pyogenes MGAS8232
ugaggcaaaugaaaaaacu

SEQ ID NO: 4127112 - RNA, 21 nt, Streptococcus pyogenes MGAS8232
ugagguauuuauaaauauuuu

SEQ ID NO: 4127113 - RNA, 22 nt, Streptococcus pyogenes MGAS8232
ugagguauuuauaaauauuuua

SEQ ID NO: 4127114 - RNA, 16 nt, Streptococcus pyogenes MGAS8232
ugaggugauucuuuuu

SEQ ID NO: 4127115 - RNA, 18 nt, Streptococcus pyogenes MGAS8232
ugagucuuuuucuaacaa

SEQ ID NO: 4127116 - RNA, 20 nt, Streptococcus pyogenes MGAS8232
ugauaaaggccuguauuucu

SEQ ID NO: 4127117 - RNA, 19 nt, Streptococcus pyogenes MGAS8232
ugauaaaugccguuguaag

SEQ ID NO: 4127118 - RNA, 18 nt, Streptococcus pyogenes MGAS8232
ugauaagguuuuuuuaag

SEQ ID NO: 4127119 - RNA, 18 nt, Streptococcus pyogenes MGAS8232
ugauaggaaaaagccaga

SEQ ID NO: 4127120 - RNA, 14 nt, Streptococcus pyogenes MGAS8232
ugauauaaaaaugg

SEQ ID NO: 4127121 - RNA, 13 nt, Streptococcus pyogenes MGAS8232
ugauauaaaauug

SEQ ID NO: 4127122 - RNA, 18 nt, Streptococcus pyogenes MGAS8232
ugaucuguuuaaaaacaa

SEQ ID NO: 4127123 - RNA, 23 nt, Streptococcus pyogenes MGAS8232
ugaugaaucauuuuggagagauu

SEQ ID NO: 4127124 - RNA, 23 nt, Streptococcus pyogenes MGAS8232
ugaugauugaguaagcagcauca

SEQ ID NO: 4127125 - RNA, 15 nt, Streptococcus pyogenes MGAS8232
ugaugcguuuauaaa

SEQ ID NO: 4127126 - RNA, 15 nt, Streptococcus pyogenes MGAS8232
ugauguuauuaaaua

SEQ ID NO: 4127127 - RNA, 12 nt, Streptococcus pyogenes MGAS8232
ugauuacugaua

SEQ ID NO: 4127128 - RNA, 21 nt, Streptococcus pyogenes MGAS8232
ugauuagaauccuccucuuuu

SEQ ID NO: 4127129 - RNA, 21 nt, Streptococcus pyogenes MGAS8232
ugauuaguuuuuagcagcaga

SEQ ID NO: 4127130 - RNA, 12 nt, Streptococcus pyogenes MGAS8232
ugauuauuauuc

SEQ ID NO: 4127131 - RNA, 16 nt, Streptococcus pyogenes MGAS8232
ugauuauuauucuaaa

SEQ ID NO: 4127132 - RNA, 17 nt, Streptococcus pyogenes MGAS8232
ugauuauucucuauuuu

SEQ ID NO: 4127133 - RNA, 18 nt, Streptococcus pyogenes MGAS8232
ugauugaguaagcagcau

SEQ ID NO: 4127134 - RNA, 17 nt, Streptococcus pyogenes MGAS8232
ugauugauuugucuucu

SEQ ID NO: 4127135 - RNA, 20 nt, Streptococcus pyogenes MGAS8232
ugauuuuaacguuuugaacu

SEQ ID NO: 4127136 - RNA, 12 nt, Streptococcus pyogenes MGAS8232
ugauuuuuaauu

SEQ ID NO: 4127137 - RNA, 14 nt, Streptococcus pyogenes MGAS8232
ugauuuuuaauucu

SEQ ID NO: 4127138 - RNA, 19 nt, Streptococcus pyogenes MGAS8232
ugcaaauaguagcaaauaa

SEQ ID NO: 4127139 - RNA, 21 nt, Streptococcus pyogenes MGAS8232
ugcaagcguccauauaguaag

SEQ ID NO: 4127140 - RNA, 18 nt, Streptococcus pyogenes MGAS8232
ugcaagugauaaccuuaa

SEQ ID NO: 4127141 - RNA, 22 nt, Streptococcus pyogenes MGAS8232
ugcaagugauaaccuuaaagac

SEQ ID NO: 4127142 - RNA, 17 nt, Streptococcus pyogenes MGAS8232
ugcaaguucuuugccuu

SEQ ID NO: 4127143 - RNA, 20 nt, Streptococcus pyogenes MGAS8232
ugcaauauccauagaaauug

SEQ ID NO: 4127144 - RNA, 15 nt, Streptococcus pyogenes MGAS8232
ugcaauucagcaucg

SEQ ID NO: 4127145 - RNA, 20 nt, Streptococcus pyogenes MGAS8232
ugcacacaaaucuucuagaa

SEQ ID NO: 4127146 - RNA, 15 nt, Streptococcus pyogenes MGAS8232
ugcacgugcuccuag

SEQ ID NO: 4127147 - RNA, 17 nt, Streptococcus pyogenes MGAS8232
ugcaggguaucugcuca

SEQ ID NO: 4127148 - RNA, 13 nt, Streptococcus pyogenes MGAS8232
ugcagguaauuau

SEQ ID NO: 4127149 - RNA, 14 nt, Streptococcus pyogenes MGAS8232
ugcauuaccuuauu

SEQ ID NO: 4127150 - RNA, 16 nt, Streptococcus pyogenes MGAS8232
ugccauggguaaaaug

SEQ ID NO: 4127151 - RNA, 19 nt, Streptococcus pyogenes MGAS8232
ugccauggguaaaaugacu

SEQ ID NO: 4127152 - RNA, 12 nt, Streptococcus pyogenes MGAS8232
ugccauuaauaa

SEQ ID NO: 4127153 - RNA, 13 nt, Streptococcus pyogenes MGAS8232
ugccuaaauccca

SEQ ID NO: 4127154 - RNA, 21 nt, Streptococcus pyogenes MGAS8232
ugccugaagccgugaggacuu

SEQ ID NO: 4127155 - RNA, 16 nt, Streptococcus pyogenes MGAS8232
ugccuuuuuaaucuug

SEQ ID NO: 4127156 - RNA, 18 nt, Streptococcus pyogenes MGAS8232
ugcgcgacuaaaaucaug

SEQ ID NO: 4127157 - RNA, 14 nt, Streptococcus pyogenes MGAS8232
ugcguagauagcaa

SEQ ID NO: 4127158 - RNA, 19 nt, Streptococcus pyogenes MGAS8232
ugcguuguagguaauagcg

SEQ ID NO: 4127159 - RNA, 13 nt, Streptococcus pyogenes MGAS8232
ugcguuuauaaag

SEQ ID NO: 4127160 - RNA, 21 nt, Streptococcus pyogenes MGAS8232
ugcucaauugcuuuuagccug

SEQ ID NO: 4127161 - RNA, 16 nt, Streptococcus pyogenes MGAS8232
ugcucauguuuucuca

SEQ ID NO: 4127162 - RNA, 15 nt, Streptococcus pyogenes MGAS8232
ugcugaguucuuuuu

SEQ ID NO: 4127163 - RNA, 15 nt, Streptococcus pyogenes MGAS8232
ugcugauuuuggaug

SEQ ID NO: 4127164 - RNA, 20 nt, Streptococcus pyogenes MGAS8232
ugcugauuuuggaugaaagu

SEQ ID NO: 4127165 - RNA, 19 nt, Streptococcus pyogenes MGAS8232
ugcuguuggauacagucca

SEQ ID NO: 4127166 - RNA, 16 nt, Streptococcus pyogenes MGAS8232
ugcuguuugucauacu

SEQ ID NO: 4127167 - RNA, 18 nt, Streptococcus pyogenes MGAS8232
ugcuuauagcuaccuacu

SEQ ID NO: 4127168 - RNA, 15 nt, Streptococcus pyogenes MGAS8232
ugcuucuuacuauga

SEQ ID NO: 4127169 - RNA, 12 nt, Streptococcus pyogenes MGAS8232
ugcuucuuucaa

SEQ ID NO: 4127170 - RNA, 14 nt, Streptococcus pyogenes MGAS8232
ugcuugaguagcua

SEQ ID NO: 4127171 - RNA, 19 nt, Streptococcus pyogenes MGAS8232
ugcuugcucaauuuuugau

SEQ ID NO: 4127172 - RNA, 12 nt, Streptococcus pyogenes MGAS8232
ugcuuuaaaaag

SEQ ID NO: 4127173 - RNA, 13 nt, Streptococcus pyogenes MGAS8232
ugcuuuaaaaagu

SEQ ID NO: 4127174 - RNA, 21 nt, Streptococcus pyogenes MGAS8232
ugcuuuugaugcagcuaaaag

SEQ ID NO: 4127175 - RNA, 13 nt, Streptococcus pyogenes MGAS8232
ugcuuuuuuuguc

SEQ ID NO: 4127176 - RNA, 18 nt, Streptococcus pyogenes MGAS8232
uggaaauuuuaaaugaca

SEQ ID NO: 4127177 - RNA, 12 nt, Streptococcus pyogenes MGAS8232
uggaauguuuac

SEQ ID NO: 4127178 - RNA, 19 nt, Streptococcus pyogenes MGAS8232
uggacaaucuuaaguuagg

SEQ ID NO: 4127179 - RNA, 21 nt, Streptococcus pyogenes MGAS8232
uggacgaaggcucuuaucuuu

SEQ ID NO: 4127180 - RNA, 16 nt, Streptococcus pyogenes MGAS8232
uggagagauaaaaagu

SEQ ID NO: 4127181 - RNA, 21 nt, Streptococcus pyogenes MGAS8232
uggagagauuucguugacaaa

SEQ ID NO: 4127182 - RNA, 23 nt, Streptococcus pyogenes MGAS8232
uggagcuuuaguugcuucuuuua

SEQ ID NO: 4127183 - RNA, 16 nt, Streptococcus pyogenes MGAS8232
uggaugaaaguaacau

SEQ ID NO: 4127184 - RNA, 23 nt, Streptococcus pyogenes MGAS8232
uggauuaaaugcccaagaugggu

SEQ ID NO: 4127185 - RNA, 13 nt, Streptococcus pyogenes MGAS8232
uggauuuccucua

SEQ ID NO: 4127186 - RNA, 14 nt, Streptococcus pyogenes MGAS8232
uggcaaccuuaccu

SEQ ID NO: 4127187 - RNA, 21 nt, Streptococcus pyogenes MGAS8232
uggccaauaaaauaucuagaa

SEQ ID NO: 4127188 - RNA, 16 nt, Streptococcus pyogenes MGAS8232
uggccuucuuggaaaa

SEQ ID NO: 4127189 - RNA, 18 nt, Streptococcus pyogenes MGAS8232
ugggauauuuagauggua

SEQ ID NO: 4127190 - RNA, 16 nt, Streptococcus pyogenes MGAS8232
uggguguuuaaucuuu

SEQ ID NO: 4127191 - RNA, 13 nt, Streptococcus pyogenes MGAS8232
ugguaaaaaggca

SEQ ID NO: 4127192 - RNA, 23 nt, Streptococcus pyogenes MGAS8232
uggucuaccgcuaggauuuuucc

SEQ ID NO: 4127193 - RNA, 19 nt, Streptococcus pyogenes MGAS8232
uggugacaauagcgaaaaa

SEQ ID NO: 4127194 - RNA, 16 nt, Streptococcus pyogenes MGAS8232
uggugcuacugaugua

SEQ ID NO: 4127195 - RNA, 20 nt, Streptococcus pyogenes MGAS8232
ugguguuauccucuuuuagu

SEQ ID NO: 4127196 - RNA, 18 nt, Streptococcus pyogenes MGAS8232
ugguuaaaaagagagcuu

SEQ ID NO: 4127197 - RNA, 18 nt, Streptococcus pyogenes MGAS8232
ugguuacagacuuuuaau

SEQ ID NO: 4127198 - RNA, 14 nt, Streptococcus pyogenes MGAS8232
ugguuuuuuuaauu

SEQ ID NO: 4127199 - RNA, 14 nt, Streptococcus pyogenes MGAS8232
uguaaaauuuaucu

SEQ ID NO: 4127200 - RNA, 18 nt, Streptococcus pyogenes MGAS8232
uguaaauauaaagucaga

SEQ ID NO: 4127201 - RNA, 19 nt, Streptococcus pyogenes MGAS8232
uguaaaucaguagugauga

SEQ ID NO: 4127202 - RNA, 21 nt, Streptococcus pyogenes MGAS8232
uguaacuguagcguuuguguu

SEQ ID NO: 4127203 - RNA, 23 nt, Streptococcus pyogenes MGAS8232
uguaauaacaaaaugaagcaaaa

SEQ ID NO: 4127204 - RNA, 19 nt, Streptococcus pyogenes MGAS8232
uguaauacgagcuagggca

SEQ ID NO: 4127205 - RNA, 12 nt, Streptococcus pyogenes MGAS8232
uguaauccccuc

SEQ ID NO: 4127206 - RNA, 14 nt, Streptococcus pyogenes MGAS8232
uguaaugaccaccc

SEQ ID NO: 4127207 - RNA, 18 nt, Streptococcus pyogenes MGAS8232
uguaauuaugcaaaagau

SEQ ID NO: 4127208 - RNA, 24 nt, Streptococcus pyogenes MGAS8232
uguaauuucuugugcuaaucuauc

SEQ ID NO: 4127209 - RNA, 19 nt, Streptococcus pyogenes MGAS8232
uguagggauuuuuuuaacu

SEQ ID NO: 4127210 - RNA, 13 nt, Streptococcus pyogenes MGAS8232
uguauacaaaaag

SEQ ID NO: 4127211 - RNA, 21 nt, Streptococcus pyogenes MGAS8232
uguauauuuaauagcauuguc

SEQ ID NO: 4127212 - RNA, 20 nt, Streptococcus pyogenes MGAS8232
uguaucucauaacaaauuua

SEQ ID NO: 4127213 - RNA, 15 nt, Streptococcus pyogenes MGAS8232
uguaugcuguccaug

SEQ ID NO: 4127214 - RNA, 16 nt, Streptococcus pyogenes MGAS8232
uguauuaugaggugaa

SEQ ID NO: 4127215 - RNA, 14 nt, Streptococcus pyogenes MGAS8232
uguauucuuaaaaa

SEQ ID NO: 4127216 - RNA, 15 nt, Streptococcus pyogenes MGAS8232
uguauucuuaaaaaa

SEQ ID NO: 4127217 - RNA, 20 nt, Streptococcus pyogenes MGAS8232
ugucaaacauaacaauccua

SEQ ID NO: 4127218 - RNA, 17 nt, Streptococcus pyogenes MGAS8232
ugucaggggaauuuccu

SEQ ID NO: 4127219 - RNA, 13 nt, Streptococcus pyogenes MGAS8232
uguccaauaccua

SEQ ID NO: 4127220 - RNA, 15 nt, Streptococcus pyogenes MGAS8232
uguccauuuuuuaua

SEQ ID NO: 4127221 - RNA, 13 nt, Streptococcus pyogenes MGAS8232
uguccuagucuuu

SEQ ID NO: 4127222 - RNA, 17 nt, Streptococcus pyogenes MGAS8232
uguccuagucuuuuggc

SEQ ID NO: 4127223 - RNA, 17 nt, Streptococcus pyogenes MGAS8232
ugucguuuuuuuuauuu

SEQ ID NO: 4127224 - RNA, 14 nt, Streptococcus pyogenes MGAS8232
ugucuaaaauaaag

SEQ ID NO: 4127225 - RNA, 13 nt, Streptococcus pyogenes MGAS8232
ugucucacuauuu

SEQ ID NO: 4127226 - RNA, 23 nt, Streptococcus pyogenes MGAS8232
ugucuggaaacuggucaaaagcu

SEQ ID NO: 4127227 - RNA, 18 nt, Streptococcus pyogenes MGAS8232
ugucuuagccuuuuuuug

SEQ ID NO: 4127228 - RNA, 21 nt, Streptococcus pyogenes MGAS8232
ugucuuagccuuuuuuugucu

SEQ ID NO: 4127229 - RNA, 19 nt, Streptococcus pyogenes MGAS8232
ugucuucuccgacugcaau

SEQ ID NO: 4127230 - RNA, 14 nt, Streptococcus pyogenes MGAS8232
ugucuucuucuuuu

SEQ ID NO: 4127231 - RNA, 15 nt, Streptococcus pyogenes MGAS8232
ugucuucuucuuuuc

SEQ ID NO: 4127232 - RNA, 14 nt, Streptococcus pyogenes MGAS8232
ugugaacaaaacaa

SEQ ID NO: 4127233 - RNA, 19 nt, Streptococcus pyogenes MGAS8232
ugugacaauuggugauuaa

SEQ ID NO: 4127234 - RNA, 22 nt, Streptococcus pyogenes MGAS8232
ugugacuaguuuauuacaaaac

SEQ ID NO: 4127235 - RNA, 21 nt, Streptococcus pyogenes MGAS8232
ugugaugaaucauuuuggaga

SEQ ID NO: 4127236 - RNA, 18 nt, Streptococcus pyogenes MGAS8232
ugugauuauuauucuaaa

SEQ ID NO: 4127237 - RNA, 17 nt, Streptococcus pyogenes MGAS8232
uguuaauauagucugca

SEQ ID NO: 4127238 - RNA, 21 nt, Streptococcus pyogenes MGAS8232
uguuauaagauaaguaauauu

SEQ ID NO: 4127239 - RNA, 22 nt, Streptococcus pyogenes MGAS8232
uguuauuggaaaguaaggguua

SEQ ID NO: 4127240 - RNA, 15 nt, Streptococcus pyogenes MGAS8232
uguuccaucugcaca

SEQ ID NO: 4127241 - RNA, 15 nt, Streptococcus pyogenes MGAS8232
uguucucauaaacaa

SEQ ID NO: 4127242 - RNA, 18 nt, Streptococcus pyogenes MGAS8232
uguucugguuuaucauuu

SEQ ID NO: 4127243 - RNA, 17 nt, Streptococcus pyogenes MGAS8232
uguucuuuauuuugaua

SEQ ID NO: 4127244 - RNA, 16 nt, Streptococcus pyogenes MGAS8232
uguuguauuaugaggu

SEQ ID NO: 4127245 - RNA, 16 nt, Streptococcus pyogenes MGAS8232
uguugucucagacucu

SEQ ID NO: 4127246 - RNA, 18 nt, Streptococcus pyogenes MGAS8232
uguuuaaucuuuguuucu

SEQ ID NO: 4127247 - RNA, 20 nt, Streptococcus pyogenes MGAS8232
uguuuuaguaaagccuuauc

SEQ ID NO: 4127248 - RNA, 22 nt, Streptococcus pyogenes MGAS8232
uguuuuggccaauaaaauaucu

SEQ ID NO: 4127249 - RNA, 13 nt, Streptococcus pyogenes MGAS8232
uuaaaaauaacuu

SEQ ID NO: 4127250 - RNA, 15 nt, Streptococcus pyogenes MGAS8232
uuaaaauagaagaca

SEQ ID NO: 4127251 - RNA, 17 nt, Streptococcus pyogenes MGAS8232
uuaaacuuccaaaccau

SEQ ID NO: 4127252 - RNA, 15 nt, Streptococcus pyogenes MGAS8232
uuaaagacaaaaaaa

SEQ ID NO: 4127253 - RNA, 16 nt, Streptococcus pyogenes MGAS8232
uuaaagacaaaaaaac

SEQ ID NO: 4127254 - RNA, 18 nt, Streptococcus pyogenes MGAS8232
uuaaagagaaagaggaaa

SEQ ID NO: 4127255 - RNA, 14 nt, Streptococcus pyogenes MGAS8232
uuaaaugcaaaaaa

SEQ ID NO: 4127256 - RNA, 15 nt, Streptococcus pyogenes MGAS8232
uuaaaugcaaaaaag

SEQ ID NO: 4127257 - RNA, 19 nt, Streptococcus pyogenes MGAS8232
uuaaauguccgaaaaaaac

SEQ ID NO: 4127258 - RNA, 18 nt, Streptococcus pyogenes MGAS8232
uuaaccauaucacaaaac

SEQ ID NO: 4127259 - RNA, 18 nt, Streptococcus pyogenes MGAS8232
uuaaccggcucuaaaaua

SEQ ID NO: 4127260 - RNA, 18 nt, Streptococcus pyogenes MGAS8232
uuaacguuaacaaaaaua

SEQ ID NO: 4127261 - RNA, 16 nt, Streptococcus pyogenes MGAS8232
uuaacucucauaaaau

SEQ ID NO: 4127262 - RNA, 15 nt, Streptococcus pyogenes MGAS8232
uuaacugguaaagca

SEQ ID NO: 4127263 - RNA, 23 nt, Streptococcus pyogenes MGAS8232
uuaagacaacauacuuuauuaau

SEQ ID NO: 4127264 - RNA, 19 nt, Streptococcus pyogenes MGAS8232
uuaagacuauguugcuuaa

SEQ ID NO: 4127265 - RNA, 18 nt, Streptococcus pyogenes MGAS8232
uuaagagggccaaggucu

SEQ ID NO: 4127266 - RNA, 21 nt, Streptococcus pyogenes MGAS8232
uuaagauuaaacuuacaaaaa

SEQ ID NO: 4127267 - RNA, 15 nt, Streptococcus pyogenes MGAS8232
uuaaggauuuagcug

SEQ ID NO: 4127268 - RNA, 22 nt, Streptococcus pyogenes MGAS8232
uuaagggcaaugccaucugcuu

SEQ ID NO: 4127269 - RNA, 20 nt, Streptococcus pyogenes MGAS8232
uuaaguaaaggauuuaguuu

SEQ ID NO: 4127270 - RNA, 13 nt, Streptococcus pyogenes MGAS8232
uuaauaaaagauu

SEQ ID NO: 4127271 - RNA, 21 nt, Streptococcus pyogenes MGAS8232
uuaauagcauugucaaauaaa

SEQ ID NO: 4127272 - RNA, 23 nt, Streptococcus pyogenes MGAS8232
uuaauagcauugucaaauaaaau

SEQ ID NO: 4127273 - RNA, 19 nt, Streptococcus pyogenes MGAS8232
uuaauauagucugcaugaa

SEQ ID NO: 4127274 - RNA, 12 nt, Streptococcus pyogenes MGAS8232
uuaaucaaaaaa

SEQ ID NO: 4127275 - RNA, 22 nt, Streptococcus pyogenes MGAS8232
uuaaucuuuguuucuauacaua

SEQ ID NO: 4127276 - RNA, 16 nt, Streptococcus pyogenes MGAS8232
uuaauuauuuuaauuu

SEQ ID NO: 4127277 - RNA, 14 nt, Streptococcus pyogenes MGAS8232
uuaauuuuucuucu

SEQ ID NO: 4127278 - RNA, 21 nt, Streptococcus pyogenes MGAS8232
uuacagucaagagcacacaua

SEQ ID NO: 4127279 - RNA, 21 nt, Streptococcus pyogenes MGAS8232
uuacauuuggagagauaaaaa

SEQ ID NO: 4127280 - RNA, 14 nt, Streptococcus pyogenes MGAS8232
uuacgauuaaaaga

SEQ ID NO: 4127281 - RNA, 13 nt, Streptococcus pyogenes MGAS8232
uuacgcauaccug

SEQ ID NO: 4127282 - RNA, 19 nt, Streptococcus pyogenes MGAS8232
uuacguccuguuugugaug

SEQ ID NO: 4127283 - RNA, 14 nt, Streptococcus pyogenes MGAS8232
uuacuauggcuucu

SEQ ID NO: 4127284 - RNA, 13 nt, Streptococcus pyogenes MGAS8232
uuacuuuuaaaau

SEQ ID NO: 4127285 - RNA, 14 nt, Streptococcus pyogenes MGAS8232
uuagaauagucuau

SEQ ID NO: 4127286 - RNA, 19 nt, Streptococcus pyogenes MGAS8232
uuagaauccuccucuuuuu

SEQ ID NO: 4127287 - RNA, 18 nt, Streptococcus pyogenes MGAS8232
uuagagcccauucuuaaa

SEQ ID NO: 4127288 - RNA, 17 nt, Streptococcus pyogenes MGAS8232
uuagcagacaaaaggga

SEQ ID NO: 4127289 - RNA, 18 nt, Streptococcus pyogenes MGAS8232
uuagcauaccuaaaagaa

SEQ ID NO: 4127290 - RNA, 17 nt, Streptococcus pyogenes MGAS8232
uuagccguccuuaaaag

SEQ ID NO: 4127291 - RNA, 14 nt, Streptococcus pyogenes MGAS8232
uuagccugccagcc

SEQ ID NO: 4127292 - RNA, 12 nt, Streptococcus pyogenes MGAS8232
uuagccuuuuuu

SEQ ID NO: 4127293 - RNA, 19 nt, Streptococcus pyogenes MGAS8232
uuagcgccagcauuugcca

SEQ ID NO: 4127294 - RNA, 19 nt, Streptococcus pyogenes MGAS8232
uuagguggagcuuuaguug

SEQ ID NO: 4127295 - RNA, 21 nt, Streptococcus pyogenes MGAS8232
uuaguaaagccuuauccauuc

SEQ ID NO: 4127296 - RNA, 13 nt, Streptococcus pyogenes MGAS8232
uuagucauuucuu

SEQ ID NO: 4127297 - RNA, 14 nt, Streptococcus pyogenes MGAS8232
uuagucauuucuuc

SEQ ID NO: 4127298 - RNA, 16 nt, Streptococcus pyogenes MGAS8232
uuaguguagauaaacu

SEQ ID NO: 4127299 - RNA, 22 nt, Streptococcus pyogenes MGAS8232
uuaguuaucucauaaaaaagaa

SEQ ID NO: 4127300 - RNA, 12 nt, Streptococcus pyogenes MGAS8232
uuaguuuuauuu

SEQ ID NO: 4127301 - RNA, 15 nt, Streptococcus pyogenes MGAS8232
uuaguuuuauuuuga

SEQ ID NO: 4127302 - RNA, 14 nt, Streptococcus pyogenes MGAS8232
uuaguuuuguauug

SEQ ID NO: 4127303 - RNA, 18 nt, Streptococcus pyogenes MGAS8232
uuauaaagaaacaaaaau

SEQ ID NO: 4127304 - RNA, 15 nt, Streptococcus pyogenes MGAS8232
uuauaagauaaguaa

SEQ ID NO: 4127305 - RNA, 19 nt, Streptococcus pyogenes MGAS8232
uuauaauaauauuauagua

SEQ ID NO: 4127306 - RNA, 22 nt, Streptococcus pyogenes MGAS8232
uuauagcacguuggaaaaggaa

SEQ ID NO: 4127307 - RNA, 17 nt, Streptococcus pyogenes MGAS8232
uuauaguauaccuauau

SEQ ID NO: 4127308 - RNA, 13 nt, Streptococcus pyogenes MGAS8232
uuauauuaaauua

SEQ ID NO: 4127309 - RNA, 15 nt, Streptococcus pyogenes MGAS8232
uuaucaaaccaaggu

SEQ ID NO: 4127310 - RNA, 13 nt, Streptococcus pyogenes MGAS8232
uuauccauucuua

SEQ ID NO: 4127311 - RNA, 17 nt, Streptococcus pyogenes MGAS8232
uuauccucccagccauc

SEQ ID NO: 4127312 - RNA, 18 nt, Streptococcus pyogenes MGAS8232
uuaucucauaaaaaagaa

SEQ ID NO: 4127313 - RNA, 18 nt, Streptococcus pyogenes MGAS8232
uuaucugauauuucaucu

SEQ ID NO: 4127314 - RNA, 14 nt, Streptococcus pyogenes MGAS8232
uuaugagaaaaaua

SEQ ID NO: 4127315 - RNA, 21 nt, Streptococcus pyogenes MGAS8232
uuaugagaaaaauaagugugu

SEQ ID NO: 4127316 - RNA, 13 nt, Streptococcus pyogenes MGAS8232
uuauuaaagagaa

SEQ ID NO: 4127317 - RNA, 23 nt, Streptococcus pyogenes MGAS8232
uuauuaaccaauuccucccuauu

SEQ ID NO: 4127318 - RNA, 18 nt, Streptococcus pyogenes MGAS8232
uuauuaacguuaacaaaa

SEQ ID NO: 4127319 - RNA, 20 nt, Streptococcus pyogenes MGAS8232
uuauuaacguuaacaaaaau

SEQ ID NO: 4127320 - RNA, 19 nt, Streptococcus pyogenes MGAS8232
uuauuaguaaccauagaag

SEQ ID NO: 4127321 - RNA, 13 nt, Streptococcus pyogenes MGAS8232
uuauuauucuaaa

SEQ ID NO: 4127322 - RNA, 14 nt, Streptococcus pyogenes MGAS8232
uuauuggaaaguaa

SEQ ID NO: 4127323 - RNA, 23 nt, Streptococcus pyogenes MGAS8232
uuauuguuagagcccauucuuaa

SEQ ID NO: 4127324 - RNA, 15 nt, Streptococcus pyogenes MGAS8232
uuauuugacauuagu

SEQ ID NO: 4127325 - RNA, 17 nt, Streptococcus pyogenes MGAS8232
uuauuugacauuagucc

SEQ ID NO: 4127326 - RNA, 20 nt, Streptococcus pyogenes MGAS8232
uuauuuucuagguuaaaaua

SEQ ID NO: 4127327 - RNA, 19 nt, Streptococcus pyogenes MGAS8232
uucaaaaaagggaagaaga

SEQ ID NO: 4127328 - RNA, 16 nt, Streptococcus pyogenes MGAS8232
uucaaacggaguucuc

SEQ ID NO: 4127329 - RNA, 18 nt, Streptococcus pyogenes MGAS8232
uucaaagggagauucuua

SEQ ID NO: 4127330 - RNA, 16 nt, Streptococcus pyogenes MGAS8232
uucaagcauaauaaaa

SEQ ID NO: 4127331 - RNA, 15 nt, Streptococcus pyogenes MGAS8232
uucaauaucacauuu

SEQ ID NO: 4127332 - RNA, 21 nt, Streptococcus pyogenes MGAS8232
uucacuauaauuucaauaaua

SEQ ID NO: 4127333 - RNA, 23 nt, Streptococcus pyogenes MGAS8232
uucagagcacguuuucugguuuu

SEQ ID NO: 4127334 - RNA, 23 nt, Streptococcus pyogenes MGAS8232
uucagauaagaccuucaaaaaag

SEQ ID NO: 4127335 - RNA, 21 nt, Streptococcus pyogenes MGAS8232
uucagcaucguuaaguggaau

SEQ ID NO: 4127336 - RNA, 14 nt, Streptococcus pyogenes MGAS8232
uucaguuaaacuga

SEQ ID NO: 4127337 - RNA, 22 nt, Streptococcus pyogenes MGAS8232
uucauagaagacggaguauuuu

SEQ ID NO: 4127338 - RNA, 18 nt, Streptococcus pyogenes MGAS8232
uucaucgaugauagcuuu

SEQ ID NO: 4127339 - RNA, 15 nt, Streptococcus pyogenes MGAS8232
uucaucuugcauuac

SEQ ID NO: 4127340 - RNA, 19 nt, Streptococcus pyogenes MGAS8232
uucaugacgccuccaaaua

SEQ ID NO: 4127341 - RNA, 19 nt, Streptococcus pyogenes MGAS8232
uucaugauguuauuaaaua

SEQ ID NO: 4127342 - RNA, 21 nt, Streptococcus pyogenes MGAS8232
uucaugauguuauuaaauaau

SEQ ID NO: 4127343 - RNA, 20 nt, Streptococcus pyogenes MGAS8232
uucaugauguuuauuccaaa

SEQ ID NO: 4127344 - RNA, 16 nt, Streptococcus pyogenes MGAS8232
uucauguuuaaaaaac

SEQ ID NO: 4127345 - RNA, 14 nt, Streptococcus pyogenes MGAS8232
uucauuuacucacc

SEQ ID NO: 4127346 - RNA, 23 nt, Streptococcus pyogenes MGAS8232
uucauuuguaacuccuuaaauua

SEQ ID NO: 4127347 - RNA, 13 nt, Streptococcus pyogenes MGAS8232
uucauuuuacuau

SEQ ID NO: 4127348 - RNA, 21 nt, Streptococcus pyogenes MGAS8232
uuccagaacaugggagcgcac

SEQ ID NO: 4127349 - RNA, 16 nt, Streptococcus pyogenes MGAS8232
uuccauacuuccaucu

SEQ ID NO: 4127350 - RNA, 17 nt, Streptococcus pyogenes MGAS8232
uuccauacuuccaucua

SEQ ID NO: 4127351 - RNA, 19 nt, Streptococcus pyogenes MGAS8232
uucccaaugccccaaagua

SEQ ID NO: 4127352 - RNA, 13 nt, Streptococcus pyogenes MGAS8232
uuccccacaaaag

SEQ ID NO: 4127353 - RNA, 17 nt, Streptococcus pyogenes MGAS8232
uuccccacaaaagacaa

SEQ ID NO: 4127354 - RNA, 14 nt, Streptococcus pyogenes MGAS8232
uuccgucguuuuuu

SEQ ID NO: 4127355 - RNA, 13 nt, Streptococcus pyogenes MGAS8232
uuccuacaaaaua

SEQ ID NO: 4127356 - RNA, 14 nt, Streptococcus pyogenes MGAS8232
uuccuacaaaauaa

SEQ ID NO: 4127357 - RNA, 15 nt, Streptococcus pyogenes MGAS8232
uuccuuguacaagag

SEQ ID NO: 4127358 - RNA, 21 nt, Streptococcus pyogenes MGAS8232
uucgccuaggaauaaaaugcc

SEQ ID NO: 4127359 - RNA, 14 nt, Streptococcus pyogenes MGAS8232
uucgguuauuguua

SEQ ID NO: 4127360 - RNA, 17 nt, Streptococcus pyogenes MGAS8232
uucguaaggguuacuau

SEQ ID NO: 4127361 - RNA, 17 nt, Streptococcus pyogenes MGAS8232
uucgucaagcaccuuga

SEQ ID NO: 4127362 - RNA, 12 nt, Streptococcus pyogenes MGAS8232
uucuaaaaaaaa

SEQ ID NO: 4127363 - RNA, 19 nt, Streptococcus pyogenes MGAS8232
uucuaacauggauaccauu

SEQ ID NO: 4127364 - RNA, 23 nt, Streptococcus pyogenes MGAS8232
uucuagacucuagcauaaaagau

SEQ ID NO: 4127365 - RNA, 14 nt, Streptococcus pyogenes MGAS8232
uucuauuaccuaua

SEQ ID NO: 4127366 - RNA, 18 nt, Streptococcus pyogenes MGAS8232
uucucaaaaauauauucu

SEQ ID NO: 4127367 - RNA, 13 nt, Streptococcus pyogenes MGAS8232
uucucauaaacaa

SEQ ID NO: 4127368 - RNA, 14 nt, Streptococcus pyogenes MGAS8232
uucucauguuuuau

SEQ ID NO: 4127369 - RNA, 19 nt, Streptococcus pyogenes MGAS8232
uucucuuuggagaaauuca

SEQ ID NO: 4127370 - RNA, 16 nt, Streptococcus pyogenes MGAS8232
uucugaaaauaaaaua

SEQ ID NO: 4127371 - RNA, 18 nt, Streptococcus pyogenes MGAS8232
uucuuacuaugaaaaaag

SEQ ID NO: 4127372 - RNA, 14 nt, Streptococcus pyogenes MGAS8232
uucuuauccauuau

SEQ ID NO: 4127373 - RNA, 18 nt, Streptococcus pyogenes MGAS8232
uucuugaggugauucuuu

SEQ ID NO: 4127374 - RNA, 17 nt, Streptococcus pyogenes MGAS8232
uucuuggaaaacagaaa

SEQ ID NO: 4127375 - RNA, 19 nt, Streptococcus pyogenes MGAS8232
uucuugugcuaaucuaucu

SEQ ID NO: 4127376 - RNA, 21 nt, Streptococcus pyogenes MGAS8232
uucuuucaaacggaguuccuc

SEQ ID NO: 4127377 - RNA, 21 nt, Streptococcus pyogenes MGAS8232
uucuuuuaaccauaucacaaa

SEQ ID NO: 4127378 - RNA, 13 nt, Streptococcus pyogenes MGAS8232
uucuuuuuccguu

SEQ ID NO: 4127379 - RNA, 19 nt, Streptococcus pyogenes MGAS8232
uugaaaagaugcacacaaa

SEQ ID NO: 4127380 - RNA, 19 nt, Streptococcus pyogenes MGAS8232
uugaaucuuguuuaaccuc

SEQ ID NO: 4127381 - RNA, 14 nt, Streptococcus pyogenes MGAS8232
uugaauguuguauu

SEQ ID NO: 4127382 - RNA, 16 nt, Streptococcus pyogenes MGAS8232
uugaauguuguauuug

SEQ ID NO: 4127383 - RNA, 17 nt, Streptococcus pyogenes MGAS8232
uugaauugaaaaaagac

SEQ ID NO: 4127384 - RNA, 13 nt, Streptococcus pyogenes MGAS8232
uugaccacaccua

SEQ ID NO: 4127385 - RNA, 15 nt, Streptococcus pyogenes MGAS8232
uugacuucaaaaaua

SEQ ID NO: 4127386 - RNA, 13 nt, Streptococcus pyogenes MGAS8232
uugagaagaaaaa

SEQ ID NO: 4127387 - RNA, 14 nt, Streptococcus pyogenes MGAS8232
uugagaagaaaaaa

SEQ ID NO: 4127388 - RNA, 15 nt, Streptococcus pyogenes MGAS8232
uugagccuuuucuuu

SEQ ID NO: 4127389 - RNA, 19 nt, Streptococcus pyogenes MGAS8232
uugagccuuuucuuuuugg

SEQ ID NO: 4127390 - RNA, 19 nt, Streptococcus pyogenes MGAS8232
uugaguagcuacugccuca

SEQ ID NO: 4127391 - RNA, 19 nt, Streptococcus pyogenes MGAS8232
uugauaugguggguaaaac

SEQ ID NO: 4127392 - RNA, 18 nt, Streptococcus pyogenes MGAS8232
uugauauuuuuucucaaa

SEQ ID NO: 4127393 - RNA, 23 nt, Streptococcus pyogenes MGAS8232
uugauauuuuuucucaaaaauau

SEQ ID NO: 4127394 - RNA, 17 nt, Streptococcus pyogenes MGAS8232
uugauuacugauaaacu

SEQ ID NO: 4127395 - RNA, 18 nt, Streptococcus pyogenes MGAS8232
uugauugccauuuaauug

SEQ ID NO: 4127396 - RNA, 14 nt, Streptococcus pyogenes MGAS8232
uugcaagucucuug

SEQ ID NO: 4127397 - RNA, 22 nt, Streptococcus pyogenes MGAS8232
uugcaauagagccaagauuuua

SEQ ID NO: 4127398 - RNA, 20 nt, Streptococcus pyogenes MGAS8232
uugcagaggcuugcauuuuu

SEQ ID NO: 4127399 - RNA, 16 nt, Streptococcus pyogenes MGAS8232
uugcaucgcaaacaga

SEQ ID NO: 4127400 - RNA, 22 nt, Streptococcus pyogenes MGAS8232
uugccauuaauaauauuaaccg

SEQ ID NO: 4127401 - RNA, 14 nt, Streptococcus pyogenes MGAS8232
uugccuuuaacaug

SEQ ID NO: 4127402 - RNA, 13 nt, Streptococcus pyogenes MGAS8232
uugcuuaaugacc

SEQ ID NO: 4127403 - RNA, 14 nt, Streptococcus pyogenes MGAS8232
uugcuuuugauacc

SEQ ID NO: 4127404 - RNA, 19 nt, Streptococcus pyogenes MGAS8232
uugcuuuuggcaaccuuac

SEQ ID NO: 4127405 - RNA, 14 nt, Streptococcus pyogenes MGAS8232
uugcuuuuuaauug

SEQ ID NO: 4127406 - RNA, 13 nt, Streptococcus pyogenes MGAS8232
uuggaaaaggaau

SEQ ID NO: 4127407 - RNA, 19 nt, Streptococcus pyogenes MGAS8232
uuggagagauaaaaaguaa

SEQ ID NO: 4127408 - RNA, 12 nt, Streptococcus pyogenes MGAS8232
uuggauccuuua

SEQ ID NO: 4127409 - RNA, 23 nt, Streptococcus pyogenes MGAS8232
uuggccaauaaaauaucuagaac

SEQ ID NO: 4127410 - RNA, 20 nt, Streptococcus pyogenes MGAS8232
uuggccuacuagcacaaaau

SEQ ID NO: 4127411 - RNA, 21 nt, Streptococcus pyogenes MGAS8232
uuggcuacucuauuuuaagua

SEQ ID NO: 4127412 - RNA, 15 nt, Streptococcus pyogenes MGAS8232
uugggagaguuccug

SEQ ID NO: 4127413 - RNA, 12 nt, Streptococcus pyogenes MGAS8232
uuggguauuuuu

SEQ ID NO: 4127414 - RNA, 15 nt, Streptococcus pyogenes MGAS8232
uuggugauuaacgcu

SEQ ID NO: 4127415 - RNA, 14 nt, Streptococcus pyogenes MGAS8232
uuguaaaaugaucc

SEQ ID NO: 4127416 - RNA, 22 nt, Streptococcus pyogenes MGAS8232
uuguacaagagcuuaaaaguua

SEQ ID NO: 4127417 - RNA, 23 nt, Streptococcus pyogenes MGAS8232
uuguagaggacuaaguccuuuua

SEQ ID NO: 4127418 - RNA, 20 nt, Streptococcus pyogenes MGAS8232
uuguagggauuuuuuuaacu

SEQ ID NO: 4127419 - RNA, 12 nt, Streptococcus pyogenes MGAS8232
uuguauagguag

SEQ ID NO: 4127420 - RNA, 17 nt, Streptococcus pyogenes MGAS8232
uugucguuuuuugcuuu

SEQ ID NO: 4127421 - RNA, 22 nt, Streptococcus pyogenes MGAS8232
uugugauuaguuuuuagcagca

SEQ ID NO: 4127422 - RNA, 23 nt, Streptococcus pyogenes MGAS8232
uugugauuaguuuuuagcagcag

SEQ ID NO: 4127423 - RNA, 22 nt, Streptococcus pyogenes MGAS8232
uugugcuaaucuaucucguaau

SEQ ID NO: 4127424 - RNA, 13 nt, Streptococcus pyogenes MGAS8232
uugugcuauucaa

SEQ ID NO: 4127425 - RNA, 17 nt, Streptococcus pyogenes MGAS8232
uuguggcgggccuucua

SEQ ID NO: 4127426 - RNA, 16 nt, Streptococcus pyogenes MGAS8232
uuguguugaagaaggu

SEQ ID NO: 4127427 - RNA, 13 nt, Streptococcus pyogenes MGAS8232
uuguuacaaaaaa

SEQ ID NO: 4127428 - RNA, 14 nt, Streptococcus pyogenes MGAS8232
uuguuacaaaaaac

SEQ ID NO: 4127429 - RNA, 16 nt, Streptococcus pyogenes MGAS8232
uuguuacaaaaaacaa

SEQ ID NO: 4127430 - RNA, 23 nt, Streptococcus pyogenes MGAS8232
uuguuguauuaugaggugaacac

SEQ ID NO: 4127431 - RNA, 17 nt, Streptococcus pyogenes MGAS8232
uuguuuaaccuccuaaa

SEQ ID NO: 4127432 - RNA, 16 nt, Streptococcus pyogenes MGAS8232
uuguuuaauaccugcu

SEQ ID NO: 4127433 - RNA, 22 nt, Streptococcus pyogenes MGAS8232
uuguuuuggccaauaaaauauc

SEQ ID NO: 4127434 - RNA, 17 nt, Streptococcus pyogenes MGAS8232
uuuaaaagggcugaccu

SEQ ID NO: 4127435 - RNA, 23 nt, Streptococcus pyogenes MGAS8232
uuuaaaauaguucccuuaauaaa

SEQ ID NO: 4127436 - RNA, 21 nt, Streptococcus pyogenes MGAS8232
uuuaaaauccucuuuuaauuu

SEQ ID NO: 4127437 - RNA, 19 nt, Streptococcus pyogenes MGAS8232
uuuaaccuccuaaacuaau

SEQ ID NO: 4127438 - RNA, 20 nt, Streptococcus pyogenes MGAS8232
uuuaacgcaauaaaauaaca

SEQ ID NO: 4127439 - RNA, 18 nt, Streptococcus pyogenes MGAS8232
uuuaacuauuuaacuuau

SEQ ID NO: 4127440 - RNA, 14 nt, Streptococcus pyogenes MGAS8232
uuuaagacaacaua

SEQ ID NO: 4127441 - RNA, 21 nt, Streptococcus pyogenes MGAS8232
uuuaagauuaaacuuacaaaa

SEQ ID NO: 4127442 - RNA, 17 nt, Streptococcus pyogenes MGAS8232
uuuaagcugagcaaaac

SEQ ID NO: 4127443 - RNA, 20 nt, Streptococcus pyogenes MGAS8232
uuuaagguauuguucaaccg

SEQ ID NO: 4127444 - RNA, 16 nt, Streptococcus pyogenes MGAS8232
uuuaauacguuuauuu

SEQ ID NO: 4127445 - RNA, 22 nt, Streptococcus pyogenes MGAS8232
uuuaauagcauugucaaauaaa

SEQ ID NO: 4127446 - RNA, 18 nt, Streptococcus pyogenes MGAS8232
uuuaaucuuuguuucuau

SEQ ID NO: 4127447 - RNA, 14 nt, Streptococcus pyogenes MGAS8232
uuuaauuauuuuaa

SEQ ID NO: 4127448 - RNA, 19 nt, Streptococcus pyogenes MGAS8232
uuuacauuuuuacaauacg

SEQ ID NO: 4127449 - RNA, 19 nt, Streptococcus pyogenes MGAS8232
uuuacggcuucuacacaaa

SEQ ID NO: 4127450 - RNA, 18 nt, Streptococcus pyogenes MGAS8232
uuuacuauggcuucuaaa

SEQ ID NO: 4127451 - RNA, 21 nt, Streptococcus pyogenes MGAS8232
uuuacuauggcuucuaaaaaa

SEQ ID NO: 4127452 - RNA, 15 nt, Streptococcus pyogenes MGAS8232
uuuacuuuuaaaauc

SEQ ID NO: 4127453 - RNA, 21 nt, Streptococcus pyogenes MGAS8232
uuuagcuuauaguuugacuuc

SEQ ID NO: 4127454 - RNA, 13 nt, Streptococcus pyogenes MGAS8232
uuuaggucuaauu

SEQ ID NO: 4127455 - RNA, 20 nt, Streptococcus pyogenes MGAS8232
uuuagucauuucuucagguu

SEQ ID NO: 4127456 - RNA, 15 nt, Streptococcus pyogenes MGAS8232
uuuaguugcuucuuu

SEQ ID NO: 4127457 - RNA, 19 nt, Streptococcus pyogenes MGAS8232
uuuauaaagcuuuaaaaaa

SEQ ID NO: 4127458 - RNA, 13 nt, Streptococcus pyogenes MGAS8232
uuuauaaauauuu

SEQ ID NO: 4127459 - RNA, 16 nt, Streptococcus pyogenes MGAS8232
uuuauaaauauuuuau

SEQ ID NO: 4127460 - RNA, 18 nt, Streptococcus pyogenes MGAS8232
uuuauacgguaaaaacuc

SEQ ID NO: 4127461 - RNA, 14 nt, Streptococcus pyogenes MGAS8232
uuuaugaaagguau

SEQ ID NO: 4127462 - RNA, 19 nt, Streptococcus pyogenes MGAS8232
uuuaugaccauuuuuacug

SEQ ID NO: 4127463 - RNA, 16 nt, Streptococcus pyogenes MGAS8232
uuuauuaaucaaaaaa

SEQ ID NO: 4127464 - RNA, 13 nt, Streptococcus pyogenes MGAS8232
uuuauuauucuaa

SEQ ID NO: 4127465 - RNA, 12 nt, Streptococcus pyogenes MGAS8232
uuuauuucacua

SEQ ID NO: 4127466 - RNA, 15 nt, Streptococcus pyogenes MGAS8232
uuucaguuguuuuaa

SEQ ID NO: 4127467 - RNA, 16 nt, Streptococcus pyogenes MGAS8232
uuucaugauguuuauu

SEQ ID NO: 4127468 - RNA, 16 nt, Streptococcus pyogenes MGAS8232
uuucauuauaggcuau

SEQ ID NO: 4127469 - RNA, 14 nt, Streptococcus pyogenes MGAS8232
uuuccuacaaaaua

SEQ ID NO: 4127470 - RNA, 17 nt, Streptococcus pyogenes MGAS8232
uuucgacaauuaaaaaa

SEQ ID NO: 4127471 - RNA, 21 nt, Streptococcus pyogenes MGAS8232
uuucggaaaacuuuugacuug

SEQ ID NO: 4127472 - RNA, 12 nt, Streptococcus pyogenes MGAS8232
uuucuauauaac

SEQ ID NO: 4127473 - RNA, 17 nt, Streptococcus pyogenes MGAS8232
uuucuauauaacuguuc

SEQ ID NO: 4127474 - RNA, 20 nt, Streptococcus pyogenes MGAS8232
uuucucagagacaauaaggu

SEQ ID NO: 4127475 - RNA, 11 nt, Streptococcus pyogenes MGAS8232
uuucucaguaa

SEQ ID NO: 4127476 - RNA, 19 nt, Streptococcus pyogenes MGAS8232
uuucuucagguuucuuuug

SEQ ID NO: 4127477 - RNA, 14 nt, Streptococcus pyogenes MGAS8232
uuucuuguuuuggu

SEQ ID NO: 4127478 - RNA, 22 nt, Streptococcus pyogenes MGAS8232
uuugaaccgaaacguaacguaa

SEQ ID NO: 4127479 - RNA, 15 nt, Streptococcus pyogenes MGAS8232
uuugaaguaaaggau

SEQ ID NO: 4127480 - RNA, 21 nt, Streptococcus pyogenes MGAS8232
uuugacuuguuacaaaaaaca

SEQ ID NO: 4127481 - RNA, 13 nt, Streptococcus pyogenes MGAS8232
uuugagaacgaau

SEQ ID NO: 4127482 - RNA, 21 nt, Streptococcus pyogenes MGAS8232
uuugagauaguuagcaaauug

SEQ ID NO: 4127483 - RNA, 22 nt, Streptococcus pyogenes MGAS8232
uuugaggugauguucucauaaa

SEQ ID NO: 4127484 - RNA, 19 nt, Streptococcus pyogenes MGAS8232
uuugauauuuuuucucaaa

SEQ ID NO: 4127485 - RNA, 20 nt, Streptococcus pyogenes MGAS8232
uuugauauuuuuucucaaaa

SEQ ID NO: 4127486 - RNA, 21 nt, Streptococcus pyogenes MGAS8232
uuugauugauuugucuucucc

SEQ ID NO: 4127487 - RNA, 18 nt, Streptococcus pyogenes MGAS8232
uuugcguuguagguaaua

SEQ ID NO: 4127488 - RNA, 16 nt, Streptococcus pyogenes MGAS8232
uuugcuuuuggcaacc

SEQ ID NO: 4127489 - RNA, 22 nt, Streptococcus pyogenes MGAS8232
uuugguaccguuagcagacaaa

SEQ ID NO: 4127490 - RNA, 16 nt, Streptococcus pyogenes MGAS8232
uuugguggaagaguaa

SEQ ID NO: 4127491 - RNA, 17 nt, Streptococcus pyogenes MGAS8232
uuuguaucucauaacaa

SEQ ID NO: 4127492 - RNA, 20 nt, Streptococcus pyogenes MGAS8232
uuuguccauuuuuuauaaug

SEQ ID NO: 4127493 - RNA, 19 nt, Streptococcus pyogenes MGAS8232
uuugucuucuucuuuucag

SEQ ID NO: 4127494 - RNA, 20 nt, Streptococcus pyogenes MGAS8232
uuuguuaccuucuucaagcu

SEQ ID NO: 4127495 - RNA, 19 nt, Streptococcus pyogenes MGAS8232
uuuguuccaucugcacaug

SEQ ID NO: 4127496 - RNA, 14 nt, Streptococcus pyogenes MGAS8232
uuuguuuucuuuag

SEQ ID NO: 4127497 - RNA, 15 nt, Streptococcus pyogenes MGAS8232
uuuuaaaauccucuu

SEQ ID NO: 4127498 - RNA, 21 nt, Streptococcus pyogenes MGAS8232
uuuuaaaauccucuuuuaauu

SEQ ID NO: 4127499 - RNA, 21 nt, Streptococcus pyogenes MGAS8232
uuuuaaacuuccaaaccauuu

SEQ ID NO: 4127500 - RNA, 19 nt, Streptococcus pyogenes MGAS8232
uuuuaaauaucuuaccauu

SEQ ID NO: 4127501 - RNA, 16 nt, Streptococcus pyogenes MGAS8232
uuuuaacuauuuaacu

SEQ ID NO: 4127502 - RNA, 14 nt, Streptococcus pyogenes MGAS8232
uuuuacuuuuaaaa

SEQ ID NO: 4127503 - RNA, 19 nt, Streptococcus pyogenes MGAS8232
uuuuaggccaccagaugcu

SEQ ID NO: 4127504 - RNA, 18 nt, Streptococcus pyogenes MGAS8232
uuuuaguugauuagaaua

SEQ ID NO: 4127505 - RNA, 14 nt, Streptococcus pyogenes MGAS8232
uuuuaguuuguaaa

SEQ ID NO: 4127506 - RNA, 19 nt, Streptococcus pyogenes MGAS8232
uuuuauauuauguucuaaa

SEQ ID NO: 4127507 - RNA, 22 nt, Streptococcus pyogenes MGAS8232
uuuuauccccuauucaauauuu

SEQ ID NO: 4127508 - RNA, 16 nt, Streptococcus pyogenes MGAS8232
uuuuauuauacucaau

SEQ ID NO: 4127509 - RNA, 13 nt, Streptococcus pyogenes MGAS8232
uuuuauuucacua

SEQ ID NO: 4127510 - RNA, 15 nt, Streptococcus pyogenes MGAS8232
uuuuauuuuuuaaag

SEQ ID NO: 4127511 - RNA, 18 nt, Streptococcus pyogenes MGAS8232
uuuucaaagggagauucu

SEQ ID NO: 4127512 - RNA, 21 nt, Streptococcus pyogenes MGAS8232
uuuucaacaaauccuuuugcu

SEQ ID NO: 4127513 - RNA, 19 nt, Streptococcus pyogenes MGAS8232
uuuuccuugccgaccuaua

SEQ ID NO: 4127514 - RNA, 15 nt, Streptococcus pyogenes MGAS8232
uuuucguauacuuua

SEQ ID NO: 4127515 - RNA, 14 nt, Streptococcus pyogenes MGAS8232
uuuucugccuuuuu

SEQ ID NO: 4127516 - RNA, 16 nt, Streptococcus pyogenes MGAS8232
uuuucuuuuggccuac

SEQ ID NO: 4127517 - RNA, 14 nt, Streptococcus pyogenes MGAS8232
uuuugauuuuaauu

SEQ ID NO: 4127518 - RNA, 16 nt, Streptococcus pyogenes MGAS8232
uuuugauuuucucagu

SEQ ID NO: 4127519 - RNA, 20 nt, Streptococcus pyogenes MGAS8232
uuuuggaugaaaguaacaug

SEQ ID NO: 4127520 - RNA, 15 nt, Streptococcus pyogenes MGAS8232
uuuuggcaaccuuac

SEQ ID NO: 4127521 - RNA, 16 nt, Streptococcus pyogenes MGAS8232
uuuugguugauauaaa

SEQ ID NO: 4127522 - RNA, 17 nt, Streptococcus pyogenes MGAS8232
uuuugucguuuuuugcu

SEQ ID NO: 4127523 - RNA, 14 nt, Streptococcus pyogenes MGAS8232
uuuugucuccuucu

SEQ ID NO: 4127524 - RNA, 16 nt, Streptococcus pyogenes MGAS8232
uuuugucuuauagaau

SEQ ID NO: 4127525 - RNA, 18 nt, Streptococcus pyogenes MGAS8232
uuuugucuuaucuaaagg

SEQ ID NO: 4127526 - RNA, 23 nt, Streptococcus pyogenes MGAS8232
uuuuguugaguguuaugaugaug

SEQ ID NO: 4127527 - RNA, 18 nt, Streptococcus pyogenes MGAS8232
uuuuguuguauuaugagg

SEQ ID NO: 4127528 - RNA, 12 nt, Streptococcus pyogenes MGAS8232
uuuuuaucugua

SEQ ID NO: 4127529 - RNA, 18 nt, Streptococcus pyogenes MGAS8232
uuuuucaaaaucuuuucu

SEQ ID NO: 4127530 - RNA, 14 nt, Streptococcus pyogenes MGAS8232
uuuuuguauuacuc

SEQ ID NO: 4127531 - RNA, 15 nt, Streptococcus pyogenes MGAS8232
uuuuugucuucuucu

SEQ ID NO: 4127532 - RNA, 14 nt, Streptococcus pyogenes MGAS8232
uuuuuuauacggua

SEQ ID NO: 4127533 - RNA, 18 nt, Streptococcus pyogenes MGAS8232
uuuuuuguauuacucaau

SEQ ID NO: 4127534 - RNA, 23 nt, Streptococcus pyogenes MGAS8232
aaaggauuuaguuuuguauugua

SEQ ID NO: 4127535 - RNA, 17 nt, Streptococcus pyogenes MGAS8232
aaaguaaaaucuuauuu

SEQ ID NO: 4127536 - RNA, 17 nt, Streptococcus pyogenes MGAS8232
aaaguaacauguccauu

SEQ ID NO: 4127537 - RNA, 18 nt, Streptococcus pyogenes MGAS8232
aaaguaaggguuaacaau

SEQ ID NO: 4127538 - RNA, 15 nt, Streptococcus pyogenes MGAS8232
aaagucacgaguguu

SEQ ID NO: 4127539 - RNA, 17 nt, Streptococcus pyogenes MGAS8232
aaagugcgcuuccagaa

SEQ ID NO: 4127540 - RNA, 15 nt, Streptococcus pyogenes MGAS8232
aaaguuauaaagaaa

SEQ ID NO: 4127541 - RNA, 15 nt, Streptococcus pyogenes MGAS8232
aaaguugauaucccc

SEQ ID NO: 4127542 - RNA, 22 nt, Streptococcus pyogenes MGAS8232
aaaguuggcuacucuauuugaa

SEQ ID NO: 4127543 - RNA, 22 nt, Streptococcus pyogenes MGAS8232
aaaguuggcuacucuauuuuaa

SEQ ID NO: 4127544 - RNA, 23 nt, Streptococcus pyogenes MGAS8232
aaaguuuucucagagacaauaag

SEQ ID NO: 4127545 - RNA, 18 nt, Streptococcus pyogenes MGAS8232
aaauaaagaugagaguaa

SEQ ID NO: 4127546 - RNA, 13 nt, Streptococcus pyogenes MGAS8232
aaauaacuuuaaa

SEQ ID NO: 4127547 - RNA, 15 nt, Streptococcus pyogenes MGAS8232
aaauaacuuucuauu

SEQ ID NO: 4127548 - RNA, 17 nt, Streptococcus pyogenes MGAS8232
aaauacugguauguuga

SEQ ID NO: 4127549 - RNA, 22 nt, Streptococcus pyogenes MGAS8232
aaauacuucaaggaaggcuugu

SEQ ID NO: 4127550 - RNA, 21 nt, Streptococcus pyogenes MGAS8232
aaauagcaaugguuaaaaaga

SEQ ID NO: 4127551 - RNA, 23 nt, Streptococcus pyogenes MGAS8232
aaauaggcagagccuuaaaaagu

SEQ ID NO: 4127552 - RNA, 13 nt, Streptococcus pyogenes MGAS8232
aaauauaaauuau

SEQ ID NO: 4127553 - RNA, 17 nt, Streptococcus pyogenes MGAS8232
aaauauaaauuauuaac

SEQ ID NO: 4127554 - RNA, 14 nt, Streptococcus pyogenes MGAS8232
aaauauauucuaau

SEQ ID NO: 4127555 - RNA, 21 nt, Streptococcus pyogenes MGAS8232
aaauaucuuuuuuacuuuuaa

SEQ ID NO: 4127556 - RNA, 23 nt, Streptococcus pyogenes MGAS8232
aaauaucuuuuuuacuuuuaaaa

SEQ ID NO: 4127557 - RNA, 21 nt, Streptococcus pyogenes MGAS8232
aaauauuuuauauuauguucu

SEQ ID NO: 4127558 - RNA, 19 nt, Streptococcus pyogenes MGAS8232
aaaucaguagugaugagua

SEQ ID NO: 4127559 - RNA, 22 nt, Streptococcus pyogenes MGAS8232
aaauccuuuugcuucuagcucu

SEQ ID NO: 4127560 - RNA, 23 nt, Streptococcus pyogenes MGAS8232
aaaucuaaucagaacucgucuuu

SEQ ID NO: 4127561 - RNA, 24 nt, Streptococcus pyogenes MGAS8232
aaaucuaaucagaacucgucuuug

SEQ ID NO: 4127562 - RNA, 17 nt, Streptococcus pyogenes MGAS8232
aaaucuuacuaacuagc

SEQ ID NO: 4127563 - RNA, 22 nt, Streptococcus pyogenes MGAS8232
aaaucuuacuaacuagcaagug

SEQ ID NO: 4127564 - RNA, 13 nt, Streptococcus pyogenes MGAS8232
aaaucuucuagaa

SEQ ID NO: 4127565 - RNA, 13 nt, Streptococcus pyogenes MGAS8232
aaaugaaaaaacu

SEQ ID NO: 4127566 - RNA, 23 nt, Streptococcus pyogenes MGAS8232
aaaugaaaaaacucaagaggucu

SEQ ID NO: 4127567 - RNA, 19 nt, Streptococcus pyogenes MGAS8232
aaaugaagcaaaauaaacu

SEQ ID NO: 4127568 - RNA, 15 nt, Streptococcus pyogenes MGAS8232
aaaugacaugaaagu

SEQ ID NO: 4127569 - RNA, 17 nt, Streptococcus pyogenes MGAS8232
aaaugacuucaaaauca

SEQ ID NO: 4127570 - RNA, 14 nt, Streptococcus pyogenes MGAS8232
aaaugauccuuucg

SEQ ID NO: 4127571 - RNA, 15 nt, Streptococcus pyogenes MGAS8232
aaaugauccuuucgu

SEQ ID NO: 4127572 - RNA, 13 nt, Streptococcus pyogenes MGAS8232
aaaugcaaaaaag

SEQ ID NO: 4127573 - RNA, 20 nt, Streptococcus pyogenes MGAS8232
aaaugccuccgacaaucgaa

SEQ ID NO: 4127574 - RNA, 20 nt, Streptococcus pyogenes MGAS8232
aaauggacaaucuuaaguua

SEQ ID NO: 4127575 - RNA, 21 nt, Streptococcus pyogenes MGAS8232
aaauggacaaucuuaaguuag

SEQ ID NO: 4127576 - RNA, 17 nt, Streptococcus pyogenes MGAS8232
aaauguaugauuuuaac

SEQ ID NO: 4127577 - RNA, 18 nt, Streptococcus pyogenes MGAS8232
aaauguaugauuuuaacg

SEQ ID NO: 4127578 - RNA, 20 nt, Streptococcus pyogenes MGAS8232
aaauguccgaaaaaaacuug

SEQ ID NO: 4127579 - RNA, 15 nt, Streptococcus pyogenes MGAS8232
aaauuaagaaggaac

SEQ ID NO: 4127580 - RNA, 23 nt, Streptococcus pyogenes MGAS8232
aaauuaaugauucaauaucacau

SEQ ID NO: 4127581 - RNA, 17 nt, Streptococcus pyogenes MGAS8232
aaauuaguuaucucaua

SEQ ID NO: 4127582 - RNA, 21 nt, Streptococcus pyogenes MGAS8232
aaauuauuaacguuaacaaaa

SEQ ID NO: 4127583 - RNA, 17 nt, Streptococcus pyogenes MGAS8232
aaauuauuauuuugcuu

SEQ ID NO: 4127584 - RNA, 14 nt, Streptococcus pyogenes MGAS8232
aaauucuuuuugaa

SEQ ID NO: 4127585 - RNA, 14 nt, Streptococcus pyogenes MGAS8232
aaauugauuauucu

SEQ ID NO: 4127586 - RNA, 22 nt, Streptococcus pyogenes MGAS8232
aaauugguccucugaaaaguug

SEQ ID NO: 4127587 - RNA, 20 nt, Streptococcus pyogenes MGAS8232
aaauugguuuuuuaguugcg

SEQ ID NO: 4127588 - RNA, 23 nt, Streptococcus pyogenes MGAS8232
aaauuguagggauuuuuuuaacu

SEQ ID NO: 4127589 - RNA, 20 nt, Streptococcus pyogenes MGAS8232
aaauuuauccugaucccuuc

SEQ ID NO: 4127590 - RNA, 23 nt, Streptococcus pyogenes MGAS8232
aaauuucaugauguuauuaaaua

SEQ ID NO: 4127591 - RNA, 16 nt, Streptococcus pyogenes MGAS8232
aaauuuuuuucaugau

SEQ ID NO: 4127592 - RNA, 11 nt, Streptococcus pyogenes MGAS8232
aacaaaacaaa

SEQ ID NO: 4127593 - RNA, 14 nt, Streptococcus pyogenes MGAS8232
aacaaaacaaaaca

SEQ ID NO: 4127594 - RNA, 15 nt, Streptococcus pyogenes MGAS8232
aacaaaacaaaacaa

SEQ ID NO: 4127595 - RNA, 11 nt, Streptococcus pyogenes MGAS8232
aacaaaacaua

SEQ ID NO: 4127596 - RNA, 12 nt, Streptococcus pyogenes MGAS8232
aacaaagauugg

SEQ ID NO: 4127597 - RNA, 13 nt, Streptococcus pyogenes MGAS8232
aacaaauccuuuu

SEQ ID NO: 4127598 - RNA, 16 nt, Streptococcus pyogenes MGAS8232
aacaaauccuuuugcu

SEQ ID NO: 4127599 - RNA, 13 nt, Streptococcus pyogenes MGAS8232
aacaagccauaaa

SEQ ID NO: 4127600 - RNA, 18 nt, Streptococcus pyogenes MGAS8232
aacaauaacacagaagcc

SEQ ID NO: 4127601 - RNA, 23 nt, Streptococcus pyogenes MGAS8232
aacaauacuaugaucuccaaaga

SEQ ID NO: 4127602 - RNA, 22 nt, Streptococcus pyogenes MGAS8232
aacaaugaaacguuauuaaaga

SEQ ID NO: 4127603 - RNA, 18 nt, Streptococcus pyogenes MGAS8232
aacaaugagaucuucuuu

SEQ ID NO: 4127604 - RNA, 20 nt, Streptococcus pyogenes MGAS8232
aacaccaccaauaaugagca

SEQ ID NO: 4127605 - RNA, 23 nt, Streptococcus pyogenes MGAS8232
aacaccccccccgcuuuuaagcu

SEQ ID NO: 4127606 - RNA, 14 nt, Streptococcus pyogenes MGAS8232
aacacguauuuuuc

SEQ ID NO: 4127607 - RNA, 11 nt, Streptococcus pyogenes MGAS8232
aacagaaagcg

SEQ ID NO: 4127608 - RNA, 19 nt, Streptococcus pyogenes MGAS8232
aacagaaagcggaagaaca

SEQ ID NO: 4127609 - RNA, 15 nt, Streptococcus pyogenes MGAS8232
aacagauaagugcca

SEQ ID NO: 4127610 - RNA, 18 nt, Streptococcus pyogenes MGAS8232
aacagauagucaaaaaga

SEQ ID NO: 4127611 - RNA, 19 nt, Streptococcus pyogenes MGAS8232
aacagauagucaaaaagac

SEQ ID NO: 4127612 - RNA, 12 nt, Streptococcus pyogenes MGAS8232
aacagcauuuuc

SEQ ID NO: 4127613 - RNA, 12 nt, Streptococcus pyogenes MGAS8232
aacaguuccagu

SEQ ID NO: 4127614 - RNA, 12 nt, Streptococcus pyogenes MGAS8232
aacauaacaauc

SEQ ID NO: 4127615 - RNA, 20 nt, Streptococcus pyogenes MGAS8232
aacauauuauaguaaccauu

SEQ ID NO: 4127616 - RNA, 22 nt, Streptococcus pyogenes MGAS8232
aacauggauaccauuucuuugc

SEQ ID NO: 4127617 - RNA, 16 nt, Streptococcus pyogenes MGAS8232
aacauuuaaucauguc

SEQ ID NO: 4127618 - RNA, 12 nt, Streptococcus pyogenes MGAS8232
aaccaagugcca

SEQ ID NO: 4127619 - RNA, 16 nt, Streptococcus pyogenes MGAS8232
aaccagcuuacagcug

SEQ ID NO: 4127620 - RNA, 14 nt, Streptococcus pyogenes MGAS8232
aaccauagaagcca

SEQ ID NO: 4127621 - RNA, 17 nt, Streptococcus pyogenes MGAS8232
aaccauaucacaaaacc

SEQ ID NO: 4127622 - RNA, 21 nt, Streptococcus pyogenes MGAS8232
aacccucauugucaaagcuga

SEQ ID NO: 4127623 - RNA, 17 nt, Streptococcus pyogenes MGAS8232
aaccgcuucuuuugcau

SEQ ID NO: 4127624 - RNA, 19 nt, Streptococcus pyogenes MGAS8232
aaccugucccuaaccgcuu

SEQ ID NO: 4127625 - RNA, 21 nt, Streptococcus pyogenes MGAS8232
aaccuuccuguaucaggaggg

SEQ ID NO: 4127626 - RNA, 20 nt, Streptococcus pyogenes MGAS8232
aacgaauugugucauuucuu

SEQ ID NO: 4127627 - RNA, 14 nt, Streptococcus pyogenes MGAS8232
aacgaucaaaaauc

SEQ ID NO: 4127628 - RNA, 23 nt, Streptococcus pyogenes MGAS8232
aacgcuagcauaaugcauguaau

SEQ ID NO: 4127629 - RNA, 22 nt, Streptococcus pyogenes MGAS8232
aacgcuaugcucguaggacacu

SEQ ID NO: 4127630 - RNA, 16 nt, Streptococcus pyogenes MGAS8232
aacgugagaaaauuuu

SEQ ID NO: 4127631 - RNA, 13 nt, Streptococcus pyogenes MGAS8232
aauaccauuuuua

SEQ ID NO: 4127632 - RNA, 19 nt, Streptococcus pyogenes MGAS8232
aauaccguagaaaguagca

SEQ ID NO: 4127633 - RNA, 17 nt, Streptococcus pyogenes MGAS8232
aauagaagacaagguga

SEQ ID NO: 4127634 - RNA, 16 nt, Streptococcus pyogenes MGAS8232
aauagcaaugguuaaa

SEQ ID NO: 4127635 - RNA, 20 nt, Streptococcus pyogenes MGAS8232
aauagcaaugguuaaaaaga

SEQ ID NO: 4127636 - RNA, 21 nt, Streptococcus pyogenes MGAS8232
aauagcaaugguuaaaaagag

SEQ ID NO: 4127637 - RNA, 21 nt, Streptococcus pyogenes MGAS8232
aauagcauugucaaauaaaau

SEQ ID NO: 4127638 - RNA, 13 nt, Streptococcus pyogenes MGAS8232
aauagcgaaaaag

SEQ ID NO: 4127639 - RNA, 21 nt, Streptococcus pyogenes MGAS8232
aauagcguaaagcaagggaaa

SEQ ID NO: 4127640 - RNA, 16 nt, Streptococcus pyogenes MGAS8232
aauagcugcugcuaaa

SEQ ID NO: 4127641 - RNA, 16 nt, Streptococcus pyogenes MGAS8232
aauagguaaagauuuu

SEQ ID NO: 4127642 - RNA, 23 nt, Streptococcus pyogenes MGAS8232
aauagguaaagauuuuaaauauc

SEQ ID NO: 4127643 - RNA, 18 nt, Streptococcus pyogenes MGAS8232
aauaguagcaaauaacau

SEQ ID NO: 4127644 - RNA, 13 nt, Streptococcus pyogenes MGAS8232
aauauaauaaaaa

SEQ ID NO: 4127645 - RNA, 16 nt, Streptococcus pyogenes MGAS8232
aauauaauaaaaagua

SEQ ID NO: 4127646 - RNA, 22 nt, Streptococcus pyogenes MGAS8232
aauaucacauuuuaaucuuuuu

SEQ ID NO: 4127647 - RNA, 14 nt, Streptococcus pyogenes MGAS8232
aauaucaggcaaaa

SEQ ID NO: 4127648 - RNA, 20 nt, Streptococcus pyogenes MGAS8232
aauauccauagaaauuguaa

SEQ ID NO: 4127649 - RNA, 18 nt, Streptococcus pyogenes MGAS8232
aauaucgccaauaaaaaa

SEQ ID NO: 4127650 - RNA, 13 nt, Streptococcus pyogenes MGAS8232
aauaucuuaccau

SEQ ID NO: 4127651 - RNA, 23 nt, Streptococcus pyogenes MGAS8232
aauaucuuaccauuguagaguuu

SEQ ID NO: 4127652 - RNA, 12 nt, Streptococcus pyogenes MGAS8232
aauaugauauaa

SEQ ID NO: 4127653 - RNA, 21 nt, Streptococcus pyogenes MGAS8232
aauaugugauuauuauucuaa

SEQ ID NO: 4127654 - RNA, 22 nt, Streptococcus pyogenes MGAS8232
aauaugugauuauuauucuaaa

SEQ ID NO: 4127655 - RNA, 22 nt, Streptococcus pyogenes MGAS8232
aauauuauaguauuaucucauu

SEQ ID NO: 4127656 - RNA, 14 nt, Streptococcus pyogenes MGAS8232
aauauuauauuaaa

SEQ ID NO: 4127657 - RNA, 19 nt, Streptococcus pyogenes MGAS8232
aauauuauauuaaauuaau

SEQ ID NO: 4127658 - RNA, 16 nt, Streptococcus pyogenes MGAS8232
aauauuuccuuuuaaa

SEQ ID NO: 4127659 - RNA, 14 nt, Streptococcus pyogenes MGAS8232
aauauuuuuacauu

SEQ ID NO: 4127660 - RNA, 12 nt, Streptococcus pyogenes MGAS8232
aaucaaaaaacu

SEQ ID NO: 4127661 - RNA, 20 nt, Streptococcus pyogenes MGAS8232
aaucaacauggcuaaugaua

SEQ ID NO: 4127662 - RNA, 18 nt, Streptococcus pyogenes MGAS8232
aaucaccguaacuugcuu

SEQ ID NO: 4127663 - RNA, 18 nt, Streptococcus pyogenes MGAS8232
aaucaccuuucuauauaa

SEQ ID NO: 4127664 - RNA, 20 nt, Streptococcus pyogenes MGAS8232
aaucauuacuccuuugacca

SEQ ID NO: 4127665 - RNA, 21 nt, Streptococcus pyogenes MGAS8232
aaucccuugcuuugauuuuuc

SEQ ID NO: 4127666 - RNA, 14 nt, Streptococcus pyogenes MGAS8232
aauccucucacaaa

SEQ ID NO: 4127667 - RNA, 17 nt, Streptococcus pyogenes MGAS8232
aauccuuuugaaaaauu

SEQ ID NO: 4127668 - RNA, 13 nt, Streptococcus pyogenes MGAS8232
aauccuuuugcuu

SEQ ID NO: 4127669 - RNA, 17 nt, Streptococcus pyogenes MGAS8232
aauccuuuugcuucuag

SEQ ID NO: 4127670 - RNA, 18 nt, Streptococcus pyogenes MGAS8232
aaucuguauuccauacuu

SEQ ID NO: 4127671 - RNA, 16 nt, Streptococcus pyogenes MGAS8232
aaucuuuauaaagcuu

SEQ ID NO: 4127672 - RNA, 21 nt, Streptococcus pyogenes MGAS8232
aaucuuuucuauuuaaccuuc

SEQ ID NO: 4127673 - RNA, 15 nt, Streptococcus pyogenes MGAS8232
aaugacaguauacau

SEQ ID NO: 4127674 - RNA, 16 nt, Streptococcus pyogenes MGAS8232
aaugaccacccucaac

SEQ ID NO: 4127675 - RNA, 19 nt, Streptococcus pyogenes MGAS8232
aaugaccacccucaacagc

SEQ ID NO: 4127676 - RNA, 16 nt, Streptococcus pyogenes MGAS8232
aaugacuucaaaauca

SEQ ID NO: 4127677 - RNA, 20 nt, Streptococcus pyogenes MGAS8232
aaugagcaaggcaagaggag

SEQ ID NO: 4127678 - RNA, 18 nt, Streptococcus pyogenes MGAS8232
aaugauaaggcugcgaug

SEQ ID NO: 4127679 - RNA, 15 nt, Streptococcus pyogenes MGAS8232
aaugauagcaccuaa

SEQ ID NO: 4127680 - RNA, 17 nt, Streptococcus pyogenes MGAS8232
aaugauuuuuaauucuu

SEQ ID NO: 4127681 - RNA, 23 nt, Streptococcus pyogenes MGAS8232
aaugcccaagauggguuagcucu

SEQ ID NO: 4127682 - RNA, 23 nt, Streptococcus pyogenes MGAS8232
aauggaaauuuuaaaugacauga

SEQ ID NO: 4127683 - RNA, 18 nt, Streptococcus pyogenes MGAS8232
aaugguuuuuugucuucu

SEQ ID NO: 4127684 - RNA, 15 nt, Streptococcus pyogenes MGAS8232
aauguaugauuuuaa

SEQ ID NO: 4127685 - RNA, 16 nt, Streptococcus pyogenes MGAS8232
aauguaugauuuuaac

SEQ ID NO: 4127686 - RNA, 13 nt, Streptococcus pyogenes MGAS8232
aauuaaaccauuc

SEQ ID NO: 4127687 - RNA, 15 nt, Streptococcus pyogenes MGAS8232
aauuaaaccauucua

SEQ ID NO: 4127688 - RNA, 15 nt, Streptococcus pyogenes MGAS8232
aauuaguauauugua

SEQ ID NO: 4127689 - RNA, 14 nt, Streptococcus pyogenes MGAS8232
aauuaguuaucuca

SEQ ID NO: 4127690 - RNA, 18 nt, Streptococcus pyogenes MGAS8232
aauuaucugaauuauuag

SEQ ID NO: 4127691 - RNA, 22 nt, Streptococcus pyogenes MGAS8232
aauuauuaacguuaacaaaaau

SEQ ID NO: 4127692 - RNA, 12 nt, Streptococcus pyogenes MGAS8232
aauuauuuuaau

SEQ ID NO: 4127693 - RNA, 17 nt, Streptococcus pyogenes MGAS8232
aauuauuuuaauuuuuc

SEQ ID NO: 4127694 - RNA, 17 nt, Streptococcus pyogenes MGAS8232
aauuccucccuauuuac

SEQ ID NO: 4127695 - RNA, 23 nt, Streptococcus pyogenes MGAS8232
aauucuuccuuagcgaaagcuuc

SEQ ID NO: 4127696 - RNA, 15 nt, Streptococcus pyogenes MGAS8232
aauugauuugcagag

SEQ ID NO: 4127697 - RNA, 17 nt, Streptococcus pyogenes MGAS8232
aauugcagcuaaaaaca

SEQ ID NO: 4127698 - RNA, 17 nt, Streptococcus pyogenes MGAS8232
aauuguaaccacagcaa

SEQ ID NO: 4127699 - RNA, 23 nt, Streptococcus pyogenes MGAS8232
aauuguagggauuuuuuuaacua

SEQ ID NO: 4127700 - RNA, 14 nt, Streptococcus pyogenes MGAS8232
aauugugucauuuc

SEQ ID NO: 4127701 - RNA, 19 nt, Streptococcus pyogenes MGAS8232
aauuguuuuaguaaagccu

SEQ ID NO: 4127702 - RNA, 16 nt, Streptococcus pyogenes MGAS8232
aauuuagccguccuua

SEQ ID NO: 4127703 - RNA, 14 nt, Streptococcus pyogenes MGAS8232
aauuuagucauuuc

SEQ ID NO: 4127704 - RNA, 18 nt, Streptococcus pyogenes MGAS8232
aauuucaauaauaccauu

SEQ ID NO: 4127705 - RNA, 14 nt, Streptococcus pyogenes MGAS8232
aauuuccuaaugca

SEQ ID NO: 4127706 - RNA, 17 nt, Streptococcus pyogenes MGAS8232
aauuugguggaagagua

SEQ ID NO: 4127707 - RNA, 14 nt, Streptococcus pyogenes MGAS8232
aauuuuaaaugaca

SEQ ID NO: 4127708 - RNA, 17 nt, Streptococcus pyogenes MGAS8232
aauuuuaaaugacauga

SEQ ID NO: 4127709 - RNA, 15 nt, Streptococcus pyogenes MGAS8232
aauuuuucuucugac

SEQ ID NO: 4127710 - RNA, 16 nt, Streptococcus pyogenes MGAS8232
aauuuuugauuuuaau

SEQ ID NO: 4127711 - RNA, 21 nt, Streptococcus pyogenes MGAS8232
acaaaaacugugaacaaaaca

SEQ ID NO: 4127712 - RNA, 22 nt, Streptococcus pyogenes MGAS8232
acaaaaacugugaacaaaacaa

SEQ ID NO: 4127713 - RNA, 23 nt, Streptococcus pyogenes MGAS8232
acaaaaacugugaacaaaacaaa

SEQ ID NO: 4127714 - RNA, 13 nt, Streptococcus pyogenes MGAS8232
acaaaaagagacc

SEQ ID NO: 4127715 - RNA, 10 nt, Streptococcus pyogenes MGAS8232
acaaaacaaa

SEQ ID NO: 4127716 - RNA, 13 nt, Streptococcus pyogenes MGAS8232
acaaaacaaaaca

SEQ ID NO: 4127717 - RNA, 15 nt, Streptococcus pyogenes MGAS8232
acaaaacaaaacaaa

SEQ ID NO: 4127718 - RNA, 13 nt, Streptococcus pyogenes MGAS8232
acaaaagggaaga

SEQ ID NO: 4127719 - RNA, 19 nt, Streptococcus pyogenes MGAS8232
acaaaaugaagcaaaauaa

SEQ ID NO: 4127720 - RNA, 16 nt, Streptococcus pyogenes MGAS8232
acaaagauuggauuuc

SEQ ID NO: 4127721 - RNA, 14 nt, Streptococcus pyogenes MGAS8232
acaaauacagaaga

SEQ ID NO: 4127722 - RNA, 13 nt, Streptococcus pyogenes MGAS8232
acaacauccauac

SEQ ID NO: 4127723 - RNA, 16 nt, Streptococcus pyogenes MGAS8232
acaacgucaauuuuau

SEQ ID NO: 4127724 - RNA, 22 nt, Streptococcus pyogenes MGAS8232
acaacgucaauuuuaucagacu

SEQ ID NO: 4127725 - RNA, 18 nt, Streptococcus pyogenes MGAS8232
acaagagcuuaaaaguua

SEQ ID NO: 4127726 - RNA, 19 nt, Streptococcus pyogenes MGAS8232
acaagcauuuuugcagggu

SEQ ID NO: 4127727 - RNA, 14 nt, Streptococcus pyogenes MGAS8232
acaaggcaauccaa

SEQ ID NO: 4127728 - RNA, 15 nt, Streptococcus pyogenes MGAS8232
acaauaacacagaag

SEQ ID NO: 4127729 - RNA, 18 nt, Streptococcus pyogenes MGAS8232
acuacaggauauugagaa

SEQ ID NO: 4127730 - RNA, 16 nt, Streptococcus pyogenes MGAS8232
acuaccuuaaauguau

SEQ ID NO: 4127731 - RNA, 16 nt, Streptococcus pyogenes MGAS8232
acuagccuacagucug

SEQ ID NO: 4127732 - RNA, 21 nt, Streptococcus pyogenes MGAS8232
acuagccuguccuagucuuuu

SEQ ID NO: 4127733 - RNA, 19 nt, Streptococcus pyogenes MGAS8232
acuaggaaucgcuuuagga

SEQ ID NO: 4127734 - RNA, 20 nt, Streptococcus pyogenes MGAS8232
acuaggaaucgcuuuaggaa

SEQ ID NO: 4127735 - RNA, 20 nt, Streptococcus pyogenes MGAS8232
acuagucggguaagggugaa

SEQ ID NO: 4127736 - RNA, 14 nt, Streptococcus pyogenes MGAS8232
acuauaauuucaau

SEQ ID NO: 4127737 - RNA, 13 nt, Streptococcus pyogenes MGAS8232
acuaugaaaaaag

SEQ ID NO: 4127738 - RNA, 19 nt, Streptococcus pyogenes MGAS8232
acuauggcuucuaaaaaaa

SEQ ID NO: 4127739 - RNA, 23 nt, Streptococcus pyogenes MGAS8232
acuauuagcauaccuaaaagaac

SEQ ID NO: 4127740 - RNA, 12 nt, Streptococcus pyogenes MGAS8232
acuauuuuguga

SEQ ID NO: 4127741 - RNA, 23 nt, Streptococcus pyogenes MGAS8232
acuauuuugugacuauauccgua

SEQ ID NO: 4127742 - RNA, 14 nt, Streptococcus pyogenes MGAS8232
acucaaaaaauaca

SEQ ID NO: 4127743 - RNA, 20 nt, Streptococcus pyogenes MGAS8232
acucaauauaauaaaaagua

SEQ ID NO: 4127744 - RNA, 23 nt, Streptococcus pyogenes MGAS8232
acucaugauaucccaucuuuguu

SEQ ID NO: 4127745 - RNA, 22 nt, Streptococcus pyogenes MGAS8232
acuccagcuggaguuuuuuuau

SEQ ID NO: 4127746 - RNA, 13 nt, Streptococcus pyogenes MGAS8232
acucguaagcauu

SEQ ID NO: 4127747 - RNA, 13 nt, Streptococcus pyogenes MGAS8232
acucuauuuugag

SEQ ID NO: 4127748 - RNA, 15 nt, Streptococcus pyogenes MGAS8232
acugagccccaaaag

SEQ ID NO: 4127749 - RNA, 16 nt, Streptococcus pyogenes MGAS8232
acugagccuuuuuuug

SEQ ID NO: 4127750 - RNA, 17 nt, Streptococcus pyogenes MGAS8232
acugccaguugagccuu

SEQ ID NO: 4127751 - RNA, 19 nt, Streptococcus pyogenes MGAS8232
acugccauggguaaaauga

SEQ ID NO: 4127752 - RNA, 16 nt, Streptococcus pyogenes MGAS8232
acugccucauuugcug

SEQ ID NO: 4127753 - RNA, 20 nt, Streptococcus pyogenes MGAS8232
acuggcagcuucauuuacuc

SEQ ID NO: 4127754 - RNA, 21 nt, Streptococcus pyogenes MGAS8232
acugggucaacuccaaucuca

SEQ ID NO: 4127755 - RNA, 22 nt, Streptococcus pyogenes MGAS8232
acuguaauauuuccuuuuaaag

SEQ ID NO: 4127756 - RNA, 14 nt, Streptococcus pyogenes MGAS8232
acuguaauuaugca

SEQ ID NO: 4127757 - RNA, 16 nt, Streptococcus pyogenes MGAS8232
acuguaauuaugcaaa

SEQ ID NO: 4127758 - RNA, 18 nt, Streptococcus pyogenes MGAS8232
acugugaacaaaacaaaa

SEQ ID NO: 4127759 - RNA, 13 nt, Streptococcus pyogenes MGAS8232
acuguuuuucuua

SEQ ID NO: 4127760 - RNA, 20 nt, Streptococcus pyogenes MGAS8232
acuuauaugaaagaacuauu

SEQ ID NO: 4127761 - RNA, 14 nt, Streptococcus pyogenes MGAS8232
acuuauguuuaucc

SEQ ID NO: 4127762 - RNA, 14 nt, Streptococcus pyogenes MGAS8232
acuucaaaaauacu

SEQ ID NO: 4127763 - RNA, 15 nt, Streptococcus pyogenes MGAS8232
acuucgguauucuuu

SEQ ID NO: 4127764 - RNA, 24 nt, Streptococcus pyogenes MGAS8232
acuucuauauguguaauuucuugu

SEQ ID NO: 4127765 - RNA, 20 nt, Streptococcus pyogenes MGAS8232
acuucuuccuuguacaagag

SEQ ID NO: 4127766 - RNA, 20 nt, Streptococcus pyogenes MGAS8232
acuugauaaucccuugcuuu

SEQ ID NO: 4127767 - RNA, 18 nt, Streptococcus pyogenes MGAS8232
acuugcaucgcaaacaga

SEQ ID NO: 4127768 - RNA, 17 nt, Streptococcus pyogenes MGAS8232
acuugggagaguuccug

SEQ ID NO: 4127769 - RNA, 17 nt, Streptococcus pyogenes MGAS8232
acuugguucugaaaaua

SEQ ID NO: 4127770 - RNA, 16 nt, Streptococcus pyogenes MGAS8232
acuuguuacaaaaaac

SEQ ID NO: 4127771 - RNA, 18 nt, Streptococcus pyogenes MGAS8232
acuuguuacaaaaaacaa

SEQ ID NO: 4127772 - RNA, 15 nt, Streptococcus pyogenes MGAS8232
acuuuaaacacuacc

SEQ ID NO: 4127773 - RNA, 19 nt, Streptococcus pyogenes MGAS8232
agaaaaucuaaucagaacu

SEQ ID NO: 4127774 - RNA, 19 nt, Streptococcus pyogenes MGAS8232
agaaagacuuaaggauuua

SEQ ID NO: 4127775 - RNA, 20 nt, Streptococcus pyogenes MGAS8232
agaaagacuuaaggauuuag

SEQ ID NO: 4127776 - RNA, 21 nt, Streptococcus pyogenes MGAS8232
agaaagcggaagaacagcauu

SEQ ID NO: 4127777 - RNA, 22 nt, Streptococcus pyogenes MGAS8232
agaaagcggaagaacagcauuu

SEQ ID NO: 4127778 - RNA, 15 nt, Streptococcus pyogenes MGAS8232
agaaagcuugucuau

SEQ ID NO: 4127779 - RNA, 22 nt, Streptococcus pyogenes MGAS8232
agaaauacuccguuucuaguuu

SEQ ID NO: 4127780 - RNA, 15 nt, Streptococcus pyogenes MGAS8232
agaaauuaauaaauu

SEQ ID NO: 4127781 - RNA, 21 nt, Streptococcus pyogenes MGAS8232
agaaauuguaaccacagcaau

SEQ ID NO: 4127782 - RNA, 15 nt, Streptococcus pyogenes MGAS8232
agaaauuuuauugca

SEQ ID NO: 4127783 - RNA, 17 nt, Streptococcus pyogenes MGAS8232
agaacagcugcuugaaa

SEQ ID NO: 4127784 - RNA, 17 nt, Streptococcus pyogenes MGAS8232
agaacgagucaauuuag

SEQ ID NO: 4127785 - RNA, 19 nt, Streptococcus pyogenes MGAS8232
agaagacaaggugaauaua

SEQ ID NO: 4127786 - RNA, 17 nt, Streptococcus pyogenes MGAS8232
agaagauccuacaagag

SEQ ID NO: 4127787 - RNA, 20 nt, Streptococcus pyogenes MGAS8232
agaagauccuacaagaggag

SEQ ID NO: 4127788 - RNA, 23 nt, Streptococcus pyogenes MGAS8232
agaagauccuacaagaggaguug

SEQ ID NO: 4127789 - RNA, 14 nt, Streptococcus pyogenes MGAS8232
agaagccucuucug

SEQ ID NO: 4127790 - RNA, 19 nt, Streptococcus pyogenes MGAS8232
agaaggaacucuccaaagu

SEQ ID NO: 4127791 - RNA, 16 nt, Streptococcus pyogenes MGAS8232
agaauaaccagcugau

SEQ ID NO: 4127792 - RNA, 21 nt, Streptococcus pyogenes MGAS8232
agaauagguaaagauuuuaaa

SEQ ID NO: 4127793 - RNA, 22 nt, Streptococcus pyogenes MGAS8232
agaauagucuaugcauguagau

SEQ ID NO: 4127794 - RNA, 17 nt, Streptococcus pyogenes MGAS8232
agacaaggugaauauaa

SEQ ID NO: 4127795 - RNA, 14 nt, Streptococcus pyogenes MGAS8232
agacaccaaaaaaa

SEQ ID NO: 4127796 - RNA, 15 nt, Streptococcus pyogenes MGAS8232
agacaccaaaaaaag

SEQ ID NO: 4127797 - RNA, 14 nt, Streptococcus pyogenes MGAS8232
agacauucguucua

SEQ ID NO: 4127798 - RNA, 19 nt, Streptococcus pyogenes MGAS8232
agacucaauugaaagaggu

SEQ ID NO: 4127799 - RNA, 19 nt, Streptococcus pyogenes MGAS8232
agacucugacuguaauuau

SEQ ID NO: 4127800 - RNA, 22 nt, Streptococcus pyogenes MGAS8232
agacuucuuccuuguacaagag

SEQ ID NO: 4127801 - RNA, 10 nt, Streptococcus pyogenes MGAS8232
agagaaucaa

SEQ ID NO: 4127802 - RNA, 16 nt, Streptococcus pyogenes MGAS8232
agagaaucaaggggau

SEQ ID NO: 4127803 - RNA, 21 nt, Streptococcus pyogenes MGAS8232
agagacaauaaggucaucaga

SEQ ID NO: 4127804 - RNA, 20 nt, Streptococcus pyogenes MGAS8232
agagagaagcuguucucuuu

SEQ ID NO: 4127805 - RNA, 13 nt, Streptococcus pyogenes MGAS8232
agagcccauucuu

SEQ ID NO: 4127806 - RNA, 13 nt, Streptococcus pyogenes MGAS8232
agaggacuaaguc

SEQ ID NO: 4127807 - RNA, 15 nt, Streptococcus pyogenes MGAS8232
agagguugguaaaaa

SEQ ID NO: 4127808 - RNA, 21 nt, Streptococcus pyogenes MGAS8232
agagguugguaaaaaggcagu

SEQ ID NO: 4127809 - RNA, 14 nt, Streptococcus pyogenes MGAS8232
agaguacaaggcaa

SEQ ID NO: 4127810 - RNA, 15 nt, Streptococcus pyogenes MGAS8232
agagucauuugacua

SEQ ID NO: 4127811 - RNA, 16 nt, Streptococcus pyogenes MGAS8232
agagucugagcaauca

SEQ ID NO: 4127812 - RNA, 19 nt, Streptococcus pyogenes MGAS8232
agaguuugaggugauguuc

SEQ ID NO: 4127813 - RNA, 19 nt, Streptococcus pyogenes MGAS8232
agauaagaccuucaaaaaa

SEQ ID NO: 4127814 - RNA, 16 nt, Streptococcus pyogenes MGAS8232
agauaaguaauauuuu

SEQ ID NO: 4127815 - RNA, 18 nt, Streptococcus pyogenes MGAS8232
agauaagugccaucaggc

SEQ ID NO: 4127816 - RNA, 18 nt, Streptococcus pyogenes MGAS8232
agauagcaaggaugaaau

SEQ ID NO: 4127817 - RNA, 16 nt, Streptococcus pyogenes MGAS8232
agauagucaaaaagac

SEQ ID NO: 4127818 - RNA, 18 nt, Streptococcus pyogenes MGAS8232
agauagucaaaaagacuu

SEQ ID NO: 4127819 - RNA, 17 nt, Streptococcus pyogenes MGAS8232
agaucauuaaauugauu

SEQ ID NO: 4127820 - RNA, 14 nt, Streptococcus pyogenes MGAS8232
agauccuacaagag

SEQ ID NO: 4127821 - RNA, 23 nt, Streptococcus pyogenes MGAS8232
agaucucgauuaucuuuuuuuaa

SEQ ID NO: 4127822 - RNA, 13 nt, Streptococcus pyogenes MGAS8232
agaucuucuuuug

SEQ ID NO: 4127823 - RNA, 16 nt, Streptococcus pyogenes MGAS8232
agaugaaaaucuguau

SEQ ID NO: 4127824 - RNA, 14 nt, Streptococcus pyogenes MGAS8232
agaugaauuuuguc

SEQ ID NO: 4127825 - RNA, 18 nt, Streptococcus pyogenes MGAS8232
agaugacgguaaauaaag

SEQ ID NO: 4127826 - RNA, 15 nt, Streptococcus pyogenes MGAS8232
aggucucaaauuuuu

SEQ ID NO: 4127827 - RNA, 20 nt, Streptococcus pyogenes MGAS8232
aggucucaaauuuuuuucau

SEQ ID NO: 4127828 - RNA, 23 nt, Streptococcus pyogenes MGAS8232
aggucugcgcgacuaaaaucaug

SEQ ID NO: 4127829 - RNA, 23 nt, Streptococcus pyogenes MGAS8232
aggucugcuucuuacuaugaaaa

SEQ ID NO: 4127830 - RNA, 18 nt, Streptococcus pyogenes MGAS8232
aggugccuguuuuugcug

SEQ ID NO: 4127831 - RNA, 14 nt, Streptococcus pyogenes MGAS8232
aguaagcagcauca

SEQ ID NO: 4127832 - RNA, 18 nt, Streptococcus pyogenes MGAS8232
aguaaggguuaacaauga

SEQ ID NO: 4127833 - RNA, 21 nt, Streptococcus pyogenes MGAS8232
aguaaugugggauauuuagau

SEQ ID NO: 4127834 - RNA, 16 nt, Streptococcus pyogenes MGAS8232
aguacaaggcaaucca

SEQ ID NO: 4127835 - RNA, 13 nt, Streptococcus pyogenes MGAS8232
aguagcaaauaac

SEQ ID NO: 4127836 - RNA, 15 nt, Streptococcus pyogenes MGAS8232
aguagcaccuuuuuu

SEQ ID NO: 4127837 - RNA, 24 nt, Streptococcus pyogenes MGAS8232
aguaguaaccguuggcauaacccu

SEQ ID NO: 4127838 - RNA, 20 nt, Streptococcus pyogenes MGAS8232
aguagugaugaguaggcgaa

SEQ ID NO: 4127839 - RNA, 23 nt, Streptococcus pyogenes MGAS8232
aguaucaccuugcuuauagcuac

SEQ ID NO: 4127840 - RNA, 21 nt, Streptococcus pyogenes MGAS8232
aguaucuaggagggacuguca

SEQ ID NO: 4127841 - RNA, 14 nt, Streptococcus pyogenes MGAS8232
aguaugcuuuuaau

SEQ ID NO: 4127842 - RNA, 12 nt, Streptococcus pyogenes MGAS8232
aguauuuuaaaa

SEQ ID NO: 4127843 - RNA, 20 nt, Streptococcus pyogenes MGAS8232
agucaaaaagacuucuuccu

SEQ ID NO: 4127844 - RNA, 14 nt, Streptococcus pyogenes MGAS8232
agucaaugaaaagu

SEQ ID NO: 4127845 - RNA, 20 nt, Streptococcus pyogenes MGAS8232
agucacgaguguuaaaacga

SEQ ID NO: 4127846 - RNA, 16 nt, Streptococcus pyogenes MGAS8232
aguccaaacucaaacu

SEQ ID NO: 4127847 - RNA, 18 nt, Streptococcus pyogenes MGAS8232
agucccacugcacgugcu

SEQ ID NO: 4127848 - RNA, 23 nt, Streptococcus pyogenes MGAS8232
agucuaugcauguagaugaauuu

SEQ ID NO: 4127849 - RNA, 16 nt, Streptococcus pyogenes MGAS8232
agucuuagcaccgcuu

SEQ ID NO: 4127850 - RNA, 15 nt, Streptococcus pyogenes MGAS8232
agucuuuuucuaaca

SEQ ID NO: 4127851 - RNA, 23 nt, Streptococcus pyogenes MGAS8232
agucuuuuucuaacaaaaucaca

SEQ ID NO: 4127852 - RNA, 15 nt, Streptococcus pyogenes MGAS8232
agugcgcuuccagaa

SEQ ID NO: 4127853 - RNA, 16 nt, Streptococcus pyogenes MGAS8232
agugguuugcaaauag

SEQ ID NO: 4127854 - RNA, 16 nt, Streptococcus pyogenes MGAS8232
aguguagauaaacugg

SEQ ID NO: 4127855 - RNA, 23 nt, Streptococcus pyogenes MGAS8232
aguguguugucaaacauaacaau

SEQ ID NO: 4127856 - RNA, 20 nt, Streptococcus pyogenes MGAS8232
aguuaaaaauaacuuuaaaa

SEQ ID NO: 4127857 - RNA, 20 nt, Streptococcus pyogenes MGAS8232
aguuauagcuccuaaaacca

SEQ ID NO: 4127858 - RNA, 12 nt, Streptococcus pyogenes MGAS8232
aguuauuuuuga

SEQ ID NO: 4127859 - RNA, 16 nt, Streptococcus pyogenes MGAS8232
aguucaauggauauaa

SEQ ID NO: 4127860 - RNA, 19 nt, Streptococcus pyogenes MGAS8232
aguucaauggauauaacaa

SEQ ID NO: 4127861 - RNA, 15 nt, Streptococcus pyogenes MGAS8232
aguucagcagcacug

SEQ ID NO: 4127862 - RNA, 21 nt, Streptococcus pyogenes MGAS8232
aguucccuuaauaaacuguau

SEQ ID NO: 4127863 - RNA, 18 nt, Streptococcus pyogenes MGAS8232
aguucgauuauuaaccaa

SEQ ID NO: 4127864 - RNA, 20 nt, Streptococcus pyogenes MGAS8232
aguucugagauauucauuuu

SEQ ID NO: 4127865 - RNA, 21 nt, Streptococcus pyogenes MGAS8232
aguugcgaucauaaauaaaga

SEQ ID NO: 4127866 - RNA, 14 nt, Streptococcus pyogenes MGAS8232
aguugcuucuuuua

SEQ ID NO: 4127867 - RNA, 21 nt, Streptococcus pyogenes MGAS8232
aguuguauggcuauaaaugga

SEQ ID NO: 4127868 - RNA, 14 nt, Streptococcus pyogenes MGAS8232
aguuuuauuuugau

SEQ ID NO: 4127869 - RNA, 22 nt, Streptococcus pyogenes MGAS8232
auaaaaaaccuuaucaaaccaa

SEQ ID NO: 4127870 - RNA, 12 nt, Streptococcus pyogenes MGAS8232
auaaaaaagaac

SEQ ID NO: 4127871 - RNA, 14 nt, Streptococcus pyogenes MGAS8232
auaaaacaaauaau

SEQ ID NO: 4127872 - RNA, 15 nt, Streptococcus pyogenes MGAS8232
auaaaacaaauaauu

SEQ ID NO: 4127873 - RNA, 14 nt, Streptococcus pyogenes MGAS8232
auaaaagauauuuu

SEQ ID NO: 4127874 - RNA, 18 nt, Streptococcus pyogenes MGAS8232
auaaaagauauuuuaaaa

SEQ ID NO: 4127875 - RNA, 20 nt, Streptococcus pyogenes MGAS8232
auaaaagauauuuuaaaaua

SEQ ID NO: 4127876 - RNA, 23 nt, Streptococcus pyogenes MGAS8232
auaaaaucguuauuaauuguuuu

SEQ ID NO: 4127877 - RNA, 17 nt, Streptococcus pyogenes MGAS8232
auaaaauuccccacaaa

SEQ ID NO: 4127878 - RNA, 23 nt, Streptococcus pyogenes MGAS8232
auaaaauuccccacaaaagacaa

SEQ ID NO: 4127879 - RNA, 18 nt, Streptococcus pyogenes MGAS8232
auaaagaaacaaaaauga

SEQ ID NO: 4127880 - RNA, 22 nt, Streptococcus pyogenes MGAS8232
auaaagcguugacaguuaaaaa

SEQ ID NO: 4127881 - RNA, 14 nt, Streptococcus pyogenes MGAS8232
auaaauauuuuaua

SEQ ID NO: 4127882 - RNA, 22 nt, Streptococcus pyogenes MGAS8232
auaaauauuuuauauuauguuc

SEQ ID NO: 4127883 - RNA, 15 nt, Streptococcus pyogenes MGAS8232
auaacaaauuuaucc

SEQ ID NO: 4127884 - RNA, 15 nt, Streptococcus pyogenes MGAS8232
auaaccgccaucuaa

SEQ ID NO: 4127885 - RNA, 14 nt, Streptococcus pyogenes MGAS8232
auaacucuucggug

SEQ ID NO: 4127886 - RNA, 12 nt, Streptococcus pyogenes MGAS8232
auaacuuucuau

SEQ ID NO: 4127887 - RNA, 20 nt, Streptococcus pyogenes MGAS8232
auaagaccuucaaaaaaggg

SEQ ID NO: 4127888 - RNA, 15 nt, Streptococcus pyogenes MGAS8232
auaagacuuauauga

SEQ ID NO: 4127889 - RNA, 17 nt, Streptococcus pyogenes MGAS8232
auaagauaaguaauauu

SEQ ID NO: 4127890 - RNA, 16 nt, Streptococcus pyogenes MGAS8232
auaagauucaauauga

SEQ ID NO: 4127891 - RNA, 20 nt, Streptococcus pyogenes MGAS8232
auaaggcugcgaugauuuug

SEQ ID NO: 4127892 - RNA, 12 nt, Streptococcus pyogenes MGAS8232
auaaguaauauu

SEQ ID NO: 4127893 - RNA, 21 nt, Streptococcus pyogenes MGAS8232
auaaguagcguacauggaugc

SEQ ID NO: 4127894 - RNA, 23 nt, Streptococcus pyogenes MGAS8232
auaagucauuuuaaguagucaaa

SEQ ID NO: 4127895 - RNA, 12 nt, Streptococcus pyogenes MGAS8232
auaauaaaaaga

SEQ ID NO: 4127896 - RNA, 13 nt, Streptococcus pyogenes MGAS8232
auaauaaaaagag

SEQ ID NO: 4127897 - RNA, 12 nt, Streptococcus pyogenes MGAS8232
auaauaaaaagu

SEQ ID NO: 4127898 - RNA, 14 nt, Streptococcus pyogenes MGAS8232
auaauauaaugaug

SEQ ID NO: 4127899 - RNA, 23 nt, Streptococcus pyogenes MGAS8232
auaauauuauaguauuaucucau

SEQ ID NO: 4127900 - RNA, 16 nt, Streptococcus pyogenes MGAS8232
auaaugagcaaggcaa

SEQ ID NO: 4127901 - RNA, 14 nt, Streptococcus pyogenes MGAS8232
auaaugauuuuuaa

SEQ ID NO: 4127902 - RNA, 13 nt, Streptococcus pyogenes MGAS8232
auaaugguuuuuu

SEQ ID NO: 4127903 - RNA, 22 nt, Streptococcus pyogenes MGAS8232
auaauguuauaauaauauuaua

SEQ ID NO: 4127904 - RNA, 21 nt, Streptococcus pyogenes MGAS8232
auaauuaguauauuguaauaa

SEQ ID NO: 4127905 - RNA, 21 nt, Streptococcus pyogenes MGAS8232
auaauuccugugacaacccaa

SEQ ID NO: 4127906 - RNA, 19 nt, Streptococcus pyogenes MGAS8232
auacaagguuaaguaaaag

SEQ ID NO: 4127907 - RNA, 18 nt, Streptococcus pyogenes MGAS8232
auacaagucuuagaaaua

SEQ ID NO: 4127908 - RNA, 14 nt, Streptococcus pyogenes MGAS8232
auacagcauacauc

SEQ ID NO: 4127909 - RNA, 22 nt, Streptococcus pyogenes MGAS8232
auacaguccaaacucaaacuaa

SEQ ID NO: 4127910 - RNA, 14 nt, Streptococcus pyogenes MGAS8232
auacauacaagucu

SEQ ID NO: 4127911 - RNA, 16 nt, Streptococcus pyogenes MGAS8232
auaccaucaaugacuu

SEQ ID NO: 4127912 - RNA, 21 nt, Streptococcus pyogenes MGAS8232
auaccauuucuuugcaaaaga

SEQ ID NO: 4127913 - RNA, 18 nt, Streptococcus pyogenes MGAS8232
auaccugagccgccaaca

SEQ ID NO: 4127914 - RNA, 15 nt, Streptococcus pyogenes MGAS8232
auaccuucauagaca

SEQ ID NO: 4127915 - RNA, 14 nt, Streptococcus pyogenes MGAS8232
auacgguaaaaacu

SEQ ID NO: 4127916 - RNA, 18 nt, Streptococcus pyogenes MGAS8232
auacucaauauaauaaaa

SEQ ID NO: 4127917 - RNA, 21 nt, Streptococcus pyogenes MGAS8232
auacucaauauaauaaaaagu

SEQ ID NO: 4127918 - RNA, 23 nt, Streptococcus pyogenes MGAS8232
auacucuauuuacucaucuacuc

SEQ ID NO: 4127919 - RNA, 15 nt, Streptococcus pyogenes MGAS8232
auacugguauguuga

SEQ ID NO: 4127920 - RNA, 22 nt, Streptococcus pyogenes MGAS8232
auacuggucaauggaaauuuua

SEQ ID NO: 4127921 - RNA, 16 nt, Streptococcus pyogenes MGAS8232
auacuuccaucuaauc

SEQ ID NO: 4127922 - RNA, 16 nt, Streptococcus pyogenes MGAS8232
auacuucgguauucuu

SEQ ID NO: 4127923 - RNA, 20 nt, Streptococcus pyogenes MGAS8232
augauugaguaagcagcauc

SEQ ID NO: 4127924 - RNA, 21 nt, Streptococcus pyogenes MGAS8232
augauugaguaagcagcauca

SEQ ID NO: 4127925 - RNA, 16 nt, Streptococcus pyogenes MGAS8232
augauuuuuaauucuu

SEQ ID NO: 4127926 - RNA, 13 nt, Streptococcus pyogenes MGAS8232
augcaaaagauga

SEQ ID NO: 4127927 - RNA, 15 nt, Streptococcus pyogenes MGAS8232
augcacacaaaucuu

SEQ ID NO: 4127928 - RNA, 23 nt, Streptococcus pyogenes MGAS8232
augcacacaaaucuucuagaauc

SEQ ID NO: 4127929 - RNA, 23 nt, Streptococcus pyogenes MGAS8232
augccaagauaccggguuguuuu

SEQ ID NO: 4127930 - RNA, 14 nt, Streptococcus pyogenes MGAS8232
augccagcagccug

SEQ ID NO: 4127931 - RNA, 18 nt, Streptococcus pyogenes MGAS8232
augcgugguggaggucug

SEQ ID NO: 4127932 - RNA, 17 nt, Streptococcus pyogenes MGAS8232
augcucauaggcagaga

SEQ ID NO: 4127933 - RNA, 15 nt, Streptococcus pyogenes MGAS8232
augcugaguucuuuu

SEQ ID NO: 4127934 - RNA, 16 nt, Streptococcus pyogenes MGAS8232
augcugaguucuuuuu

SEQ ID NO: 4127935 - RNA, 12 nt, Streptococcus pyogenes MGAS8232
augcuguccaug

SEQ ID NO: 4127936 - RNA, 14 nt, Streptococcus pyogenes MGAS8232
augcuguccaugau

SEQ ID NO: 4127937 - RNA, 19 nt, Streptococcus pyogenes MGAS8232
augcuguccaugauuuuca

SEQ ID NO: 4127938 - RNA, 20 nt, Streptococcus pyogenes MGAS8232
augcuguccaugauuuucau

SEQ ID NO: 4127939 - RNA, 19 nt, Streptococcus pyogenes MGAS8232
augcuugaguagcuacugc

SEQ ID NO: 4127940 - RNA, 16 nt, Streptococcus pyogenes MGAS8232
augcuuuuaauuuuau

SEQ ID NO: 4127941 - RNA, 20 nt, Streptococcus pyogenes MGAS8232
auggaaauuuuaaaugacau

SEQ ID NO: 4127942 - RNA, 21 nt, Streptococcus pyogenes MGAS8232
auggauauaacaacucccucc

SEQ ID NO: 4127943 - RNA, 17 nt, Streptococcus pyogenes MGAS8232
auggcuucuaaaaaaaa

SEQ ID NO: 4127944 - RNA, 17 nt, Streptococcus pyogenes MGAS8232
auggggugucaggggaa

SEQ ID NO: 4127945 - RNA, 20 nt, Streptococcus pyogenes MGAS8232
auggguguuuaaucuuuguu

SEQ ID NO: 4127946 - RNA, 15 nt, Streptococcus pyogenes MGAS8232
auggguuguuuuguu

SEQ ID NO: 4127947 - RNA, 15 nt, Streptococcus pyogenes MGAS8232
augguaaaggccuua

SEQ ID NO: 4127948 - RNA, 17 nt, Streptococcus pyogenes MGAS8232
augguagcaagaaguuu

SEQ ID NO: 4127949 - RNA, 16 nt, Streptococcus pyogenes MGAS8232
auguaaacaauugguu

SEQ ID NO: 4127950 - RNA, 14 nt, Streptococcus pyogenes MGAS8232
auguaauugucucu

SEQ ID NO: 4127951 - RNA, 23 nt, Streptococcus pyogenes MGAS8232
auguaccaauuuaagguauuguu

SEQ ID NO: 4127952 - RNA, 22 nt, Streptococcus pyogenes MGAS8232
auguaugcuguccaugauuuuc

SEQ ID NO: 4127953 - RNA, 12 nt, Streptococcus pyogenes MGAS8232
auguauuuuuca

SEQ ID NO: 4127954 - RNA, 16 nt, Streptococcus pyogenes MGAS8232
auguauuuuucaaaau

SEQ ID NO: 4127955 - RNA, 20 nt, Streptococcus pyogenes MGAS8232
auguuaggagcacaaaagag

SEQ ID NO: 4127956 - RNA, 21 nt, Streptococcus pyogenes MGAS8232
auguuuauccucuuauagcac

SEQ ID NO: 4127957 - RNA, 13 nt, Streptococcus pyogenes MGAS8232
auguuuuauuacc

SEQ ID NO: 4127958 - RNA, 22 nt, Streptococcus pyogenes MGAS8232
auguuuugcucgacagugcgca

SEQ ID NO: 4127959 - RNA, 16 nt, Streptococcus pyogenes MGAS8232
auuaaccguuccuguc

SEQ ID NO: 4127960 - RNA, 23 nt, Streptococcus pyogenes MGAS8232
auuaagauuugaccacaccuaau

SEQ ID NO: 4127961 - RNA, 12 nt, Streptococcus pyogenes MGAS8232
auuaauaaauuu

SEQ ID NO: 4127962 - RNA, 15 nt, Streptococcus pyogenes MGAS8232
auuaauaaauuuuug

SEQ ID NO: 4127963 - RNA, 19 nt, Streptococcus pyogenes MGAS8232
auuaauaaguauuuuaaaa

SEQ ID NO: 4127964 - RNA, 13 nt, Streptococcus pyogenes MGAS8232
auuaaucaaaaaa

SEQ ID NO: 4127965 - RNA, 22 nt, Streptococcus pyogenes MGAS8232
auuaaucaaaaaacugagacaa

SEQ ID NO: 4127966 - RNA, 14 nt, Streptococcus pyogenes MGAS8232
auuaauuguuuuag

SEQ ID NO: 4127967 - RNA, 17 nt, Streptococcus pyogenes MGAS8232
auuacaagcauuuugca

SEQ ID NO: 4127968 - RNA, 14 nt, Streptococcus pyogenes MGAS8232
auuacucaauuaau

SEQ ID NO: 4127969 - RNA, 17 nt, Streptococcus pyogenes MGAS8232
auuagcgccagcauuug

SEQ ID NO: 4127970 - RNA, 15 nt, Streptococcus pyogenes MGAS8232
auuauaguauaccua

SEQ ID NO: 4127971 - RNA, 13 nt, Streptococcus pyogenes MGAS8232
auuauauuaggau

SEQ ID NO: 4127972 - RNA, 14 nt, Streptococcus pyogenes MGAS8232
auuauauuaggaua

SEQ ID NO: 4127973 - RNA, 17 nt, Streptococcus pyogenes MGAS8232
auuaucaauaacagaaa

SEQ ID NO: 4127974 - RNA, 14 nt, Streptococcus pyogenes MGAS8232
auuauccaacuuuu

SEQ ID NO: 4127975 - RNA, 17 nt, Streptococcus pyogenes MGAS8232
auuaucugaauuauuag

SEQ ID NO: 4127976 - RNA, 19 nt, Streptococcus pyogenes MGAS8232
auuaucugaauuauuagua

SEQ ID NO: 4127977 - RNA, 14 nt, Streptococcus pyogenes MGAS8232
auuaugaaaaagaa

SEQ ID NO: 4127978 - RNA, 13 nt, Streptococcus pyogenes MGAS8232
auuauguucuaaa

SEQ ID NO: 4127979 - RNA, 14 nt, Streptococcus pyogenes MGAS8232
auuauguucuaaaa

SEQ ID NO: 4127980 - RNA, 18 nt, Streptococcus pyogenes MGAS8232
auuauuaaccaauuccuc

SEQ ID NO: 4127981 - RNA, 22 nt, Streptococcus pyogenes MGAS8232
auuauuaaccaauuccucccua

SEQ ID NO: 4127982 - RNA, 16 nt, Streptococcus pyogenes MGAS8232
auuauucuaaaugaca

SEQ ID NO: 4127983 - RNA, 17 nt, Streptococcus pyogenes MGAS8232
auuauuuuaauuuuucc

SEQ ID NO: 4127984 - RNA, 13 nt, Streptococcus pyogenes MGAS8232
auuauuuugcuuc

SEQ ID NO: 4127985 - RNA, 13 nt, Streptococcus pyogenes MGAS8232
auucaauaucaca

SEQ ID NO: 4127986 - RNA, 18 nt, Streptococcus pyogenes MGAS8232
auucaauaucacauuuua

SEQ ID NO: 4127987 - RNA, 19 nt, Streptococcus pyogenes MGAS8232
auucaugacgccuccaaau

SEQ ID NO: 4127988 - RNA, 13 nt, Streptococcus pyogenes MGAS8232
auucauuuucuuc

SEQ ID NO: 4127989 - RNA, 14 nt, Streptococcus pyogenes MGAS8232
auuccaaacaucca

SEQ ID NO: 4127990 - RNA, 16 nt, Streptococcus pyogenes MGAS8232
auuccggcagggguca

SEQ ID NO: 4127991 - RNA, 23 nt, Streptococcus pyogenes MGAS8232
auuccucaaacacguauuuuucg

SEQ ID NO: 4127992 - RNA, 16 nt, Streptococcus pyogenes MGAS8232
auuccuucuuuuuccu

SEQ ID NO: 4127993 - RNA, 14 nt, Streptococcus pyogenes MGAS8232
auucuaacauggau

SEQ ID NO: 4127994 - RNA, 18 nt, Streptococcus pyogenes MGAS8232
auucuuaaaaaaaucccu

SEQ ID NO: 4127995 - RNA, 15 nt, Streptococcus pyogenes MGAS8232
auucuuuauaauggu

SEQ ID NO: 4127996 - RNA, 16 nt, Streptococcus pyogenes MGAS8232
auugaaucuuguuuaa

SEQ ID NO: 4127997 - RNA, 17 nt, Streptococcus pyogenes MGAS8232
auugaaucuuguuuaac

SEQ ID NO: 4127998 - RNA, 23 nt, Streptococcus pyogenes MGAS8232
auugacuugguucugaaaauaaa

SEQ ID NO: 4127999 - RNA, 16 nt, Streptococcus pyogenes MGAS8232
auugaguaagcagcau

SEQ ID NO: 4128000 - RNA, 23 nt, Streptococcus pyogenes MGAS8232
auugaucucugcaacaucaaggg

SEQ ID NO: 4128001 - RNA, 17 nt, Streptococcus pyogenes MGAS8232
auugauuauucucuauu

SEQ ID NO: 4128002 - RNA, 15 nt, Streptococcus pyogenes MGAS8232
auugcagcuaaaaac

SEQ ID NO: 4128003 - RNA, 17 nt, Streptococcus pyogenes MGAS8232
auugcagcuaaaaacaa

SEQ ID NO: 4128004 - RNA, 14 nt, Streptococcus pyogenes MGAS8232
auuggaaaauauau

SEQ ID NO: 4128005 - RNA, 20 nt, Streptococcus pyogenes MGAS8232
auuguaauaacaaaaugaag

SEQ ID NO: 4128006 - RNA, 23 nt, Streptococcus pyogenes MGAS8232
auuguaauaacaaaaugaagcaa

SEQ ID NO: 4128007 - RNA, 15 nt, Streptococcus pyogenes MGAS8232
auuguagggauuuuu

SEQ ID NO: 4128008 - RNA, 21 nt, Streptococcus pyogenes MGAS8232
auuguagggauuuuuuuaacu

SEQ ID NO: 4128009 - RNA, 14 nt, Streptococcus pyogenes MGAS8232
auugucaaauaaaa

SEQ ID NO: 4128010 - RNA, 20 nt, Streptococcus pyogenes MGAS8232
auuuaaccauaucgacauuu

SEQ ID NO: 4128011 - RNA, 17 nt, Streptococcus pyogenes MGAS8232
auuuaagguauuguuca

SEQ ID NO: 4128012 - RNA, 21 nt, Streptococcus pyogenes MGAS8232
auuuaaucuuauuaaagagaa

SEQ ID NO: 4128013 - RNA, 16 nt, Streptococcus pyogenes MGAS8232
auuuacaguuguaugg

SEQ ID NO: 4128014 - RNA, 15 nt, Streptococcus pyogenes MGAS8232
auuuagaaauuuuau

SEQ ID NO: 4128015 - RNA, 22 nt, Streptococcus pyogenes MGAS8232
auuuagaugguagcaagaaguu

SEQ ID NO: 4128016 - RNA, 14 nt, Streptococcus pyogenes MGAS8232
auuuaguucuaagu

SEQ ID NO: 4128017 - RNA, 20 nt, Streptococcus pyogenes MGAS8232
auuuauaaauauuuuauauu

SEQ ID NO: 4128018 - RNA, 22 nt, Streptococcus pyogenes MGAS8232
auuuaugcugauuuuggaugaa

SEQ ID NO: 4128019 - RNA, 16 nt, Streptococcus pyogenes MGAS8232
auuucaauaauaccau

SEQ ID NO: 4128020 - RNA, 17 nt, Streptococcus pyogenes MGAS8232
auuucaauaauaccauu

SEQ ID NO: 4128021 - RNA, 15 nt, Streptococcus pyogenes MGAS8232
caauauagcaaucuu

SEQ ID NO: 4128022 - RNA, 15 nt, Streptococcus pyogenes MGAS8232
caauauccauagaaa

SEQ ID NO: 4128023 - RNA, 20 nt, Streptococcus pyogenes MGAS8232
caauaugugauuauuauucu

SEQ ID NO: 4128024 - RNA, 17 nt, Streptococcus pyogenes MGAS8232
caaucgaaaugauagca

SEQ ID NO: 4128025 - RNA, 20 nt, Streptococcus pyogenes MGAS8232
caaucgaaaugauagcaccu

SEQ ID NO: 4128026 - RNA, 19 nt, Streptococcus pyogenes MGAS8232
caaucuucaacaccuucgu

SEQ ID NO: 4128027 - RNA, 20 nt, Streptococcus pyogenes MGAS8232
caaugacuugaccaaauaca

SEQ ID NO: 4128028 - RNA, 13 nt, Streptococcus pyogenes MGAS8232
caaugccaucugc

SEQ ID NO: 4128029 - RNA, 15 nt, Streptococcus pyogenes MGAS8232
caauggaaauuuuaa

SEQ ID NO: 4128030 - RNA, 15 nt, Streptococcus pyogenes MGAS8232
caaugguuaaaaaga

SEQ ID NO: 4128031 - RNA, 23 nt, Streptococcus pyogenes MGAS8232
caauguuuugcucgacagugcgc

SEQ ID NO: 4128032 - RNA, 12 nt, Streptococcus pyogenes MGAS8232
caauuaaaaaag

SEQ ID NO: 4128033 - RNA, 22 nt, Streptococcus pyogenes MGAS8232
caauuaaaaaagcuuuuuaucu

SEQ ID NO: 4128034 - RNA, 23 nt, Streptococcus pyogenes MGAS8232
caauuaauguuaggagcacaaaa

SEQ ID NO: 4128035 - RNA, 22 nt, Streptococcus pyogenes MGAS8232
caauucaagguaguaaugacga

SEQ ID NO: 4128036 - RNA, 14 nt, Streptococcus pyogenes MGAS8232
caauucagcaucgu

SEQ ID NO: 4128037 - RNA, 10 nt, Streptococcus pyogenes MGAS8232
caauucuuuu

SEQ ID NO: 4128038 - RNA, 15 nt, Streptococcus pyogenes MGAS8232
caauugcuuuuagcc

SEQ ID NO: 4128039 - RNA, 14 nt, Streptococcus pyogenes MGAS8232
cacaacucaagaua

SEQ ID NO: 4128040 - RNA, 13 nt, Streptococcus pyogenes MGAS8232
cacacaaaucuuc

SEQ ID NO: 4128041 - RNA, 17 nt, Streptococcus pyogenes MGAS8232
cacacaaaucuucuaga

SEQ ID NO: 4128042 - RNA, 11 nt, Streptococcus pyogenes MGAS8232
cacagcaauuu

SEQ ID NO: 4128043 - RNA, 21 nt, Streptococcus pyogenes MGAS8232
cacauacuggucaauggaaau

SEQ ID NO: 4128044 - RNA, 22 nt, Streptococcus pyogenes MGAS8232
cacaugcuugaguagcuacugc

SEQ ID NO: 4128045 - RNA, 12 nt, Streptococcus pyogenes MGAS8232
caccaaaaaaag

SEQ ID NO: 4128046 - RNA, 14 nt, Streptococcus pyogenes MGAS8232
caccaaaaaaagca

SEQ ID NO: 4128047 - RNA, 22 nt, Streptococcus pyogenes MGAS8232
caccaauaaugagcaaggcaag

SEQ ID NO: 4128048 - RNA, 10 nt, Streptococcus pyogenes MGAS8232
caccaccaau

SEQ ID NO: 4128049 - RNA, 13 nt, Streptococcus pyogenes MGAS8232
caccaccaauaau

SEQ ID NO: 4128050 - RNA, 20 nt, Streptococcus pyogenes MGAS8232
cacccucaacagcaggccuu

SEQ ID NO: 4128051 - RNA, 17 nt, Streptococcus pyogenes MGAS8232
caccgacauacaaagca

SEQ ID NO: 4128052 - RNA, 23 nt, Streptococcus pyogenes MGAS8232
caccuacgauaaaacaaauaauu

SEQ ID NO: 4128053 - RNA, 20 nt, Streptococcus pyogenes MGAS8232
caccuuagugguuugcaaau

SEQ ID NO: 4128054 - RNA, 22 nt, Streptococcus pyogenes MGAS8232
caccuucguauuggccuucuug

SEQ ID NO: 4128055 - RNA, 22 nt, Streptococcus pyogenes MGAS8232
cacuacucguuacauaaaauga

SEQ ID NO: 4128056 - RNA, 18 nt, Streptococcus pyogenes MGAS8232
cacuaucugauacagagc

SEQ ID NO: 4128057 - RNA, 15 nt, Streptococcus pyogenes MGAS8232
cacuauuuugugacu

SEQ ID NO: 4128058 - RNA, 21 nt, Streptococcus pyogenes MGAS8232
cagaaauuaauaaauuuuugu

SEQ ID NO: 4128059 - RNA, 16 nt, Streptococcus pyogenes MGAS8232
cagaagccucuucuga

SEQ ID NO: 4128060 - RNA, 16 nt, Streptococcus pyogenes MGAS8232
cagaauaagaaaaccu

SEQ ID NO: 4128061 - RNA, 22 nt, Streptococcus pyogenes MGAS8232
cagacuuuuaauguauuggaaa

SEQ ID NO: 4128062 - RNA, 15 nt, Streptococcus pyogenes MGAS8232
cagagcaguucagca

SEQ ID NO: 4128063 - RNA, 17 nt, Streptococcus pyogenes MGAS8232
cagagcucgucuuuguc

SEQ ID NO: 4128064 - RNA, 15 nt, Streptococcus pyogenes MGAS8232
cagaguacaaggcaa

SEQ ID NO: 4128065 - RNA, 20 nt, Streptococcus pyogenes MGAS8232
cagauaagaccuucaaaaaa

SEQ ID NO: 4128066 - RNA, 12 nt, Streptococcus pyogenes MGAS8232
cagcaauuuguu

SEQ ID NO: 4128067 - RNA, 18 nt, Streptococcus pyogenes MGAS8232
cagcaccuucaaccgcuu

SEQ ID NO: 4128068 - RNA, 14 nt, Streptococcus pyogenes MGAS8232
cagcaccuucuuuu

SEQ ID NO: 4128069 - RNA, 13 nt, Streptococcus pyogenes MGAS8232
cagcuaaaagcau

SEQ ID NO: 4128070 - RNA, 23 nt, Streptococcus pyogenes MGAS8232
cagcugguuuuuuuaauuauuuu

SEQ ID NO: 4128071 - RNA, 23 nt, Streptococcus pyogenes MGAS8232
cagcuucuacgggauuuaguucu

SEQ ID NO: 4128072 - RNA, 20 nt, Streptococcus pyogenes MGAS8232
caguauguaaauauaaaguc

SEQ ID NO: 4128073 - RNA, 14 nt, Streptococcus pyogenes MGAS8232
caguccgucaaaaa

SEQ ID NO: 4128074 - RNA, 23 nt, Streptococcus pyogenes MGAS8232
caguccuccucuuuagaauucuu

SEQ ID NO: 4128075 - RNA, 19 nt, Streptococcus pyogenes MGAS8232
cagucugauuggugcgucu

SEQ ID NO: 4128076 - RNA, 14 nt, Streptococcus pyogenes MGAS8232
caguuaaaaauaac

SEQ ID NO: 4128077 - RNA, 19 nt, Streptococcus pyogenes MGAS8232
caguuaaaaauaacuuuaa

SEQ ID NO: 4128078 - RNA, 23 nt, Streptococcus pyogenes MGAS8232
caguucugagauauucauuuucu

SEQ ID NO: 4128079 - RNA, 12 nt, Streptococcus pyogenes MGAS8232
caguuuuuucug

SEQ ID NO: 4128080 - RNA, 12 nt, Streptococcus pyogenes MGAS8232
cauaaaaaagaa

SEQ ID NO: 4128081 - RNA, 13 nt, Streptococcus pyogenes MGAS8232
cauaaaaaagaac

SEQ ID NO: 4128082 - RNA, 22 nt, Streptococcus pyogenes MGAS8232
cauaaucauagguugcaccacc

SEQ ID NO: 4128083 - RNA, 23 nt, Streptococcus pyogenes MGAS8232
cauaaucauagguugcaccacca

SEQ ID NO: 4128084 - RNA, 16 nt, Streptococcus pyogenes MGAS8232
cauaaugcauguaaug

SEQ ID NO: 4128085 - RNA, 23 nt, Streptococcus pyogenes MGAS8232
cauaaugcauguaaugaccaccc

SEQ ID NO: 4128086 - RNA, 18 nt, Streptococcus pyogenes MGAS8232
cauacucaauagcugcug

SEQ ID NO: 4128087 - RNA, 21 nt, Streptococcus pyogenes MGAS8232
cauagacaagcuuuuuuauaa

SEQ ID NO: 4128088 - RNA, 15 nt, Streptococcus pyogenes MGAS8232
cauaucgacauuuau

SEQ ID NO: 4128089 - RNA, 18 nt, Streptococcus pyogenes MGAS8232
cauaucgacauuuaugcu

SEQ ID NO: 4128090 - RNA, 18 nt, Streptococcus pyogenes MGAS8232
cauauuuuugaaaaaaau

SEQ ID NO: 4128091 - RNA, 20 nt, Streptococcus pyogenes MGAS8232
caucaaaagaccauaaaaaa

SEQ ID NO: 4128092 - RNA, 21 nt, Streptococcus pyogenes MGAS8232
caucaaaggcuuuuuuguauu

SEQ ID NO: 4128093 - RNA, 19 nt, Streptococcus pyogenes MGAS8232
caucaacaaguguuuuguc

SEQ ID NO: 4128094 - RNA, 11 nt, Streptococcus pyogenes MGAS8232
caucaauagca

SEQ ID NO: 4128095 - RNA, 16 nt, Streptococcus pyogenes MGAS8232
caucaauguuuugcuc

SEQ ID NO: 4128096 - RNA, 15 nt, Streptococcus pyogenes MGAS8232
caucacguacagaaa

SEQ ID NO: 4128097 - RNA, 17 nt, Streptococcus pyogenes MGAS8232
caucagcucucaagaga

SEQ ID NO: 4128098 - RNA, 17 nt, Streptococcus pyogenes MGAS8232
caucaggcuuaaacaua

SEQ ID NO: 4128099 - RNA, 18 nt, Streptococcus pyogenes MGAS8232
caucaggcuuaaacauau

SEQ ID NO: 4128100 - RNA, 13 nt, Streptococcus pyogenes MGAS8232
caucauauuguua

SEQ ID NO: 4128101 - RNA, 19 nt, Streptococcus pyogenes MGAS8232
caucaucaagaauagcuuu

SEQ ID NO: 4128102 - RNA, 20 nt, Streptococcus pyogenes MGAS8232
caucaucaagaauagcuuuu

SEQ ID NO: 4128103 - RNA, 22 nt, Streptococcus pyogenes MGAS8232
caucaucgaguggauacaaggu

SEQ ID NO: 4128104 - RNA, 22 nt, Streptococcus pyogenes MGAS8232
cauccuaauggugucguuuuuu

SEQ ID NO: 4128105 - RNA, 22 nt, Streptococcus pyogenes MGAS8232
caucgagauuccuucuuuuucc

SEQ ID NO: 4128106 - RNA, 21 nt, Streptococcus pyogenes MGAS8232
caucgaguggauacaagguua

SEQ ID NO: 4128107 - RNA, 20 nt, Streptococcus pyogenes MGAS8232
caucguuaaguggaauguuu

SEQ ID NO: 4128108 - RNA, 18 nt, Streptococcus pyogenes MGAS8232
caucuuaacgaaaagcau

SEQ ID NO: 4128109 - RNA, 22 nt, Streptococcus pyogenes MGAS8232
caugaaaguuauagcuccuaaa

SEQ ID NO: 4128110 - RNA, 20 nt, Streptococcus pyogenes MGAS8232
caugacacuuaaaugcaaaa

SEQ ID NO: 4128111 - RNA, 15 nt, Streptococcus pyogenes MGAS8232
caugaccaaaaaauu

SEQ ID NO: 4128112 - RNA, 12 nt, Streptococcus pyogenes MGAS8232
caugaggcaaau

SEQ ID NO: 4128113 - RNA, 20 nt, Streptococcus pyogenes MGAS8232
caugaggcaaaugaaaaaac

SEQ ID NO: 4128114 - RNA, 19 nt, Streptococcus pyogenes MGAS8232
caugauaucccaucuuugu

SEQ ID NO: 4128115 - RNA, 19 nt, Streptococcus pyogenes MGAS8232
caugaugccauuuaaaagg

SEQ ID NO: 4128116 - RNA, 23 nt, Streptococcus pyogenes MGAS8232
cauggcaagagcaccgcgaauau

SEQ ID NO: 4128117 - RNA, 14 nt, Streptococcus pyogenes MGAS8232
caugggaaaagcua

SEQ ID NO: 4128118 - RNA, 12 nt, Streptococcus pyogenes MGAS8232
cgauuaaaagau

SEQ ID NO: 4128119 - RNA, 14 nt, Streptococcus pyogenes MGAS8232
cgauuaaaagaugu

SEQ ID NO: 4128120 - RNA, 18 nt, Streptococcus pyogenes MGAS8232
cgauuaaccguuccuguc

SEQ ID NO: 4128121 - RNA, 21 nt, Streptococcus pyogenes MGAS8232
cgcauacuggguaucaguccu

SEQ ID NO: 4128122 - RNA, 22 nt, Streptococcus pyogenes MGAS8232
cgccaguaaagucacgaguguu

SEQ ID NO: 4128123 - RNA, 20 nt, Streptococcus pyogenes MGAS8232
cgcguuucgaaaaaggggag

SEQ ID NO: 4128124 - RNA, 13 nt, Streptococcus pyogenes MGAS8232
cggcaucuacagc

SEQ ID NO: 4128125 - RNA, 13 nt, Streptococcus pyogenes MGAS8232
cgguaaaaacuca

SEQ ID NO: 4128126 - RNA, 14 nt, Streptococcus pyogenes MGAS8232
cgguauucuuuuuc

SEQ ID NO: 4128127 - RNA, 16 nt, Streptococcus pyogenes MGAS8232
cguaacguaauagaau

SEQ ID NO: 4128128 - RNA, 17 nt, Streptococcus pyogenes MGAS8232
cguaaugucuuguucug

SEQ ID NO: 4128129 - RNA, 15 nt, Streptococcus pyogenes MGAS8232
cguauuggccuucuu

SEQ ID NO: 4128130 - RNA, 20 nt, Streptococcus pyogenes MGAS8232
cgucaaaaagucgucaacgc

SEQ ID NO: 4128131 - RNA, 17 nt, Streptococcus pyogenes MGAS8232
cgucuuacaauuaauag

SEQ ID NO: 4128132 - RNA, 14 nt, Streptococcus pyogenes MGAS8232
cgugacaaugugac

SEQ ID NO: 4128133 - RNA, 13 nt, Streptococcus pyogenes MGAS8232
cguuaacaaaaau

SEQ ID NO: 4128134 - RNA, 19 nt, Streptococcus pyogenes MGAS8232
cguuaucuccacagagucu

SEQ ID NO: 4128135 - RNA, 22 nt, Streptococcus pyogenes MGAS8232
cguuuaaauguccgaaaaaaac

SEQ ID NO: 4128136 - RNA, 19 nt, Streptococcus pyogenes MGAS8232
cguuuauuuaguuauuuuu

SEQ ID NO: 4128137 - RNA, 21 nt, Streptococcus pyogenes MGAS8232
cguuucagaaguuugcggcuc

SEQ ID NO: 4128138 - RNA, 21 nt, Streptococcus pyogenes MGAS8232
cguuuuacggcuucuacacaa

SEQ ID NO: 4128139 - RNA, 16 nt, Streptococcus pyogenes MGAS8232
cuaaaagcauaaaaau

SEQ ID NO: 4128140 - RNA, 15 nt, Streptococcus pyogenes MGAS8232
cuaaaauauauuggu

SEQ ID NO: 4128141 - RNA, 23 nt, Streptococcus pyogenes MGAS8232
cuaaaaucaugggaaaagcuaag

SEQ ID NO: 4128142 - RNA, 23 nt, Streptococcus pyogenes MGAS8232
cuaaauccuuuugaaaaauuaug

SEQ ID NO: 4128143 - RNA, 15 nt, Streptococcus pyogenes MGAS8232
cuaaaugacaguaua

SEQ ID NO: 4128144 - RNA, 23 nt, Streptococcus pyogenes MGAS8232
cuaacauggauaccauuucuuug

SEQ ID NO: 4128145 - RNA, 13 nt, Streptococcus pyogenes MGAS8232
cuaagauuuccac

SEQ ID NO: 4128146 - RNA, 18 nt, Streptococcus pyogenes MGAS8232
cuaagauuuccacuuggu

SEQ ID NO: 4128147 - RNA, 21 nt, Streptococcus pyogenes MGAS8232
cuaagauuuccacuuggucca

SEQ ID NO: 4128148 - RNA, 23 nt, Streptococcus pyogenes MGAS8232
cuaagcuauagaaacuuuuuaua

SEQ ID NO: 4128149 - RNA, 17 nt, Streptococcus pyogenes MGAS8232
cuaaguccuuuuaguuu

SEQ ID NO: 4128150 - RNA, 11 nt, Streptococcus pyogenes MGAS8232
cuaauaaaaua

SEQ ID NO: 4128151 - RNA, 20 nt, Streptococcus pyogenes MGAS8232
cuaauauuauauuaaauuaa

SEQ ID NO: 4128152 - RNA, 23 nt, Streptococcus pyogenes MGAS8232
cuaaucagaacucgucuuugucc

SEQ ID NO: 4128153 - RNA, 14 nt, Streptococcus pyogenes MGAS8232
cuaauccaguagua

SEQ ID NO: 4128154 - RNA, 15 nt, Streptococcus pyogenes MGAS8232
cuaauugaccugcug

SEQ ID NO: 4128155 - RNA, 17 nt, Streptococcus pyogenes MGAS8232
cuaauuuagucauuucu

SEQ ID NO: 4128156 - RNA, 18 nt, Streptococcus pyogenes MGAS8232
cuaauuuagucauuucuu

SEQ ID NO: 4128157 - RNA, 12 nt, Streptococcus pyogenes MGAS8232
cuacaaaauaac

SEQ ID NO: 4128158 - RNA, 14 nt, Streptococcus pyogenes MGAS8232
cuacacaaaagcuu

SEQ ID NO: 4128159 - RNA, 14 nt, Streptococcus pyogenes MGAS8232
cuacagcaccuuca

SEQ ID NO: 4128160 - RNA, 19 nt, Streptococcus pyogenes MGAS8232
cuacaggauauugagaaga

SEQ ID NO: 4128161 - RNA, 20 nt, Streptococcus pyogenes MGAS8232
cuacaggauauugagaagaa

SEQ ID NO: 4128162 - RNA, 21 nt, Streptococcus pyogenes MGAS8232
cuacaggauauugagaagaaa

SEQ ID NO: 4128163 - RNA, 15 nt, Streptococcus pyogenes MGAS8232
cuacaugaccaaaaa

SEQ ID NO: 4128164 - RNA, 19 nt, Streptococcus pyogenes MGAS8232
cuacaugaccaaaaaauua

SEQ ID NO: 4128165 - RNA, 17 nt, Streptococcus pyogenes MGAS8232
cuaccgcaauuaaacca

SEQ ID NO: 4128166 - RNA, 12 nt, Streptococcus pyogenes MGAS8232
cuacuaaaacgu

SEQ ID NO: 4128167 - RNA, 19 nt, Streptococcus pyogenes MGAS8232
cuacuaaaacgugagaaaa

SEQ ID NO: 4128168 - RNA, 21 nt, Streptococcus pyogenes MGAS8232
cuacuaggcuuucauuauagg

SEQ ID NO: 4128169 - RNA, 17 nt, Streptococcus pyogenes MGAS8232
cuacucuauuuuaagua

SEQ ID NO: 4128170 - RNA, 15 nt, Streptococcus pyogenes MGAS8232
cuagccuacagucug

SEQ ID NO: 4128171 - RNA, 22 nt, Streptococcus pyogenes MGAS8232
cuagccuguccuagucuuuugg

SEQ ID NO: 4128172 - RNA, 13 nt, Streptococcus pyogenes MGAS8232
cuagcgggaacac

SEQ ID NO: 4128173 - RNA, 14 nt, Streptococcus pyogenes MGAS8232
cuagcgggaacacu

SEQ ID NO: 4128174 - RNA, 14 nt, Streptococcus pyogenes MGAS8232
cuaggaauaaaaug

SEQ ID NO: 4128175 - RNA, 21 nt, Streptococcus pyogenes MGAS8232
cuaggagggacugucaaaaaa

SEQ ID NO: 4128176 - RNA, 15 nt, Streptococcus pyogenes MGAS8232
cuagguuaaaauaga

SEQ ID NO: 4128177 - RNA, 17 nt, Streptococcus pyogenes MGAS8232
cuagguuaaaauagaag

SEQ ID NO: 4128178 - RNA, 22 nt, Streptococcus pyogenes MGAS8232
cuagucgaaauugguccucuga

SEQ ID NO: 4128179 - RNA, 21 nt, Streptococcus pyogenes MGAS8232
cuaguguguugucaaacauaa

SEQ ID NO: 4128180 - RNA, 19 nt, Streptococcus pyogenes MGAS8232
cuauaaacgguaauuuauu

SEQ ID NO: 4128181 - RNA, 15 nt, Streptococcus pyogenes MGAS8232
cuauaauuucaauaa

SEQ ID NO: 4128182 - RNA, 15 nt, Streptococcus pyogenes MGAS8232
cuaugaaaaaagaac

SEQ ID NO: 4128183 - RNA, 16 nt, Streptococcus pyogenes MGAS8232
cuaugaucuguuuaaa

SEQ ID NO: 4128184 - RNA, 15 nt, Streptococcus pyogenes MGAS8232
cuauggcuucuaaaa

SEQ ID NO: 4128185 - RNA, 20 nt, Streptococcus pyogenes MGAS8232
cuauguugcuuaaugaccuu

SEQ ID NO: 4128186 - RNA, 16 nt, Streptococcus pyogenes MGAS8232
cuauuaccuauagaaa

SEQ ID NO: 4128187 - RNA, 18 nt, Streptococcus pyogenes MGAS8232
cuauugaaucuuguuuaa

SEQ ID NO: 4128188 - RNA, 21 nt, Streptococcus pyogenes MGAS8232
cuauugaaucuuguuuaaccu

SEQ ID NO: 4128189 - RNA, 17 nt, Streptococcus pyogenes MGAS8232
cuauuuaaccuucaaca

SEQ ID NO: 4128190 - RNA, 21 nt, Streptococcus pyogenes MGAS8232
cuauuuaauaggcuuuuuuug

SEQ ID NO: 4128191 - RNA, 23 nt, Streptococcus pyogenes MGAS8232
cuauuuagguacucguaagcauu

SEQ ID NO: 4128192 - RNA, 12 nt, Streptococcus pyogenes MGAS8232
cuauuuuaagua

SEQ ID NO: 4128193 - RNA, 22 nt, Streptococcus pyogenes MGAS8232
cucaacaguauaacuguuuuuc

SEQ ID NO: 4128194 - RNA, 14 nt, Streptococcus pyogenes MGAS8232
cucaauagcugcug

SEQ ID NO: 4128195 - RNA, 13 nt, Streptococcus pyogenes MGAS8232
cucaauauaauaa

SEQ ID NO: 4128196 - RNA, 19 nt, Streptococcus pyogenes MGAS8232
cucaauuuuugauuuuaau

SEQ ID NO: 4128197 - RNA, 14 nt, Streptococcus pyogenes MGAS8232
cucagagacaauaa

SEQ ID NO: 4128198 - RNA, 22 nt, Streptococcus pyogenes MGAS8232
cucagagcuuuuuuuguuuugg

SEQ ID NO: 4128199 - RNA, 18 nt, Streptococcus pyogenes MGAS8232
cucaguucugagauauuc

SEQ ID NO: 4128200 - RNA, 14 nt, Streptococcus pyogenes MGAS8232
cucaucuacucuau

SEQ ID NO: 4128201 - RNA, 17 nt, Streptococcus pyogenes MGAS8232
cucaugggcaaauaaac

SEQ ID NO: 4128202 - RNA, 12 nt, Streptococcus pyogenes MGAS8232
cuccaaagacau

SEQ ID NO: 4128203 - RNA, 16 nt, Streptococcus pyogenes MGAS8232
cuccaaaguucuucua

SEQ ID NO: 4128204 - RNA, 20 nt, Streptococcus pyogenes MGAS8232
cuccuugcaauagagccaag

SEQ ID NO: 4128205 - RNA, 21 nt, Streptococcus pyogenes MGAS8232
cuccuuguuauccucccagcc

SEQ ID NO: 4128206 - RNA, 15 nt, Streptococcus pyogenes MGAS8232
cucgguuuuuuuaag

SEQ ID NO: 4128207 - RNA, 17 nt, Streptococcus pyogenes MGAS8232
cucgguuuuuuuaagua

SEQ ID NO: 4128208 - RNA, 17 nt, Streptococcus pyogenes MGAS8232
cucuaacauguccaaau

SEQ ID NO: 4128209 - RNA, 16 nt, Streptococcus pyogenes MGAS8232
cucuaauuuagucauu

SEQ ID NO: 4128210 - RNA, 21 nt, Streptococcus pyogenes MGAS8232
cucuaauuuagucauuucuuc

SEQ ID NO: 4128211 - RNA, 14 nt, Streptococcus pyogenes MGAS8232
cucuaucaucuuug

SEQ ID NO: 4128212 - RNA, 17 nt, Streptococcus pyogenes MGAS8232
cucucaugggcaaauaa

SEQ ID NO: 4128213 - RNA, 14 nt, Streptococcus pyogenes MGAS8232
cucugcaacaucaa

SEQ ID NO: 4128214 - RNA, 22 nt, Streptococcus pyogenes MGAS8232
cucuugcaaggugcuuuuuuug

SEQ ID NO: 4128215 - RNA, 16 nt, Streptococcus pyogenes MGAS8232
cuuuaggaucauuauc

SEQ ID NO: 4128216 - RNA, 19 nt, Streptococcus pyogenes MGAS8232
cuuuauaaagcuuuaaaaa

SEQ ID NO: 4128217 - RNA, 20 nt, Streptococcus pyogenes MGAS8232
cuuuauaaagcuuuaaaaaa

SEQ ID NO: 4128218 - RNA, 18 nt, Streptococcus pyogenes MGAS8232
cuuuaucagucuguccaa

SEQ ID NO: 4128219 - RNA, 17 nt, Streptococcus pyogenes MGAS8232
cuuuauuaaucaaaaaa

SEQ ID NO: 4128220 - RNA, 11 nt, Streptococcus pyogenes MGAS8232
cuuuauugaug

SEQ ID NO: 4128221 - RNA, 12 nt, Streptococcus pyogenes MGAS8232
cuuuauuuugau

SEQ ID NO: 4128222 - RNA, 13 nt, Streptococcus pyogenes MGAS8232
cuuucaaacggag

SEQ ID NO: 4128223 - RNA, 19 nt, Streptococcus pyogenes MGAS8232
cuuucaguuaucugauauu

SEQ ID NO: 4128224 - RNA, 14 nt, Streptococcus pyogenes MGAS8232
cuuuccauucuugc

SEQ ID NO: 4128225 - RNA, 21 nt, Streptococcus pyogenes MGAS8232
cuuucucaucuacucaugaca

SEQ ID NO: 4128226 - RNA, 21 nt, Streptococcus pyogenes MGAS8232
cuuugacagacaccaaaaaaa

SEQ ID NO: 4128227 - RNA, 18 nt, Streptococcus pyogenes MGAS8232
cuuugauuuuucuuguuu

SEQ ID NO: 4128228 - RNA, 15 nt, Streptococcus pyogenes MGAS8232
cuuuguccauuuuuu

SEQ ID NO: 4128229 - RNA, 20 nt, Streptococcus pyogenes MGAS8232
cuuuguuaccuucuucaagc

SEQ ID NO: 4128230 - RNA, 12 nt, Streptococcus pyogenes MGAS8232
cuuuuaaaaucu

SEQ ID NO: 4128231 - RNA, 13 nt, Streptococcus pyogenes MGAS8232
cuuuuaaaaucug

SEQ ID NO: 4128232 - RNA, 20 nt, Streptococcus pyogenes MGAS8232
cuuuuaagcugagcaaaaca

SEQ ID NO: 4128233 - RNA, 14 nt, Streptococcus pyogenes MGAS8232
cuuuuaauuuggag

SEQ ID NO: 4128234 - RNA, 19 nt, Streptococcus pyogenes MGAS8232
cuuuuaauuuuauuuuuua

SEQ ID NO: 4128235 - RNA, 14 nt, Streptococcus pyogenes MGAS8232
cuuuuaguuuuauu

SEQ ID NO: 4128236 - RNA, 19 nt, Streptococcus pyogenes MGAS8232
cuuuucguuuuauuuugau

SEQ ID NO: 4128237 - RNA, 17 nt, Streptococcus pyogenes MGAS8232
cuuuugacuugguuuaa

SEQ ID NO: 4128238 - RNA, 15 nt, Streptococcus pyogenes MGAS8232
cuuuugauaccuuuu

SEQ ID NO: 4128239 - RNA, 20 nt, Streptococcus pyogenes MGAS8232
cuuuuuaucuaugauuguuu

SEQ ID NO: 4128240 - RNA, 16 nt, Streptococcus pyogenes MGAS8232
cuuuuucuaacaaaau

SEQ ID NO: 4128241 - RNA, 19 nt, Streptococcus pyogenes MGAS8232
cuuuuuuugucguuuuuug

SEQ ID NO: 4128242 - RNA, 14 nt, Streptococcus pyogenes MGAS8232
gaaaaaaacuugca

SEQ ID NO: 4128243 - RNA, 18 nt, Streptococcus pyogenes MGAS8232
gaaaaaacucaagagguc

SEQ ID NO: 4128244 - RNA, 14 nt, Streptococcus pyogenes MGAS8232
gaaaaaggguccac

SEQ ID NO: 4128245 - RNA, 11 nt, Streptococcus pyogenes MGAS8232
gaaaacagaaa

SEQ ID NO: 4128246 - RNA, 16 nt, Streptococcus pyogenes MGAS8232
gaaaaggaauaucagg

SEQ ID NO: 4128247 - RNA, 13 nt, Streptococcus pyogenes MGAS8232
gaaaauaaaauau

SEQ ID NO: 4128248 - RNA, 17 nt, Streptococcus pyogenes MGAS8232
gaaaaucuguauuccau

SEQ ID NO: 4128249 - RNA, 19 nt, Streptococcus pyogenes MGAS8232
gaaacaccaccaauaauga

SEQ ID NO: 4128250 - RNA, 20 nt, Streptococcus pyogenes MGAS8232
gaaacguuauuaaagacaaa

SEQ ID NO: 4128251 - RNA, 16 nt, Streptococcus pyogenes MGAS8232
gaaacugcacugagcc

SEQ ID NO: 4128252 - RNA, 15 nt, Streptococcus pyogenes MGAS8232
gaaagaggaaacaaa

SEQ ID NO: 4128253 - RNA, 23 nt, Streptococcus pyogenes MGAS8232
gaaaguuauagcuccuaaaacca

SEQ ID NO: 4128254 - RNA, 19 nt, Streptococcus pyogenes MGAS8232
gaaauacuccguuucuagu

SEQ ID NO: 4128255 - RNA, 24 nt, Streptococcus pyogenes MGAS8232
gaaauacuccguuucuaguuucau

SEQ ID NO: 4128256 - RNA, 16 nt, Streptococcus pyogenes MGAS8232
gaaaugauagcaccua

SEQ ID NO: 4128257 - RNA, 17 nt, Streptococcus pyogenes MGAS8232
gaaauucaaauacuuca

SEQ ID NO: 4128258 - RNA, 12 nt, Streptococcus pyogenes MGAS8232
gaacagcugcuu

SEQ ID NO: 4128259 - RNA, 19 nt, Streptococcus pyogenes MGAS8232
gaaccaacuuggacgaagg

SEQ ID NO: 4128260 - RNA, 19 nt, Streptococcus pyogenes MGAS8232
gaacuccccuuuauaacuu

SEQ ID NO: 4128261 - RNA, 17 nt, Streptococcus pyogenes MGAS8232
gaacuccuggauuaaau

SEQ ID NO: 4128262 - RNA, 19 nt, Streptococcus pyogenes MGAS8232
gaagaaggucaugaugcca

SEQ ID NO: 4128263 - RNA, 22 nt, Streptococcus pyogenes MGAS8232
gaagccgcucuaauuuagucau

SEQ ID NO: 4128264 - RNA, 23 nt, Streptococcus pyogenes MGAS8232
gaagcuaagauuuccacuugguc

SEQ ID NO: 4128265 - RNA, 22 nt, Streptococcus pyogenes MGAS8232
gaaggaacucuccaaaguucuu

SEQ ID NO: 4128266 - RNA, 16 nt, Streptococcus pyogenes MGAS8232
gaaggcucuuaucuuu

SEQ ID NO: 4128267 - RNA, 15 nt, Streptococcus pyogenes MGAS8232
gaaggcuuguucuuu

SEQ ID NO: 4128268 - RNA, 15 nt, Streptococcus pyogenes MGAS8232
gaagucucuuuugug

SEQ ID NO: 4128269 - RNA, 23 nt, Streptococcus pyogenes MGAS8232
gaauaaaaagacuagagucucua

SEQ ID NO: 4128270 - RNA, 13 nt, Streptococcus pyogenes MGAS8232
gaauaaaaugccu

SEQ ID NO: 4128271 - RNA, 22 nt, Streptococcus pyogenes MGAS8232
gaauagguaaagauuuuaaaua

SEQ ID NO: 4128272 - RNA, 16 nt, Streptococcus pyogenes MGAS8232
gaauauaauucauguu

SEQ ID NO: 4128273 - RNA, 19 nt, Streptococcus pyogenes MGAS8232
gaauaugauauaaaaaugg

SEQ ID NO: 4128274 - RNA, 16 nt, Streptococcus pyogenes MGAS8232
gaauuuccuaaugcaa

SEQ ID NO: 4128275 - RNA, 21 nt, Streptococcus pyogenes MGAS8232
gacaaaaaaacuggaaacugc

SEQ ID NO: 4128276 - RNA, 11 nt, Streptococcus pyogenes MGAS8232
gacaacaauau

SEQ ID NO: 4128277 - RNA, 21 nt, Streptococcus pyogenes MGAS8232
gacaacaauaugugauuauua

SEQ ID NO: 4128278 - RNA, 17 nt, Streptococcus pyogenes MGAS8232
gacaauagcgaaaaagg

SEQ ID NO: 4128279 - RNA, 18 nt, Streptococcus pyogenes MGAS8232
gacaauagcgaaaaaggg

SEQ ID NO: 4128280 - RNA, 23 nt, Streptococcus pyogenes MGAS8232
gacaaucgaaaugauagcaccua

SEQ ID NO: 4128281 - RNA, 16 nt, Streptococcus pyogenes MGAS8232
gacaauuauuuugcag

SEQ ID NO: 4128282 - RNA, 15 nt, Streptococcus pyogenes MGAS8232
gacaguuaaaaauaa

SEQ ID NO: 4128283 - RNA, 16 nt, Streptococcus pyogenes MGAS8232
gacaguuaaaaauaac

SEQ ID NO: 4128284 - RNA, 17 nt, Streptococcus pyogenes MGAS8232
gacauacaaagcaucag

SEQ ID NO: 4128285 - RNA, 15 nt, Streptococcus pyogenes MGAS8232
gacauucguucuagu

SEQ ID NO: 4128286 - RNA, 17 nt, Streptococcus pyogenes MGAS8232
gacauuuaugcugauuu

SEQ ID NO: 4128287 - RNA, 21 nt, Streptococcus pyogenes MGAS8232
gaccacccucaacagcaggcc

SEQ ID NO: 4128288 - RNA, 12 nt, Streptococcus pyogenes MGAS8232
gaccccuuaguu

SEQ ID NO: 4128289 - RNA, 19 nt, Streptococcus pyogenes MGAS8232
gaccccuuaguucaaugga

SEQ ID NO: 4128290 - RNA, 13 nt, Streptococcus pyogenes MGAS8232
gaccucuuuuucu

SEQ ID NO: 4128291 - RNA, 14 nt, Streptococcus pyogenes MGAS8232
gaccuuaaaggccu

SEQ ID NO: 4128292 - RNA, 23 nt, Streptococcus pyogenes MGAS8232
gaccuuauuggucgcccuuuuua

SEQ ID NO: 4128293 - RNA, 14 nt, Streptococcus pyogenes MGAS8232
gaccuuugauaaga

SEQ ID NO: 4128294 - RNA, 20 nt, Streptococcus pyogenes MGAS8232
gacgauaagucaguuuuuuc

SEQ ID NO: 4128295 - RNA, 15 nt, Streptococcus pyogenes MGAS8232
gacgguaaauaaagu

SEQ ID NO: 4128296 - RNA, 13 nt, Streptococcus pyogenes MGAS8232
gacuaaguccuuu

SEQ ID NO: 4128297 - RNA, 21 nt, Streptococcus pyogenes MGAS8232
gacuaggaaucgcuuuaggaa

SEQ ID NO: 4128298 - RNA, 16 nt, Streptococcus pyogenes MGAS8232
gacucuagcauaaaag

SEQ ID NO: 4128299 - RNA, 17 nt, Streptococcus pyogenes MGAS8232
gacucuagcauaaaaga

SEQ ID NO: 4128300 - RNA, 22 nt, Streptococcus pyogenes MGAS8232
gacugcaauagcaugacuguau

SEQ ID NO: 4128301 - RNA, 17 nt, Streptococcus pyogenes MGAS8232
gacuguauguaucaaga

SEQ ID NO: 4128302 - RNA, 15 nt, Streptococcus pyogenes MGAS8232
gacugugaaaguauc

SEQ ID NO: 4128303 - RNA, 15 nt, Streptococcus pyogenes MGAS8232
gacuucaaaaucacc

SEQ ID NO: 4128304 - RNA, 19 nt, Streptococcus pyogenes MGAS8232
gacuugguuuaauacguuu

SEQ ID NO: 4128305 - RNA, 16 nt, Streptococcus pyogenes MGAS8232
gacuuguaaaaugauc

SEQ ID NO: 4128306 - RNA, 21 nt, Streptococcus pyogenes MGAS8232
gacuuguuacaaaaaacaagu

SEQ ID NO: 4128307 - RNA, 18 nt, Streptococcus pyogenes MGAS8232
gagaaauucaaauacuuc

SEQ ID NO: 4128308 - RNA, 22 nt, Streptococcus pyogenes MGAS8232
gagacaaguugccuuaucucag

SEQ ID NO: 4128309 - RNA, 20 nt, Streptococcus pyogenes MGAS8232
gagacuaaaggucugcuucu

SEQ ID NO: 4128310 - RNA, 18 nt, Streptococcus pyogenes MGAS8232
gagagauuuuuaaaaccu

SEQ ID NO: 4128311 - RNA, 16 nt, Streptococcus pyogenes MGAS8232
gagauuuuuaaaaccu

SEQ ID NO: 4128312 - RNA, 19 nt, Streptococcus pyogenes MGAS8232
gagcaaggcaagaggaggc

SEQ ID NO: 4128313 - RNA, 23 nt, Streptococcus pyogenes MGAS8232
gccucuucugaugcguuuauaaa

SEQ ID NO: 4128314 - RNA, 14 nt, Streptococcus pyogenes MGAS8232
gcgaucauaaauaa

SEQ ID NO: 4128315 - RNA, 19 nt, Streptococcus pyogenes MGAS8232
gcggaagaacagcauuuuc

SEQ ID NO: 4128316 - RNA, 21 nt, Streptococcus pyogenes MGAS8232
gcggaagaacagcauuuucau

SEQ ID NO: 4128317 - RNA, 23 nt, Streptococcus pyogenes MGAS8232
gcgucuggcauuugucuguggcu

SEQ ID NO: 4128318 - RNA, 16 nt, Streptococcus pyogenes MGAS8232
gcgugguggaggucug

SEQ ID NO: 4128319 - RNA, 15 nt, Streptococcus pyogenes MGAS8232
gcguuucgaaaaagg

SEQ ID NO: 4128320 - RNA, 18 nt, Streptococcus pyogenes MGAS8232
gcuaaaaacaaugcucuu

SEQ ID NO: 4128321 - RNA, 16 nt, Streptococcus pyogenes MGAS8232
gcuaaaagcauaaaaa

SEQ ID NO: 4128322 - RNA, 22 nt, Streptococcus pyogenes MGAS8232
gcuaagauuuccacuuggucca

SEQ ID NO: 4128323 - RNA, 18 nt, Streptococcus pyogenes MGAS8232
gcuaaguagauacuucgg

SEQ ID NO: 4128324 - RNA, 21 nt, Streptococcus pyogenes MGAS8232
gcuauagaaacuuuuuauaag

SEQ ID NO: 4128325 - RNA, 13 nt, Streptococcus pyogenes MGAS8232
gcuauuaauggua

SEQ ID NO: 4128326 - RNA, 23 nt, Streptococcus pyogenes MGAS8232
gcuauuauccaacuuuuaucacu

SEQ ID NO: 4128327 - RNA, 17 nt, Streptococcus pyogenes MGAS8232
gcucuaauuuagucauu

SEQ ID NO: 4128328 - RNA, 13 nt, Streptococcus pyogenes MGAS8232
gcucuaucaucuu

SEQ ID NO: 4128329 - RNA, 17 nt, Streptococcus pyogenes MGAS8232
gcucuaucaucuuugua

SEQ ID NO: 4128330 - RNA, 14 nt, Streptococcus pyogenes MGAS8232
gcucuuagaagccu

SEQ ID NO: 4128331 - RNA, 15 nt, Streptococcus pyogenes MGAS8232
gcugagcaaaacaau

SEQ ID NO: 4128332 - RNA, 20 nt, Streptococcus pyogenes MGAS8232
gcugauaggucugcaauauc

SEQ ID NO: 4128333 - RNA, 14 nt, Streptococcus pyogenes MGAS8232
gcugcgaugauuuu

SEQ ID NO: 4128334 - RNA, 16 nt, Streptococcus pyogenes MGAS8232
gcugcuaaagcaauca

SEQ ID NO: 4128335 - RNA, 19 nt, Streptococcus pyogenes MGAS8232
gcugcuaauggguuguuuu

SEQ ID NO: 4128336 - RNA, 15 nt, Streptococcus pyogenes MGAS8232
gcugcugcuaaagca

SEQ ID NO: 4128337 - RNA, 16 nt, Streptococcus pyogenes MGAS8232
gcuuacgacagcagca

SEQ ID NO: 4128338 - RNA, 23 nt, Streptococcus pyogenes MGAS8232
gcuuaucaagguugcaagugaua

SEQ ID NO: 4128339 - RNA, 22 nt, Streptococcus pyogenes MGAS8232
gcuucuuacuaugaaaaaagaa

SEQ ID NO: 4128340 - RNA, 13 nt, Streptococcus pyogenes MGAS8232
gcuucuuucaaac

SEQ ID NO: 4128341 - RNA, 16 nt, Streptococcus pyogenes MGAS8232
gcuugcucaauuuuug

SEQ ID NO: 4128342 - RNA, 18 nt, Streptococcus pyogenes MGAS8232
gcuuggauuuccucuaac

SEQ ID NO: 4128343 - RNA, 23 nt, Streptococcus pyogenes MGAS8232
gcuugucuaugagauaccuucau

SEQ ID NO: 4128344 - RNA, 18 nt, Streptococcus pyogenes MGAS8232
gcuuucucaucuacucau

SEQ ID NO: 4128345 - RNA, 22 nt, Streptococcus pyogenes MGAS8232
gcuuugacaaagcagugcuuua

SEQ ID NO: 4128346 - RNA, 18 nt, Streptococcus pyogenes MGAS8232
gcuuugauuuuucuuguu

SEQ ID NO: 4128347 - RNA, 15 nt, Streptococcus pyogenes MGAS8232
gcuuuuuuuguaucu

SEQ ID NO: 4128348 - RNA, 11 nt, Streptococcus pyogenes MGAS8232
ggaaaacagaa

SEQ ID NO: 4128349 - RNA, 15 nt, Streptococcus pyogenes MGAS8232
ggaacacucaucaua

SEQ ID NO: 4128350 - RNA, 14 nt, Streptococcus pyogenes MGAS8232
ggaagaacagcauu

SEQ ID NO: 4128351 - RNA, 18 nt, Streptococcus pyogenes MGAS8232
ggaagaacagcauuuuca

SEQ ID NO: 4128352 - RNA, 13 nt, Streptococcus pyogenes MGAS8232
ggaagaagauccu

SEQ ID NO: 4128353 - RNA, 22 nt, Streptococcus pyogenes MGAS8232
ggaaucgaucgucucgguucac

SEQ ID NO: 4128354 - RNA, 21 nt, Streptococcus pyogenes MGAS8232
ggaauguuuacuggacgaaca

SEQ ID NO: 4128355 - RNA, 13 nt, Streptococcus pyogenes MGAS8232
ggaccaagauuca

SEQ ID NO: 4128356 - RNA, 17 nt, Streptococcus pyogenes MGAS8232
ggacuuuucagucuucu

SEQ ID NO: 4128357 - RNA, 16 nt, Streptococcus pyogenes MGAS8232
ggagcuuuaguugcuu

SEQ ID NO: 4128358 - RNA, 14 nt, Streptococcus pyogenes MGAS8232
ggauauugagaaga

SEQ ID NO: 4128359 - RNA, 19 nt, Streptococcus pyogenes MGAS8232
ggauuuagcuguuauugga

SEQ ID NO: 4128360 - RNA, 16 nt, Streptococcus pyogenes MGAS8232
ggcaauccaaaucaac

SEQ ID NO: 4128361 - RNA, 16 nt, Streptococcus pyogenes MGAS8232
ggccaauaaaauaucu

SEQ ID NO: 4128362 - RNA, 22 nt, Streptococcus pyogenes MGAS8232
ggccacuucaagcauaauaaaa

SEQ ID NO: 4128363 - RNA, 18 nt, Streptococcus pyogenes MGAS8232
ggccguaggugucuacua

SEQ ID NO: 4128364 - RNA, 21 nt, Streptococcus pyogenes MGAS8232
ggccguaggugucuacuaaaa

SEQ ID NO: 4128365 - RNA, 17 nt, Streptococcus pyogenes MGAS8232
ggccuucuaucaaaacg

SEQ ID NO: 4128366 - RNA, 19 nt, Streptococcus pyogenes MGAS8232
ggcuacucuauuugaagua

SEQ ID NO: 4128367 - RNA, 17 nt, Streptococcus pyogenes MGAS8232
ggcucauauuagcaaaa

SEQ ID NO: 4128368 - RNA, 20 nt, Streptococcus pyogenes MGAS8232
ggcugaugcgauucccaucu

SEQ ID NO: 4128369 - RNA, 13 nt, Streptococcus pyogenes MGAS8232
ggcuuaaacauau

SEQ ID NO: 4128370 - RNA, 14 nt, Streptococcus pyogenes MGAS8232
ggcuucuaaaaaaa

SEQ ID NO: 4128371 - RNA, 12 nt, Streptococcus pyogenes MGAS8232
gggcaaugccau

SEQ ID NO: 4128372 - RNA, 17 nt, Streptococcus pyogenes MGAS8232
ggguaaaaugacugaca

SEQ ID NO: 4128373 - RNA, 10 nt, Streptococcus pyogenes MGAS8232
ggguccacuu

SEQ ID NO: 4128374 - RNA, 14 nt, Streptococcus pyogenes MGAS8232
gggugaaucauuac

SEQ ID NO: 4128375 - RNA, 14 nt, Streptococcus pyogenes MGAS8232
gggugucugacacc

SEQ ID NO: 4128376 - RNA, 14 nt, Streptococcus pyogenes MGAS8232
gguaaaaaggcagu

SEQ ID NO: 4128377 - RNA, 12 nt, Streptococcus pyogenes MGAS8232
gguaaaggccuu

SEQ ID NO: 4128378 - RNA, 21 nt, Streptococcus pyogenes MGAS8232
gguaauuuauuccauuuaucu

SEQ ID NO: 4128379 - RNA, 17 nt, Streptococcus pyogenes MGAS8232
gguaguuacgcauaccu

SEQ ID NO: 4128380 - RNA, 15 nt, Streptococcus pyogenes MGAS8232
ggucaucagaauaag

SEQ ID NO: 4128381 - RNA, 18 nt, Streptococcus pyogenes MGAS8232
ggucauuauugucacuga

SEQ ID NO: 4128382 - RNA, 22 nt, Streptococcus pyogenes MGAS8232
ggugcaacugccaguugagccu

SEQ ID NO: 4128383 - RNA, 16 nt, Streptococcus pyogenes MGAS8232
ggugcuuuaaaaaguu

SEQ ID NO: 4128384 - RNA, 21 nt, Streptococcus pyogenes MGAS8232
gguguaauccccucguuuaaa

SEQ ID NO: 4128385 - RNA, 15 nt, Streptococcus pyogenes MGAS8232
ggugucuacuaaaac

SEQ ID NO: 4128386 - RNA, 11 nt, Streptococcus pyogenes MGAS8232
gguuucuuuug

SEQ ID NO: 4128387 - RNA, 11 nt, Streptococcus pyogenes MGAS8232
guaaaaacuca

SEQ ID NO: 4128388 - RNA, 11 nt, Streptococcus pyogenes MGAS8232
guaaaaugacu

SEQ ID NO: 4128389 - RNA, 13 nt, Streptococcus pyogenes MGAS8232
guaaaauuuaucu

SEQ ID NO: 4128390 - RNA, 20 nt, Streptococcus pyogenes MGAS8232
guaaagauuuuaaauaucuu

SEQ ID NO: 4128391 - RNA, 16 nt, Streptococcus pyogenes MGAS8232
guaaagcaagggaaac

SEQ ID NO: 4128392 - RNA, 19 nt, Streptococcus pyogenes MGAS8232
guaaaggauuuaguucugu

SEQ ID NO: 4128393 - RNA, 18 nt, Streptococcus pyogenes MGAS8232
guaaaggauuuaguuuug

SEQ ID NO: 4128394 - RNA, 23 nt, Streptococcus pyogenes MGAS8232
guaacauguccauugaugaguuu

SEQ ID NO: 4128395 - RNA, 20 nt, Streptococcus pyogenes MGAS8232
guaaccauagaagccaauua

SEQ ID NO: 4128396 - RNA, 17 nt, Streptococcus pyogenes MGAS8232
guaacgcuuguuuauga

SEQ ID NO: 4128397 - RNA, 19 nt, Streptococcus pyogenes MGAS8232
guaacgcuuguuuaugaaa

SEQ ID NO: 4128398 - RNA, 20 nt, Streptococcus pyogenes MGAS8232
guaagcaaccucaguucuga

SEQ ID NO: 4128399 - RNA, 24 nt, Streptococcus pyogenes MGAS8232
guaauacgagcuagggcaacugca

SEQ ID NO: 4128400 - RNA, 17 nt, Streptococcus pyogenes MGAS8232
guaauagcguaaagcaa

SEQ ID NO: 4128401 - RNA, 18 nt, Streptococcus pyogenes MGAS8232
guaauagcguaaagcaag

SEQ ID NO: 4128402 - RNA, 18 nt, Streptococcus pyogenes MGAS8232
guaauauuuccuuuuaaa

SEQ ID NO: 4128403 - RNA, 20 nt, Streptococcus pyogenes MGAS8232
guaauuuauuccauuuaucu

SEQ ID NO: 4128404 - RNA, 19 nt, Streptococcus pyogenes MGAS8232
guaauuugguggaagagua

SEQ ID NO: 4128405 - RNA, 15 nt, Streptococcus pyogenes MGAS8232
guacacgugauaaau

SEQ ID NO: 4128406 - RNA, 14 nt, Streptococcus pyogenes MGAS8232
guacagaaaugaaa

SEQ ID NO: 4128407 - RNA, 16 nt, Streptococcus pyogenes MGAS8232
guagaggugaugaagc

SEQ ID NO: 4128408 - RNA, 20 nt, Streptococcus pyogenes MGAS8232
guagauagcaaggaugaaau

SEQ ID NO: 4128409 - RNA, 21 nt, Streptococcus pyogenes MGAS8232
guagaugaauuuugucuaaaa

SEQ ID NO: 4128410 - RNA, 14 nt, Streptococcus pyogenes MGAS8232
guagcguacaugga

SEQ ID NO: 4128411 - RNA, 16 nt, Streptococcus pyogenes MGAS8232
uaaaaugacugacaaa

SEQ ID NO: 4128412 - RNA, 19 nt, Streptococcus pyogenes MGAS8232
uaaacaagaccuuauuaaa

SEQ ID NO: 4128413 - RNA, 20 nt, Streptococcus pyogenes MGAS8232
uaaacaaugagucaccugua

SEQ ID NO: 4128414 - RNA, 21 nt, Streptococcus pyogenes MGAS8232
uaaacacuaccuuaaauguau

SEQ ID NO: 4128415 - RNA, 23 nt, Streptococcus pyogenes MGAS8232
uaaacacuaccuuaaauguauga

SEQ ID NO: 4128416 - RNA, 20 nt, Streptococcus pyogenes MGAS8232
uaaacauauuauaguaacca

SEQ ID NO: 4128417 - RNA, 16 nt, Streptococcus pyogenes MGAS8232
uaaacgguaauuuauu

SEQ ID NO: 4128418 - RNA, 14 nt, Streptococcus pyogenes MGAS8232
uaaacuaauaagau

SEQ ID NO: 4128419 - RNA, 17 nt, Streptococcus pyogenes MGAS8232
uaaacuguauacaaaaa

SEQ ID NO: 4128420 - RNA, 14 nt, Streptococcus pyogenes MGAS8232
uaaacuuacaaaaa

SEQ ID NO: 4128421 - RNA, 15 nt, Streptococcus pyogenes MGAS8232
uaaacuuacaaaaag

SEQ ID NO: 4128422 - RNA, 15 nt, Streptococcus pyogenes MGAS8232
uaaacuuauguuuau

SEQ ID NO: 4128423 - RNA, 18 nt, Streptococcus pyogenes MGAS8232
uaaagaaacaaaaaugaa

SEQ ID NO: 4128424 - RNA, 15 nt, Streptococcus pyogenes MGAS8232
uaaagaccucucaug

SEQ ID NO: 4128425 - RNA, 23 nt, Streptococcus pyogenes MGAS8232
uaaagagaaagaggaaacaaaaa

SEQ ID NO: 4128426 - RNA, 16 nt, Streptococcus pyogenes MGAS8232
uaaagauaauuucuuu

SEQ ID NO: 4128427 - RNA, 13 nt, Streptococcus pyogenes MGAS8232
uaaagauuuuaaa

SEQ ID NO: 4128428 - RNA, 14 nt, Streptococcus pyogenes MGAS8232
uaaagcaagggaaa

SEQ ID NO: 4128429 - RNA, 13 nt, Streptococcus pyogenes MGAS8232
uaaagcaucagca

SEQ ID NO: 4128430 - RNA, 16 nt, Streptococcus pyogenes MGAS8232
uaaagccuuauccauu

SEQ ID NO: 4128431 - RNA, 17 nt, Streptococcus pyogenes MGAS8232
uaaaggauuuaguuuug

SEQ ID NO: 4128432 - RNA, 17 nt, Streptococcus pyogenes MGAS8232
uaaaggccuguauuucu

SEQ ID NO: 4128433 - RNA, 19 nt, Streptococcus pyogenes MGAS8232
uaaaggccuguauuucuuu

SEQ ID NO: 4128434 - RNA, 18 nt, Streptococcus pyogenes MGAS8232
uaaaggugccuguuuuug

SEQ ID NO: 4128435 - RNA, 20 nt, Streptococcus pyogenes MGAS8232
uaaaggugccuguuuuugcu

SEQ ID NO: 4128436 - RNA, 19 nt, Streptococcus pyogenes MGAS8232
uaaauaucuuaccauugua

SEQ ID NO: 4128437 - RNA, 13 nt, Streptococcus pyogenes MGAS8232
uaaauauuuuaua

SEQ ID NO: 4128438 - RNA, 17 nt, Streptococcus pyogenes MGAS8232
uaaauccuuuugaaaaa

SEQ ID NO: 4128439 - RNA, 14 nt, Streptococcus pyogenes MGAS8232
uaaaugacaugaaa

SEQ ID NO: 4128440 - RNA, 15 nt, Streptococcus pyogenes MGAS8232
uaaaugcaaaaaagc

SEQ ID NO: 4128441 - RNA, 18 nt, Streptococcus pyogenes MGAS8232
uaaauuauaguauaccua

SEQ ID NO: 4128442 - RNA, 15 nt, Streptococcus pyogenes MGAS8232
uaacaaaaauaagua

SEQ ID NO: 4128443 - RNA, 19 nt, Streptococcus pyogenes MGAS8232
uaacaaugagaucuucuuu

SEQ ID NO: 4128444 - RNA, 18 nt, Streptococcus pyogenes MGAS8232
uaaccauagaagccaauu

SEQ ID NO: 4128445 - RNA, 22 nt, Streptococcus pyogenes MGAS8232
uaaccauugccauuaauaauau

SEQ ID NO: 4128446 - RNA, 17 nt, Streptococcus pyogenes MGAS8232
uaacccucauugucaaa

SEQ ID NO: 4128447 - RNA, 15 nt, Streptococcus pyogenes MGAS8232
uaaccuccuaaacua

SEQ ID NO: 4128448 - RNA, 13 nt, Streptococcus pyogenes MGAS8232
uaacgaaaagcau

SEQ ID NO: 4128449 - RNA, 18 nt, Streptococcus pyogenes MGAS8232
uaacgcuuguuuaugaaa

SEQ ID NO: 4128450 - RNA, 14 nt, Streptococcus pyogenes MGAS8232
uaacuguugucuca

SEQ ID NO: 4128451 - RNA, 20 nt, Streptococcus pyogenes MGAS8232
uaacuuuaaaagggcugacc

SEQ ID NO: 4128452 - RNA, 13 nt, Streptococcus pyogenes MGAS8232
uaacuuucuauua

SEQ ID NO: 4128453 - RNA, 20 nt, Streptococcus pyogenes MGAS8232
uaagaaggaacucuccaaag

SEQ ID NO: 4128454 - RNA, 13 nt, Streptococcus pyogenes MGAS8232
uaagaccuucaaa

SEQ ID NO: 4128455 - RNA, 14 nt, Streptococcus pyogenes MGAS8232
uaagaccuucaaaa

SEQ ID NO: 4128456 - RNA, 19 nt, Streptococcus pyogenes MGAS8232
uaagaccuucaaaaaaggg

SEQ ID NO: 4128457 - RNA, 17 nt, Streptococcus pyogenes MGAS8232
uaagacuauguugcuua

SEQ ID NO: 4128458 - RNA, 22 nt, Streptococcus pyogenes MGAS8232
uaagagagguugguaaaaaggc

SEQ ID NO: 4128459 - RNA, 20 nt, Streptococcus pyogenes MGAS8232
uaagagccaucagcucucaa

SEQ ID NO: 4128460 - RNA, 17 nt, Streptococcus pyogenes MGAS8232
uaagauaaguaauauuu

SEQ ID NO: 4128461 - RNA, 20 nt, Streptococcus pyogenes MGAS8232
uaagauuaaacuuacaaaaa

SEQ ID NO: 4128462 - RNA, 12 nt, Streptococcus pyogenes MGAS8232
uaagauuuccac

SEQ ID NO: 4128463 - RNA, 23 nt, Streptococcus pyogenes MGAS8232
uaagcagcaucacguacagaaau

SEQ ID NO: 4128464 - RNA, 13 nt, Streptococcus pyogenes MGAS8232
uaagcauuuugag

SEQ ID NO: 4128465 - RNA, 15 nt, Streptococcus pyogenes MGAS8232
uaagcauuuugagaa

SEQ ID NO: 4128466 - RNA, 18 nt, Streptococcus pyogenes MGAS8232
uaagcugacgauaaguca

SEQ ID NO: 4128467 - RNA, 15 nt, Streptococcus pyogenes MGAS8232
uaaggauuaugaaaa

SEQ ID NO: 4128468 - RNA, 20 nt, Streptococcus pyogenes MGAS8232
uaaggauuaugaaaaagaag

SEQ ID NO: 4128469 - RNA, 14 nt, Streptococcus pyogenes MGAS8232
uaaguaagauggug

SEQ ID NO: 4128470 - RNA, 18 nt, Streptococcus pyogenes MGAS8232
uaaguaauguguuguaua

SEQ ID NO: 4128471 - RNA, 15 nt, Streptococcus pyogenes MGAS8232
uaaguauuuuaaaau

SEQ ID NO: 4128472 - RNA, 18 nt, Streptococcus pyogenes MGAS8232
uaaguccuuuuaguuuua

SEQ ID NO: 4128473 - RNA, 18 nt, Streptococcus pyogenes MGAS8232
uaaguccuuuucguuuua

SEQ ID NO: 4128474 - RNA, 13 nt, Streptococcus pyogenes MGAS8232
uaauaaaaagagu

SEQ ID NO: 4128475 - RNA, 21 nt, Streptococcus pyogenes MGAS8232
uaauaaaaaguaguuucucau

SEQ ID NO: 4128476 - RNA, 20 nt, Streptococcus pyogenes MGAS8232
uaauaagauucaauaugaaa

SEQ ID NO: 4128477 - RNA, 14 nt, Streptococcus pyogenes MGAS8232
uaauaaguauuuua

SEQ ID NO: 4128478 - RNA, 17 nt, Streptococcus pyogenes MGAS8232
uaauaaguauuuuaaaa

SEQ ID NO: 4128479 - RNA, 21 nt, Streptococcus pyogenes MGAS8232
uaauaaguauuuuaaaauccu

SEQ ID NO: 4128480 - RNA, 19 nt, Streptococcus pyogenes MGAS8232
uaauacguuuauuuaguua

SEQ ID NO: 4128481 - RNA, 18 nt, Streptococcus pyogenes MGAS8232
uaauauaaggcaaucacc

SEQ ID NO: 4128482 - RNA, 16 nt, Streptococcus pyogenes MGAS8232
uaauauguaacgcuug

SEQ ID NO: 4128483 - RNA, 16 nt, Streptococcus pyogenes MGAS8232
uaauccaacaacgcua

SEQ ID NO: 4128484 - RNA, 14 nt, Streptococcus pyogenes MGAS8232
uaaucgaaaaugcu

SEQ ID NO: 4128485 - RNA, 18 nt, Streptococcus pyogenes MGAS8232
uaaucgagagauuauucu

SEQ ID NO: 4128486 - RNA, 14 nt, Streptococcus pyogenes MGAS8232
uaaucgaugauaau

SEQ ID NO: 4128487 - RNA, 18 nt, Streptococcus pyogenes MGAS8232
uaaucguaaugucuuguu

SEQ ID NO: 4128488 - RNA, 15 nt, Streptococcus pyogenes MGAS8232
uaaucuaaagcauca

SEQ ID NO: 4128489 - RNA, 15 nt, Streptococcus pyogenes MGAS8232
uaaucuuauuaaaga

SEQ ID NO: 4128490 - RNA, 23 nt, Streptococcus pyogenes MGAS8232
uaaucuucagagcacguuuucug

SEQ ID NO: 4128491 - RNA, 18 nt, Streptococcus pyogenes MGAS8232
uaaucuuuauaaagcuuu

SEQ ID NO: 4128492 - RNA, 18 nt, Streptococcus pyogenes MGAS8232
uaaucuuugacaauguca

SEQ ID NO: 4128493 - RNA, 18 nt, Streptococcus pyogenes MGAS8232
uaaugaccacccucaaca

SEQ ID NO: 4128494 - RNA, 15 nt, Streptococcus pyogenes MGAS8232
uaaugaccuuugaua

SEQ ID NO: 4128495 - RNA, 15 nt, Streptococcus pyogenes MGAS8232
uaaugauucaauauc

SEQ ID NO: 4128496 - RNA, 19 nt, Streptococcus pyogenes MGAS8232
uaaugauuuuuaauucuuc

SEQ ID NO: 4128497 - RNA, 22 nt, Streptococcus pyogenes MGAS8232
uaauggugucguuuuuuuuauu

SEQ ID NO: 4128498 - RNA, 15 nt, Streptococcus pyogenes MGAS8232
uaauuagcauauuuu

SEQ ID NO: 4128499 - RNA, 15 nt, Streptococcus pyogenes MGAS8232
uaauuaguauauugu

SEQ ID NO: 4128500 - RNA, 17 nt, Streptococcus pyogenes MGAS8232
uaauuaucugaauuauu

SEQ ID NO: 4128501 - RNA, 19 nt, Streptococcus pyogenes MGAS8232
uaauuauuuuaauuuuucc

SEQ ID NO: 4128502 - RNA, 19 nt, Streptococcus pyogenes MGAS8232
uaauuccugugacaaccca

SEQ ID NO: 4128503 - RNA, 22 nt, Streptococcus pyogenes MGAS8232
uaauuguugcaaccugaaaagu

SEQ ID NO: 4128504 - RNA, 19 nt, Streptococcus pyogenes MGAS8232
uaauuuagucauuucuuca

SEQ ID NO: 4128505 - RNA, 17 nt, Streptococcus pyogenes MGAS8232
uaauuuauuccauuuau

SEQ ID NO: 4128506 - RNA, 14 nt, Streptococcus pyogenes MGAS8232
uaauuucuugugcu

SEQ ID NO: 4128507 - RNA, 13 nt, Streptococcus pyogenes MGAS8232
uaauuucuuuuuc

SEQ ID NO: 4128508 - RNA, 12 nt, Streptococcus pyogenes MGAS8232
uaauuuuuccuu

SEQ ID NO: 4128509 - RNA, 15 nt, Streptococcus pyogenes MGAS8232
uauaguauuaucuca

SEQ ID NO: 4128510 - RNA, 13 nt, Streptococcus pyogenes MGAS8232
uauaguuauguua

SEQ ID NO: 4128511 - RNA, 15 nt, Streptococcus pyogenes MGAS8232
uauauuauguucuaa

SEQ ID NO: 4128512 - RNA, 17 nt, Streptococcus pyogenes MGAS8232
uauauugugcuauucaa

SEQ ID NO: 4128513 - RNA, 16 nt, Streptococcus pyogenes MGAS8232
uaucaaauccgcuugc

SEQ ID NO: 4128514 - RNA, 21 nt, Streptococcus pyogenes MGAS8232
uaucaaguaugcuuuuaauuu

SEQ ID NO: 4128515 - RNA, 20 nt, Streptococcus pyogenes MGAS8232
uaucaauaacagaaauuaau

SEQ ID NO: 4128516 - RNA, 17 nt, Streptococcus pyogenes MGAS8232
uaucacauuuuaaucuu

SEQ ID NO: 4128517 - RNA, 20 nt, Streptococcus pyogenes MGAS8232
uaucaccuugcuuauagcua

SEQ ID NO: 4128518 - RNA, 16 nt, Streptococcus pyogenes MGAS8232
uaucaggcaaaacaaa

SEQ ID NO: 4128519 - RNA, 21 nt, Streptococcus pyogenes MGAS8232
uaucagucuguccaauaccua

SEQ ID NO: 4128520 - RNA, 18 nt, Streptococcus pyogenes MGAS8232
uaucauggagucaaugaa

SEQ ID NO: 4128521 - RNA, 16 nt, Streptococcus pyogenes MGAS8232
uauccaaugaaaacuc

SEQ ID NO: 4128522 - RNA, 14 nt, Streptococcus pyogenes MGAS8232
uauccauagaaauu

SEQ ID NO: 4128523 - RNA, 16 nt, Streptococcus pyogenes MGAS8232
uauccauagaaauugu

SEQ ID NO: 4128524 - RNA, 14 nt, Streptococcus pyogenes MGAS8232
uauccuccuaaaua

SEQ ID NO: 4128525 - RNA, 20 nt, Streptococcus pyogenes MGAS8232
uauccuccuaaauauaaauu

SEQ ID NO: 4128526 - RNA, 16 nt, Streptococcus pyogenes MGAS8232
uaucgccaauaaaaaa

SEQ ID NO: 4128527 - RNA, 14 nt, Streptococcus pyogenes MGAS8232
uaucuagaacagcu

SEQ ID NO: 4128528 - RNA, 14 nt, Streptococcus pyogenes MGAS8232
uaucucauaaaaaa

SEQ ID NO: 4128529 - RNA, 14 nt, Streptococcus pyogenes MGAS8232
uaucucguaauccu

SEQ ID NO: 4128530 - RNA, 18 nt, Streptococcus pyogenes MGAS8232
uaucugauaagguuuuuu

SEQ ID NO: 4128531 - RNA, 16 nt, Streptococcus pyogenes MGAS8232
uaugacaaauucuuuu

SEQ ID NO: 4128532 - RNA, 14 nt, Streptococcus pyogenes MGAS8232
uaugcuguccauga

SEQ ID NO: 4128533 - RNA, 17 nt, Streptococcus pyogenes MGAS8232
uauggguaugccugaag

SEQ ID NO: 4128534 - RNA, 16 nt, Streptococcus pyogenes MGAS8232
uauguaaauauaaagu

SEQ ID NO: 4128535 - RNA, 22 nt, Streptococcus pyogenes MGAS8232
uauguaacgcuuguuuaugaaa

SEQ ID NO: 4128536 - RNA, 15 nt, Streptococcus pyogenes MGAS8232
uaugugauuauuauu

SEQ ID NO: 4128537 - RNA, 19 nt, Streptococcus pyogenes MGAS8232
uauguuauaagauaaguaa

SEQ ID NO: 4128538 - RNA, 16 nt, Streptococcus pyogenes MGAS8232
uauguugauugccauu

SEQ ID NO: 4128539 - RNA, 12 nt, Streptococcus pyogenes MGAS8232
uauuaaagacaa

SEQ ID NO: 4128540 - RNA, 15 nt, Streptococcus pyogenes MGAS8232
uauuaaauaauacag

SEQ ID NO: 4128541 - RNA, 20 nt, Streptococcus pyogenes MGAS8232
uauuaaccggcucuaaaaua

SEQ ID NO: 4128542 - RNA, 22 nt, Streptococcus pyogenes MGAS8232
uauuaaccggcucuaaaauaua

SEQ ID NO: 4128543 - RNA, 15 nt, Streptococcus pyogenes MGAS8232
uauuaaucaaaaaac

SEQ ID NO: 4128544 - RNA, 16 nt, Streptococcus pyogenes MGAS8232
uauuacaaaacugucu

SEQ ID NO: 4128545 - RNA, 15 nt, Streptococcus pyogenes MGAS8232
uauuagcaaaaugcu

SEQ ID NO: 4128546 - RNA, 15 nt, Streptococcus pyogenes MGAS8232
uauuauauuaaauua

SEQ ID NO: 4128547 - RNA, 12 nt, Streptococcus pyogenes MGAS8232
uauuauuuugcu

SEQ ID NO: 4128548 - RNA, 16 nt, Streptococcus pyogenes MGAS8232
uauucauuuucuucuu

SEQ ID NO: 4128549 - RNA, 14 nt, Streptococcus pyogenes MGAS8232
uauugagaagaaaa

SEQ ID NO: 4128550 - RNA, 17 nt, Streptococcus pyogenes MGAS8232
uauugagucuuuuucua

SEQ ID NO: 4128551 - RNA, 18 nt, Streptococcus pyogenes MGAS8232
uauugagucuuuuucuaa

SEQ ID NO: 4128552 - RNA, 14 nt, Streptococcus pyogenes MGAS8232
uauuguuaguuuua

SEQ ID NO: 4128553 - RNA, 17 nt, Streptococcus pyogenes MGAS8232
uauuuaacuuauuauuu

SEQ ID NO: 4128554 - RNA, 18 nt, Streptococcus pyogenes MGAS8232
uauuuaacuuauuauuuu

SEQ ID NO: 4128555 - RNA, 12 nt, Streptococcus pyogenes MGAS8232
uauuuaauagca

SEQ ID NO: 4128556 - RNA, 23 nt, Streptococcus pyogenes MGAS8232
uauuuaauagcauugucaaauaa

SEQ ID NO: 4128557 - RNA, 15 nt, Streptococcus pyogenes MGAS8232
uauuuacugggucaa

SEQ ID NO: 4128558 - RNA, 22 nt, Streptococcus pyogenes MGAS8232
uauuuacugggucaacuccaau

SEQ ID NO: 4128559 - RNA, 15 nt, Streptococcus pyogenes MGAS8232
uauuuauaaauauuu

SEQ ID NO: 4128560 - RNA, 14 nt, Streptococcus pyogenes MGAS8232
uauuucacuagaca

SEQ ID NO: 4128561 - RNA, 23 nt, Streptococcus pyogenes MGAS8232
uauuugacuuguuacaaaaaaca

SEQ ID NO: 4128562 - RNA, 13 nt, Streptococcus pyogenes MGAS8232
uauuuuaaaauag

SEQ ID NO: 4128563 - RNA, 17 nt, Streptococcus pyogenes MGAS8232
uauuuuaaguaaaggau

SEQ ID NO: 4128564 - RNA, 15 nt, Streptococcus pyogenes MGAS8232
uauuuuauuaauaag

SEQ ID NO: 4128565 - RNA, 19 nt, Streptococcus pyogenes MGAS8232
uauuuugauauuuuuucuc

SEQ ID NO: 4128566 - RNA, 23 nt, Streptococcus pyogenes MGAS8232
uauuuuucgaccaauucuaaaac

SEQ ID NO: 4128567 - RNA, 18 nt, Streptococcus pyogenes MGAS8232
uauuuuugaaaaaaauga

SEQ ID NO: 4128568 - RNA, 17 nt, Streptococcus pyogenes MGAS8232
ucaaaaaauuaagaagg

SEQ ID NO: 4128569 - RNA, 12 nt, Streptococcus pyogenes MGAS8232
ucaaaaagucgu

SEQ ID NO: 4128570 - RNA, 15 nt, Streptococcus pyogenes MGAS8232
ucaaaaauauauucu

SEQ ID NO: 4128571 - RNA, 15 nt, Streptococcus pyogenes MGAS8232
ucaaaaaucuuuuuc

SEQ ID NO: 4128572 - RNA, 18 nt, Streptococcus pyogenes MGAS8232
ucaaaagaccauaaaaaa

SEQ ID NO: 4128573 - RNA, 20 nt, Streptococcus pyogenes MGAS8232
ucaaaagaccauaaaaaacc

SEQ ID NO: 4128574 - RNA, 13 nt, Streptococcus pyogenes MGAS8232
ucaaacuaaacaa

SEQ ID NO: 4128575 - RNA, 20 nt, Streptococcus pyogenes MGAS8232
ucaaacuauauuguuaguuu

SEQ ID NO: 4128576 - RNA, 15 nt, Streptococcus pyogenes MGAS8232
ucaaagcugacagua

SEQ ID NO: 4128577 - RNA, 21 nt, Streptococcus pyogenes MGAS8232
ucaaaggguguuuuuuauaug

SEQ ID NO: 4128578 - RNA, 22 nt, Streptococcus pyogenes MGAS8232
ucaaauccgcuugcagcauaau

SEQ ID NO: 4128579 - RNA, 16 nt, Streptococcus pyogenes MGAS8232
ucaaauuuuuuucaug

SEQ ID NO: 4128580 - RNA, 16 nt, Streptococcus pyogenes MGAS8232
ucaacaaauccuuuug

SEQ ID NO: 4128581 - RNA, 19 nt, Streptococcus pyogenes MGAS8232
ucaacaaauccuuuugcuu

SEQ ID NO: 4128582 - RNA, 19 nt, Streptococcus pyogenes MGAS8232
ucaacagcaggccuuuccg

SEQ ID NO: 4128583 - RNA, 16 nt, Streptococcus pyogenes MGAS8232
ucaacaguauaacugu

SEQ ID NO: 4128584 - RNA, 23 nt, Streptococcus pyogenes MGAS8232
ucaacaguauaacuguuuuucuu

SEQ ID NO: 4128585 - RNA, 16 nt, Streptococcus pyogenes MGAS8232
ucaaccgcuucuuuug

SEQ ID NO: 4128586 - RNA, 16 nt, Streptococcus pyogenes MGAS8232
ucaacgcuagcauaau

SEQ ID NO: 4128587 - RNA, 21 nt, Streptococcus pyogenes MGAS8232
ucaacuaucaaguaugcuuuu

SEQ ID NO: 4128588 - RNA, 21 nt, Streptococcus pyogenes MGAS8232
ucaagcucgguuuuaaacuuc

SEQ ID NO: 4128589 - RNA, 23 nt, Streptococcus pyogenes MGAS8232
ucaaggaauugcagcuaaaaaca

SEQ ID NO: 4128590 - RNA, 22 nt, Streptococcus pyogenes MGAS8232
ucaauaacaacgucaauuuuau

SEQ ID NO: 4128591 - RNA, 19 nt, Streptococcus pyogenes MGAS8232
ucaauaacagaaauuaaua

SEQ ID NO: 4128592 - RNA, 17 nt, Streptococcus pyogenes MGAS8232
ucaauauaauaaaaagu

SEQ ID NO: 4128593 - RNA, 21 nt, Streptococcus pyogenes MGAS8232
ucaauauuuuauuaauaagua

SEQ ID NO: 4128594 - RNA, 22 nt, Streptococcus pyogenes MGAS8232
ucaaugacuugaccaaauacag

SEQ ID NO: 4128595 - RNA, 20 nt, Streptococcus pyogenes MGAS8232
ucaauggaaauuuuaaauga

SEQ ID NO: 4128596 - RNA, 13 nt, Streptococcus pyogenes MGAS8232
ucaauguuuugcu

SEQ ID NO: 4128597 - RNA, 16 nt, Streptococcus pyogenes MGAS8232
ucaauguuuugcucga

SEQ ID NO: 4128598 - RNA, 21 nt, Streptococcus pyogenes MGAS8232
ucaauuaauguuaggagcaca

SEQ ID NO: 4128599 - RNA, 13 nt, Streptococcus pyogenes MGAS8232
ucaauugcuuuua

SEQ ID NO: 4128600 - RNA, 18 nt, Streptococcus pyogenes MGAS8232
ucaauuuuguugaguguu

SEQ ID NO: 4128601 - RNA, 20 nt, Streptococcus pyogenes MGAS8232
ucaauuuuugauuuuaauuu

SEQ ID NO: 4128602 - RNA, 14 nt, Streptococcus pyogenes MGAS8232
ucacaacuucuaua

SEQ ID NO: 4128603 - RNA, 22 nt, Streptococcus pyogenes MGAS8232
ucacagccucgcugaaagucuu

SEQ ID NO: 4128604 - RNA, 19 nt, Streptococcus pyogenes MGAS8232
ucaccuuaggcagacaauu

SEQ ID NO: 4128605 - RNA, 21 nt, Streptococcus pyogenes MGAS8232
ucaccuuaggcagacaauuau

SEQ ID NO: 4128606 - RNA, 17 nt, Streptococcus pyogenes MGAS8232
ucacguacagaaaugaa

SEQ ID NO: 4128607 - RNA, 15 nt, Streptococcus pyogenes MGAS8232
ucugcaaguucuuug

SEQ ID NO: 4128608 - RNA, 19 nt, Streptococcus pyogenes MGAS8232
ucugcaauauccauagaaa

SEQ ID NO: 4128609 - RNA, 18 nt, Streptococcus pyogenes MGAS8232
ucugcagauuuuaagaca

SEQ ID NO: 4128610 - RNA, 15 nt, Streptococcus pyogenes MGAS8232
ucugccuuuuuaauc

SEQ ID NO: 4128611 - RNA, 20 nt, Streptococcus pyogenes MGAS8232
ucuggaaacuggucaaaagc

SEQ ID NO: 4128612 - RNA, 18 nt, Streptococcus pyogenes MGAS8232
ucuggccagcuacaaggc

SEQ ID NO: 4128613 - RNA, 16 nt, Streptococcus pyogenes MGAS8232
ucugguuuuaauauug

SEQ ID NO: 4128614 - RNA, 18 nt, Streptococcus pyogenes MGAS8232
ucugugaugaaucauuuu

SEQ ID NO: 4128615 - RNA, 21 nt, Streptococcus pyogenes MGAS8232
ucugugaugaaucauuuugga

SEQ ID NO: 4128616 - RNA, 16 nt, Streptococcus pyogenes MGAS8232
ucuguuucuugcaaug

SEQ ID NO: 4128617 - RNA, 21 nt, Streptococcus pyogenes MGAS8232
ucuuaaaagaaaaucuaauca

SEQ ID NO: 4128618 - RNA, 13 nt, Streptococcus pyogenes MGAS8232
ucuuagcaccgcu

SEQ ID NO: 4128619 - RNA, 17 nt, Streptococcus pyogenes MGAS8232
ucuuauagaauaaccag

SEQ ID NO: 4128620 - RNA, 20 nt, Streptococcus pyogenes MGAS8232
ucuuauagcacguuggaaaa

SEQ ID NO: 4128621 - RNA, 20 nt, Streptococcus pyogenes MGAS8232
ucuuaucuuuuccgagauga

SEQ ID NO: 4128622 - RNA, 15 nt, Streptococcus pyogenes MGAS8232
ucuucaagcucgguu

SEQ ID NO: 4128623 - RNA, 14 nt, Streptococcus pyogenes MGAS8232
ucuucagguuucuu

SEQ ID NO: 4128624 - RNA, 14 nt, Streptococcus pyogenes MGAS8232
ucuucuaaacguuu

SEQ ID NO: 4128625 - RNA, 22 nt, Streptococcus pyogenes MGAS8232
ucuucugaugcguuuauaaagu

SEQ ID NO: 4128626 - RNA, 12 nt, Streptococcus pyogenes MGAS8232
ucuucuucuuuu

SEQ ID NO: 4128627 - RNA, 23 nt, Streptococcus pyogenes MGAS8232
ucuucuuuuuauuauacucaaua

SEQ ID NO: 4128628 - RNA, 17 nt, Streptococcus pyogenes MGAS8232
ucuugcauuaccuuauu

SEQ ID NO: 4128629 - RNA, 13 nt, Streptococcus pyogenes MGAS8232
ucuugcucauguu

SEQ ID NO: 4128630 - RNA, 23 nt, Streptococcus pyogenes MGAS8232
ucuuguuuaaccuccuaaacuaa

SEQ ID NO: 4128631 - RNA, 13 nt, Streptococcus pyogenes MGAS8232
ucuuguuuugguu

SEQ ID NO: 4128632 - RNA, 20 nt, Streptococcus pyogenes MGAS8232
ucuuguuuugguugauauaa

SEQ ID NO: 4128633 - RNA, 23 nt, Streptococcus pyogenes MGAS8232
ucuuguuuugguugauauaaaau

SEQ ID NO: 4128634 - RNA, 13 nt, Streptococcus pyogenes MGAS8232
ucuuuaauaguuu

SEQ ID NO: 4128635 - RNA, 23 nt, Streptococcus pyogenes MGAS8232
ucuuuauuuugauauuuuuucuc

SEQ ID NO: 4128636 - RNA, 19 nt, Streptococcus pyogenes MGAS8232
ucuuucaguuguuuuaacu

SEQ ID NO: 4128637 - RNA, 15 nt, Streptococcus pyogenes MGAS8232
ucuuugacaauguca

SEQ ID NO: 4128638 - RNA, 19 nt, Streptococcus pyogenes MGAS8232
ucuuugcagagaugcuucu

SEQ ID NO: 4128639 - RNA, 18 nt, Streptococcus pyogenes MGAS8232
ucuuuggagaaauucaaa

SEQ ID NO: 4128640 - RNA, 17 nt, Streptococcus pyogenes MGAS8232
ucuuuguccauucuuua

SEQ ID NO: 4128641 - RNA, 19 nt, Streptococcus pyogenes MGAS8232
ucuuuguccauuuuuuaua

SEQ ID NO: 4128642 - RNA, 16 nt, Streptococcus pyogenes MGAS8232
ucuuuguuaccuucuu

SEQ ID NO: 4128643 - RNA, 13 nt, Streptococcus pyogenes MGAS8232
ucuuuuaguucag

SEQ ID NO: 4128644 - RNA, 13 nt, Streptococcus pyogenes MGAS8232
ucuuuuuuaccuu

SEQ ID NO: 4128645 - RNA, 17 nt, Streptococcus pyogenes MGAS8232
ucuuuuuuacuuuuaaa

SEQ ID NO: 4128646 - RNA, 19 nt, Streptococcus pyogenes MGAS8232
ucuuuuuuacuuuuaaaau

SEQ ID NO: 4128647 - RNA, 14 nt, Streptococcus pyogenes MGAS8232
ucuuuuuuuuauua

SEQ ID NO: 4128648 - RNA, 18 nt, Streptococcus pyogenes MGAS8232
ucuuuuuuuuauuauucu

SEQ ID NO: 4128649 - RNA, 18 nt, Streptococcus pyogenes MGAS8232
ugaaaaaacucaagaggu

SEQ ID NO: 4128650 - RNA, 12 nt, Streptococcus pyogenes MGAS8232
ugaaaaaagaac

SEQ ID NO: 4128651 - RNA, 17 nt, Streptococcus pyogenes MGAS8232
ugaaaacguguauucuu

SEQ ID NO: 4128652 - RNA, 13 nt, Streptococcus pyogenes MGAS8232
ugaaaauaaaaua

SEQ ID NO: 4128653 - RNA, 16 nt, Streptococcus pyogenes MGAS8232
ugaaaguuccuuagca

SEQ ID NO: 4128654 - RNA, 12 nt, Streptococcus pyogenes MGAS8232
ugaaaugauugu

SEQ ID NO: 4128655 - RNA, 11 nt, Streptococcus pyogenes MGAS8232
ugaacaaaaca

SEQ ID NO: 4128656 - RNA, 14 nt, Streptococcus pyogenes MGAS8232
ugaacaaaacaaaa

SEQ ID NO: 4128657 - RNA, 17 nt, Streptococcus pyogenes MGAS8232
ugaacaaaacaaaacaa

SEQ ID NO: 4128658 - RNA, 21 nt, Streptococcus pyogenes MGAS8232
ugaagacauggucgaccuuaa

SEQ ID NO: 4128659 - RNA, 14 nt, Streptococcus pyogenes MGAS8232
ugaagcaaaauaaa

SEQ ID NO: 4128660 - RNA, 23 nt, Streptococcus pyogenes MGAS8232
ugaagccuaauugaccugcugca

SEQ ID NO: 4128661 - RNA, 13 nt, Streptococcus pyogenes MGAS8232
ugaauuauuagua

SEQ ID NO: 4128662 - RNA, 17 nt, Streptococcus pyogenes MGAS8232
ugaauuauuaguaacca

SEQ ID NO: 4128663 - RNA, 17 nt, Streptococcus pyogenes MGAS8232
ugaauuuugucuaaaau

SEQ ID NO: 4128664 - RNA, 15 nt, Streptococcus pyogenes MGAS8232
ugacaaauucuuuuu

SEQ ID NO: 4128665 - RNA, 22 nt, Streptococcus pyogenes MGAS8232
ugacaacaauaugugauuauua

SEQ ID NO: 4128666 - RNA, 16 nt, Streptococcus pyogenes MGAS8232
ugacaauagcgaaaaa

SEQ ID NO: 4128667 - RNA, 18 nt, Streptococcus pyogenes MGAS8232
ugacaauagcgaaaaagg

SEQ ID NO: 4128668 - RNA, 19 nt, Streptococcus pyogenes MGAS8232
ugacagacaccaaaaaaag

SEQ ID NO: 4128669 - RNA, 20 nt, Streptococcus pyogenes MGAS8232
ugacagacaccaaaaaaagc

SEQ ID NO: 4128670 - RNA, 17 nt, Streptococcus pyogenes MGAS8232
ugacaguuaaaaauaac

SEQ ID NO: 4128671 - RNA, 21 nt, Streptococcus pyogenes MGAS8232
ugaccaccggugccucaccac

SEQ ID NO: 4128672 - RNA, 17 nt, Streptococcus pyogenes MGAS8232
ugaccauuuuuacugua

SEQ ID NO: 4128673 - RNA, 19 nt, Streptococcus pyogenes MGAS8232
ugacccguuuuccugcuca

SEQ ID NO: 4128674 - RNA, 21 nt, Streptococcus pyogenes MGAS8232
ugacuacuagccuguccuagu

SEQ ID NO: 4128675 - RNA, 14 nt, Streptococcus pyogenes MGAS8232
ugacuaguuuauua

SEQ ID NO: 4128676 - RNA, 22 nt, Streptococcus pyogenes MGAS8232
ugacuauauccguaguaggcug

SEQ ID NO: 4128677 - RNA, 20 nt, Streptococcus pyogenes MGAS8232
ugacucugauccgaguuuug

SEQ ID NO: 4128678 - RNA, 18 nt, Streptococcus pyogenes MGAS8232
ugacuguaauuaugcaaa

SEQ ID NO: 4128679 - RNA, 15 nt, Streptococcus pyogenes MGAS8232
ugacuugguuuaaua

SEQ ID NO: 4128680 - RNA, 19 nt, Streptococcus pyogenes MGAS8232
ugacuuguuacaaaaaaca

SEQ ID NO: 4128681 - RNA, 15 nt, Streptococcus pyogenes MGAS8232
ugagacaaguugccu

SEQ ID NO: 4128682 - RNA, 17 nt, Streptococcus pyogenes MGAS8232
ugagauauucauuuucu

SEQ ID NO: 4128683 - RNA, 14 nt, Streptococcus pyogenes MGAS8232
ugagcaaaacaaua

SEQ ID NO: 4128684 - RNA, 21 nt, Streptococcus pyogenes MGAS8232
ugagcaaaacaauaacacaga

SEQ ID NO: 4128685 - RNA, 16 nt, Streptococcus pyogenes MGAS8232
ugagcaaggcaagagg

SEQ ID NO: 4128686 - RNA, 16 nt, Streptococcus pyogenes MGAS8232
ugagccccaaaaguug

SEQ ID NO: 4128687 - RNA, 16 nt, Streptococcus pyogenes MGAS8232
ugagccgccaacauag

SEQ ID NO: 4128688 - RNA, 19 nt, Streptococcus pyogenes MGAS8232
ugagccgccaacauagcua

SEQ ID NO: 4128689 - RNA, 20 nt, Streptococcus pyogenes MGAS8232
ugagccugcauuuaaucuua

SEQ ID NO: 4128690 - RNA, 15 nt, Streptococcus pyogenes MGAS8232
ugaggucaaccucua

SEQ ID NO: 4128691 - RNA, 13 nt, Streptococcus pyogenes MGAS8232
ugaggugaacacc

SEQ ID NO: 4128692 - RNA, 17 nt, Streptococcus pyogenes MGAS8232
ugaguaagcagcaucac

SEQ ID NO: 4128693 - RNA, 13 nt, Streptococcus pyogenes MGAS8232
ugaguugauuuau

SEQ ID NO: 4128694 - RNA, 15 nt, Streptococcus pyogenes MGAS8232
ugaguuuauguaugc

SEQ ID NO: 4128695 - RNA, 23 nt, Streptococcus pyogenes MGAS8232
ugauaaaggccuguauuucuuug

SEQ ID NO: 4128696 - RNA, 13 nt, Streptococcus pyogenes MGAS8232
ugauauaaaaaug

SEQ ID NO: 4128697 - RNA, 16 nt, Streptococcus pyogenes MGAS8232
ugauauaaaaauggag

SEQ ID NO: 4128698 - RNA, 14 nt, Streptococcus pyogenes MGAS8232
ugauauaaaauugg

SEQ ID NO: 4128699 - RNA, 21 nt, Streptococcus pyogenes MGAS8232
ugauaugguggguaaaaccaa

SEQ ID NO: 4128700 - RNA, 23 nt, Streptococcus pyogenes MGAS8232
ugauauugaucucugcaacauca

SEQ ID NO: 4128701 - RNA, 20 nt, Streptococcus pyogenes MGAS8232
ugauauuucaucuugcauua

SEQ ID NO: 4128702 - RNA, 23 nt, Streptococcus pyogenes MGAS8232
ugauauuuuuucucaaaaauaua

SEQ ID NO: 4128703 - RNA, 16 nt, Streptococcus pyogenes MGAS8232
ugaucuguuuaaaaac

SEQ ID NO: 4128704 - RNA, 15 nt, Streptococcus pyogenes MGAS8232
ugaugagguauuuau

SEQ ID NO: 4128705 - RNA, 21 nt, Streptococcus pyogenes MGAS8232
uguaucaagagucauuugacu

SEQ ID NO: 4128706 - RNA, 16 nt, Streptococcus pyogenes MGAS8232
uguauuacucaauuaa

SEQ ID NO: 4128707 - RNA, 16 nt, Streptococcus pyogenes MGAS8232
uguauuccauacuucc

SEQ ID NO: 4128708 - RNA, 15 nt, Streptococcus pyogenes MGAS8232
uguauuucuuuggua

SEQ ID NO: 4128709 - RNA, 13 nt, Streptococcus pyogenes MGAS8232
uguauuuuucaaa

SEQ ID NO: 4128710 - RNA, 14 nt, Streptococcus pyogenes MGAS8232
ugucaaauaaaauc

SEQ ID NO: 4128711 - RNA, 23 nt, Streptococcus pyogenes MGAS8232
ugucaagccauagccagauggug

SEQ ID NO: 4128712 - RNA, 16 nt, Streptococcus pyogenes MGAS8232
ugucaauaacaacguc

SEQ ID NO: 4128713 - RNA, 17 nt, Streptococcus pyogenes MGAS8232
ugucauacucaauagcu

SEQ ID NO: 4128714 - RNA, 12 nt, Streptococcus pyogenes MGAS8232
ugucauuucuug

SEQ ID NO: 4128715 - RNA, 18 nt, Streptococcus pyogenes MGAS8232
uguccuagucuuuuggcu

SEQ ID NO: 4128716 - RNA, 16 nt, Streptococcus pyogenes MGAS8232
ugucguuuuuugcuuu

SEQ ID NO: 4128717 - RNA, 21 nt, Streptococcus pyogenes MGAS8232
ugucguuuuuugcuuuugaua

SEQ ID NO: 4128718 - RNA, 13 nt, Streptococcus pyogenes MGAS8232
ugucuacuuauuu

SEQ ID NO: 4128719 - RNA, 16 nt, Streptococcus pyogenes MGAS8232
ugucucacuauuuugu

SEQ ID NO: 4128720 - RNA, 14 nt, Streptococcus pyogenes MGAS8232
ugucuccuucuuug

SEQ ID NO: 4128721 - RNA, 15 nt, Streptococcus pyogenes MGAS8232
ugucuccuucuuugc

SEQ ID NO: 4128722 - RNA, 17 nt, Streptococcus pyogenes MGAS8232
ugucucgaauauaauuc

SEQ ID NO: 4128723 - RNA, 16 nt, Streptococcus pyogenes MGAS8232
ugugauguaauugucu

SEQ ID NO: 4128724 - RNA, 21 nt, Streptococcus pyogenes MGAS8232
ugugauuaguuuuuagcagca

SEQ ID NO: 4128725 - RNA, 22 nt, Streptococcus pyogenes MGAS8232
ugugauuaguuuuuagcagcag

SEQ ID NO: 4128726 - RNA, 20 nt, Streptococcus pyogenes MGAS8232
ugugccuaauccucucacaa

SEQ ID NO: 4128727 - RNA, 18 nt, Streptococcus pyogenes MGAS8232
uguuaguggaccucuuuu

SEQ ID NO: 4128728 - RNA, 21 nt, Streptococcus pyogenes MGAS8232
uguuaucccuggaccauuauc

SEQ ID NO: 4128729 - RNA, 22 nt, Streptococcus pyogenes MGAS8232
uguucaaccgucacuauugaau

SEQ ID NO: 4128730 - RNA, 17 nt, Streptococcus pyogenes MGAS8232
uguucauuuagugguau

SEQ ID NO: 4128731 - RNA, 22 nt, Streptococcus pyogenes MGAS8232
uguucuaaaaaagcucuaucau

SEQ ID NO: 4128732 - RNA, 16 nt, Streptococcus pyogenes MGAS8232
uguucuuuauuuugau

SEQ ID NO: 4128733 - RNA, 20 nt, Streptococcus pyogenes MGAS8232
uguugacucugauccgaguu

SEQ ID NO: 4128734 - RNA, 15 nt, Streptococcus pyogenes MGAS8232
uguugucaaacauaa

SEQ ID NO: 4128735 - RNA, 14 nt, Streptococcus pyogenes MGAS8232
uguuuaaaaaacuu

SEQ ID NO: 4128736 - RNA, 13 nt, Streptococcus pyogenes MGAS8232
uguuuauuccaaa

SEQ ID NO: 4128737 - RNA, 11 nt, Streptococcus pyogenes MGAS8232
uguuuuauuac

SEQ ID NO: 4128738 - RNA, 16 nt, Streptococcus pyogenes MGAS8232
uguuuugucuuauaga

SEQ ID NO: 4128739 - RNA, 14 nt, Streptococcus pyogenes MGAS8232
uguuuuguuuaaua

SEQ ID NO: 4128740 - RNA, 13 nt, Streptococcus pyogenes MGAS8232
uguuuuucuuaua

SEQ ID NO: 4128741 - RNA, 20 nt, Streptococcus pyogenes MGAS8232
uguuuuuucaacaaauccuu

SEQ ID NO: 4128742 - RNA, 20 nt, Streptococcus pyogenes MGAS8232
uuaaaaaauauuguaaauca

SEQ ID NO: 4128743 - RNA, 12 nt, Streptococcus pyogenes MGAS8232
uuaaaagaaaau

SEQ ID NO: 4128744 - RNA, 18 nt, Streptococcus pyogenes MGAS8232
uuaaaagaaaaucuaauc

SEQ ID NO: 4128745 - RNA, 23 nt, Streptococcus pyogenes MGAS8232
uuaaaagaaaaucuaaucagaac

SEQ ID NO: 4128746 - RNA, 15 nt, Streptococcus pyogenes MGAS8232
uuaaaagaugucgca

SEQ ID NO: 4128747 - RNA, 13 nt, Streptococcus pyogenes MGAS8232
uuaaacauauuau

SEQ ID NO: 4128748 - RNA, 14 nt, Streptococcus pyogenes MGAS8232
uuaaagacaaaaaa

SEQ ID NO: 4128749 - RNA, 21 nt, Streptococcus pyogenes MGAS8232
uuaaagacaaaaaaacuggaa

SEQ ID NO: 4128750 - RNA, 21 nt, Streptococcus pyogenes MGAS8232
uuaaagagaaagaggaaacaa

SEQ ID NO: 4128751 - RNA, 13 nt, Streptococcus pyogenes MGAS8232
uuaacaaaaauaa

SEQ ID NO: 4128752 - RNA, 17 nt, Streptococcus pyogenes MGAS8232
uuaacaaugaaacguua

SEQ ID NO: 4128753 - RNA, 20 nt, Streptococcus pyogenes MGAS8232
uuaacaggugacauaguguu

SEQ ID NO: 4128754 - RNA, 16 nt, Streptococcus pyogenes MGAS8232
uuaaccauaucacaaa

SEQ ID NO: 4128755 - RNA, 14 nt, Streptococcus pyogenes MGAS8232
uuaaccuccuaaac

SEQ ID NO: 4128756 - RNA, 15 nt, Streptococcus pyogenes MGAS8232
uuaacuauuuaacuu

SEQ ID NO: 4128757 - RNA, 14 nt, Streptococcus pyogenes MGAS8232
uuaacucucauaaa

SEQ ID NO: 4128758 - RNA, 17 nt, Streptococcus pyogenes MGAS8232
uuaacuuauuauuuugg

SEQ ID NO: 4128759 - RNA, 20 nt, Streptococcus pyogenes MGAS8232
uuaagaaggaacucuccaaa

SEQ ID NO: 4128760 - RNA, 17 nt, Streptococcus pyogenes MGAS8232
uuaagcuuuguugcauu

SEQ ID NO: 4128761 - RNA, 20 nt, Streptococcus pyogenes MGAS8232
uuaaggauuaugaaaaagaa

SEQ ID NO: 4128762 - RNA, 16 nt, Streptococcus pyogenes MGAS8232
uuaaguagucaaaaua

SEQ ID NO: 4128763 - RNA, 20 nt, Streptococcus pyogenes MGAS8232
uuaauaaacuguauacaaaa

SEQ ID NO: 4128764 - RNA, 14 nt, Streptococcus pyogenes MGAS8232
uuaauaauauuaac

SEQ ID NO: 4128765 - RNA, 18 nt, Streptococcus pyogenes MGAS8232
uuaauagagaacagauaa

SEQ ID NO: 4128766 - RNA, 20 nt, Streptococcus pyogenes MGAS8232
uuaauagcauugucaaauaa

SEQ ID NO: 4128767 - RNA, 22 nt, Streptococcus pyogenes MGAS8232
uuaauaggcuuuuuuuguaucu

SEQ ID NO: 4128768 - RNA, 17 nt, Streptococcus pyogenes MGAS8232
uuaauauagucugcaug

SEQ ID NO: 4128769 - RNA, 15 nt, Streptococcus pyogenes MGAS8232
uuaaucaaaaaacug

SEQ ID NO: 4128770 - RNA, 19 nt, Streptococcus pyogenes MGAS8232
uuaaucuuauuaaagagaa

SEQ ID NO: 4128771 - RNA, 18 nt, Streptococcus pyogenes MGAS8232
uuaaucuuuguuucuaua

SEQ ID NO: 4128772 - RNA, 23 nt, Streptococcus pyogenes MGAS8232
uuaaugaccuuugauaagauauu

SEQ ID NO: 4128773 - RNA, 21 nt, Streptococcus pyogenes MGAS8232
uuaaugauucaauaucacauu

SEQ ID NO: 4128774 - RNA, 12 nt, Streptococcus pyogenes MGAS8232
uuaauuuuauuu

SEQ ID NO: 4128775 - RNA, 14 nt, Streptococcus pyogenes MGAS8232
uuacagcugguuuu

SEQ ID NO: 4128776 - RNA, 19 nt, Streptococcus pyogenes MGAS8232
uuacauggguguuuaaucu

SEQ ID NO: 4128777 - RNA, 14 nt, Streptococcus pyogenes MGAS8232
uuaccagcaccuuc

SEQ ID NO: 4128778 - RNA, 14 nt, Streptococcus pyogenes MGAS8232
uuaccuuauuuucu

SEQ ID NO: 4128779 - RNA, 17 nt, Streptococcus pyogenes MGAS8232
uuacgauuaaaagaugu

SEQ ID NO: 4128780 - RNA, 15 nt, Streptococcus pyogenes MGAS8232
uuacuaacuagcaag

SEQ ID NO: 4128781 - RNA, 17 nt, Streptococcus pyogenes MGAS8232
uuacuaugaaaaaagaa

SEQ ID NO: 4128782 - RNA, 21 nt, Streptococcus pyogenes MGAS8232
uuacuauggcuucuaaaaaaa

SEQ ID NO: 4128783 - RNA, 18 nt, Streptococcus pyogenes MGAS8232
uuacucaauuaauguuag

SEQ ID NO: 4128784 - RNA, 17 nt, Streptococcus pyogenes MGAS8232
uuacucaucuacucuau

SEQ ID NO: 4128785 - RNA, 21 nt, Streptococcus pyogenes MGAS8232
uuacugggucaacuccaaucu

SEQ ID NO: 4128786 - RNA, 19 nt, Streptococcus pyogenes MGAS8232
uuacuguauaaacuuguug

SEQ ID NO: 4128787 - RNA, 21 nt, Streptococcus pyogenes MGAS8232
uuacuucuaagagccaaaaua

SEQ ID NO: 4128788 - RNA, 19 nt, Streptococcus pyogenes MGAS8232
uuagcaaaaugcuguuugu

SEQ ID NO: 4128789 - RNA, 18 nt, Streptococcus pyogenes MGAS8232
uuagcaauccaacuuuga

SEQ ID NO: 4128790 - RNA, 15 nt, Streptococcus pyogenes MGAS8232
uuagcaauuguuuuu

SEQ ID NO: 4128791 - RNA, 15 nt, Streptococcus pyogenes MGAS8232
uuagcagacaaaagg

SEQ ID NO: 4128792 - RNA, 14 nt, Streptococcus pyogenes MGAS8232
uuagcauauuuuga

SEQ ID NO: 4128793 - RNA, 12 nt, Streptococcus pyogenes MGAS8232
uuaguagagacg

SEQ ID NO: 4128794 - RNA, 18 nt, Streptococcus pyogenes MGAS8232
uuagugguauagacaaac

SEQ ID NO: 4128795 - RNA, 15 nt, Streptococcus pyogenes MGAS8232
uuaguugauuagaau

SEQ ID NO: 4128796 - RNA, 17 nt, Streptococcus pyogenes MGAS8232
uuaguugcuucuuuuaa

SEQ ID NO: 4128797 - RNA, 19 nt, Streptococcus pyogenes MGAS8232
uuaguuuaggaaucacaac

SEQ ID NO: 4128798 - RNA, 12 nt, Streptococcus pyogenes MGAS8232
uuaguuuuuaaa

SEQ ID NO: 4128799 - RNA, 23 nt, Streptococcus pyogenes MGAS8232
uuauaaaguuuucucagagacaa

SEQ ID NO: 4128800 - RNA, 15 nt, Streptococcus pyogenes MGAS8232
uuauaaauauuuuau

SEQ ID NO: 4128801 - RNA, 14 nt, Streptococcus pyogenes MGAS8232
uuauagcuccuaaa

SEQ ID NO: 4128802 - RNA, 22 nt, Streptococcus pyogenes MGAS8232
uuauaguuugacuucaaaaaua

SEQ ID NO: 4128803 - RNA, 15 nt, Streptococcus pyogenes MGAS8232
uugcuuaaugaccuu

SEQ ID NO: 4128804 - RNA, 20 nt, Streptococcus pyogenes MGAS8232
uugcuuaaugaccuuugaua

SEQ ID NO: 4128805 - RNA, 17 nt, Streptococcus pyogenes MGAS8232
uugcuuauagcuaccua

SEQ ID NO: 4128806 - RNA, 14 nt, Streptococcus pyogenes MGAS8232
uuggagagauuuuu

SEQ ID NO: 4128807 - RNA, 19 nt, Streptococcus pyogenes MGAS8232
uuggagagauuuuuaaaac

SEQ ID NO: 4128808 - RNA, 20 nt, Streptococcus pyogenes MGAS8232
uuggcauaacccucauuguc

SEQ ID NO: 4128809 - RNA, 22 nt, Streptococcus pyogenes MGAS8232
uuggcuacucuauuugaaguaa

SEQ ID NO: 4128810 - RNA, 17 nt, Streptococcus pyogenes MGAS8232
uuggcuacucuauuuua

SEQ ID NO: 4128811 - RNA, 23 nt, Streptococcus pyogenes MGAS8232
uugggacuuuucagucuucugua

SEQ ID NO: 4128812 - RNA, 14 nt, Streptococcus pyogenes MGAS8232
uugguaaaaaggca

SEQ ID NO: 4128813 - RNA, 20 nt, Streptococcus pyogenes MGAS8232
uuggugacaauagcgaaaaa

SEQ ID NO: 4128814 - RNA, 22 nt, Streptococcus pyogenes MGAS8232
uugguggaagaguaaggaccaa

SEQ ID NO: 4128815 - RNA, 14 nt, Streptococcus pyogenes MGAS8232
uuguaaaauuuauc

SEQ ID NO: 4128816 - RNA, 19 nt, Streptococcus pyogenes MGAS8232
uuguaauaacaaaaugaag

SEQ ID NO: 4128817 - RNA, 18 nt, Streptococcus pyogenes MGAS8232
uuguaguaggugacacua

SEQ ID NO: 4128818 - RNA, 22 nt, Streptococcus pyogenes MGAS8232
uuguauuacucaauuaauguua

SEQ ID NO: 4128819 - RNA, 20 nt, Streptococcus pyogenes MGAS8232
uugucuaugagauaccuuca

SEQ ID NO: 4128820 - RNA, 17 nt, Streptococcus pyogenes MGAS8232
uugucuccuucuuugca

SEQ ID NO: 4128821 - RNA, 14 nt, Streptococcus pyogenes MGAS8232
uugucuuauagaau

SEQ ID NO: 4128822 - RNA, 12 nt, Streptococcus pyogenes MGAS8232
uugugacuauau

SEQ ID NO: 4128823 - RNA, 14 nt, Streptococcus pyogenes MGAS8232
uugugauauaaaau

SEQ ID NO: 4128824 - RNA, 22 nt, Streptococcus pyogenes MGAS8232
uuguggcgggccuucuaucaaa

SEQ ID NO: 4128825 - RNA, 22 nt, Streptococcus pyogenes MGAS8232
uugugguuacagacuuuuaaug

SEQ ID NO: 4128826 - RNA, 21 nt, Streptococcus pyogenes MGAS8232
uuguuagagcccauucuuaaa

SEQ ID NO: 4128827 - RNA, 16 nt, Streptococcus pyogenes MGAS8232
uuguuaguggaccucu

SEQ ID NO: 4128828 - RNA, 18 nt, Streptococcus pyogenes MGAS8232
uuguuaguuuuauccccu

SEQ ID NO: 4128829 - RNA, 21 nt, Streptococcus pyogenes MGAS8232
uuguucaaccgucacuauuga

SEQ ID NO: 4128830 - RNA, 13 nt, Streptococcus pyogenes MGAS8232
uuguuguauuaug

SEQ ID NO: 4128831 - RNA, 21 nt, Streptococcus pyogenes MGAS8232
uuguuuaaccuccuaaacuaa

SEQ ID NO: 4128832 - RNA, 19 nt, Streptococcus pyogenes MGAS8232
uuguuuuaguaaagccuua

SEQ ID NO: 4128833 - RNA, 12 nt, Streptococcus pyogenes MGAS8232
uuguuuuuucaa

SEQ ID NO: 4128834 - RNA, 23 nt, Streptococcus pyogenes MGAS8232
uuguuuuuucaaagggagauucu

SEQ ID NO: 4128835 - RNA, 16 nt, Streptococcus pyogenes MGAS8232
uuuaaaaacaaauugu

SEQ ID NO: 4128836 - RNA, 18 nt, Streptococcus pyogenes MGAS8232
uuuaaaagggcaacaauu

SEQ ID NO: 4128837 - RNA, 15 nt, Streptococcus pyogenes MGAS8232
uuuaacaugauguac

SEQ ID NO: 4128838 - RNA, 20 nt, Streptococcus pyogenes MGAS8232
uuuaacaugauguaccaauu

SEQ ID NO: 4128839 - RNA, 14 nt, Streptococcus pyogenes MGAS8232
uuuaaguagucaaa

SEQ ID NO: 4128840 - RNA, 15 nt, Streptococcus pyogenes MGAS8232
uuuaauucuucuuuc

SEQ ID NO: 4128841 - RNA, 14 nt, Streptococcus pyogenes MGAS8232
uuuaauuuuuccuu

SEQ ID NO: 4128842 - RNA, 13 nt, Streptococcus pyogenes MGAS8232
uuuaauuuuucuu

SEQ ID NO: 4128843 - RNA, 22 nt, Streptococcus pyogenes MGAS8232
uuuacagucaagagcacacaua

SEQ ID NO: 4128844 - RNA, 20 nt, Streptococcus pyogenes MGAS8232
uuuacuauggcuucuaaaaa

SEQ ID NO: 4128845 - RNA, 19 nt, Streptococcus pyogenes MGAS8232
uuuagcaauuguuuuuuca

SEQ ID NO: 4128846 - RNA, 17 nt, Streptococcus pyogenes MGAS8232
uuuagguacucguaagc

SEQ ID NO: 4128847 - RNA, 18 nt, Streptococcus pyogenes MGAS8232
uuuauauuauguucuaaa

SEQ ID NO: 4128848 - RNA, 19 nt, Streptococcus pyogenes MGAS8232
uuuauguaugcuguccaug

SEQ ID NO: 4128849 - RNA, 18 nt, Streptococcus pyogenes MGAS8232
uuuauuaauaaguauuuu

SEQ ID NO: 4128850 - RNA, 19 nt, Streptococcus pyogenes MGAS8232
uuuauuuguugaagugucu

SEQ ID NO: 4128851 - RNA, 16 nt, Streptococcus pyogenes MGAS8232
uuuauuuugauauuuu

SEQ ID NO: 4128852 - RNA, 23 nt, Streptococcus pyogenes MGAS8232
uuuauuuugauauuuuuucucaa

SEQ ID NO: 4128853 - RNA, 14 nt, Streptococcus pyogenes MGAS8232
uuucaacaaauccu

SEQ ID NO: 4128854 - RNA, 21 nt, Streptococcus pyogenes MGAS8232
uuucaacaaauccuuuugcuu

SEQ ID NO: 4128855 - RNA, 20 nt, Streptococcus pyogenes MGAS8232
uuucaauaauaccauuuuua

SEQ ID NO: 4128856 - RNA, 22 nt, Streptococcus pyogenes MGAS8232
uuucagauaagaccuucaaaaa

SEQ ID NO: 4128857 - RNA, 16 nt, Streptococcus pyogenes MGAS8232
uuucagucuucuguaa

SEQ ID NO: 4128858 - RNA, 19 nt, Streptococcus pyogenes MGAS8232
uuucaugauguuuauucca

SEQ ID NO: 4128859 - RNA, 18 nt, Streptococcus pyogenes MGAS8232
uuuccuagcgggaacacu

SEQ ID NO: 4128860 - RNA, 17 nt, Streptococcus pyogenes MGAS8232
uuucgaccaauucuaaa

SEQ ID NO: 4128861 - RNA, 21 nt, Streptococcus pyogenes MGAS8232
uuucuuauauugugcuauuca

SEQ ID NO: 4128862 - RNA, 13 nt, Streptococcus pyogenes MGAS8232
uuucuuugucaug

SEQ ID NO: 4128863 - RNA, 12 nt, Streptococcus pyogenes MGAS8232
uuugaauguugu

SEQ ID NO: 4128864 - RNA, 19 nt, Streptococcus pyogenes MGAS8232
uuugacagacaccaaaaaa

SEQ ID NO: 4128865 - RNA, 23 nt, Streptococcus pyogenes MGAS8232
uuugaccgaaaaaggcaaagaaa

SEQ ID NO: 4128866 - RNA, 16 nt, Streptococcus pyogenes MGAS8232
uuugacuucaaaaaua

SEQ ID NO: 4128867 - RNA, 19 nt, Streptococcus pyogenes MGAS8232
uuugccauggcaagagcac

SEQ ID NO: 4128868 - RNA, 20 nt, Streptococcus pyogenes MGAS8232
uuugcugaaauaucuuucag

SEQ ID NO: 4128869 - RNA, 18 nt, Streptococcus pyogenes MGAS8232
uuugcugagcuaaagcca

SEQ ID NO: 4128870 - RNA, 19 nt, Streptococcus pyogenes MGAS8232
uuuggagagauuuuuaaaa

SEQ ID NO: 4128871 - RNA, 20 nt, Streptococcus pyogenes MGAS8232
uuuggaggugaaaauaucuu

SEQ ID NO: 4128872 - RNA, 13 nt, Streptococcus pyogenes MGAS8232
uuuggcaaccuua

SEQ ID NO: 4128873 - RNA, 19 nt, Streptococcus pyogenes MGAS8232
uuuggccaauaaaauaucu

SEQ ID NO: 4128874 - RNA, 17 nt, Streptococcus pyogenes MGAS8232
uuuggccuacuagcaca

SEQ ID NO: 4128875 - RNA, 19 nt, Streptococcus pyogenes MGAS8232
uuuggccuacuagcacaaa

SEQ ID NO: 4128876 - RNA, 22 nt, Streptococcus pyogenes MGAS8232
uuuggccuacuagcacaaaauc

SEQ ID NO: 4128877 - RNA, 21 nt, Streptococcus pyogenes MGAS8232
uuugguguuauccucuuuuag

SEQ ID NO: 4128878 - RNA, 19 nt, Streptococcus pyogenes MGAS8232
uuuguaguaggugacacua

SEQ ID NO: 4128879 - RNA, 19 nt, Streptococcus pyogenes MGAS8232
uuuguaucucauaacaaau

SEQ ID NO: 4128880 - RNA, 18 nt, Streptococcus pyogenes MGAS8232
uuuguauuguagaggacu

SEQ ID NO: 4128881 - RNA, 21 nt, Streptococcus pyogenes MGAS8232
uuugucaacucgauaaaaacg

SEQ ID NO: 4128882 - RNA, 13 nt, Streptococcus pyogenes MGAS8232
uuugugauggucu

SEQ ID NO: 4128883 - RNA, 21 nt, Streptococcus pyogenes MGAS8232
uuuguguugaagaaggucaug

SEQ ID NO: 4128884 - RNA, 13 nt, Streptococcus pyogenes MGAS8232
uuuguuaacaggu

SEQ ID NO: 4128885 - RNA, 13 nt, Streptococcus pyogenes MGAS8232
uuuuaaaaccuuu

SEQ ID NO: 4128886 - RNA, 13 nt, Streptococcus pyogenes MGAS8232
uuuuaaauaucuu

SEQ ID NO: 4128887 - RNA, 15 nt, Streptococcus pyogenes MGAS8232
uuuuaacguuuugaa

SEQ ID NO: 4128888 - RNA, 22 nt, Streptococcus pyogenes MGAS8232
uuuuaagauuaaacuuacaaaa

SEQ ID NO: 4128889 - RNA, 17 nt, Streptococcus pyogenes MGAS8232
uuuuacauuuuuacaau

SEQ ID NO: 4128890 - RNA, 13 nt, Streptococcus pyogenes MGAS8232
uuuuacuuuuaaa

SEQ ID NO: 4128891 - RNA, 19 nt, Streptococcus pyogenes MGAS8232
uuuuagccugccagccaua

SEQ ID NO: 4128892 - RNA, 19 nt, Streptococcus pyogenes MGAS8232
uuuuaguaaagccuuaucc

SEQ ID NO: 4128893 - RNA, 22 nt, Streptococcus pyogenes MGAS8232
uuuuaguaaagccuuauccauu

SEQ ID NO: 4128894 - RNA, 19 nt, Streptococcus pyogenes MGAS8232
uuuuaguugugauauaaaa

SEQ ID NO: 4128895 - RNA, 18 nt, Streptococcus pyogenes MGAS8232
uuuuaguuuguaaaauuu

SEQ ID NO: 4128896 - RNA, 12 nt, Streptococcus pyogenes MGAS8232
uuuuaguuuuau

SEQ ID NO: 4128897 - RNA, 19 nt, Streptococcus pyogenes MGAS8232
uuuuauagcugauuuguuu

SEQ ID NO: 4128898 - RNA, 18 nt, Streptococcus pyogenes MGAS8232
uuuuauaugucaucaaaa

SEQ ID NO: 4128899 - RNA, 18 nt, Streptococcus pyogenes MGAS8232
uuuuauccccuauucaau

SEQ ID NO: 4128900 - RNA, 15 nt, Yersinia pestis
aaaacucucgaaaau

SEQ ID NO: 4128901 - RNA, 13 nt, Yersinia pestis
aaaacugaagcau

SEQ ID NO: 4128902 - RNA, 18 nt, Yersinia pestis
aaaacugaagcaucaaua

SEQ ID NO: 4128903 - RNA, 17 nt, Yersinia pestis
aaaacugacugccauaa

SEQ ID NO: 4128904 - RNA, 20 nt, Yersinia pestis
aaaacugauauaaagcauuu

SEQ ID NO: 4128905 - RNA, 16 nt, Yersinia pestis
aaaacugauuaauagu

SEQ ID NO: 4128906 - RNA, 18 nt, Yersinia pestis
aaaacugugcaaauggcu

SEQ ID NO: 4128907 - RNA, 16 nt, Yersinia pestis
aaaacuuaucuaaaaa

SEQ ID NO: 4128908 - RNA, 16 nt, Yersinia pestis
aaaacuuuggcugagg

SEQ ID NO: 4128909 - RNA, 13 nt, Yersinia pestis
aaaagaaaaaaac

SEQ ID NO: 4128910 - RNA, 22 nt, Yersinia pestis
aaaagaauaaaugucacuugcc

SEQ ID NO: 4128911 - RNA, 20 nt, Yersinia pestis
aaaagaauaaguagcuuaug

SEQ ID NO: 4128912 - RNA, 19 nt, Yersinia pestis
aaaagaauuaauaaauauc

SEQ ID NO: 4128913 - RNA, 21 nt, Yersinia pestis
aaaagacgccuuccggcaucu

SEQ ID NO: 4128914 - RNA, 15 nt, Yersinia pestis
aaaagauaauaaaac

SEQ ID NO: 4128915 - RNA, 18 nt, Yersinia pestis
aaaagauaauaaaacucu

SEQ ID NO: 4128916 - RNA, 22 nt, Yersinia pestis
aaaagaucugcauugauuaaau

SEQ ID NO: 4128917 - RNA, 18 nt, Yersinia pestis
aaaagauggcuacguagc

SEQ ID NO: 4128918 - RNA, 16 nt, Yersinia pestis
aaaagcaacuuggcac

SEQ ID NO: 4128919 - RNA, 13 nt, Yersinia pestis
aaaagcacagaca

SEQ ID NO: 4128920 - RNA, 17 nt, Yersinia pestis
aaaagcacagacaaaca

SEQ ID NO: 4128921 - RNA, 18 nt, Yersinia pestis
aaaagcacagacaaacaa

SEQ ID NO: 4128922 - RNA, 20 nt, Yersinia pestis
aaaagcacagacaaacaacc

SEQ ID NO: 4128923 - RNA, 22 nt, Yersinia pestis
aaaagcacagacaaacaaccua

SEQ ID NO: 4128924 - RNA, 24 nt, Yersinia pestis
aaaagcaccgcagucgauaaacau

SEQ ID NO: 4128925 - RNA, 14 nt, Yersinia pestis
aaaagcagcaaacg

SEQ ID NO: 4128926 - RNA, 16 nt, Yersinia pestis
aaaagcagcaaacgaa

SEQ ID NO: 4128927 - RNA, 13 nt, Yersinia pestis
aaaagcaugccca

SEQ ID NO: 4128928 - RNA, 17 nt, Yersinia pestis
aaaagcccaucgccuga

SEQ ID NO: 4128929 - RNA, 17 nt, Yersinia pestis
aaaagcccggucacuca

SEQ ID NO: 4128930 - RNA, 18 nt, Yersinia pestis
aaaagcccggucacucaa

SEQ ID NO: 4128931 - RNA, 19 nt, Yersinia pestis
aaaagcccggucacucaau

SEQ ID NO: 4128932 - RNA, 14 nt, Yersinia pestis
aaaagcgaucagca

SEQ ID NO: 4128933 - RNA, 18 nt, Yersinia pestis
aaaagcgccuuuuauucu

SEQ ID NO: 4128934 - RNA, 23 nt, Yersinia pestis
aaaagcgccuuuuauucuuuggu

SEQ ID NO: 4128935 - RNA, 20 nt, Yersinia pestis
aaaaggauuuuauuaaauca

SEQ ID NO: 4128936 - RNA, 14 nt, Yersinia pestis
aaaagguaaacaga

SEQ ID NO: 4128937 - RNA, 17 nt, Yersinia pestis
aaaagucagcaaaucaa

SEQ ID NO: 4128938 - RNA, 17 nt, Yersinia pestis
aaaaguggcuaucugaa

SEQ ID NO: 4128939 - RNA, 18 nt, Yersinia pestis
aaaaguggcuaucugaaa

SEQ ID NO: 4128940 - RNA, 17 nt, Yersinia pestis
aaaaguuucagcgugga

SEQ ID NO: 4128941 - RNA, 21 nt, Yersinia pestis
aaaaguuucagcguggaauua

SEQ ID NO: 4128942 - RNA, 19 nt, Yersinia pestis
aaaaguuuuuugaaauuag

SEQ ID NO: 4128943 - RNA, 16 nt, Yersinia pestis
aaaauaaaauucguuu

SEQ ID NO: 4128944 - RNA, 16 nt, Yersinia pestis
aaaauaaacaucaaug

SEQ ID NO: 4128945 - RNA, 18 nt, Yersinia pestis
aaaauaaagggggcaccg

SEQ ID NO: 4128946 - RNA, 15 nt, Yersinia pestis
aaaauaaauuuauuu

SEQ ID NO: 4128947 - RNA, 15 nt, Yersinia pestis
aaaauaaggcgaaua

SEQ ID NO: 4128948 - RNA, 22 nt, Yersinia pestis
aaaauaaguaacauuuguauuu

SEQ ID NO: 4128949 - RNA, 19 nt, Yersinia pestis
aaaauaauaauucugcuau

SEQ ID NO: 4128950 - RNA, 10 nt, Yersinia pestis
aaaauaauga

SEQ ID NO: 4128951 - RNA, 13 nt, Yersinia pestis
aaaauacaaccaa

SEQ ID NO: 4128952 - RNA, 15 nt, Yersinia pestis
aaaauacaaccaaca

SEQ ID NO: 4128953 - RNA, 21 nt, Yersinia pestis
aaaauacaaccaacaaacaau

SEQ ID NO: 4128954 - RNA, 14 nt, Yersinia pestis
aaaauacuacucaa

SEQ ID NO: 4128955 - RNA, 16 nt, Yersinia pestis
aaaauacuacucaaaa

SEQ ID NO: 4128956 - RNA, 18 nt, Yersinia pestis
aaaauacuacucaaaaaa

SEQ ID NO: 4128957 - RNA, 18 nt, Yersinia pestis
aaaauacucauuuuuaag

SEQ ID NO: 4128958 - RNA, 21 nt, Yersinia pestis
aaaauacugccaaucgcucug

SEQ ID NO: 4128959 - RNA, 15 nt, Yersinia pestis
aaaauagacucaaca

SEQ ID NO: 4128960 - RNA, 18 nt, Yersinia pestis
aaaauagauuaaaagucu

SEQ ID NO: 4128961 - RNA, 19 nt, Yersinia pestis
aaaauagauuaaaagucua

SEQ ID NO: 4128962 - RNA, 16 nt, Yersinia pestis
aaaauagccuucccug

SEQ ID NO: 4128963 - RNA, 22 nt, Yersinia pestis
aaaauauagcaaucauuuauau

SEQ ID NO: 4128964 - RNA, 13 nt, Yersinia pestis
aaaauaucacuau

SEQ ID NO: 4128965 - RNA, 17 nt, Yersinia pestis
aaaauaucgcgcuucag

SEQ ID NO: 4128966 - RNA, 20 nt, Yersinia pestis
aaaauaugauaguguaaaaa

SEQ ID NO: 4128967 - RNA, 13 nt, Yersinia pestis
aaaauaugcccca

SEQ ID NO: 4128968 - RNA, 17 nt, Yersinia pestis
aaaauauggcagguauc

SEQ ID NO: 4128969 - RNA, 18 nt, Yersinia pestis
aaaauauucuaaguaaaa

SEQ ID NO: 4128970 - RNA, 13 nt, Yersinia pestis
aaaauauuuugcu

SEQ ID NO: 4128971 - RNA, 23 nt, Yersinia pestis
aaaaucaccuggccaggaauuaa

SEQ ID NO: 4128972 - RNA, 19 nt, Yersinia pestis
aaaaucacgaaauacguag

SEQ ID NO: 4128973 - RNA, 18 nt, Yersinia pestis
aaaaucacguuuccaaaa

SEQ ID NO: 4128974 - RNA, 22 nt, Yersinia pestis
aaaaucaguaccgacaccaaua

SEQ ID NO: 4128975 - RNA, 18 nt, Yersinia pestis
aaaaucaguuuacaugau

SEQ ID NO: 4128976 - RNA, 19 nt, Yersinia pestis
aaaaucaucgcucaucgcc

SEQ ID NO: 4128977 - RNA, 12 nt, Yersinia pestis
aaaaucauugac

SEQ ID NO: 4128978 - RNA, 15 nt, Yersinia pestis
aaaaucccaaaauau

SEQ ID NO: 4128979 - RNA, 23 nt, Yersinia pestis
aaaaucccgggaauaaucaauua

SEQ ID NO: 4128980 - RNA, 17 nt, Yersinia pestis
aaaaucgauagucaacu

SEQ ID NO: 4128981 - RNA, 19 nt, Yersinia pestis
aaaaucgauagucaacuuu

SEQ ID NO: 4128982 - RNA, 15 nt, Yersinia pestis
aaaaucgcacugagu

SEQ ID NO: 4128983 - RNA, 19 nt, Yersinia pestis
aaaaucguauaacauaaua

SEQ ID NO: 4128984 - RNA, 16 nt, Yersinia pestis
aaaaucuuguuaauuu

SEQ ID NO: 4128985 - RNA, 20 nt, Yersinia pestis
aaaaucuuguuaauuuaaac

SEQ ID NO: 4128986 - RNA, 19 nt, Yersinia pestis
aaaaugagagcgaauggca

SEQ ID NO: 4128987 - RNA, 22 nt, Yersinia pestis
aaaaugagcacggacagcagca

SEQ ID NO: 4128988 - RNA, 14 nt, Yersinia pestis
aaaaugagccugaa

SEQ ID NO: 4128989 - RNA, 18 nt, Yersinia pestis
aaaaugauaauaaaaaaa

SEQ ID NO: 4128990 - RNA, 17 nt, Yersinia pestis
aaaaugaucuuuauuau

SEQ ID NO: 4128991 - RNA, 20 nt, Yersinia pestis
aaaaugauuaauaauaguuu

SEQ ID NO: 4128992 - RNA, 12 nt, Yersinia pestis
aaaaugauuuuu

SEQ ID NO: 4128993 - RNA, 16 nt, Yersinia pestis
aaaaugauuuuuuugc

SEQ ID NO: 4128994 - RNA, 17 nt, Yersinia pestis
aaaaugccguacaacaa

SEQ ID NO: 4128995 - RNA, 12 nt, Yersinia pestis
aaaaugcucuuc

SEQ ID NO: 4128996 - RNA, 18 nt, Yersinia pestis
aaaauggcuuuuuuaaua

SEQ ID NO: 4128997 - RNA, 19 nt, Yersinia pestis
aaaauggcuuuuuuaauaa

SEQ ID NO: 4128998 - RNA, 22 nt, Yersinia pestis
aaaauggguauauuuaccaaaa

SEQ ID NO: 4128999 - RNA, 12 nt, Yersinia pestis
aaaauuaacuua

SEQ ID NO: 4129000 - RNA, 16 nt, Yersinia pestis
aaaauuacccagcauc

SEQ ID NO: 4129001 - RNA, 13 nt, Yersinia pestis
aaaauuagagcaa

SEQ ID NO: 4129002 - RNA, 13 nt, Yersinia pestis
aaaauucacaaca

SEQ ID NO: 4129003 - RNA, 20 nt, Yersinia pestis
aaaauucaucuuuaacaaca

SEQ ID NO: 4129004 - RNA, 18 nt, Yersinia pestis
aaaauuccaccauucuca

SEQ ID NO: 4129005 - RNA, 19 nt, Yersinia pestis
aaaauuccgcuucacauuu

SEQ ID NO: 4129006 - RNA, 20 nt, Yersinia pestis
aaaauucgugcucaucaacc

SEQ ID NO: 4129007 - RNA, 17 nt, Yersinia pestis
aaaauugacgaaaguua

SEQ ID NO: 4129008 - RNA, 15 nt, Yersinia pestis
aaaauuguuugacuu

SEQ ID NO: 4129009 - RNA, 12 nt, Yersinia pestis
aaaauuucucuu

SEQ ID NO: 4129010 - RNA, 19 nt, Yersinia pestis
aaaauuucucuuuuauucu

SEQ ID NO: 4129011 - RNA, 23 nt, Yersinia pestis
aaacaaaaccuaacgccaaaaug

SEQ ID NO: 4129012 - RNA, 15 nt, Yersinia pestis
aaacaaaucuuaaau

SEQ ID NO: 4129013 - RNA, 21 nt, Yersinia pestis
aaacaaaucuuaaauugaaga

SEQ ID NO: 4129014 - RNA, 13 nt, Yersinia pestis
aaacaaauguuua

SEQ ID NO: 4129015 - RNA, 20 nt, Yersinia pestis
aaacaaccuaaaaaaaacaa

SEQ ID NO: 4129016 - RNA, 19 nt, Yersinia pestis
aaacaacgccgcucaauua

SEQ ID NO: 4129017 - RNA, 22 nt, Yersinia pestis
aaacaacgccgcucaauuaacc

SEQ ID NO: 4129018 - RNA, 22 nt, Yersinia pestis
aaacaacgcugaaaaaucuuug

SEQ ID NO: 4129019 - RNA, 12 nt, Yersinia pestis
aaacaagccauu

SEQ ID NO: 4129020 - RNA, 23 nt, Yersinia pestis
aaacaauaaacagacuaaaaacc

SEQ ID NO: 4129021 - RNA, 19 nt, Yersinia pestis
aaacaaucugaugaauuaa

SEQ ID NO: 4129022 - RNA, 18 nt, Yersinia pestis
aaacuggcccagcuuuau

SEQ ID NO: 4129023 - RNA, 22 nt, Yersinia pestis
aaacuguuuuuuaaagaaaaaa

SEQ ID NO: 4129024 - RNA, 14 nt, Yersinia pestis
aaacuuaaaaauca

SEQ ID NO: 4129025 - RNA, 17 nt, Yersinia pestis
aaacuuaucuaaaaaac

SEQ ID NO: 4129026 - RNA, 14 nt, Yersinia pestis
aaacuucaaaauca

SEQ ID NO: 4129027 - RNA, 16 nt, Yersinia pestis
aaacuucaaaaucaag

SEQ ID NO: 4129028 - RNA, 17 nt, Yersinia pestis
aaacuucacaaugcaca

SEQ ID NO: 4129029 - RNA, 21 nt, Yersinia pestis
aaacuuccagcguauguuccu

SEQ ID NO: 4129030 - RNA, 18 nt, Yersinia pestis
aaacuugauucaccagau

SEQ ID NO: 4129031 - RNA, 16 nt, Yersinia pestis
aaacuuuccugacccg

SEQ ID NO: 4129032 - RNA, 15 nt, Yersinia pestis
aaagaaaauggcuuu

SEQ ID NO: 4129033 - RNA, 17 nt, Yersinia pestis
aaagaaauaaaagaaaa

SEQ ID NO: 4129034 - RNA, 14 nt, Yersinia pestis
aaagaaauaaucau

SEQ ID NO: 4129035 - RNA, 24 nt, Yersinia pestis
aaagaaccccccaccaucaacaua

SEQ ID NO: 4129036 - RNA, 12 nt, Yersinia pestis
aaagaagaauaa

SEQ ID NO: 4129037 - RNA, 14 nt, Yersinia pestis
aaagaagacauauc

SEQ ID NO: 4129038 - RNA, 21 nt, Yersinia pestis
aaagaagacgaguaaugaaau

SEQ ID NO: 4129039 - RNA, 23 nt, Yersinia pestis
aaagaagacgaguaaugaaaucu

SEQ ID NO: 4129040 - RNA, 21 nt, Yersinia pestis
aaagaauaacuggagaauuua

SEQ ID NO: 4129041 - RNA, 20 nt, Yersinia pestis
aaagaaugcgaagaaaaaca

SEQ ID NO: 4129042 - RNA, 16 nt, Yersinia pestis
aaagacgccguaaaua

SEQ ID NO: 4129043 - RNA, 18 nt, Yersinia pestis
aaagacgccguaaauaca

SEQ ID NO: 4129044 - RNA, 23 nt, Yersinia pestis
aaagagcccgcaacgggagagaa

SEQ ID NO: 4129045 - RNA, 15 nt, Yersinia pestis
aaagagguguucuug

SEQ ID NO: 4129046 - RNA, 15 nt, Yersinia pestis
aaagagucgcuuugg

SEQ ID NO: 4129047 - RNA, 13 nt, Yersinia pestis
aaagagugaaaua

SEQ ID NO: 4129048 - RNA, 19 nt, Yersinia pestis
aaagagugauuaccugaga

SEQ ID NO: 4129049 - RNA, 20 nt, Yersinia pestis
aaagauacaguggaacauuu

SEQ ID NO: 4129050 - RNA, 16 nt, Yersinia pestis
aaagauagcaaaagaa

SEQ ID NO: 4129051 - RNA, 15 nt, Yersinia pestis
aaagauagccacuaa

SEQ ID NO: 4129052 - RNA, 18 nt, Yersinia pestis
aaagauagccacuaacua

SEQ ID NO: 4129053 - RNA, 16 nt, Yersinia pestis
aaagauuaagacuuuc

SEQ ID NO: 4129054 - RNA, 17 nt, Yersinia pestis
aaagauuucaucauuca

SEQ ID NO: 4129055 - RNA, 22 nt, Yersinia pestis
aaagauuucaucauucaauacc

SEQ ID NO: 4129056 - RNA, 21 nt, Yersinia pestis
aaagauuucaucggcaaaaac

SEQ ID NO: 4129057 - RNA, 22 nt, Yersinia pestis
aaagauuucaucggcaaaaaca

SEQ ID NO: 4129058 - RNA, 14 nt, Yersinia pestis
aaagauuuccuuuc

SEQ ID NO: 4129059 - RNA, 20 nt, Yersinia pestis
aaagauuuccuuucgcacuu

SEQ ID NO: 4129060 - RNA, 23 nt, Yersinia pestis
aaagcaaacaauuagucacuaaa

SEQ ID NO: 4129061 - RNA, 16 nt, Yersinia pestis
aaagcacagacaaaca

SEQ ID NO: 4129062 - RNA, 18 nt, Yersinia pestis
aaagcacagacaaacaac

SEQ ID NO: 4129063 - RNA, 18 nt, Yersinia pestis
aaagcacuaagauucaaa

SEQ ID NO: 4129064 - RNA, 21 nt, Yersinia pestis
aaagcagaaagggcgcaugua

SEQ ID NO: 4129065 - RNA, 12 nt, Yersinia pestis
aaagcagcaguu

SEQ ID NO: 4129066 - RNA, 12 nt, Yersinia pestis
aaagcagcguuu

SEQ ID NO: 4129067 - RNA, 17 nt, Yersinia pestis
aaagcagcguuuuuagu

SEQ ID NO: 4129068 - RNA, 16 nt, Yersinia pestis
aaagcaggccuucuaa

SEQ ID NO: 4129069 - RNA, 20 nt, Yersinia pestis
aaagcaggccuucuaacucu

SEQ ID NO: 4129070 - RNA, 12 nt, Yersinia pestis
aaagcagugcug

SEQ ID NO: 4129071 - RNA, 24 nt, Yersinia pestis
aaagcaucaaucaucugcuguaca

SEQ ID NO: 4129072 - RNA, 19 nt, Yersinia pestis
aaagcaucagacugcucuu

SEQ ID NO: 4129073 - RNA, 22 nt, Yersinia pestis
aaagcauuuaucauauuaacau

SEQ ID NO: 4129074 - RNA, 14 nt, Yersinia pestis
aaagccaaaaccau

SEQ ID NO: 4129075 - RNA, 22 nt, Yersinia pestis
aaagccagucagggcgauagcc

SEQ ID NO: 4129076 - RNA, 16 nt, Yersinia pestis
aaagccauuagcguug

SEQ ID NO: 4129077 - RNA, 16 nt, Yersinia pestis
aaagccauucagcagc

SEQ ID NO: 4129078 - RNA, 22 nt, Yersinia pestis
aaagccauuucaguaacuuacc

SEQ ID NO: 4129079 - RNA, 13 nt, Yersinia pestis
aaagcccagguua

SEQ ID NO: 4129080 - RNA, 15 nt, Yersinia pestis
aaagcccgcuucaaa

SEQ ID NO: 4129081 - RNA, 17 nt, Yersinia pestis
aaagcccggucacucaa

SEQ ID NO: 4129082 - RNA, 12 nt, Yersinia pestis
aaagccugccau

SEQ ID NO: 4129083 - RNA, 18 nt, Yersinia pestis
aaagccuuucagcgcugc

SEQ ID NO: 4129084 - RNA, 14 nt, Yersinia pestis
aaagcgccuuuuau

SEQ ID NO: 4129085 - RNA, 22 nt, Yersinia pestis
aaagcgcguaucguccagcagc

SEQ ID NO: 4129086 - RNA, 22 nt, Yersinia pestis
aaagcgcuggcgauaaucucgu

SEQ ID NO: 4129087 - RNA, 22 nt, Yersinia pestis
aaagcggaucucuucagcaauu

SEQ ID NO: 4129088 - RNA, 18 nt, Yersinia pestis
aaagcgggccagcaacca

SEQ ID NO: 4129089 - RNA, 22 nt, Yersinia pestis
aaagcguccgcgccaaggaagg

SEQ ID NO: 4129090 - RNA, 23 nt, Yersinia pestis
aaagcguccgcgccaaggcaagg

SEQ ID NO: 4129091 - RNA, 18 nt, Yersinia pestis
aaagcguccgcgccaggg

SEQ ID NO: 4129092 - RNA, 20 nt, Yersinia pestis
aaagcguccgcgccagggag

SEQ ID NO: 4129093 - RNA, 16 nt, Yersinia pestis
aaagcguuaauuauag

SEQ ID NO: 4129094 - RNA, 16 nt, Yersinia pestis
aaagcuaauauucucu

SEQ ID NO: 4129095 - RNA, 18 nt, Yersinia pestis
aaagcugaacuuuacuuu

SEQ ID NO: 4129096 - RNA, 21 nt, Yersinia pestis
aaagcugaacuuuacuuuaau

SEQ ID NO: 4129097 - RNA, 20 nt, Yersinia pestis
aaagcugaucgcuaaaaagc

SEQ ID NO: 4129098 - RNA, 21 nt, Yersinia pestis
aaagcuuccaauauugagcag

SEQ ID NO: 4129099 - RNA, 16 nt, Yersinia pestis
aaaggaacaaaagaga

SEQ ID NO: 4129100 - RNA, 19 nt, Yersinia pestis
aaaggaauaucugugauaa

SEQ ID NO: 4129101 - RNA, 21 nt, Yersinia pestis
aaaggaauaucugugauaacc

SEQ ID NO: 4129102 - RNA, 23 nt, Yersinia pestis
aaaggauggcccaagccauccuu

SEQ ID NO: 4129103 - RNA, 23 nt, Yersinia pestis
aaaggauuugaagacaacucuuc

SEQ ID NO: 4129104 - RNA, 19 nt, Yersinia pestis
aaaggauuuuauuaaauca

SEQ ID NO: 4129105 - RNA, 20 nt, Yersinia pestis
aaaggcagagaggagaauua

SEQ ID NO: 4129106 - RNA, 16 nt, Yersinia pestis
aaaggcccgcuaguga

SEQ ID NO: 4129107 - RNA, 15 nt, Yersinia pestis
aaaggcuauuuaaau

SEQ ID NO: 4129108 - RNA, 16 nt, Yersinia pestis
aaaggcuauuuaaauu

SEQ ID NO: 4129109 - RNA, 19 nt, Yersinia pestis
aaagggauuacgccaucca

SEQ ID NO: 4129110 - RNA, 15 nt, Yersinia pestis
aaagggcaacaauau

SEQ ID NO: 4129111 - RNA, 18 nt, Yersinia pestis
aaagggccguaacaaggc

SEQ ID NO: 4129112 - RNA, 19 nt, Yersinia pestis
aaagggccugcaaacggcu

SEQ ID NO: 4129113 - RNA, 11 nt, Yersinia pestis
aaagguaaaca

SEQ ID NO: 4129114 - RNA, 19 nt, Yersinia pestis
aaaggucguugccuguagc

SEQ ID NO: 4129115 - RNA, 16 nt, Yersinia pestis
aaagguuaacugcagu

SEQ ID NO: 4129116 - RNA, 17 nt, Yersinia pestis
aaagguuaacugcagug

SEQ ID NO: 4129117 - RNA, 21 nt, Yersinia pestis
aaagguuucugccuuaucaau

SEQ ID NO: 4129118 - RNA, 20 nt, Yersinia pestis
aaaguaacuugccguaaaau

SEQ ID NO: 4129119 - RNA, 17 nt, Yersinia pestis
aaaguaaucuuugagca

SEQ ID NO: 4129120 - RNA, 13 nt, Yersinia pestis
aaaguaauuuauc

SEQ ID NO: 4129121 - RNA, 13 nt, Yersinia pestis
aaaguagaaauaa

SEQ ID NO: 4129122 - RNA, 12 nt, Yersinia pestis
aaaguagccaau

SEQ ID NO: 4129123 - RNA, 18 nt, Yersinia pestis
aaaguaucgcuaucaccg

SEQ ID NO: 4129124 - RNA, 15 nt, Yersinia pestis
aaaguaugggaaagu

SEQ ID NO: 4129125 - RNA, 15 nt, Yersinia pestis
aaaguauugcacuga

SEQ ID NO: 4129126 - RNA, 22 nt, Yersinia pestis
aaagucagcaaaucaaacaaau

SEQ ID NO: 4129127 - RNA, 16 nt, Yersinia pestis
aaagucaucaaaacug

SEQ ID NO: 4129128 - RNA, 21 nt, Yersinia pestis
aaagucauugguguuacagca

SEQ ID NO: 4129129 - RNA, 13 nt, Yersinia pestis
aaagucuuaaucu

SEQ ID NO: 4129130 - RNA, 14 nt, Yersinia pestis
aaagucuuaaucuu

SEQ ID NO: 4129131 - RNA, 15 nt, Yersinia pestis
aaagugacgaaugag

SEQ ID NO: 4129132 - RNA, 18 nt, Yersinia pestis
aaaguggccacucaccuc

SEQ ID NO: 4129133 - RNA, 23 nt, Yersinia pestis
aaaguuaggguucaguaaaacca

SEQ ID NO: 4129134 - RNA, 18 nt, Yersinia pestis
aaaguuauguuuuuccuu

SEQ ID NO: 4129135 - RNA, 16 nt, Yersinia pestis
aaaguucuucgaucaa

SEQ ID NO: 4129136 - RNA, 15 nt, Yersinia pestis
aaaguugagcagcaa

SEQ ID NO: 4129137 - RNA, 18 nt, Yersinia pestis
aaaguugagcagcaauaa

SEQ ID NO: 4129138 - RNA, 17 nt, Yersinia pestis
aaaguuuagcaaagcau

SEQ ID NO: 4129139 - RNA, 20 nt, Yersinia pestis
aaaguuuagcaaagcaucga

SEQ ID NO: 4129140 - RNA, 18 nt, Yersinia pestis
aaaguuuuuuauuuauag

SEQ ID NO: 4129141 - RNA, 15 nt, Yersinia pestis
aaaguuuuuugaaau

SEQ ID NO: 4129142 - RNA, 17 nt, Yersinia pestis
aaaguuuuuugaaauua

SEQ ID NO: 4129143 - RNA, 18 nt, Yersinia pestis
aaaucccgggaauaauca

SEQ ID NO: 4129144 - RNA, 23 nt, Yersinia pestis
aaaucccgggaauaaucaauuaa

SEQ ID NO: 4129145 - RNA, 20 nt, Yersinia pestis
aaauccgugcugguccuuuu

SEQ ID NO: 4129146 - RNA, 19 nt, Yersinia pestis
aaauccugaauaauacugu

SEQ ID NO: 4129147 - RNA, 24 nt, Yersinia pestis
aaaucgcacugaguucugcugcca

SEQ ID NO: 4129148 - RNA, 16 nt, Yersinia pestis
aaaucguauaacauaa

SEQ ID NO: 4129149 - RNA, 19 nt, Yersinia pestis
aaaucguauaacauaauaa

SEQ ID NO: 4129150 - RNA, 16 nt, Yersinia pestis
aaaucguauuaucaau

SEQ ID NO: 4129151 - RNA, 22 nt, Yersinia pestis
aaaucguauuaucaauagggca

SEQ ID NO: 4129152 - RNA, 21 nt, Yersinia pestis
aaaucuacuuuauucaauacu

SEQ ID NO: 4129153 - RNA, 16 nt, Yersinia pestis
aaaucuagcccuucag

SEQ ID NO: 4129154 - RNA, 20 nt, Yersinia pestis
aaaucuagcccuucagcaaa

SEQ ID NO: 4129155 - RNA, 16 nt, Yersinia pestis
aaaucucaucggcaua

SEQ ID NO: 4129156 - RNA, 18 nt, Yersinia pestis
aaaucuccuccggagagg

SEQ ID NO: 4129157 - RNA, 23 nt, Yersinia pestis
aaaucucuugauuaccaauaauu

SEQ ID NO: 4129158 - RNA, 21 nt, Yersinia pestis
aaaucugacucuguaaaaauc

SEQ ID NO: 4129159 - RNA, 15 nt, Yersinia pestis
aaaucugauacugaa

SEQ ID NO: 4129160 - RNA, 12 nt, Yersinia pestis
aaaucugcggca

SEQ ID NO: 4129161 - RNA, 16 nt, Yersinia pestis
aaaucugcuccaucaa

SEQ ID NO: 4129162 - RNA, 12 nt, Yersinia pestis
aaaucugcuccc

SEQ ID NO: 4129163 - RNA, 19 nt, Yersinia pestis
aaaucuggaauaggggaaa

SEQ ID NO: 4129164 - RNA, 13 nt, Yersinia pestis
aaaucuucauaaa

SEQ ID NO: 4129165 - RNA, 16 nt, Yersinia pestis
aaaucuuuguuacaua

SEQ ID NO: 4129166 - RNA, 20 nt, Yersinia pestis
aaaugaagggggcuuauucu

SEQ ID NO: 4129167 - RNA, 21 nt, Yersinia pestis
aaaugaagggggcuuauucua

SEQ ID NO: 4129168 - RNA, 13 nt, Yersinia pestis
aaaugacauucuu

SEQ ID NO: 4129169 - RNA, 15 nt, Yersinia pestis
aaaugacauucuuug

SEQ ID NO: 4129170 - RNA, 21 nt, Yersinia pestis
aaaugaccaacuguaaaaucu

SEQ ID NO: 4129171 - RNA, 12 nt, Yersinia pestis
aaaugagccugu

SEQ ID NO: 4129172 - RNA, 13 nt, Yersinia pestis
aaaugauggcggc

SEQ ID NO: 4129173 - RNA, 20 nt, Yersinia pestis
aaaugcacugaacaaugcca

SEQ ID NO: 4129174 - RNA, 17 nt, Yersinia pestis
aaaugcauuauaaggaa

SEQ ID NO: 4129175 - RNA, 20 nt, Yersinia pestis
aaaugcccgucgggauaucu

SEQ ID NO: 4129176 - RNA, 17 nt, Yersinia pestis
aaaugccguacaacaau

SEQ ID NO: 4129177 - RNA, 11 nt, Yersinia pestis
aaaugcugacu

SEQ ID NO: 4129178 - RNA, 20 nt, Yersinia pestis
aaaugcuuuuugcgcugcgu

SEQ ID NO: 4129179 - RNA, 21 nt, Yersinia pestis
aaauggcacuggaaacaaaac

SEQ ID NO: 4129180 - RNA, 16 nt, Yersinia pestis
aaauggccuugcccau

SEQ ID NO: 4129181 - RNA, 15 nt, Yersinia pestis
aaauggcuaaacucu

SEQ ID NO: 4129182 - RNA, 19 nt, Yersinia pestis
aaauggcuuuuuuaauaaa

SEQ ID NO: 4129183 - RNA, 23 nt, Yersinia pestis
aaauggcuuuuuuaauaaaaaac

SEQ ID NO: 4129184 - RNA, 23 nt, Yersinia pestis
aaaugguaagucuuauaaugcag

SEQ ID NO: 4129185 - RNA, 16 nt, Yersinia pestis
aaauguaagcuacuaa

SEQ ID NO: 4129186 - RNA, 19 nt, Yersinia pestis
aaauguacuacuucauaau

SEQ ID NO: 4129187 - RNA, 13 nt, Yersinia pestis
aaauguauaaaaa

SEQ ID NO: 4129188 - RNA, 18 nt, Yersinia pestis
aaauguauaaaaaagaua

SEQ ID NO: 4129189 - RNA, 13 nt, Yersinia pestis
aaaugucagaucg

SEQ ID NO: 4129190 - RNA, 14 nt, Yersinia pestis
aaaugucagcguuu

SEQ ID NO: 4129191 - RNA, 15 nt, Yersinia pestis
aaauguccacuguac

SEQ ID NO: 4129192 - RNA, 13 nt, Yersinia pestis
aaauuaaaacuga

SEQ ID NO: 4129193 - RNA, 12 nt, Yersinia pestis
aaauuaaaauaa

SEQ ID NO: 4129194 - RNA, 14 nt, Yersinia pestis
aaauuaaauuuuaa

SEQ ID NO: 4129195 - RNA, 23 nt, Yersinia pestis
aaauuaauaacgccgaguaaguc

SEQ ID NO: 4129196 - RNA, 12 nt, Yersinia pestis
aaauuaauaggu

SEQ ID NO: 4129197 - RNA, 15 nt, Yersinia pestis
aaauuaauauuuaaa

SEQ ID NO: 4129198 - RNA, 14 nt, Yersinia pestis
aaauuaaucuugua

SEQ ID NO: 4129199 - RNA, 16 nt, Yersinia pestis
aaauuaaucuuguaaa

SEQ ID NO: 4129200 - RNA, 22 nt, Yersinia pestis
aaauuaauuacuuuauuuaaaa

SEQ ID NO: 4129201 - RNA, 19 nt, Yersinia pestis
aaauuacucguauaaaaaa

SEQ ID NO: 4129202 - RNA, 12 nt, Yersinia pestis
aaauuacuuuaa

SEQ ID NO: 4129203 - RNA, 14 nt, Yersinia pestis
aaauuagaaaacaa

SEQ ID NO: 4129204 - RNA, 15 nt, Yersinia pestis
aaauuagaaaacaag

SEQ ID NO: 4129205 - RNA, 23 nt, Yersinia pestis
aaauuagcagggcauucgccuga

SEQ ID NO: 4129206 - RNA, 15 nt, Yersinia pestis
aaauuaguuaauuua

SEQ ID NO: 4129207 - RNA, 12 nt, Yersinia pestis
aaauuaucuaau

SEQ ID NO: 4129208 - RNA, 15 nt, Yersinia pestis
aaauuauuaaauaag

SEQ ID NO: 4129209 - RNA, 23 nt, Yersinia pestis
aaauuauuuuagguccagauuuc

SEQ ID NO: 4129210 - RNA, 13 nt, Yersinia pestis
aaauucaaauauc

SEQ ID NO: 4129211 - RNA, 18 nt, Yersinia pestis
aaauucaaauaucauuau

SEQ ID NO: 4129212 - RNA, 12 nt, Yersinia pestis
aaauucaucuuu

SEQ ID NO: 4129213 - RNA, 16 nt, Yersinia pestis
aaauucccguuuuauu

SEQ ID NO: 4129214 - RNA, 21 nt, Yersinia pestis
aaauuccgcuucacauuugaa

SEQ ID NO: 4129215 - RNA, 17 nt, Yersinia pestis
aaauuccuauaaauuuu

SEQ ID NO: 4129216 - RNA, 18 nt, Yersinia pestis
aaauuccuauaaauuuua

SEQ ID NO: 4129217 - RNA, 21 nt, Yersinia pestis
aaauuccuggcggcaacacua

SEQ ID NO: 4129218 - RNA, 23 nt, Yersinia pestis
aaauucgcuuuucgcaucauuaa

SEQ ID NO: 4129219 - RNA, 18 nt, Yersinia pestis
aaauucggcuuguugaau

SEQ ID NO: 4129220 - RNA, 23 nt, Yersinia pestis
aaauucguuucucuaaaauuuua

SEQ ID NO: 4129221 - RNA, 14 nt, Yersinia pestis
aaauucuaucuggu

SEQ ID NO: 4129222 - RNA, 15 nt, Yersinia pestis
aaauucuaucugguu

SEQ ID NO: 4129223 - RNA, 17 nt, Yersinia pestis
aaauucucaaugauaaa

SEQ ID NO: 4129224 - RNA, 22 nt, Yersinia pestis
aaauucucaaugauaaaauccu

SEQ ID NO: 4129225 - RNA, 23 nt, Yersinia pestis
aaauucucaaugauaaaauccug

SEQ ID NO: 4129226 - RNA, 21 nt, Yersinia pestis
aaauucugagaucuaaaaaau

SEQ ID NO: 4129227 - RNA, 16 nt, Yersinia pestis
aaauugacuuuaaaaa

SEQ ID NO: 4129228 - RNA, 23 nt, Yersinia pestis
aaauugacuuuaaaaaaauuauc

SEQ ID NO: 4129229 - RNA, 14 nt, Yersinia pestis
aaauugagauauuu

SEQ ID NO: 4129230 - RNA, 19 nt, Yersinia pestis
aaauugcgcccggcccacu

SEQ ID NO: 4129231 - RNA, 14 nt, Yersinia pestis
aaauugcugaaaaa

SEQ ID NO: 4129232 - RNA, 16 nt, Yersinia pestis
aaauugcugaaaaaaa

SEQ ID NO: 4129233 - RNA, 18 nt, Yersinia pestis
aaauuggcuucacccugg

SEQ ID NO: 4129234 - RNA, 18 nt, Yersinia pestis
aaauugggggucagggcg

SEQ ID NO: 4129235 - RNA, 23 nt, Yersinia pestis
aaauuguauguuucuuuaauaag

SEQ ID NO: 4129236 - RNA, 19 nt, Yersinia pestis
aaauugugaguuaaaaaua

SEQ ID NO: 4129237 - RNA, 20 nt, Yersinia pestis
aaauugugauucaacugccg

SEQ ID NO: 4129238 - RNA, 14 nt, Yersinia pestis
aaauuuaaaguaaa

SEQ ID NO: 4129239 - RNA, 15 nt, Yersinia pestis
aaauuuaucaguagc

SEQ ID NO: 4129240 - RNA, 14 nt, Yersinia pestis
aaauuuauccugua

SEQ ID NO: 4129241 - RNA, 14 nt, Yersinia pestis
aaauuuaucucuau

SEQ ID NO: 4129242 - RNA, 11 nt, Yersinia pestis
aaauuucaaaa

SEQ ID NO: 4129243 - RNA, 21 nt, Yersinia pestis
aaauuucacugugcuuuucuu

SEQ ID NO: 4129244 - RNA, 13 nt, Yersinia pestis
aaauuucucuuuu

SEQ ID NO: 4129245 - RNA, 17 nt, Yersinia pestis
aaauuugacauuuccuu

SEQ ID NO: 4129246 - RNA, 11 nt, Yersinia pestis
aaauuuuauga

SEQ ID NO: 4129247 - RNA, 20 nt, Yersinia pestis
aaauuuuuaccuucuacaaa

SEQ ID NO: 4129248 - RNA, 16 nt, Yersinia pestis
aaauuuuuuauauucc

SEQ ID NO: 4129249 - RNA, 16 nt, Yersinia pestis
aacaaaauagggcgcc

SEQ ID NO: 4129250 - RNA, 23 nt, Yersinia pestis
aacaaaauagggcgccccgauaa

SEQ ID NO: 4129251 - RNA, 14 nt, Yersinia pestis
aacaaacacaucca

SEQ ID NO: 4129252 - RNA, 15 nt, Yersinia pestis
aacaaacacauggcu

SEQ ID NO: 4129253 - RNA, 12 nt, Yersinia pestis
aacaaacagccg

SEQ ID NO: 4129254 - RNA, 19 nt, Yersinia pestis
aacaaacagccgaucaacc

SEQ ID NO: 4129255 - RNA, 13 nt, Yersinia pestis
aacaaagccgcuu

SEQ ID NO: 4129256 - RNA, 15 nt, Yersinia pestis
aacaaaggcgccaag

SEQ ID NO: 4129257 - RNA, 23 nt, Yersinia pestis
aacaaaucuuaaauugaagaguu

SEQ ID NO: 4129258 - RNA, 15 nt, Yersinia pestis
aacaaaugaacccuu

SEQ ID NO: 4129259 - RNA, 20 nt, Yersinia pestis
aacaaaugggccacaggcug

SEQ ID NO: 4129260 - RNA, 24 nt, Yersinia pestis
aacaaauucggcuuguugaaucaa

SEQ ID NO: 4129261 - RNA, 12 nt, Yersinia pestis
aacaacaacaca

SEQ ID NO: 4129262 - RNA, 15 nt, Yersinia pestis
aacaaccaagcuuug

SEQ ID NO: 4129263 - RNA, 17 nt, Yersinia pestis
aacaacccgaauuaaua

SEQ ID NO: 4129264 - RNA, 22 nt, Yersinia pestis
aacaaccguggcgucgcccguu

SEQ ID NO: 4129265 - RNA, 14 nt, Yersinia pestis
aacaucuaccucug

SEQ ID NO: 4129266 - RNA, 23 nt, Yersinia pestis
aacaucugccaggcgacaugguc

SEQ ID NO: 4129267 - RNA, 15 nt, Yersinia pestis
aacaugagccacaca

SEQ ID NO: 4129268 - RNA, 22 nt, Yersinia pestis
aacaugagccacacauucaguc

SEQ ID NO: 4129269 - RNA, 14 nt, Yersinia pestis
aacaugccauugau

SEQ ID NO: 4129270 - RNA, 12 nt, Yersinia pestis
aacaugcugaag

SEQ ID NO: 4129271 - RNA, 17 nt, Yersinia pestis
aacaugcugaagccagc

SEQ ID NO: 4129272 - RNA, 19 nt, Yersinia pestis
aacaugcugaagccagcac

SEQ ID NO: 4129273 - RNA, 21 nt, Yersinia pestis
aacaugcugaagccagcaccg

SEQ ID NO: 4129274 - RNA, 16 nt, Yersinia pestis
aacauggacggcauau

SEQ ID NO: 4129275 - RNA, 19 nt, Yersinia pestis
aacaugguccacagucagu

SEQ ID NO: 4129276 - RNA, 22 nt, Yersinia pestis
aacaugguuaagagaucccgug

SEQ ID NO: 4129277 - RNA, 12 nt, Yersinia pestis
aacauuaaaaau

SEQ ID NO: 4129278 - RNA, 13 nt, Yersinia pestis
aacauuaacucau

SEQ ID NO: 4129279 - RNA, 14 nt, Yersinia pestis
aacauuaacucauu

SEQ ID NO: 4129280 - RNA, 22 nt, Yersinia pestis
aacauuagggccaccagacuga

SEQ ID NO: 4129281 - RNA, 14 nt, Yersinia pestis
aacauucaucuuuu

SEQ ID NO: 4129282 - RNA, 23 nt, Yersinia pestis
aacauuguuaccuaaccaaacau

SEQ ID NO: 4129283 - RNA, 21 nt, Yersinia pestis
aacauuucauuccagauaaaa

SEQ ID NO: 4129284 - RNA, 15 nt, Yersinia pestis
aacauuuuuagcuuc

SEQ ID NO: 4129285 - RNA, 14 nt, Yersinia pestis
aacauuuuuucuuu

SEQ ID NO: 4129286 - RNA, 13 nt, Yersinia pestis
aaccaaaaacucc

SEQ ID NO: 4129287 - RNA, 12 nt, Yersinia pestis
aaccaaaaccuu

SEQ ID NO: 4129288 - RNA, 13 nt, Yersinia pestis
aaccaaacauugu

SEQ ID NO: 4129289 - RNA, 18 nt, Yersinia pestis
aaccaaauuacuuuaaag

SEQ ID NO: 4129290 - RNA, 14 nt, Yersinia pestis
aaccaacaaacaau

SEQ ID NO: 4129291 - RNA, 20 nt, Yersinia pestis
aaccaacaauauucgcagcc

SEQ ID NO: 4129292 - RNA, 16 nt, Yersinia pestis
aaccaacguuauugac

SEQ ID NO: 4129293 - RNA, 15 nt, Yersinia pestis
aaccaacugaaacug

SEQ ID NO: 4129294 - RNA, 16 nt, Yersinia pestis
aaccaaggugguaucu

SEQ ID NO: 4129295 - RNA, 15 nt, Yersinia pestis
aaccaauacacagca

SEQ ID NO: 4129296 - RNA, 16 nt, Yersinia pestis
aaccaauacacagcac

SEQ ID NO: 4129297 - RNA, 20 nt, Yersinia pestis
aaccaauagaccguagaaac

SEQ ID NO: 4129298 - RNA, 21 nt, Yersinia pestis
aaccacauuuuuuaaaaccaa

SEQ ID NO: 4129299 - RNA, 14 nt, Yersinia pestis
aaccaccaaaauag

SEQ ID NO: 4129300 - RNA, 20 nt, Yersinia pestis
aaccacccgacaucaagaaa

SEQ ID NO: 4129301 - RNA, 18 nt, Yersinia pestis
aaccaccggguuuaguau

SEQ ID NO: 4129302 - RNA, 16 nt, Yersinia pestis
aaccaccgucaccaaa

SEQ ID NO: 4129303 - RNA, 15 nt, Yersinia pestis
aaccaccuuaaguaa

SEQ ID NO: 4129304 - RNA, 15 nt, Yersinia pestis
aaccacgguaucaau

SEQ ID NO: 4129305 - RNA, 13 nt, Yersinia pestis
aaccacgucuacg

SEQ ID NO: 4129306 - RNA, 17 nt, Yersinia pestis
aaccacuaaaccacaua

SEQ ID NO: 4129307 - RNA, 13 nt, Yersinia pestis
aaccacugaccua

SEQ ID NO: 4129308 - RNA, 14 nt, Yersinia pestis
aaccacugaccuau

SEQ ID NO: 4129309 - RNA, 18 nt, Yersinia pestis
aaccacugaccuauugau

SEQ ID NO: 4129310 - RNA, 21 nt, Yersinia pestis
aaccacugaccuauugauaaa

SEQ ID NO: 4129311 - RNA, 19 nt, Yersinia pestis
aaccacuuauccagcucau

SEQ ID NO: 4129312 - RNA, 20 nt, Yersinia pestis
aaccagacguuaugaauaaa

SEQ ID NO: 4129313 - RNA, 14 nt, Yersinia pestis
aaccagagacagca

SEQ ID NO: 4129314 - RNA, 19 nt, Yersinia pestis
aaccagagacagcaacaaa

SEQ ID NO: 4129315 - RNA, 20 nt, Yersinia pestis
aaccagagcggagccucagu

SEQ ID NO: 4129316 - RNA, 21 nt, Yersinia pestis
aaccagagcggagccucaguu

SEQ ID NO: 4129317 - RNA, 14 nt, Yersinia pestis
aaccagcaagccgu

SEQ ID NO: 4129318 - RNA, 14 nt, Yersinia pestis
aaccagcguugaga

SEQ ID NO: 4129319 - RNA, 17 nt, Yersinia pestis
aaccaggucaguuuuac

SEQ ID NO: 4129320 - RNA, 15 nt, Yersinia pestis
aaccaggugcagaua

SEQ ID NO: 4129321 - RNA, 17 nt, Yersinia pestis
aaccaggugcagauaaa

SEQ ID NO: 4129322 - RNA, 22 nt, Yersinia pestis
aaccagugccgcccagcgacgc

SEQ ID NO: 4129323 - RNA, 21 nt, Yersinia pestis
aaccagugcgccguaaaucgu

SEQ ID NO: 4129324 - RNA, 20 nt, Yersinia pestis
aaccaguucugguagcugcu

SEQ ID NO: 4129325 - RNA, 19 nt, Yersinia pestis
aaccauaaaauaaauaauu

SEQ ID NO: 4129326 - RNA, 20 nt, Yersinia pestis
aaccauaaaauaaauaauuu

SEQ ID NO: 4129327 - RNA, 15 nt, Yersinia pestis
aaccaucaaauacac

SEQ ID NO: 4129328 - RNA, 11 nt, Yersinia pestis
aaccaucagcg

SEQ ID NO: 4129329 - RNA, 22 nt, Yersinia pestis
aaccaucagcgauagcugcuuu

SEQ ID NO: 4129330 - RNA, 20 nt, Yersinia pestis
aaccauccccagaacagcua

SEQ ID NO: 4129331 - RNA, 19 nt, Yersinia pestis
aaccaucgcucuccugccc

SEQ ID NO: 4129332 - RNA, 15 nt, Yersinia pestis
aaccaucugaugcag

SEQ ID NO: 4129333 - RNA, 15 nt, Yersinia pestis
aaccaugaugacaau

SEQ ID NO: 4129334 - RNA, 15 nt, Yersinia pestis
aaccauggcacucuc

SEQ ID NO: 4129335 - RNA, 21 nt, Yersinia pestis
aaccauggcucaccauaaauu

SEQ ID NO: 4129336 - RNA, 11 nt, Yersinia pestis
aaccauuuacc

SEQ ID NO: 4129337 - RNA, 20 nt, Yersinia pestis
aaccauuuuacuaaaccagu

SEQ ID NO: 4129338 - RNA, 23 nt, Yersinia pestis
aacccaaagcccuuauccguuaa

SEQ ID NO: 4129339 - RNA, 16 nt, Yersinia pestis
aacccacaucccggca

SEQ ID NO: 4129340 - RNA, 21 nt, Yersinia pestis
aacccagccccuaacagcagu

SEQ ID NO: 4129341 - RNA, 17 nt, Yersinia pestis
aacccauaaguccuuaa

SEQ ID NO: 4129342 - RNA, 17 nt, Yersinia pestis
aacccauauuacucaca

SEQ ID NO: 4129343 - RNA, 23 nt, Yersinia pestis
aacccauuaaaaacaaaugauua

SEQ ID NO: 4129344 - RNA, 17 nt, Yersinia pestis
aacccauucaucaaacu

SEQ ID NO: 4129345 - RNA, 16 nt, Yersinia pestis
aacccauugguuuuua

SEQ ID NO: 4129346 - RNA, 23 nt, Yersinia pestis
aacccauuuccccuuucuggugg

SEQ ID NO: 4129347 - RNA, 19 nt, Yersinia pestis
aacccauuugcacagcauu

SEQ ID NO: 4129348 - RNA, 21 nt, Yersinia pestis
aacccauuugcacagcauuua

SEQ ID NO: 4129349 - RNA, 15 nt, Yersinia pestis
aaccccaacugaaug

SEQ ID NO: 4129350 - RNA, 24 nt, Yersinia pestis
aaccccacccugugaaauaccgau

SEQ ID NO: 4129351 - RNA, 13 nt, Yersinia pestis
aaccccauauugc

SEQ ID NO: 4129352 - RNA, 16 nt, Yersinia pestis
aacccccugcuaggca

SEQ ID NO: 4129353 - RNA, 15 nt, Yersinia pestis
aaccccgaugacuca

SEQ ID NO: 4129354 - RNA, 22 nt, Yersinia pestis
aaccccguagcacacacagccu

SEQ ID NO: 4129355 - RNA, 14 nt, Yersinia pestis
aaccccgugccagg

SEQ ID NO: 4129356 - RNA, 13 nt, Yersinia pestis
aaccccuagccag

SEQ ID NO: 4129357 - RNA, 22 nt, Yersinia pestis
aacccgauuaccguagauaauu

SEQ ID NO: 4129358 - RNA, 17 nt, Yersinia pestis
aacccgcuaacaugcca

SEQ ID NO: 4129359 - RNA, 15 nt, Yersinia pestis
aacccggcaucaacc

SEQ ID NO: 4129360 - RNA, 12 nt, Yersinia pestis
aacccggcgacg

SEQ ID NO: 4129361 - RNA, 14 nt, Yersinia pestis
aacccggcuguuaa

SEQ ID NO: 4129362 - RNA, 16 nt, Yersinia pestis
aacccggcuguuaaau

SEQ ID NO: 4129363 - RNA, 22 nt, Yersinia pestis
aacccguauuaguccguagaaa

SEQ ID NO: 4129364 - RNA, 23 nt, Yersinia pestis
aacccguucgcgguuuacggcaa

SEQ ID NO: 4129365 - RNA, 24 nt, Yersinia pestis
aacccguucgcgguuuacggcaau

SEQ ID NO: 4129366 - RNA, 12 nt, Yersinia pestis
aacccugacggc

SEQ ID NO: 4129367 - RNA, 16 nt, Yersinia pestis
aaccgaagcugcggcu

SEQ ID NO: 4129368 - RNA, 22 nt, Yersinia pestis
aaccgaauaauauuaaagccau

SEQ ID NO: 4129369 - RNA, 19 nt, Yersinia pestis
aaccgacaucaaccguuaa

SEQ ID NO: 4129370 - RNA, 13 nt, Yersinia pestis
aaccgagaagucg

SEQ ID NO: 4129371 - RNA, 16 nt, Yersinia pestis
aaccgagccugcuuua

SEQ ID NO: 4129372 - RNA, 20 nt, Yersinia pestis
aaccgaguaacaaaugguca

SEQ ID NO: 4129373 - RNA, 21 nt, Yersinia pestis
aaccgaguucagaucgcauuu

SEQ ID NO: 4129374 - RNA, 21 nt, Yersinia pestis
aaccgaugaagaagcguucaa

SEQ ID NO: 4129375 - RNA, 14 nt, Yersinia pestis
aaccgauuucagca

SEQ ID NO: 4129376 - RNA, 16 nt, Yersinia pestis
aaccgcagacauaucu

SEQ ID NO: 4129377 - RNA, 23 nt, Yersinia pestis
aaccgcaucauuguuuacuauuu

SEQ ID NO: 4129378 - RNA, 13 nt, Yersinia pestis
aaccgccauugca

SEQ ID NO: 4129379 - RNA, 15 nt, Yersinia pestis
aaccgccccccaucc

SEQ ID NO: 4129380 - RNA, 17 nt, Yersinia pestis
aaccgccccccaucccc

SEQ ID NO: 4129381 - RNA, 16 nt, Yersinia pestis
aaccgcccucuugaac

SEQ ID NO: 4129382 - RNA, 21 nt, Yersinia pestis
aaccgcuauaucaucagcaga

SEQ ID NO: 4129383 - RNA, 23 nt, Yersinia pestis
aaccgcugaaguggcugaauauc

SEQ ID NO: 4129384 - RNA, 18 nt, Yersinia pestis
aaccgcuugcauacgcuu

SEQ ID NO: 4129385 - RNA, 17 nt, Yersinia pestis
aaccgcuuuuuacccag

SEQ ID NO: 4129386 - RNA, 14 nt, Yersinia pestis
aaccggauaaaaca

SEQ ID NO: 4129387 - RNA, 19 nt, Yersinia pestis
aacguuguuauuucuguuc

SEQ ID NO: 4129388 - RNA, 22 nt, Yersinia pestis
aacguuucuggaaugagaugaa

SEQ ID NO: 4129389 - RNA, 16 nt, Yersinia pestis
aacuaaacagaucacc

SEQ ID NO: 4129390 - RNA, 18 nt, Yersinia pestis
aacuaaacagaucacccg

SEQ ID NO: 4129391 - RNA, 20 nt, Yersinia pestis
aacuaaacagggcagaaaau

SEQ ID NO: 4129392 - RNA, 16 nt, Yersinia pestis
aacuaacguuuuguaa

SEQ ID NO: 4129393 - RNA, 21 nt, Yersinia pestis
aacuaacguuuuguaaucaac

SEQ ID NO: 4129394 - RNA, 19 nt, Yersinia pestis
aacuaagagucacagcauu

SEQ ID NO: 4129395 - RNA, 15 nt, Yersinia pestis
aacuaagaguccuua

SEQ ID NO: 4129396 - RNA, 13 nt, Yersinia pestis
aacuaaggggcca

SEQ ID NO: 4129397 - RNA, 18 nt, Yersinia pestis
aacuaccgaucaucaggc

SEQ ID NO: 4129398 - RNA, 23 nt, Yersinia pestis
aacuacgauguaaucugaauagg

SEQ ID NO: 4129399 - RNA, 23 nt, Yersinia pestis
aacuacgccucgcagauccagaa

SEQ ID NO: 4129400 - RNA, 16 nt, Yersinia pestis
aacuacuccaucccca

SEQ ID NO: 4129401 - RNA, 22 nt, Yersinia pestis
aacuacuccauccccaacucuu

SEQ ID NO: 4129402 - RNA, 19 nt, Yersinia pestis
aacuagcgccgcaucaaag

SEQ ID NO: 4129403 - RNA, 20 nt, Yersinia pestis
aacuauauucucauugcccc

SEQ ID NO: 4129404 - RNA, 16 nt, Yersinia pestis
aacuaucgccugggcg

SEQ ID NO: 4129405 - RNA, 14 nt, Yersinia pestis
aacuauuagcgcuu

SEQ ID NO: 4129406 - RNA, 21 nt, Yersinia pestis
aacuauuggucaaucuagagg

SEQ ID NO: 4129407 - RNA, 15 nt, Yersinia pestis
aacuauuuggugguu

SEQ ID NO: 4129408 - RNA, 13 nt, Yersinia pestis
aacucaaaacaau

SEQ ID NO: 4129409 - RNA, 16 nt, Yersinia pestis
aacucaaacugauaaa

SEQ ID NO: 4129410 - RNA, 21 nt, Yersinia pestis
aacucaaacugauaaagcaaa

SEQ ID NO: 4129411 - RNA, 22 nt, Yersinia pestis
aacucaccgagcauauuuuuua

SEQ ID NO: 4129412 - RNA, 16 nt, Yersinia pestis
aacucaccuaaaucau

SEQ ID NO: 4129413 - RNA, 18 nt, Yersinia pestis
aacucaccuaaaucauac

SEQ ID NO: 4129414 - RNA, 19 nt, Yersinia pestis
aacucaccuaaaucauaca

SEQ ID NO: 4129415 - RNA, 21 nt, Yersinia pestis
aacucacgguuucuaaaaaau

SEQ ID NO: 4129416 - RNA, 16 nt, Yersinia pestis
aacucacguaccaaau

SEQ ID NO: 4129417 - RNA, 22 nt, Yersinia pestis
aacucagcagagucgcaaaaaa

SEQ ID NO: 4129418 - RNA, 19 nt, Yersinia pestis
aacucagccaauccagcaa

SEQ ID NO: 4129419 - RNA, 16 nt, Yersinia pestis
aacucagccaucaguu

SEQ ID NO: 4129420 - RNA, 15 nt, Yersinia pestis
aacucagccauugcu

SEQ ID NO: 4129421 - RNA, 20 nt, Yersinia pestis
aacucagcgaauaaauaauu

SEQ ID NO: 4129422 - RNA, 22 nt, Yersinia pestis
aacucaggauccucgucguaau

SEQ ID NO: 4129423 - RNA, 11 nt, Yersinia pestis
aacucagggcu

SEQ ID NO: 4129424 - RNA, 12 nt, Yersinia pestis
aacucaucagcg

SEQ ID NO: 4129425 - RNA, 18 nt, Yersinia pestis
aacucaugacaucccagc

SEQ ID NO: 4129426 - RNA, 21 nt, Yersinia pestis
aacucauuuaucuaaaacugc

SEQ ID NO: 4129427 - RNA, 23 nt, Yersinia pestis
aacuccaggguaauaagugauca

SEQ ID NO: 4129428 - RNA, 23 nt, Yersinia pestis
aacucccgauucagcucugccag

SEQ ID NO: 4129429 - RNA, 21 nt, Yersinia pestis
aacucgccacccgcuuucaga

SEQ ID NO: 4129430 - RNA, 15 nt, Yersinia pestis
aacucgcgccugaaa

SEQ ID NO: 4129431 - RNA, 22 nt, Yersinia pestis
aacucuaaggguaaaaucccca

SEQ ID NO: 4129432 - RNA, 16 nt, Yersinia pestis
aacucuggcacuggca

SEQ ID NO: 4129433 - RNA, 17 nt, Yersinia pestis
aacucuggcacuggcaa

SEQ ID NO: 4129434 - RNA, 18 nt, Yersinia pestis
aacucuuuuuaaacuauu

SEQ ID NO: 4129435 - RNA, 20 nt, Yersinia pestis
aacucuuuuuaaacuauuag

SEQ ID NO: 4129436 - RNA, 20 nt, Yersinia pestis
aacugaaaauacuacucaaa

SEQ ID NO: 4129437 - RNA, 17 nt, Yersinia pestis
aacugaauggauugaaa

SEQ ID NO: 4129438 - RNA, 20 nt, Yersinia pestis
aacugacucacgucaguaau

SEQ ID NO: 4129439 - RNA, 19 nt, Yersinia pestis
aacugagaauaaucacagg

SEQ ID NO: 4129440 - RNA, 13 nt, Yersinia pestis
aacugagugagcg

SEQ ID NO: 4129441 - RNA, 23 nt, Yersinia pestis
aacugaguuggaaaugacaaauc

SEQ ID NO: 4129442 - RNA, 16 nt, Yersinia pestis
aacugauaaaccgcua

SEQ ID NO: 4129443 - RNA, 21 nt, Yersinia pestis
aacugauauaaagcauuuauc

SEQ ID NO: 4129444 - RNA, 13 nt, Yersinia pestis
aacugaucacugg

SEQ ID NO: 4129445 - RNA, 15 nt, Yersinia pestis
aacugaucacuggca

SEQ ID NO: 4129446 - RNA, 18 nt, Yersinia pestis
aacugaucguuugauuaa

SEQ ID NO: 4129447 - RNA, 17 nt, Yersinia pestis
aacugauguauucccuc

SEQ ID NO: 4129448 - RNA, 17 nt, Yersinia pestis
aacugcauagcuaaccu

SEQ ID NO: 4129449 - RNA, 19 nt, Yersinia pestis
aacugcauagcuaaccuua

SEQ ID NO: 4129450 - RNA, 13 nt, Yersinia pestis
aacugcgaccaaa

SEQ ID NO: 4129451 - RNA, 21 nt, Yersinia pestis
aacugcgauaacguauugcug

SEQ ID NO: 4129452 - RNA, 21 nt, Yersinia pestis
aacugcggcaauaagcauuau

SEQ ID NO: 4129453 - RNA, 14 nt, Yersinia pestis
aacugcggcauuaa

SEQ ID NO: 4129454 - RNA, 22 nt, Yersinia pestis
aacugcggcauuaaugcagguu

SEQ ID NO: 4129455 - RNA, 14 nt, Yersinia pestis
aacugcucaacugc

SEQ ID NO: 4129456 - RNA, 15 nt, Yersinia pestis
aacugcucaacugcu

SEQ ID NO: 4129457 - RNA, 22 nt, Yersinia pestis
aacugcucauaaagcaucagac

SEQ ID NO: 4129458 - RNA, 20 nt, Yersinia pestis
aacugcuggccaacugcgcc

SEQ ID NO: 4129459 - RNA, 21 nt, Yersinia pestis
aacugcuggccaacugcgccu

SEQ ID NO: 4129460 - RNA, 22 nt, Yersinia pestis
aacuggcccgcguggcaacagu

SEQ ID NO: 4129461 - RNA, 15 nt, Yersinia pestis
aacuggcggggcaaa

SEQ ID NO: 4129462 - RNA, 16 nt, Yersinia pestis
aacuggcuccgcacgg

SEQ ID NO: 4129463 - RNA, 20 nt, Yersinia pestis
aacugggcgacaaucaaugg

SEQ ID NO: 4129464 - RNA, 13 nt, Yersinia pestis
aacuguaaaaucu

SEQ ID NO: 4129465 - RNA, 16 nt, Yersinia pestis
aacuguaaaaucuuuc

SEQ ID NO: 4129466 - RNA, 19 nt, Yersinia pestis
aacuguaaggccaaacccg

SEQ ID NO: 4129467 - RNA, 21 nt, Yersinia pestis
aacuguccgcaauagccaaga

SEQ ID NO: 4129468 - RNA, 17 nt, Yersinia pestis
aacuguggcaugacuga

SEQ ID NO: 4129469 - RNA, 16 nt, Yersinia pestis
aacuguguuuauacca

SEQ ID NO: 4129470 - RNA, 17 nt, Yersinia pestis
aacuguguuuauaccaa

SEQ ID NO: 4129471 - RNA, 20 nt, Yersinia pestis
aacuguucuuauugcuaucu

SEQ ID NO: 4129472 - RNA, 23 nt, Yersinia pestis
aacuguucuuauugcuaucuguu

SEQ ID NO: 4129473 - RNA, 23 nt, Yersinia pestis
aacuguuuugcugauucagauuu

SEQ ID NO: 4129474 - RNA, 20 nt, Yersinia pestis
aacuguuuuuuaaagaaaaa

SEQ ID NO: 4129475 - RNA, 20 nt, Yersinia pestis
aacuuaagauagccggauua

SEQ ID NO: 4129476 - RNA, 15 nt, Yersinia pestis
aacuuaucgacacca

SEQ ID NO: 4129477 - RNA, 15 nt, Yersinia pestis
aacuuaucgaccaac

SEQ ID NO: 4129478 - RNA, 24 nt, Yersinia pestis
aacuuaucgaccaacuggcaauca

SEQ ID NO: 4129479 - RNA, 16 nt, Yersinia pestis
aacuuauggggcacuu

SEQ ID NO: 4129480 - RNA, 20 nt, Yersinia pestis
aacuucaaaaucaaguugau

SEQ ID NO: 4129481 - RNA, 21 nt, Yersinia pestis
aacuucaaaucgccaaacugc

SEQ ID NO: 4129482 - RNA, 22 nt, Yersinia pestis
aacuucaaaucgccaaacugcu

SEQ ID NO: 4129483 - RNA, 15 nt, Yersinia pestis
aacuucaagccgaua

SEQ ID NO: 4129484 - RNA, 12 nt, Yersinia pestis
aacuucagagcc

SEQ ID NO: 4129485 - RNA, 17 nt, Yersinia pestis
aacuucaguuacucacu

SEQ ID NO: 4129486 - RNA, 18 nt, Yersinia pestis
aacuucaucggauugaac

SEQ ID NO: 4129487 - RNA, 19 nt, Yersinia pestis
aacuucaugacgaaaaaca

SEQ ID NO: 4129488 - RNA, 14 nt, Yersinia pestis
aacuucauuuuucu

SEQ ID NO: 4129489 - RNA, 20 nt, Yersinia pestis
aacuuccagcguauguuccu

SEQ ID NO: 4129490 - RNA, 15 nt, Yersinia pestis
aacuuccuaacaaua

SEQ ID NO: 4129491 - RNA, 13 nt, Yersinia pestis
aacuuccuuugcc

SEQ ID NO: 4129492 - RNA, 14 nt, Yersinia pestis
aacuucuuuaucua

SEQ ID NO: 4129493 - RNA, 23 nt, Yersinia pestis
aacuucuuuaucuaaaauaucuu

SEQ ID NO: 4129494 - RNA, 14 nt, Yersinia pestis
aacuuuaacuucca

SEQ ID NO: 4129495 - RNA, 14 nt, Yersinia pestis
aacuuuaucagucu

SEQ ID NO: 4129496 - RNA, 18 nt, Yersinia pestis
aacuuuaucagucuguag

SEQ ID NO: 4129497 - RNA, 18 nt, Yersinia pestis
aacuuucaucccuuuagc

SEQ ID NO: 4129498 - RNA, 15 nt, Yersinia pestis
aacuuucccagucau

SEQ ID NO: 4129499 - RNA, 13 nt, Yersinia pestis
aacuuucucuuuc

SEQ ID NO: 4129500 - RNA, 12 nt, Yersinia pestis
aacuuugccagu

SEQ ID NO: 4129501 - RNA, 13 nt, Yersinia pestis
aacuuuggcaaag

SEQ ID NO: 4129502 - RNA, 19 nt, Yersinia pestis
aacuuuggguauaugacug

SEQ ID NO: 4129503 - RNA, 13 nt, Yersinia pestis
aacuuuucaguuu

SEQ ID NO: 4129504 - RNA, 23 nt, Yersinia pestis
aacuuuucaguuuuaauuuauga

SEQ ID NO: 4129505 - RNA, 22 nt, Yersinia pestis
aacuuuucaucgcauaggccaa

SEQ ID NO: 4129506 - RNA, 18 nt, Yersinia pestis
aacuuuucuucauugcug

SEQ ID NO: 4129507 - RNA, 19 nt, Yersinia pestis
aacuuuucuucauugcugc

SEQ ID NO: 4129508 - RNA, 21 nt, Yersinia pestis
aagccaccaccacggccagaa

SEQ ID NO: 4129509 - RNA, 18 nt, Yersinia pestis
aagccacgccauucauuu

SEQ ID NO: 4129510 - RNA, 21 nt, Yersinia pestis
aagccagauugugcggcuggc

SEQ ID NO: 4129511 - RNA, 13 nt, Yersinia pestis
aagccagucaggg

SEQ ID NO: 4129512 - RNA, 14 nt, Yersinia pestis
aagccagucagggc

SEQ ID NO: 4129513 - RNA, 16 nt, Yersinia pestis
aagccagugucaggau

SEQ ID NO: 4129514 - RNA, 22 nt, Yersinia pestis
aagccaucgacuaauuaaacaa

SEQ ID NO: 4129515 - RNA, 16 nt, Yersinia pestis
aagccauuagcaguau

SEQ ID NO: 4129516 - RNA, 15 nt, Yersinia pestis
aagcccucauuuucg

SEQ ID NO: 4129517 - RNA, 17 nt, Yersinia pestis
aagccgacgaucuugcc

SEQ ID NO: 4129518 - RNA, 17 nt, Yersinia pestis
aagccgcaccgagccac

SEQ ID NO: 4129519 - RNA, 13 nt, Yersinia pestis
aagccgcugcuca

SEQ ID NO: 4129520 - RNA, 20 nt, Yersinia pestis
aagccgguaucaacucugau

SEQ ID NO: 4129521 - RNA, 15 nt, Yersinia pestis
aagccucaugaauga

SEQ ID NO: 4129522 - RNA, 16 nt, Yersinia pestis
aagccucaugaaugag

SEQ ID NO: 4129523 - RNA, 9 nt, Yersinia pestis
aagccucuu

SEQ ID NO: 4129524 - RNA, 16 nt, Yersinia pestis
aagccuucaaccugaa

SEQ ID NO: 4129525 - RNA, 14 nt, Yersinia pestis
aagccuucauucaa

SEQ ID NO: 4129526 - RNA, 21 nt, Yersinia pestis
aagcgaucaccucuugcauac

SEQ ID NO: 4129527 - RNA, 13 nt, Yersinia pestis
aagcgauccugcu

SEQ ID NO: 4129528 - RNA, 12 nt, Yersinia pestis
aagcgcagugcu

SEQ ID NO: 4129529 - RNA, 11 nt, Yersinia pestis
aagcgcccuga

SEQ ID NO: 4129530 - RNA, 23 nt, Yersinia pestis
aagcgccguaaaaagcagcaaac

SEQ ID NO: 4129531 - RNA, 14 nt, Yersinia pestis
aagcgccugcgaca

SEQ ID NO: 4129532 - RNA, 23 nt, Yersinia pestis
aagcgccuuccuuuuauuuagag

SEQ ID NO: 4129533 - RNA, 20 nt, Yersinia pestis
aagcgcgacgguacugauca

SEQ ID NO: 4129534 - RNA, 18 nt, Yersinia pestis
aagcgcguaucguccagc

SEQ ID NO: 4129535 - RNA, 12 nt, Yersinia pestis
aagcgcucaaau

SEQ ID NO: 4129536 - RNA, 15 nt, Yersinia pestis
aagcgcucaaauacg

SEQ ID NO: 4129537 - RNA, 13 nt, Yersinia pestis
aagcgguaaaugg

SEQ ID NO: 4129538 - RNA, 17 nt, Yersinia pestis
aagcgguuucauggcug

SEQ ID NO: 4129539 - RNA, 18 nt, Yersinia pestis
aagcgguuuuaucaauag

SEQ ID NO: 4129540 - RNA, 16 nt, Yersinia pestis
aagcguagggauaaau

SEQ ID NO: 4129541 - RNA, 19 nt, Yersinia pestis
aagcguauuuugucaugaa

SEQ ID NO: 4129542 - RNA, 13 nt, Yersinia pestis
aagcgucucaagg

SEQ ID NO: 4129543 - RNA, 21 nt, Yersinia pestis
aagcgugacgcugaacagccu

SEQ ID NO: 4129544 - RNA, 20 nt, Yersinia pestis
aagcguggcgcaggaagcgu

SEQ ID NO: 4129545 - RNA, 22 nt, Yersinia pestis
aagcguuaauuauagugaaaac

SEQ ID NO: 4129546 - RNA, 19 nt, Yersinia pestis
aagcuaaacguaaugcgaa

SEQ ID NO: 4129547 - RNA, 17 nt, Yersinia pestis
aagcuacagcgucagau

SEQ ID NO: 4129548 - RNA, 17 nt, Yersinia pestis
aagcuacagcucagacu

SEQ ID NO: 4129549 - RNA, 18 nt, Yersinia pestis
aagcuacagcucagacug

SEQ ID NO: 4129550 - RNA, 22 nt, Yersinia pestis
aagcuacaggcaacgaccuuua

SEQ ID NO: 4129551 - RNA, 21 nt, Yersinia pestis
aagcuacggccuguaccacca

SEQ ID NO: 4129552 - RNA, 15 nt, Yersinia pestis
aagcucgccaucgca

SEQ ID NO: 4129553 - RNA, 15 nt, Yersinia pestis
aagcucuacuaauau

SEQ ID NO: 4129554 - RNA, 18 nt, Yersinia pestis
aagcucuacuaauauucc

SEQ ID NO: 4129555 - RNA, 22 nt, Yersinia pestis
aagcugcggcuugggagucaga

SEQ ID NO: 4129556 - RNA, 16 nt, Yersinia pestis
aagcugcucaaugcgu

SEQ ID NO: 4129557 - RNA, 22 nt, Yersinia pestis
aagcugcuuuuaccgcagggcg

SEQ ID NO: 4129558 - RNA, 21 nt, Yersinia pestis
aagcuggagccauaaguaaag

SEQ ID NO: 4129559 - RNA, 14 nt, Yersinia pestis
aagcuggcccugau

SEQ ID NO: 4129560 - RNA, 20 nt, Yersinia pestis
aagcuggcgcacucauccuc

SEQ ID NO: 4129561 - RNA, 14 nt, Yersinia pestis
aagcugggaaggcg

SEQ ID NO: 4129562 - RNA, 15 nt, Yersinia pestis
aagcuuacuguucac

SEQ ID NO: 4129563 - RNA, 16 nt, Yersinia pestis
aagcuuaguauccgcg

SEQ ID NO: 4129564 - RNA, 22 nt, Yersinia pestis
aagcuuauccauuacagcaccu

SEQ ID NO: 4129565 - RNA, 14 nt, Yersinia pestis
aagcuucaacuuaa

SEQ ID NO: 4129566 - RNA, 14 nt, Yersinia pestis
aagcuucucccuuu

SEQ ID NO: 4129567 - RNA, 20 nt, Yersinia pestis
aagcuuuugccacauuuccc

SEQ ID NO: 4129568 - RNA, 23 nt, Yersinia pestis
aaggaaaaguagccaauagacaa

SEQ ID NO: 4129569 - RNA, 20 nt, Yersinia pestis
aaggaauauacuuuacauau

SEQ ID NO: 4129570 - RNA, 19 nt, Yersinia pestis
aaggaauuucacggagaag

SEQ ID NO: 4129571 - RNA, 20 nt, Yersinia pestis
aaggacaguaauauuuucau

SEQ ID NO: 4129572 - RNA, 21 nt, Yersinia pestis
aaggacgacggguauauugcc

SEQ ID NO: 4129573 - RNA, 13 nt, Yersinia pestis
aaggacuuggcgu

SEQ ID NO: 4129574 - RNA, 17 nt, Yersinia pestis
aaggauaaacgaaagag

SEQ ID NO: 4129575 - RNA, 13 nt, Yersinia pestis
aaggauaagcagu

SEQ ID NO: 4129576 - RNA, 14 nt, Yersinia pestis
aaggaugaauaaau

SEQ ID NO: 4129577 - RNA, 14 nt, Yersinia pestis
aaggauggcccaag

SEQ ID NO: 4129578 - RNA, 17 nt, Yersinia pestis
aaggauggcccaagcca

SEQ ID NO: 4129579 - RNA, 20 nt, Yersinia pestis
aaggauuugaagacaacucu

SEQ ID NO: 4129580 - RNA, 18 nt, Yersinia pestis
aaggauuuggaaugaguu

SEQ ID NO: 4129581 - RNA, 21 nt, Yersinia pestis
aaggcaaaaauugacgaaagu

SEQ ID NO: 4129582 - RNA, 13 nt, Yersinia pestis
aaggcaauaccaa

SEQ ID NO: 4129583 - RNA, 13 nt, Yersinia pestis
aaggcaccagcgc

SEQ ID NO: 4129584 - RNA, 13 nt, Yersinia pestis
aaggcagcaagca

SEQ ID NO: 4129585 - RNA, 16 nt, Yersinia pestis
aaggcauccacaucuu

SEQ ID NO: 4129586 - RNA, 22 nt, Yersinia pestis
aaggccaguaguaaaaaaucua

SEQ ID NO: 4129587 - RNA, 16 nt, Yersinia pestis
aaggcccuaaccaauu

SEQ ID NO: 4129588 - RNA, 14 nt, Yersinia pestis
aaggccgaucaaca

SEQ ID NO: 4129589 - RNA, 20 nt, Yersinia pestis
aaggccgcgauaaaaaauaa

SEQ ID NO: 4129590 - RNA, 15 nt, Yersinia pestis
aaggcgagucagcac

SEQ ID NO: 4129591 - RNA, 23 nt, Yersinia pestis
aaggcggagaauguuaaaccccc

SEQ ID NO: 4129592 - RNA, 15 nt, Yersinia pestis
aaggcggaugugggu

SEQ ID NO: 4129593 - RNA, 17 nt, Yersinia pestis
aaggcggcaagcaagca

SEQ ID NO: 4129594 - RNA, 18 nt, Yersinia pestis
aaggcuaaaccggcacag

SEQ ID NO: 4129595 - RNA, 21 nt, Yersinia pestis
aaggcuaaccggguggcccaa

SEQ ID NO: 4129596 - RNA, 14 nt, Yersinia pestis
aaggcuauuuuuau

SEQ ID NO: 4129597 - RNA, 18 nt, Yersinia pestis
aaggcugacggugccaga

SEQ ID NO: 4129598 - RNA, 22 nt, Yersinia pestis
aaggcuggagcaagugcuucaa

SEQ ID NO: 4129599 - RNA, 19 nt, Yersinia pestis
aaggcuuuugggucagggu

SEQ ID NO: 4129600 - RNA, 11 nt, Yersinia pestis
aagggagccau

SEQ ID NO: 4129601 - RNA, 13 nt, Yersinia pestis
aagggauaugaca

SEQ ID NO: 4129602 - RNA, 15 nt, Yersinia pestis
aagggcgcagccccc

SEQ ID NO: 4129603 - RNA, 15 nt, Yersinia pestis
aagggcgcaucccca

SEQ ID NO: 4129604 - RNA, 20 nt, Yersinia pestis
aagggcgcauccccaucgcc

SEQ ID NO: 4129605 - RNA, 21 nt, Yersinia pestis
aagggcggccagcaagagcag

SEQ ID NO: 4129606 - RNA, 21 nt, Yersinia pestis
aagggcguuuugcguuaucuu

SEQ ID NO: 4129607 - RNA, 17 nt, Yersinia pestis
aaggggagccacacacu

SEQ ID NO: 4129608 - RNA, 20 nt, Yersinia pestis
aaggggcguuuaaugccccu

SEQ ID NO: 4129609 - RNA, 18 nt, Yersinia pestis
aagggggggaagcucccc

SEQ ID NO: 4129610 - RNA, 23 nt, Yersinia pestis
aagggguuucagacuccugcccc

SEQ ID NO: 4129611 - RNA, 15 nt, Yersinia pestis
aaggguauaacucau

SEQ ID NO: 4129612 - RNA, 16 nt, Yersinia pestis
aaggguauaacucauc

SEQ ID NO: 4129613 - RNA, 13 nt, Yersinia pestis
aaggguauugaag

SEQ ID NO: 4129614 - RNA, 15 nt, Yersinia pestis
aaggguauugaagau

SEQ ID NO: 4129615 - RNA, 17 nt, Yersinia pestis
aaggguauugaagauac

SEQ ID NO: 4129616 - RNA, 18 nt, Yersinia pestis
aagggucaucaacaaagu

SEQ ID NO: 4129617 - RNA, 22 nt, Yersinia pestis
aagguaaagggccguaacaagg

SEQ ID NO: 4129618 - RNA, 15 nt, Yersinia pestis
aagguagucccucaa

SEQ ID NO: 4129619 - RNA, 21 nt, Yersinia pestis
aagguagucccucaagaccug

SEQ ID NO: 4129620 - RNA, 18 nt, Yersinia pestis
aagguauagcgauagagu

SEQ ID NO: 4129621 - RNA, 21 nt, Yersinia pestis
aagguccaacucccaaauaua

SEQ ID NO: 4129622 - RNA, 18 nt, Yersinia pestis
aaggugaugaaugacugg

SEQ ID NO: 4129623 - RNA, 15 nt, Yersinia pestis
aaggugcuagugcug

SEQ ID NO: 4129624 - RNA, 20 nt, Yersinia pestis
aagguguaguggaagugauc

SEQ ID NO: 4129625 - RNA, 18 nt, Yersinia pestis
aaggugugauugaagcgu

SEQ ID NO: 4129626 - RNA, 16 nt, Yersinia pestis
aagguuaaauuuaaua

SEQ ID NO: 4129627 - RNA, 15 nt, Yersinia pestis
aagguuagcuaugca

SEQ ID NO: 4129628 - RNA, 12 nt, Yersinia pestis
aagguugaccug

SEQ ID NO: 4129629 - RNA, 20 nt, Yersinia pestis
aaguaaaacgugaaacgccu

SEQ ID NO: 4129630 - RNA, 19 nt, Yersinia pestis
aauaacgcuggauaaguga

SEQ ID NO: 4129631 - RNA, 18 nt, Yersinia pestis
aauaacggaaaaucaucg

SEQ ID NO: 4129632 - RNA, 16 nt, Yersinia pestis
aauaacguccugauga

SEQ ID NO: 4129633 - RNA, 14 nt, Yersinia pestis
aauaacuauuuuug

SEQ ID NO: 4129634 - RNA, 21 nt, Yersinia pestis
aauaacuauuuuugacuuuaa

SEQ ID NO: 4129635 - RNA, 14 nt, Yersinia pestis
aauaacucagggcu

SEQ ID NO: 4129636 - RNA, 23 nt, Yersinia pestis
aauaacugccaauauugaccaac

SEQ ID NO: 4129637 - RNA, 23 nt, Yersinia pestis
aauaacugccagggcguuuacca

SEQ ID NO: 4129638 - RNA, 19 nt, Yersinia pestis
aauaacuuauuacaccuua

SEQ ID NO: 4129639 - RNA, 23 nt, Yersinia pestis
aauaacuuauuacaccuuaaaac

SEQ ID NO: 4129640 - RNA, 18 nt, Yersinia pestis
aauaacuucaguuacuca

SEQ ID NO: 4129641 - RNA, 20 nt, Yersinia pestis
aauaacuucgcgaacacaau

SEQ ID NO: 4129642 - RNA, 17 nt, Yersinia pestis
aauaagaucccagagau

SEQ ID NO: 4129643 - RNA, 21 nt, Yersinia pestis
aauaagccagauaucacucag

SEQ ID NO: 4129644 - RNA, 23 nt, Yersinia pestis
aauaagcccaguauugcagagca

SEQ ID NO: 4129645 - RNA, 13 nt, Yersinia pestis
aauaagcucuggg

SEQ ID NO: 4129646 - RNA, 18 nt, Yersinia pestis
aauaaggcgaauaugauu

SEQ ID NO: 4129647 - RNA, 21 nt, Yersinia pestis
aauaaggcgaauaugauuaau

SEQ ID NO: 4129648 - RNA, 18 nt, Yersinia pestis
aauaaggugccacacaga

SEQ ID NO: 4129649 - RNA, 16 nt, Yersinia pestis
aauaaguaaauauuau

SEQ ID NO: 4129650 - RNA, 15 nt, Yersinia pestis
aauaaguacuuccaa

SEQ ID NO: 4129651 - RNA, 23 nt, Yersinia pestis
aauaaguaggcaucugccacacu

SEQ ID NO: 4129652 - RNA, 14 nt, Yersinia pestis
aauaaguauuucaa

SEQ ID NO: 4129653 - RNA, 22 nt, Yersinia pestis
aauaagucacuuuccuuugcuu

SEQ ID NO: 4129654 - RNA, 15 nt, Yersinia pestis
aauaagugaaacaaa

SEQ ID NO: 4129655 - RNA, 19 nt, Yersinia pestis
aauaagugcaaacuuaaaa

SEQ ID NO: 4129656 - RNA, 20 nt, Yersinia pestis
aauaagugcaaacuuaaaaa

SEQ ID NO: 4129657 - RNA, 17 nt, Yersinia pestis
aauaaguguuucaaaua

SEQ ID NO: 4129658 - RNA, 19 nt, Yersinia pestis
aauaaguguuucaaauaag

SEQ ID NO: 4129659 - RNA, 21 nt, Yersinia pestis
aauaaguuacgucagaaauaa

SEQ ID NO: 4129660 - RNA, 12 nt, Yersinia pestis
aauaaguucaga

SEQ ID NO: 4129661 - RNA, 19 nt, Yersinia pestis
aauaaguugauaacgccgg

SEQ ID NO: 4129662 - RNA, 11 nt, Yersinia pestis
aauaauaaaaa

SEQ ID NO: 4129663 - RNA, 12 nt, Yersinia pestis
aauaauaaaaaa

SEQ ID NO: 4129664 - RNA, 16 nt, Yersinia pestis
aauaauaaaaaaaaau

SEQ ID NO: 4129665 - RNA, 15 nt, Yersinia pestis
aauaauaaauaaauu

SEQ ID NO: 4129666 - RNA, 23 nt, Yersinia pestis
aauaauaacgguuuuaacaucau

SEQ ID NO: 4129667 - RNA, 24 nt, Yersinia pestis
aauaauaacgguuuuaacaucauu

SEQ ID NO: 4129668 - RNA, 13 nt, Yersinia pestis
aauaauagauagu

SEQ ID NO: 4129669 - RNA, 16 nt, Yersinia pestis
aauaauagauaguacu

SEQ ID NO: 4129670 - RNA, 14 nt, Yersinia pestis
aauaauauaauuca

SEQ ID NO: 4129671 - RNA, 14 nt, Yersinia pestis
aauaauaucaauga

SEQ ID NO: 4129672 - RNA, 16 nt, Yersinia pestis
aauaauaucaaugaug

SEQ ID NO: 4129673 - RNA, 14 nt, Yersinia pestis
aauaauauucaaua

SEQ ID NO: 4129674 - RNA, 16 nt, Yersinia pestis
aauaaucaccagacaa

SEQ ID NO: 4129675 - RNA, 14 nt, Yersinia pestis
aauaaucauaucaa

SEQ ID NO: 4129676 - RNA, 15 nt, Yersinia pestis
aauaaucauaucaaa

SEQ ID NO: 4129677 - RNA, 22 nt, Yersinia pestis
aauaaucauaucaaaauaaaaa

SEQ ID NO: 4129678 - RNA, 20 nt, Yersinia pestis
aauaaucgggaaauugugau

SEQ ID NO: 4129679 - RNA, 17 nt, Yersinia pestis
aauaaucuaaauuaaua

SEQ ID NO: 4129680 - RNA, 18 nt, Yersinia pestis
aauaaucuuaaguaaauu

SEQ ID NO: 4129681 - RNA, 21 nt, Yersinia pestis
aauaaugaccacgcaucaaua

SEQ ID NO: 4129682 - RNA, 16 nt, Yersinia pestis
aauaaugagccauaaa

SEQ ID NO: 4129683 - RNA, 20 nt, Yersinia pestis
aauaaugcaccaaucaacau

SEQ ID NO: 4129684 - RNA, 16 nt, Yersinia pestis
aauaauuaaucuuaau

SEQ ID NO: 4129685 - RNA, 14 nt, Yersinia pestis
aauaauuaauuuca

SEQ ID NO: 4129686 - RNA, 21 nt, Yersinia pestis
aauaauuaggauuuauuuuug

SEQ ID NO: 4129687 - RNA, 20 nt, Yersinia pestis
aauaauuauaccuacccuuu

SEQ ID NO: 4129688 - RNA, 14 nt, Yersinia pestis
aauaauucagguug

SEQ ID NO: 4129689 - RNA, 22 nt, Yersinia pestis
aauaauucauaugacaaauaag

SEQ ID NO: 4129690 - RNA, 20 nt, Yersinia pestis
aauaauugccgcucaaguug

SEQ ID NO: 4129691 - RNA, 14 nt, Yersinia pestis
aauaauuuguaaau

SEQ ID NO: 4129692 - RNA, 13 nt, Yersinia pestis
aauaauuuuaugg

SEQ ID NO: 4129693 - RNA, 20 nt, Yersinia pestis
aauaauuuuucuuccaccau

SEQ ID NO: 4129694 - RNA, 18 nt, Yersinia pestis
aauacaaauauaaugcug

SEQ ID NO: 4129695 - RNA, 15 nt, Yersinia pestis
aauacaaccaacaaa

SEQ ID NO: 4129696 - RNA, 18 nt, Yersinia pestis
aauacaacguuuaguaau

SEQ ID NO: 4129697 - RNA, 18 nt, Yersinia pestis
aauacaauuauuuuuaca

SEQ ID NO: 4129698 - RNA, 20 nt, Yersinia pestis
aauacaccuucuuuaucugu

SEQ ID NO: 4129699 - RNA, 18 nt, Yersinia pestis
aauacacgcuuccaguaa

SEQ ID NO: 4129700 - RNA, 20 nt, Yersinia pestis
aauacacucguggugauuaa

SEQ ID NO: 4129701 - RNA, 21 nt, Yersinia pestis
aauacacucguggugauuaau

SEQ ID NO: 4129702 - RNA, 22 nt, Yersinia pestis
aauacaggguaaauuauuuuag

SEQ ID NO: 4129703 - RNA, 14 nt, Yersinia pestis
aauacauagaagcu

SEQ ID NO: 4129704 - RNA, 20 nt, Yersinia pestis
aauacauaucaacacugccu

SEQ ID NO: 4129705 - RNA, 14 nt, Yersinia pestis
aauacaucaucaaa

SEQ ID NO: 4129706 - RNA, 14 nt, Yersinia pestis
aauacauccaugua

SEQ ID NO: 4129707 - RNA, 17 nt, Yersinia pestis
aauacaugguaccugua

SEQ ID NO: 4129708 - RNA, 16 nt, Yersinia pestis
aauaccaaaaaucucu

SEQ ID NO: 4129709 - RNA, 13 nt, Yersinia pestis
aauaccaaauuua

SEQ ID NO: 4129710 - RNA, 22 nt, Yersinia pestis
aauaccaaggagauagcgugua

SEQ ID NO: 4129711 - RNA, 12 nt, Yersinia pestis
aauaccacaaca

SEQ ID NO: 4129712 - RNA, 17 nt, Yersinia pestis
aauaccagaugcauaua

SEQ ID NO: 4129713 - RNA, 19 nt, Yersinia pestis
aauaccauuuucagacuga

SEQ ID NO: 4129714 - RNA, 21 nt, Yersinia pestis
aauaccauuuucagacugaaa

SEQ ID NO: 4129715 - RNA, 17 nt, Yersinia pestis
aauacccagcuucuuuu

SEQ ID NO: 4129716 - RNA, 16 nt, Yersinia pestis
aauacccgguuuccag

SEQ ID NO: 4129717 - RNA, 18 nt, Yersinia pestis
aauacccgguuuccaguu

SEQ ID NO: 4129718 - RNA, 15 nt, Yersinia pestis
aauaccgacgugugc

SEQ ID NO: 4129719 - RNA, 18 nt, Yersinia pestis
aauaccgccgguuuuugc

SEQ ID NO: 4129720 - RNA, 14 nt, Yersinia pestis
aauaccgcuaacgu

SEQ ID NO: 4129721 - RNA, 21 nt, Yersinia pestis
aauaccggauuguucagcaac

SEQ ID NO: 4129722 - RNA, 19 nt, Yersinia pestis
aauaccguguacccgaucu

SEQ ID NO: 4129723 - RNA, 22 nt, Yersinia pestis
aauaccuaaaauuaucgcaauu

SEQ ID NO: 4129724 - RNA, 19 nt, Yersinia pestis
aauaccuuacugcaucaau

SEQ ID NO: 4129725 - RNA, 15 nt, Yersinia pestis
aauacgaaauacuua

SEQ ID NO: 4129726 - RNA, 22 nt, Yersinia pestis
aauacgaaauacuuaucuguuu

SEQ ID NO: 4129727 - RNA, 17 nt, Yersinia pestis
aauacgccccugaucau

SEQ ID NO: 4129728 - RNA, 16 nt, Yersinia pestis
aauacggcacucaaau

SEQ ID NO: 4129729 - RNA, 22 nt, Yersinia pestis
aauacggcacucaaauagauag

SEQ ID NO: 4129730 - RNA, 23 nt, Yersinia pestis
aauacggcguuugacaauaucaa

SEQ ID NO: 4129731 - RNA, 19 nt, Yersinia pestis
aauacgguagcaauaccuu

SEQ ID NO: 4129732 - RNA, 18 nt, Yersinia pestis
aauacguucaaaugauuc

SEQ ID NO: 4129733 - RNA, 19 nt, Yersinia pestis
aauacuaucaucaucgcca

SEQ ID NO: 4129734 - RNA, 14 nt, Yersinia pestis
aauacuauuuguag

SEQ ID NO: 4129735 - RNA, 13 nt, Yersinia pestis
aauacucauuuuu

SEQ ID NO: 4129736 - RNA, 15 nt, Yersinia pestis
aauacucauuuuuaa

SEQ ID NO: 4129737 - RNA, 19 nt, Yersinia pestis
aauacuccuugaauagcca

SEQ ID NO: 4129738 - RNA, 22 nt, Yersinia pestis
aauacuccuugaauagccagaa

SEQ ID NO: 4129739 - RNA, 21 nt, Yersinia pestis
aauacucuugagaaaugaaua

SEQ ID NO: 4129740 - RNA, 14 nt, Yersinia pestis
aauacugauagcgg

SEQ ID NO: 4129741 - RNA, 17 nt, Yersinia pestis
aauacugcacguuuaau

SEQ ID NO: 4129742 - RNA, 20 nt, Yersinia pestis
aauacugcgguccuacccuu

SEQ ID NO: 4129743 - RNA, 21 nt, Yersinia pestis
aauacuuaagucaaauuuaaa

SEQ ID NO: 4129744 - RNA, 20 nt, Yersinia pestis
aauacuuauuugaaacagau

SEQ ID NO: 4129745 - RNA, 14 nt, Yersinia pestis
aauacuucaggcca

SEQ ID NO: 4129746 - RNA, 12 nt, Yersinia pestis
aauagaaaaaca

SEQ ID NO: 4129747 - RNA, 17 nt, Yersinia pestis
aauagaaccggaauaaa

SEQ ID NO: 4129748 - RNA, 18 nt, Yersinia pestis
aauagaaccggaauaaau

SEQ ID NO: 4129749 - RNA, 15 nt, Yersinia pestis
aauagaagguaauca

SEQ ID NO: 4129750 - RNA, 18 nt, Yersinia pestis
aauagaccguagaaacua

SEQ ID NO: 4129751 - RNA, 24 nt, Yersinia pestis
aauauucuucacuggaucuuuuag

SEQ ID NO: 4129752 - RNA, 14 nt, Yersinia pestis
aauauugaauuaaa

SEQ ID NO: 4129753 - RNA, 15 nt, Yersinia pestis
aauauugauccaccg

SEQ ID NO: 4129754 - RNA, 12 nt, Yersinia pestis
aauauugcacaa

SEQ ID NO: 4129755 - RNA, 12 nt, Yersinia pestis
aauauugccccc

SEQ ID NO: 4129756 - RNA, 12 nt, Yersinia pestis
aauauugccgca

SEQ ID NO: 4129757 - RNA, 22 nt, Yersinia pestis
aauauuggcgcacaacugcgau

SEQ ID NO: 4129758 - RNA, 15 nt, Yersinia pestis
aauauugucacugca

SEQ ID NO: 4129759 - RNA, 22 nt, Yersinia pestis
aauauugugcacucguuguauu

SEQ ID NO: 4129760 - RNA, 13 nt, Yersinia pestis
aauauuguugcca

SEQ ID NO: 4129761 - RNA, 16 nt, Yersinia pestis
aauauuuauaaaaaau

SEQ ID NO: 4129762 - RNA, 12 nt, Yersinia pestis
aauauuucaggc

SEQ ID NO: 4129763 - RNA, 20 nt, Yersinia pestis
aauauuuguuugaauuuuag

SEQ ID NO: 4129764 - RNA, 17 nt, Yersinia pestis
aauauuuuuaaucugcc

SEQ ID NO: 4129765 - RNA, 23 nt, Yersinia pestis
aaucaaaaaacagaauagugggu

SEQ ID NO: 4129766 - RNA, 13 nt, Yersinia pestis
aaucaaaaaauaa

SEQ ID NO: 4129767 - RNA, 12 nt, Yersinia pestis
aaucaaaacagg

SEQ ID NO: 4129768 - RNA, 17 nt, Yersinia pestis
aaucaaaagggaucacc

SEQ ID NO: 4129769 - RNA, 21 nt, Yersinia pestis
aaucaacagauaugcauuauu

SEQ ID NO: 4129770 - RNA, 23 nt, Yersinia pestis
aaucaacagaugaugauuuuuac

SEQ ID NO: 4129771 - RNA, 21 nt, Yersinia pestis
aaucaaccacgguaauagcuu

SEQ ID NO: 4129772 - RNA, 16 nt, Yersinia pestis
aaucaacgcucaauca

SEQ ID NO: 4129773 - RNA, 21 nt, Yersinia pestis
aaucaacgcucaaucacgaca

SEQ ID NO: 4129774 - RNA, 14 nt, Yersinia pestis
aaucaacggcacca

SEQ ID NO: 4129775 - RNA, 14 nt, Yersinia pestis
aaucaacucauuua

SEQ ID NO: 4129776 - RNA, 17 nt, Yersinia pestis
aaucaacugaaccacag

SEQ ID NO: 4129777 - RNA, 12 nt, Yersinia pestis
aaucaagauauu

SEQ ID NO: 4129778 - RNA, 14 nt, Yersinia pestis
aaucaagcgccauu

SEQ ID NO: 4129779 - RNA, 15 nt, Yersinia pestis
aaucaaggcuuuaau

SEQ ID NO: 4129780 - RNA, 14 nt, Yersinia pestis
aaucaaguaaccaa

SEQ ID NO: 4129781 - RNA, 21 nt, Yersinia pestis
aaucaauaaagccauuucagu

SEQ ID NO: 4129782 - RNA, 15 nt, Yersinia pestis
aaucaauguauugcu

SEQ ID NO: 4129783 - RNA, 17 nt, Yersinia pestis
aaucaauguauugcucc

SEQ ID NO: 4129784 - RNA, 14 nt, Yersinia pestis
aaucaauuaaucaa

SEQ ID NO: 4129785 - RNA, 20 nt, Yersinia pestis
aaucacacgggaucuacaua

SEQ ID NO: 4129786 - RNA, 15 nt, Yersinia pestis
aaucacaucaccgac

SEQ ID NO: 4129787 - RNA, 20 nt, Yersinia pestis
aaucacaucaccgacagcau

SEQ ID NO: 4129788 - RNA, 23 nt, Yersinia pestis
aaucacaucauucagcgucacga

SEQ ID NO: 4129789 - RNA, 11 nt, Yersinia pestis
aaucaccaaca

SEQ ID NO: 4129790 - RNA, 14 nt, Yersinia pestis
aaucacccgcaaga

SEQ ID NO: 4129791 - RNA, 18 nt, Yersinia pestis
aaucaccuuggaaaacag

SEQ ID NO: 4129792 - RNA, 23 nt, Yersinia pestis
aaucaccuuggauggcgaaacaa

SEQ ID NO: 4129793 - RNA, 22 nt, Yersinia pestis
aaucacguuuccaaaacucaug

SEQ ID NO: 4129794 - RNA, 19 nt, Yersinia pestis
aaucacugacugauguaag

SEQ ID NO: 4129795 - RNA, 21 nt, Yersinia pestis
aaucacugacugauguaagcu

SEQ ID NO: 4129796 - RNA, 18 nt, Yersinia pestis
aaucacugauucagaaag

SEQ ID NO: 4129797 - RNA, 16 nt, Yersinia pestis
aaucacuggcaauaau

SEQ ID NO: 4129798 - RNA, 22 nt, Yersinia pestis
aaucacuucacuugcaugccug

SEQ ID NO: 4129799 - RNA, 18 nt, Yersinia pestis
aaucagacggaauaccac

SEQ ID NO: 4129800 - RNA, 17 nt, Yersinia pestis
aaucagauacggcucca

SEQ ID NO: 4129801 - RNA, 15 nt, Yersinia pestis
aaucagcaagcugcu

SEQ ID NO: 4129802 - RNA, 18 nt, Yersinia pestis
aaucagcauuaacccaua

SEQ ID NO: 4129803 - RNA, 21 nt, Yersinia pestis
aaucagccacuuccuguuuau

SEQ ID NO: 4129804 - RNA, 15 nt, Yersinia pestis
aaucagccccaagcu

SEQ ID NO: 4129805 - RNA, 20 nt, Yersinia pestis
aaucagcgugguauaaaugg

SEQ ID NO: 4129806 - RNA, 22 nt, Yersinia pestis
aaucagcgugguauaaauggca

SEQ ID NO: 4129807 - RNA, 17 nt, Yersinia pestis
aaucagcugauaugaaa

SEQ ID NO: 4129808 - RNA, 11 nt, Yersinia pestis
aaucagcuuca

SEQ ID NO: 4129809 - RNA, 18 nt, Yersinia pestis
aaucagcuucauuaagga

SEQ ID NO: 4129810 - RNA, 15 nt, Yersinia pestis
aaucagggcacucug

SEQ ID NO: 4129811 - RNA, 19 nt, Yersinia pestis
aaucaggugaacguuggcu

SEQ ID NO: 4129812 - RNA, 13 nt, Yersinia pestis
aaucaguaaauau

SEQ ID NO: 4129813 - RNA, 18 nt, Yersinia pestis
aaucaguaaauauggcgg

SEQ ID NO: 4129814 - RNA, 19 nt, Yersinia pestis
aaucaguaccaccaccaca

SEQ ID NO: 4129815 - RNA, 20 nt, Yersinia pestis
aaucaguacuauucacgagc

SEQ ID NO: 4129816 - RNA, 20 nt, Yersinia pestis
aaucagugaaggaugaauaa

SEQ ID NO: 4129817 - RNA, 17 nt, Yersinia pestis
aaucaguguaucaauag

SEQ ID NO: 4129818 - RNA, 22 nt, Yersinia pestis
aaucaguguauuacuccacacg

SEQ ID NO: 4129819 - RNA, 14 nt, Yersinia pestis
aaucaguuuacaug

SEQ ID NO: 4129820 - RNA, 14 nt, Yersinia pestis
aaucauaaaagccc

SEQ ID NO: 4129821 - RNA, 17 nt, Yersinia pestis
aaucauacgcagccuga

SEQ ID NO: 4129822 - RNA, 18 nt, Yersinia pestis
aaucauaucaaaauaaaa

SEQ ID NO: 4129823 - RNA, 14 nt, Yersinia pestis
aaucauauuuuccu

SEQ ID NO: 4129824 - RNA, 15 nt, Yersinia pestis
aaucaucagccucua

SEQ ID NO: 4129825 - RNA, 11 nt, Yersinia pestis
aaucaucaucc

SEQ ID NO: 4129826 - RNA, 16 nt, Yersinia pestis
aaucaucaucccaguc

SEQ ID NO: 4129827 - RNA, 17 nt, Yersinia pestis
aaucaucgcucaucgcc

SEQ ID NO: 4129828 - RNA, 18 nt, Yersinia pestis
aaucaucuacaacaucau

SEQ ID NO: 4129829 - RNA, 20 nt, Yersinia pestis
aaucauguaacacacagcag

SEQ ID NO: 4129830 - RNA, 18 nt, Yersinia pestis
aaucauucugucaucaag

SEQ ID NO: 4129831 - RNA, 19 nt, Yersinia pestis
aaucauucugucaucaaga

SEQ ID NO: 4129832 - RNA, 19 nt, Yersinia pestis
aaucauugacguuacagau

SEQ ID NO: 4129833 - RNA, 19 nt, Yersinia pestis
aaucauugagaucaguuca

SEQ ID NO: 4129834 - RNA, 15 nt, Yersinia pestis
aaucauugcaaugcu

SEQ ID NO: 4129835 - RNA, 22 nt, Yersinia pestis
aaucauuuuuuuauuaaguuuu

SEQ ID NO: 4129836 - RNA, 17 nt, Yersinia pestis
aauccaaaauaauauaa

SEQ ID NO: 4129837 - RNA, 21 nt, Yersinia pestis
aauccaaaugcccauuaguaa

SEQ ID NO: 4129838 - RNA, 22 nt, Yersinia pestis
aauccaaccuauauagcccagc

SEQ ID NO: 4129839 - RNA, 16 nt, Yersinia pestis
aauccacacgcgagca

SEQ ID NO: 4129840 - RNA, 21 nt, Yersinia pestis
aauccaccacugauaggucau

SEQ ID NO: 4129841 - RNA, 21 nt, Yersinia pestis
aauccaccugacgaaaugccg

SEQ ID NO: 4129842 - RNA, 15 nt, Yersinia pestis
aauccacucuugcac

SEQ ID NO: 4129843 - RNA, 15 nt, Yersinia pestis
aauccagaagccauu

SEQ ID NO: 4129844 - RNA, 21 nt, Yersinia pestis
aauccagcgccuguuccaacg

SEQ ID NO: 4129845 - RNA, 17 nt, Yersinia pestis
aauccaguugaguaauu

SEQ ID NO: 4129846 - RNA, 23 nt, Yersinia pestis
aauccauaagauugagggcgucu

SEQ ID NO: 4129847 - RNA, 23 nt, Yersinia pestis
aauccaugccagcccaucaccau

SEQ ID NO: 4129848 - RNA, 21 nt, Yersinia pestis
aaucccaaagcuuaucgauaa

SEQ ID NO: 4129849 - RNA, 19 nt, Yersinia pestis
aaucccccacgaucuccuc

SEQ ID NO: 4129850 - RNA, 15 nt, Yersinia pestis
aauccccucaaaauu

SEQ ID NO: 4129851 - RNA, 19 nt, Yersinia pestis
aaucccgauauaaauaaaa

SEQ ID NO: 4129852 - RNA, 16 nt, Yersinia pestis
aaucccgggaauaauc

SEQ ID NO: 4129853 - RNA, 17 nt, Yersinia pestis
aaucccguuccgcuucc

SEQ ID NO: 4129854 - RNA, 13 nt, Yersinia pestis
aaucccuacggca

SEQ ID NO: 4129855 - RNA, 14 nt, Yersinia pestis
aaucccugccagaa

SEQ ID NO: 4129856 - RNA, 16 nt, Yersinia pestis
aauccgaccacugaca

SEQ ID NO: 4129857 - RNA, 17 nt, Yersinia pestis
aauccgguuagcaaaaa

SEQ ID NO: 4129858 - RNA, 15 nt, Yersinia pestis
aauccuaaugaacac

SEQ ID NO: 4129859 - RNA, 19 nt, Yersinia pestis
aauccuacaauaucuuccc

SEQ ID NO: 4129860 - RNA, 20 nt, Yersinia pestis
aauccuauauacaaggcaca

SEQ ID NO: 4129861 - RNA, 21 nt, Yersinia pestis
aauccugcaaauuaaccugcu

SEQ ID NO: 4129862 - RNA, 13 nt, Yersinia pestis
aauccuguagcuc

SEQ ID NO: 4129863 - RNA, 19 nt, Yersinia pestis
aauccuugcuaguuauaua

SEQ ID NO: 4129864 - RNA, 12 nt, Yersinia pestis
aaucgaaacacc

SEQ ID NO: 4129865 - RNA, 14 nt, Yersinia pestis
aaucgaaacaccac

SEQ ID NO: 4129866 - RNA, 18 nt, Yersinia pestis
aaucgacggaaacagcac

SEQ ID NO: 4129867 - RNA, 18 nt, Yersinia pestis
aaucgauacgcauugagg

SEQ ID NO: 4129868 - RNA, 15 nt, Yersinia pestis
aaucgauggaauaaa

SEQ ID NO: 4129869 - RNA, 21 nt, Yersinia pestis
aaucgauggccgcccuccaau

SEQ ID NO: 4129870 - RNA, 15 nt, Yersinia pestis
aaucgauuacuggcu

SEQ ID NO: 4129871 - RNA, 17 nt, Yersinia pestis
aaucgcaucgucgcugu

SEQ ID NO: 4129872 - RNA, 17 nt, Yersinia pestis
aaucgccaaacugcuca

SEQ ID NO: 4129873 - RNA, 18 nt, Yersinia pestis
aauggcacuggaaacaaa

SEQ ID NO: 4129874 - RNA, 20 nt, Yersinia pestis
aauggccgccauuuuuaugu

SEQ ID NO: 4129875 - RNA, 22 nt, Yersinia pestis
aauggccgccauuuuuauguuu

SEQ ID NO: 4129876 - RNA, 22 nt, Yersinia pestis
aauggcgaaaggaacaaaagag

SEQ ID NO: 4129877 - RNA, 18 nt, Yersinia pestis
aauggcuggcaaggcacg

SEQ ID NO: 4129878 - RNA, 23 nt, Yersinia pestis
aauggcuuuuuuaauaaaaaacu

SEQ ID NO: 4129879 - RNA, 17 nt, Yersinia pestis
aaugggaugauagcuuc

SEQ ID NO: 4129880 - RNA, 23 nt, Yersinia pestis
aaugggcuaccgacaagauugcc

SEQ ID NO: 4129881 - RNA, 12 nt, Yersinia pestis
aauggguauauu

SEQ ID NO: 4129882 - RNA, 21 nt, Yersinia pestis
aauggguauauuuaccaaaag

SEQ ID NO: 4129883 - RNA, 23 nt, Yersinia pestis
aauggguuugguuauuaugauug

SEQ ID NO: 4129884 - RNA, 17 nt, Yersinia pestis
aaugguaccggcaccaa

SEQ ID NO: 4129885 - RNA, 18 nt, Yersinia pestis
aaugguauuugaaauauu

SEQ ID NO: 4129886 - RNA, 12 nt, Yersinia pestis
aauggucaggaa

SEQ ID NO: 4129887 - RNA, 12 nt, Yersinia pestis
aauggucuugau

SEQ ID NO: 4129888 - RNA, 17 nt, Yersinia pestis
aaugguguaaaugcccg

SEQ ID NO: 4129889 - RNA, 23 nt, Yersinia pestis
aaugguuuccaguacugaccacg

SEQ ID NO: 4129890 - RNA, 14 nt, Yersinia pestis
aaugguuuggccau

SEQ ID NO: 4129891 - RNA, 21 nt, Yersinia pestis
aauguaaaacgaguaaauaca

SEQ ID NO: 4129892 - RNA, 13 nt, Yersinia pestis
aauguaaauuucc

SEQ ID NO: 4129893 - RNA, 16 nt, Yersinia pestis
aauguaagcaucuuuu

SEQ ID NO: 4129894 - RNA, 12 nt, Yersinia pestis
aauguaauaauc

SEQ ID NO: 4129895 - RNA, 18 nt, Yersinia pestis
aauguacagucauuuacu

SEQ ID NO: 4129896 - RNA, 20 nt, Yersinia pestis
aauguagagcguagacuaaa

SEQ ID NO: 4129897 - RNA, 22 nt, Yersinia pestis
aauguauaaaaaagauaauaaa

SEQ ID NO: 4129898 - RNA, 23 nt, Yersinia pestis
aauguaugguuguauuuugaaug

SEQ ID NO: 4129899 - RNA, 16 nt, Yersinia pestis
aaugucacgcuuuaaa

SEQ ID NO: 4129900 - RNA, 19 nt, Yersinia pestis
aauguccauuacuguccuu

SEQ ID NO: 4129901 - RNA, 23 nt, Yersinia pestis
aauguccccuugaguauccaaua

SEQ ID NO: 4129902 - RNA, 17 nt, Yersinia pestis
aaugucuauuuagucau

SEQ ID NO: 4129903 - RNA, 16 nt, Yersinia pestis
aaugugaaaagcaguc

SEQ ID NO: 4129904 - RNA, 21 nt, Yersinia pestis
aaugugacucagcgaauagua

SEQ ID NO: 4129905 - RNA, 17 nt, Yersinia pestis
aauguguugaauaucca

SEQ ID NO: 4129906 - RNA, 23 nt, Yersinia pestis
aauguuaaacuuugcuauuaaga

SEQ ID NO: 4129907 - RNA, 21 nt, Yersinia pestis
aauguucucuggguaagaaca

SEQ ID NO: 4129908 - RNA, 18 nt, Yersinia pestis
aauguugagucccuuggc

SEQ ID NO: 4129909 - RNA, 19 nt, Yersinia pestis
aauguuggggcacaauaag

SEQ ID NO: 4129910 - RNA, 21 nt, Yersinia pestis
aauguuguuuaugaaaucuac

SEQ ID NO: 4129911 - RNA, 22 nt, Yersinia pestis
aauguuucuauccgaaaaauau

SEQ ID NO: 4129912 - RNA, 18 nt, Yersinia pestis
aauguuuuacgaucaacc

SEQ ID NO: 4129913 - RNA, 14 nt, Yersinia pestis
aauuaaaaacccuc

SEQ ID NO: 4129914 - RNA, 13 nt, Yersinia pestis
aauuaaaaauaga

SEQ ID NO: 4129915 - RNA, 11 nt, Yersinia pestis
aauuaaaacau

SEQ ID NO: 4129916 - RNA, 16 nt, Yersinia pestis
aauuaaaacauauuaa

SEQ ID NO: 4129917 - RNA, 19 nt, Yersinia pestis
aauuaaaacugaaaaguuu

SEQ ID NO: 4129918 - RNA, 18 nt, Yersinia pestis
aauuaaacgcucaucaac

SEQ ID NO: 4129919 - RNA, 17 nt, Yersinia pestis
aauuaaauguauaaaaa

SEQ ID NO: 4129920 - RNA, 20 nt, Yersinia pestis
aauuaacacccaauaauaaa

SEQ ID NO: 4129921 - RNA, 21 nt, Yersinia pestis
aauuaacacccaauaauaaaa

SEQ ID NO: 4129922 - RNA, 23 nt, Yersinia pestis
aauuaagaagccucaugaaugag

SEQ ID NO: 4129923 - RNA, 13 nt, Yersinia pestis
aauuaaggaaaag

SEQ ID NO: 4129924 - RNA, 17 nt, Yersinia pestis
aauuaaggaaacucaug

SEQ ID NO: 4129925 - RNA, 17 nt, Yersinia pestis
aauuaauauauaaaaua

SEQ ID NO: 4129926 - RNA, 17 nt, Yersinia pestis
aauuaauaucuuuaaau

SEQ ID NO: 4129927 - RNA, 19 nt, Yersinia pestis
aauuaauaucuuuaaauua

SEQ ID NO: 4129928 - RNA, 12 nt, Yersinia pestis
aauuaauauuua

SEQ ID NO: 4129929 - RNA, 15 nt, Yersinia pestis
aauuaaucaauuaaa

SEQ ID NO: 4129930 - RNA, 17 nt, Yersinia pestis
aauuaaucaauuaaaua

SEQ ID NO: 4129931 - RNA, 18 nt, Yersinia pestis
aauuaaucuaauuucaaa

SEQ ID NO: 4129932 - RNA, 19 nt, Yersinia pestis
aauuaaucuaauuucaaau

SEQ ID NO: 4129933 - RNA, 13 nt, Yersinia pestis
aauuaauuuaaac

SEQ ID NO: 4129934 - RNA, 17 nt, Yersinia pestis
aauuacacccaacuuuu

SEQ ID NO: 4129935 - RNA, 14 nt, Yersinia pestis
aauuacgcacugcc

SEQ ID NO: 4129936 - RNA, 19 nt, Yersinia pestis
aauuacggcucaguugaug

SEQ ID NO: 4129937 - RNA, 22 nt, Yersinia pestis
aauuacgguuuaccaccuuaaa

SEQ ID NO: 4129938 - RNA, 17 nt, Yersinia pestis
aauuacuuuaaagccaa

SEQ ID NO: 4129939 - RNA, 15 nt, Yersinia pestis
aauuagauaugaucg

SEQ ID NO: 4129940 - RNA, 16 nt, Yersinia pestis
aauuagcacauaugca

SEQ ID NO: 4129941 - RNA, 24 nt, Yersinia pestis
aauuagggguugcaggcugucagg

SEQ ID NO: 4129942 - RNA, 17 nt, Yersinia pestis
aauuagguaacuuucca

SEQ ID NO: 4129943 - RNA, 15 nt, Yersinia pestis
aauuauaauccacug

SEQ ID NO: 4129944 - RNA, 13 nt, Yersinia pestis
aauuauagugaaa

SEQ ID NO: 4129945 - RNA, 13 nt, Yersinia pestis
aauuauauuuaau

SEQ ID NO: 4129946 - RNA, 16 nt, Yersinia pestis
aauuauauuuaauuua

SEQ ID NO: 4129947 - RNA, 13 nt, Yersinia pestis
aauuauccguaaa

SEQ ID NO: 4129948 - RNA, 20 nt, Yersinia pestis
aauuaucgaucacaugcuca

SEQ ID NO: 4129949 - RNA, 18 nt, Yersinia pestis
aauuaucgcaauuucaga

SEQ ID NO: 4129950 - RNA, 22 nt, Yersinia pestis
aauuaucuaauaaugagccaua

SEQ ID NO: 4129951 - RNA, 19 nt, Yersinia pestis
aauuaucugaauagcgcug

SEQ ID NO: 4129952 - RNA, 19 nt, Yersinia pestis
aauuaucuuauccacagca

SEQ ID NO: 4129953 - RNA, 19 nt, Yersinia pestis
aauuaugacguucaguagu

SEQ ID NO: 4129954 - RNA, 12 nt, Yersinia pestis
aauuauuaaaua

SEQ ID NO: 4129955 - RNA, 13 nt, Yersinia pestis
aauuauuaaauaa

SEQ ID NO: 4129956 - RNA, 12 nt, Yersinia pestis
aauuauuucucu

SEQ ID NO: 4129957 - RNA, 11 nt, Yersinia pestis
aauucaaaaua

SEQ ID NO: 4129958 - RNA, 16 nt, Yersinia pestis
aauucaaaauguauua

SEQ ID NO: 4129959 - RNA, 13 nt, Yersinia pestis
aauucaaauauca

SEQ ID NO: 4129960 - RNA, 14 nt, Yersinia pestis
aauucaaauaucau

SEQ ID NO: 4129961 - RNA, 23 nt, Yersinia pestis
aauucacaacagugcaacauuaa

SEQ ID NO: 4129962 - RNA, 22 nt, Yersinia pestis
aauucaccggcaaucgcuucca

SEQ ID NO: 4129963 - RNA, 15 nt, Yersinia pestis
aauucacgccuaucu

SEQ ID NO: 4129964 - RNA, 14 nt, Yersinia pestis
aauucacguuuacu

SEQ ID NO: 4129965 - RNA, 15 nt, Yersinia pestis
aauucacugcuuaau

SEQ ID NO: 4129966 - RNA, 13 nt, Yersinia pestis
aauucacuuuccc

SEQ ID NO: 4129967 - RNA, 22 nt, Yersinia pestis
aauucagacggcagauccugaa

SEQ ID NO: 4129968 - RNA, 15 nt, Yersinia pestis
aauucagauguuaac

SEQ ID NO: 4129969 - RNA, 16 nt, Yersinia pestis
aauucagccucauaca

SEQ ID NO: 4129970 - RNA, 21 nt, Yersinia pestis
aauucagcguauugugauuca

SEQ ID NO: 4129971 - RNA, 23 nt, Yersinia pestis
aauucaguaucaccagaugccgc

SEQ ID NO: 4129972 - RNA, 18 nt, Yersinia pestis
aauucauaccgcagauaa

SEQ ID NO: 4129973 - RNA, 19 nt, Yersinia pestis
aauucauaugacaaauaag

SEQ ID NO: 4129974 - RNA, 20 nt, Yersinia pestis
aauucaucagauuguuuaua

SEQ ID NO: 4129975 - RNA, 15 nt, Yersinia pestis
aauucaucagcgcug

SEQ ID NO: 4129976 - RNA, 18 nt, Yersinia pestis
aauucaucagcgcuggcu

SEQ ID NO: 4129977 - RNA, 16 nt, Yersinia pestis
aauucaucuuuaacaa

SEQ ID NO: 4129978 - RNA, 19 nt, Yersinia pestis
aauucaucuuuaacaacaa

SEQ ID NO: 4129979 - RNA, 19 nt, Yersinia pestis
aauucaugcuaauaccaca

SEQ ID NO: 4129980 - RNA, 13 nt, Yersinia pestis
aauucauuauuac

SEQ ID NO: 4129981 - RNA, 16 nt, Yersinia pestis
aauucauuauuacuca

SEQ ID NO: 4129982 - RNA, 22 nt, Yersinia pestis
aauucauuauuacucagcacau

SEQ ID NO: 4129983 - RNA, 23 nt, Yersinia pestis
aauuccacgcugaaacuuuucag

SEQ ID NO: 4129984 - RNA, 18 nt, Yersinia pestis
aauuccauaauaagugaa

SEQ ID NO: 4129985 - RNA, 15 nt, Yersinia pestis
aauuccauauuuaau

SEQ ID NO: 4129986 - RNA, 17 nt, Yersinia pestis
aauucccccaaaaccuc

SEQ ID NO: 4129987 - RNA, 23 nt, Yersinia pestis
aauucccgucagguucaauuccc

SEQ ID NO: 4129988 - RNA, 19 nt, Yersinia pestis
aauucgauaaaaggcuauu

SEQ ID NO: 4129989 - RNA, 21 nt, Yersinia pestis
aauucgggaucaugaugauca

SEQ ID NO: 4129990 - RNA, 17 nt, Yersinia pestis
aauucguuucucuaaaa

SEQ ID NO: 4129991 - RNA, 19 nt, Yersinia pestis
aauucuaccuggcucaaau

SEQ ID NO: 4129992 - RNA, 18 nt, Yersinia pestis
aauucuauccggauuaaa

SEQ ID NO: 4129993 - RNA, 14 nt, Yersinia pestis
aauucucccauuua

SEQ ID NO: 4129994 - RNA, 18 nt, Yersinia pestis
acaaauaguaauaauuaa

SEQ ID NO: 4129995 - RNA, 13 nt, Yersinia pestis
acaaauaugaaga

SEQ ID NO: 4129996 - RNA, 19 nt, Yersinia pestis
acaaauauuggcccacugg

SEQ ID NO: 4129997 - RNA, 20 nt, Yersinia pestis
acaaaucaucaucuugaaaa

SEQ ID NO: 4129998 - RNA, 14 nt, Yersinia pestis
acaaauccuuuuaa

SEQ ID NO: 4129999 - RNA, 16 nt, Yersinia pestis
acaaauccuuuuaaaa

SEQ ID NO: 4130000 - RNA, 18 nt, Yersinia pestis
acaaauucaccagcaaua

SEQ ID NO: 4130001 - RNA, 15 nt, Yersinia pestis
acaaauugcggcaac

SEQ ID NO: 4130002 - RNA, 19 nt, Yersinia pestis
acaaauugcggcaaccaaa

SEQ ID NO: 4130003 - RNA, 17 nt, Yersinia pestis
acaaauuugacauuucc

SEQ ID NO: 4130004 - RNA, 15 nt, Yersinia pestis
acaacaaaggcgcca

SEQ ID NO: 4130005 - RNA, 17 nt, Yersinia pestis
acaacaacggugaacag

SEQ ID NO: 4130006 - RNA, 20 nt, Yersinia pestis
acaacaagaucccaagcagg

SEQ ID NO: 4130007 - RNA, 15 nt, Yersinia pestis
acaacagauggcgau

SEQ ID NO: 4130008 - RNA, 22 nt, Yersinia pestis
acaacagucacaccaacacuga

SEQ ID NO: 4130009 - RNA, 19 nt, Yersinia pestis
acaacauagguuuuuucac

SEQ ID NO: 4130010 - RNA, 18 nt, Yersinia pestis
acaacaucaaaugaaggg

SEQ ID NO: 4130011 - RNA, 12 nt, Yersinia pestis
acaacaucaucg

SEQ ID NO: 4130012 - RNA, 15 nt, Yersinia pestis
acaacaucaucguca

SEQ ID NO: 4130013 - RNA, 20 nt, Yersinia pestis
acaacauuagggccaccaga

SEQ ID NO: 4130014 - RNA, 22 nt, Yersinia pestis
acaacauugccaaauuauucau

SEQ ID NO: 4130015 - RNA, 14 nt, Yersinia pestis
acaaccaacaaaca

SEQ ID NO: 4130016 - RNA, 15 nt, Yersinia pestis
acaaccaacaaacaa

SEQ ID NO: 4130017 - RNA, 16 nt, Yersinia pestis
acaaccaacaaacaau

SEQ ID NO: 4130018 - RNA, 17 nt, Yersinia pestis
acaaccaauacacagca

SEQ ID NO: 4130019 - RNA, 18 nt, Yersinia pestis
acaaccacuaaaccacau

SEQ ID NO: 4130020 - RNA, 18 nt, Yersinia pestis
acaaccacugaacaccau

SEQ ID NO: 4130021 - RNA, 23 nt, Yersinia pestis
acaaccauuguggcuaaacccaa

SEQ ID NO: 4130022 - RNA, 13 nt, Yersinia pestis
acaacccauuucc

SEQ ID NO: 4130023 - RNA, 23 nt, Yersinia pestis
acaacccccgaacacucgaucuu

SEQ ID NO: 4130024 - RNA, 22 nt, Yersinia pestis
acaacccgaauuaauaaaaccu

SEQ ID NO: 4130025 - RNA, 15 nt, Yersinia pestis
acaaccgugcaccau

SEQ ID NO: 4130026 - RNA, 14 nt, Yersinia pestis
acaaccuaccaccu

SEQ ID NO: 4130027 - RNA, 12 nt, Yersinia pestis
acaaccucucag

SEQ ID NO: 4130028 - RNA, 24 nt, Yersinia pestis
acaacgacagccaaaucaguacca

SEQ ID NO: 4130029 - RNA, 15 nt, Yersinia pestis
acaacgagggcucaa

SEQ ID NO: 4130030 - RNA, 14 nt, Yersinia pestis
acaacgccgcaccg

SEQ ID NO: 4130031 - RNA, 20 nt, Yersinia pestis
acaacgccggaucaucaacc

SEQ ID NO: 4130032 - RNA, 15 nt, Yersinia pestis
acaacgcuccagguu

SEQ ID NO: 4130033 - RNA, 18 nt, Yersinia pestis
acaacgcugaaaaaucuu

SEQ ID NO: 4130034 - RNA, 16 nt, Yersinia pestis
acaacguccagaacaa

SEQ ID NO: 4130035 - RNA, 19 nt, Yersinia pestis
acaacguccagaacaauac

SEQ ID NO: 4130036 - RNA, 13 nt, Yersinia pestis
acaacguuucugg

SEQ ID NO: 4130037 - RNA, 14 nt, Yersinia pestis
acaacguuucugga

SEQ ID NO: 4130038 - RNA, 13 nt, Yersinia pestis
acaacugaaaaua

SEQ ID NO: 4130039 - RNA, 18 nt, Yersinia pestis
acaacugacaacaucaaa

SEQ ID NO: 4130040 - RNA, 19 nt, Yersinia pestis
acaacuggguggccaguaa

SEQ ID NO: 4130041 - RNA, 18 nt, Yersinia pestis
acaacugguuaucacugu

SEQ ID NO: 4130042 - RNA, 14 nt, Yersinia pestis
acaacuuccacaca

SEQ ID NO: 4130043 - RNA, 15 nt, Yersinia pestis
acaacuuccacacaa

SEQ ID NO: 4130044 - RNA, 16 nt, Yersinia pestis
acaacuugcuggaggc

SEQ ID NO: 4130045 - RNA, 13 nt, Yersinia pestis
acaacuuucccag

SEQ ID NO: 4130046 - RNA, 22 nt, Yersinia pestis
acaagaaggucuugauggcuau

SEQ ID NO: 4130047 - RNA, 15 nt, Yersinia pestis
acaagagcaauggcg

SEQ ID NO: 4130048 - RNA, 12 nt, Yersinia pestis
acaagccaaaca

SEQ ID NO: 4130049 - RNA, 21 nt, Yersinia pestis
acaagccagcgaggcuucuca

SEQ ID NO: 4130050 - RNA, 14 nt, Yersinia pestis
acaagcgaccauca

SEQ ID NO: 4130051 - RNA, 17 nt, Yersinia pestis
acaagcgaccaucauga

SEQ ID NO: 4130052 - RNA, 20 nt, Yersinia pestis
acaagcgaccaucaugaaua

SEQ ID NO: 4130053 - RNA, 22 nt, Yersinia pestis
acaagcuacagcgucagauauu

SEQ ID NO: 4130054 - RNA, 15 nt, Yersinia pestis
acaaggaaaaggcag

SEQ ID NO: 4130055 - RNA, 20 nt, Yersinia pestis
acaagggguuucagacuccu

SEQ ID NO: 4130056 - RNA, 15 nt, Yersinia pestis
acaagugccaaaugg

SEQ ID NO: 4130057 - RNA, 20 nt, Yersinia pestis
acaaguuggugcaguugguc

SEQ ID NO: 4130058 - RNA, 21 nt, Yersinia pestis
acaaguugucuguaauaauaa

SEQ ID NO: 4130059 - RNA, 22 nt, Yersinia pestis
acaaguugucuguaauaauaau

SEQ ID NO: 4130060 - RNA, 15 nt, Yersinia pestis
acaauaacgccguua

SEQ ID NO: 4130061 - RNA, 23 nt, Yersinia pestis
acaauaacgcugaauacacucgu

SEQ ID NO: 4130062 - RNA, 15 nt, Yersinia pestis
acaauacagcaaaua

SEQ ID NO: 4130063 - RNA, 17 nt, Yersinia pestis
acaauaccauuuugccg

SEQ ID NO: 4130064 - RNA, 15 nt, Yersinia pestis
acaauaucuucccug

SEQ ID NO: 4130065 - RNA, 15 nt, Yersinia pestis
acaauauuauauucu

SEQ ID NO: 4130066 - RNA, 18 nt, Yersinia pestis
acaaucagcccgauggca

SEQ ID NO: 4130067 - RNA, 20 nt, Yersinia pestis
acaaucagcccgauggcaaa

SEQ ID NO: 4130068 - RNA, 22 nt, Yersinia pestis
acaaucagugcaauaaauucaa

SEQ ID NO: 4130069 - RNA, 19 nt, Yersinia pestis
acaauccaauuuaccacua

SEQ ID NO: 4130070 - RNA, 14 nt, Yersinia pestis
acaauccgaacaaa

SEQ ID NO: 4130071 - RNA, 12 nt, Yersinia pestis
acaaucgauucc

SEQ ID NO: 4130072 - RNA, 13 nt, Yersinia pestis
acaaucuggcagc

SEQ ID NO: 4130073 - RNA, 13 nt, Yersinia pestis
acaaugacuuaac

SEQ ID NO: 4130074 - RNA, 14 nt, Yersinia pestis
acaaugacuuaacu

SEQ ID NO: 4130075 - RNA, 16 nt, Yersinia pestis
acaaugacuuaacuga

SEQ ID NO: 4130076 - RNA, 23 nt, Yersinia pestis
acaaugacuuaacugaaagccaa

SEQ ID NO: 4130077 - RNA, 15 nt, Yersinia pestis
acaaugccuaaaaug

SEQ ID NO: 4130078 - RNA, 17 nt, Yersinia pestis
acaaugcggccuuugcu

SEQ ID NO: 4130079 - RNA, 16 nt, Yersinia pestis
acaauggccggacuca

SEQ ID NO: 4130080 - RNA, 17 nt, Yersinia pestis
acaaugguucaucauuu

SEQ ID NO: 4130081 - RNA, 18 nt, Yersinia pestis
acaaugguugaaugacca

SEQ ID NO: 4130082 - RNA, 22 nt, Yersinia pestis
acaaugucacgcuuuaaaacug

SEQ ID NO: 4130083 - RNA, 15 nt, Yersinia pestis
acaauguuauauuuc

SEQ ID NO: 4130084 - RNA, 16 nt, Yersinia pestis
acaauuaacacuuauu

SEQ ID NO: 4130085 - RNA, 19 nt, Yersinia pestis
acaauuaauaugccgacaa

SEQ ID NO: 4130086 - RNA, 13 nt, Yersinia pestis
acaauuacacacc

SEQ ID NO: 4130087 - RNA, 18 nt, Yersinia pestis
acaauuacgcacugccug

SEQ ID NO: 4130088 - RNA, 14 nt, Yersinia pestis
acaauuauuuuuac

SEQ ID NO: 4130089 - RNA, 15 nt, Yersinia pestis
acaauuauuuuuaca

SEQ ID NO: 4130090 - RNA, 13 nt, Yersinia pestis
acaauucacccau

SEQ ID NO: 4130091 - RNA, 20 nt, Yersinia pestis
acaauucccguuagguucaa

SEQ ID NO: 4130092 - RNA, 19 nt, Yersinia pestis
acaauugccugauuuuuau

SEQ ID NO: 4130093 - RNA, 21 nt, Yersinia pestis
acaauuuuauuguuuucguuu

SEQ ID NO: 4130094 - RNA, 14 nt, Yersinia pestis
acacaaaagacgcc

SEQ ID NO: 4130095 - RNA, 15 nt, Yersinia pestis
acacaauacauagaa

SEQ ID NO: 4130096 - RNA, 12 nt, Yersinia pestis
acacaauuuuua

SEQ ID NO: 4130097 - RNA, 13 nt, Yersinia pestis
acacaauuuuuag

SEQ ID NO: 4130098 - RNA, 19 nt, Yersinia pestis
acacacagccuacgggguc

SEQ ID NO: 4130099 - RNA, 21 nt, Yersinia pestis
acacaccagucugcauacaga

SEQ ID NO: 4130100 - RNA, 13 nt, Yersinia pestis
acacaccugcaac

SEQ ID NO: 4130101 - RNA, 23 nt, Yersinia pestis
acacaccugcaacguuaaagaug

SEQ ID NO: 4130102 - RNA, 15 nt, Yersinia pestis
acacacucaggcgau

SEQ ID NO: 4130103 - RNA, 13 nt, Yersinia pestis
acacagcacggca

SEQ ID NO: 4130104 - RNA, 15 nt, Yersinia pestis
acacagcacggcaac

SEQ ID NO: 4130105 - RNA, 14 nt, Yersinia pestis
acacagccagccuu

SEQ ID NO: 4130106 - RNA, 12 nt, Yersinia pestis
acacagcccugc

SEQ ID NO: 4130107 - RNA, 23 nt, Yersinia pestis
acacagcccugccuggcaggaag

SEQ ID NO: 4130108 - RNA, 15 nt, Yersinia pestis
acacagguucuccag

SEQ ID NO: 4130109 - RNA, 21 nt, Yersinia pestis
acacagucgcacugauagcaa

SEQ ID NO: 4130110 - RNA, 16 nt, Yersinia pestis
acacagugaugaccau

SEQ ID NO: 4130111 - RNA, 13 nt, Yersinia pestis
acacauaaccauc

SEQ ID NO: 4130112 - RNA, 15 nt, Yersinia pestis
acacauaaccaucaa

SEQ ID NO: 4130113 - RNA, 18 nt, Yersinia pestis
acacauaaccaucaaaca

SEQ ID NO: 4130114 - RNA, 14 nt, Yersinia pestis
acacauaccacaca

SEQ ID NO: 4130115 - RNA, 15 nt, Yersinia pestis
acacauaccacacac

SEQ ID NO: 4130116 - RNA, 13 nt, Yersinia pestis
acacauauuucau

SEQ ID NO: 4130117 - RNA, 16 nt, Yersinia pestis
acaggguaaauuauuu

SEQ ID NO: 4130118 - RNA, 22 nt, Yersinia pestis
acagguaaaaccggagucaauc

SEQ ID NO: 4130119 - RNA, 18 nt, Yersinia pestis
acagguggggcaguuaac

SEQ ID NO: 4130120 - RNA, 18 nt, Yersinia pestis
acaguaagauaggccacc

SEQ ID NO: 4130121 - RNA, 19 nt, Yersinia pestis
acaguaagguauugacaca

SEQ ID NO: 4130122 - RNA, 21 nt, Yersinia pestis
acaguacaaaaaacaaaccgg

SEQ ID NO: 4130123 - RNA, 18 nt, Yersinia pestis
acaguaggcugaaggccu

SEQ ID NO: 4130124 - RNA, 21 nt, Yersinia pestis
acaguagugaguuaacgagug

SEQ ID NO: 4130125 - RNA, 18 nt, Yersinia pestis
acaguaucaaccaccgcu

SEQ ID NO: 4130126 - RNA, 16 nt, Yersinia pestis
acaguauucugcuucc

SEQ ID NO: 4130127 - RNA, 15 nt, Yersinia pestis
acagucaauugagaa

SEQ ID NO: 4130128 - RNA, 18 nt, Yersinia pestis
acagucaauugagaauaa

SEQ ID NO: 4130129 - RNA, 17 nt, Yersinia pestis
acagucaguucauuaca

SEQ ID NO: 4130130 - RNA, 13 nt, Yersinia pestis
acagucauuaaca

SEQ ID NO: 4130131 - RNA, 14 nt, Yersinia pestis
acagucccugugcg

SEQ ID NO: 4130132 - RNA, 22 nt, Yersinia pestis
acagucccugugcgcccacgcc

SEQ ID NO: 4130133 - RNA, 20 nt, Yersinia pestis
acagucuagugcgcugugcc

SEQ ID NO: 4130134 - RNA, 18 nt, Yersinia pestis
acagucuuauuacucauu

SEQ ID NO: 4130135 - RNA, 20 nt, Yersinia pestis
acagugcaacauuaaaaaua

SEQ ID NO: 4130136 - RNA, 17 nt, Yersinia pestis
acagugccaaaagaccg

SEQ ID NO: 4130137 - RNA, 22 nt, Yersinia pestis
acaguguaaaaagcgaucgacc

SEQ ID NO: 4130138 - RNA, 20 nt, Yersinia pestis
acaguuaaacaacgcugaaa

SEQ ID NO: 4130139 - RNA, 14 nt, Yersinia pestis
acaguuacgucagg

SEQ ID NO: 4130140 - RNA, 14 nt, Yersinia pestis
acaguuauuaggca

SEQ ID NO: 4130141 - RNA, 21 nt, Yersinia pestis
acaguuauuuuaauugcugau

SEQ ID NO: 4130142 - RNA, 21 nt, Yersinia pestis
acaguucauaucgauaccgau

SEQ ID NO: 4130143 - RNA, 22 nt, Yersinia pestis
acaguucauaucgauaccgaua

SEQ ID NO: 4130144 - RNA, 20 nt, Yersinia pestis
acaguuccuguuuuugaaua

SEQ ID NO: 4130145 - RNA, 18 nt, Yersinia pestis
acaguugugucagaccaa

SEQ ID NO: 4130146 - RNA, 15 nt, Yersinia pestis
acaguuguuucaaua

SEQ ID NO: 4130147 - RNA, 15 nt, Yersinia pestis
acauaaaaaagagua

SEQ ID NO: 4130148 - RNA, 15 nt, Yersinia pestis
acauaaaaagaaaaa

SEQ ID NO: 4130149 - RNA, 16 nt, Yersinia pestis
acauaaaaaugcacug

SEQ ID NO: 4130150 - RNA, 18 nt, Yersinia pestis
acauaaaccgugugcuuc

SEQ ID NO: 4130151 - RNA, 15 nt, Yersinia pestis
acauaaauaaguuca

SEQ ID NO: 4130152 - RNA, 16 nt, Yersinia pestis
acauaaauaggccgcc

SEQ ID NO: 4130153 - RNA, 17 nt, Yersinia pestis
acauaacguuauaacuc

SEQ ID NO: 4130154 - RNA, 18 nt, Yersinia pestis
acauaacguuauaacuca

SEQ ID NO: 4130155 - RNA, 17 nt, Yersinia pestis
acauaaguaagugauuc

SEQ ID NO: 4130156 - RNA, 13 nt, Yersinia pestis
acauaaucaaucc

SEQ ID NO: 4130157 - RNA, 13 nt, Yersinia pestis
acauaauuaaaua

SEQ ID NO: 4130158 - RNA, 12 nt, Yersinia pestis
acauaccacaca

SEQ ID NO: 4130159 - RNA, 21 nt, Yersinia pestis
acauaccccauuuaucgccaa

SEQ ID NO: 4130160 - RNA, 20 nt, Yersinia pestis
acauacgucuccauuucaac

SEQ ID NO: 4130161 - RNA, 21 nt, Yersinia pestis
acauacgucuccauuucaacg

SEQ ID NO: 4130162 - RNA, 20 nt, Yersinia pestis
acauagaagcucauaugcag

SEQ ID NO: 4130163 - RNA, 19 nt, Yersinia pestis
acauagagagaacagcgaa

SEQ ID NO: 4130164 - RNA, 23 nt, Yersinia pestis
acauagcacccaauguauauguu

SEQ ID NO: 4130165 - RNA, 18 nt, Yersinia pestis
acauagcuauuggcugau

SEQ ID NO: 4130166 - RNA, 22 nt, Yersinia pestis
acauagcugcgauaauccgcca

SEQ ID NO: 4130167 - RNA, 23 nt, Yersinia pestis
acauaguuaugaugaguaacaua

SEQ ID NO: 4130168 - RNA, 17 nt, Yersinia pestis
acauaguugaauaacuu

SEQ ID NO: 4130169 - RNA, 15 nt, Yersinia pestis
acauauaaaccagcc

SEQ ID NO: 4130170 - RNA, 20 nt, Yersinia pestis
acauauaaaccagccaguga

SEQ ID NO: 4130171 - RNA, 16 nt, Yersinia pestis
acauauaaccaucaaa

SEQ ID NO: 4130172 - RNA, 17 nt, Yersinia pestis
acauauaaccaucaaau

SEQ ID NO: 4130173 - RNA, 22 nt, Yersinia pestis
acauauaauccaaaauaauaua

SEQ ID NO: 4130174 - RNA, 15 nt, Yersinia pestis
acauaucaacacugc

SEQ ID NO: 4130175 - RNA, 22 nt, Yersinia pestis
acauaucucaucgcuugccacu

SEQ ID NO: 4130176 - RNA, 21 nt, Yersinia pestis
acauaucuccguugaaaccua

SEQ ID NO: 4130177 - RNA, 21 nt, Yersinia pestis
acauaucuuuauuaucaaugg

SEQ ID NO: 4130178 - RNA, 10 nt, Yersinia pestis
acauauguug

SEQ ID NO: 4130179 - RNA, 15 nt, Yersinia pestis
acauauugguaauuu

SEQ ID NO: 4130180 - RNA, 18 nt, Yersinia pestis
acaucaaagguuucacau

SEQ ID NO: 4130181 - RNA, 20 nt, Yersinia pestis
acaucaaagguuucacaugu

SEQ ID NO: 4130182 - RNA, 20 nt, Yersinia pestis
acaucaaccccuuucuuaac

SEQ ID NO: 4130183 - RNA, 14 nt, Yersinia pestis
acaucaaccguuaa

SEQ ID NO: 4130184 - RNA, 15 nt, Yersinia pestis
acaucaaguacuuca

SEQ ID NO: 4130185 - RNA, 12 nt, Yersinia pestis
acaucaauggca

SEQ ID NO: 4130186 - RNA, 22 nt, Yersinia pestis
acaucaggcuguugacauaaac

SEQ ID NO: 4130187 - RNA, 19 nt, Yersinia pestis
acaucauccacuagcauca

SEQ ID NO: 4130188 - RNA, 13 nt, Yersinia pestis
acaucauccaguu

SEQ ID NO: 4130189 - RNA, 18 nt, Yersinia pestis
acaucaucuucuauuauu

SEQ ID NO: 4130190 - RNA, 13 nt, Yersinia pestis
acaucauugguuu

SEQ ID NO: 4130191 - RNA, 12 nt, Yersinia pestis
acauccaauggc

SEQ ID NO: 4130192 - RNA, 12 nt, Yersinia pestis
acauccaauuca

SEQ ID NO: 4130193 - RNA, 19 nt, Yersinia pestis
acauccaauucaguacgac

SEQ ID NO: 4130194 - RNA, 11 nt, Yersinia pestis
acauccacauu

SEQ ID NO: 4130195 - RNA, 16 nt, Yersinia pestis
acaucccgccauggca

SEQ ID NO: 4130196 - RNA, 23 nt, Yersinia pestis
acauccgcuugcagcaacagggu

SEQ ID NO: 4130197 - RNA, 13 nt, Yersinia pestis
acauccuaaaaag

SEQ ID NO: 4130198 - RNA, 17 nt, Yersinia pestis
acauccuaaauaauucc

SEQ ID NO: 4130199 - RNA, 13 nt, Yersinia pestis
acauccucagagc

SEQ ID NO: 4130200 - RNA, 13 nt, Yersinia pestis
acauccuuauuuu

SEQ ID NO: 4130201 - RNA, 13 nt, Yersinia pestis
acaucgacaccaa

SEQ ID NO: 4130202 - RNA, 21 nt, Yersinia pestis
acaucgagcgggcuucaccau

SEQ ID NO: 4130203 - RNA, 22 nt, Yersinia pestis
acaucgguaucggccaauucag

SEQ ID NO: 4130204 - RNA, 19 nt, Yersinia pestis
acaucgugaccccguggcg

SEQ ID NO: 4130205 - RNA, 21 nt, Yersinia pestis
acaucugcuuuacugcuuuuc

SEQ ID NO: 4130206 - RNA, 17 nt, Yersinia pestis
acaucuggcuggcauau

SEQ ID NO: 4130207 - RNA, 20 nt, Yersinia pestis
acaucuggcuggcauauuuc

SEQ ID NO: 4130208 - RNA, 22 nt, Yersinia pestis
acaucuugcgccgaaauaaaac

SEQ ID NO: 4130209 - RNA, 24 nt, Yersinia pestis
acaucuuugcugccaucagccgga

SEQ ID NO: 4130210 - RNA, 18 nt, Yersinia pestis
acaugaacucaacuuucu

SEQ ID NO: 4130211 - RNA, 14 nt, Yersinia pestis
acaugacugaacau

SEQ ID NO: 4130212 - RNA, 16 nt, Yersinia pestis
acaugagacagcgcgg

SEQ ID NO: 4130213 - RNA, 13 nt, Yersinia pestis
acaugagauggca

SEQ ID NO: 4130214 - RNA, 22 nt, Yersinia pestis
acaugagauucaggagauagcc

SEQ ID NO: 4130215 - RNA, 16 nt, Yersinia pestis
acaugaugaaugcgaa

SEQ ID NO: 4130216 - RNA, 21 nt, Yersinia pestis
acaugauuaaaucaagcugcu

SEQ ID NO: 4130217 - RNA, 18 nt, Yersinia pestis
acaugauugaaaaacaga

SEQ ID NO: 4130218 - RNA, 20 nt, Yersinia pestis
acaugcaccguaacuucuuc

SEQ ID NO: 4130219 - RNA, 21 nt, Yersinia pestis
acaugcagcccgaccaaacgg

SEQ ID NO: 4130220 - RNA, 21 nt, Yersinia pestis
acaugccgucaccucaucagu

SEQ ID NO: 4130221 - RNA, 22 nt, Yersinia pestis
acaugcgaugcgagcaaggcau

SEQ ID NO: 4130222 - RNA, 16 nt, Yersinia pestis
acaugcugaagccagc

SEQ ID NO: 4130223 - RNA, 17 nt, Yersinia pestis
acaugcugaagccagca

SEQ ID NO: 4130224 - RNA, 16 nt, Yersinia pestis
acauggcgcaauggcg

SEQ ID NO: 4130225 - RNA, 19 nt, Yersinia pestis
acauggcggcagcacagag

SEQ ID NO: 4130226 - RNA, 18 nt, Yersinia pestis
acauggcucucuuuuuuc

SEQ ID NO: 4130227 - RNA, 22 nt, Yersinia pestis
acaugguccacagucaguucau

SEQ ID NO: 4130228 - RNA, 20 nt, Yersinia pestis
acaugugagugguguaagau

SEQ ID NO: 4130229 - RNA, 15 nt, Yersinia pestis
acauguugaaaucua

SEQ ID NO: 4130230 - RNA, 19 nt, Yersinia pestis
acauuaaaaauacaaccaa

SEQ ID NO: 4130231 - RNA, 20 nt, Yersinia pestis
acauuaaaaauacaaccaac

SEQ ID NO: 4130232 - RNA, 16 nt, Yersinia pestis
acauuaaacccacccc

SEQ ID NO: 4130233 - RNA, 13 nt, Yersinia pestis
acauuaaaugaau

SEQ ID NO: 4130234 - RNA, 16 nt, Yersinia pestis
acauuaacuucagguu

SEQ ID NO: 4130235 - RNA, 24 nt, Yersinia pestis
acauuacaagugccaaauggaaua

SEQ ID NO: 4130236 - RNA, 21 nt, Yersinia pestis
acauuacggcccugaauuaaa

SEQ ID NO: 4130237 - RNA, 22 nt, Yersinia pestis
acauuacgggccucgcggaaau

SEQ ID NO: 4130238 - RNA, 18 nt, Yersinia pestis
accacgcaucaauaauaa

SEQ ID NO: 4130239 - RNA, 19 nt, Yersinia pestis
accacgcauuccaucagcc

SEQ ID NO: 4130240 - RNA, 19 nt, Yersinia pestis
accacgccgucuggcuaau

SEQ ID NO: 4130241 - RNA, 16 nt, Yersinia pestis
accacggccagaauca

SEQ ID NO: 4130242 - RNA, 15 nt, Yersinia pestis
accacguugaauauu

SEQ ID NO: 4130243 - RNA, 21 nt, Yersinia pestis
accacguugaauauucaacgc

SEQ ID NO: 4130244 - RNA, 15 nt, Yersinia pestis
accacuaaaccacau

SEQ ID NO: 4130245 - RNA, 14 nt, Yersinia pestis
accacuaguuaaaa

SEQ ID NO: 4130246 - RNA, 18 nt, Yersinia pestis
accacugacaaaaacagc

SEQ ID NO: 4130247 - RNA, 12 nt, Yersinia pestis
accacugaccua

SEQ ID NO: 4130248 - RNA, 21 nt, Yersinia pestis
accacugaccuauugauaaaa

SEQ ID NO: 4130249 - RNA, 18 nt, Yersinia pestis
accacugaguugcucaag

SEQ ID NO: 4130250 - RNA, 21 nt, Yersinia pestis
accacugccacacuuuugcug

SEQ ID NO: 4130251 - RNA, 19 nt, Yersinia pestis
accagaaugguuuggccgu

SEQ ID NO: 4130252 - RNA, 16 nt, Yersinia pestis
accagacaacagucac

SEQ ID NO: 4130253 - RNA, 22 nt, Yersinia pestis
accagacucugcuaccaggaag

SEQ ID NO: 4130254 - RNA, 23 nt, Yersinia pestis
accagacucugcuaccaggaagc

SEQ ID NO: 4130255 - RNA, 20 nt, Yersinia pestis
accagagaugauagcaaugu

SEQ ID NO: 4130256 - RNA, 14 nt, Yersinia pestis
accagagauuguuu

SEQ ID NO: 4130257 - RNA, 15 nt, Yersinia pestis
accagauaacaacaa

SEQ ID NO: 4130258 - RNA, 16 nt, Yersinia pestis
accagauaacaacaaa

SEQ ID NO: 4130259 - RNA, 21 nt, Yersinia pestis
accagauagcuguuagccaga

SEQ ID NO: 4130260 - RNA, 17 nt, Yersinia pestis
accagcaaagccucuac

SEQ ID NO: 4130261 - RNA, 16 nt, Yersinia pestis
accagcacauaaagcg

SEQ ID NO: 4130262 - RNA, 15 nt, Yersinia pestis
accagcaucaguagc

SEQ ID NO: 4130263 - RNA, 20 nt, Yersinia pestis
accagccgauaauccaccug

SEQ ID NO: 4130264 - RNA, 16 nt, Yersinia pestis
accagcgcacugaaua

SEQ ID NO: 4130265 - RNA, 21 nt, Yersinia pestis
accagcgucaaaccauuuuac

SEQ ID NO: 4130266 - RNA, 18 nt, Yersinia pestis
accagcguggcauugagg

SEQ ID NO: 4130267 - RNA, 20 nt, Yersinia pestis
accagcucaauacgguaauc

SEQ ID NO: 4130268 - RNA, 15 nt, Yersinia pestis
accaggaagcggcca

SEQ ID NO: 4130269 - RNA, 14 nt, Yersinia pestis
accaggccacuugg

SEQ ID NO: 4130270 - RNA, 19 nt, Yersinia pestis
accagggcuaaaauggcac

SEQ ID NO: 4130271 - RNA, 17 nt, Yersinia pestis
accagguauuucuccau

SEQ ID NO: 4130272 - RNA, 14 nt, Yersinia pestis
accaguaaacgcca

SEQ ID NO: 4130273 - RNA, 15 nt, Yersinia pestis
accaguaaacgccaa

SEQ ID NO: 4130274 - RNA, 19 nt, Yersinia pestis
accaguaaacgccaaucac

SEQ ID NO: 4130275 - RNA, 14 nt, Yersinia pestis
accaguagcccagc

SEQ ID NO: 4130276 - RNA, 17 nt, Yersinia pestis
accagucauuuuauuag

SEQ ID NO: 4130277 - RNA, 13 nt, Yersinia pestis
accagucugcaua

SEQ ID NO: 4130278 - RNA, 17 nt, Yersinia pestis
accagucugcauacaga

SEQ ID NO: 4130279 - RNA, 19 nt, Yersinia pestis
accagugaauaaguucugc

SEQ ID NO: 4130280 - RNA, 21 nt, Yersinia pestis
accagugauucgggcaaaugg

SEQ ID NO: 4130281 - RNA, 17 nt, Yersinia pestis
accagugccaaucccca

SEQ ID NO: 4130282 - RNA, 22 nt, Yersinia pestis
accaguuaaagaauacagccag

SEQ ID NO: 4130283 - RNA, 22 nt, Yersinia pestis
accaguugaugaaucaaugaaa

SEQ ID NO: 4130284 - RNA, 20 nt, Yersinia pestis
accaguuuauuuucccuuuc

SEQ ID NO: 4130285 - RNA, 19 nt, Yersinia pestis
accauaaaaggauggccca

SEQ ID NO: 4130286 - RNA, 22 nt, Yersinia pestis
accauaaaauaaauaauuugua

SEQ ID NO: 4130287 - RNA, 23 nt, Yersinia pestis
accauaaaauaaauaauuuguaa

SEQ ID NO: 4130288 - RNA, 20 nt, Yersinia pestis
accauaaaguuacugcgcuc

SEQ ID NO: 4130289 - RNA, 17 nt, Yersinia pestis
accauaaauucacagcg

SEQ ID NO: 4130290 - RNA, 14 nt, Yersinia pestis
accauaacgcugcu

SEQ ID NO: 4130291 - RNA, 13 nt, Yersinia pestis
accauacagcagu

SEQ ID NO: 4130292 - RNA, 22 nt, Yersinia pestis
accauacagcagucaaaaugaa

SEQ ID NO: 4130293 - RNA, 15 nt, Yersinia pestis
accauaguugaacuc

SEQ ID NO: 4130294 - RNA, 14 nt, Yersinia pestis
accauaucagaacc

SEQ ID NO: 4130295 - RNA, 20 nt, Yersinia pestis
accaucaaggacuucaucac

SEQ ID NO: 4130296 - RNA, 18 nt, Yersinia pestis
accaucaauauaagagaa

SEQ ID NO: 4130297 - RNA, 20 nt, Yersinia pestis
accaucacggucaugcggcc

SEQ ID NO: 4130298 - RNA, 18 nt, Yersinia pestis
accaucacuuccagcgcc

SEQ ID NO: 4130299 - RNA, 22 nt, Yersinia pestis
accaucaggauuaaugcggaua

SEQ ID NO: 4130300 - RNA, 16 nt, Yersinia pestis
accauccccagaacag

SEQ ID NO: 4130301 - RNA, 17 nt, Yersinia pestis
accauccccagaacagc

SEQ ID NO: 4130302 - RNA, 20 nt, Yersinia pestis
accauccccugucuugccag

SEQ ID NO: 4130303 - RNA, 23 nt, Yersinia pestis
accauccggguuuaucccauuaa

SEQ ID NO: 4130304 - RNA, 14 nt, Yersinia pestis
accaucgacgccag

SEQ ID NO: 4130305 - RNA, 17 nt, Yersinia pestis
accaucgcucuccugcc

SEQ ID NO: 4130306 - RNA, 20 nt, Yersinia pestis
accaucuugucauuaccaau

SEQ ID NO: 4130307 - RNA, 22 nt, Yersinia pestis
accaucuugucauuaccaaugg

SEQ ID NO: 4130308 - RNA, 16 nt, Yersinia pestis
accaugagugaaaaua

SEQ ID NO: 4130309 - RNA, 21 nt, Yersinia pestis
accaugagugaaaauauguag

SEQ ID NO: 4130310 - RNA, 14 nt, Yersinia pestis
accaugaugacaau

SEQ ID NO: 4130311 - RNA, 20 nt, Yersinia pestis
accaugccaucaauguucgg

SEQ ID NO: 4130312 - RNA, 24 nt, Yersinia pestis
accaugcuuauugccaugcuuguc

SEQ ID NO: 4130313 - RNA, 14 nt, Yersinia pestis
accauggcaggucu

SEQ ID NO: 4130314 - RNA, 12 nt, Yersinia pestis
accauguccaug

SEQ ID NO: 4130315 - RNA, 16 nt, Yersinia pestis
accauguucuggcaga

SEQ ID NO: 4130316 - RNA, 17 nt, Yersinia pestis
accauuaacaauauuau

SEQ ID NO: 4130317 - RNA, 14 nt, Yersinia pestis
accauuaacaaugu

SEQ ID NO: 4130318 - RNA, 22 nt, Yersinia pestis
accauuaacaauguuauauuuc

SEQ ID NO: 4130319 - RNA, 15 nt, Yersinia pestis
accauucucaaaaua

SEQ ID NO: 4130320 - RNA, 12 nt, Yersinia pestis
accauugaccag

SEQ ID NO: 4130321 - RNA, 15 nt, Yersinia pestis
accauugaccagcgu

SEQ ID NO: 4130322 - RNA, 20 nt, Yersinia pestis
accauuggggaagauauauu

SEQ ID NO: 4130323 - RNA, 15 nt, Yersinia pestis
accauuuccaggcua

SEQ ID NO: 4130324 - RNA, 16 nt, Yersinia pestis
accauuugcccuggag

SEQ ID NO: 4130325 - RNA, 21 nt, Yersinia pestis
accauuugcccuggagcaaga

SEQ ID NO: 4130326 - RNA, 18 nt, Yersinia pestis
accauuuuagcuggcagu

SEQ ID NO: 4130327 - RNA, 17 nt, Yersinia pestis
acccaaaccaacaauau

SEQ ID NO: 4130328 - RNA, 23 nt, Yersinia pestis
acccaaaguggugagcugaucug

SEQ ID NO: 4130329 - RNA, 14 nt, Yersinia pestis
acccaaauuacggc

SEQ ID NO: 4130330 - RNA, 23 nt, Yersinia pestis
acccaacaaugaacuguguuuau

SEQ ID NO: 4130331 - RNA, 22 nt, Yersinia pestis
acccaacaguaccuucuaucgu

SEQ ID NO: 4130332 - RNA, 23 nt, Yersinia pestis
acccaacagugcucgcaaacgau

SEQ ID NO: 4130333 - RNA, 15 nt, Yersinia pestis
acccaaccccaucag

SEQ ID NO: 4130334 - RNA, 13 nt, Yersinia pestis
acccaacuuuuuu

SEQ ID NO: 4130335 - RNA, 19 nt, Yersinia pestis
acccaagggcuauugcugu

SEQ ID NO: 4130336 - RNA, 16 nt, Yersinia pestis
acccaauaauaaucca

SEQ ID NO: 4130337 - RNA, 21 nt, Yersinia pestis
acccacaauauauacauacgu

SEQ ID NO: 4130338 - RNA, 14 nt, Yersinia pestis
acccacauucaggc

SEQ ID NO: 4130339 - RNA, 18 nt, Yersinia pestis
acccaccagagaccacag

SEQ ID NO: 4130340 - RNA, 17 nt, Yersinia pestis
acccacgccgaaaacaa

SEQ ID NO: 4130341 - RNA, 20 nt, Yersinia pestis
acccacgguaucugcuuuau

SEQ ID NO: 4130342 - RNA, 18 nt, Yersinia pestis
acccacucggccaaacaa

SEQ ID NO: 4130343 - RNA, 22 nt, Yersinia pestis
acccacuugccauaagugaaca

SEQ ID NO: 4130344 - RNA, 22 nt, Yersinia pestis
acccagcaacagguucgauacu

SEQ ID NO: 4130345 - RNA, 21 nt, Yersinia pestis
acccagccguggaucauggcu

SEQ ID NO: 4130346 - RNA, 19 nt, Yersinia pestis
acccagcgaacguaaaaag

SEQ ID NO: 4130347 - RNA, 15 nt, Yersinia pestis
acccaguaacugagc

SEQ ID NO: 4130348 - RNA, 14 nt, Yersinia pestis
acccaguugcgccg

SEQ ID NO: 4130349 - RNA, 23 nt, Yersinia pestis
acccauaaguccuuaaaaaucca

SEQ ID NO: 4130350 - RNA, 23 nt, Yersinia pestis
acccauacaaauaguaauaauua

SEQ ID NO: 4130351 - RNA, 20 nt, Yersinia pestis
acccauacgaucagcaagau

SEQ ID NO: 4130352 - RNA, 18 nt, Yersinia pestis
acccauauuacucacaca

SEQ ID NO: 4130353 - RNA, 20 nt, Yersinia pestis
acccauauuggcaauauuca

SEQ ID NO: 4130354 - RNA, 22 nt, Yersinia pestis
acccauuauauagauuuauuca

SEQ ID NO: 4130355 - RNA, 20 nt, Yersinia pestis
acccauuugcacagcauuua

SEQ ID NO: 4130356 - RNA, 16 nt, Yersinia pestis
accccaacgcuggcug

SEQ ID NO: 4130357 - RNA, 13 nt, Yersinia pestis
accccaauucuua

SEQ ID NO: 4130358 - RNA, 14 nt, Yersinia pestis
accccacaaccugc

SEQ ID NO: 4130359 - RNA, 18 nt, Yersinia pestis
accggauuguucagcaac

SEQ ID NO: 4130360 - RNA, 21 nt, Yersinia pestis
accggcaacugccgcuucagu

SEQ ID NO: 4130361 - RNA, 20 nt, Yersinia pestis
accggcaguucauuccccau

SEQ ID NO: 4130362 - RNA, 22 nt, Yersinia pestis
accggcgaagggcgcagccccc

SEQ ID NO: 4130363 - RNA, 19 nt, Yersinia pestis
accggcuaauaccaggcug

SEQ ID NO: 4130364 - RNA, 18 nt, Yersinia pestis
accggcuggcauuuuuau

SEQ ID NO: 4130365 - RNA, 15 nt, Yersinia pestis
accgggauacgggau

SEQ ID NO: 4130366 - RNA, 16 nt, Yersinia pestis
accgggcuugauuaaa

SEQ ID NO: 4130367 - RNA, 18 nt, Yersinia pestis
accggggaagagauaaau

SEQ ID NO: 4130368 - RNA, 19 nt, Yersinia pestis
accgggguucgcaaugaac

SEQ ID NO: 4130369 - RNA, 23 nt, Yersinia pestis
accgguacggcccaaugucccca

SEQ ID NO: 4130370 - RNA, 14 nt, Yersinia pestis
accggucacaccag

SEQ ID NO: 4130371 - RNA, 17 nt, Yersinia pestis
accggucauacauuggc

SEQ ID NO: 4130372 - RNA, 22 nt, Yersinia pestis
accggugauuacugucauuucc

SEQ ID NO: 4130373 - RNA, 17 nt, Yersinia pestis
accgguuaaacuucuuu

SEQ ID NO: 4130374 - RNA, 17 nt, Yersinia pestis
accgguuuacccugcgc

SEQ ID NO: 4130375 - RNA, 14 nt, Yersinia pestis
accguaacuucuuc

SEQ ID NO: 4130376 - RNA, 16 nt, Yersinia pestis
accguacauuaaauga

SEQ ID NO: 4130377 - RNA, 22 nt, Yersinia pestis
accguacauuaaaugaauaccu

SEQ ID NO: 4130378 - RNA, 14 nt, Yersinia pestis
accguaucaacgua

SEQ ID NO: 4130379 - RNA, 14 nt, Yersinia pestis
accguaucacccgc

SEQ ID NO: 4130380 - RNA, 20 nt, Yersinia pestis
accguaucaucaccaaacag

SEQ ID NO: 4130381 - RNA, 17 nt, Yersinia pestis
accgucaagacaacaaa

SEQ ID NO: 4130382 - RNA, 20 nt, Yersinia pestis
accgucaagacaacaaacag

SEQ ID NO: 4130383 - RNA, 16 nt, Yersinia pestis
accgucaccuuuauga

SEQ ID NO: 4130384 - RNA, 16 nt, Yersinia pestis
accgucauccagcacu

SEQ ID NO: 4130385 - RNA, 16 nt, Yersinia pestis
accgucuuugaccgaa

SEQ ID NO: 4130386 - RNA, 16 nt, Yersinia pestis
accgugacauuuucac

SEQ ID NO: 4130387 - RNA, 18 nt, Yersinia pestis
accgugacuaaaacaagc

SEQ ID NO: 4130388 - RNA, 14 nt, Yersinia pestis
accguggauaaaca

SEQ ID NO: 4130389 - RNA, 16 nt, Yersinia pestis
accguggauaaacaaa

SEQ ID NO: 4130390 - RNA, 14 nt, Yersinia pestis
accguguacccgau

SEQ ID NO: 4130391 - RNA, 13 nt, Yersinia pestis
accgugugauaaa

SEQ ID NO: 4130392 - RNA, 17 nt, Yersinia pestis
accguuguauguggcug

SEQ ID NO: 4130393 - RNA, 16 nt, Yersinia pestis
accguuuauuuacugg

SEQ ID NO: 4130394 - RNA, 20 nt, Yersinia pestis
accguuucagaucgcgucau

SEQ ID NO: 4130395 - RNA, 18 nt, Yersinia pestis
accguuuuuacaauucgg

SEQ ID NO: 4130396 - RNA, 14 nt, Yersinia pestis
accuaaaaaaaaca

SEQ ID NO: 4130397 - RNA, 16 nt, Yersinia pestis
accuaaaaaaaacaac

SEQ ID NO: 4130398 - RNA, 15 nt, Yersinia pestis
accuaaaaugacgau

SEQ ID NO: 4130399 - RNA, 21 nt, Yersinia pestis
accuaacacuuuaucgaccac

SEQ ID NO: 4130400 - RNA, 14 nt, Yersinia pestis
accuaacaugcuga

SEQ ID NO: 4130401 - RNA, 16 nt, Yersinia pestis
accuaaccaaacauug

SEQ ID NO: 4130402 - RNA, 20 nt, Yersinia pestis
accuaacuuccuaacaauau

SEQ ID NO: 4130403 - RNA, 17 nt, Yersinia pestis
accuaauacagcaccac

SEQ ID NO: 4130404 - RNA, 14 nt, Yersinia pestis
accuaauccaaggc

SEQ ID NO: 4130405 - RNA, 18 nt, Yersinia pestis
accuaaugcaauggcucc

SEQ ID NO: 4130406 - RNA, 13 nt, Yersinia pestis
accuaccaccuac

SEQ ID NO: 4130407 - RNA, 14 nt, Yersinia pestis
accuaccaccuaca

SEQ ID NO: 4130408 - RNA, 19 nt, Yersinia pestis
accuaccaccuacaaccua

SEQ ID NO: 4130409 - RNA, 14 nt, Yersinia pestis
accuaccaccuacc

SEQ ID NO: 4130410 - RNA, 14 nt, Yersinia pestis
accuacccuuuaga

SEQ ID NO: 4130411 - RNA, 16 nt, Yersinia pestis
accuaccgcaccaaug

SEQ ID NO: 4130412 - RNA, 13 nt, Yersinia pestis
accuaccggauaa

SEQ ID NO: 4130413 - RNA, 16 nt, Yersinia pestis
accuagguucuggacu

SEQ ID NO: 4130414 - RNA, 16 nt, Yersinia pestis
accuaguagauaauca

SEQ ID NO: 4130415 - RNA, 23 nt, Yersinia pestis
accuauaaacuugauucaccaga

SEQ ID NO: 4130416 - RNA, 18 nt, Yersinia pestis
accuauaauuaacagcau

SEQ ID NO: 4130417 - RNA, 19 nt, Yersinia pestis
accuauaauuaacagcauc

SEQ ID NO: 4130418 - RNA, 18 nt, Yersinia pestis
accuaucgccgccgccag

SEQ ID NO: 4130419 - RNA, 22 nt, Yersinia pestis
accuaucgguaucucccgcaaa

SEQ ID NO: 4130420 - RNA, 15 nt, Yersinia pestis
accuauugauaaaac

SEQ ID NO: 4130421 - RNA, 18 nt, Yersinia pestis
accuauugauaaaaccac

SEQ ID NO: 4130422 - RNA, 20 nt, Yersinia pestis
accuauugauaaaaccgcuu

SEQ ID NO: 4130423 - RNA, 14 nt, Yersinia pestis
accucaaaaggaug

SEQ ID NO: 4130424 - RNA, 19 nt, Yersinia pestis
accucaaaaggauggccca

SEQ ID NO: 4130425 - RNA, 14 nt, Yersinia pestis
accucaaaauacau

SEQ ID NO: 4130426 - RNA, 23 nt, Yersinia pestis
accucaaaauacauaagcuccug

SEQ ID NO: 4130427 - RNA, 19 nt, Yersinia pestis
accucaaccugccagccug

SEQ ID NO: 4130428 - RNA, 18 nt, Yersinia pestis
accucacacgauuuuuac

SEQ ID NO: 4130429 - RNA, 22 nt, Yersinia pestis
accucaccguuaauggcaccau

SEQ ID NO: 4130430 - RNA, 16 nt, Yersinia pestis
accucaccucugcgaa

SEQ ID NO: 4130431 - RNA, 23 nt, Yersinia pestis
accucaccucugcgaagccgcug

SEQ ID NO: 4130432 - RNA, 13 nt, Yersinia pestis
accucacgggcuu

SEQ ID NO: 4130433 - RNA, 14 nt, Yersinia pestis
accucaucacccgc

SEQ ID NO: 4130434 - RNA, 23 nt, Yersinia pestis
accucaucccaaaauagccagcc

SEQ ID NO: 4130435 - RNA, 15 nt, Yersinia pestis
accuccacaggaggu

SEQ ID NO: 4130436 - RNA, 20 nt, Yersinia pestis
accuccggggccugcggcca

SEQ ID NO: 4130437 - RNA, 14 nt, Yersinia pestis
accuccguaggcca

SEQ ID NO: 4130438 - RNA, 15 nt, Yersinia pestis
accuccguaggccaa

SEQ ID NO: 4130439 - RNA, 17 nt, Yersinia pestis
accucgaaaucauccgc

SEQ ID NO: 4130440 - RNA, 16 nt, Yersinia pestis
accucgggcgcuuaaa

SEQ ID NO: 4130441 - RNA, 20 nt, Yersinia pestis
accucgggcgcuuaaauaaa

SEQ ID NO: 4130442 - RNA, 18 nt, Yersinia pestis
accucuaaucuccucucc

SEQ ID NO: 4130443 - RNA, 22 nt, Yersinia pestis
accucucaguugauggcuuuau

SEQ ID NO: 4130444 - RNA, 21 nt, Yersinia pestis
accucugcgaagccgcugcaa

SEQ ID NO: 4130445 - RNA, 19 nt, Yersinia pestis
accucuucuuccgccaccg

SEQ ID NO: 4130446 - RNA, 19 nt, Yersinia pestis
accugaaucaacucauuua

SEQ ID NO: 4130447 - RNA, 24 nt, Yersinia pestis
accugaaucgauaaacccgugcuc

SEQ ID NO: 4130448 - RNA, 15 nt, Yersinia pestis
accugaaugccauuc

SEQ ID NO: 4130449 - RNA, 17 nt, Yersinia pestis
accugaaugccauucaa

SEQ ID NO: 4130450 - RNA, 16 nt, Yersinia pestis
accugacgaaaugccg

SEQ ID NO: 4130451 - RNA, 20 nt, Yersinia pestis
accugacgaaaugccgccug

SEQ ID NO: 4130452 - RNA, 17 nt, Yersinia pestis
accugaggauaaaaacu

SEQ ID NO: 4130453 - RNA, 19 nt, Yersinia pestis
accugaggauaaaaacuac

SEQ ID NO: 4130454 - RNA, 14 nt, Yersinia pestis
accugauaggccaa

SEQ ID NO: 4130455 - RNA, 19 nt, Yersinia pestis
accugauaggccaaaaaug

SEQ ID NO: 4130456 - RNA, 22 nt, Yersinia pestis
accugauaggccaaaaaugcga

SEQ ID NO: 4130457 - RNA, 17 nt, Yersinia pestis
accugauccaguuucag

SEQ ID NO: 4130458 - RNA, 19 nt, Yersinia pestis
accugaugacccgguaaaa

SEQ ID NO: 4130459 - RNA, 18 nt, Yersinia pestis
accugauguaacucagga

SEQ ID NO: 4130460 - RNA, 22 nt, Yersinia pestis
accugauguuuugcugccauuu

SEQ ID NO: 4130461 - RNA, 17 nt, Yersinia pestis
accugcaacguuaaaga

SEQ ID NO: 4130462 - RNA, 19 nt, Yersinia pestis
accugcaccaaucauuaca

SEQ ID NO: 4130463 - RNA, 15 nt, Yersinia pestis
accugcaccaaugac

SEQ ID NO: 4130464 - RNA, 14 nt, Yersinia pestis
accugcacuuucau

SEQ ID NO: 4130465 - RNA, 14 nt, Yersinia pestis
accugcauauccuc

SEQ ID NO: 4130466 - RNA, 15 nt, Yersinia pestis
accugcaucaucaca

SEQ ID NO: 4130467 - RNA, 17 nt, Yersinia pestis
accugcaucaucacauu

SEQ ID NO: 4130468 - RNA, 18 nt, Yersinia pestis
accugcauccccggcauc

SEQ ID NO: 4130469 - RNA, 14 nt, Yersinia pestis
accugccugcugcu

SEQ ID NO: 4130470 - RNA, 15 nt, Yersinia pestis
accugccugcugcug

SEQ ID NO: 4130471 - RNA, 13 nt, Yersinia pestis
accugcuaaccga

SEQ ID NO: 4130472 - RNA, 12 nt, Yersinia pestis
accugcucaacu

SEQ ID NO: 4130473 - RNA, 18 nt, Yersinia pestis
accugcucaacugcucaa

SEQ ID NO: 4130474 - RNA, 15 nt, Yersinia pestis
accugcuuaguuaca

SEQ ID NO: 4130475 - RNA, 16 nt, Yersinia pestis
accuggcucaaauuug

SEQ ID NO: 4130476 - RNA, 14 nt, Yersinia pestis
accuguaaaagcag

SEQ ID NO: 4130477 - RNA, 23 nt, Yersinia pestis
accuguaaaagcagccgugcuug

SEQ ID NO: 4130478 - RNA, 23 nt, Yersinia pestis
accuguagcuuuuuaaauaccag

SEQ ID NO: 4130479 - RNA, 20 nt, Yersinia pestis
accugucaccuaccaccuac

SEQ ID NO: 4130480 - RNA, 15 nt, Yersinia pestis
accugucaccuguca

SEQ ID NO: 4130481 - RNA, 21 nt, Yersinia pestis
acgcagaacuagcgccgcauc

SEQ ID NO: 4130482 - RNA, 15 nt, Yersinia pestis
acgcagauaaaucag

SEQ ID NO: 4130483 - RNA, 14 nt, Yersinia pestis
acgcagcgaaaugu

SEQ ID NO: 4130484 - RNA, 22 nt, Yersinia pestis
acgcagcuccagcgucacuuca

SEQ ID NO: 4130485 - RNA, 15 nt, Yersinia pestis
acgcagcuuguugau

SEQ ID NO: 4130486 - RNA, 16 nt, Yersinia pestis
acgcaucacaucuugc

SEQ ID NO: 4130487 - RNA, 16 nt, Yersinia pestis
acgcaucacgcccggc

SEQ ID NO: 4130488 - RNA, 16 nt, Yersinia pestis
acgcaucaugguccag

SEQ ID NO: 4130489 - RNA, 15 nt, Yersinia pestis
acgcaucgaccaccc

SEQ ID NO: 4130490 - RNA, 18 nt, Yersinia pestis
acgcaucgaccacccgua

SEQ ID NO: 4130491 - RNA, 22 nt, Yersinia pestis
acgcauuacucucgccaaacaa

SEQ ID NO: 4130492 - RNA, 17 nt, Yersinia pestis
acgcauucaucagggca

SEQ ID NO: 4130493 - RNA, 17 nt, Yersinia pestis
acgcauuccaucagcca

SEQ ID NO: 4130494 - RNA, 13 nt, Yersinia pestis
acgccaauaccgg

SEQ ID NO: 4130495 - RNA, 14 nt, Yersinia pestis
acgccaauucacgc

SEQ ID NO: 4130496 - RNA, 14 nt, Yersinia pestis
acgccaccaaugca

SEQ ID NO: 4130497 - RNA, 19 nt, Yersinia pestis
acgccacuacgaccccaac

SEQ ID NO: 4130498 - RNA, 19 nt, Yersinia pestis
acgccaguaaacagccagc

SEQ ID NO: 4130499 - RNA, 22 nt, Yersinia pestis
acgccaugcagcuaaaagaugc

SEQ ID NO: 4130500 - RNA, 15 nt, Yersinia pestis
acgccaugccgguug

SEQ ID NO: 4130501 - RNA, 21 nt, Yersinia pestis
acgccauuuaccgcaauauca

SEQ ID NO: 4130502 - RNA, 21 nt, Yersinia pestis
acgcccagcuuuagcauugca

SEQ ID NO: 4130503 - RNA, 17 nt, Yersinia pestis
acgcccaggccauagca

SEQ ID NO: 4130504 - RNA, 13 nt, Yersinia pestis
acgccccgccccu

SEQ ID NO: 4130505 - RNA, 22 nt, Yersinia pestis
acgcccgcagcggcuagcagca

SEQ ID NO: 4130506 - RNA, 14 nt, Yersinia pestis
acgccgacaauacu

SEQ ID NO: 4130507 - RNA, 16 nt, Yersinia pestis
acgccgacaauacugc

SEQ ID NO: 4130508 - RNA, 22 nt, Yersinia pestis
acgccgaggugaagacacccgu

SEQ ID NO: 4130509 - RNA, 15 nt, Yersinia pestis
acgccgaucauaaau

SEQ ID NO: 4130510 - RNA, 13 nt, Yersinia pestis
acgccgccgcacc

SEQ ID NO: 4130511 - RNA, 20 nt, Yersinia pestis
acgccgcuacaagcauguga

SEQ ID NO: 4130512 - RNA, 15 nt, Yersinia pestis
acgccgcucaauuaa

SEQ ID NO: 4130513 - RNA, 20 nt, Yersinia pestis
acgccgcucaauuaaccuga

SEQ ID NO: 4130514 - RNA, 17 nt, Yersinia pestis
acgccggcgccauugcg

SEQ ID NO: 4130515 - RNA, 22 nt, Yersinia pestis
acgccgggguggauuaccggcg

SEQ ID NO: 4130516 - RNA, 17 nt, Yersinia pestis
acgccuauccucaugau

SEQ ID NO: 4130517 - RNA, 17 nt, Yersinia pestis
acgccucaucuucacga

SEQ ID NO: 4130518 - RNA, 22 nt, Yersinia pestis
acgccucguuuaacucaaauaa

SEQ ID NO: 4130519 - RNA, 20 nt, Yersinia pestis
acgccugggauccauaggau

SEQ ID NO: 4130520 - RNA, 22 nt, Yersinia pestis
acgccuuggcguuucugaagau

SEQ ID NO: 4130521 - RNA, 20 nt, Yersinia pestis
acgcgaaacgcccaaaucug

SEQ ID NO: 4130522 - RNA, 14 nt, Yersinia pestis
acgcgauuauuugc

SEQ ID NO: 4130523 - RNA, 14 nt, Yersinia pestis
acgcgcuagcuuca

SEQ ID NO: 4130524 - RNA, 19 nt, Yersinia pestis
acgcggcguuccucuugag

SEQ ID NO: 4130525 - RNA, 14 nt, Yersinia pestis
acgcgggauauaag

SEQ ID NO: 4130526 - RNA, 23 nt, Yersinia pestis
acgcguagagccuuuacgggcug

SEQ ID NO: 4130527 - RNA, 14 nt, Yersinia pestis
acgcguaugcuggu

SEQ ID NO: 4130528 - RNA, 17 nt, Yersinia pestis
acgcguuagcgauuucu

SEQ ID NO: 4130529 - RNA, 15 nt, Yersinia pestis
acgcguugauccauc

SEQ ID NO: 4130530 - RNA, 18 nt, Yersinia pestis
acgcguugcccuucuuca

SEQ ID NO: 4130531 - RNA, 13 nt, Yersinia pestis
acgcguuugcuug

SEQ ID NO: 4130532 - RNA, 21 nt, Yersinia pestis
acgcuaauuauuuuauuuaaa

SEQ ID NO: 4130533 - RNA, 16 nt, Yersinia pestis
acgcuaccaugaguga

SEQ ID NO: 4130534 - RNA, 15 nt, Yersinia pestis
acgcuaucaacuuug

SEQ ID NO: 4130535 - RNA, 15 nt, Yersinia pestis
acgcucaaacaaugu

SEQ ID NO: 4130536 - RNA, 12 nt, Yersinia pestis
acgcucaucaac

SEQ ID NO: 4130537 - RNA, 21 nt, Yersinia pestis
acgcuccagugcaucgcugag

SEQ ID NO: 4130538 - RNA, 21 nt, Yersinia pestis
acgcucccuccgccagcaagu

SEQ ID NO: 4130539 - RNA, 13 nt, Yersinia pestis
acgcuccuggcga

SEQ ID NO: 4130540 - RNA, 15 nt, Yersinia pestis
acgcucuaacgucag

SEQ ID NO: 4130541 - RNA, 18 nt, Yersinia pestis
acgcugaaacuuuucagu

SEQ ID NO: 4130542 - RNA, 16 nt, Yersinia pestis
acgcugaauacacucg

SEQ ID NO: 4130543 - RNA, 17 nt, Yersinia pestis
acgcugaauacacucgu

SEQ ID NO: 4130544 - RNA, 22 nt, Yersinia pestis
acgcugaauacacucgugguga

SEQ ID NO: 4130545 - RNA, 16 nt, Yersinia pestis
acgcugauacauuucc

SEQ ID NO: 4130546 - RNA, 13 nt, Yersinia pestis
acgcugauuaaac

SEQ ID NO: 4130547 - RNA, 19 nt, Yersinia pestis
acgcugcaccgcugauaac

SEQ ID NO: 4130548 - RNA, 20 nt, Yersinia pestis
acgcugcccgucaauaucau

SEQ ID NO: 4130549 - RNA, 17 nt, Yersinia pestis
acgcuggcacugccauc

SEQ ID NO: 4130550 - RNA, 13 nt, Yersinia pestis
acgcugggcgaua

SEQ ID NO: 4130551 - RNA, 23 nt, Yersinia pestis
acgcugggcgcuuacaugaugaa

SEQ ID NO: 4130552 - RNA, 20 nt, Yersinia pestis
acgcugguguaacggcugcu

SEQ ID NO: 4130553 - RNA, 15 nt, Yersinia pestis
acgcuuuacuccucu

SEQ ID NO: 4130554 - RNA, 16 nt, Yersinia pestis
acgcuuuacuccucug

SEQ ID NO: 4130555 - RNA, 20 nt, Yersinia pestis
acgcuuuacuccucugccua

SEQ ID NO: 4130556 - RNA, 23 nt, Yersinia pestis
acgcuuuacucuucagccuaucc

SEQ ID NO: 4130557 - RNA, 22 nt, Yersinia pestis
acgcuuucaggagugaauuucu

SEQ ID NO: 4130558 - RNA, 14 nt, Yersinia pestis
acggaacucaucuu

SEQ ID NO: 4130559 - RNA, 15 nt, Yersinia pestis
acggaacucaucuuu

SEQ ID NO: 4130560 - RNA, 21 nt, Yersinia pestis
acggacacauaaguguauucg

SEQ ID NO: 4130561 - RNA, 17 nt, Yersinia pestis
acggacaguugugucag

SEQ ID NO: 4130562 - RNA, 18 nt, Yersinia pestis
acggacauuuuacucccu

SEQ ID NO: 4130563 - RNA, 19 nt, Yersinia pestis
acggacauuuuacucccug

SEQ ID NO: 4130564 - RNA, 15 nt, Yersinia pestis
acggacgugaauaug

SEQ ID NO: 4130565 - RNA, 19 nt, Yersinia pestis
acggacuaauacggguuuc

SEQ ID NO: 4130566 - RNA, 15 nt, Yersinia pestis
acggagaauaaaaau

SEQ ID NO: 4130567 - RNA, 14 nt, Yersinia pestis
acggagcguacacg

SEQ ID NO: 4130568 - RNA, 20 nt, Yersinia pestis
acggauacccagcacaauga

SEQ ID NO: 4130569 - RNA, 18 nt, Yersinia pestis
acggauacccgagaauac

SEQ ID NO: 4130570 - RNA, 17 nt, Yersinia pestis
acggauagcgcuucagu

SEQ ID NO: 4130571 - RNA, 12 nt, Yersinia pestis
acggauaucaac

SEQ ID NO: 4130572 - RNA, 14 nt, Yersinia pestis
acggauaucaacau

SEQ ID NO: 4130573 - RNA, 14 nt, Yersinia pestis
acggaucacgcugu

SEQ ID NO: 4130574 - RNA, 14 nt, Yersinia pestis
acggaugagucgcu

SEQ ID NO: 4130575 - RNA, 15 nt, Yersinia pestis
acggaugaucggcau

SEQ ID NO: 4130576 - RNA, 20 nt, Yersinia pestis
acggcaacuucuacauagaa

SEQ ID NO: 4130577 - RNA, 16 nt, Yersinia pestis
acggcaccuuuuuugu

SEQ ID NO: 4130578 - RNA, 17 nt, Yersinia pestis
acggcacguuuccccuu

SEQ ID NO: 4130579 - RNA, 14 nt, Yersinia pestis
acggcagcaacgaa

SEQ ID NO: 4130580 - RNA, 15 nt, Yersinia pestis
acggcagcaacgaaa

SEQ ID NO: 4130581 - RNA, 16 nt, Yersinia pestis
acggcagugaucgcac

SEQ ID NO: 4130582 - RNA, 22 nt, Yersinia pestis
acggcagugaucgcacuucaac

SEQ ID NO: 4130583 - RNA, 23 nt, Yersinia pestis
acggcagugaucgcacuucaacc

SEQ ID NO: 4130584 - RNA, 22 nt, Yersinia pestis
acggcaucgaguccguuaaaaa

SEQ ID NO: 4130585 - RNA, 23 nt, Yersinia pestis
acggcaugauaauuugucaguaa

SEQ ID NO: 4130586 - RNA, 16 nt, Yersinia pestis
acggccaacugcuggc

SEQ ID NO: 4130587 - RNA, 20 nt, Yersinia pestis
acggccagagccaccagaau

SEQ ID NO: 4130588 - RNA, 14 nt, Yersinia pestis
acggccagcaaccu

SEQ ID NO: 4130589 - RNA, 22 nt, Yersinia pestis
acggccagcaaccuggcggccc

SEQ ID NO: 4130590 - RNA, 16 nt, Yersinia pestis
acggccagcaaugugu

SEQ ID NO: 4130591 - RNA, 20 nt, Yersinia pestis
acggcccaauauugauccac

SEQ ID NO: 4130592 - RNA, 17 nt, Yersinia pestis
acggccuguaccaccac

SEQ ID NO: 4130593 - RNA, 19 nt, Yersinia pestis
acggccuguaccaccacca

SEQ ID NO: 4130594 - RNA, 12 nt, Yersinia pestis
acggccuucuuu

SEQ ID NO: 4130595 - RNA, 21 nt, Yersinia pestis
acggcgcagggcgauauccag

SEQ ID NO: 4130596 - RNA, 22 nt, Yersinia pestis
acggcggcuacugguagcagcc

SEQ ID NO: 4130597 - RNA, 23 nt, Yersinia pestis
acggcgucuuuacgaucugccug

SEQ ID NO: 4130598 - RNA, 14 nt, Yersinia pestis
acggcguuugacaa

SEQ ID NO: 4130599 - RNA, 16 nt, Yersinia pestis
acggcguuugacaaua

SEQ ID NO: 4130600 - RNA, 12 nt, Yersinia pestis
acggcucaucac

SEQ ID NO: 4130601 - RNA, 17 nt, Yersinia pestis
acggcucaucacaccgc

SEQ ID NO: 4130602 - RNA, 22 nt, Yersinia pestis
acggcucaucgcuaaccgccag

SEQ ID NO: 4130603 - RNA, 14 nt, Yersinia pestis
acuauuaauuuuau

SEQ ID NO: 4130604 - RNA, 15 nt, Yersinia pestis
acuauuaauuuuauu

SEQ ID NO: 4130605 - RNA, 19 nt, Yersinia pestis
acuauucaaugacuccuga

SEQ ID NO: 4130606 - RNA, 20 nt, Yersinia pestis
acuauucccauggugauaaa

SEQ ID NO: 4130607 - RNA, 22 nt, Yersinia pestis
acuauucgcuuuauauccccug

SEQ ID NO: 4130608 - RNA, 16 nt, Yersinia pestis
acuauucucgaaaaag

SEQ ID NO: 4130609 - RNA, 17 nt, Yersinia pestis
acuauucucgaaaaaga

SEQ ID NO: 4130610 - RNA, 19 nt, Yersinia pestis
acuauucucgaaaaagaga

SEQ ID NO: 4130611 - RNA, 20 nt, Yersinia pestis
acuauugcaucuuuaauuaa

SEQ ID NO: 4130612 - RNA, 18 nt, Yersinia pestis
acuauuggucaaucuaga

SEQ ID NO: 4130613 - RNA, 22 nt, Yersinia pestis
acuauuuauuaaucuauuaaua

SEQ ID NO: 4130614 - RNA, 16 nt, Yersinia pestis
acuauuucagacauac

SEQ ID NO: 4130615 - RNA, 19 nt, Yersinia pestis
acuauuuguaguuuuucau

SEQ ID NO: 4130616 - RNA, 14 nt, Yersinia pestis
acuauuuuucucaa

SEQ ID NO: 4130617 - RNA, 21 nt, Yersinia pestis
acuauuuuugacuuuaauuaa

SEQ ID NO: 4130618 - RNA, 13 nt, Yersinia pestis
acucaaaacaauu

SEQ ID NO: 4130619 - RNA, 15 nt, Yersinia pestis
acucaaaauacuuaa

SEQ ID NO: 4130620 - RNA, 16 nt, Yersinia pestis
acucaaacugauaaag

SEQ ID NO: 4130621 - RNA, 18 nt, Yersinia pestis
acucaaauaaaccaauau

SEQ ID NO: 4130622 - RNA, 19 nt, Yersinia pestis
acucaaauagauagcaauc

SEQ ID NO: 4130623 - RNA, 14 nt, Yersinia pestis
acucaaauuauuuu

SEQ ID NO: 4130624 - RNA, 18 nt, Yersinia pestis
acucaaccccagccggug

SEQ ID NO: 4130625 - RNA, 13 nt, Yersinia pestis
acucaagccucua

SEQ ID NO: 4130626 - RNA, 17 nt, Yersinia pestis
acucaagcguacaucag

SEQ ID NO: 4130627 - RNA, 22 nt, Yersinia pestis
acucaaucuuugccuauuucag

SEQ ID NO: 4130628 - RNA, 18 nt, Yersinia pestis
acucaaugcuuaacagcc

SEQ ID NO: 4130629 - RNA, 23 nt, Yersinia pestis
acucaaugucaugcaauuacugc

SEQ ID NO: 4130630 - RNA, 12 nt, Yersinia pestis
acucacacagcc

SEQ ID NO: 4130631 - RNA, 17 nt, Yersinia pestis
acucacacagccagccu

SEQ ID NO: 4130632 - RNA, 18 nt, Yersinia pestis
acucacacagccagccuu

SEQ ID NO: 4130633 - RNA, 16 nt, Yersinia pestis
acucaccuaaaucaua

SEQ ID NO: 4130634 - RNA, 18 nt, Yersinia pestis
acucaccuaaaucauaca

SEQ ID NO: 4130635 - RNA, 22 nt, Yersinia pestis
acucacguaccaaaucagcaag

SEQ ID NO: 4130636 - RNA, 16 nt, Yersinia pestis
acucacuacauucuga

SEQ ID NO: 4130637 - RNA, 12 nt, Yersinia pestis
acucacugaaua

SEQ ID NO: 4130638 - RNA, 12 nt, Yersinia pestis
acucacugucgg

SEQ ID NO: 4130639 - RNA, 14 nt, Yersinia pestis
acucagaaaacagc

SEQ ID NO: 4130640 - RNA, 16 nt, Yersinia pestis
acucagaugaaaaacu

SEQ ID NO: 4130641 - RNA, 17 nt, Yersinia pestis
acucagcacauuuuuau

SEQ ID NO: 4130642 - RNA, 16 nt, Yersinia pestis
acucagcuugguaaug

SEQ ID NO: 4130643 - RNA, 18 nt, Yersinia pestis
acucaggcccugagauuc

SEQ ID NO: 4130644 - RNA, 14 nt, Yersinia pestis
acucagucaucgcu

SEQ ID NO: 4130645 - RNA, 22 nt, Yersinia pestis
acucauaaucgcuuggucacug

SEQ ID NO: 4130646 - RNA, 23 nt, Yersinia pestis
acucauaccgaauaauaaauauc

SEQ ID NO: 4130647 - RNA, 15 nt, Yersinia pestis
acucauauuguccaa

SEQ ID NO: 4130648 - RNA, 13 nt, Yersinia pestis
acucaucaaaaca

SEQ ID NO: 4130649 - RNA, 14 nt, Yersinia pestis
acucaucaaaacaa

SEQ ID NO: 4130650 - RNA, 20 nt, Yersinia pestis
acucauccgaaucacaaacu

SEQ ID NO: 4130651 - RNA, 15 nt, Yersinia pestis
acucauuauggauaa

SEQ ID NO: 4130652 - RNA, 13 nt, Yersinia pestis
acucauugcaccu

SEQ ID NO: 4130653 - RNA, 13 nt, Yersinia pestis
acucauuuuuaag

SEQ ID NO: 4130654 - RNA, 21 nt, Yersinia pestis
acuccacauuuuggccuucau

SEQ ID NO: 4130655 - RNA, 14 nt, Yersinia pestis
acucccauucgcgc

SEQ ID NO: 4130656 - RNA, 18 nt, Yersinia pestis
acucccauucgcgcccca

SEQ ID NO: 4130657 - RNA, 19 nt, Yersinia pestis
acuccccuggcaggccagc

SEQ ID NO: 4130658 - RNA, 23 nt, Yersinia pestis
acuccccuggcaggccagcgaca

SEQ ID NO: 4130659 - RNA, 21 nt, Yersinia pestis
acucccgauucagcucugcca

SEQ ID NO: 4130660 - RNA, 17 nt, Yersinia pestis
acucccgccaagaaacg

SEQ ID NO: 4130661 - RNA, 17 nt, Yersinia pestis
acucccguccugagcug

SEQ ID NO: 4130662 - RNA, 13 nt, Yersinia pestis
acucccuguuacg

SEQ ID NO: 4130663 - RNA, 18 nt, Yersinia pestis
acuccggcaucauccuca

SEQ ID NO: 4130664 - RNA, 13 nt, Yersinia pestis
acuccucugccua

SEQ ID NO: 4130665 - RNA, 14 nt, Yersinia pestis
acuccucugccuau

SEQ ID NO: 4130666 - RNA, 15 nt, Yersinia pestis
acuccucugccuauc

SEQ ID NO: 4130667 - RNA, 16 nt, Yersinia pestis
acuccucugccuaucc

SEQ ID NO: 4130668 - RNA, 22 nt, Yersinia pestis
acuccucuuucuuaauaauauc

SEQ ID NO: 4130669 - RNA, 15 nt, Yersinia pestis
acuccugaaauaaag

SEQ ID NO: 4130670 - RNA, 21 nt, Yersinia pestis
acuccuuaccacugcucacuu

SEQ ID NO: 4130671 - RNA, 18 nt, Yersinia pestis
acuccuugaauagccaga

SEQ ID NO: 4130672 - RNA, 23 nt, Yersinia pestis
acuccuugaauagccagaagcca

SEQ ID NO: 4130673 - RNA, 20 nt, Yersinia pestis
acuccuuggaacuuacuccc

SEQ ID NO: 4130674 - RNA, 22 nt, Yersinia pestis
acuccuuggaacuuacucccuu

SEQ ID NO: 4130675 - RNA, 13 nt, Yersinia pestis
acucgaauuauuu

SEQ ID NO: 4130676 - RNA, 15 nt, Yersinia pestis
acucgaauuauuugg

SEQ ID NO: 4130677 - RNA, 14 nt, Yersinia pestis
acucgagcauuuga

SEQ ID NO: 4130678 - RNA, 19 nt, Yersinia pestis
acucgaucaccacgucacc

SEQ ID NO: 4130679 - RNA, 14 nt, Yersinia pestis
acucgaucuugaac

SEQ ID NO: 4130680 - RNA, 20 nt, Yersinia pestis
acucgaugacguaauuuuaa

SEQ ID NO: 4130681 - RNA, 12 nt, Yersinia pestis
acucgcuccgag

SEQ ID NO: 4130682 - RNA, 22 nt, Yersinia pestis
acucgcuuaacugugcagccca

SEQ ID NO: 4130683 - RNA, 22 nt, Yersinia pestis
acucggccaaacaaaguuaugc

SEQ ID NO: 4130684 - RNA, 20 nt, Yersinia pestis
acucggccgcuaagucacgc

SEQ ID NO: 4130685 - RNA, 22 nt, Yersinia pestis
acucggcgguuugagccaccgc

SEQ ID NO: 4130686 - RNA, 19 nt, Yersinia pestis
acucggcucaccugcggga

SEQ ID NO: 4130687 - RNA, 15 nt, Yersinia pestis
acucgggucagugaa

SEQ ID NO: 4130688 - RNA, 21 nt, Yersinia pestis
acucggucgccaaggaugccu

SEQ ID NO: 4130689 - RNA, 15 nt, Yersinia pestis
acucguauaaaaaau

SEQ ID NO: 4130690 - RNA, 22 nt, Yersinia pestis
acucuacauugacuaauuaaua

SEQ ID NO: 4130691 - RNA, 16 nt, Yersinia pestis
acucuagcgccagcaa

SEQ ID NO: 4130692 - RNA, 17 nt, Yersinia pestis
acucuagcgccagcaau

SEQ ID NO: 4130693 - RNA, 13 nt, Yersinia pestis
acucuaucagcgc

SEQ ID NO: 4130694 - RNA, 23 nt, Yersinia pestis
acucuaucagcgcccuacugcau

SEQ ID NO: 4130695 - RNA, 13 nt, Yersinia pestis
acucucaagccca

SEQ ID NO: 4130696 - RNA, 14 nt, Yersinia pestis
acucucgaaaaugu

SEQ ID NO: 4130697 - RNA, 19 nt, Yersinia pestis
acucucuucaucagucacu

SEQ ID NO: 4130698 - RNA, 21 nt, Yersinia pestis
acucugaacccugcgauuuau

SEQ ID NO: 4130699 - RNA, 16 nt, Yersinia pestis
acucugaugaaaucgc

SEQ ID NO: 4130700 - RNA, 21 nt, Yersinia pestis
acucugccagauagucaucuu

SEQ ID NO: 4130701 - RNA, 22 nt, Yersinia pestis
acucugccagauagucaucuuu

SEQ ID NO: 4130702 - RNA, 19 nt, Yersinia pestis
acucugcuaccaggaagcg

SEQ ID NO: 4130703 - RNA, 17 nt, Yersinia pestis
acucuggauggguaaug

SEQ ID NO: 4130704 - RNA, 19 nt, Yersinia pestis
acucuggauggguaaugca

SEQ ID NO: 4130705 - RNA, 20 nt, Yersinia pestis
acucuggauggguaaugcau

SEQ ID NO: 4130706 - RNA, 16 nt, Yersinia pestis
acucuggcacuggcaa

SEQ ID NO: 4130707 - RNA, 17 nt, Yersinia pestis
acucuggcacuggcaau

SEQ ID NO: 4130708 - RNA, 23 nt, Yersinia pestis
acucugggccgugaguuuucgau

SEQ ID NO: 4130709 - RNA, 16 nt, Yersinia pestis
acucuggggcaaucaa

SEQ ID NO: 4130710 - RNA, 23 nt, Yersinia pestis
acucuggggcaaucaauguauug

SEQ ID NO: 4130711 - RNA, 20 nt, Yersinia pestis
acucugguccagaucggcaa

SEQ ID NO: 4130712 - RNA, 15 nt, Yersinia pestis
acucuguaccgcccg

SEQ ID NO: 4130713 - RNA, 20 nt, Yersinia pestis
acucuguagcacauuuaagc

SEQ ID NO: 4130714 - RNA, 15 nt, Yersinia pestis
acucuguuaccaaug

SEQ ID NO: 4130715 - RNA, 12 nt, Yersinia pestis
acucuguuuuaa

SEQ ID NO: 4130716 - RNA, 13 nt, Yersinia pestis
acucuucagccua

SEQ ID NO: 4130717 - RNA, 12 nt, Yersinia pestis
acucuuccaacu

SEQ ID NO: 4130718 - RNA, 16 nt, Yersinia pestis
acucuucggccuauca

SEQ ID NO: 4130719 - RNA, 19 nt, Yersinia pestis
acucuucggccuaucauca

SEQ ID NO: 4130720 - RNA, 13 nt, Yersinia pestis
acucuucuuuacu

SEQ ID NO: 4130721 - RNA, 19 nt, Yersinia pestis
acucuucuuuacugcccuc

SEQ ID NO: 4130722 - RNA, 20 nt, Yersinia pestis
acucuuugaguagcaggccg

SEQ ID NO: 4130723 - RNA, 15 nt, Yersinia pestis
acucuuuuuaaacua

SEQ ID NO: 4130724 - RNA, 12 nt, Yersinia pestis
acucuuuuuaau

SEQ ID NO: 4130725 - RNA, 23 nt, Yersinia pestis
acucuuuuuuauguuugauuacu

SEQ ID NO: 4130726 - RNA, 14 nt, Yersinia pestis
acugaacaaugcca

SEQ ID NO: 4130727 - RNA, 17 nt, Yersinia pestis
acugaaccgccauugca

SEQ ID NO: 4130728 - RNA, 17 nt, Yersinia pestis
acugaacgccgaccuga

SEQ ID NO: 4130729 - RNA, 23 nt, Yersinia pestis
acugaagaauucaguaucaccag

SEQ ID NO: 4130730 - RNA, 20 nt, Yersinia pestis
acugaaguuuaccgcaugaa

SEQ ID NO: 4130731 - RNA, 11 nt, Yersinia pestis
acugaauaucc

SEQ ID NO: 4130732 - RNA, 21 nt, Yersinia pestis
acugaaucccagaaccucaac

SEQ ID NO: 4130733 - RNA, 13 nt, Yersinia pestis
acugaaugugaag

SEQ ID NO: 4130734 - RNA, 16 nt, Yersinia pestis
acugaaugugaagagc

SEQ ID NO: 4130735 - RNA, 17 nt, Yersinia pestis
acugaaugugaagagcg

SEQ ID NO: 4130736 - RNA, 17 nt, Yersinia pestis
acugacaaaaacagcac

SEQ ID NO: 4130737 - RNA, 16 nt, Yersinia pestis
acugacaacaucaaau

SEQ ID NO: 4130738 - RNA, 14 nt, Yersinia pestis
acugacaucaucac

SEQ ID NO: 4130739 - RNA, 19 nt, Yersinia pestis
acugacgauuguccaggcu

SEQ ID NO: 4130740 - RNA, 21 nt, Yersinia pestis
acugacgauuguccaggcuau

SEQ ID NO: 4130741 - RNA, 12 nt, Yersinia pestis
acugacgcagcg

SEQ ID NO: 4130742 - RNA, 18 nt, Yersinia pestis
acugacguaguguauuca

SEQ ID NO: 4130743 - RNA, 13 nt, Yersinia pestis
acugacugaaguu

SEQ ID NO: 4130744 - RNA, 16 nt, Yersinia pestis
acugacugauguaagc

SEQ ID NO: 4130745 - RNA, 18 nt, Yersinia pestis
acugacuuagcucaucgu

SEQ ID NO: 4130746 - RNA, 15 nt, Yersinia pestis
acugagauaaucccu

SEQ ID NO: 4130747 - RNA, 14 nt, Yersinia pestis
acugagauuugcca

SEQ ID NO: 4130748 - RNA, 22 nt, Yersinia pestis
acugagauuugccaaacgugaa

SEQ ID NO: 4130749 - RNA, 13 nt, Yersinia pestis
acugagcaccgca

SEQ ID NO: 4130750 - RNA, 18 nt, Yersinia pestis
acugaguuggaaaugaca

SEQ ID NO: 4130751 - RNA, 18 nt, Yersinia pestis
acugaguugggccuugcu

SEQ ID NO: 4130752 - RNA, 12 nt, Yersinia pestis
acugauacaaca

SEQ ID NO: 4130753 - RNA, 16 nt, Yersinia pestis
acugauagcaauccca

SEQ ID NO: 4130754 - RNA, 20 nt, Yersinia pestis
acugauauagccuucuucac

SEQ ID NO: 4130755 - RNA, 22 nt, Yersinia pestis
acugaucaauaucccgagaaac

SEQ ID NO: 4130756 - RNA, 14 nt, Yersinia pestis
acugaucacuggca

SEQ ID NO: 4130757 - RNA, 20 nt, Yersinia pestis
acugaucacuggcauugcau

SEQ ID NO: 4130758 - RNA, 22 nt, Yersinia pestis
acugaugacgccguacaaauau

SEQ ID NO: 4130759 - RNA, 21 nt, Yersinia pestis
acugaugacgcgccauacugc

SEQ ID NO: 4130760 - RNA, 15 nt, Yersinia pestis
acugaugcuuggccc

SEQ ID NO: 4130761 - RNA, 13 nt, Yersinia pestis
acugauucagaaa

SEQ ID NO: 4130762 - RNA, 17 nt, Yersinia pestis
acugauucucuucaccu

SEQ ID NO: 4130763 - RNA, 16 nt, Yersinia pestis
acugauugaccaucaa

SEQ ID NO: 4130764 - RNA, 16 nt, Yersinia pestis
acugauuggauaaaau

SEQ ID NO: 4130765 - RNA, 17 nt, Yersinia pestis
acugauuggauaaaaua

SEQ ID NO: 4130766 - RNA, 15 nt, Yersinia pestis
acugcaaacgagagu

SEQ ID NO: 4130767 - RNA, 22 nt, Yersinia pestis
acugcacaauuugguagaacug

SEQ ID NO: 4130768 - RNA, 18 nt, Yersinia pestis
acugcaguaaaaauauua

SEQ ID NO: 4130769 - RNA, 13 nt, Yersinia pestis
acugcauagcuaa

SEQ ID NO: 4130770 - RNA, 20 nt, Yersinia pestis
acugcaucagcgacgcuaaa

SEQ ID NO: 4130771 - RNA, 14 nt, Yersinia pestis
acugcauuaucuaa

SEQ ID NO: 4130772 - RNA, 13 nt, Yersinia pestis
acugcauugcguu

SEQ ID NO: 4130773 - RNA, 15 nt, Yersinia pestis
acugccaaucgcucu

SEQ ID NO: 4130774 - RNA, 15 nt, Yersinia pestis
acugccaccaaaugc

SEQ ID NO: 4130775 - RNA, 13 nt, Yersinia pestis
acugccaucauca

SEQ ID NO: 4130776 - RNA, 17 nt, Yersinia pestis
acugccccgaagcucaa

SEQ ID NO: 4130777 - RNA, 20 nt, Yersinia pestis
acugccccgaagcucaagcu

SEQ ID NO: 4130778 - RNA, 20 nt, Yersinia pestis
acugcccucgcaauggugau

SEQ ID NO: 4130779 - RNA, 18 nt, Yersinia pestis
acugcgcaaauccugaau

SEQ ID NO: 4130780 - RNA, 16 nt, Yersinia pestis
acugcgcgcugaacgu

SEQ ID NO: 4130781 - RNA, 16 nt, Yersinia pestis
acugcgguccuacccu

SEQ ID NO: 4130782 - RNA, 13 nt, Yersinia pestis
acugcucaacugc

SEQ ID NO: 4130783 - RNA, 14 nt, Yersinia pestis
acugcucaacugcu

SEQ ID NO: 4130784 - RNA, 21 nt, Yersinia pestis
acugcucaacugcucaacugc

SEQ ID NO: 4130785 - RNA, 20 nt, Yersinia pestis
acugcucacuuuuauccagc

SEQ ID NO: 4130786 - RNA, 15 nt, Yersinia pestis
acugcucauaaagca

SEQ ID NO: 4130787 - RNA, 16 nt, Yersinia pestis
acugcucuaucucuuc

SEQ ID NO: 4130788 - RNA, 15 nt, Yersinia pestis
acugcucuuucccuu

SEQ ID NO: 4130789 - RNA, 12 nt, Yersinia pestis
acugcugacaac

SEQ ID NO: 4130790 - RNA, 13 nt, Yersinia pestis
acugcugacaacc

SEQ ID NO: 4130791 - RNA, 15 nt, Yersinia pestis
acugcugacaacccu

SEQ ID NO: 4130792 - RNA, 16 nt, Yersinia pestis
acugcugauuuuguag

SEQ ID NO: 4130793 - RNA, 15 nt, Yersinia pestis
acugcugcaacucau

SEQ ID NO: 4130794 - RNA, 21 nt, Yersinia pestis
acugcugcaacucauuaacaa

SEQ ID NO: 4130795 - RNA, 12 nt, Yersinia pestis
acugcuggccaa

SEQ ID NO: 4130796 - RNA, 14 nt, Yersinia pestis
acugcuugccaaau

SEQ ID NO: 4130797 - RNA, 21 nt, Yersinia pestis
acugcuugccaaauauagcau

SEQ ID NO: 4130798 - RNA, 13 nt, Yersinia pestis
acugcuuuuuaca

SEQ ID NO: 4130799 - RNA, 14 nt, Yersinia pestis
acugcuuuuuacac

SEQ ID NO: 4130800 - RNA, 13 nt, Yersinia pestis
acuggaagaaacc

SEQ ID NO: 4130801 - RNA, 22 nt, Yersinia pestis
acuggaagccgacgaucuugcc

SEQ ID NO: 4130802 - RNA, 21 nt, Yersinia pestis
acuggaauauggguaaauaca

SEQ ID NO: 4130803 - RNA, 16 nt, Yersinia pestis
acuggaucacaaugca

SEQ ID NO: 4130804 - RNA, 21 nt, Yersinia pestis
acuggcaaaaaaacgccucca

SEQ ID NO: 4130805 - RNA, 20 nt, Yersinia pestis
acuggcaauaauucagauga

SEQ ID NO: 4130806 - RNA, 12 nt, Yersinia pestis
acuggcagauag

SEQ ID NO: 4130807 - RNA, 23 nt, Yersinia pestis
acuggcaggaaaucuucauaaac

SEQ ID NO: 4130808 - RNA, 16 nt, Yersinia pestis
acuggcagggaaaggu

SEQ ID NO: 4130809 - RNA, 13 nt, Yersinia pestis
acuggccaugugu

SEQ ID NO: 4130810 - RNA, 16 nt, Yersinia pestis
acuggcccgcguggca

SEQ ID NO: 4130811 - RNA, 11 nt, Yersinia pestis
acuggccguuu

SEQ ID NO: 4130812 - RNA, 19 nt, Yersinia pestis
acuggccuauuaagauaau

SEQ ID NO: 4130813 - RNA, 20 nt, Yersinia pestis
acuggccuauuaagauaauu

SEQ ID NO: 4130814 - RNA, 15 nt, Yersinia pestis
acuggcgggccguuu

SEQ ID NO: 4130815 - RNA, 19 nt, Yersinia pestis
acuggcucucaaaagauaa

SEQ ID NO: 4130816 - RNA, 14 nt, Yersinia pestis
acuggcugaaguua

SEQ ID NO: 4130817 - RNA, 16 nt, Yersinia pestis
acuggcugaaguuaau

SEQ ID NO: 4130818 - RNA, 15 nt, Yersinia pestis
acuggcuuuauuaua

SEQ ID NO: 4130819 - RNA, 16 nt, Yersinia pestis
acuggguaaggcaaac

SEQ ID NO: 4130820 - RNA, 21 nt, Yersinia pestis
acugggucaucacccagcaaa

SEQ ID NO: 4130821 - RNA, 18 nt, Yersinia pestis
acuggguggccaguaacg

SEQ ID NO: 4130822 - RNA, 22 nt, Yersinia pestis
acuggguuuaaagguggcuggu

SEQ ID NO: 4130823 - RNA, 16 nt, Yersinia pestis
acugguaauaaugcug

SEQ ID NO: 4130824 - RNA, 23 nt, Yersinia pestis
acugguaauaaugcuguccaguu

SEQ ID NO: 4130825 - RNA, 23 nt, Yersinia pestis
acugguacggcgcaucgccaucc

SEQ ID NO: 4130826 - RNA, 19 nt, Yersinia pestis
acugguagcaucaucgcac

SEQ ID NO: 4130827 - RNA, 22 nt, Yersinia pestis
acugguccaacuaaacagggca

SEQ ID NO: 4130828 - RNA, 20 nt, Yersinia pestis
acuggugugugucaguucau

SEQ ID NO: 4130829 - RNA, 13 nt, Yersinia pestis
acugguugaaacc

SEQ ID NO: 4130830 - RNA, 20 nt, Yersinia pestis
acugguugaaaccucaucau

SEQ ID NO: 4130831 - RNA, 13 nt, Yersinia pestis
acuguaaaaucuu

SEQ ID NO: 4130832 - RNA, 14 nt, Yersinia pestis
acuguaaaaucuuu

SEQ ID NO: 4130833 - RNA, 21 nt, Yersinia pestis
acuguaaacuuguuuauauua

SEQ ID NO: 4130834 - RNA, 20 nt, Yersinia pestis
acuguacugggaugaagaaa

SEQ ID NO: 4130835 - RNA, 16 nt, Yersinia pestis
acuguaguucaauggu

SEQ ID NO: 4130836 - RNA, 14 nt, Yersinia pestis
acuguaucaauacc

SEQ ID NO: 4130837 - RNA, 18 nt, Yersinia pestis
acugucaaaaagcaccuu

SEQ ID NO: 4130838 - RNA, 17 nt, Yersinia pestis
acugucaaaaccaauag

SEQ ID NO: 4130839 - RNA, 13 nt, Yersinia pestis
acugucgacugcu

SEQ ID NO: 4130840 - RNA, 18 nt, Yersinia pestis
acugucuauuuuuauaau

SEQ ID NO: 4130841 - RNA, 12 nt, Yersinia pestis
acugugccaacc

SEQ ID NO: 4130842 - RNA, 14 nt, Yersinia pestis
acugugcugaauug

SEQ ID NO: 4130843 - RNA, 15 nt, Yersinia pestis
acugugcuuuucuua

SEQ ID NO: 4130844 - RNA, 19 nt, Yersinia pestis
acugugggacugaucaagu

SEQ ID NO: 4130845 - RNA, 12 nt, Yersinia pestis
acuguuaucacu

SEQ ID NO: 4130846 - RNA, 18 nt, Yersinia pestis
acuguucugggggugaua

SEQ ID NO: 4130847 - RNA, 14 nt, Yersinia pestis
acuguuugccagug

SEQ ID NO: 4130848 - RNA, 18 nt, Yersinia pestis
agaaaauuucucuuuuau

SEQ ID NO: 4130849 - RNA, 16 nt, Yersinia pestis
agaaacagcagguggu

SEQ ID NO: 4130850 - RNA, 18 nt, Yersinia pestis
agaaacauccuaaaaagc

SEQ ID NO: 4130851 - RNA, 12 nt, Yersinia pestis
agaaacaucgcc

SEQ ID NO: 4130852 - RNA, 16 nt, Yersinia pestis
agaaacccauagcaaa

SEQ ID NO: 4130853 - RNA, 24 nt, Yersinia pestis
agaaacccguauuaguccguagaa

SEQ ID NO: 4130854 - RNA, 19 nt, Yersinia pestis
agaaaccuaaugccagaca

SEQ ID NO: 4130855 - RNA, 15 nt, Yersinia pestis
agaaacgaucuuggu

SEQ ID NO: 4130856 - RNA, 16 nt, Yersinia pestis
agaaacgauuacccac

SEQ ID NO: 4130857 - RNA, 18 nt, Yersinia pestis
agaaacgauuacccacca

SEQ ID NO: 4130858 - RNA, 16 nt, Yersinia pestis
agaaacgccccgauaa

SEQ ID NO: 4130859 - RNA, 20 nt, Yersinia pestis
agaaacggugaaaauaccca

SEQ ID NO: 4130860 - RNA, 21 nt, Yersinia pestis
agaaacgugaauugcuacugg

SEQ ID NO: 4130861 - RNA, 20 nt, Yersinia pestis
agaaacuaagaguccuuaaa

SEQ ID NO: 4130862 - RNA, 20 nt, Yersinia pestis
agaaacucccuucaaucaau

SEQ ID NO: 4130863 - RNA, 19 nt, Yersinia pestis
agaaacugugauaaccaac

SEQ ID NO: 4130864 - RNA, 14 nt, Yersinia pestis
agaaagcagcagcu

SEQ ID NO: 4130865 - RNA, 14 nt, Yersinia pestis
agaaaggauuugaa

SEQ ID NO: 4130866 - RNA, 23 nt, Yersinia pestis
agaaaggcggauaaucuaggccu

SEQ ID NO: 4130867 - RNA, 21 nt, Yersinia pestis
agaaagguaugugccaaaaaa

SEQ ID NO: 4130868 - RNA, 18 nt, Yersinia pestis
agaaaguuguucaacgcc

SEQ ID NO: 4130869 - RNA, 13 nt, Yersinia pestis
agaaauaaaagaa

SEQ ID NO: 4130870 - RNA, 14 nt, Yersinia pestis
agaaauaaauucau

SEQ ID NO: 4130871 - RNA, 19 nt, Yersinia pestis
agaaauaaguugaaccaua

SEQ ID NO: 4130872 - RNA, 14 nt, Yersinia pestis
agaaauaauaucaa

SEQ ID NO: 4130873 - RNA, 16 nt, Yersinia pestis
agaaauaauaucaagu

SEQ ID NO: 4130874 - RNA, 15 nt, Yersinia pestis
agaaauaaucauauc

SEQ ID NO: 4130875 - RNA, 22 nt, Yersinia pestis
agaaauaccugaguuaccuugu

SEQ ID NO: 4130876 - RNA, 16 nt, Yersinia pestis
agaaaucaaugugccg

SEQ ID NO: 4130877 - RNA, 21 nt, Yersinia pestis
agaaaucgccccuuuuuuguu

SEQ ID NO: 4130878 - RNA, 17 nt, Yersinia pestis
agaaauuuaaaaacccu

SEQ ID NO: 4130879 - RNA, 13 nt, Yersinia pestis
agaacagcgaauc

SEQ ID NO: 4130880 - RNA, 21 nt, Yersinia pestis
agaacaggcagaucguaaaga

SEQ ID NO: 4130881 - RNA, 22 nt, Yersinia pestis
agaacaggcagaucguaaagac

SEQ ID NO: 4130882 - RNA, 14 nt, Yersinia pestis
agaacaggcagcaa

SEQ ID NO: 4130883 - RNA, 21 nt, Yersinia pestis
agaacaggcagcaaauaaagc

SEQ ID NO: 4130884 - RNA, 21 nt, Yersinia pestis
agaacauuuccacaaucagcc

SEQ ID NO: 4130885 - RNA, 21 nt, Yersinia pestis
agaaccaguucugguagcugc

SEQ ID NO: 4130886 - RNA, 20 nt, Yersinia pestis
agaacccccgcgaacagcag

SEQ ID NO: 4130887 - RNA, 22 nt, Yersinia pestis
agaaccgacaagcgcugcgcca

SEQ ID NO: 4130888 - RNA, 15 nt, Yersinia pestis
agaaccggaauaaau

SEQ ID NO: 4130889 - RNA, 15 nt, Yersinia pestis
agaaccggcugacau

SEQ ID NO: 4130890 - RNA, 12 nt, Yersinia pestis
agaaccggggcg

SEQ ID NO: 4130891 - RNA, 20 nt, Yersinia pestis
agaaccggggcgauacacca

SEQ ID NO: 4130892 - RNA, 15 nt, Yersinia pestis
agaaccguaaucuug

SEQ ID NO: 4130893 - RNA, 17 nt, Yersinia pestis
agaaccuguuacaucag

SEQ ID NO: 4130894 - RNA, 21 nt, Yersinia pestis
agaaccuguuacaucagagcu

SEQ ID NO: 4130895 - RNA, 23 nt, Yersinia pestis
agaacgaacgaagcgugaaagca

SEQ ID NO: 4130896 - RNA, 16 nt, Yersinia pestis
agaacgggcacagcau

SEQ ID NO: 4130897 - RNA, 22 nt, Yersinia pestis
agaacgucaccgccaaaauaaa

SEQ ID NO: 4130898 - RNA, 14 nt, Yersinia pestis
agaacguucaacca

SEQ ID NO: 4130899 - RNA, 19 nt, Yersinia pestis
agaacugauuucaggaaug

SEQ ID NO: 4130900 - RNA, 14 nt, Yersinia pestis
agaagaaaaucacu

SEQ ID NO: 4130901 - RNA, 15 nt, Yersinia pestis
agaagaaaaucacuu

SEQ ID NO: 4130902 - RNA, 14 nt, Yersinia pestis
agaagaauaucugc

SEQ ID NO: 4130903 - RNA, 20 nt, Yersinia pestis
agaagaauugcagauaccac

SEQ ID NO: 4130904 - RNA, 20 nt, Yersinia pestis
agaagacaauaaaucgccac

SEQ ID NO: 4130905 - RNA, 17 nt, Yersinia pestis
agaagagcgaacaaaug

SEQ ID NO: 4130906 - RNA, 18 nt, Yersinia pestis
agaagcauauggauguga

SEQ ID NO: 4130907 - RNA, 20 nt, Yersinia pestis
agaagcccugaguuaaguaa

SEQ ID NO: 4130908 - RNA, 17 nt, Yersinia pestis
agaagccucaugaauga

SEQ ID NO: 4130909 - RNA, 19 nt, Yersinia pestis
agaagccucaugaaugagg

SEQ ID NO: 4130910 - RNA, 22 nt, Yersinia pestis
agaagccucaugaaugaggcug

SEQ ID NO: 4130911 - RNA, 22 nt, Yersinia pestis
agaagcucauaugcagcaucca

SEQ ID NO: 4130912 - RNA, 17 nt, Yersinia pestis
agaaggccaguaguaaa

SEQ ID NO: 4130913 - RNA, 18 nt, Yersinia pestis
agaagggcggccagcaag

SEQ ID NO: 4130914 - RNA, 13 nt, Yersinia pestis
agaagguuccccu

SEQ ID NO: 4130915 - RNA, 14 nt, Yersinia pestis
agaaguagaaugag

SEQ ID NO: 4130916 - RNA, 14 nt, Yersinia pestis
agaaguccugauuc

SEQ ID NO: 4130917 - RNA, 17 nt, Yersinia pestis
agaagucggcuuugacu

SEQ ID NO: 4130918 - RNA, 22 nt, Yersinia pestis
agaagugaacgaacacaucuuu

SEQ ID NO: 4130919 - RNA, 18 nt, Yersinia pestis
agaagugagaagugaaaa

SEQ ID NO: 4130920 - RNA, 20 nt, Yersinia pestis
agaagugagaagugaaaaac

SEQ ID NO: 4130921 - RNA, 16 nt, Yersinia pestis
agaaguucagaccagc

SEQ ID NO: 4130922 - RNA, 18 nt, Yersinia pestis
agaaguucuaaauaaaau

SEQ ID NO: 4130923 - RNA, 17 nt, Yersinia pestis
agaaguugaauuugacg

SEQ ID NO: 4130924 - RNA, 18 nt, Yersinia pestis
agaauaaugcuaaaugag

SEQ ID NO: 4130925 - RNA, 13 nt, Yersinia pestis
agaauacagccag

SEQ ID NO: 4130926 - RNA, 17 nt, Yersinia pestis
agaauacuucaggccaa

SEQ ID NO: 4130927 - RNA, 16 nt, Yersinia pestis
agaauagugauauccc

SEQ ID NO: 4130928 - RNA, 23 nt, Yersinia pestis
agaauauaaaagcacagacaaac

SEQ ID NO: 4130929 - RNA, 17 nt, Yersinia pestis
agaaucaaccacgguaa

SEQ ID NO: 4130930 - RNA, 16 nt, Yersinia pestis
agaaucaaugggauau

SEQ ID NO: 4130931 - RNA, 19 nt, Yersinia pestis
agaaucaccaacaccacca

SEQ ID NO: 4130932 - RNA, 17 nt, Yersinia pestis
agaaucaccgaaagaag

SEQ ID NO: 4130933 - RNA, 15 nt, Yersinia pestis
agaauccacauaaaa

SEQ ID NO: 4130934 - RNA, 18 nt, Yersinia pestis
agaauccacauaaaaaga

SEQ ID NO: 4130935 - RNA, 21 nt, Yersinia pestis
agaaucccgguugauaucggc

SEQ ID NO: 4130936 - RNA, 23 nt, Yersinia pestis
agaaucucuccagugcaaauuua

SEQ ID NO: 4130937 - RNA, 21 nt, Yersinia pestis
agaaugaaaggcggugaacag

SEQ ID NO: 4130938 - RNA, 13 nt, Yersinia pestis
agaaugaacugau

SEQ ID NO: 4130939 - RNA, 20 nt, Yersinia pestis
agaaugcaaccaguuaaaga

SEQ ID NO: 4130940 - RNA, 18 nt, Yersinia pestis
agaaugcagauaucagcc

SEQ ID NO: 4130941 - RNA, 16 nt, Yersinia pestis
agaaugcgaagaaaaa

SEQ ID NO: 4130942 - RNA, 22 nt, Yersinia pestis
agaaugucaugguuaaacugac

SEQ ID NO: 4130943 - RNA, 15 nt, Yersinia pestis
agaauguuaaacccc

SEQ ID NO: 4130944 - RNA, 19 nt, Yersinia pestis
agaauuaaggaaacucaug

SEQ ID NO: 4130945 - RNA, 16 nt, Yersinia pestis
agaauuccggcgcauu

SEQ ID NO: 4130946 - RNA, 21 nt, Yersinia pestis
agaauugcagauaccacauca

SEQ ID NO: 4130947 - RNA, 11 nt, Yersinia pestis
agaauuuugca

SEQ ID NO: 4130948 - RNA, 23 nt, Yersinia pestis
agaauuuuuuuagauaucagaaa

SEQ ID NO: 4130949 - RNA, 22 nt, Yersinia pestis
agacaaccacccgacaucaaga

SEQ ID NO: 4130950 - RNA, 18 nt, Yersinia pestis
agacaacucuucuaucuu

SEQ ID NO: 4130951 - RNA, 20 nt, Yersinia pestis
agacaacugacaacaucaaa

SEQ ID NO: 4130952 - RNA, 17 nt, Yersinia pestis
agacaagagcaauggcg

SEQ ID NO: 4130953 - RNA, 12 nt, Yersinia pestis
agacaaugccga

SEQ ID NO: 4130954 - RNA, 21 nt, Yersinia pestis
agacaaugcggccuuugcuca

SEQ ID NO: 4130955 - RNA, 13 nt, Yersinia pestis
agacacaagauaa

SEQ ID NO: 4130956 - RNA, 14 nt, Yersinia pestis
agacacagcaacaa

SEQ ID NO: 4130957 - RNA, 14 nt, Yersinia pestis
agacagcaguuaau

SEQ ID NO: 4130958 - RNA, 18 nt, Yersinia pestis
agacagcaguuaaugcuu

SEQ ID NO: 4130959 - RNA, 17 nt, Yersinia pestis
agacaguaaauccugau

SEQ ID NO: 4130960 - RNA, 13 nt, Yersinia pestis
agacaguaacuaa

SEQ ID NO: 4130961 - RNA, 12 nt, Yersinia pestis
agacauaaagcc

SEQ ID NO: 4130962 - RNA, 22 nt, Yersinia pestis
agacauaaagcccgcuucaaag

SEQ ID NO: 4130963 - RNA, 12 nt, Yersinia pestis
agacauaaugcc

SEQ ID NO: 4130964 - RNA, 16 nt, Yersinia pestis
agacauaucacaguua

SEQ ID NO: 4130965 - RNA, 16 nt, Yersinia pestis
agacaucgccagauuc

SEQ ID NO: 4130966 - RNA, 14 nt, Yersinia pestis
agacaucuuuacca

SEQ ID NO: 4130967 - RNA, 13 nt, Yersinia pestis
agacaugauuaaa

SEQ ID NO: 4130968 - RNA, 22 nt, Yersinia pestis
agacaugggcagugcacaguca

SEQ ID NO: 4130969 - RNA, 19 nt, Yersinia pestis
agacauguuguucuuguuu

SEQ ID NO: 4130970 - RNA, 22 nt, Yersinia pestis
agauagagcagugcagcaaaag

SEQ ID NO: 4130971 - RNA, 14 nt, Yersinia pestis
agauagauuucacu

SEQ ID NO: 4130972 - RNA, 14 nt, Yersinia pestis
agauagcaaaagaa

SEQ ID NO: 4130973 - RNA, 15 nt, Yersinia pestis
agauagcaaucaaua

SEQ ID NO: 4130974 - RNA, 23 nt, Yersinia pestis
agauagcaaucaauaagcuacag

SEQ ID NO: 4130975 - RNA, 16 nt, Yersinia pestis
agauagccggauuauu

SEQ ID NO: 4130976 - RNA, 12 nt, Yersinia pestis
agauagcgaauc

SEQ ID NO: 4130977 - RNA, 16 nt, Yersinia pestis
agauagcgaaucacau

SEQ ID NO: 4130978 - RNA, 21 nt, Yersinia pestis
agauaggcacuaacugcgccu

SEQ ID NO: 4130979 - RNA, 18 nt, Yersinia pestis
agauaggcgaaauugacu

SEQ ID NO: 4130980 - RNA, 22 nt, Yersinia pestis
agauaguacguagcgauaacag

SEQ ID NO: 4130981 - RNA, 15 nt, Yersinia pestis
agauaguacuuagca

SEQ ID NO: 4130982 - RNA, 19 nt, Yersinia pestis
agauaucagccagugcuaa

SEQ ID NO: 4130983 - RNA, 21 nt, Yersinia pestis
agauaucgaaacacauacaaa

SEQ ID NO: 4130984 - RNA, 14 nt, Yersinia pestis
agauaucuuugagu

SEQ ID NO: 4130985 - RNA, 21 nt, Yersinia pestis
agauaucuuugaguugcguua

SEQ ID NO: 4130986 - RNA, 19 nt, Yersinia pestis
agauaugccaggcaucauc

SEQ ID NO: 4130987 - RNA, 14 nt, Yersinia pestis
agauauuacgcagc

SEQ ID NO: 4130988 - RNA, 14 nt, Yersinia pestis
agauauuauuagcc

SEQ ID NO: 4130989 - RNA, 16 nt, Yersinia pestis
agauauugcgcaguaa

SEQ ID NO: 4130990 - RNA, 14 nt, Yersinia pestis
agauauuugcugcc

SEQ ID NO: 4130991 - RNA, 20 nt, Yersinia pestis
agaucaaaagcagagaauga

SEQ ID NO: 4130992 - RNA, 15 nt, Yersinia pestis
agaucaacauuccau

SEQ ID NO: 4130993 - RNA, 23 nt, Yersinia pestis
agaucacagacguuuaaauaagc

SEQ ID NO: 4130994 - RNA, 11 nt, Yersinia pestis
agaucagugcc

SEQ ID NO: 4130995 - RNA, 16 nt, Yersinia pestis
agaucagugccaguaa

SEQ ID NO: 4130996 - RNA, 23 nt, Yersinia pestis
agaucauuuuuuuccacccgcug

SEQ ID NO: 4130997 - RNA, 16 nt, Yersinia pestis
agauccaccacaucau

SEQ ID NO: 4130998 - RNA, 13 nt, Yersinia pestis
agauccagaacac

SEQ ID NO: 4130999 - RNA, 17 nt, Yersinia pestis
agauccagaauuucauu

SEQ ID NO: 4131000 - RNA, 18 nt, Yersinia pestis
agaucccaagcaggaaac

SEQ ID NO: 4131001 - RNA, 23 nt, Yersinia pestis
agauccgugcgccugaacagccu

SEQ ID NO: 4131002 - RNA, 14 nt, Yersinia pestis
agaucgcucucacc

SEQ ID NO: 4131003 - RNA, 15 nt, Yersinia pestis
agaucgcucucaccc

SEQ ID NO: 4131004 - RNA, 16 nt, Yersinia pestis
agaucggcauuauuau

SEQ ID NO: 4131005 - RNA, 19 nt, Yersinia pestis
agaucggggcgcuuaauuc

SEQ ID NO: 4131006 - RNA, 16 nt, Yersinia pestis
agaucggguaaaccaa

SEQ ID NO: 4131007 - RNA, 12 nt, Yersinia pestis
agaucguaaaga

SEQ ID NO: 4131008 - RNA, 16 nt, Yersinia pestis
agaucguuaaacccgg

SEQ ID NO: 4131009 - RNA, 23 nt, Yersinia pestis
agaucugcccccccuuucaccaa

SEQ ID NO: 4131010 - RNA, 14 nt, Yersinia pestis
agaucuuuuucauu

SEQ ID NO: 4131011 - RNA, 16 nt, Yersinia pestis
agaugaaggucaccau

SEQ ID NO: 4131012 - RNA, 21 nt, Yersinia pestis
agaugacaucgacgcgccaua

SEQ ID NO: 4131013 - RNA, 22 nt, Yersinia pestis
agaugacaucgacgcgccauaa

SEQ ID NO: 4131014 - RNA, 15 nt, Yersinia pestis
agaugagugguuuau

SEQ ID NO: 4131015 - RNA, 13 nt, Yersinia pestis
agaugaucaaauu

SEQ ID NO: 4131016 - RNA, 13 nt, Yersinia pestis
agaugauugaggc

SEQ ID NO: 4131017 - RNA, 20 nt, Yersinia pestis
agaugcauauuugcagaaag

SEQ ID NO: 4131018 - RNA, 14 nt, Yersinia pestis
agaugccaaucaaa

SEQ ID NO: 4131019 - RNA, 23 nt, Yersinia pestis
agaugccaaucaaaaaaccggcu

SEQ ID NO: 4131020 - RNA, 13 nt, Yersinia pestis
agaugccagacuu

SEQ ID NO: 4131021 - RNA, 21 nt, Yersinia pestis
agaugccgcacacaucugucg

SEQ ID NO: 4131022 - RNA, 19 nt, Yersinia pestis
agaugccuauuugcagaaa

SEQ ID NO: 4131023 - RNA, 13 nt, Yersinia pestis
agaugcugacccu

SEQ ID NO: 4131024 - RNA, 21 nt, Yersinia pestis
agauggcagugacauuaccug

SEQ ID NO: 4131025 - RNA, 16 nt, Yersinia pestis
agauggccccaauugu

SEQ ID NO: 4131026 - RNA, 15 nt, Yersinia pestis
agauggcgaucaagc

SEQ ID NO: 4131027 - RNA, 17 nt, Yersinia pestis
agauggcgaucaagccc

SEQ ID NO: 4131028 - RNA, 20 nt, Yersinia pestis
agauggucaacuaaacagau

SEQ ID NO: 4131029 - RNA, 15 nt, Yersinia pestis
agauguauccaaggc

SEQ ID NO: 4131030 - RNA, 20 nt, Yersinia pestis
agauguauuaguuucaaaua

SEQ ID NO: 4131031 - RNA, 16 nt, Yersinia pestis
agaugucccagaaaua

SEQ ID NO: 4131032 - RNA, 17 nt, Yersinia pestis
agaugucccagaaauau

SEQ ID NO: 4131033 - RNA, 18 nt, Yersinia pestis
agaugucccagaaauauu

SEQ ID NO: 4131034 - RNA, 23 nt, Yersinia pestis
agauuaaaagucuaucucggccc

SEQ ID NO: 4131035 - RNA, 13 nt, Yersinia pestis
agauuaagacuuu

SEQ ID NO: 4131036 - RNA, 19 nt, Yersinia pestis
agauuaauacaucaucaaa

SEQ ID NO: 4131037 - RNA, 13 nt, Yersinia pestis
agauuacagccua

SEQ ID NO: 4131038 - RNA, 19 nt, Yersinia pestis
agauuacgcaucgucaguu

SEQ ID NO: 4131039 - RNA, 22 nt, Yersinia pestis
agauuagagguuauugacaaag

SEQ ID NO: 4131040 - RNA, 15 nt, Yersinia pestis
agauuagguuuuauu

SEQ ID NO: 4131041 - RNA, 21 nt, Yersinia pestis
agauuagucuuagacgucaga

SEQ ID NO: 4131042 - RNA, 21 nt, Yersinia pestis
agauuaguuuuagacgucaga

SEQ ID NO: 4131043 - RNA, 22 nt, Yersinia pestis
agauuaguuuuagaugucagau

SEQ ID NO: 4131044 - RNA, 13 nt, Yersinia pestis
agauuaucagccc

SEQ ID NO: 4131045 - RNA, 17 nt, Yersinia pestis
agauuaucagcccaucu

SEQ ID NO: 4131046 - RNA, 16 nt, Yersinia pestis
agauuauccagcccua

SEQ ID NO: 4131047 - RNA, 12 nt, Yersinia pestis
agauucaccagu

SEQ ID NO: 4131048 - RNA, 12 nt, Yersinia pestis
agauucagcugc

SEQ ID NO: 4131049 - RNA, 16 nt, Yersinia pestis
agauucauuagccagc

SEQ ID NO: 4131050 - RNA, 14 nt, Yersinia pestis
agauuccuuaccug

SEQ ID NO: 4131051 - RNA, 19 nt, Yersinia pestis
agauugccaaucagaacua

SEQ ID NO: 4131052 - RNA, 19 nt, Yersinia pestis
agauugccucauucgggca

SEQ ID NO: 4131053 - RNA, 17 nt, Yersinia pestis
agauuguuuauaaauua

SEQ ID NO: 4131054 - RNA, 21 nt, Yersinia pestis
agauuguuuauaaauuaaaaa

SEQ ID NO: 4131055 - RNA, 15 nt, Yersinia pestis
agauuuaauugugcu

SEQ ID NO: 4131056 - RNA, 14 nt, Yersinia pestis
agauuucagacugc

SEQ ID NO: 4131057 - RNA, 19 nt, Yersinia pestis
agauuucagacugcugaca

SEQ ID NO: 4131058 - RNA, 19 nt, Yersinia pestis
agauuucaucauucaauac

SEQ ID NO: 4131059 - RNA, 22 nt, Yersinia pestis
agauuucaucggcaaaaacagu

SEQ ID NO: 4131060 - RNA, 23 nt, Yersinia pestis
agauuuuugauaauuucaguuca

SEQ ID NO: 4131061 - RNA, 21 nt, Yersinia pestis
agcaaaaaaacugacugccau

SEQ ID NO: 4131062 - RNA, 12 nt, Yersinia pestis
agcaaaagccuc

SEQ ID NO: 4131063 - RNA, 21 nt, Yersinia pestis
agcaaaauccgguaauggcca

SEQ ID NO: 4131064 - RNA, 20 nt, Yersinia pestis
agcaaacccacaauauauac

SEQ ID NO: 4131065 - RNA, 15 nt, Yersinia pestis
agcaaacccaccuga

SEQ ID NO: 4131066 - RNA, 16 nt, Yersinia pestis
agcaaacgaacgaaua

SEQ ID NO: 4131067 - RNA, 23 nt, Yersinia pestis
agcaaagcgauaucguuaucaac

SEQ ID NO: 4131068 - RNA, 14 nt, Yersinia pestis
agcaaaggcccgcu

SEQ ID NO: 4131069 - RNA, 17 nt, Yersinia pestis
agcaaaguauuuauaca

SEQ ID NO: 4131070 - RNA, 16 nt, Yersinia pestis
agcaaauaaacaaaau

SEQ ID NO: 4131071 - RNA, 22 nt, Yersinia pestis
agcaaauaacaugauguaacag

SEQ ID NO: 4131072 - RNA, 15 nt, Yersinia pestis
agcaaaucaaacaaa

SEQ ID NO: 4131073 - RNA, 15 nt, Yersinia pestis
agcaaaucauuuaau

SEQ ID NO: 4131074 - RNA, 17 nt, Yersinia pestis
agcaaauucccaccaua

SEQ ID NO: 4131075 - RNA, 15 nt, Yersinia pestis
agcaaauugcugaaa

SEQ ID NO: 4131076 - RNA, 16 nt, Yersinia pestis
agcaaauuuaucagua

SEQ ID NO: 4131077 - RNA, 21 nt, Yersinia pestis
agcaaauuuaucaguagcuag

SEQ ID NO: 4131078 - RNA, 13 nt, Yersinia pestis
agcaaauuuugca

SEQ ID NO: 4131079 - RNA, 15 nt, Yersinia pestis
agcaacaaacagccg

SEQ ID NO: 4131080 - RNA, 16 nt, Yersinia pestis
agcaacaaccccauga

SEQ ID NO: 4131081 - RNA, 21 nt, Yersinia pestis
agcaaccggauacaaagugaa

SEQ ID NO: 4131082 - RNA, 22 nt, Yersinia pestis
agcaacgguaucccggugauca

SEQ ID NO: 4131083 - RNA, 20 nt, Yersinia pestis
agcaacugaaaccgaucacu

SEQ ID NO: 4131084 - RNA, 12 nt, Yersinia pestis
agcaagaaacug

SEQ ID NO: 4131085 - RNA, 20 nt, Yersinia pestis
agcaagauuuuguagcccac

SEQ ID NO: 4131086 - RNA, 23 nt, Yersinia pestis
agcaagauuuuguagcccacuga

SEQ ID NO: 4131087 - RNA, 19 nt, Yersinia pestis
agcaagccgauaaucaauu

SEQ ID NO: 4131088 - RNA, 16 nt, Yersinia pestis
agcaaggcagcaagca

SEQ ID NO: 4131089 - RNA, 16 nt, Yersinia pestis
agcaagggcagcuaac

SEQ ID NO: 4131090 - RNA, 11 nt, Yersinia pestis
agcaagugaac

SEQ ID NO: 4131091 - RNA, 19 nt, Yersinia pestis
agcaagugaauaacgcugg

SEQ ID NO: 4131092 - RNA, 14 nt, Yersinia pestis
agcaucuuuucaug

SEQ ID NO: 4131093 - RNA, 17 nt, Yersinia pestis
agcaugccauccugcca

SEQ ID NO: 4131094 - RNA, 13 nt, Yersinia pestis
agcaugcccagcc

SEQ ID NO: 4131095 - RNA, 14 nt, Yersinia pestis
agcaugcccagccu

SEQ ID NO: 4131096 - RNA, 19 nt, Yersinia pestis
agcaugcccagccucugga

SEQ ID NO: 4131097 - RNA, 18 nt, Yersinia pestis
agcaugcguaucauuauu

SEQ ID NO: 4131098 - RNA, 14 nt, Yersinia pestis
agcaugggcuugca

SEQ ID NO: 4131099 - RNA, 22 nt, Yersinia pestis
agcauguuccuguugcuggcca

SEQ ID NO: 4131100 - RNA, 23 nt, Yersinia pestis
agcauguuccuguugcuggccag

SEQ ID NO: 4131101 - RNA, 13 nt, Yersinia pestis
agcauuaaacaga

SEQ ID NO: 4131102 - RNA, 22 nt, Yersinia pestis
agcauuauauuauuuaucaauc

SEQ ID NO: 4131103 - RNA, 12 nt, Yersinia pestis
agcauucagaua

SEQ ID NO: 4131104 - RNA, 12 nt, Yersinia pestis
agcauucauucg

SEQ ID NO: 4131105 - RNA, 21 nt, Yersinia pestis
agcauucgcgguuacaccaau

SEQ ID NO: 4131106 - RNA, 24 nt, Yersinia pestis
agcauugaguacgcuaagacauua

SEQ ID NO: 4131107 - RNA, 15 nt, Yersinia pestis
agcauuuaucauauu

SEQ ID NO: 4131108 - RNA, 13 nt, Yersinia pestis
agcauuucaggau

SEQ ID NO: 4131109 - RNA, 18 nt, Yersinia pestis
agcauuuucagcaacuga

SEQ ID NO: 4131110 - RNA, 14 nt, Yersinia pestis
agccaaaauaauca

SEQ ID NO: 4131111 - RNA, 18 nt, Yersinia pestis
agccaaaauaaucaccag

SEQ ID NO: 4131112 - RNA, 14 nt, Yersinia pestis
agccaaaauaauua

SEQ ID NO: 4131113 - RNA, 19 nt, Yersinia pestis
agccaaacaaaugaacccu

SEQ ID NO: 4131114 - RNA, 16 nt, Yersinia pestis
agccaaaccccgccuc

SEQ ID NO: 4131115 - RNA, 21 nt, Yersinia pestis
agccaaaccccgccucuucua

SEQ ID NO: 4131116 - RNA, 14 nt, Yersinia pestis
agccaaaguggcau

SEQ ID NO: 4131117 - RNA, 22 nt, Yersinia pestis
agccaaauacccuaauucagau

SEQ ID NO: 4131118 - RNA, 20 nt, Yersinia pestis
agccaaaugagauugaucag

SEQ ID NO: 4131119 - RNA, 21 nt, Yersinia pestis
agccaaauugugaguuaaaaa

SEQ ID NO: 4131120 - RNA, 20 nt, Yersinia pestis
agccaagacuuuccacaaca

SEQ ID NO: 4131121 - RNA, 16 nt, Yersinia pestis
agccaagcaaccuugu

SEQ ID NO: 4131122 - RNA, 23 nt, Yersinia pestis
agccaagcaagcggcagcgcugg

SEQ ID NO: 4131123 - RNA, 16 nt, Yersinia pestis
agccaaucggccuuaa

SEQ ID NO: 4131124 - RNA, 21 nt, Yersinia pestis
agccacaaguucugccccuga

SEQ ID NO: 4131125 - RNA, 20 nt, Yersinia pestis
agccacacauucagucacuu

SEQ ID NO: 4131126 - RNA, 20 nt, Yersinia pestis
agccaccaccacggccagaa

SEQ ID NO: 4131127 - RNA, 14 nt, Yersinia pestis
agccaccagaauca

SEQ ID NO: 4131128 - RNA, 11 nt, Yersinia pestis
agccaccagau

SEQ ID NO: 4131129 - RNA, 18 nt, Yersinia pestis
agccaccaguuuauuuuc

SEQ ID NO: 4131130 - RNA, 20 nt, Yersinia pestis
agccaccccguggcaggccu

SEQ ID NO: 4131131 - RNA, 15 nt, Yersinia pestis
agccaccgcauucca

SEQ ID NO: 4131132 - RNA, 21 nt, Yersinia pestis
agccacgaaucgggauuggcc

SEQ ID NO: 4131133 - RNA, 14 nt, Yersinia pestis
agccacgcguaauc

SEQ ID NO: 4131134 - RNA, 24 nt, Yersinia pestis
agccacgcguaaucauagccauca

SEQ ID NO: 4131135 - RNA, 15 nt, Yersinia pestis
agccacguaauacca

SEQ ID NO: 4131136 - RNA, 22 nt, Yersinia pestis
agccacguaauaccacuagcag

SEQ ID NO: 4131137 - RNA, 14 nt, Yersinia pestis
agccacuacugaac

SEQ ID NO: 4131138 - RNA, 17 nt, Yersinia pestis
agccacucacauaagaa

SEQ ID NO: 4131139 - RNA, 15 nt, Yersinia pestis
agccacugggcuacc

SEQ ID NO: 4131140 - RNA, 14 nt, Yersinia pestis
agccagaaugaacu

SEQ ID NO: 4131141 - RNA, 21 nt, Yersinia pestis
agccagauaggcgaaauugac

SEQ ID NO: 4131142 - RNA, 17 nt, Yersinia pestis
agccagcacacagaugc

SEQ ID NO: 4131143 - RNA, 16 nt, Yersinia pestis
agccagccaccgcaca

SEQ ID NO: 4131144 - RNA, 20 nt, Yersinia pestis
agccagccaccgcacacuga

SEQ ID NO: 4131145 - RNA, 20 nt, Yersinia pestis
agccagccacugggcuaccc

SEQ ID NO: 4131146 - RNA, 13 nt, Yersinia pestis
agccagccuuaac

SEQ ID NO: 4131147 - RNA, 16 nt, Yersinia pestis
agccagcgucaucaca

SEQ ID NO: 4131148 - RNA, 15 nt, Yersinia pestis
agccagugcgggaga

SEQ ID NO: 4131149 - RNA, 16 nt, Yersinia pestis
agccaguuuacgggug

SEQ ID NO: 4131150 - RNA, 18 nt, Yersinia pestis
agccauaaagugcguagg

SEQ ID NO: 4131151 - RNA, 14 nt, Yersinia pestis
agccauaacuucug

SEQ ID NO: 4131152 - RNA, 14 nt, Yersinia pestis
agccauaauaaugc

SEQ ID NO: 4131153 - RNA, 17 nt, Yersinia pestis
agccauauguugccacc

SEQ ID NO: 4131154 - RNA, 16 nt, Yersinia pestis
agccaucaguucacug

SEQ ID NO: 4131155 - RNA, 15 nt, Yersinia pestis
agccauccaggcaag

SEQ ID NO: 4131156 - RNA, 18 nt, Yersinia pestis
agccauccuucagacugc

SEQ ID NO: 4131157 - RNA, 22 nt, Yersinia pestis
agccaucgacuaauuaaacaag

SEQ ID NO: 4131158 - RNA, 11 nt, Yersinia pestis
agccaucgcca

SEQ ID NO: 4131159 - RNA, 23 nt, Yersinia pestis
agccaucuugggccgacucugca

SEQ ID NO: 4131160 - RNA, 15 nt, Yersinia pestis
agccaugagguuuau

SEQ ID NO: 4131161 - RNA, 15 nt, Yersinia pestis
agccauggcuuuagg

SEQ ID NO: 4131162 - RNA, 18 nt, Yersinia pestis
agccauucagcagcaaga

SEQ ID NO: 4131163 - RNA, 14 nt, Yersinia pestis
agccauugauuggc

SEQ ID NO: 4131164 - RNA, 16 nt, Yersinia pestis
agccauuucaccaaua

SEQ ID NO: 4131165 - RNA, 15 nt, Yersinia pestis
agccauuucaguaac

SEQ ID NO: 4131166 - RNA, 16 nt, Yersinia pestis
agcccaacugacugaa

SEQ ID NO: 4131167 - RNA, 18 nt, Yersinia pestis
agcccaacugacugaagu

SEQ ID NO: 4131168 - RNA, 13 nt, Yersinia pestis
agcccaagagaaa

SEQ ID NO: 4131169 - RNA, 13 nt, Yersinia pestis
agcccaaggcgac

SEQ ID NO: 4131170 - RNA, 19 nt, Yersinia pestis
agcccacgaggacaggugg

SEQ ID NO: 4131171 - RNA, 20 nt, Yersinia pestis
agcccacugacacugauaga

SEQ ID NO: 4131172 - RNA, 16 nt, Yersinia pestis
agcccagauggcaauc

SEQ ID NO: 4131173 - RNA, 19 nt, Yersinia pestis
agcccagauggcaaucugc

SEQ ID NO: 4131174 - RNA, 17 nt, Yersinia pestis
agcccaggcgacgcagu

SEQ ID NO: 4131175 - RNA, 21 nt, Yersinia pestis
agcccaggcgacgcaguaaga

SEQ ID NO: 4131176 - RNA, 20 nt, Yersinia pestis
agcccagguuacugcccugg

SEQ ID NO: 4131177 - RNA, 19 nt, Yersinia pestis
agcccaguauugcagagca

SEQ ID NO: 4131178 - RNA, 16 nt, Yersinia pestis
agcccauagccauggc

SEQ ID NO: 4131179 - RNA, 17 nt, Yersinia pestis
agcccauagccauggcu

SEQ ID NO: 4131180 - RNA, 12 nt, Yersinia pestis
agcccauugcug

SEQ ID NO: 4131181 - RNA, 13 nt, Yersinia pestis
agcccauugcugu

SEQ ID NO: 4131182 - RNA, 19 nt, Yersinia pestis
agccccacaguacaaaaaa

SEQ ID NO: 4131183 - RNA, 21 nt, Yersinia pestis
agcccccaaaguagaacuggc

SEQ ID NO: 4131184 - RNA, 13 nt, Yersinia pestis
agcccccagggaa

SEQ ID NO: 4131185 - RNA, 14 nt, Yersinia pestis
agccccugccagaa

SEQ ID NO: 4131186 - RNA, 20 nt, Yersinia pestis
agccccuuugaacugcaccc

SEQ ID NO: 4131187 - RNA, 16 nt, Yersinia pestis
agcccggaaacgucca

SEQ ID NO: 4131188 - RNA, 21 nt, Yersinia pestis
agcccgguguuaaccgcccca

SEQ ID NO: 4131189 - RNA, 16 nt, Yersinia pestis
agcccguucggucaca

SEQ ID NO: 4131190 - RNA, 17 nt, Yersinia pestis
agcccuacuggcugaag

SEQ ID NO: 4131191 - RNA, 18 nt, Yersinia pestis
agcccuacuggcugaagu

SEQ ID NO: 4131192 - RNA, 18 nt, Yersinia pestis
agcccuuauucaaagaau

SEQ ID NO: 4131193 - RNA, 16 nt, Yersinia pestis
agcccuucgcaccgcc

SEQ ID NO: 4131194 - RNA, 21 nt, Yersinia pestis
agcccuuugaccauuuguuuu

SEQ ID NO: 4131195 - RNA, 18 nt, Yersinia pestis
agcccuuugcuuucagga

SEQ ID NO: 4131196 - RNA, 23 nt, Yersinia pestis
agcccuuuggcaaucacaacccc

SEQ ID NO: 4131197 - RNA, 15 nt, Yersinia pestis
agccgaagcgccccu

SEQ ID NO: 4131198 - RNA, 15 nt, Yersinia pestis
agccgaauaucccac

SEQ ID NO: 4131199 - RNA, 19 nt, Yersinia pestis
agccgagaaauaguuacug

SEQ ID NO: 4131200 - RNA, 19 nt, Yersinia pestis
agccgagcaagugaauaac

SEQ ID NO: 4131201 - RNA, 23 nt, Yersinia pestis
agccgagcaagugaauaacgcug

SEQ ID NO: 4131202 - RNA, 18 nt, Yersinia pestis
agccgauaauccaccuga

SEQ ID NO: 4131203 - RNA, 21 nt, Yersinia pestis
agccgauaaucccugccagaa

SEQ ID NO: 4131204 - RNA, 16 nt, Yersinia pestis
agccgauuuagacaag

SEQ ID NO: 4131205 - RNA, 23 nt, Yersinia pestis
agccgcagaugccagacuugggu

SEQ ID NO: 4131206 - RNA, 17 nt, Yersinia pestis
agccgcaggcaaacaau

SEQ ID NO: 4131207 - RNA, 15 nt, Yersinia pestis
agccgcauuguucgg

SEQ ID NO: 4131208 - RNA, 21 nt, Yersinia pestis
agccgccagucauucaccugc

SEQ ID NO: 4131209 - RNA, 23 nt, Yersinia pestis
agccgcgaugccaucgcuuuggc

SEQ ID NO: 4131210 - RNA, 18 nt, Yersinia pestis
agccgcgccauccuuggc

SEQ ID NO: 4131211 - RNA, 14 nt, Yersinia pestis
agccgcgcccuccc

SEQ ID NO: 4131212 - RNA, 18 nt, Yersinia pestis
agccgcuuuaaucgccug

SEQ ID NO: 4131213 - RNA, 19 nt, Yersinia pestis
agccgcuuuaaucgccuga

SEQ ID NO: 4131214 - RNA, 21 nt, Yersinia pestis
agcguggaauuaauaucccac

SEQ ID NO: 4131215 - RNA, 20 nt, Yersinia pestis
agcguucaaaucugcucccg

SEQ ID NO: 4131216 - RNA, 14 nt, Yersinia pestis
agcguucaucgccc

SEQ ID NO: 4131217 - RNA, 15 nt, Yersinia pestis
agcguucaucgcccu

SEQ ID NO: 4131218 - RNA, 20 nt, Yersinia pestis
agcguucgaggauaucacuc

SEQ ID NO: 4131219 - RNA, 21 nt, Yersinia pestis
agcguucuucugauucaauuu

SEQ ID NO: 4131220 - RNA, 16 nt, Yersinia pestis
agcguuuaaauacccg

SEQ ID NO: 4131221 - RNA, 14 nt, Yersinia pestis
agcguuuacucgcu

SEQ ID NO: 4131222 - RNA, 18 nt, Yersinia pestis
agcguuucuacaauggcc

SEQ ID NO: 4131223 - RNA, 14 nt, Yersinia pestis
agcuaaaaugaucu

SEQ ID NO: 4131224 - RNA, 17 nt, Yersinia pestis
agcuaacaaaaccggga

SEQ ID NO: 4131225 - RNA, 14 nt, Yersinia pestis
agcuaacagugacc

SEQ ID NO: 4131226 - RNA, 17 nt, Yersinia pestis
agcuaaccuuaacugca

SEQ ID NO: 4131227 - RNA, 18 nt, Yersinia pestis
agcuaaccuuaacugcau

SEQ ID NO: 4131228 - RNA, 22 nt, Yersinia pestis
agcuaacgcuuucagguuguua

SEQ ID NO: 4131229 - RNA, 17 nt, Yersinia pestis
agcuaauaauuguucau

SEQ ID NO: 4131230 - RNA, 14 nt, Yersinia pestis
agcuaaucauugca

SEQ ID NO: 4131231 - RNA, 20 nt, Yersinia pestis
agcuaaugcucgcucaucau

SEQ ID NO: 4131232 - RNA, 23 nt, Yersinia pestis
agcuacagcaccauuaucuucca

SEQ ID NO: 4131233 - RNA, 22 nt, Yersinia pestis
agcuaccggaaugaguugcccu

SEQ ID NO: 4131234 - RNA, 17 nt, Yersinia pestis
agcuacggccuguacca

SEQ ID NO: 4131235 - RNA, 20 nt, Yersinia pestis
agcuacuaauggagagaugu

SEQ ID NO: 4131236 - RNA, 19 nt, Yersinia pestis
agcuacugcacgcauucuu

SEQ ID NO: 4131237 - RNA, 22 nt, Yersinia pestis
agcuagaauaaguugaugcagu

SEQ ID NO: 4131238 - RNA, 16 nt, Yersinia pestis
agcuaucuuugccugg

SEQ ID NO: 4131239 - RNA, 15 nt, Yersinia pestis
agcuaugcaguuaag

SEQ ID NO: 4131240 - RNA, 13 nt, Yersinia pestis
agcucaagcuggc

SEQ ID NO: 4131241 - RNA, 13 nt, Yersinia pestis
agcucaaucacau

SEQ ID NO: 4131242 - RNA, 14 nt, Yersinia pestis
agcucaaucacauc

SEQ ID NO: 4131243 - RNA, 16 nt, Yersinia pestis
agcucagcuggauaga

SEQ ID NO: 4131244 - RNA, 13 nt, Yersinia pestis
agcucaucaccaa

SEQ ID NO: 4131245 - RNA, 19 nt, Yersinia pestis
agcucauuaauccccgguc

SEQ ID NO: 4131246 - RNA, 19 nt, Yersinia pestis
agcucgcuguggcuaccau

SEQ ID NO: 4131247 - RNA, 21 nt, Yersinia pestis
agcucuacagugacuuuguca

SEQ ID NO: 4131248 - RNA, 14 nt, Yersinia pestis
agcucucgcggcgu

SEQ ID NO: 4131249 - RNA, 17 nt, Yersinia pestis
agcucucugagccaucc

SEQ ID NO: 4131250 - RNA, 16 nt, Yersinia pestis
agcucuucaauuucca

SEQ ID NO: 4131251 - RNA, 14 nt, Yersinia pestis
agcucuuccagcaa

SEQ ID NO: 4131252 - RNA, 18 nt, Yersinia pestis
agcugaacaaacuuaucc

SEQ ID NO: 4131253 - RNA, 21 nt, Yersinia pestis
agcugauaugaaaaaucugac

SEQ ID NO: 4131254 - RNA, 15 nt, Yersinia pestis
agcugcgauaauccg

SEQ ID NO: 4131255 - RNA, 15 nt, Yersinia pestis
agcugcuaaucccuu

SEQ ID NO: 4131256 - RNA, 20 nt, Yersinia pestis
agcugcugcaagaguccagc

SEQ ID NO: 4131257 - RNA, 23 nt, Yersinia pestis
agcugcugcaagaguccagcacu

SEQ ID NO: 4131258 - RNA, 16 nt, Yersinia pestis
agcugcugcuuucagu

SEQ ID NO: 4131259 - RNA, 18 nt, Yersinia pestis
agcugcuuuugcugaugc

SEQ ID NO: 4131260 - RNA, 22 nt, Yersinia pestis
agcuggagccauaaguaaagcg

SEQ ID NO: 4131261 - RNA, 18 nt, Yersinia pestis
agcuggcaguucggcuuu

SEQ ID NO: 4131262 - RNA, 17 nt, Yersinia pestis
agcuggcggauaaaaau

SEQ ID NO: 4131263 - RNA, 16 nt, Yersinia pestis
agcuggcuucaaaauc

SEQ ID NO: 4131264 - RNA, 18 nt, Yersinia pestis
agcuguaaauauaaaaua

SEQ ID NO: 4131265 - RNA, 20 nt, Yersinia pestis
agcuguacuaaagguguacu

SEQ ID NO: 4131266 - RNA, 19 nt, Yersinia pestis
agcuguagaacuuguucau

SEQ ID NO: 4131267 - RNA, 18 nt, Yersinia pestis
agcuguagcaauauaucu

SEQ ID NO: 4131268 - RNA, 15 nt, Yersinia pestis
agcuguauugcccga

SEQ ID NO: 4131269 - RNA, 18 nt, Yersinia pestis
agcuguuagccagauagg

SEQ ID NO: 4131270 - RNA, 13 nt, Yersinia pestis
agcuguuguuguu

SEQ ID NO: 4131271 - RNA, 22 nt, Yersinia pestis
agcuguuguuguugauuacggg

SEQ ID NO: 4131272 - RNA, 17 nt, Yersinia pestis
agcuuaaucaucaucac

SEQ ID NO: 4131273 - RNA, 12 nt, Yersinia pestis
agcuuagcccac

SEQ ID NO: 4131274 - RNA, 22 nt, Yersinia pestis
agcuuauccauuacagcaccug

SEQ ID NO: 4131275 - RNA, 21 nt, Yersinia pestis
agcuuauggaaguaauccaga

SEQ ID NO: 4131276 - RNA, 17 nt, Yersinia pestis
agcuucaccuuuguguu

SEQ ID NO: 4131277 - RNA, 20 nt, Yersinia pestis
agcuuccagcaccccuucac

SEQ ID NO: 4131278 - RNA, 17 nt, Yersinia pestis
agcuuccgcuucaacuu

SEQ ID NO: 4131279 - RNA, 19 nt, Yersinia pestis
agcuucgccaccagauagu

SEQ ID NO: 4131280 - RNA, 17 nt, Yersinia pestis
agcuucucgcaccagau

SEQ ID NO: 4131281 - RNA, 15 nt, Yersinia pestis
agcuucuucaaaagc

SEQ ID NO: 4131282 - RNA, 13 nt, Yersinia pestis
agcuucuuuuaaa

SEQ ID NO: 4131283 - RNA, 11 nt, Yersinia pestis
agcuugauucg

SEQ ID NO: 4131284 - RNA, 15 nt, Yersinia pestis
agcuugcaaguguau

SEQ ID NO: 4131285 - RNA, 22 nt, Yersinia pestis
agcuugggcgauagucggcauu

SEQ ID NO: 4131286 - RNA, 22 nt, Yersinia pestis
agcuugguaaugcgcaccagcu

SEQ ID NO: 4131287 - RNA, 23 nt, Yersinia pestis
agcuugguaaugcgcaccagcuc

SEQ ID NO: 4131288 - RNA, 22 nt, Yersinia pestis
agcuuguugauaucaaucucuu

SEQ ID NO: 4131289 - RNA, 15 nt, Yersinia pestis
agcuuucuccuuuga

SEQ ID NO: 4131290 - RNA, 20 nt, Yersinia pestis
agcuuugugcaaaauacaaa

SEQ ID NO: 4131291 - RNA, 21 nt, Yersinia pestis
aggaaacucaugacaucccag

SEQ ID NO: 4131292 - RNA, 21 nt, Yersinia pestis
aggaaaggccggauguaaaac

SEQ ID NO: 4131293 - RNA, 22 nt, Yersinia pestis
aggaaaggccggauguaaaaca

SEQ ID NO: 4131294 - RNA, 21 nt, Yersinia pestis
aggaaauaaaugacuaucccu

SEQ ID NO: 4131295 - RNA, 20 nt, Yersinia pestis
aggaacgaaguuagacccaa

SEQ ID NO: 4131296 - RNA, 21 nt, Yersinia pestis
aggaagcguauaagcagggga

SEQ ID NO: 4131297 - RNA, 20 nt, Yersinia pestis
aggaagggguucuuccaacg

SEQ ID NO: 4131298 - RNA, 16 nt, Yersinia pestis
aggaaguccaguaaua

SEQ ID NO: 4131299 - RNA, 15 nt, Yersinia pestis
aggaauaagguuuuu

SEQ ID NO: 4131300 - RNA, 19 nt, Yersinia pestis
aggaauaucugugauaacc

SEQ ID NO: 4131301 - RNA, 19 nt, Yersinia pestis
aggaaugccgauaagcccu

SEQ ID NO: 4131302 - RNA, 15 nt, Yersinia pestis
aggaaugcgcccuuu

SEQ ID NO: 4131303 - RNA, 16 nt, Yersinia pestis
aggaauggcgugauau

SEQ ID NO: 4131304 - RNA, 22 nt, Yersinia pestis
aggacgaaggguaaaauaaaua

SEQ ID NO: 4131305 - RNA, 17 nt, Yersinia pestis
aggacgacggguauauu

SEQ ID NO: 4131306 - RNA, 20 nt, Yersinia pestis
aggacgacggguauauugcc

SEQ ID NO: 4131307 - RNA, 14 nt, Yersinia pestis
aggacggugccaug

SEQ ID NO: 4131308 - RNA, 20 nt, Yersinia pestis
aggacucugcgcucauacuc

SEQ ID NO: 4131309 - RNA, 13 nt, Yersinia pestis
aggacuucaucac

SEQ ID NO: 4131310 - RNA, 13 nt, Yersinia pestis
aggacuuccugcc

SEQ ID NO: 4131311 - RNA, 23 nt, Yersinia pestis
aggagagauuggcgguaucuuau

SEQ ID NO: 4131312 - RNA, 15 nt, Yersinia pestis
aggagauagcgugua

SEQ ID NO: 4131313 - RNA, 17 nt, Yersinia pestis
aggagauuucagacugc

SEQ ID NO: 4131314 - RNA, 20 nt, Yersinia pestis
aggagauuucagacugcuga

SEQ ID NO: 4131315 - RNA, 16 nt, Yersinia pestis
aggagccauugauugg

SEQ ID NO: 4131316 - RNA, 23 nt, Yersinia pestis
aggagcgauaacauuuuuucuuu

SEQ ID NO: 4131317 - RNA, 18 nt, Yersinia pestis
aggagguaugacgagcgg

SEQ ID NO: 4131318 - RNA, 21 nt, Yersinia pestis
aggaguaaagcguccgcgcca

SEQ ID NO: 4131319 - RNA, 11 nt, Yersinia pestis
aggauaaaaac

SEQ ID NO: 4131320 - RNA, 14 nt, Yersinia pestis
aggauaggcagagg

SEQ ID NO: 4131321 - RNA, 21 nt, Yersinia pestis
aggauaggguuuuuugaacaa

SEQ ID NO: 4131322 - RNA, 16 nt, Yersinia pestis
aggauauuuauuaaaa

SEQ ID NO: 4131323 - RNA, 17 nt, Yersinia pestis
aggauauuuauuaaaac

SEQ ID NO: 4131324 - RNA, 18 nt, Yersinia pestis
aggauauuuauuaaaaca

SEQ ID NO: 4131325 - RNA, 14 nt, Yersinia pestis
aggauauuuauucg

SEQ ID NO: 4131326 - RNA, 16 nt, Yersinia pestis
aggauauuuauugcau

SEQ ID NO: 4131327 - RNA, 20 nt, Yersinia pestis
aggauauuuauuguuaucaa

SEQ ID NO: 4131328 - RNA, 22 nt, Yersinia pestis
aggauauuuauuguuaucaaau

SEQ ID NO: 4131329 - RNA, 20 nt, Yersinia pestis
aggauauuuauuuacucuuu

SEQ ID NO: 4131330 - RNA, 19 nt, Yersinia pestis
aggauauuuauuuuuaugg

SEQ ID NO: 4131331 - RNA, 13 nt, Yersinia pestis
aggaucuggauuu

SEQ ID NO: 4131332 - RNA, 12 nt, Yersinia pestis
aggaucuuccuc

SEQ ID NO: 4131333 - RNA, 15 nt, Yersinia pestis
aggaugaugaauacc

SEQ ID NO: 4131334 - RNA, 18 nt, Yersinia pestis
aggauggcgcggcucgag

SEQ ID NO: 4131335 - RNA, 22 nt, Yersinia pestis
agggcuguuauccggguggcuu

SEQ ID NO: 4131336 - RNA, 22 nt, Yersinia pestis
agggcuucuggcgugucaucuu

SEQ ID NO: 4131337 - RNA, 18 nt, Yersinia pestis
agggcuuuguucacccca

SEQ ID NO: 4131338 - RNA, 20 nt, Yersinia pestis
aggggaugacaccuuucaaa

SEQ ID NO: 4131339 - RNA, 18 nt, Yersinia pestis
aggggccaacaggccccu

SEQ ID NO: 4131340 - RNA, 18 nt, Yersinia pestis
aggggccaauaggccccu

SEQ ID NO: 4131341 - RNA, 15 nt, Yersinia pestis
agggggaugccuugu

SEQ ID NO: 4131342 - RNA, 21 nt, Yersinia pestis
agggggcuguuaagcauugag

SEQ ID NO: 4131343 - RNA, 16 nt, Yersinia pestis
agggggcuuauucuaa

SEQ ID NO: 4131344 - RNA, 19 nt, Yersinia pestis
aggggguuuuccccucaga

SEQ ID NO: 4131345 - RNA, 14 nt, Yersinia pestis
agggguucuuccaa

SEQ ID NO: 4131346 - RNA, 14 nt, Yersinia pestis
aggguaaccaaugu

SEQ ID NO: 4131347 - RNA, 15 nt, Yersinia pestis
aggguauugaagaua

SEQ ID NO: 4131348 - RNA, 17 nt, Yersinia pestis
aggguauugaagauacc

SEQ ID NO: 4131349 - RNA, 22 nt, Yersinia pestis
agggucagaauacguagcccuu

SEQ ID NO: 4131350 - RNA, 17 nt, Yersinia pestis
agggugaaagcccaacu

SEQ ID NO: 4131351 - RNA, 14 nt, Yersinia pestis
agggugaugacaau

SEQ ID NO: 4131352 - RNA, 21 nt, Yersinia pestis
agggugggauauuaauuccac

SEQ ID NO: 4131353 - RNA, 23 nt, Yersinia pestis
aggguguggcgaaaaccccaccc

SEQ ID NO: 4131354 - RNA, 20 nt, Yersinia pestis
aggguucaagucccucccuu

SEQ ID NO: 4131355 - RNA, 17 nt, Yersinia pestis
aggguucaguaaaacca

SEQ ID NO: 4131356 - RNA, 21 nt, Yersinia pestis
aggguucgaaucccucccuca

SEQ ID NO: 4131357 - RNA, 20 nt, Yersinia pestis
aggguugcgggccucuucuu

SEQ ID NO: 4131358 - RNA, 14 nt, Yersinia pestis
aggguuuccaagcu

SEQ ID NO: 4131359 - RNA, 16 nt, Yersinia pestis
aggguuuugaaaucau

SEQ ID NO: 4131360 - RNA, 18 nt, Yersinia pestis
aggguuuugugggagagg

SEQ ID NO: 4131361 - RNA, 20 nt, Yersinia pestis
agguaaacgcaauguccccc

SEQ ID NO: 4131362 - RNA, 12 nt, Yersinia pestis
agguaaauccag

SEQ ID NO: 4131363 - RNA, 16 nt, Yersinia pestis
agguaaauccuucugg

SEQ ID NO: 4131364 - RNA, 12 nt, Yersinia pestis
agguaagaaaga

SEQ ID NO: 4131365 - RNA, 20 nt, Yersinia pestis
agguaagccuuucuccacau

SEQ ID NO: 4131366 - RNA, 15 nt, Yersinia pestis
agguaauaccaaugc

SEQ ID NO: 4131367 - RNA, 22 nt, Yersinia pestis
agguaauacucauccagauuau

SEQ ID NO: 4131368 - RNA, 18 nt, Yersinia pestis
agguaauauugaagacaa

SEQ ID NO: 4131369 - RNA, 16 nt, Yersinia pestis
agguaaucagacugcu

SEQ ID NO: 4131370 - RNA, 17 nt, Yersinia pestis
agguaaucagacugcug

SEQ ID NO: 4131371 - RNA, 19 nt, Yersinia pestis
agguaaucagacugcugac

SEQ ID NO: 4131372 - RNA, 19 nt, Yersinia pestis
agguaaugcauucugcugg

SEQ ID NO: 4131373 - RNA, 16 nt, Yersinia pestis
agguaaugucacugcc

SEQ ID NO: 4131374 - RNA, 16 nt, Yersinia pestis
agguaccccauaaauc

SEQ ID NO: 4131375 - RNA, 21 nt, Yersinia pestis
agguaccccauaaaucccgag

SEQ ID NO: 4131376 - RNA, 22 nt, Yersinia pestis
agguaccgcugcccggcucauc

SEQ ID NO: 4131377 - RNA, 18 nt, Yersinia pestis
agguaccugaucagcauu

SEQ ID NO: 4131378 - RNA, 15 nt, Yersinia pestis
agguacggccagcaa

SEQ ID NO: 4131379 - RNA, 21 nt, Yersinia pestis
agguauaaccauuaacaauau

SEQ ID NO: 4131380 - RNA, 19 nt, Yersinia pestis
agguauacaccucaacgug

SEQ ID NO: 4131381 - RNA, 18 nt, Yersinia pestis
agguaugugccaaaaaaa

SEQ ID NO: 4131382 - RNA, 14 nt, Yersinia pestis
aggucaauugcggc

SEQ ID NO: 4131383 - RNA, 21 nt, Yersinia pestis
aggucaauugcggccagccuu

SEQ ID NO: 4131384 - RNA, 18 nt, Yersinia pestis
aggucacuguuucgccuu

SEQ ID NO: 4131385 - RNA, 11 nt, Yersinia pestis
aggucaggaag

SEQ ID NO: 4131386 - RNA, 20 nt, Yersinia pestis
aggucaggaagagaaaagca

SEQ ID NO: 4131387 - RNA, 19 nt, Yersinia pestis
aggucagugguuuuaucaa

SEQ ID NO: 4131388 - RNA, 16 nt, Yersinia pestis
aggucaucccagcaca

SEQ ID NO: 4131389 - RNA, 21 nt, Yersinia pestis
aggucaucgucacgaucaacc

SEQ ID NO: 4131390 - RNA, 14 nt, Yersinia pestis
aggucccuuugaca

SEQ ID NO: 4131391 - RNA, 18 nt, Yersinia pestis
aggucgaucgacuucuua

SEQ ID NO: 4131392 - RNA, 14 nt, Yersinia pestis
aggucgccucuggg

SEQ ID NO: 4131393 - RNA, 15 nt, Yersinia pestis
aggucgggcgcugag

SEQ ID NO: 4131394 - RNA, 23 nt, Yersinia pestis
aggucucgcaaugaaaguggcca

SEQ ID NO: 4131395 - RNA, 15 nt, Yersinia pestis
aggugaaaauaauaa

SEQ ID NO: 4131396 - RNA, 21 nt, Yersinia pestis
aggugaaguucuauaaaacgc

SEQ ID NO: 4131397 - RNA, 22 nt, Yersinia pestis
aggugacaggcaaagacuacac

SEQ ID NO: 4131398 - RNA, 13 nt, Yersinia pestis
aggugcaguaacc

SEQ ID NO: 4131399 - RNA, 17 nt, Yersinia pestis
aggugcaguuucuaccg

SEQ ID NO: 4131400 - RNA, 21 nt, Yersinia pestis
aggugcauccacauauauaga

SEQ ID NO: 4131401 - RNA, 22 nt, Yersinia pestis
aggugcgccaguggcaucaaua

SEQ ID NO: 4131402 - RNA, 21 nt, Yersinia pestis
aggugcgggaugcaguuacug

SEQ ID NO: 4131403 - RNA, 13 nt, Yersinia pestis
aggugcuuauuua

SEQ ID NO: 4131404 - RNA, 15 nt, Yersinia pestis
aggugcuuauuuauu

SEQ ID NO: 4131405 - RNA, 14 nt, Yersinia pestis
agguggccauuacg

SEQ ID NO: 4131406 - RNA, 21 nt, Yersinia pestis
agguggcgauaaagagugaaa

SEQ ID NO: 4131407 - RNA, 23 nt, Yersinia pestis
agguguaaauuucaaaaaagccc

SEQ ID NO: 4131408 - RNA, 13 nt, Yersinia pestis
aggugucaucaag

SEQ ID NO: 4131409 - RNA, 23 nt, Yersinia pestis
aggugucaucaaggcaaccauca

SEQ ID NO: 4131410 - RNA, 23 nt, Yersinia pestis
aggugugcccaacaacgccgcac

SEQ ID NO: 4131411 - RNA, 20 nt, Yersinia pestis
agguguuacaacaugaaagg

SEQ ID NO: 4131412 - RNA, 17 nt, Yersinia pestis
agguguuucgugccgca

SEQ ID NO: 4131413 - RNA, 20 nt, Yersinia pestis
agguuaaauucacuuucccc

SEQ ID NO: 4131414 - RNA, 15 nt, Yersinia pestis
agguuaacagccccg

SEQ ID NO: 4131415 - RNA, 13 nt, Yersinia pestis
agguuaacugcag

SEQ ID NO: 4131416 - RNA, 14 nt, Yersinia pestis
agguuagaaaacag

SEQ ID NO: 4131417 - RNA, 16 nt, Yersinia pestis
agguuauugacaaaga

SEQ ID NO: 4131418 - RNA, 23 nt, Yersinia pestis
agguuauugacaaagagcccgca

SEQ ID NO: 4131419 - RNA, 22 nt, Yersinia pestis
agguucaauucccgccagguuu

SEQ ID NO: 4131420 - RNA, 18 nt, Yersinia pestis
agguucauuacacagcau

SEQ ID NO: 4131421 - RNA, 18 nt, Yersinia pestis
agguucuccaggguuucu

SEQ ID NO: 4131422 - RNA, 21 nt, Yersinia pestis
agguugcaaauuuccagaugg

SEQ ID NO: 4131423 - RNA, 15 nt, Yersinia pestis
agguugcagcuaaac

SEQ ID NO: 4131424 - RNA, 18 nt, Yersinia pestis
agguugcagcuaaacacg

SEQ ID NO: 4131425 - RNA, 18 nt, Yersinia pestis
agguuggggaugccauuu

SEQ ID NO: 4131426 - RNA, 17 nt, Yersinia pestis
agguuguauuuugcagg

SEQ ID NO: 4131427 - RNA, 16 nt, Yersinia pestis
agguuuaacaaugugg

SEQ ID NO: 4131428 - RNA, 15 nt, Yersinia pestis
agguuucagccucug

SEQ ID NO: 4131429 - RNA, 21 nt, Yersinia pestis
agguuucccguaccagugcca

SEQ ID NO: 4131430 - RNA, 18 nt, Yersinia pestis
agguuuuuucaccaacca

SEQ ID NO: 4131431 - RNA, 21 nt, Yersinia pestis
aguaaaaaaucuauugauugc

SEQ ID NO: 4131432 - RNA, 23 nt, Yersinia pestis
aguaaaaauauuaacugcaguga

SEQ ID NO: 4131433 - RNA, 17 nt, Yersinia pestis
aguaaaacugauauaaa

SEQ ID NO: 4131434 - RNA, 21 nt, Yersinia pestis
aguaaaacugauauaaagcau

SEQ ID NO: 4131435 - RNA, 18 nt, Yersinia pestis
aguaaaagauucauaaaa

SEQ ID NO: 4131436 - RNA, 16 nt, Yersinia pestis
aguaaaaucaucagcc

SEQ ID NO: 4131437 - RNA, 21 nt, Yersinia pestis
aguaaacaccuucagacugac

SEQ ID NO: 4131438 - RNA, 12 nt, Yersinia pestis
aguaaacagcca

SEQ ID NO: 4131439 - RNA, 14 nt, Yersinia pestis
aguaaaccaauuuu

SEQ ID NO: 4131440 - RNA, 17 nt, Yersinia pestis
aguaaacgccaaucacc

SEQ ID NO: 4131441 - RNA, 17 nt, Yersinia pestis
aguaaagcgaucgugag

SEQ ID NO: 4131442 - RNA, 13 nt, Yersinia pestis
aguaaauagcaaa

SEQ ID NO: 4131443 - RNA, 13 nt, Yersinia pestis
aguaaauauaauu

SEQ ID NO: 4131444 - RNA, 15 nt, Yersinia pestis
aguaaaucaggccgg

SEQ ID NO: 4131445 - RNA, 19 nt, Yersinia pestis
aguaaauccugaugaccag

SEQ ID NO: 4131446 - RNA, 17 nt, Yersinia pestis
aguaaauuaaauuuuaa

SEQ ID NO: 4131447 - RNA, 20 nt, Yersinia pestis
aguaacaaaaugcgguggca

SEQ ID NO: 4131448 - RNA, 12 nt, Yersinia pestis
aguaacaaaugg

SEQ ID NO: 4131449 - RNA, 18 nt, Yersinia pestis
aguaacacuucagacuga

SEQ ID NO: 4131450 - RNA, 21 nt, Yersinia pestis
aguaacacuucagacugaaag

SEQ ID NO: 4131451 - RNA, 21 nt, Yersinia pestis
aguaacauuuguauuuuuucu

SEQ ID NO: 4131452 - RNA, 20 nt, Yersinia pestis
aguaaccccuucgagcaccg

SEQ ID NO: 4131453 - RNA, 11 nt, Yersinia pestis
aguaaccgggc

SEQ ID NO: 4131454 - RNA, 21 nt, Yersinia pestis
aguaaccgggcuugauuaaau

SEQ ID NO: 4131455 - RNA, 16 nt, Yersinia pestis
aguaacggaauucaga

SEQ ID NO: 4131456 - RNA, 14 nt, Yersinia pestis
agucugaggagcca

SEQ ID NO: 4131457 - RNA, 15 nt, Yersinia pestis
agucugaggagccau

SEQ ID NO: 4131458 - RNA, 15 nt, Yersinia pestis
agucugaggcccgcu

SEQ ID NO: 4131459 - RNA, 14 nt, Yersinia pestis
agucugagggccac

SEQ ID NO: 4131460 - RNA, 15 nt, Yersinia pestis
agucuguuucauucu

SEQ ID NO: 4131461 - RNA, 20 nt, Yersinia pestis
agucuuccaugacaaaauac

SEQ ID NO: 4131462 - RNA, 20 nt, Yersinia pestis
agucuugguagagaucagag

SEQ ID NO: 4131463 - RNA, 16 nt, Yersinia pestis
agugaaaacguuaacu

SEQ ID NO: 4131464 - RNA, 18 nt, Yersinia pestis
agugaaaacguuaacugc

SEQ ID NO: 4131465 - RNA, 21 nt, Yersinia pestis
agugaaaacguuaacugcagu

SEQ ID NO: 4131466 - RNA, 22 nt, Yersinia pestis
agugaaaacguuaacugcagua

SEQ ID NO: 4131467 - RNA, 16 nt, Yersinia pestis
agugaaaagguuaacu

SEQ ID NO: 4131468 - RNA, 20 nt, Yersinia pestis
agugaaaagguuaacugcag

SEQ ID NO: 4131469 - RNA, 14 nt, Yersinia pestis
agugaaaaugguuu

SEQ ID NO: 4131470 - RNA, 14 nt, Yersinia pestis
agugaaaucaucac

SEQ ID NO: 4131471 - RNA, 18 nt, Yersinia pestis
agugaaccgcgcucugcu

SEQ ID NO: 4131472 - RNA, 12 nt, Yersinia pestis
agugaagacauc

SEQ ID NO: 4131473 - RNA, 17 nt, Yersinia pestis
agugaagacaucgccag

SEQ ID NO: 4131474 - RNA, 17 nt, Yersinia pestis
agugaaguaauaaaaau

SEQ ID NO: 4131475 - RNA, 16 nt, Yersinia pestis
agugaaguaucaccac

SEQ ID NO: 4131476 - RNA, 15 nt, Yersinia pestis
agugaauaaaucaaa

SEQ ID NO: 4131477 - RNA, 14 nt, Yersinia pestis
agugaaucgccguu

SEQ ID NO: 4131478 - RNA, 17 nt, Yersinia pestis
agugaauuauuucagua

SEQ ID NO: 4131479 - RNA, 23 nt, Yersinia pestis
agugacaugcuuaauuauugcag

SEQ ID NO: 4131480 - RNA, 14 nt, Yersinia pestis
agugaccaaagcag

SEQ ID NO: 4131481 - RNA, 14 nt, Yersinia pestis
agugacgcagugac

SEQ ID NO: 4131482 - RNA, 15 nt, Yersinia pestis
agugacgcagugacg

SEQ ID NO: 4131483 - RNA, 20 nt, Yersinia pestis
agugacgcagugacgcagug

SEQ ID NO: 4131484 - RNA, 14 nt, Yersinia pestis
agugacgcagugau

SEQ ID NO: 4131485 - RNA, 20 nt, Yersinia pestis
agugacuaauuguuugcuuu

SEQ ID NO: 4131486 - RNA, 16 nt, Yersinia pestis
agugacucugcccuuu

SEQ ID NO: 4131487 - RNA, 22 nt, Yersinia pestis
agugagaaggguauugaagaua

SEQ ID NO: 4131488 - RNA, 17 nt, Yersinia pestis
agugagaagugaaaaac

SEQ ID NO: 4131489 - RNA, 15 nt, Yersinia pestis
agugagacaauuaac

SEQ ID NO: 4131490 - RNA, 13 nt, Yersinia pestis
agugaguaucuuc

SEQ ID NO: 4131491 - RNA, 19 nt, Yersinia pestis
agugagugaauagauaaca

SEQ ID NO: 4131492 - RNA, 19 nt, Yersinia pestis
agugauaaacuuaucgguu

SEQ ID NO: 4131493 - RNA, 15 nt, Yersinia pestis
agugauaaggccuuu

SEQ ID NO: 4131494 - RNA, 14 nt, Yersinia pestis
agugauaaucacgu

SEQ ID NO: 4131495 - RNA, 15 nt, Yersinia pestis
agugauauaacccag

SEQ ID NO: 4131496 - RNA, 15 nt, Yersinia pestis
agugaucaaugacuu

SEQ ID NO: 4131497 - RNA, 18 nt, Yersinia pestis
agugaucaaugacuucuu

SEQ ID NO: 4131498 - RNA, 17 nt, Yersinia pestis
agugauccacauuaccg

SEQ ID NO: 4131499 - RNA, 16 nt, Yersinia pestis
agugaucgcacuucaa

SEQ ID NO: 4131500 - RNA, 20 nt, Yersinia pestis
agugaugaaaccaaaaccuu

SEQ ID NO: 4131501 - RNA, 15 nt, Yersinia pestis
agugaugacuagcga

SEQ ID NO: 4131502 - RNA, 15 nt, Yersinia pestis
agugaugggggcaau

SEQ ID NO: 4131503 - RNA, 20 nt, Yersinia pestis
agugaugggggcaauugauu

SEQ ID NO: 4131504 - RNA, 21 nt, Yersinia pestis
agugauuauagcggcaaggau

SEQ ID NO: 4131505 - RNA, 18 nt, Yersinia pestis
agugauucgggugaguga

SEQ ID NO: 4131506 - RNA, 22 nt, Yersinia pestis
agugauuucagugucaguucga

SEQ ID NO: 4131507 - RNA, 14 nt, Yersinia pestis
agugauuuuaacca

SEQ ID NO: 4131508 - RNA, 17 nt, Yersinia pestis
agugcaaacuuaaaaau

SEQ ID NO: 4131509 - RNA, 17 nt, Yersinia pestis
agugcaacauuaaaaau

SEQ ID NO: 4131510 - RNA, 19 nt, Yersinia pestis
agugcaaccaacaccaaug

SEQ ID NO: 4131511 - RNA, 21 nt, Yersinia pestis
agugcaauuauuuagccugcc

SEQ ID NO: 4131512 - RNA, 18 nt, Yersinia pestis
agugcagaucugcccccc

SEQ ID NO: 4131513 - RNA, 18 nt, Yersinia pestis
agugcagcaaaagguauc

SEQ ID NO: 4131514 - RNA, 14 nt, Yersinia pestis
agugcagccaagau

SEQ ID NO: 4131515 - RNA, 22 nt, Yersinia pestis
agugcauccagcguaaacagua

SEQ ID NO: 4131516 - RNA, 16 nt, Yersinia pestis
agugcauccccacuga

SEQ ID NO: 4131517 - RNA, 15 nt, Yersinia pestis
agugcaugcagguca

SEQ ID NO: 4131518 - RNA, 17 nt, Yersinia pestis
agugcauuaucuuuaau

SEQ ID NO: 4131519 - RNA, 22 nt, Yersinia pestis
agugcauuaucuuuaauuuuuc

SEQ ID NO: 4131520 - RNA, 20 nt, Yersinia pestis
agugcauugcagaaagcuga

SEQ ID NO: 4131521 - RNA, 13 nt, Yersinia pestis
agugccaacagcg

SEQ ID NO: 4131522 - RNA, 22 nt, Yersinia pestis
agugccaucgccaacaggccua

SEQ ID NO: 4131523 - RNA, 22 nt, Yersinia pestis
agugccgcggcggccagcggca

SEQ ID NO: 4131524 - RNA, 20 nt, Yersinia pestis
agugccgucaauuaucaaaa

SEQ ID NO: 4131525 - RNA, 22 nt, Yersinia pestis
agugccgucaauuaucaaaaaa

SEQ ID NO: 4131526 - RNA, 21 nt, Yersinia pestis
agugccugcaacggagagaac

SEQ ID NO: 4131527 - RNA, 17 nt, Yersinia pestis
agugcgacgauaaaggc

SEQ ID NO: 4131528 - RNA, 18 nt, Yersinia pestis
agugcggcauguacaccg

SEQ ID NO: 4131529 - RNA, 12 nt, Yersinia pestis
agugcggccacc

SEQ ID NO: 4131530 - RNA, 23 nt, Yersinia pestis
agugcggccaccuaucuauuuuu

SEQ ID NO: 4131531 - RNA, 19 nt, Yersinia pestis
agugcggccaucuaacugc

SEQ ID NO: 4131532 - RNA, 13 nt, Yersinia pestis
agugcgguaacca

SEQ ID NO: 4131533 - RNA, 22 nt, Yersinia pestis
agugcgguaaccagcaucagua

SEQ ID NO: 4131534 - RNA, 15 nt, Yersinia pestis
agugcguacgccaac

SEQ ID NO: 4131535 - RNA, 15 nt, Yersinia pestis
agugcguuuuauuca

SEQ ID NO: 4131536 - RNA, 17 nt, Yersinia pestis
agugcguuuuauucaag

SEQ ID NO: 4131537 - RNA, 15 nt, Yersinia pestis
agugcuauccucuua

SEQ ID NO: 4131538 - RNA, 15 nt, Yersinia pestis
agugcuauucauaaa

SEQ ID NO: 4131539 - RNA, 18 nt, Yersinia pestis
agugcuauucauaaguca

SEQ ID NO: 4131540 - RNA, 16 nt, Yersinia pestis
agugcucccugaacgc

SEQ ID NO: 4131541 - RNA, 13 nt, Yersinia pestis
agugcugaucacc

SEQ ID NO: 4131542 - RNA, 13 nt, Yersinia pestis
agugcugccagac

SEQ ID NO: 4131543 - RNA, 21 nt, Yersinia pestis
agugcugccgcaacggcaccu

SEQ ID NO: 4131544 - RNA, 22 nt, Yersinia pestis
agugcugccgcaacggcaccuc

SEQ ID NO: 4131545 - RNA, 22 nt, Yersinia pestis
agugcugguugagauuaucagc

SEQ ID NO: 4131546 - RNA, 16 nt, Yersinia pestis
agugcuuaacccacca

SEQ ID NO: 4131547 - RNA, 15 nt, Yersinia pestis
aguggaaaaacugaa

SEQ ID NO: 4131548 - RNA, 16 nt, Yersinia pestis
aguggacgaacagcuc

SEQ ID NO: 4131549 - RNA, 19 nt, Yersinia pestis
aguggacgauaaauucaaa

SEQ ID NO: 4131550 - RNA, 15 nt, Yersinia pestis
aguggcacaaauaaa

SEQ ID NO: 4131551 - RNA, 16 nt, Yersinia pestis
aguggcacaaauaaaa

SEQ ID NO: 4131552 - RNA, 15 nt, Yersinia pestis
aguggcaucaauaua

SEQ ID NO: 4131553 - RNA, 16 nt, Yersinia pestis
aguggcggccagugau

SEQ ID NO: 4131554 - RNA, 16 nt, Yersinia pestis
aguggcuuaauugaag

SEQ ID NO: 4131555 - RNA, 22 nt, Yersinia pestis
aguggcuucucuuccuguucau

SEQ ID NO: 4131556 - RNA, 19 nt, Yersinia pestis
agugggcagggcgcaaugg

SEQ ID NO: 4131557 - RNA, 13 nt, Yersinia pestis
aguggguaaaccu

SEQ ID NO: 4131558 - RNA, 20 nt, Yersinia pestis
agugguagauguauuaguuu

SEQ ID NO: 4131559 - RNA, 14 nt, Yersinia pestis
aguguaaaaagcag

SEQ ID NO: 4131560 - RNA, 12 nt, Yersinia pestis
aguguaaaaccu

SEQ ID NO: 4131561 - RNA, 20 nt, Yersinia pestis
aguguaaaaccugacuguuu

SEQ ID NO: 4131562 - RNA, 17 nt, Yersinia pestis
aguguacuguuaacuca

SEQ ID NO: 4131563 - RNA, 18 nt, Yersinia pestis
aguguaugaguaucaaua

SEQ ID NO: 4131564 - RNA, 20 nt, Yersinia pestis
aguguaugaguaucaauauu

SEQ ID NO: 4131565 - RNA, 21 nt, Yersinia pestis
aguguauucgcaucuuccaaa

SEQ ID NO: 4131566 - RNA, 20 nt, Yersinia pestis
agugucagggcaauaacaaa

SEQ ID NO: 4131567 - RNA, 16 nt, Yersinia pestis
agugucaugcgcagaa

SEQ ID NO: 4131568 - RNA, 23 nt, Yersinia pestis
agugucgaaagacgcaaacgggu

SEQ ID NO: 4131569 - RNA, 23 nt, Yersinia pestis
agugucgauuuaauggguaaacc

SEQ ID NO: 4131570 - RNA, 13 nt, Yersinia pestis
agugugaugaugg

SEQ ID NO: 4131571 - RNA, 20 nt, Yersinia pestis
agugugccuuggucucagaa

SEQ ID NO: 4131572 - RNA, 22 nt, Yersinia pestis
agugugccuuggucucagaaca

SEQ ID NO: 4131573 - RNA, 23 nt, Yersinia pestis
agugugccuuggucucagaacaa

SEQ ID NO: 4131574 - RNA, 16 nt, Yersinia pestis
aguguguguauuuaaa

SEQ ID NO: 4131575 - RNA, 21 nt, Yersinia pestis
aguguguuauuuuucucuuuc

SEQ ID NO: 4131576 - RNA, 17 nt, Yersinia pestis
aguguuaccaagagaga

SEQ ID NO: 4131577 - RNA, 20 nt, Yersinia pestis
aguguuaguuuuaauaacuu

SEQ ID NO: 4131578 - RNA, 21 nt, Yersinia pestis
auaaaaguaauuuaucaguag

SEQ ID NO: 4131579 - RNA, 20 nt, Yersinia pestis
auaaaaguacaacuacgaug

SEQ ID NO: 4131580 - RNA, 16 nt, Yersinia pestis
auaaaauaauaauggu

SEQ ID NO: 4131581 - RNA, 12 nt, Yersinia pestis
auaaaauauuau

SEQ ID NO: 4131582 - RNA, 13 nt, Yersinia pestis
auaaaauccacua

SEQ ID NO: 4131583 - RNA, 16 nt, Yersinia pestis
auaaaauccugaauaa

SEQ ID NO: 4131584 - RNA, 20 nt, Yersinia pestis
auaaaauccugaauaauacu

SEQ ID NO: 4131585 - RNA, 21 nt, Yersinia pestis
auaaaaucgaacccuucagca

SEQ ID NO: 4131586 - RNA, 22 nt, Yersinia pestis
auaaaaucgaacccuucagcau

SEQ ID NO: 4131587 - RNA, 19 nt, Yersinia pestis
auaaaaugggccugagugg

SEQ ID NO: 4131588 - RNA, 15 nt, Yersinia pestis
auaaaauuacccagc

SEQ ID NO: 4131589 - RNA, 14 nt, Yersinia pestis
auaaaauucagcca

SEQ ID NO: 4131590 - RNA, 22 nt, Yersinia pestis
auaaaauucguuucucuaaaau

SEQ ID NO: 4131591 - RNA, 17 nt, Yersinia pestis
auaaacaaaauagggcg

SEQ ID NO: 4131592 - RNA, 21 nt, Yersinia pestis
auaaacaaucugaugaauuaa

SEQ ID NO: 4131593 - RNA, 18 nt, Yersinia pestis
auaaacacgcaaucagau

SEQ ID NO: 4131594 - RNA, 15 nt, Yersinia pestis
auaaacagacuaaaa

SEQ ID NO: 4131595 - RNA, 11 nt, Yersinia pestis
auaaaccaaau

SEQ ID NO: 4131596 - RNA, 16 nt, Yersinia pestis
auaaaccaaaugguua

SEQ ID NO: 4131597 - RNA, 18 nt, Yersinia pestis
auaaaccagcaagccgug

SEQ ID NO: 4131598 - RNA, 18 nt, Yersinia pestis
auaaaccgugauugguuu

SEQ ID NO: 4131599 - RNA, 20 nt, Yersinia pestis
auaaaccuacagccaucggu

SEQ ID NO: 4131600 - RNA, 21 nt, Yersinia pestis
auaaacgaccauuucucugau

SEQ ID NO: 4131601 - RNA, 20 nt, Yersinia pestis
auaaacgccagucagcuagc

SEQ ID NO: 4131602 - RNA, 15 nt, Yersinia pestis
auaaacgccuccgau

SEQ ID NO: 4131603 - RNA, 18 nt, Yersinia pestis
auaaacgcgaguuaggaa

SEQ ID NO: 4131604 - RNA, 19 nt, Yersinia pestis
auaaacgcuuuugcugcaa

SEQ ID NO: 4131605 - RNA, 20 nt, Yersinia pestis
auaaacggaacucaucuuuc

SEQ ID NO: 4131606 - RNA, 15 nt, Yersinia pestis
auaaacgggcuucca

SEQ ID NO: 4131607 - RNA, 23 nt, Yersinia pestis
auaaacgggugcaguaacauaau

SEQ ID NO: 4131608 - RNA, 12 nt, Yersinia pestis
auaaacucauac

SEQ ID NO: 4131609 - RNA, 21 nt, Yersinia pestis
auaaacuccguaaucuguucg

SEQ ID NO: 4131610 - RNA, 18 nt, Yersinia pestis
auaaacugaaguuaaaaa

SEQ ID NO: 4131611 - RNA, 20 nt, Yersinia pestis
auaaacugaaguuaaaaagc

SEQ ID NO: 4131612 - RNA, 19 nt, Yersinia pestis
auaaacugacucacgucag

SEQ ID NO: 4131613 - RNA, 17 nt, Yersinia pestis
auaaacugugcccuuga

SEQ ID NO: 4131614 - RNA, 16 nt, Yersinia pestis
auaaacuucacaaugc

SEQ ID NO: 4131615 - RNA, 19 nt, Yersinia pestis
auaaacuucacaaugcaca

SEQ ID NO: 4131616 - RNA, 13 nt, Yersinia pestis
auaaacuucgaua

SEQ ID NO: 4131617 - RNA, 18 nt, Yersinia pestis
auaaagacgucauaaaua

SEQ ID NO: 4131618 - RNA, 22 nt, Yersinia pestis
auaaagacgucauaaauauuuu

SEQ ID NO: 4131619 - RNA, 13 nt, Yersinia pestis
auaaagagugaaa

SEQ ID NO: 4131620 - RNA, 14 nt, Yersinia pestis
auaaagcaucagac

SEQ ID NO: 4131621 - RNA, 15 nt, Yersinia pestis
auaaagcaucagacu

SEQ ID NO: 4131622 - RNA, 22 nt, Yersinia pestis
auaaagccgagcaagugaauaa

SEQ ID NO: 4131623 - RNA, 16 nt, Yersinia pestis
auaaagccguuaucaa

SEQ ID NO: 4131624 - RNA, 24 nt, Yersinia pestis
auaaagcggaucucuucagcaauu

SEQ ID NO: 4131625 - RNA, 20 nt, Yersinia pestis
auaaagcgguaaauggcgaa

SEQ ID NO: 4131626 - RNA, 16 nt, Yersinia pestis
auaaaggcaaaagcau

SEQ ID NO: 4131627 - RNA, 17 nt, Yersinia pestis
auaaaggcaaaagcauc

SEQ ID NO: 4131628 - RNA, 16 nt, Yersinia pestis
auaaaggcgagucagc

SEQ ID NO: 4131629 - RNA, 20 nt, Yersinia pestis
auaaaguaaaagccagucag

SEQ ID NO: 4131630 - RNA, 12 nt, Yersinia pestis
auaaauaaaaua

SEQ ID NO: 4131631 - RNA, 16 nt, Yersinia pestis
auaaauaaaauaauaa

SEQ ID NO: 4131632 - RNA, 14 nt, Yersinia pestis
auaaauaaauuuaa

SEQ ID NO: 4131633 - RNA, 19 nt, Yersinia pestis
auaaauaauuuguaaauuu

SEQ ID NO: 4131634 - RNA, 14 nt, Yersinia pestis
auaaauaccaauuu

SEQ ID NO: 4131635 - RNA, 14 nt, Yersinia pestis
auaaauaccgccaa

SEQ ID NO: 4131636 - RNA, 23 nt, Yersinia pestis
auaaauagagugaaguaucacca

SEQ ID NO: 4131637 - RNA, 18 nt, Yersinia pestis
auaaauaggccgccaaau

SEQ ID NO: 4131638 - RNA, 20 nt, Yersinia pestis
auaaauauccucggccagug

SEQ ID NO: 4131639 - RNA, 18 nt, Yersinia pestis
auaaauauucauuaaaaa

SEQ ID NO: 4131640 - RNA, 23 nt, Yersinia pestis
auaaauauuuuaugcccccuauu

SEQ ID NO: 4131641 - RNA, 15 nt, Yersinia pestis
auaaauccaucaaua

SEQ ID NO: 4131642 - RNA, 19 nt, Yersinia pestis
auaaaucccgagacacuca

SEQ ID NO: 4131643 - RNA, 15 nt, Yersinia pestis
auaaauccugaacau

SEQ ID NO: 4131644 - RNA, 15 nt, Yersinia pestis
auaaaucgcauuuuu

SEQ ID NO: 4131645 - RNA, 18 nt, Yersinia pestis
auaaaucgcauuuuuaag

SEQ ID NO: 4131646 - RNA, 19 nt, Yersinia pestis
auaaaucgcccaacccccc

SEQ ID NO: 4131647 - RNA, 15 nt, Yersinia pestis
auaaaucggcggcca

SEQ ID NO: 4131648 - RNA, 16 nt, Yersinia pestis
auaaaucuuauuuaau

SEQ ID NO: 4131649 - RNA, 22 nt, Yersinia pestis
auaaaugaccaacuguaaaauc

SEQ ID NO: 4131650 - RNA, 21 nt, Yersinia pestis
auaaaugacuaucccuucaau

SEQ ID NO: 4131651 - RNA, 20 nt, Yersinia pestis
auaaaugagauugaugggau

SEQ ID NO: 4131652 - RNA, 17 nt, Yersinia pestis
auaaauggcaacuuaaa

SEQ ID NO: 4131653 - RNA, 17 nt, Yersinia pestis
auaaauggucaguuuaa

SEQ ID NO: 4131654 - RNA, 18 nt, Yersinia pestis
auaaauggucaguuuaau

SEQ ID NO: 4131655 - RNA, 21 nt, Yersinia pestis
auaaaugucgcuaauaggccu

SEQ ID NO: 4131656 - RNA, 14 nt, Yersinia pestis
auaaauuaaaaaga

SEQ ID NO: 4131657 - RNA, 15 nt, Yersinia pestis
auaaauuaaaacuga

SEQ ID NO: 4131658 - RNA, 19 nt, Yersinia pestis
auaaauuaaaacugaaaag

SEQ ID NO: 4131659 - RNA, 22 nt, Yersinia pestis
auaaauuacucguauaaaaaau

SEQ ID NO: 4131660 - RNA, 14 nt, Yersinia pestis
auaaauuaucugaa

SEQ ID NO: 4131661 - RNA, 22 nt, Yersinia pestis
auaaauucaaaauagaggaaau

SEQ ID NO: 4131662 - RNA, 23 nt, Yersinia pestis
auaaauucaaauaucauuauuuu

SEQ ID NO: 4131663 - RNA, 12 nt, Yersinia pestis
auaaauuccugg

SEQ ID NO: 4131664 - RNA, 19 nt, Yersinia pestis
auaaauuccuggcggcaac

SEQ ID NO: 4131665 - RNA, 21 nt, Yersinia pestis
auaaauucuugcgcuucauca

SEQ ID NO: 4131666 - RNA, 22 nt, Yersinia pestis
auaaauugcuuugucaucaacc

SEQ ID NO: 4131667 - RNA, 21 nt, Yersinia pestis
auaaauuggccgauagauuuu

SEQ ID NO: 4131668 - RNA, 15 nt, Yersinia pestis
auaaauuuaauaaaa

SEQ ID NO: 4131669 - RNA, 16 nt, Yersinia pestis
auaaauuuaauaaaaa

SEQ ID NO: 4131670 - RNA, 17 nt, Yersinia pestis
auaaauuuaauaaaaac

SEQ ID NO: 4131671 - RNA, 13 nt, Yersinia pestis
auaaauuuauuuu

SEQ ID NO: 4131672 - RNA, 15 nt, Yersinia pestis
auaaauuuauuuuuu

SEQ ID NO: 4131673 - RNA, 19 nt, Yersinia pestis
auaacaaacacauccagga

SEQ ID NO: 4131674 - RNA, 15 nt, Yersinia pestis
auaacaauaaaaucu

SEQ ID NO: 4131675 - RNA, 12 nt, Yersinia pestis
auaacaauggcc

SEQ ID NO: 4131676 - RNA, 18 nt, Yersinia pestis
auaacaccaauugcaggc

SEQ ID NO: 4131677 - RNA, 23 nt, Yersinia pestis
auaacacccauuugcccgaauca

SEQ ID NO: 4131678 - RNA, 17 nt, Yersinia pestis
auaacacggcuuuuauc

SEQ ID NO: 4131679 - RNA, 12 nt, Yersinia pestis
auaacagauauu

SEQ ID NO: 4131680 - RNA, 20 nt, Yersinia pestis
auaacagauauuacgcagcc

SEQ ID NO: 4131681 - RNA, 21 nt, Yersinia pestis
auaacagauauuacgcagcca

SEQ ID NO: 4131682 - RNA, 12 nt, Yersinia pestis
auaacagcuaaa

SEQ ID NO: 4131683 - RNA, 12 nt, Yersinia pestis
auaacagcuaau

SEQ ID NO: 4131684 - RNA, 18 nt, Yersinia pestis
auaacauaauaaauuaau

SEQ ID NO: 4131685 - RNA, 15 nt, Yersinia pestis
auaacauccuaaaaa

SEQ ID NO: 4131686 - RNA, 13 nt, Yersinia pestis
auaacauuuuuuc

SEQ ID NO: 4131687 - RNA, 16 nt, Yersinia pestis
auaacauuuuuucuuu

SEQ ID NO: 4131688 - RNA, 15 nt, Yersinia pestis
auaaccaaaagcccc

SEQ ID NO: 4131689 - RNA, 18 nt, Yersinia pestis
auaaccaaucaucacgau

SEQ ID NO: 4131690 - RNA, 13 nt, Yersinia pestis
auaaccagccaac

SEQ ID NO: 4131691 - RNA, 23 nt, Yersinia pestis
auaaccagccaaccaucaucaau

SEQ ID NO: 4131692 - RNA, 22 nt, Yersinia pestis
auaaccaugauguuaggcguuu

SEQ ID NO: 4131693 - RNA, 14 nt, Yersinia pestis
auaacccaguugcg

SEQ ID NO: 4131694 - RNA, 23 nt, Yersinia pestis
auaacccgccuagcaucauaaau

SEQ ID NO: 4131695 - RNA, 22 nt, Yersinia pestis
auaaccgcagcaggcagagcaa

SEQ ID NO: 4131696 - RNA, 15 nt, Yersinia pestis
auaaccgccggauaa

SEQ ID NO: 4131697 - RNA, 19 nt, Yersinia pestis
auaaccgcgaagaggguuu

SEQ ID NO: 4131698 - RNA, 20 nt, Yersinia pestis
auaaccgcuaaggccaaugg

SEQ ID NO: 4131699 - RNA, 13 nt, Yersinia pestis
auaauucagauaa

SEQ ID NO: 4131700 - RNA, 12 nt, Yersinia pestis
auaauucagcau

SEQ ID NO: 4131701 - RNA, 21 nt, Yersinia pestis
auaauucagcaucaaauuauu

SEQ ID NO: 4131702 - RNA, 15 nt, Yersinia pestis
auaauucauaugaca

SEQ ID NO: 4131703 - RNA, 20 nt, Yersinia pestis
auaauucaugcuaauaccac

SEQ ID NO: 4131704 - RNA, 12 nt, Yersinia pestis
auaauucauuuu

SEQ ID NO: 4131705 - RNA, 21 nt, Yersinia pestis
auaauucauuuuuugggauga

SEQ ID NO: 4131706 - RNA, 14 nt, Yersinia pestis
auaauuccacauaa

SEQ ID NO: 4131707 - RNA, 15 nt, Yersinia pestis
auaauuccaugaaaa

SEQ ID NO: 4131708 - RNA, 22 nt, Yersinia pestis
auaauucccccgguuaaugcca

SEQ ID NO: 4131709 - RNA, 22 nt, Yersinia pestis
auaauucgcaugguuaaaacuc

SEQ ID NO: 4131710 - RNA, 15 nt, Yersinia pestis
auaauucgugaaaac

SEQ ID NO: 4131711 - RNA, 18 nt, Yersinia pestis
auaauucugccgacuaau

SEQ ID NO: 4131712 - RNA, 13 nt, Yersinia pestis
auaauucugcuau

SEQ ID NO: 4131713 - RNA, 21 nt, Yersinia pestis
auaauucugcuauuaauuauu

SEQ ID NO: 4131714 - RNA, 11 nt, Yersinia pestis
auaauugaaga

SEQ ID NO: 4131715 - RNA, 22 nt, Yersinia pestis
auaauugaguggcgaucuuaau

SEQ ID NO: 4131716 - RNA, 17 nt, Yersinia pestis
auaauuggcaauaaugu

SEQ ID NO: 4131717 - RNA, 19 nt, Yersinia pestis
auaauuucaaaguaaaaua

SEQ ID NO: 4131718 - RNA, 13 nt, Yersinia pestis
auaauuucagcag

SEQ ID NO: 4131719 - RNA, 16 nt, Yersinia pestis
auaauuucagcagcac

SEQ ID NO: 4131720 - RNA, 18 nt, Yersinia pestis
auaauuucagcagcacgu

SEQ ID NO: 4131721 - RNA, 21 nt, Yersinia pestis
auaauuucuacgccgucauca

SEQ ID NO: 4131722 - RNA, 22 nt, Yersinia pestis
auaauuuguauucucaucauca

SEQ ID NO: 4131723 - RNA, 17 nt, Yersinia pestis
auaauuugucaguaaug

SEQ ID NO: 4131724 - RNA, 21 nt, Yersinia pestis
auaauuuuuacgauaucacca

SEQ ID NO: 4131725 - RNA, 20 nt, Yersinia pestis
auaauuuuucuuccaccauc

SEQ ID NO: 4131726 - RNA, 21 nt, Yersinia pestis
auacaaauaguaauaauuaau

SEQ ID NO: 4131727 - RNA, 21 nt, Yersinia pestis
auacaaauauuacgaaugagu

SEQ ID NO: 4131728 - RNA, 16 nt, Yersinia pestis
auacaaccaacaaaca

SEQ ID NO: 4131729 - RNA, 21 nt, Yersinia pestis
auacaacguuuaguaaucaau

SEQ ID NO: 4131730 - RNA, 18 nt, Yersinia pestis
auacaaggcacaucucca

SEQ ID NO: 4131731 - RNA, 18 nt, Yersinia pestis
auacaauccaaccuauau

SEQ ID NO: 4131732 - RNA, 11 nt, Yersinia pestis
auacaauuuuu

SEQ ID NO: 4131733 - RNA, 17 nt, Yersinia pestis
auacacaagucauugga

SEQ ID NO: 4131734 - RNA, 17 nt, Yersinia pestis
auacacaugaaaaucaa

SEQ ID NO: 4131735 - RNA, 14 nt, Yersinia pestis
auacaccgcaccac

SEQ ID NO: 4131736 - RNA, 15 nt, Yersinia pestis
auacaccgccaguau

SEQ ID NO: 4131737 - RNA, 19 nt, Yersinia pestis
auacaccucaacgugauau

SEQ ID NO: 4131738 - RNA, 18 nt, Yersinia pestis
auacaccuucgagagcua

SEQ ID NO: 4131739 - RNA, 17 nt, Yersinia pestis
auacacuaagugcauca

SEQ ID NO: 4131740 - RNA, 17 nt, Yersinia pestis
auacacuggcagugcca

SEQ ID NO: 4131741 - RNA, 18 nt, Yersinia pestis
auacacuugcucuaccac

SEQ ID NO: 4131742 - RNA, 21 nt, Yersinia pestis
auacaggcguugggguggcag

SEQ ID NO: 4131743 - RNA, 19 nt, Yersinia pestis
auacaggcuauauugcuga

SEQ ID NO: 4131744 - RNA, 17 nt, Yersinia pestis
auacaggguaaauuauu

SEQ ID NO: 4131745 - RNA, 13 nt, Yersinia pestis
auacaggugucau

SEQ ID NO: 4131746 - RNA, 21 nt, Yersinia pestis
auacaggugucaucaaggcaa

SEQ ID NO: 4131747 - RNA, 23 nt, Yersinia pestis
auacaguggcgagcgcaggguca

SEQ ID NO: 4131748 - RNA, 17 nt, Yersinia pestis
auacauagaagcucaua

SEQ ID NO: 4131749 - RNA, 18 nt, Yersinia pestis
auacauauaaccaucaaa

SEQ ID NO: 4131750 - RNA, 16 nt, Yersinia pestis
auacauccuaaauaau

SEQ ID NO: 4131751 - RNA, 20 nt, Yersinia pestis
auacaucgcuggacgcauca

SEQ ID NO: 4131752 - RNA, 20 nt, Yersinia pestis
auacaugccucugcuaacaa

SEQ ID NO: 4131753 - RNA, 17 nt, Yersinia pestis
auacauggcgaucacca

SEQ ID NO: 4131754 - RNA, 13 nt, Yersinia pestis
auacauuauuauu

SEQ ID NO: 4131755 - RNA, 19 nt, Yersinia pestis
auacauuauuauuuacaaa

SEQ ID NO: 4131756 - RNA, 12 nt, Yersinia pestis
auacauuuccau

SEQ ID NO: 4131757 - RNA, 13 nt, Yersinia pestis
auaccaacagcag

SEQ ID NO: 4131758 - RNA, 19 nt, Yersinia pestis
auaccaacucugaaguaaa

SEQ ID NO: 4131759 - RNA, 16 nt, Yersinia pestis
auaccacaauccggug

SEQ ID NO: 4131760 - RNA, 16 nt, Yersinia pestis
auaccaccaccaaccc

SEQ ID NO: 4131761 - RNA, 14 nt, Yersinia pestis
auaccaccaccaca

SEQ ID NO: 4131762 - RNA, 21 nt, Yersinia pestis
auaccacccguugcauuuuuc

SEQ ID NO: 4131763 - RNA, 12 nt, Yersinia pestis
auaccagagacg

SEQ ID NO: 4131764 - RNA, 22 nt, Yersinia pestis
auaccagagacgugcguuuuug

SEQ ID NO: 4131765 - RNA, 15 nt, Yersinia pestis
auaccauaacgcugc

SEQ ID NO: 4131766 - RNA, 20 nt, Yersinia pestis
auaccaugccaucaauguuc

SEQ ID NO: 4131767 - RNA, 13 nt, Yersinia pestis
auaccauuuugcc

SEQ ID NO: 4131768 - RNA, 14 nt, Yersinia pestis
auacccaaaccaac

SEQ ID NO: 4131769 - RNA, 20 nt, Yersinia pestis
auacccagcuucuuuuaaag

SEQ ID NO: 4131770 - RNA, 19 nt, Yersinia pestis
auacccuaucgacuucacg

SEQ ID NO: 4131771 - RNA, 23 nt, Yersinia pestis
auaccgccaagcgccgugcauaa

SEQ ID NO: 4131772 - RNA, 18 nt, Yersinia pestis
auaccgccacacaauaca

SEQ ID NO: 4131773 - RNA, 16 nt, Yersinia pestis
auaccgcugcuaccag

SEQ ID NO: 4131774 - RNA, 20 nt, Yersinia pestis
auaccgcugcuaccagcagu

SEQ ID NO: 4131775 - RNA, 14 nt, Yersinia pestis
auaccguuuuguac

SEQ ID NO: 4131776 - RNA, 13 nt, Yersinia pestis
auaccuacccuuu

SEQ ID NO: 4131777 - RNA, 13 nt, Yersinia pestis
auaccucaagcug

SEQ ID NO: 4131778 - RNA, 18 nt, Yersinia pestis
auaccugauguuuugcug

SEQ ID NO: 4131779 - RNA, 18 nt, Yersinia pestis
auaccuggcgggucuccc

SEQ ID NO: 4131780 - RNA, 18 nt, Yersinia pestis
auaccuuaauuaacucuu

SEQ ID NO: 4131781 - RNA, 12 nt, Yersinia pestis
auaccuuacugu

SEQ ID NO: 4131782 - RNA, 14 nt, Yersinia pestis
auaccuuuguaucc

SEQ ID NO: 4131783 - RNA, 14 nt, Yersinia pestis
auacgaauuuuucc

SEQ ID NO: 4131784 - RNA, 22 nt, Yersinia pestis
auacgccaguuaggcaagaaca

SEQ ID NO: 4131785 - RNA, 17 nt, Yersinia pestis
auacgcuuccugcgcca

SEQ ID NO: 4131786 - RNA, 16 nt, Yersinia pestis
auacggcgaaauauaa

SEQ ID NO: 4131787 - RNA, 15 nt, Yersinia pestis
auacgguagcaauac

SEQ ID NO: 4131788 - RNA, 14 nt, Yersinia pestis
auacggucaaaagc

SEQ ID NO: 4131789 - RNA, 16 nt, Yersinia pestis
auacgucuccauuuca

SEQ ID NO: 4131790 - RNA, 15 nt, Yersinia pestis
auacguuggcggcuc

SEQ ID NO: 4131791 - RNA, 12 nt, Yersinia pestis
auacuaaaacag

SEQ ID NO: 4131792 - RNA, 15 nt, Yersinia pestis
auacuaaagaaauaa

SEQ ID NO: 4131793 - RNA, 17 nt, Yersinia pestis
auacuaacgaaucccac

SEQ ID NO: 4131794 - RNA, 21 nt, Yersinia pestis
auacuaauagaagagaggcaa

SEQ ID NO: 4131795 - RNA, 19 nt, Yersinia pestis
auacuauuccgucgauauc

SEQ ID NO: 4131796 - RNA, 18 nt, Yersinia pestis
auacucauccagauuauu

SEQ ID NO: 4131797 - RNA, 15 nt, Yersinia pestis
auacucauugcaccu

SEQ ID NO: 4131798 - RNA, 18 nt, Yersinia pestis
auacucuguuaccaaugg

SEQ ID NO: 4131799 - RNA, 21 nt, Yersinia pestis
auacugaaauauacacaaguc

SEQ ID NO: 4131800 - RNA, 17 nt, Yersinia pestis
auacugccaaucgcucu

SEQ ID NO: 4131801 - RNA, 18 nt, Yersinia pestis
auacugccgaccauaucu

SEQ ID NO: 4131802 - RNA, 19 nt, Yersinia pestis
auacuggcauacagcucau

SEQ ID NO: 4131803 - RNA, 21 nt, Yersinia pestis
auacuggguuuaaagguggcu

SEQ ID NO: 4131804 - RNA, 20 nt, Yersinia pestis
auacuguuaacucgccaaca

SEQ ID NO: 4131805 - RNA, 15 nt, Yersinia pestis
auacuuaacaaucag

SEQ ID NO: 4131806 - RNA, 18 nt, Yersinia pestis
auacuuaagucaaauuua

SEQ ID NO: 4131807 - RNA, 20 nt, Yersinia pestis
auacuuaagucaaauuuaaa

SEQ ID NO: 4131808 - RNA, 16 nt, Yersinia pestis
auacuucaaacugcgu

SEQ ID NO: 4131809 - RNA, 13 nt, Yersinia pestis
auacuuccuucaa

SEQ ID NO: 4131810 - RNA, 21 nt, Yersinia pestis
auacuugaaacagcaggggcg

SEQ ID NO: 4131811 - RNA, 20 nt, Yersinia pestis
auacuuuuagccagcaacau

SEQ ID NO: 4131812 - RNA, 15 nt, Yersinia pestis
auagaagcucauaug

SEQ ID NO: 4131813 - RNA, 18 nt, Yersinia pestis
auagaaggcggagaaugu

SEQ ID NO: 4131814 - RNA, 20 nt, Yersinia pestis
auagaagguaaucagacugc

SEQ ID NO: 4131815 - RNA, 15 nt, Yersinia pestis
auagaaucugcugca

SEQ ID NO: 4131816 - RNA, 16 nt, Yersinia pestis
auagaaucugcugcaa

SEQ ID NO: 4131817 - RNA, 14 nt, Yersinia pestis
auagaccccuucuu

SEQ ID NO: 4131818 - RNA, 14 nt, Yersinia pestis
auagaccguagaaa

SEQ ID NO: 4131819 - RNA, 15 nt, Yersinia pestis
auagacgaaggcacg

SEQ ID NO: 4131820 - RNA, 16 nt, Yersinia pestis
auagacuguuuuauua

SEQ ID NO: 4131821 - RNA, 15 nt, Yersinia pestis
auauaauucaauaua

SEQ ID NO: 4131822 - RNA, 16 nt, Yersinia pestis
auauaauugaagauuu

SEQ ID NO: 4131823 - RNA, 14 nt, Yersinia pestis
auauacaaggcaca

SEQ ID NO: 4131824 - RNA, 17 nt, Yersinia pestis
auauacaaggcacaucu

SEQ ID NO: 4131825 - RNA, 17 nt, Yersinia pestis
auauacagucaauugag

SEQ ID NO: 4131826 - RNA, 15 nt, Yersinia pestis
auauaccacaugaga

SEQ ID NO: 4131827 - RNA, 16 nt, Yersinia pestis
auauacccaaagccag

SEQ ID NO: 4131828 - RNA, 17 nt, Yersinia pestis
auauacccgucauacuu

SEQ ID NO: 4131829 - RNA, 16 nt, Yersinia pestis
auauacuuuacauaua

SEQ ID NO: 4131830 - RNA, 23 nt, Yersinia pestis
auauagaaauaaggaauaacuuc

SEQ ID NO: 4131831 - RNA, 23 nt, Yersinia pestis
auauagagcucagcuucaggcca

SEQ ID NO: 4131832 - RNA, 22 nt, Yersinia pestis
auauagcggcguucagcaauau

SEQ ID NO: 4131833 - RNA, 22 nt, Yersinia pestis
auauaggaaaugucguacaucu

SEQ ID NO: 4131834 - RNA, 16 nt, Yersinia pestis
auauaggguauaugcc

SEQ ID NO: 4131835 - RNA, 14 nt, Yersinia pestis
auauauagaaauaa

SEQ ID NO: 4131836 - RNA, 17 nt, Yersinia pestis
auauaucacuauuucag

SEQ ID NO: 4131837 - RNA, 13 nt, Yersinia pestis
auauauccaaaau

SEQ ID NO: 4131838 - RNA, 15 nt, Yersinia pestis
auauauccaaaauaa

SEQ ID NO: 4131839 - RNA, 17 nt, Yersinia pestis
auauauccaaaauaauu

SEQ ID NO: 4131840 - RNA, 19 nt, Yersinia pestis
auauauucuguuguaacca

SEQ ID NO: 4131841 - RNA, 14 nt, Yersinia pestis
auauauugcauuua

SEQ ID NO: 4131842 - RNA, 13 nt, Yersinia pestis
auauauuuuuaau

SEQ ID NO: 4131843 - RNA, 12 nt, Yersinia pestis
auauauuuuucu

SEQ ID NO: 4131844 - RNA, 19 nt, Yersinia pestis
auauauuuuuucauauccg

SEQ ID NO: 4131845 - RNA, 13 nt, Yersinia pestis
auaucaaaacuga

SEQ ID NO: 4131846 - RNA, 17 nt, Yersinia pestis
auaucaaaacugauuaa

SEQ ID NO: 4131847 - RNA, 21 nt, Yersinia pestis
auaucaaaaggauaaccuauu

SEQ ID NO: 4131848 - RNA, 16 nt, Yersinia pestis
auaucaacacugccug

SEQ ID NO: 4131849 - RNA, 20 nt, Yersinia pestis
auaucaauaagugcaaacuu

SEQ ID NO: 4131850 - RNA, 16 nt, Yersinia pestis
auaucacaguuaaaaa

SEQ ID NO: 4131851 - RNA, 17 nt, Yersinia pestis
auaucacuauaauuauu

SEQ ID NO: 4131852 - RNA, 12 nt, Yersinia pestis
auaucacuauuu

SEQ ID NO: 4131853 - RNA, 17 nt, Yersinia pestis
auaucagaaacaauaaa

SEQ ID NO: 4131854 - RNA, 21 nt, Yersinia pestis
auaucagaaacaauaaauauc

SEQ ID NO: 4131855 - RNA, 23 nt, Yersinia pestis
auaucagaaacaauaaauauccu

SEQ ID NO: 4131856 - RNA, 18 nt, Yersinia pestis
auaucagcauuaauaccg

SEQ ID NO: 4131857 - RNA, 15 nt, Yersinia pestis
auaucauguucuuug

SEQ ID NO: 4131858 - RNA, 14 nt, Yersinia pestis
auauccaaaauaau

SEQ ID NO: 4131859 - RNA, 17 nt, Yersinia pestis
auauccaauuguuuuac

SEQ ID NO: 4131860 - RNA, 20 nt, Yersinia pestis
auauccagcaacgaauaaaa

SEQ ID NO: 4131861 - RNA, 18 nt, Yersinia pestis
auaucccaauaauagcua

SEQ ID NO: 4131862 - RNA, 18 nt, Yersinia pestis
auaucccccccaagagaa

SEQ ID NO: 4131863 - RNA, 20 nt, Yersinia pestis
auaucccgagaaacaaaacc

SEQ ID NO: 4131864 - RNA, 17 nt, Yersinia pestis
auaucccuguuuucuag

SEQ ID NO: 4131865 - RNA, 19 nt, Yersinia pestis
auauccucaagaccgauuu

SEQ ID NO: 4131866 - RNA, 20 nt, Yersinia pestis
auauccugcgucucuaaccc

SEQ ID NO: 4131867 - RNA, 17 nt, Yersinia pestis
auauccuguggccuuaa

SEQ ID NO: 4131868 - RNA, 18 nt, Yersinia pestis
auauccuguggccuuaau

SEQ ID NO: 4131869 - RNA, 14 nt, Yersinia pestis
auaucgacaaucac

SEQ ID NO: 4131870 - RNA, 16 nt, Yersinia pestis
auaucgagguucgacu

SEQ ID NO: 4131871 - RNA, 16 nt, Yersinia pestis
auaucgaugacagcau

SEQ ID NO: 4131872 - RNA, 14 nt, Yersinia pestis
auaucgcaauuaau

SEQ ID NO: 4131873 - RNA, 20 nt, Yersinia pestis
auaucgguacgcugauagcc

SEQ ID NO: 4131874 - RNA, 15 nt, Yersinia pestis
auaucuaacugaugu

SEQ ID NO: 4131875 - RNA, 17 nt, Yersinia pestis
auaucuaacugauguau

SEQ ID NO: 4131876 - RNA, 18 nt, Yersinia pestis
auaucuaaguccaagaca

SEQ ID NO: 4131877 - RNA, 14 nt, Yersinia pestis
auaucuccguugaa

SEQ ID NO: 4131878 - RNA, 16 nt, Yersinia pestis
auaucuccguugaaac

SEQ ID NO: 4131879 - RNA, 18 nt, Yersinia pestis
auaucuccguugaaaccu

SEQ ID NO: 4131880 - RNA, 14 nt, Yersinia pestis
auaucugcauaacu

SEQ ID NO: 4131881 - RNA, 13 nt, Yersinia pestis
auaucugccaccg

SEQ ID NO: 4131882 - RNA, 16 nt, Yersinia pestis
auaucugcguuuucug

SEQ ID NO: 4131883 - RNA, 17 nt, Yersinia pestis
auaucugcucauuacca

SEQ ID NO: 4131884 - RNA, 20 nt, Yersinia pestis
auaucugugauaaccagcag

SEQ ID NO: 4131885 - RNA, 14 nt, Yersinia pestis
auaucuucacucag

SEQ ID NO: 4131886 - RNA, 22 nt, Yersinia pestis
auaucuucggcggcuaaagcug

SEQ ID NO: 4131887 - RNA, 15 nt, Yersinia pestis
auaucuuuaccuguu

SEQ ID NO: 4131888 - RNA, 16 nt, Yersinia pestis
auaucuuucaaguccu

SEQ ID NO: 4131889 - RNA, 15 nt, Yersinia pestis
auaugaaaaaccucc

SEQ ID NO: 4131890 - RNA, 19 nt, Yersinia pestis
auaugaaaaaucugacucu

SEQ ID NO: 4131891 - RNA, 13 nt, Yersinia pestis
auaugaacaccug

SEQ ID NO: 4131892 - RNA, 16 nt, Yersinia pestis
auaugaacuuguucau

SEQ ID NO: 4131893 - RNA, 16 nt, Yersinia pestis
auaugaagcacaaaaa

SEQ ID NO: 4131894 - RNA, 21 nt, Yersinia pestis
auaugacagaaaaaucacaug

SEQ ID NO: 4131895 - RNA, 14 nt, Yersinia pestis
auaugacuaaacug

SEQ ID NO: 4131896 - RNA, 13 nt, Yersinia pestis
auaugauuaauca

SEQ ID NO: 4131897 - RNA, 23 nt, Yersinia pestis
auaugauucgguuauucuucuau

SEQ ID NO: 4131898 - RNA, 17 nt, Yersinia pestis
auaugcgcgucaaucca

SEQ ID NO: 4131899 - RNA, 18 nt, Yersinia pestis
auaugcgcgucaauccac

SEQ ID NO: 4131900 - RNA, 23 nt, Yersinia pestis
auaugcucugcugggauacuggu

SEQ ID NO: 4131901 - RNA, 18 nt, Yersinia pestis
auaugcugauaaaauucg

SEQ ID NO: 4131902 - RNA, 21 nt, Yersinia pestis
auaugcugauaaaauucguuu

SEQ ID NO: 4131903 - RNA, 19 nt, Yersinia pestis
auaugcuucaucacuugcu

SEQ ID NO: 4131904 - RNA, 15 nt, Yersinia pestis
auauggaugaugcac

SEQ ID NO: 4131905 - RNA, 19 nt, Yersinia pestis
auauggcggcaucagcaaa

SEQ ID NO: 4131906 - RNA, 20 nt, Yersinia pestis
auauggguaaauacauggcg

SEQ ID NO: 4131907 - RNA, 20 nt, Yersinia pestis
auaugucagauagaccaaug

SEQ ID NO: 4131908 - RNA, 20 nt, Yersinia pestis
auauguucgaucaaaacaau

SEQ ID NO: 4131909 - RNA, 22 nt, Yersinia pestis
auauuaaagccauucagcagca

SEQ ID NO: 4131910 - RNA, 22 nt, Yersinia pestis
auauuaaaugcauuauaaggaa

SEQ ID NO: 4131911 - RNA, 12 nt, Yersinia pestis
auauuaacauau

SEQ ID NO: 4131912 - RNA, 11 nt, Yersinia pestis
auauuaacccg

SEQ ID NO: 4131913 - RNA, 13 nt, Yersinia pestis
auauuaacugcag

SEQ ID NO: 4131914 - RNA, 19 nt, Yersinia pestis
auauuaacugcagugaaaa

SEQ ID NO: 4131915 - RNA, 13 nt, Yersinia pestis
auauuaauccaua

SEQ ID NO: 4131916 - RNA, 18 nt, Yersinia pestis
auauuaccgcugaaaaau

SEQ ID NO: 4131917 - RNA, 14 nt, Yersinia pestis
auauuacgcagcca

SEQ ID NO: 4131918 - RNA, 16 nt, Yersinia pestis
auauuacgcagccaua

SEQ ID NO: 4131919 - RNA, 22 nt, Yersinia pestis
auauuacgcagccauacccaaa

SEQ ID NO: 4131920 - RNA, 18 nt, Yersinia pestis
auauuacggcccuccuga

SEQ ID NO: 4131921 - RNA, 14 nt, Yersinia pestis
auauuacucacaca

SEQ ID NO: 4131922 - RNA, 16 nt, Yersinia pestis
auauuagcaauuggcc

SEQ ID NO: 4131923 - RNA, 13 nt, Yersinia pestis
auauuauuuaauu

SEQ ID NO: 4131924 - RNA, 13 nt, Yersinia pestis
auauuauuuauuu

SEQ ID NO: 4131925 - RNA, 13 nt, Yersinia pestis
auauuauuuugca

SEQ ID NO: 4131926 - RNA, 15 nt, Yersinia pestis
auauucaccacacau

SEQ ID NO: 4131927 - RNA, 21 nt, Yersinia pestis
auauucaccacacauaccaca

SEQ ID NO: 4131928 - RNA, 22 nt, Yersinia pestis
auauucaccguuuccagaauca

SEQ ID NO: 4131929 - RNA, 13 nt, Yersinia pestis
auauucauauuuc

SEQ ID NO: 4131930 - RNA, 16 nt, Yersinia pestis
auauuccacauacaaa

SEQ ID NO: 4131931 - RNA, 18 nt, Yersinia pestis
auauuccccaccauugca

SEQ ID NO: 4131932 - RNA, 21 nt, Yersinia pestis
auauucgccagauugccaauc

SEQ ID NO: 4131933 - RNA, 14 nt, Yersinia pestis
auauucguacuacc

SEQ ID NO: 4131934 - RNA, 14 nt, Yersinia pestis
auauucuuguugua

SEQ ID NO: 4131935 - RNA, 16 nt, Yersinia pestis
auauugaauaaagccg

SEQ ID NO: 4131936 - RNA, 20 nt, Yersinia pestis
auauugaauaaccuacucca

SEQ ID NO: 4131937 - RNA, 11 nt, Yersinia pestis
auauugagcag

SEQ ID NO: 4131938 - RNA, 23 nt, Yersinia pestis
auauugauaaaaguaauuuauca

SEQ ID NO: 4131939 - RNA, 13 nt, Yersinia pestis
auauugaugacug

SEQ ID NO: 4131940 - RNA, 23 nt, Yersinia pestis
auauugaugugaaacauaauuaa

SEQ ID NO: 4131941 - RNA, 15 nt, Yersinia pestis
auauugccaucuugu

SEQ ID NO: 4131942 - RNA, 15 nt, Yersinia pestis
auauuggauaauaac

SEQ ID NO: 4131943 - RNA, 15 nt, Yersinia pestis
auauuggcaacaaca

SEQ ID NO: 4131944 - RNA, 12 nt, Yersinia pestis
aucacccagcaa

SEQ ID NO: 4131945 - RNA, 11 nt, Yersinia pestis
aucaccccuuc

SEQ ID NO: 4131946 - RNA, 15 nt, Yersinia pestis
aucacccgcaaaacu

SEQ ID NO: 4131947 - RNA, 16 nt, Yersinia pestis
aucacccgccucuaaa

SEQ ID NO: 4131948 - RNA, 22 nt, Yersinia pestis
aucaccggucuggacuuuggcc

SEQ ID NO: 4131949 - RNA, 15 nt, Yersinia pestis
aucaccuuccaaacu

SEQ ID NO: 4131950 - RNA, 22 nt, Yersinia pestis
aucaccuuccaaacuuugugga

SEQ ID NO: 4131951 - RNA, 23 nt, Yersinia pestis
aucaccuuccgucccaagaaaag

SEQ ID NO: 4131952 - RNA, 18 nt, Yersinia pestis
aucaccuuggaaaacagc

SEQ ID NO: 4131953 - RNA, 17 nt, Yersinia pestis
aucaccuuuuuucaggc

SEQ ID NO: 4131954 - RNA, 14 nt, Yersinia pestis
aucacgacuuuaau

SEQ ID NO: 4131955 - RNA, 22 nt, Yersinia pestis
aucacgauacgacuucuuauua

SEQ ID NO: 4131956 - RNA, 22 nt, Yersinia pestis
aucacgcagcaggccauuuuca

SEQ ID NO: 4131957 - RNA, 17 nt, Yersinia pestis
aucacgcauguucagcc

SEQ ID NO: 4131958 - RNA, 16 nt, Yersinia pestis
aucacggaaaucugcg

SEQ ID NO: 4131959 - RNA, 16 nt, Yersinia pestis
aucacgguacgcauga

SEQ ID NO: 4131960 - RNA, 18 nt, Yersinia pestis
aucacgguucauuuuuag

SEQ ID NO: 4131961 - RNA, 14 nt, Yersinia pestis
aucacuagcgggcc

SEQ ID NO: 4131962 - RNA, 18 nt, Yersinia pestis
aucacuagcgggccucag

SEQ ID NO: 4131963 - RNA, 23 nt, Yersinia pestis
aucacuauauacccgucauacuu

SEQ ID NO: 4131964 - RNA, 16 nt, Yersinia pestis
aucacuauuucagaca

SEQ ID NO: 4131965 - RNA, 22 nt, Yersinia pestis
aucacuauuucaggcauaucac

SEQ ID NO: 4131966 - RNA, 23 nt, Yersinia pestis
aucacuauuucguguauaucacu

SEQ ID NO: 4131967 - RNA, 18 nt, Yersinia pestis
aucacucgggauaugacu

SEQ ID NO: 4131968 - RNA, 17 nt, Yersinia pestis
aucacucugcuacugcg

SEQ ID NO: 4131969 - RNA, 16 nt, Yersinia pestis
aucacucuguacguaa

SEQ ID NO: 4131970 - RNA, 15 nt, Yersinia pestis
aucacugauaucggu

SEQ ID NO: 4131971 - RNA, 15 nt, Yersinia pestis
aucacugauucagaa

SEQ ID NO: 4131972 - RNA, 22 nt, Yersinia pestis
aucacugauucagaaagguaug

SEQ ID NO: 4131973 - RNA, 20 nt, Yersinia pestis
aucacuggcaauaauucaga

SEQ ID NO: 4131974 - RNA, 16 nt, Yersinia pestis
aucacugucaaaaagc

SEQ ID NO: 4131975 - RNA, 23 nt, Yersinia pestis
aucacuucaauguuuuuauccaa

SEQ ID NO: 4131976 - RNA, 19 nt, Yersinia pestis
aucacuuuuaugacggcau

SEQ ID NO: 4131977 - RNA, 22 nt, Yersinia pestis
aucagaaacaauaaauauccuc

SEQ ID NO: 4131978 - RNA, 23 nt, Yersinia pestis
aucagaauaaggcuuaccgccug

SEQ ID NO: 4131979 - RNA, 15 nt, Yersinia pestis
aucagaccuuuagga

SEQ ID NO: 4131980 - RNA, 16 nt, Yersinia pestis
aucagacggcagcaac

SEQ ID NO: 4131981 - RNA, 14 nt, Yersinia pestis
aucagacugcucuu

SEQ ID NO: 4131982 - RNA, 20 nt, Yersinia pestis
aucagacugcucuuucccuu

SEQ ID NO: 4131983 - RNA, 13 nt, Yersinia pestis
aucagagcucaau

SEQ ID NO: 4131984 - RNA, 14 nt, Yersinia pestis
aucagaugaugaug

SEQ ID NO: 4131985 - RNA, 19 nt, Yersinia pestis
aucagcaaaaacaaauaau

SEQ ID NO: 4131986 - RNA, 14 nt, Yersinia pestis
aucagcaaauuuug

SEQ ID NO: 4131987 - RNA, 18 nt, Yersinia pestis
aucagcaagcugcucaau

SEQ ID NO: 4131988 - RNA, 16 nt, Yersinia pestis
aucagcacuccccgcc

SEQ ID NO: 4131989 - RNA, 21 nt, Yersinia pestis
aucagcaguggcuuggcaacc

SEQ ID NO: 4131990 - RNA, 20 nt, Yersinia pestis
aucagccagccacugggcua

SEQ ID NO: 4131991 - RNA, 23 nt, Yersinia pestis
aucagccagccacugggcuaccc

SEQ ID NO: 4131992 - RNA, 18 nt, Yersinia pestis
aucagccauauguugcca

SEQ ID NO: 4131993 - RNA, 23 nt, Yersinia pestis
aucagccauauguugccaccagc

SEQ ID NO: 4131994 - RNA, 19 nt, Yersinia pestis
aucagcccaucuuugauuu

SEQ ID NO: 4131995 - RNA, 23 nt, Yersinia pestis
aucagcccaucuuugauuuaaau

SEQ ID NO: 4131996 - RNA, 18 nt, Yersinia pestis
aucagccccuuugaacug

SEQ ID NO: 4131997 - RNA, 16 nt, Yersinia pestis
aucagccgcaucacug

SEQ ID NO: 4131998 - RNA, 20 nt, Yersinia pestis
aucagccgcggcgcuggcau

SEQ ID NO: 4131999 - RNA, 20 nt, Yersinia pestis
aucagcgaccaaauggacga

SEQ ID NO: 4132000 - RNA, 24 nt, Yersinia pestis
aucagcgaccaaauggacgaacag

SEQ ID NO: 4132001 - RNA, 16 nt, Yersinia pestis
aucagcgcccuugcca

SEQ ID NO: 4132002 - RNA, 22 nt, Yersinia pestis
aucagcgcccuugccagugcaa

SEQ ID NO: 4132003 - RNA, 22 nt, Yersinia pestis
aucagcgcuagauuuucuuuca

SEQ ID NO: 4132004 - RNA, 22 nt, Yersinia pestis
aucagcggggcauucauuucuu

SEQ ID NO: 4132005 - RNA, 16 nt, Yersinia pestis
aucagcgguaucuaga

SEQ ID NO: 4132006 - RNA, 21 nt, Yersinia pestis
aucagcgguugggcuaaccag

SEQ ID NO: 4132007 - RNA, 22 nt, Yersinia pestis
aucagcgguugggcuaaccagu

SEQ ID NO: 4132008 - RNA, 17 nt, Yersinia pestis
aucagcguagauuuucu

SEQ ID NO: 4132009 - RNA, 21 nt, Yersinia pestis
aucagcguauagcgccgccag

SEQ ID NO: 4132010 - RNA, 16 nt, Yersinia pestis
aucagcguuuuauucg

SEQ ID NO: 4132011 - RNA, 15 nt, Yersinia pestis
aucagcugauaugaa

SEQ ID NO: 4132012 - RNA, 16 nt, Yersinia pestis
aucagcuuaaucgcau

SEQ ID NO: 4132013 - RNA, 17 nt, Yersinia pestis
aucagcuucauuaagga

SEQ ID NO: 4132014 - RNA, 17 nt, Yersinia pestis
aucagcuuucugucgau

SEQ ID NO: 4132015 - RNA, 14 nt, Yersinia pestis
aucaggcagacaau

SEQ ID NO: 4132016 - RNA, 23 nt, Yersinia pestis
aucaggccgguauucagccaaau

SEQ ID NO: 4132017 - RNA, 16 nt, Yersinia pestis
aucaggccuucuuuuc

SEQ ID NO: 4132018 - RNA, 18 nt, Yersinia pestis
aucaggccuucuuuucuc

SEQ ID NO: 4132019 - RNA, 19 nt, Yersinia pestis
aucaggccuucuuuucucc

SEQ ID NO: 4132020 - RNA, 15 nt, Yersinia pestis
aucaggcuguugaca

SEQ ID NO: 4132021 - RNA, 24 nt, Yersinia pestis
aucaggucaguaaugaauucauug

SEQ ID NO: 4132022 - RNA, 16 nt, Yersinia pestis
aucagguuguauuuug

SEQ ID NO: 4132023 - RNA, 20 nt, Yersinia pestis
aucagguuguauuuugcagg

SEQ ID NO: 4132024 - RNA, 22 nt, Yersinia pestis
aucagguuguccgaagagaaag

SEQ ID NO: 4132025 - RNA, 23 nt, Yersinia pestis
aucaguaccaccaccacaaacag

SEQ ID NO: 4132026 - RNA, 14 nt, Yersinia pestis
aucagugaagagau

SEQ ID NO: 4132027 - RNA, 15 nt, Yersinia pestis
aucagugaagagaua

SEQ ID NO: 4132028 - RNA, 16 nt, Yersinia pestis
aucagugaagagauaa

SEQ ID NO: 4132029 - RNA, 23 nt, Yersinia pestis
aucagugcaauaaauucaaaaua

SEQ ID NO: 4132030 - RNA, 16 nt, Yersinia pestis
aucagugcacggcagu

SEQ ID NO: 4132031 - RNA, 11 nt, Yersinia pestis
aucaguggcac

SEQ ID NO: 4132032 - RNA, 21 nt, Yersinia pestis
aucaguguugcaacggucauu

SEQ ID NO: 4132033 - RNA, 19 nt, Yersinia pestis
aucaguuccugauucgguu

SEQ ID NO: 4132034 - RNA, 16 nt, Yersinia pestis
aucaguucguucccug

SEQ ID NO: 4132035 - RNA, 19 nt, Yersinia pestis
aucaguucguucccuguau

SEQ ID NO: 4132036 - RNA, 21 nt, Yersinia pestis
aucaguugugggucgccuugc

SEQ ID NO: 4132037 - RNA, 23 nt, Yersinia pestis
aucauaacuaagagucacagcau

SEQ ID NO: 4132038 - RNA, 16 nt, Yersinia pestis
aucauaagacuaacag

SEQ ID NO: 4132039 - RNA, 17 nt, Yersinia pestis
aucauaaugguaccggc

SEQ ID NO: 4132040 - RNA, 13 nt, Yersinia pestis
aucauagaaggcg

SEQ ID NO: 4132041 - RNA, 14 nt, Yersinia pestis
aucauagccaucag

SEQ ID NO: 4132042 - RNA, 15 nt, Yersinia pestis
aucauagccauccca

SEQ ID NO: 4132043 - RNA, 14 nt, Yersinia pestis
aucauauuaacaua

SEQ ID NO: 4132044 - RNA, 22 nt, Yersinia pestis
aucaucaauggauucuugcugc

SEQ ID NO: 4132045 - RNA, 14 nt, Yersinia pestis
aucaucacaaauaa

SEQ ID NO: 4132046 - RNA, 21 nt, Yersinia pestis
aucaucacauucaaacacuua

SEQ ID NO: 4132047 - RNA, 14 nt, Yersinia pestis
aucaucaccauuca

SEQ ID NO: 4132048 - RNA, 15 nt, Yersinia pestis
aucaucauaaauggu

SEQ ID NO: 4132049 - RNA, 12 nt, Yersinia pestis
aucaucaucaau

SEQ ID NO: 4132050 - RNA, 13 nt, Yersinia pestis
aucaucaucacaa

SEQ ID NO: 4132051 - RNA, 20 nt, Yersinia pestis
aucaucaucgguaccgccag

SEQ ID NO: 4132052 - RNA, 18 nt, Yersinia pestis
aucaucaucuugaaaaua

SEQ ID NO: 4132053 - RNA, 19 nt, Yersinia pestis
aucaucaucuuuaauaaua

SEQ ID NO: 4132054 - RNA, 20 nt, Yersinia pestis
aucauccaguuuggcugcca

SEQ ID NO: 4132055 - RNA, 17 nt, Yersinia pestis
aucauccccuauauacc

SEQ ID NO: 4132056 - RNA, 23 nt, Yersinia pestis
aucaucgacuugaugaaguuauu

SEQ ID NO: 4132057 - RNA, 18 nt, Yersinia pestis
aucaucgcucaucgccaa

SEQ ID NO: 4132058 - RNA, 17 nt, Yersinia pestis
aucaucgggaacaggau

SEQ ID NO: 4132059 - RNA, 14 nt, Yersinia pestis
aucaucguggcuuu

SEQ ID NO: 4132060 - RNA, 20 nt, Yersinia pestis
aucaucugcgguaaccaaua

SEQ ID NO: 4132061 - RNA, 14 nt, Yersinia pestis
aucaucuucuucau

SEQ ID NO: 4132062 - RNA, 22 nt, Yersinia pestis
aucaugaauaggauagacagua

SEQ ID NO: 4132063 - RNA, 18 nt, Yersinia pestis
aucaugaugaucaagaua

SEQ ID NO: 4132064 - RNA, 13 nt, Yersinia pestis
aucaugccagcaa

SEQ ID NO: 4132065 - RNA, 19 nt, Yersinia pestis
auccuugcuaguuauauaa

SEQ ID NO: 4132066 - RNA, 23 nt, Yersinia pestis
auccuuuacuccccugccuauuc

SEQ ID NO: 4132067 - RNA, 14 nt, Yersinia pestis
aucgaaaaaaauac

SEQ ID NO: 4132068 - RNA, 20 nt, Yersinia pestis
aucgaaaaaaauacuaucau

SEQ ID NO: 4132069 - RNA, 12 nt, Yersinia pestis
aucgaaugauca

SEQ ID NO: 4132070 - RNA, 19 nt, Yersinia pestis
aucgaaugaucagaggcug

SEQ ID NO: 4132071 - RNA, 18 nt, Yersinia pestis
aucgaauugaucugauau

SEQ ID NO: 4132072 - RNA, 13 nt, Yersinia pestis
aucgacaauggcu

SEQ ID NO: 4132073 - RNA, 17 nt, Yersinia pestis
aucgacaccauguccau

SEQ ID NO: 4132074 - RNA, 19 nt, Yersinia pestis
aucgaccgaguguaaaaag

SEQ ID NO: 4132075 - RNA, 23 nt, Yersinia pestis
aucgaccgaguguaaaaagcagu

SEQ ID NO: 4132076 - RNA, 22 nt, Yersinia pestis
aucgacuaaaaccugcuugaaa

SEQ ID NO: 4132077 - RNA, 23 nt, Yersinia pestis
aucgagaguugcucacccauuuu

SEQ ID NO: 4132078 - RNA, 15 nt, Yersinia pestis
aucgauacggcaccg

SEQ ID NO: 4132079 - RNA, 14 nt, Yersinia pestis
aucgaucaaccauu

SEQ ID NO: 4132080 - RNA, 21 nt, Yersinia pestis
aucgaucucuuuauauucaau

SEQ ID NO: 4132081 - RNA, 20 nt, Yersinia pestis
aucgaucuggauauauuuac

SEQ ID NO: 4132082 - RNA, 22 nt, Yersinia pestis
aucgaugacagcauuauauuau

SEQ ID NO: 4132083 - RNA, 19 nt, Yersinia pestis
aucgauggauguuccuggc

SEQ ID NO: 4132084 - RNA, 23 nt, Yersinia pestis
aucgauuccgcgagcaauaccaa

SEQ ID NO: 4132085 - RNA, 14 nt, Yersinia pestis
aucgauugauauau

SEQ ID NO: 4132086 - RNA, 12 nt, Yersinia pestis
aucgcaauuuca

SEQ ID NO: 4132087 - RNA, 22 nt, Yersinia pestis
aucgcacugaguucugcugcca

SEQ ID NO: 4132088 - RNA, 19 nt, Yersinia pestis
aucgcacuguacacacagu

SEQ ID NO: 4132089 - RNA, 18 nt, Yersinia pestis
aucgcaguuaaagacaug

SEQ ID NO: 4132090 - RNA, 17 nt, Yersinia pestis
aucgcauugucacccac

SEQ ID NO: 4132091 - RNA, 14 nt, Yersinia pestis
aucgccaaacugcu

SEQ ID NO: 4132092 - RNA, 12 nt, Yersinia pestis
aucgccaacacu

SEQ ID NO: 4132093 - RNA, 16 nt, Yersinia pestis
aucgccaacauaagua

SEQ ID NO: 4132094 - RNA, 12 nt, Yersinia pestis
aucgccaauugg

SEQ ID NO: 4132095 - RNA, 19 nt, Yersinia pestis
aucgccaauuggucaugau

SEQ ID NO: 4132096 - RNA, 19 nt, Yersinia pestis
aucgccagcaaaucacauu

SEQ ID NO: 4132097 - RNA, 22 nt, Yersinia pestis
aucgccagcggguacacugucg

SEQ ID NO: 4132098 - RNA, 17 nt, Yersinia pestis
aucgccagucuuucggc

SEQ ID NO: 4132099 - RNA, 16 nt, Yersinia pestis
aucgccaguguugcca

SEQ ID NO: 4132100 - RNA, 13 nt, Yersinia pestis
aucgccauagccg

SEQ ID NO: 4132101 - RNA, 13 nt, Yersinia pestis
aucgccgaaaucu

SEQ ID NO: 4132102 - RNA, 21 nt, Yersinia pestis
aucgccgaaaucucaccacgc

SEQ ID NO: 4132103 - RNA, 17 nt, Yersinia pestis
aucgccgccaauguuuc

SEQ ID NO: 4132104 - RNA, 18 nt, Yersinia pestis
aucgccguacuuggucac

SEQ ID NO: 4132105 - RNA, 21 nt, Yersinia pestis
aucgccguuacccccuucacc

SEQ ID NO: 4132106 - RNA, 22 nt, Yersinia pestis
aucgccugaucacguaaacaau

SEQ ID NO: 4132107 - RNA, 15 nt, Yersinia pestis
aucgcgaaagcacuc

SEQ ID NO: 4132108 - RNA, 17 nt, Yersinia pestis
aucgcgacgaaaaccua

SEQ ID NO: 4132109 - RNA, 15 nt, Yersinia pestis
aucgcgaugcgccug

SEQ ID NO: 4132110 - RNA, 17 nt, Yersinia pestis
aucgcgcauuucuucuc

SEQ ID NO: 4132111 - RNA, 18 nt, Yersinia pestis
aucgcgcauuucuucucu

SEQ ID NO: 4132112 - RNA, 21 nt, Yersinia pestis
aucgcgcccauccgcaggaag

SEQ ID NO: 4132113 - RNA, 13 nt, Yersinia pestis
aucgcgcuucagg

SEQ ID NO: 4132114 - RNA, 17 nt, Yersinia pestis
aucgcggguuuuuaacu

SEQ ID NO: 4132115 - RNA, 19 nt, Yersinia pestis
aucgcuaacccucaguaaa

SEQ ID NO: 4132116 - RNA, 22 nt, Yersinia pestis
aucgcuaaccgccaguucugga

SEQ ID NO: 4132117 - RNA, 20 nt, Yersinia pestis
aucgcuacguacuaucuauu

SEQ ID NO: 4132118 - RNA, 21 nt, Yersinia pestis
aucgcuacguacuaucuauua

SEQ ID NO: 4132119 - RNA, 14 nt, Yersinia pestis
aucgcucaucgcca

SEQ ID NO: 4132120 - RNA, 13 nt, Yersinia pestis
aucgcucuucacg

SEQ ID NO: 4132121 - RNA, 15 nt, Yersinia pestis
aucgcugccgcaaga

SEQ ID NO: 4132122 - RNA, 11 nt, Yersinia pestis
aucgcuguaug

SEQ ID NO: 4132123 - RNA, 15 nt, Yersinia pestis
aucgcuguaugguau

SEQ ID NO: 4132124 - RNA, 17 nt, Yersinia pestis
aucgcugugguaucaaa

SEQ ID NO: 4132125 - RNA, 19 nt, Yersinia pestis
aucgcugugguuaucacgg

SEQ ID NO: 4132126 - RNA, 15 nt, Yersinia pestis
aucgcuugccacuuu

SEQ ID NO: 4132127 - RNA, 19 nt, Yersinia pestis
aucgcuuuggcuucuggau

SEQ ID NO: 4132128 - RNA, 21 nt, Yersinia pestis
aucgcuuuggcuucuggaugg

SEQ ID NO: 4132129 - RNA, 24 nt, Yersinia pestis
aucgcuuuuaugguuuugugucac

SEQ ID NO: 4132130 - RNA, 17 nt, Yersinia pestis
aucgcuuuuuacacugu

SEQ ID NO: 4132131 - RNA, 19 nt, Yersinia pestis
aucggaaccaccaagaacg

SEQ ID NO: 4132132 - RNA, 14 nt, Yersinia pestis
aucggaauccauua

SEQ ID NO: 4132133 - RNA, 23 nt, Yersinia pestis
aucggauggucauccacaaccag

SEQ ID NO: 4132134 - RNA, 15 nt, Yersinia pestis
aucggcaaaaacagu

SEQ ID NO: 4132135 - RNA, 20 nt, Yersinia pestis
aucggcaaaccgaauaccau

SEQ ID NO: 4132136 - RNA, 13 nt, Yersinia pestis
aucggcagugcca

SEQ ID NO: 4132137 - RNA, 18 nt, Yersinia pestis
aucggccaauucagcaac

SEQ ID NO: 4132138 - RNA, 16 nt, Yersinia pestis
aucggccagugcgccg

SEQ ID NO: 4132139 - RNA, 14 nt, Yersinia pestis
aucggcccugccau

SEQ ID NO: 4132140 - RNA, 14 nt, Yersinia pestis
aucggccugcgcug

SEQ ID NO: 4132141 - RNA, 20 nt, Yersinia pestis
aucggccugcgcugcuuuuu

SEQ ID NO: 4132142 - RNA, 15 nt, Yersinia pestis
aucggcgacauccac

SEQ ID NO: 4132143 - RNA, 21 nt, Yersinia pestis
aucggcggccaugucaggcca

SEQ ID NO: 4132144 - RNA, 22 nt, Yersinia pestis
aucggcgucaagguacccauua

SEQ ID NO: 4132145 - RNA, 23 nt, Yersinia pestis
aucgggaugcgcucgcuugcugc

SEQ ID NO: 4132146 - RNA, 17 nt, Yersinia pestis
aucgggcaauugaaaau

SEQ ID NO: 4132147 - RNA, 21 nt, Yersinia pestis
aucgggcggauagccgaagaa

SEQ ID NO: 4132148 - RNA, 23 nt, Yersinia pestis
aucgggguuugucagcagucuga

SEQ ID NO: 4132149 - RNA, 17 nt, Yersinia pestis
aucgguaucaucgagau

SEQ ID NO: 4132150 - RNA, 13 nt, Yersinia pestis
aucgguuucaguu

SEQ ID NO: 4132151 - RNA, 18 nt, Yersinia pestis
aucguauucucaauggcu

SEQ ID NO: 4132152 - RNA, 15 nt, Yersinia pestis
aucgucacagcaauu

SEQ ID NO: 4132153 - RNA, 17 nt, Yersinia pestis
aucgucacgaucaacca

SEQ ID NO: 4132154 - RNA, 17 nt, Yersinia pestis
aucgucacuggcaccau

SEQ ID NO: 4132155 - RNA, 16 nt, Yersinia pestis
aucgucagaaccugca

SEQ ID NO: 4132156 - RNA, 21 nt, Yersinia pestis
aucgucagccccugccagaau

SEQ ID NO: 4132157 - RNA, 13 nt, Yersinia pestis
aucguccagcagc

SEQ ID NO: 4132158 - RNA, 14 nt, Yersinia pestis
aucguccagcagca

SEQ ID NO: 4132159 - RNA, 24 nt, Yersinia pestis
aucgucuauagugccuaauaaaua

SEQ ID NO: 4132160 - RNA, 16 nt, Yersinia pestis
aucgugaauaaaaaua

SEQ ID NO: 4132161 - RNA, 15 nt, Yersinia pestis
aucgugaccaauaau

SEQ ID NO: 4132162 - RNA, 23 nt, Yersinia pestis
aucgugauugguaaacugccaau

SEQ ID NO: 4132163 - RNA, 21 nt, Yersinia pestis
aucguuaaacccggcaucaac

SEQ ID NO: 4132164 - RNA, 20 nt, Yersinia pestis
aucguuaaaguuaucaccaa

SEQ ID NO: 4132165 - RNA, 17 nt, Yersinia pestis
aucguuacggcugcgcg

SEQ ID NO: 4132166 - RNA, 16 nt, Yersinia pestis
aucguuauaauauuaa

SEQ ID NO: 4132167 - RNA, 17 nt, Yersinia pestis
aucguuauaauauuaaa

SEQ ID NO: 4132168 - RNA, 17 nt, Yersinia pestis
aucguugcuaccagcaa

SEQ ID NO: 4132169 - RNA, 12 nt, Yersinia pestis
aucguuuuaugg

SEQ ID NO: 4132170 - RNA, 17 nt, Yersinia pestis
aucuaaacaauugccuu

SEQ ID NO: 4132171 - RNA, 20 nt, Yersinia pestis
aucuaacuggcccucuuuuu

SEQ ID NO: 4132172 - RNA, 22 nt, Yersinia pestis
aucuaaucggcuggcaagauaa

SEQ ID NO: 4132173 - RNA, 16 nt, Yersinia pestis
aucuaauuuauaaccu

SEQ ID NO: 4132174 - RNA, 17 nt, Yersinia pestis
aucuaauuucaaaugaa

SEQ ID NO: 4132175 - RNA, 13 nt, Yersinia pestis
aucuacaacauca

SEQ ID NO: 4132176 - RNA, 19 nt, Yersinia pestis
aucuacagacuccaaauua

SEQ ID NO: 4132177 - RNA, 22 nt, Yersinia pestis
aucuacauaaucuuuacugcau

SEQ ID NO: 4132178 - RNA, 11 nt, Yersinia pestis
aucuacgggca

SEQ ID NO: 4132179 - RNA, 18 nt, Yersinia pestis
aucuacuucuauuacccu

SEQ ID NO: 4132180 - RNA, 18 nt, Yersinia pestis
aucuacuuuauucaauac

SEQ ID NO: 4132181 - RNA, 13 nt, Yersinia pestis
aucuagcagugau

SEQ ID NO: 4132182 - RNA, 16 nt, Yersinia pestis
aucuaggccugggugu

SEQ ID NO: 4132183 - RNA, 17 nt, Yersinia pestis
aucuauaaacuucacga

SEQ ID NO: 4132184 - RNA, 13 nt, Yersinia pestis
aucuauaucggcc

SEQ ID NO: 4132185 - RNA, 16 nt, Yersinia pestis
aucuaucgauacccuu

SEQ ID NO: 4132186 - RNA, 17 nt, Yersinia pestis
aucuauuaggcaguucc

SEQ ID NO: 4132187 - RNA, 22 nt, Yersinia pestis
augaaauauggugauaacugcc

SEQ ID NO: 4132188 - RNA, 14 nt, Yersinia pestis
augaaccaaaauuc

SEQ ID NO: 4132189 - RNA, 18 nt, Yersinia pestis
augaacccuuucagcgcu

SEQ ID NO: 4132190 - RNA, 13 nt, Yersinia pestis
augaaccgccaau

SEQ ID NO: 4132191 - RNA, 17 nt, Yersinia pestis
augaaccgucauagcau

SEQ ID NO: 4132192 - RNA, 23 nt, Yersinia pestis
augaacguguuagguaauaccaa

SEQ ID NO: 4132193 - RNA, 12 nt, Yersinia pestis
augaagaaauac

SEQ ID NO: 4132194 - RNA, 17 nt, Yersinia pestis
augaagcauuaaacaga

SEQ ID NO: 4132195 - RNA, 19 nt, Yersinia pestis
augaagggggcuuauucua

SEQ ID NO: 4132196 - RNA, 22 nt, Yersinia pestis
augaagggggcuuauucuaauu

SEQ ID NO: 4132197 - RNA, 12 nt, Yersinia pestis
augaaguuauuu

SEQ ID NO: 4132198 - RNA, 15 nt, Yersinia pestis
augaauaaagggggu

SEQ ID NO: 4132199 - RNA, 23 nt, Yersinia pestis
augaauaaaggggguuuuccccu

SEQ ID NO: 4132200 - RNA, 23 nt, Yersinia pestis
augaauaggauagacaguaacua

SEQ ID NO: 4132201 - RNA, 13 nt, Yersinia pestis
augaauauaugau

SEQ ID NO: 4132202 - RNA, 14 nt, Yersinia pestis
augaauaugcuuca

SEQ ID NO: 4132203 - RNA, 17 nt, Yersinia pestis
augaauaugcuucauca

SEQ ID NO: 4132204 - RNA, 15 nt, Yersinia pestis
augaauauuauucag

SEQ ID NO: 4132205 - RNA, 13 nt, Yersinia pestis
augaaucaacaga

SEQ ID NO: 4132206 - RNA, 17 nt, Yersinia pestis
augaaugacuggcuauu

SEQ ID NO: 4132207 - RNA, 14 nt, Yersinia pestis
augaaugaggcuga

SEQ ID NO: 4132208 - RNA, 13 nt, Yersinia pestis
augaauuaaagau

SEQ ID NO: 4132209 - RNA, 11 nt, Yersinia pestis
augaauuauua

SEQ ID NO: 4132210 - RNA, 22 nt, Yersinia pestis
augaauuuauccuguacauaua

SEQ ID NO: 4132211 - RNA, 15 nt, Yersinia pestis
augacaagucaugau

SEQ ID NO: 4132212 - RNA, 15 nt, Yersinia pestis
augacacaauucccg

SEQ ID NO: 4132213 - RNA, 22 nt, Yersinia pestis
augacacauauuucaggcuguu

SEQ ID NO: 4132214 - RNA, 16 nt, Yersinia pestis
augacaccuuucaaaa

SEQ ID NO: 4132215 - RNA, 16 nt, Yersinia pestis
augacagcaucaauau

SEQ ID NO: 4132216 - RNA, 19 nt, Yersinia pestis
augacagcauuauauuauu

SEQ ID NO: 4132217 - RNA, 21 nt, Yersinia pestis
augacaggggauagcaacugc

SEQ ID NO: 4132218 - RNA, 19 nt, Yersinia pestis
augacaguauuugcagcgg

SEQ ID NO: 4132219 - RNA, 22 nt, Yersinia pestis
augacaguauuugcagcggaug

SEQ ID NO: 4132220 - RNA, 20 nt, Yersinia pestis
augacaguauuuguagugga

SEQ ID NO: 4132221 - RNA, 20 nt, Yersinia pestis
augacauauucaaccgccag

SEQ ID NO: 4132222 - RNA, 15 nt, Yersinia pestis
augacauucagcguu

SEQ ID NO: 4132223 - RNA, 17 nt, Yersinia pestis
augaccaagguuauaca

SEQ ID NO: 4132224 - RNA, 17 nt, Yersinia pestis
augaccauuuauuucca

SEQ ID NO: 4132225 - RNA, 21 nt, Yersinia pestis
augaccuacacacucaguaca

SEQ ID NO: 4132226 - RNA, 23 nt, Yersinia pestis
augacgcuaaccaccgucaccaa

SEQ ID NO: 4132227 - RNA, 16 nt, Yersinia pestis
augacggugauguccg

SEQ ID NO: 4132228 - RNA, 18 nt, Yersinia pestis
augacgguugcugggauc

SEQ ID NO: 4132229 - RNA, 13 nt, Yersinia pestis
augacuagcgagc

SEQ ID NO: 4132230 - RNA, 19 nt, Yersinia pestis
augacuagguuauaauucc

SEQ ID NO: 4132231 - RNA, 17 nt, Yersinia pestis
augacuuagcacggcau

SEQ ID NO: 4132232 - RNA, 16 nt, Yersinia pestis
augacuucuuccacuu

SEQ ID NO: 4132233 - RNA, 16 nt, Yersinia pestis
augacuuuuuuuaugg

SEQ ID NO: 4132234 - RNA, 16 nt, Yersinia pestis
augagaaccaguucug

SEQ ID NO: 4132235 - RNA, 14 nt, Yersinia pestis
augagaauguaaau

SEQ ID NO: 4132236 - RNA, 16 nt, Yersinia pestis
augagaugaacacaga

SEQ ID NO: 4132237 - RNA, 17 nt, Yersinia pestis
augagauucaggagaua

SEQ ID NO: 4132238 - RNA, 20 nt, Yersinia pestis
augagcacgaauuuugagga

SEQ ID NO: 4132239 - RNA, 19 nt, Yersinia pestis
augagcagcccagucucuu

SEQ ID NO: 4132240 - RNA, 14 nt, Yersinia pestis
augagcaugccuga

SEQ ID NO: 4132241 - RNA, 15 nt, Yersinia pestis
augagccuuaccccu

SEQ ID NO: 4132242 - RNA, 20 nt, Yersinia pestis
augagcgcauugcacagguc

SEQ ID NO: 4132243 - RNA, 16 nt, Yersinia pestis
augagcuuaugcgucu

SEQ ID NO: 4132244 - RNA, 13 nt, Yersinia pestis
augaggcucagac

SEQ ID NO: 4132245 - RNA, 13 nt, Yersinia pestis
augaggcugaggu

SEQ ID NO: 4132246 - RNA, 13 nt, Yersinia pestis
augaguaaacaga

SEQ ID NO: 4132247 - RNA, 14 nt, Yersinia pestis
augaguaaacagag

SEQ ID NO: 4132248 - RNA, 14 nt, Yersinia pestis
augagucgcuggua

SEQ ID NO: 4132249 - RNA, 18 nt, Yersinia pestis
augagugaaaauauguag

SEQ ID NO: 4132250 - RNA, 21 nt, Yersinia pestis
augagugauauccgccaaaga

SEQ ID NO: 4132251 - RNA, 21 nt, Yersinia pestis
augagugaucauauuaggcag

SEQ ID NO: 4132252 - RNA, 21 nt, Yersinia pestis
augaguuugaucacagcucuc

SEQ ID NO: 4132253 - RNA, 17 nt, Yersinia pestis
augaguuuuguccugag

SEQ ID NO: 4132254 - RNA, 14 nt, Yersinia pestis
augauaaaacuauu

SEQ ID NO: 4132255 - RNA, 20 nt, Yersinia pestis
augauaaccacaacgacagc

SEQ ID NO: 4132256 - RNA, 13 nt, Yersinia pestis
augauaaugccau

SEQ ID NO: 4132257 - RNA, 13 nt, Yersinia pestis
augauagacagca

SEQ ID NO: 4132258 - RNA, 17 nt, Yersinia pestis
augauagcgcgagagcg

SEQ ID NO: 4132259 - RNA, 19 nt, Yersinia pestis
augauauacccaccagaga

SEQ ID NO: 4132260 - RNA, 15 nt, Yersinia pestis
augauauugaugacg

SEQ ID NO: 4132261 - RNA, 14 nt, Yersinia pestis
augaucaaauuaua

SEQ ID NO: 4132262 - RNA, 23 nt, Yersinia pestis
augaucaaauuauauaagagaug

SEQ ID NO: 4132263 - RNA, 16 nt, Yersinia pestis
augaucaagauagcgu

SEQ ID NO: 4132264 - RNA, 17 nt, Yersinia pestis
augaucagccgauguuu

SEQ ID NO: 4132265 - RNA, 20 nt, Yersinia pestis
augaucccugguuugccaua

SEQ ID NO: 4132266 - RNA, 18 nt, Yersinia pestis
augaucugaugaucaucu

SEQ ID NO: 4132267 - RNA, 22 nt, Yersinia pestis
augaugaauaccaccaucacuc

SEQ ID NO: 4132268 - RNA, 11 nt, Yersinia pestis
augaugacaau

SEQ ID NO: 4132269 - RNA, 21 nt, Yersinia pestis
augaugagcgcauugcacagg

SEQ ID NO: 4132270 - RNA, 14 nt, Yersinia pestis
augaugaguaacau

SEQ ID NO: 4132271 - RNA, 15 nt, Yersinia pestis
augaugauaucaccu

SEQ ID NO: 4132272 - RNA, 19 nt, Yersinia pestis
augaugcuggguauauaua

SEQ ID NO: 4132273 - RNA, 20 nt, Yersinia pestis
augaugcuggguauauauac

SEQ ID NO: 4132274 - RNA, 16 nt, Yersinia pestis
augauuaaacgccugg

SEQ ID NO: 4132275 - RNA, 18 nt, Yersinia pestis
augauuaacggauacccu

SEQ ID NO: 4132276 - RNA, 19 nt, Yersinia pestis
augauuaacggauacccuu

SEQ ID NO: 4132277 - RNA, 22 nt, Yersinia pestis
augauuaggcauaaauaauaaa

SEQ ID NO: 4132278 - RNA, 16 nt, Yersinia pestis
augauucgccauucug

SEQ ID NO: 4132279 - RNA, 16 nt, Yersinia pestis
augauucgguuauucu

SEQ ID NO: 4132280 - RNA, 13 nt, Yersinia pestis
augauucucuauu

SEQ ID NO: 4132281 - RNA, 15 nt, Yersinia pestis
augauucucuauucu

SEQ ID NO: 4132282 - RNA, 20 nt, Yersinia pestis
augauugagaucauauuguu

SEQ ID NO: 4132283 - RNA, 13 nt, Yersinia pestis
augauugauuauc

SEQ ID NO: 4132284 - RNA, 13 nt, Yersinia pestis
augauuucucgcu

SEQ ID NO: 4132285 - RNA, 12 nt, Yersinia pestis
augauuuuuaac

SEQ ID NO: 4132286 - RNA, 20 nt, Yersinia pestis
augauuuuuacagcaaacgu

SEQ ID NO: 4132287 - RNA, 14 nt, Yersinia pestis
augauuuuuuucau

SEQ ID NO: 4132288 - RNA, 23 nt, Yersinia pestis
augcaaaauaugguagaauuuac

SEQ ID NO: 4132289 - RNA, 21 nt, Yersinia pestis
augcaaucuaacuaauaauaa

SEQ ID NO: 4132290 - RNA, 20 nt, Yersinia pestis
augcaauuacugcauugcgu

SEQ ID NO: 4132291 - RNA, 17 nt, Yersinia pestis
augcacaguaggcugaa

SEQ ID NO: 4132292 - RNA, 19 nt, Yersinia pestis
augcaccaaucaacauaaa

SEQ ID NO: 4132293 - RNA, 17 nt, Yersinia pestis
augcaccgacaaagaua

SEQ ID NO: 4132294 - RNA, 20 nt, Yersinia pestis
augcaccgcccagauucauu

SEQ ID NO: 4132295 - RNA, 13 nt, Yersinia pestis
augcacugaacaa

SEQ ID NO: 4132296 - RNA, 18 nt, Yersinia pestis
augcacugaacaaugcca

SEQ ID NO: 4132297 - RNA, 14 nt, Yersinia pestis
augcacuucaccug

SEQ ID NO: 4132298 - RNA, 17 nt, Yersinia pestis
augcagauaaccgugcg

SEQ ID NO: 4132299 - RNA, 19 nt, Yersinia pestis
augcagaugccaaugaucg

SEQ ID NO: 4132300 - RNA, 16 nt, Yersinia pestis
augcagauuuuugcuu

SEQ ID NO: 4132301 - RNA, 15 nt, Yersinia pestis
augcagcuaaaagau

SEQ ID NO: 4132302 - RNA, 17 nt, Yersinia pestis
augcagcuaaaagaugc

SEQ ID NO: 4132303 - RNA, 19 nt, Yersinia pestis
augcagcuuagaguaagua

SEQ ID NO: 4132304 - RNA, 14 nt, Yersinia pestis
augcaguaaauagu

SEQ ID NO: 4132305 - RNA, 22 nt, Yersinia pestis
augcaguuaagguuagcuaugc

SEQ ID NO: 4132306 - RNA, 13 nt, Yersinia pestis
augcauaacugcu

SEQ ID NO: 4132307 - RNA, 16 nt, Yersinia pestis
augcauaagcacgaau

SEQ ID NO: 4132308 - RNA, 20 nt, Yersinia pestis
augcauacccgucguacuuu

SEQ ID NO: 4132309 - RNA, 18 nt, Yersinia pestis
augggauauuaucgaaac

SEQ ID NO: 4132310 - RNA, 20 nt, Yersinia pestis
augggcagugcacagucacu

SEQ ID NO: 4132311 - RNA, 20 nt, Yersinia pestis
augggcgccgcuuuaccugu

SEQ ID NO: 4132312 - RNA, 14 nt, Yersinia pestis
auggggaaaagcag

SEQ ID NO: 4132313 - RNA, 22 nt, Yersinia pestis
auggggaucugcauaccuggau

SEQ ID NO: 4132314 - RNA, 23 nt, Yersinia pestis
auggggcauugcagacugcugac

SEQ ID NO: 4132315 - RNA, 19 nt, Yersinia pestis
auggggccaccuaauccaa

SEQ ID NO: 4132316 - RNA, 20 nt, Yersinia pestis
augggguucgcuauccccac

SEQ ID NO: 4132317 - RNA, 20 nt, Yersinia pestis
auggguaauccccaccaaca

SEQ ID NO: 4132318 - RNA, 19 nt, Yersinia pestis
auggguauauuuaccaaaa

SEQ ID NO: 4132319 - RNA, 14 nt, Yersinia pestis
augggucguugaua

SEQ ID NO: 4132320 - RNA, 18 nt, Yersinia pestis
augguaagaauaaauaau

SEQ ID NO: 4132321 - RNA, 13 nt, Yersinia pestis
augguaagucuua

SEQ ID NO: 4132322 - RNA, 24 nt, Yersinia pestis
augguagcaaggcguacaucucuu

SEQ ID NO: 4132323 - RNA, 16 nt, Yersinia pestis
augguauagacuguuu

SEQ ID NO: 4132324 - RNA, 13 nt, Yersinia pestis
augguaucagaaa

SEQ ID NO: 4132325 - RNA, 20 nt, Yersinia pestis
augguauucgauauggaugg

SEQ ID NO: 4132326 - RNA, 19 nt, Yersinia pestis
auggucaacucgagcauuu

SEQ ID NO: 4132327 - RNA, 21 nt, Yersinia pestis
auggucacccuuuugaauuca

SEQ ID NO: 4132328 - RNA, 18 nt, Yersinia pestis
auggucaggaacccauuu

SEQ ID NO: 4132329 - RNA, 22 nt, Yersinia pestis
auggucaggaacccauuugcac

SEQ ID NO: 4132330 - RNA, 14 nt, Yersinia pestis
auggucauccacaa

SEQ ID NO: 4132331 - RNA, 17 nt, Yersinia pestis
auggugccgucaacagg

SEQ ID NO: 4132332 - RNA, 13 nt, Yersinia pestis
auggugcuauuuc

SEQ ID NO: 4132333 - RNA, 14 nt, Yersinia pestis
auggugcuauuucu

SEQ ID NO: 4132334 - RNA, 13 nt, Yersinia pestis
augguggcagccu

SEQ ID NO: 4132335 - RNA, 19 nt, Yersinia pestis
auggugggccgugcgggau

SEQ ID NO: 4132336 - RNA, 19 nt, Yersinia pestis
auggugggucgugcgggau

SEQ ID NO: 4132337 - RNA, 15 nt, Yersinia pestis
augguguagcugaac

SEQ ID NO: 4132338 - RNA, 16 nt, Yersinia pestis
auggugucuuuacugg

SEQ ID NO: 4132339 - RNA, 21 nt, Yersinia pestis
augguuaaaacucaaacugau

SEQ ID NO: 4132340 - RNA, 17 nt, Yersinia pestis
augguugaaugaccaag

SEQ ID NO: 4132341 - RNA, 18 nt, Yersinia pestis
augguugaaugaccaagg

SEQ ID NO: 4132342 - RNA, 22 nt, Yersinia pestis
augguuuccagcccaccagcag

SEQ ID NO: 4132343 - RNA, 23 nt, Yersinia pestis
augguuuccuucaccaaaaaaac

SEQ ID NO: 4132344 - RNA, 20 nt, Yersinia pestis
augguuuuuauuguuauuuu

SEQ ID NO: 4132345 - RNA, 14 nt, Yersinia pestis
auguaaauuucccu

SEQ ID NO: 4132346 - RNA, 17 nt, Yersinia pestis
auguaaggcaauaccaa

SEQ ID NO: 4132347 - RNA, 17 nt, Yersinia pestis
auguaauaaucuaaauu

SEQ ID NO: 4132348 - RNA, 14 nt, Yersinia pestis
auguacauuauuca

SEQ ID NO: 4132349 - RNA, 21 nt, Yersinia pestis
auguacauuauucaugaugcc

SEQ ID NO: 4132350 - RNA, 20 nt, Yersinia pestis
auguagcacacuaccgucuu

SEQ ID NO: 4132351 - RNA, 16 nt, Yersinia pestis
auguaggcaauacacc

SEQ ID NO: 4132352 - RNA, 20 nt, Yersinia pestis
auguagggguacagcaggga

SEQ ID NO: 4132353 - RNA, 21 nt, Yersinia pestis
auguaguuaaucuacccgagu

SEQ ID NO: 4132354 - RNA, 13 nt, Yersinia pestis
auguauaaaaaag

SEQ ID NO: 4132355 - RNA, 14 nt, Yersinia pestis
auguauaaaaaaga

SEQ ID NO: 4132356 - RNA, 23 nt, Yersinia pestis
auguauaaaaaagauaauaaaac

SEQ ID NO: 4132357 - RNA, 12 nt, Yersinia pestis
auguauccaucu

SEQ ID NO: 4132358 - RNA, 22 nt, Yersinia pestis
auguauuagcgcugcucaauca

SEQ ID NO: 4132359 - RNA, 15 nt, Yersinia pestis
auguauuaguuucaa

SEQ ID NO: 4132360 - RNA, 20 nt, Yersinia pestis
auguauucccucaauagcua

SEQ ID NO: 4132361 - RNA, 18 nt, Yersinia pestis
augucaccuccacuucaa

SEQ ID NO: 4132362 - RNA, 13 nt, Yersinia pestis
augucacuugccc

SEQ ID NO: 4132363 - RNA, 22 nt, Yersinia pestis
augucagacagcacgggcuauc

SEQ ID NO: 4132364 - RNA, 13 nt, Yersinia pestis
augucagauuagu

SEQ ID NO: 4132365 - RNA, 17 nt, Yersinia pestis
augucagccguuuacga

SEQ ID NO: 4132366 - RNA, 21 nt, Yersinia pestis
augucaugauaaaacuauucu

SEQ ID NO: 4132367 - RNA, 14 nt, Yersinia pestis
auguccaguuauca

SEQ ID NO: 4132368 - RNA, 17 nt, Yersinia pestis
auguccaguuaucaucg

SEQ ID NO: 4132369 - RNA, 23 nt, Yersinia pestis
auguccauguuaggauaggguuu

SEQ ID NO: 4132370 - RNA, 15 nt, Yersinia pestis
auguccucaccauuu

SEQ ID NO: 4132371 - RNA, 16 nt, Yersinia pestis
auguccucaccauuua

SEQ ID NO: 4132372 - RNA, 17 nt, Yersinia pestis
auguccucaccauuuau

SEQ ID NO: 4132373 - RNA, 21 nt, Yersinia pestis
auguccucaccauuuauugcc

SEQ ID NO: 4132374 - RNA, 23 nt, Yersinia pestis
auguccucaccauuuauugccac

SEQ ID NO: 4132375 - RNA, 20 nt, Yersinia pestis
augucucuggcgcgaaaugc

SEQ ID NO: 4132376 - RNA, 22 nt, Yersinia pestis
augucuuuuucuuuuuaacuua

SEQ ID NO: 4132377 - RNA, 13 nt, Yersinia pestis
augugaaaagcag

SEQ ID NO: 4132378 - RNA, 14 nt, Yersinia pestis
augugaaaagcagu

SEQ ID NO: 4132379 - RNA, 18 nt, Yersinia pestis
augugaaaagcagucgac

SEQ ID NO: 4132380 - RNA, 14 nt, Yersinia pestis
augugaaacauaau

SEQ ID NO: 4132381 - RNA, 15 nt, Yersinia pestis
augugaaacauaauu

SEQ ID NO: 4132382 - RNA, 18 nt, Yersinia pestis
augugaaacauaauuaaa

SEQ ID NO: 4132383 - RNA, 20 nt, Yersinia pestis
augugaacgcccuguaaugg

SEQ ID NO: 4132384 - RNA, 17 nt, Yersinia pestis
augugauaccuaaaccu

SEQ ID NO: 4132385 - RNA, 14 nt, Yersinia pestis
augugauguggcuu

SEQ ID NO: 4132386 - RNA, 19 nt, Yersinia pestis
augugcugguuauuggccc

SEQ ID NO: 4132387 - RNA, 19 nt, Yersinia pestis
augugcuucuuugaagcgc

SEQ ID NO: 4132388 - RNA, 16 nt, Yersinia pestis
auguggcauguucagc

SEQ ID NO: 4132389 - RNA, 18 nt, Yersinia pestis
auguguuuguaccgauuu

SEQ ID NO: 4132390 - RNA, 14 nt, Yersinia pestis
auguguuuuucuua

SEQ ID NO: 4132391 - RNA, 18 nt, Yersinia pestis
auguuaaaucagugaagg

SEQ ID NO: 4132392 - RNA, 14 nt, Yersinia pestis
auguuagagauaac

SEQ ID NO: 4132393 - RNA, 13 nt, Yersinia pestis
auguuaggauagg

SEQ ID NO: 4132394 - RNA, 20 nt, Yersinia pestis
auguuaucgccaacacuauu

SEQ ID NO: 4132395 - RNA, 18 nt, Yersinia pestis
auguuaugaggggaggcu

SEQ ID NO: 4132396 - RNA, 14 nt, Yersinia pestis
auguuauuaaugau

SEQ ID NO: 4132397 - RNA, 16 nt, Yersinia pestis
auguucacaucgguca

SEQ ID NO: 4132398 - RNA, 14 nt, Yersinia pestis
auguucgaacaugc

SEQ ID NO: 4132399 - RNA, 19 nt, Yersinia pestis
auguucgcacugcucugcc

SEQ ID NO: 4132400 - RNA, 20 nt, Yersinia pestis
auguucgcacugcucugccc

SEQ ID NO: 4132401 - RNA, 22 nt, Yersinia pestis
auguucgcucccccggaucacu

SEQ ID NO: 4132402 - RNA, 20 nt, Yersinia pestis
auguucucuggguaagaaca

SEQ ID NO: 4132403 - RNA, 12 nt, Yersinia pestis
auguucugccaa

SEQ ID NO: 4132404 - RNA, 16 nt, Yersinia pestis
auguucuuccugugcg

SEQ ID NO: 4132405 - RNA, 17 nt, Yersinia pestis
auguugaaucaauugcu

SEQ ID NO: 4132406 - RNA, 16 nt, Yersinia pestis
auguugaccaaacaga

SEQ ID NO: 4132407 - RNA, 14 nt, Yersinia pestis
auguugcaacaugc

SEQ ID NO: 4132408 - RNA, 18 nt, Yersinia pestis
auguugccaaugggccaa

SEQ ID NO: 4132409 - RNA, 20 nt, Yersinia pestis
auguugccgcuucauauccu

SEQ ID NO: 4132410 - RNA, 18 nt, Yersinia pestis
auguugcgggaauagcuc

SEQ ID NO: 4132411 - RNA, 20 nt, Yersinia pestis
auguuuaaacacuuagccag

SEQ ID NO: 4132412 - RNA, 22 nt, Yersinia pestis
auguuuacggcauuagugaauc

SEQ ID NO: 4132413 - RNA, 19 nt, Yersinia pestis
auguuucuuuaauaagccu

SEQ ID NO: 4132414 - RNA, 22 nt, Yersinia pestis
auguuuuacgaucaacccccug

SEQ ID NO: 4132415 - RNA, 14 nt, Yersinia pestis
auguuuuuaacaaa

SEQ ID NO: 4132416 - RNA, 22 nt, Yersinia pestis
auguuuuuauccaaacaaacac

SEQ ID NO: 4132417 - RNA, 18 nt, Yersinia pestis
auguuuuuccuucaguuc

SEQ ID NO: 4132418 - RNA, 14 nt, Yersinia pestis
auguuuuugaccau

SEQ ID NO: 4132419 - RNA, 12 nt, Yersinia pestis
auuaaaaauaca

SEQ ID NO: 4132420 - RNA, 22 nt, Yersinia pestis
auuaaaaauagauuaaaagucu

SEQ ID NO: 4132421 - RNA, 14 nt, Yersinia pestis
auuaaaacacauca

SEQ ID NO: 4132422 - RNA, 15 nt, Yersinia pestis
auuaaaacauauuaa

SEQ ID NO: 4132423 - RNA, 12 nt, Yersinia pestis
auuaaaacugaa

SEQ ID NO: 4132424 - RNA, 17 nt, Yersinia pestis
auuaaaacugaaaaguu

SEQ ID NO: 4132425 - RNA, 11 nt, Yersinia pestis
auuaaacagau

SEQ ID NO: 4132426 - RNA, 16 nt, Yersinia pestis
auuaaacagucuuauu

SEQ ID NO: 4132427 - RNA, 22 nt, Yersinia pestis
auuaaacagucuuauuacucau

SEQ ID NO: 4132428 - RNA, 16 nt, Yersinia pestis
auuaaacgcucaucaa

SEQ ID NO: 4132429 - RNA, 17 nt, Yersinia pestis
auuaaacgcucaucaac

SEQ ID NO: 4132430 - RNA, 19 nt, Yersinia pestis
auuaaacuauuaacucuuu

SEQ ID NO: 4132431 - RNA, 22 nt, Yersinia pestis
auuaggguugguugguggcuuu

SEQ ID NO: 4132432 - RNA, 15 nt, Yersinia pestis
auuaguccguagaaa

SEQ ID NO: 4132433 - RNA, 22 nt, Yersinia pestis
auuagugagcgguugaaaaguu

SEQ ID NO: 4132434 - RNA, 15 nt, Yersinia pestis
auuagugcacagaua

SEQ ID NO: 4132435 - RNA, 13 nt, Yersinia pestis
auuaguuucaaau

SEQ ID NO: 4132436 - RNA, 19 nt, Yersinia pestis
auuauaauccacugaaaua

SEQ ID NO: 4132437 - RNA, 23 nt, Yersinia pestis
auuauauaagagaugaaauuuua

SEQ ID NO: 4132438 - RNA, 14 nt, Yersinia pestis
auuauauuuaauuu

SEQ ID NO: 4132439 - RNA, 17 nt, Yersinia pestis
auuauauuuaauuuaaa

SEQ ID NO: 4132440 - RNA, 17 nt, Yersinia pestis
auuaucauauucaucaa

SEQ ID NO: 4132441 - RNA, 16 nt, Yersinia pestis
auuaucaucaauagcg

SEQ ID NO: 4132442 - RNA, 23 nt, Yersinia pestis
auuauccacgggcgcaauggaag

SEQ ID NO: 4132443 - RNA, 15 nt, Yersinia pestis
auuaucccaguuuuu

SEQ ID NO: 4132444 - RNA, 17 nt, Yersinia pestis
auuaucccguucaauaa

SEQ ID NO: 4132445 - RNA, 19 nt, Yersinia pestis
auuaucccguucaauaaua

SEQ ID NO: 4132446 - RNA, 21 nt, Yersinia pestis
auuaucccguucaauaauagu

SEQ ID NO: 4132447 - RNA, 14 nt, Yersinia pestis
auuaucgaucacau

SEQ ID NO: 4132448 - RNA, 21 nt, Yersinia pestis
auuaucgaucacaugcucagu

SEQ ID NO: 4132449 - RNA, 15 nt, Yersinia pestis
auuaucgcaauuuca

SEQ ID NO: 4132450 - RNA, 17 nt, Yersinia pestis
auuaucgccuggcuuga

SEQ ID NO: 4132451 - RNA, 22 nt, Yersinia pestis
auuaucugaaagcaaacaauua

SEQ ID NO: 4132452 - RNA, 19 nt, Yersinia pestis
auuaugaaaguaagagucu

SEQ ID NO: 4132453 - RNA, 17 nt, Yersinia pestis
auuauggacaggcucau

SEQ ID NO: 4132454 - RNA, 17 nt, Yersinia pestis
auuauggauaauuuaau

SEQ ID NO: 4132455 - RNA, 15 nt, Yersinia pestis
auuauuaaagaugau

SEQ ID NO: 4132456 - RNA, 19 nt, Yersinia pestis
auuauuaacgauuauuaaa

SEQ ID NO: 4132457 - RNA, 14 nt, Yersinia pestis
auuauuaaugaaau

SEQ ID NO: 4132458 - RNA, 15 nt, Yersinia pestis
auuauuaaugaaauu

SEQ ID NO: 4132459 - RNA, 22 nt, Yersinia pestis
auuauuacucagcacauuuuua

SEQ ID NO: 4132460 - RNA, 15 nt, Yersinia pestis
auuauucaacgugac

SEQ ID NO: 4132461 - RNA, 13 nt, Yersinia pestis
auuauucaugaug

SEQ ID NO: 4132462 - RNA, 18 nt, Yersinia pestis
auuauucuucaccacgau

SEQ ID NO: 4132463 - RNA, 19 nt, Yersinia pestis
auuauugacgguuacagcg

SEQ ID NO: 4132464 - RNA, 19 nt, Yersinia pestis
auuauugauugcaucguca

SEQ ID NO: 4132465 - RNA, 17 nt, Yersinia pestis
auuauuggcgauuuaau

SEQ ID NO: 4132466 - RNA, 22 nt, Yersinia pestis
auuauugguguguaauuuuuac

SEQ ID NO: 4132467 - RNA, 24 nt, Yersinia pestis
auuauugguguguaauuuuuacau

SEQ ID NO: 4132468 - RNA, 17 nt, Yersinia pestis
auuauuguuauuaucau

SEQ ID NO: 4132469 - RNA, 14 nt, Yersinia pestis
auuauuuaaacaau

SEQ ID NO: 4132470 - RNA, 16 nt, Yersinia pestis
auuauuuaaacaauga

SEQ ID NO: 4132471 - RNA, 19 nt, Yersinia pestis
auuauuuaaacaaugaaau

SEQ ID NO: 4132472 - RNA, 21 nt, Yersinia pestis
auuauuuaaacaaugaaauug

SEQ ID NO: 4132473 - RNA, 14 nt, Yersinia pestis
auuauuuacacuua

SEQ ID NO: 4132474 - RNA, 23 nt, Yersinia pestis
auuauuuagccugccaauaucca

SEQ ID NO: 4132475 - RNA, 17 nt, Yersinia pestis
auuauuuauuuacagcc

SEQ ID NO: 4132476 - RNA, 16 nt, Yersinia pestis
auuauuucucugauga

SEQ ID NO: 4132477 - RNA, 14 nt, Yersinia pestis
auuauuugauauag

SEQ ID NO: 4132478 - RNA, 23 nt, Yersinia pestis
auuauuuuggguauauaguuuau

SEQ ID NO: 4132479 - RNA, 21 nt, Yersinia pestis
auucaaaauagaggaaauaaa

SEQ ID NO: 4132480 - RNA, 14 nt, Yersinia pestis
auucaaaaugccag

SEQ ID NO: 4132481 - RNA, 13 nt, Yersinia pestis
auucaaacaguaa

SEQ ID NO: 4132482 - RNA, 22 nt, Yersinia pestis
auucaaacggucuguuaauccu

SEQ ID NO: 4132483 - RNA, 16 nt, Yersinia pestis
auucaaacggugugca

SEQ ID NO: 4132484 - RNA, 22 nt, Yersinia pestis
auucaaacggugugcaaugcag

SEQ ID NO: 4132485 - RNA, 20 nt, Yersinia pestis
auucaacagccuuucccuga

SEQ ID NO: 4132486 - RNA, 16 nt, Yersinia pestis
auucaacgccaauacc

SEQ ID NO: 4132487 - RNA, 17 nt, Yersinia pestis
auucaacgcuguuucug

SEQ ID NO: 4132488 - RNA, 23 nt, Yersinia pestis
auucaaggcuacccaauaacccc

SEQ ID NO: 4132489 - RNA, 20 nt, Yersinia pestis
auucaaggucgccauauuau

SEQ ID NO: 4132490 - RNA, 14 nt, Yersinia pestis
auucaaguugcaga

SEQ ID NO: 4132491 - RNA, 19 nt, Yersinia pestis
auucaauaggguaauacca

SEQ ID NO: 4132492 - RNA, 16 nt, Yersinia pestis
auucaauaucacugau

SEQ ID NO: 4132493 - RNA, 21 nt, Yersinia pestis
auucaauccauugaucucauu

SEQ ID NO: 4132494 - RNA, 22 nt, Yersinia pestis
auucaaugacuccugaaauaaa

SEQ ID NO: 4132495 - RNA, 23 nt, Yersinia pestis
auucaaugacuccugaaauaaag

SEQ ID NO: 4132496 - RNA, 15 nt, Yersinia pestis
auucaauugaucuaa

SEQ ID NO: 4132497 - RNA, 19 nt, Yersinia pestis
auucaauugugcaaaauca

SEQ ID NO: 4132498 - RNA, 20 nt, Yersinia pestis
auucacaacagugcaacauu

SEQ ID NO: 4132499 - RNA, 22 nt, Yersinia pestis
auucacaacagugcaacauuaa

SEQ ID NO: 4132500 - RNA, 22 nt, Yersinia pestis
auucacaacauagguuuuuuca

SEQ ID NO: 4132501 - RNA, 12 nt, Yersinia pestis
auucacagcaga

SEQ ID NO: 4132502 - RNA, 14 nt, Yersinia pestis
auucacagcagaac

SEQ ID NO: 4132503 - RNA, 15 nt, Yersinia pestis
auucaccacacauac

SEQ ID NO: 4132504 - RNA, 17 nt, Yersinia pestis
auucaccacacauacca

SEQ ID NO: 4132505 - RNA, 13 nt, Yersinia pestis
auucaccaccauu

SEQ ID NO: 4132506 - RNA, 15 nt, Yersinia pestis
auucaccagcaauaa

SEQ ID NO: 4132507 - RNA, 16 nt, Yersinia pestis
auucaccagcaauaaa

SEQ ID NO: 4132508 - RNA, 21 nt, Yersinia pestis
auucaccguguuucagcauca

SEQ ID NO: 4132509 - RNA, 20 nt, Yersinia pestis
auucaccuugauuaauaaca

SEQ ID NO: 4132510 - RNA, 22 nt, Yersinia pestis
auucaccuugauuaauaacagu

SEQ ID NO: 4132511 - RNA, 18 nt, Yersinia pestis
auucacgaauagcgguac

SEQ ID NO: 4132512 - RNA, 23 nt, Yersinia pestis
auucacgagcuaacgcgucaauc

SEQ ID NO: 4132513 - RNA, 15 nt, Yersinia pestis
auucacgcaaggcca

SEQ ID NO: 4132514 - RNA, 16 nt, Yersinia pestis
auucacgcaaggccag

SEQ ID NO: 4132515 - RNA, 18 nt, Yersinia pestis
auucacgcaaggccaggu

SEQ ID NO: 4132516 - RNA, 14 nt, Yersinia pestis
auucacgccuaucu

SEQ ID NO: 4132517 - RNA, 18 nt, Yersinia pestis
auucacguaugguuuuua

SEQ ID NO: 4132518 - RNA, 14 nt, Yersinia pestis
auucacguuuuucc

SEQ ID NO: 4132519 - RNA, 15 nt, Yersinia pestis
auucacguuuuucca

SEQ ID NO: 4132520 - RNA, 19 nt, Yersinia pestis
auucacucauaauuuugau

SEQ ID NO: 4132521 - RNA, 19 nt, Yersinia pestis
auucagacccgauuucaac

SEQ ID NO: 4132522 - RNA, 19 nt, Yersinia pestis
auucagacgacgugcagcg

SEQ ID NO: 4132523 - RNA, 17 nt, Yersinia pestis
auucagaggaaagagag

SEQ ID NO: 4132524 - RNA, 18 nt, Yersinia pestis
auucagaugcugaacuug

SEQ ID NO: 4132525 - RNA, 20 nt, Yersinia pestis
auucagcaaacucagccaau

SEQ ID NO: 4132526 - RNA, 17 nt, Yersinia pestis
auucagcagcauuucuc

SEQ ID NO: 4132527 - RNA, 23 nt, Yersinia pestis
auucagcaucaaauuauuuuucc

SEQ ID NO: 4132528 - RNA, 17 nt, Yersinia pestis
auucagccaacagcuga

SEQ ID NO: 4132529 - RNA, 13 nt, Yersinia pestis
auucagccacuca

SEQ ID NO: 4132530 - RNA, 23 nt, Yersinia pestis
auucagcguauugugauucauac

SEQ ID NO: 4132531 - RNA, 16 nt, Yersinia pestis
auucagcgucagucaa

SEQ ID NO: 4132532 - RNA, 21 nt, Yersinia pestis
auucagcgucagucaaugagc

SEQ ID NO: 4132533 - RNA, 15 nt, Yersinia pestis
auucagcucugccag

SEQ ID NO: 4132534 - RNA, 15 nt, Yersinia pestis
auucaguaacaacau

SEQ ID NO: 4132535 - RNA, 17 nt, Yersinia pestis
auucaguacauaaaccg

SEQ ID NO: 4132536 - RNA, 20 nt, Yersinia pestis
auucagucaaucgcucuuca

SEQ ID NO: 4132537 - RNA, 13 nt, Yersinia pestis
auucauaaaaaaa

SEQ ID NO: 4132538 - RNA, 14 nt, Yersinia pestis
auucauaguuaaga

SEQ ID NO: 4132539 - RNA, 17 nt, Yersinia pestis
auucauaugacaaauaa

SEQ ID NO: 4132540 - RNA, 17 nt, Yersinia pestis
auucauaugcgcgucaa

SEQ ID NO: 4132541 - RNA, 12 nt, Yersinia pestis
auucaucaccag

SEQ ID NO: 4132542 - RNA, 14 nt, Yersinia pestis
auucaucagcaauu

SEQ ID NO: 4132543 - RNA, 18 nt, Yersinia pestis
auucaucggcgucaaggu

SEQ ID NO: 4132544 - RNA, 13 nt, Yersinia pestis
auucaugaggcuc

SEQ ID NO: 4132545 - RNA, 17 nt, Yersinia pestis
auucaugaggcucagac

SEQ ID NO: 4132546 - RNA, 15 nt, Yersinia pestis
auucaugcaucucca

SEQ ID NO: 4132547 - RNA, 16 nt, Yersinia pestis
auucaugcuaauacca

SEQ ID NO: 4132548 - RNA, 22 nt, Yersinia pestis
auucaugcuaauaccacaacau

SEQ ID NO: 4132549 - RNA, 16 nt, Yersinia pestis
auucaugguuucaaaa

SEQ ID NO: 4132550 - RNA, 21 nt, Yersinia pestis
auucauuagccagccaauggc

SEQ ID NO: 4132551 - RNA, 16 nt, Yersinia pestis
auucauuuuaaaaaaa

SEQ ID NO: 4132552 - RNA, 17 nt, Yersinia pestis
auugcccgcguaaucuc

SEQ ID NO: 4132553 - RNA, 16 nt, Yersinia pestis
auugcccgguaacaua

SEQ ID NO: 4132554 - RNA, 20 nt, Yersinia pestis
auugccgcagauaaaucugu

SEQ ID NO: 4132555 - RNA, 23 nt, Yersinia pestis
auugccgcauacaccuucuuaau

SEQ ID NO: 4132556 - RNA, 16 nt, Yersinia pestis
auugccuggcccaucu

SEQ ID NO: 4132557 - RNA, 16 nt, Yersinia pestis
auugccuucuccuuuc

SEQ ID NO: 4132558 - RNA, 22 nt, Yersinia pestis
auugcgagucucaucaaggaaa

SEQ ID NO: 4132559 - RNA, 16 nt, Yersinia pestis
auugcgcuaacagcgu

SEQ ID NO: 4132560 - RNA, 14 nt, Yersinia pestis
auugcggaguaaca

SEQ ID NO: 4132561 - RNA, 15 nt, Yersinia pestis
auugcggcaaccaaa

SEQ ID NO: 4132562 - RNA, 19 nt, Yersinia pestis
auugcggccaguauccaga

SEQ ID NO: 4132563 - RNA, 21 nt, Yersinia pestis
auugcguaauuacccaagauc

SEQ ID NO: 4132564 - RNA, 22 nt, Yersinia pestis
auugcguguagcgggagauaga

SEQ ID NO: 4132565 - RNA, 20 nt, Yersinia pestis
auugcguuaguccacccagc

SEQ ID NO: 4132566 - RNA, 15 nt, Yersinia pestis
auugcguucaauaca

SEQ ID NO: 4132567 - RNA, 23 nt, Yersinia pestis
auugcuaaauuuuguacaacuuc

SEQ ID NO: 4132568 - RNA, 20 nt, Yersinia pestis
auugcucacgcguaaaugga

SEQ ID NO: 4132569 - RNA, 15 nt, Yersinia pestis
auugcucagggccac

SEQ ID NO: 4132570 - RNA, 13 nt, Yersinia pestis
auugcucaucaac

SEQ ID NO: 4132571 - RNA, 19 nt, Yersinia pestis
auugcuccuuacuauuuuc

SEQ ID NO: 4132572 - RNA, 20 nt, Yersinia pestis
auugcuccuuacuauuuuca

SEQ ID NO: 4132573 - RNA, 21 nt, Yersinia pestis
auugcucuggauagcagagaa

SEQ ID NO: 4132574 - RNA, 13 nt, Yersinia pestis
auugcugaguaaa

SEQ ID NO: 4132575 - RNA, 16 nt, Yersinia pestis
auugcugaugucauuc

SEQ ID NO: 4132576 - RNA, 18 nt, Yersinia pestis
auugcugcuguuauuacu

SEQ ID NO: 4132577 - RNA, 23 nt, Yersinia pestis
auugcugcuguuauuacugucau

SEQ ID NO: 4132578 - RNA, 21 nt, Yersinia pestis
auugcuggcggucacgcugau

SEQ ID NO: 4132579 - RNA, 18 nt, Yersinia pestis
auugcuguuguuauuacu

SEQ ID NO: 4132580 - RNA, 22 nt, Yersinia pestis
auugcuguuguuauuacuguca

SEQ ID NO: 4132581 - RNA, 22 nt, Yersinia pestis
auugcuuaccacuggccuccca

SEQ ID NO: 4132582 - RNA, 23 nt, Yersinia pestis
auuggaaguacuuauuugaaaca

SEQ ID NO: 4132583 - RNA, 13 nt, Yersinia pestis
auuggagucauga

SEQ ID NO: 4132584 - RNA, 23 nt, Yersinia pestis
auuggauaauuugccuggcgaau

SEQ ID NO: 4132585 - RNA, 16 nt, Yersinia pestis
auuggcaaaggccagc

SEQ ID NO: 4132586 - RNA, 13 nt, Yersinia pestis
auuggcuccccuu

SEQ ID NO: 4132587 - RNA, 17 nt, Yersinia pestis
auuggcuccuauagcuc

SEQ ID NO: 4132588 - RNA, 14 nt, Yersinia pestis
auuggcuucaacuu

SEQ ID NO: 4132589 - RNA, 22 nt, Yersinia pestis
auuggcuucuaccguaucagcc

SEQ ID NO: 4132590 - RNA, 23 nt, Yersinia pestis
auugggcucuucgccaguucauu

SEQ ID NO: 4132591 - RNA, 21 nt, Yersinia pestis
auuggucaugaugaauacgau

SEQ ID NO: 4132592 - RNA, 14 nt, Yersinia pestis
auugguuaacuuau

SEQ ID NO: 4132593 - RNA, 22 nt, Yersinia pestis
auugguuauccuauucagcagc

SEQ ID NO: 4132594 - RNA, 17 nt, Yersinia pestis
auugguuuauaacaagg

SEQ ID NO: 4132595 - RNA, 16 nt, Yersinia pestis
auuguaacucuuguua

SEQ ID NO: 4132596 - RNA, 15 nt, Yersinia pestis
auuguauaaaacacc

SEQ ID NO: 4132597 - RNA, 13 nt, Yersinia pestis
auugucaaucacu

SEQ ID NO: 4132598 - RNA, 13 nt, Yersinia pestis
auugucacagacg

SEQ ID NO: 4132599 - RNA, 22 nt, Yersinia pestis
auugucacccacuaauggguua

SEQ ID NO: 4132600 - RNA, 15 nt, Yersinia pestis
auuguccaaaggaag

SEQ ID NO: 4132601 - RNA, 16 nt, Yersinia pestis
auuguccaaaggaagg

SEQ ID NO: 4132602 - RNA, 15 nt, Yersinia pestis
auugucuccaucccu

SEQ ID NO: 4132603 - RNA, 15 nt, Yersinia pestis
auugucuuuaauaaa

SEQ ID NO: 4132604 - RNA, 13 nt, Yersinia pestis
auugugcggcugg

SEQ ID NO: 4132605 - RNA, 17 nt, Yersinia pestis
auuguggcuaaacccaa

SEQ ID NO: 4132606 - RNA, 14 nt, Yersinia pestis
auugugucaauacc

SEQ ID NO: 4132607 - RNA, 17 nt, Yersinia pestis
auuguuaccuaaccaaa

SEQ ID NO: 4132608 - RNA, 21 nt, Yersinia pestis
auuguuaccuaaccaaacauu

SEQ ID NO: 4132609 - RNA, 21 nt, Yersinia pestis
auuguucaauaggccagcaau

SEQ ID NO: 4132610 - RNA, 16 nt, Yersinia pestis
auuguucuuacuguuu

SEQ ID NO: 4132611 - RNA, 17 nt, Yersinia pestis
auuguugcucaacauau

SEQ ID NO: 4132612 - RNA, 12 nt, Yersinia pestis
auuguuugcuuu

SEQ ID NO: 4132613 - RNA, 20 nt, Yersinia pestis
auuguuuggucgguaagcug

SEQ ID NO: 4132614 - RNA, 20 nt, Yersinia pestis
auuguuuucguuuaaaaaau

SEQ ID NO: 4132615 - RNA, 16 nt, Yersinia pestis
auuguuuugacuaaaa

SEQ ID NO: 4132616 - RNA, 17 nt, Yersinia pestis
auuguuuugacuaaaau

SEQ ID NO: 4132617 - RNA, 12 nt, Yersinia pestis
auuuaaaauacu

SEQ ID NO: 4132618 - RNA, 14 nt, Yersinia pestis
auuuaaacacucaa

SEQ ID NO: 4132619 - RNA, 12 nt, Yersinia pestis
auuuaaaguaaa

SEQ ID NO: 4132620 - RNA, 19 nt, Yersinia pestis
auuuaaaguuuuuuauuua

SEQ ID NO: 4132621 - RNA, 20 nt, Yersinia pestis
auuuaaaguuuuuuauuuau

SEQ ID NO: 4132622 - RNA, 16 nt, Yersinia pestis
auuuaaauaacagcua

SEQ ID NO: 4132623 - RNA, 19 nt, Yersinia pestis
auuuaaauuacagacaaau

SEQ ID NO: 4132624 - RNA, 23 nt, Yersinia pestis
auuuaaauuacagacaaaucaca

SEQ ID NO: 4132625 - RNA, 12 nt, Yersinia pestis
auuuaacaaaaa

SEQ ID NO: 4132626 - RNA, 18 nt, Yersinia pestis
auuuaagcugaaauuuuu

SEQ ID NO: 4132627 - RNA, 13 nt, Yersinia pestis
auuuaauccaacg

SEQ ID NO: 4132628 - RNA, 15 nt, Yersinia pestis
auuuaaugguuucca

SEQ ID NO: 4132629 - RNA, 11 nt, Yersinia pestis
auuuaauuaaa

SEQ ID NO: 4132630 - RNA, 13 nt, Yersinia pestis
auuuaauuaaaug

SEQ ID NO: 4132631 - RNA, 20 nt, Yersinia pestis
auuuaauuaaauguauaaaa

SEQ ID NO: 4132632 - RNA, 17 nt, Yersinia pestis
auuuaauuuaaauaaaa

SEQ ID NO: 4132633 - RNA, 20 nt, Yersinia pestis
auuuaauuuaaauaaaauaa

SEQ ID NO: 4132634 - RNA, 19 nt, Yersinia pestis
auuuaauuuaugauuaaau

SEQ ID NO: 4132635 - RNA, 11 nt, Yersinia pestis
auuuacaaacc

SEQ ID NO: 4132636 - RNA, 13 nt, Yersinia pestis
auuuacaaaccac

SEQ ID NO: 4132637 - RNA, 14 nt, Yersinia pestis
auuuacaaaccaua

SEQ ID NO: 4132638 - RNA, 13 nt, Yersinia pestis
auuuacaaauaac

SEQ ID NO: 4132639 - RNA, 20 nt, Yersinia pestis
auuuacaccgugcaauagcu

SEQ ID NO: 4132640 - RNA, 21 nt, Yersinia pestis
auuuacaccgugcaauagcua

SEQ ID NO: 4132641 - RNA, 16 nt, Yersinia pestis
auuuacauaauaacca

SEQ ID NO: 4132642 - RNA, 23 nt, Yersinia pestis
auuuacauaauaaccauuuauau

SEQ ID NO: 4132643 - RNA, 12 nt, Yersinia pestis
auuuaccacuau

SEQ ID NO: 4132644 - RNA, 15 nt, Yersinia pestis
auuuaccgacagcau

SEQ ID NO: 4132645 - RNA, 17 nt, Yersinia pestis
auuuaccuccauauccu

SEQ ID NO: 4132646 - RNA, 12 nt, Yersinia pestis
auuuaccugcuc

SEQ ID NO: 4132647 - RNA, 18 nt, Yersinia pestis
auuuaccugcucaacugc

SEQ ID NO: 4132648 - RNA, 19 nt, Yersinia pestis
auuuaccugcucaacugcu

SEQ ID NO: 4132649 - RNA, 22 nt, Yersinia pestis
auuuagaagccucgucuuuuga

SEQ ID NO: 4132650 - RNA, 13 nt, Yersinia pestis
auuuagacucugc

SEQ ID NO: 4132651 - RNA, 23 nt, Yersinia pestis
auuuagcauuauucuucaccacg

SEQ ID NO: 4132652 - RNA, 17 nt, Yersinia pestis
auuuagcuggcugaacg

SEQ ID NO: 4132653 - RNA, 16 nt, Yersinia pestis
auuuaggguauagcau

SEQ ID NO: 4132654 - RNA, 14 nt, Yersinia pestis
auuuauaaaaccac

SEQ ID NO: 4132655 - RNA, 15 nt, Yersinia pestis
auuuauaaaaccacu

SEQ ID NO: 4132656 - RNA, 16 nt, Yersinia pestis
auuuauaaaaccacug

SEQ ID NO: 4132657 - RNA, 22 nt, Yersinia pestis
auuuauaaaaccacugaccuau

SEQ ID NO: 4132658 - RNA, 14 nt, Yersinia pestis
auuuauaaacaauc

SEQ ID NO: 4132659 - RNA, 21 nt, Yersinia pestis
auuuauagaauacaggguaaa

SEQ ID NO: 4132660 - RNA, 19 nt, Yersinia pestis
auuuauagguauacaccuc

SEQ ID NO: 4132661 - RNA, 16 nt, Yersinia pestis
auuuauauaaggucaa

SEQ ID NO: 4132662 - RNA, 16 nt, Yersinia pestis
auuuauauaguaacua

SEQ ID NO: 4132663 - RNA, 14 nt, Yersinia pestis
auuuaucaguagcu

SEQ ID NO: 4132664 - RNA, 14 nt, Yersinia pestis
auuuaucauaaaua

SEQ ID NO: 4132665 - RNA, 18 nt, Yersinia pestis
auuuaucccgagcuaacg

SEQ ID NO: 4132666 - RNA, 17 nt, Yersinia pestis
auuuaucgccaacauaa

SEQ ID NO: 4132667 - RNA, 20 nt, Yersinia pestis
auuuaucgccaagccaguaa

SEQ ID NO: 4132668 - RNA, 19 nt, Yersinia pestis
auuuaucgcuguuuacuga

SEQ ID NO: 4132669 - RNA, 21 nt, Yersinia pestis
auuuaucugcauuaaaauaac

SEQ ID NO: 4132670 - RNA, 13 nt, Yersinia pestis
auuuaugcaccaa

SEQ ID NO: 4132671 - RNA, 23 nt, Yersinia pestis
auuuaugcaccaaauucagaaug

SEQ ID NO: 4132672 - RNA, 14 nt, Yersinia pestis
auuuauuaaaacac

SEQ ID NO: 4132673 - RNA, 17 nt, Yersinia pestis
auuuauuaaaacacauc

SEQ ID NO: 4132674 - RNA, 22 nt, Yersinia pestis
auuuuacuguucugggggugau

SEQ ID NO: 4132675 - RNA, 21 nt, Yersinia pestis
auuuuauaaugagaauguaaa

SEQ ID NO: 4132676 - RNA, 16 nt, Yersinia pestis
auuuuauauugauaaa

SEQ ID NO: 4132677 - RNA, 16 nt, Yersinia pestis
auuuuaucgugaauaa

SEQ ID NO: 4132678 - RNA, 20 nt, Yersinia pestis
auuuuaucgugaauaaaaau

SEQ ID NO: 4132679 - RNA, 22 nt, Yersinia pestis
auuuuaucgugaauaaaaauaa

SEQ ID NO: 4132680 - RNA, 15 nt, Yersinia pestis
auuuuaugcccccua

SEQ ID NO: 4132681 - RNA, 21 nt, Yersinia pestis
auuuuaugcccccuauuaugc

SEQ ID NO: 4132682 - RNA, 16 nt, Yersinia pestis
auuuucaugauccaca

SEQ ID NO: 4132683 - RNA, 21 nt, Yersinia pestis
auuuucccagugcguacgcca

SEQ ID NO: 4132684 - RNA, 15 nt, Yersinia pestis
auuuucccugugcaa

SEQ ID NO: 4132685 - RNA, 19 nt, Yersinia pestis
auuuucccugugcaaucaa

SEQ ID NO: 4132686 - RNA, 19 nt, Yersinia pestis
auuuuccgcagcucaccua

SEQ ID NO: 4132687 - RNA, 22 nt, Yersinia pestis
auuuuccugcauauuauuuugc

SEQ ID NO: 4132688 - RNA, 22 nt, Yersinia pestis
auuuucgaacuuaacuacugca

SEQ ID NO: 4132689 - RNA, 12 nt, Yersinia pestis
auuuucggguau

SEQ ID NO: 4132690 - RNA, 16 nt, Yersinia pestis
auuuucggguaucugu

SEQ ID NO: 4132691 - RNA, 19 nt, Yersinia pestis
auuuucggucauacacaug

SEQ ID NO: 4132692 - RNA, 22 nt, Yersinia pestis
auuuucguggaaaucgggugau

SEQ ID NO: 4132693 - RNA, 14 nt, Yersinia pestis
auuuucuauaccaa

SEQ ID NO: 4132694 - RNA, 18 nt, Yersinia pestis
auuuucuauaccaauuga

SEQ ID NO: 4132695 - RNA, 23 nt, Yersinia pestis
auuuucuaucucauccagcaacu

SEQ ID NO: 4132696 - RNA, 19 nt, Yersinia pestis
auuuucugauguguauauu

SEQ ID NO: 4132697 - RNA, 23 nt, Yersinia pestis
auuuucugugauuacgucugcau

SEQ ID NO: 4132698 - RNA, 12 nt, Yersinia pestis
auuuugcagcgc

SEQ ID NO: 4132699 - RNA, 15 nt, Yersinia pestis
auuuugcggaucaca

SEQ ID NO: 4132700 - RNA, 17 nt, Yersinia pestis
auuuuggaguauacauu

SEQ ID NO: 4132701 - RNA, 20 nt, Yersinia pestis
auuuuggguauauacucugu

SEQ ID NO: 4132702 - RNA, 17 nt, Yersinia pestis
auuuugggugaacacag

SEQ ID NO: 4132703 - RNA, 18 nt, Yersinia pestis
auuuuguacaacuucuuc

SEQ ID NO: 4132704 - RNA, 16 nt, Yersinia pestis
auuuuguagcccacug

SEQ ID NO: 4132705 - RNA, 20 nt, Yersinia pestis
auuuuguaucaguguugcaa

SEQ ID NO: 4132706 - RNA, 12 nt, Yersinia pestis
auuuugugggaa

SEQ ID NO: 4132707 - RNA, 11 nt, Yersinia pestis
auuuuuacauu

SEQ ID NO: 4132708 - RNA, 13 nt, Yersinia pestis
auuuuuacauucc

SEQ ID NO: 4132709 - RNA, 19 nt, Yersinia pestis
auuuuuacgauaucaccag

SEQ ID NO: 4132710 - RNA, 22 nt, Yersinia pestis
auuuuuaguauuggaaaaauca

SEQ ID NO: 4132711 - RNA, 13 nt, Yersinia pestis
auuuuuauaauca

SEQ ID NO: 4132712 - RNA, 18 nt, Yersinia pestis
auuuuuauaaucaucuac

SEQ ID NO: 4132713 - RNA, 13 nt, Yersinia pestis
auuuuuauauuuu

SEQ ID NO: 4132714 - RNA, 18 nt, Yersinia pestis
auuuuuaucaauggggau

SEQ ID NO: 4132715 - RNA, 12 nt, Yersinia pestis
auuuuuaugguu

SEQ ID NO: 4132716 - RNA, 16 nt, Yersinia pestis
auuuuuaugguuuuua

SEQ ID NO: 4132717 - RNA, 14 nt, Yersinia pestis
auuuuucgcaguaa

SEQ ID NO: 4132718 - RNA, 22 nt, Yersinia pestis
auuuuucuccgauucaccuuga

SEQ ID NO: 4132719 - RNA, 20 nt, Yersinia pestis
auuuuucuguaucgaauuga

SEQ ID NO: 4132720 - RNA, 21 nt, Yersinia pestis
auuuuucuguaucgaauugau

SEQ ID NO: 4132721 - RNA, 20 nt, Yersinia pestis
auuuuugacuuuaauuaaaa

SEQ ID NO: 4132722 - RNA, 19 nt, Yersinia pestis
auuuuugcauauaaaacac

SEQ ID NO: 4132723 - RNA, 21 nt, Yersinia pestis
auuuuugcuuguuauuuuaau

SEQ ID NO: 4132724 - RNA, 14 nt, Yersinia pestis
auuuuuuaccauua

SEQ ID NO: 4132725 - RNA, 14 nt, Yersinia pestis
auuuuuuguagguu

SEQ ID NO: 4132726 - RNA, 15 nt, Yersinia pestis
auuuuuuguuuuuau

SEQ ID NO: 4132727 - RNA, 17 nt, Yersinia pestis
auuuuuuucaugguaaa

SEQ ID NO: 4132728 - RNA, 15 nt, Yersinia pestis
caaaaaaaaagccug

SEQ ID NO: 4132729 - RNA, 20 nt, Yersinia pestis
caaaaaaacugacugccaua

SEQ ID NO: 4132730 - RNA, 13 nt, Yersinia pestis
caaaaaacaaacc

SEQ ID NO: 4132731 - RNA, 11 nt, Yersinia pestis
caaaaaauaaa

SEQ ID NO: 4132732 - RNA, 12 nt, Yersinia pestis
caaaaaauaagg

SEQ ID NO: 4132733 - RNA, 20 nt, Yersinia pestis
caaaaaauauuaauccauag

SEQ ID NO: 4132734 - RNA, 13 nt, Yersinia pestis
caaaaacaaauaa

SEQ ID NO: 4132735 - RNA, 21 nt, Yersinia pestis
caaaaacccauuaaaaacaaa

SEQ ID NO: 4132736 - RNA, 15 nt, Yersinia pestis
caaaaaguuaaauau

SEQ ID NO: 4132737 - RNA, 20 nt, Yersinia pestis
caaaaauaaacgggcuucca

SEQ ID NO: 4132738 - RNA, 21 nt, Yersinia pestis
caaaacaauaucuauuugagu

SEQ ID NO: 4132739 - RNA, 12 nt, Yersinia pestis
caaaacagccua

SEQ ID NO: 4132740 - RNA, 18 nt, Yersinia pestis
caaaacagccuaaggcca

SEQ ID NO: 4132741 - RNA, 14 nt, Yersinia pestis
caaaaccauuggaa

SEQ ID NO: 4132742 - RNA, 20 nt, Yersinia pestis
caaaaccguacugauaucuu

SEQ ID NO: 4132743 - RNA, 14 nt, Yersinia pestis
caaaacgaacaaaa

SEQ ID NO: 4132744 - RNA, 18 nt, Yersinia pestis
caaaacgacgggcugcug

SEQ ID NO: 4132745 - RNA, 14 nt, Yersinia pestis
caaaacgcgcgcca

SEQ ID NO: 4132746 - RNA, 18 nt, Yersinia pestis
caaaacucacaaaauaac

SEQ ID NO: 4132747 - RNA, 19 nt, Yersinia pestis
caaaacucaggugaguaaa

SEQ ID NO: 4132748 - RNA, 17 nt, Yersinia pestis
caaaacucccuguuacg

SEQ ID NO: 4132749 - RNA, 15 nt, Yersinia pestis
caaaacugaagcaag

SEQ ID NO: 4132750 - RNA, 18 nt, Yersinia pestis
caaaacugaugguuuccu

SEQ ID NO: 4132751 - RNA, 13 nt, Yersinia pestis
caaaagaaucagu

SEQ ID NO: 4132752 - RNA, 13 nt, Yersinia pestis
caaaagauaaucu

SEQ ID NO: 4132753 - RNA, 17 nt, Yersinia pestis
caaaagcaaguuaggua

SEQ ID NO: 4132754 - RNA, 14 nt, Yersinia pestis
caaaagcaucacca

SEQ ID NO: 4132755 - RNA, 16 nt, Yersinia pestis
caaaagcaucaccaaa

SEQ ID NO: 4132756 - RNA, 17 nt, Yersinia pestis
caaaagcaucaccaaag

SEQ ID NO: 4132757 - RNA, 23 nt, Yersinia pestis
caaaagcauccaauaccaccaau

SEQ ID NO: 4132758 - RNA, 20 nt, Yersinia pestis
caaaagccucuugcgcucca

SEQ ID NO: 4132759 - RNA, 14 nt, Yersinia pestis
caaaaggauggccc

SEQ ID NO: 4132760 - RNA, 18 nt, Yersinia pestis
caaaaggugcaagcagcu

SEQ ID NO: 4132761 - RNA, 13 nt, Yersinia pestis
caaaagucauguu

SEQ ID NO: 4132762 - RNA, 23 nt, Yersinia pestis
caaaaguuaggguucaguaaaac

SEQ ID NO: 4132763 - RNA, 12 nt, Yersinia pestis
caaaauaaaaau

SEQ ID NO: 4132764 - RNA, 19 nt, Yersinia pestis
caaaauaauaauucugcua

SEQ ID NO: 4132765 - RNA, 14 nt, Yersinia pestis
caaaauaauauaau

SEQ ID NO: 4132766 - RNA, 23 nt, Yersinia pestis
caaaauagggccguuuaccuugu

SEQ ID NO: 4132767 - RNA, 15 nt, Yersinia pestis
caaaauagggcgccc

SEQ ID NO: 4132768 - RNA, 21 nt, Yersinia pestis
caaaauaucgcgcuucagguc

SEQ ID NO: 4132769 - RNA, 20 nt, Yersinia pestis
caaaauaugauaguguaaaa

SEQ ID NO: 4132770 - RNA, 22 nt, Yersinia pestis
caaaauauucgcauugugcuuu

SEQ ID NO: 4132771 - RNA, 16 nt, Yersinia pestis
caaaaucaccuggcca

SEQ ID NO: 4132772 - RNA, 15 nt, Yersinia pestis
caaaauccaccagcg

SEQ ID NO: 4132773 - RNA, 18 nt, Yersinia pestis
caaaaucccaaaauauga

SEQ ID NO: 4132774 - RNA, 20 nt, Yersinia pestis
caaaaugccguacaacaaua

SEQ ID NO: 4132775 - RNA, 23 nt, Yersinia pestis
caaaauuaugccagucuuccaug

SEQ ID NO: 4132776 - RNA, 20 nt, Yersinia pestis
caaaauugagauaacgcuga

SEQ ID NO: 4132777 - RNA, 22 nt, Yersinia pestis
caaaauugagauaacgcugaug

SEQ ID NO: 4132778 - RNA, 14 nt, Yersinia pestis
caaacaaacgcuug

SEQ ID NO: 4132779 - RNA, 17 nt, Yersinia pestis
caaacaaccuaaaaaaa

SEQ ID NO: 4132780 - RNA, 19 nt, Yersinia pestis
caaacaaccuaaaaaaaac

SEQ ID NO: 4132781 - RNA, 17 nt, Yersinia pestis
caaacaccgcacguuua

SEQ ID NO: 4132782 - RNA, 19 nt, Yersinia pestis
caaacaccgcacguuuaaa

SEQ ID NO: 4132783 - RNA, 14 nt, Yersinia pestis
caaacagauacauc

SEQ ID NO: 4132784 - RNA, 21 nt, Yersinia pestis
caaacagccgaucaacccgca

SEQ ID NO: 4132785 - RNA, 18 nt, Yersinia pestis
caaacagcuucgccacca

SEQ ID NO: 4132786 - RNA, 23 nt, Yersinia pestis
caaacaguaagauaggccaccuc

SEQ ID NO: 4132787 - RNA, 19 nt, Yersinia pestis
caaacaguucauaucgaua

SEQ ID NO: 4132788 - RNA, 17 nt, Yersinia pestis
caaacauugucaccuga

SEQ ID NO: 4132789 - RNA, 17 nt, Yersinia pestis
caaacauuuucaucuga

SEQ ID NO: 4132790 - RNA, 19 nt, Yersinia pestis
caaaccacauuuuuuaaaa

SEQ ID NO: 4132791 - RNA, 21 nt, Yersinia pestis
caaaccacucuuuuuucauag

SEQ ID NO: 4132792 - RNA, 15 nt, Yersinia pestis
caaaccagcccuguu

SEQ ID NO: 4132793 - RNA, 16 nt, Yersinia pestis
caaaccaucgcucucc

SEQ ID NO: 4132794 - RNA, 11 nt, Yersinia pestis
caaaccauggg

SEQ ID NO: 4132795 - RNA, 21 nt, Yersinia pestis
caaaccauuuuacuaaaccag

SEQ ID NO: 4132796 - RNA, 15 nt, Yersinia pestis
caacaacggugaaca

SEQ ID NO: 4132797 - RNA, 17 nt, Yersinia pestis
caacaacggugaacaga

SEQ ID NO: 4132798 - RNA, 12 nt, Yersinia pestis
caacaagccucg

SEQ ID NO: 4132799 - RNA, 15 nt, Yersinia pestis
caacaauuuccauau

SEQ ID NO: 4132800 - RNA, 13 nt, Yersinia pestis
caacacaaaaacc

SEQ ID NO: 4132801 - RNA, 19 nt, Yersinia pestis
caacacacuuagcuaagcu

SEQ ID NO: 4132802 - RNA, 14 nt, Yersinia pestis
caacaccacacuga

SEQ ID NO: 4132803 - RNA, 20 nt, Yersinia pestis
caacaccacacugagcaccg

SEQ ID NO: 4132804 - RNA, 15 nt, Yersinia pestis
caacaccguaacgcc

SEQ ID NO: 4132805 - RNA, 19 nt, Yersinia pestis
caacacggugaauaaaccc

SEQ ID NO: 4132806 - RNA, 14 nt, Yersinia pestis
caacacuagcugcc

SEQ ID NO: 4132807 - RNA, 23 nt, Yersinia pestis
caacacuccucuuucuuaauaau

SEQ ID NO: 4132808 - RNA, 19 nt, Yersinia pestis
caacacuggggcgcagaga

SEQ ID NO: 4132809 - RNA, 14 nt, Yersinia pestis
caacacuucuggcc

SEQ ID NO: 4132810 - RNA, 20 nt, Yersinia pestis
caacacuucuggccgcucuu

SEQ ID NO: 4132811 - RNA, 20 nt, Yersinia pestis
caacacuuuuaaggaacggg

SEQ ID NO: 4132812 - RNA, 16 nt, Yersinia pestis
caacagacucacucuc

SEQ ID NO: 4132813 - RNA, 22 nt, Yersinia pestis
caacagauaugcauuauugaug

SEQ ID NO: 4132814 - RNA, 21 nt, Yersinia pestis
caacagaugaugauuuuuaca

SEQ ID NO: 4132815 - RNA, 15 nt, Yersinia pestis
caacagcauuaccaa

SEQ ID NO: 4132816 - RNA, 18 nt, Yersinia pestis
caacagcgcucauagcaa

SEQ ID NO: 4132817 - RNA, 13 nt, Yersinia pestis
caacaggccaccu

SEQ ID NO: 4132818 - RNA, 18 nt, Yersinia pestis
caacaguaaaccggcuaa

SEQ ID NO: 4132819 - RNA, 13 nt, Yersinia pestis
caacagucaauau

SEQ ID NO: 4132820 - RNA, 19 nt, Yersinia pestis
caacagucacaccaacacu

SEQ ID NO: 4132821 - RNA, 21 nt, Yersinia pestis
caacagugcaacauuaaaaau

SEQ ID NO: 4132822 - RNA, 20 nt, Yersinia pestis
caacagugcucgcaaacgau

SEQ ID NO: 4132823 - RNA, 21 nt, Yersinia pestis
caacagugcucgcaaacgauc

SEQ ID NO: 4132824 - RNA, 14 nt, Yersinia pestis
caacauaaguaaua

SEQ ID NO: 4132825 - RNA, 17 nt, Yersinia pestis
caacauaaguaauaagu

SEQ ID NO: 4132826 - RNA, 18 nt, Yersinia pestis
caacauaguugaauaacu

SEQ ID NO: 4132827 - RNA, 14 nt, Yersinia pestis
caacaucaaaugaa

SEQ ID NO: 4132828 - RNA, 13 nt, Yersinia pestis
caacaucaauggc

SEQ ID NO: 4132829 - RNA, 19 nt, Yersinia pestis
caacaucaauggcaccuca

SEQ ID NO: 4132830 - RNA, 13 nt, Yersinia pestis
caacaucacaucc

SEQ ID NO: 4132831 - RNA, 15 nt, Yersinia pestis
caacaucauauauua

SEQ ID NO: 4132832 - RNA, 15 nt, Yersinia pestis
caacauccaguucga

SEQ ID NO: 4132833 - RNA, 21 nt, Yersinia pestis
caacaucgcuugugcuacauc

SEQ ID NO: 4132834 - RNA, 12 nt, Yersinia pestis
caacaucuucca

SEQ ID NO: 4132835 - RNA, 16 nt, Yersinia pestis
caacaugagccacaca

SEQ ID NO: 4132836 - RNA, 13 nt, Yersinia pestis
caacauuaaaaau

SEQ ID NO: 4132837 - RNA, 15 nt, Yersinia pestis
caacauuaaaaauac

SEQ ID NO: 4132838 - RNA, 17 nt, Yersinia pestis
caacauuaaaaauacaa

SEQ ID NO: 4132839 - RNA, 13 nt, Yersinia pestis
caacauuccauac

SEQ ID NO: 4132840 - RNA, 18 nt, Yersinia pestis
caacauuuauuuaucgcc

SEQ ID NO: 4132841 - RNA, 15 nt, Yersinia pestis
caacauuuguugcaa

SEQ ID NO: 4132842 - RNA, 14 nt, Yersinia pestis
caacauuuuuagcu

SEQ ID NO: 4132843 - RNA, 20 nt, Yersinia pestis
caaccaaacggcccucauua

SEQ ID NO: 4132844 - RNA, 18 nt, Yersinia pestis
caaccaacaaacaauccu

SEQ ID NO: 4132845 - RNA, 13 nt, Yersinia pestis
caaccaacaccaa

SEQ ID NO: 4132846 - RNA, 17 nt, Yersinia pestis
caaccaacacuccucuu

SEQ ID NO: 4132847 - RNA, 18 nt, Yersinia pestis
caaccaaucguugcuggu

SEQ ID NO: 4132848 - RNA, 20 nt, Yersinia pestis
caaccacgaagagcgccuca

SEQ ID NO: 4132849 - RNA, 18 nt, Yersinia pestis
caaccacgguaauagcuu

SEQ ID NO: 4132850 - RNA, 20 nt, Yersinia pestis
caaccacgucuacgcucucc

SEQ ID NO: 4132851 - RNA, 16 nt, Yersinia pestis
caaccacuuauccagc

SEQ ID NO: 4132852 - RNA, 19 nt, Yersinia pestis
caaccacuuauccagcuca

SEQ ID NO: 4132853 - RNA, 19 nt, Yersinia pestis
caaccauccgcccaauacg

SEQ ID NO: 4132854 - RNA, 17 nt, Yersinia pestis
caaccauuguggcuaaa

SEQ ID NO: 4132855 - RNA, 22 nt, Yersinia pestis
caacccagacaagaaugccugc

SEQ ID NO: 4132856 - RNA, 17 nt, Yersinia pestis
caaccccaucagcauau

SEQ ID NO: 4132857 - RNA, 17 nt, Yersinia pestis
caacccccgaacacucg

SEQ ID NO: 4132858 - RNA, 23 nt, Yersinia pestis
caaccccuaauccagcagccucu

SEQ ID NO: 4132859 - RNA, 16 nt, Yersinia pestis
caacccgcacguucag

SEQ ID NO: 4132860 - RNA, 20 nt, Yersinia pestis
caacccgccccccaucaacg

SEQ ID NO: 4132861 - RNA, 14 nt, Yersinia pestis
caacccgcugaugc

SEQ ID NO: 4132862 - RNA, 18 nt, Yersinia pestis
caaccgcagugauauaac

SEQ ID NO: 4132863 - RNA, 19 nt, Yersinia pestis
caaccgcuugcauacgcuu

SEQ ID NO: 4132864 - RNA, 21 nt, Yersinia pestis
caaccgcuugcauacgcuuaa

SEQ ID NO: 4132865 - RNA, 16 nt, Yersinia pestis
caaccggcgcuccagu

SEQ ID NO: 4132866 - RNA, 15 nt, Yersinia pestis
caaccguuaacgggc

SEQ ID NO: 4132867 - RNA, 18 nt, Yersinia pestis
caaccguuacgauaaucu

SEQ ID NO: 4132868 - RNA, 15 nt, Yersinia pestis
caaccuauauagccc

SEQ ID NO: 4132869 - RNA, 12 nt, Yersinia pestis
caaccucagccu

SEQ ID NO: 4132870 - RNA, 16 nt, Yersinia pestis
caaccucagccucauu

SEQ ID NO: 4132871 - RNA, 18 nt, Yersinia pestis
caaccucagccucauuca

SEQ ID NO: 4132872 - RNA, 17 nt, Yersinia pestis
caaccugacugcuggca

SEQ ID NO: 4132873 - RNA, 16 nt, Yersinia pestis
caaccugcgccaccca

SEQ ID NO: 4132874 - RNA, 18 nt, Yersinia pestis
caaccugguuaucggcca

SEQ ID NO: 4132875 - RNA, 18 nt, Yersinia pestis
caaccuguagcucauacu

SEQ ID NO: 4132876 - RNA, 19 nt, Yersinia pestis
caaccuguagcucauacuc

SEQ ID NO: 4132877 - RNA, 23 nt, Yersinia pestis
caaccuguuguggaauuaccaca

SEQ ID NO: 4132878 - RNA, 22 nt, Yersinia pestis
caaccuugggggaccagcacau

SEQ ID NO: 4132879 - RNA, 22 nt, Yersinia pestis
caaccuuuuccgccaugagaac

SEQ ID NO: 4132880 - RNA, 12 nt, Yersinia pestis
caacgaaaucac

SEQ ID NO: 4132881 - RNA, 21 nt, Yersinia pestis
caacgaaaugucgaaagauag

SEQ ID NO: 4132882 - RNA, 14 nt, Yersinia pestis
caacgacagcaaca

SEQ ID NO: 4132883 - RNA, 17 nt, Yersinia pestis
caacgacagcaacaaca

SEQ ID NO: 4132884 - RNA, 14 nt, Yersinia pestis
caacgacagccaaa

SEQ ID NO: 4132885 - RNA, 18 nt, Yersinia pestis
caacgauauagagcucag

SEQ ID NO: 4132886 - RNA, 13 nt, Yersinia pestis
caacgcacacccc

SEQ ID NO: 4132887 - RNA, 17 nt, Yersinia pestis
caacgcaccauccagca

SEQ ID NO: 4132888 - RNA, 16 nt, Yersinia pestis
caacgcagacaugauu

SEQ ID NO: 4132889 - RNA, 15 nt, Yersinia pestis
caacgccaauaccgg

SEQ ID NO: 4132890 - RNA, 15 nt, Yersinia pestis
caacgccagauaacg

SEQ ID NO: 4132891 - RNA, 22 nt, Yersinia pestis
caacgcccagcuuuuuacgcaa

SEQ ID NO: 4132892 - RNA, 22 nt, Yersinia pestis
caacgcccgcggccaauagcaa

SEQ ID NO: 4132893 - RNA, 16 nt, Yersinia pestis
caacgccucaucuuca

SEQ ID NO: 4132894 - RNA, 18 nt, Yersinia pestis
caacgcuaugcagcccag

SEQ ID NO: 4132895 - RNA, 18 nt, Yersinia pestis
caacgcucuaacgucaga

SEQ ID NO: 4132896 - RNA, 20 nt, Yersinia pestis
caacggagagaacaggcaga

SEQ ID NO: 4132897 - RNA, 15 nt, Yersinia pestis
caacggcacauccca

SEQ ID NO: 4132898 - RNA, 18 nt, Yersinia pestis
caacggcacaucccaaua

SEQ ID NO: 4132899 - RNA, 17 nt, Yersinia pestis
caacggcccaauauuga

SEQ ID NO: 4132900 - RNA, 19 nt, Yersinia pestis
caacgggguauuuaacccg

SEQ ID NO: 4132901 - RNA, 14 nt, Yersinia pestis
caacgguaaaaggu

SEQ ID NO: 4132902 - RNA, 16 nt, Yersinia pestis
caacgguaaaagguua

SEQ ID NO: 4132903 - RNA, 19 nt, Yersinia pestis
caacgguagguucaaccca

SEQ ID NO: 4132904 - RNA, 22 nt, Yersinia pestis
caacguaacaugcagcccgacc

SEQ ID NO: 4132905 - RNA, 24 nt, Yersinia pestis
caacguaauaucugccaccgcaca

SEQ ID NO: 4132906 - RNA, 19 nt, Yersinia pestis
caacgugauaugccugaag

SEQ ID NO: 4132907 - RNA, 15 nt, Yersinia pestis
caacgugguuuauuu

SEQ ID NO: 4132908 - RNA, 15 nt, Yersinia pestis
caacguuaaagauga

SEQ ID NO: 4132909 - RNA, 15 nt, Yersinia pestis
caacguuuuaccugc

SEQ ID NO: 4132910 - RNA, 16 nt, Yersinia pestis
caacuaaacagaucac

SEQ ID NO: 4132911 - RNA, 20 nt, Yersinia pestis
caacuaaacagggcagaaaa

SEQ ID NO: 4132912 - RNA, 22 nt, Yersinia pestis
caacuaaacagggcagaaaaua

SEQ ID NO: 4132913 - RNA, 17 nt, Yersinia pestis
caacuaauauuaagucu

SEQ ID NO: 4132914 - RNA, 18 nt, Yersinia pestis
caacuagcccacucagcc

SEQ ID NO: 4132915 - RNA, 22 nt, Yersinia pestis
caacuauugcaucuuuaauuaa

SEQ ID NO: 4132916 - RNA, 17 nt, Yersinia pestis
caacucagcggccuggg

SEQ ID NO: 4132917 - RNA, 19 nt, Yersinia pestis
caacucagggcuggcaccg

SEQ ID NO: 4132918 - RNA, 18 nt, Yersinia pestis
caaguuguggauccagca

SEQ ID NO: 4132919 - RNA, 15 nt, Yersinia pestis
caauaaaaacgccuc

SEQ ID NO: 4132920 - RNA, 19 nt, Yersinia pestis
caauaaaaccuuuauguaa

SEQ ID NO: 4132921 - RNA, 13 nt, Yersinia pestis
caauaaaacucac

SEQ ID NO: 4132922 - RNA, 21 nt, Yersinia pestis
caauaaacagacuaaaaaccg

SEQ ID NO: 4132923 - RNA, 13 nt, Yersinia pestis
caauaaacucaua

SEQ ID NO: 4132924 - RNA, 16 nt, Yersinia pestis
caauaaauauccuccg

SEQ ID NO: 4132925 - RNA, 15 nt, Yersinia pestis
caauaacaauauuca

SEQ ID NO: 4132926 - RNA, 22 nt, Yersinia pestis
caauaacaccgucuuugaccga

SEQ ID NO: 4132927 - RNA, 18 nt, Yersinia pestis
caauaaccgcagcaggca

SEQ ID NO: 4132928 - RNA, 20 nt, Yersinia pestis
caauaaccucaaaaggaugg

SEQ ID NO: 4132929 - RNA, 15 nt, Yersinia pestis
caauaaccucagccu

SEQ ID NO: 4132930 - RNA, 17 nt, Yersinia pestis
caauaaccucagccuca

SEQ ID NO: 4132931 - RNA, 21 nt, Yersinia pestis
caauaaccucagccucauuca

SEQ ID NO: 4132932 - RNA, 22 nt, Yersinia pestis
caauaaccucagccucauucau

SEQ ID NO: 4132933 - RNA, 22 nt, Yersinia pestis
caauaaccucagggcgucucua

SEQ ID NO: 4132934 - RNA, 20 nt, Yersinia pestis
caauaacggaaaaucaucgc

SEQ ID NO: 4132935 - RNA, 19 nt, Yersinia pestis
caauaacguccugaugaug

SEQ ID NO: 4132936 - RNA, 17 nt, Yersinia pestis
caauaacguuuaccgcu

SEQ ID NO: 4132937 - RNA, 13 nt, Yersinia pestis
caauaacuauuuu

SEQ ID NO: 4132938 - RNA, 23 nt, Yersinia pestis
caauaacuuuggguauaugacug

SEQ ID NO: 4132939 - RNA, 19 nt, Yersinia pestis
caauaagugaaacaaauac

SEQ ID NO: 4132940 - RNA, 14 nt, Yersinia pestis
caauaauaaaaaaa

SEQ ID NO: 4132941 - RNA, 19 nt, Yersinia pestis
caauaauaaaaaaaaauaa

SEQ ID NO: 4132942 - RNA, 19 nt, Yersinia pestis
caauaauaacgaauuucau

SEQ ID NO: 4132943 - RNA, 17 nt, Yersinia pestis
caauaauaucuggcguu

SEQ ID NO: 4132944 - RNA, 14 nt, Yersinia pestis
caauaaucucagca

SEQ ID NO: 4132945 - RNA, 15 nt, Yersinia pestis
caauaaucucagcau

SEQ ID NO: 4132946 - RNA, 18 nt, Yersinia pestis
caauaauucagaugagaa

SEQ ID NO: 4132947 - RNA, 15 nt, Yersinia pestis
caauaauuucacuau

SEQ ID NO: 4132948 - RNA, 21 nt, Yersinia pestis
caauaauuuuuaauugccgcc

SEQ ID NO: 4132949 - RNA, 13 nt, Yersinia pestis
caauacaccagac

SEQ ID NO: 4132950 - RNA, 19 nt, Yersinia pestis
caauacaccagacucugcu

SEQ ID NO: 4132951 - RNA, 12 nt, Yersinia pestis
caauacagcaaa

SEQ ID NO: 4132952 - RNA, 15 nt, Yersinia pestis
caauacagcaaauag

SEQ ID NO: 4132953 - RNA, 14 nt, Yersinia pestis
caauacauagaagc

SEQ ID NO: 4132954 - RNA, 15 nt, Yersinia pestis
caauaccaaaaaucu

SEQ ID NO: 4132955 - RNA, 15 nt, Yersinia pestis
caauaccaacgguag

SEQ ID NO: 4132956 - RNA, 16 nt, Yersinia pestis
caauaccaauucuuca

SEQ ID NO: 4132957 - RNA, 16 nt, Yersinia pestis
caauaccauauaccca

SEQ ID NO: 4132958 - RNA, 16 nt, Yersinia pestis
caauaccgccaauauc

SEQ ID NO: 4132959 - RNA, 15 nt, Yersinia pestis
caauaccgccacaca

SEQ ID NO: 4132960 - RNA, 16 nt, Yersinia pestis
caauaccgccacacaa

SEQ ID NO: 4132961 - RNA, 15 nt, Yersinia pestis
caauaccuuacugca

SEQ ID NO: 4132962 - RNA, 19 nt, Yersinia pestis
caauaccuuacuguaucaa

SEQ ID NO: 4132963 - RNA, 22 nt, Yersinia pestis
caauaccuuacuguaucaauac

SEQ ID NO: 4132964 - RNA, 14 nt, Yersinia pestis
caauacggcacuca

SEQ ID NO: 4132965 - RNA, 22 nt, Yersinia pestis
caauacguguagccaaaguggc

SEQ ID NO: 4132966 - RNA, 19 nt, Yersinia pestis
caauacuggccaugugugu

SEQ ID NO: 4132967 - RNA, 19 nt, Yersinia pestis
caauagcauaaauaucagu

SEQ ID NO: 4132968 - RNA, 16 nt, Yersinia pestis
caauagcccaaauaac

SEQ ID NO: 4132969 - RNA, 22 nt, Yersinia pestis
caauagcggaauauuuaaccag

SEQ ID NO: 4132970 - RNA, 21 nt, Yersinia pestis
caauagcguuaacgauauaau

SEQ ID NO: 4132971 - RNA, 22 nt, Yersinia pestis
caauagcuaauaauuguucaua

SEQ ID NO: 4132972 - RNA, 23 nt, Yersinia pestis
caauagcuagccccaaucaagca

SEQ ID NO: 4132973 - RNA, 14 nt, Yersinia pestis
caauaggcuauuuu

SEQ ID NO: 4132974 - RNA, 19 nt, Yersinia pestis
caauaggcuauuuuacuug

SEQ ID NO: 4132975 - RNA, 21 nt, Yersinia pestis
caauaggcuauuuuacuugcc

SEQ ID NO: 4132976 - RNA, 15 nt, Yersinia pestis
caauagguaaaucca

SEQ ID NO: 4132977 - RNA, 14 nt, Yersinia pestis
caauaggucagugg

SEQ ID NO: 4132978 - RNA, 17 nt, Yersinia pestis
caauaggucagugguuu

SEQ ID NO: 4132979 - RNA, 23 nt, Yersinia pestis
caauagguguugccggcggcgcu

SEQ ID NO: 4132980 - RNA, 23 nt, Yersinia pestis
caauaguguugcuaaggugugau

SEQ ID NO: 4132981 - RNA, 13 nt, Yersinia pestis
caauauaagagaa

SEQ ID NO: 4132982 - RNA, 20 nt, Yersinia pestis
caauauaaggcuuuauauug

SEQ ID NO: 4132983 - RNA, 16 nt, Yersinia pestis
caauauaauaaucuau

SEQ ID NO: 4132984 - RNA, 21 nt, Yersinia pestis
caauauaggcgucaucagcau

SEQ ID NO: 4132985 - RNA, 13 nt, Yersinia pestis
caauaucaacgcc

SEQ ID NO: 4132986 - RNA, 14 nt, Yersinia pestis
caauaucuuugucu

SEQ ID NO: 4132987 - RNA, 22 nt, Yersinia pestis
caauaugaauacgaauuuuuuc

SEQ ID NO: 4132988 - RNA, 16 nt, Yersinia pestis
caauauggguauugag

SEQ ID NO: 4132989 - RNA, 16 nt, Yersinia pestis
caauauguugcacuga

SEQ ID NO: 4132990 - RNA, 15 nt, Yersinia pestis
caauauguuuguuga

SEQ ID NO: 4132991 - RNA, 17 nt, Yersinia pestis
caauauuauauucucug

SEQ ID NO: 4132992 - RNA, 18 nt, Yersinia pestis
caauauucagcguugaca

SEQ ID NO: 4132993 - RNA, 14 nt, Yersinia pestis
caauauucgcagcc

SEQ ID NO: 4132994 - RNA, 22 nt, Yersinia pestis
caauauucgcagccaaaauaau

SEQ ID NO: 4132995 - RNA, 16 nt, Yersinia pestis
caauauucgccagauu

SEQ ID NO: 4132996 - RNA, 15 nt, Yersinia pestis
caaucaaaaaauaaa

SEQ ID NO: 4132997 - RNA, 18 nt, Yersinia pestis
caaucaaaaaauaaauua

SEQ ID NO: 4132998 - RNA, 16 nt, Yersinia pestis
caaucaauaagcuaca

SEQ ID NO: 4132999 - RNA, 16 nt, Yersinia pestis
caaucaauacacuggc

SEQ ID NO: 4133000 - RNA, 19 nt, Yersinia pestis
caaucaauguauugcucca

SEQ ID NO: 4133001 - RNA, 16 nt, Yersinia pestis
caaucacaaccccccc

SEQ ID NO: 4133002 - RNA, 20 nt, Yersinia pestis
caaucacauccccugccguu

SEQ ID NO: 4133003 - RNA, 14 nt, Yersinia pestis
caaucaccaccucc

SEQ ID NO: 4133004 - RNA, 23 nt, Yersinia pestis
caaucaccggcuggcauuuuuau

SEQ ID NO: 4133005 - RNA, 18 nt, Yersinia pestis
caaucacuucugcugcca

SEQ ID NO: 4133006 - RNA, 22 nt, Yersinia pestis
caaucagacggaauaccacccc

SEQ ID NO: 4133007 - RNA, 19 nt, Yersinia pestis
caaucagccgcaucacuga

SEQ ID NO: 4133008 - RNA, 18 nt, Yersinia pestis
caaucagcgcgaaaccac

SEQ ID NO: 4133009 - RNA, 18 nt, Yersinia pestis
caaucaggaaauuaccac

SEQ ID NO: 4133010 - RNA, 17 nt, Yersinia pestis
caaucagugcaauaaau

SEQ ID NO: 4133011 - RNA, 15 nt, Yersinia pestis
caaucaucaucccag

SEQ ID NO: 4133012 - RNA, 14 nt, Yersinia pestis
caaucaugggccaa

SEQ ID NO: 4133013 - RNA, 15 nt, Yersinia pestis
caaucauuacaucau

SEQ ID NO: 4133014 - RNA, 12 nt, Yersinia pestis
caaucauucugu

SEQ ID NO: 4133015 - RNA, 19 nt, Yersinia pestis
caaucauugagaucaguuc

SEQ ID NO: 4133016 - RNA, 20 nt, Yersinia pestis
caaucauugagaucaguuca

SEQ ID NO: 4133017 - RNA, 22 nt, Yersinia pestis
caaucauuuauauaguaacuau

SEQ ID NO: 4133018 - RNA, 13 nt, Yersinia pestis
caauccaugccag

SEQ ID NO: 4133019 - RNA, 21 nt, Yersinia pestis
caaucccggccauuugcucug

SEQ ID NO: 4133020 - RNA, 20 nt, Yersinia pestis
caauccgaccacugacaaaa

SEQ ID NO: 4133021 - RNA, 14 nt, Yersinia pestis
caauccgcugacau

SEQ ID NO: 4133022 - RNA, 22 nt, Yersinia pestis
caaucgcucugcguuuuucccu

SEQ ID NO: 4133023 - RNA, 23 nt, Yersinia pestis
caaucgcucugcguuuuucccug

SEQ ID NO: 4133024 - RNA, 14 nt, Yersinia pestis
caaucgcucuucac

SEQ ID NO: 4133025 - RNA, 15 nt, Yersinia pestis
caaucgcucuucacg

SEQ ID NO: 4133026 - RNA, 15 nt, Yersinia pestis
caaucuaacuaauaa

SEQ ID NO: 4133027 - RNA, 13 nt, Yersinia pestis
caaucucaucaau

SEQ ID NO: 4133028 - RNA, 13 nt, Yersinia pestis
caaucuccaauga

SEQ ID NO: 4133029 - RNA, 14 nt, Yersinia pestis
caaucuccacuuua

SEQ ID NO: 4133030 - RNA, 21 nt, Yersinia pestis
caaucuccaguaaaucuacuu

SEQ ID NO: 4133031 - RNA, 21 nt, Yersinia pestis
caaucucugcaguacagauaa

SEQ ID NO: 4133032 - RNA, 21 nt, Yersinia pestis
caaucucugggugcugcuccc

SEQ ID NO: 4133033 - RNA, 20 nt, Yersinia pestis
caaucuggggguaacgccgc

SEQ ID NO: 4133034 - RNA, 22 nt, Yersinia pestis
caaucuugguuaauagcauuug

SEQ ID NO: 4133035 - RNA, 14 nt, Yersinia pestis
caaugaaaauuagc

SEQ ID NO: 4133036 - RNA, 15 nt, Yersinia pestis
caaugaaucaacaga

SEQ ID NO: 4133037 - RNA, 19 nt, Yersinia pestis
caaugacacaagauugaug

SEQ ID NO: 4133038 - RNA, 20 nt, Yersinia pestis
caaugaccacuaaauuaaau

SEQ ID NO: 4133039 - RNA, 17 nt, Yersinia pestis
caaugaccaucuuccag

SEQ ID NO: 4133040 - RNA, 19 nt, Yersinia pestis
cacacacaaagcccaaaaa

SEQ ID NO: 4133041 - RNA, 13 nt, Yersinia pestis
cacacagaaucac

SEQ ID NO: 4133042 - RNA, 17 nt, Yersinia pestis
cacacauaccacacaca

SEQ ID NO: 4133043 - RNA, 14 nt, Yersinia pestis
cacaccaacacuga

SEQ ID NO: 4133044 - RNA, 11 nt, Yersinia pestis
cacaccaucag

SEQ ID NO: 4133045 - RNA, 19 nt, Yersinia pestis
cacaccauuuggacugaau

SEQ ID NO: 4133046 - RNA, 20 nt, Yersinia pestis
cacacccucucuuuccagca

SEQ ID NO: 4133047 - RNA, 17 nt, Yersinia pestis
cacaccgugcacccggc

SEQ ID NO: 4133048 - RNA, 20 nt, Yersinia pestis
cacacgacagcgcggcuaaa

SEQ ID NO: 4133049 - RNA, 23 nt, Yersinia pestis
cacacgacugaguuccaaaaugc

SEQ ID NO: 4133050 - RNA, 20 nt, Yersinia pestis
cacacgauuaccugcauauc

SEQ ID NO: 4133051 - RNA, 20 nt, Yersinia pestis
cacacguguacucauauugu

SEQ ID NO: 4133052 - RNA, 22 nt, Yersinia pestis
cacacugacagcaacgacgccc

SEQ ID NO: 4133053 - RNA, 14 nt, Yersinia pestis
cacacugagcaccg

SEQ ID NO: 4133054 - RNA, 15 nt, Yersinia pestis
cacacugagcaccgc

SEQ ID NO: 4133055 - RNA, 18 nt, Yersinia pestis
cacacuggguaaggcaaa

SEQ ID NO: 4133056 - RNA, 16 nt, Yersinia pestis
cacagaaucaccaaca

SEQ ID NO: 4133057 - RNA, 12 nt, Yersinia pestis
cacagacaaaca

SEQ ID NO: 4133058 - RNA, 13 nt, Yersinia pestis
cacagacaaacaa

SEQ ID NO: 4133059 - RNA, 18 nt, Yersinia pestis
cacagagcgggaacgcca

SEQ ID NO: 4133060 - RNA, 14 nt, Yersinia pestis
cacagauaaacaag

SEQ ID NO: 4133061 - RNA, 15 nt, Yersinia pestis
cacagauaaauaaaa

SEQ ID NO: 4133062 - RNA, 18 nt, Yersinia pestis
cacagauaaauaaaauaa

SEQ ID NO: 4133063 - RNA, 20 nt, Yersinia pestis
cacagcaaauugcugaaaaa

SEQ ID NO: 4133064 - RNA, 12 nt, Yersinia pestis
cacagcaacagg

SEQ ID NO: 4133065 - RNA, 19 nt, Yersinia pestis
cacagcacggcaacaggcu

SEQ ID NO: 4133066 - RNA, 16 nt, Yersinia pestis
cacagcacucauaaug

SEQ ID NO: 4133067 - RNA, 15 nt, Yersinia pestis
cacagcauucugcuu

SEQ ID NO: 4133068 - RNA, 19 nt, Yersinia pestis
cacagccacguaauaccac

SEQ ID NO: 4133069 - RNA, 16 nt, Yersinia pestis
cacagcccugccuggc

SEQ ID NO: 4133070 - RNA, 23 nt, Yersinia pestis
cacagccugccgggaugacuuuu

SEQ ID NO: 4133071 - RNA, 12 nt, Yersinia pestis
cacagcgcgaca

SEQ ID NO: 4133072 - RNA, 14 nt, Yersinia pestis
cacagcggcggaua

SEQ ID NO: 4133073 - RNA, 14 nt, Yersinia pestis
cacagcucucugag

SEQ ID NO: 4133074 - RNA, 14 nt, Yersinia pestis
cacaggcugcaugg

SEQ ID NO: 4133075 - RNA, 19 nt, Yersinia pestis
cacaggcuucgacaggcaa

SEQ ID NO: 4133076 - RNA, 17 nt, Yersinia pestis
cacaggggcaauuugcc

SEQ ID NO: 4133077 - RNA, 20 nt, Yersinia pestis
cacaggggcgaugucaccau

SEQ ID NO: 4133078 - RNA, 23 nt, Yersinia pestis
cacagucaguucauuacaggccc

SEQ ID NO: 4133079 - RNA, 22 nt, Yersinia pestis
cacagucugucguacuuuccuu

SEQ ID NO: 4133080 - RNA, 18 nt, Yersinia pestis
cacagugaugaccauuca

SEQ ID NO: 4133081 - RNA, 22 nt, Yersinia pestis
cacaguggaaccuccaaaugaa

SEQ ID NO: 4133082 - RNA, 20 nt, Yersinia pestis
cacaguuuucuuaaaauacu

SEQ ID NO: 4133083 - RNA, 12 nt, Yersinia pestis
cacauaaauaag

SEQ ID NO: 4133084 - RNA, 18 nt, Yersinia pestis
cacauaaauaaguucagg

SEQ ID NO: 4133085 - RNA, 15 nt, Yersinia pestis
cacauaccacacaca

SEQ ID NO: 4133086 - RNA, 20 nt, Yersinia pestis
cacauagcauggucaucgcu

SEQ ID NO: 4133087 - RNA, 11 nt, Yersinia pestis
cacauaucucc

SEQ ID NO: 4133088 - RNA, 13 nt, Yersinia pestis
cacauaugcagcu

SEQ ID NO: 4133089 - RNA, 22 nt, Yersinia pestis
cacauauuucaggcuguugcgu

SEQ ID NO: 4133090 - RNA, 15 nt, Yersinia pestis
cacauauuucauuag

SEQ ID NO: 4133091 - RNA, 23 nt, Yersinia pestis
cacaucaaaaccggaagccaccu

SEQ ID NO: 4133092 - RNA, 17 nt, Yersinia pestis
cacaucaaauuuuugau

SEQ ID NO: 4133093 - RNA, 12 nt, Yersinia pestis
cacaucaauaua

SEQ ID NO: 4133094 - RNA, 17 nt, Yersinia pestis
cacaucaccgacagcau

SEQ ID NO: 4133095 - RNA, 12 nt, Yersinia pestis
cacaucaggccg

SEQ ID NO: 4133096 - RNA, 22 nt, Yersinia pestis
cacaucagugggauagagauca

SEQ ID NO: 4133097 - RNA, 15 nt, Yersinia pestis
cacaucauaaucggu

SEQ ID NO: 4133098 - RNA, 15 nt, Yersinia pestis
cacaucauuacccau

SEQ ID NO: 4133099 - RNA, 12 nt, Yersinia pestis
cacauccaaugg

SEQ ID NO: 4133100 - RNA, 22 nt, Yersinia pestis
cacaucccggcagcaguuguca

SEQ ID NO: 4133101 - RNA, 22 nt, Yersinia pestis
cacaucgcgcuuuuuaggaugu

SEQ ID NO: 4133102 - RNA, 23 nt, Yersinia pestis
cacaucgggauccgccugcuggc

SEQ ID NO: 4133103 - RNA, 21 nt, Yersinia pestis
cacaucggucaauaccauauc

SEQ ID NO: 4133104 - RNA, 18 nt, Yersinia pestis
cacaucucggcguaaaca

SEQ ID NO: 4133105 - RNA, 21 nt, Yersinia pestis
cacaucuugcgccgaaauaaa

SEQ ID NO: 4133106 - RNA, 18 nt, Yersinia pestis
cacaugccgucaccucau

SEQ ID NO: 4133107 - RNA, 12 nt, Yersinia pestis
cacaugcucagu

SEQ ID NO: 4133108 - RNA, 14 nt, Yersinia pestis
cacaugugcaauua

SEQ ID NO: 4133109 - RNA, 19 nt, Yersinia pestis
cacauuaacuucagguuca

SEQ ID NO: 4133110 - RNA, 17 nt, Yersinia pestis
cacauucaaacacuuau

SEQ ID NO: 4133111 - RNA, 13 nt, Yersinia pestis
cacauucaggccg

SEQ ID NO: 4133112 - RNA, 13 nt, Yersinia pestis
cacauucagucaa

SEQ ID NO: 4133113 - RNA, 16 nt, Yersinia pestis
cacauuccaguaaaaa

SEQ ID NO: 4133114 - RNA, 16 nt, Yersinia pestis
cacauucuguguaccc

SEQ ID NO: 4133115 - RNA, 17 nt, Yersinia pestis
cacauuucccuuacugu

SEQ ID NO: 4133116 - RNA, 15 nt, Yersinia pestis
cacauuuugugugag

SEQ ID NO: 4133117 - RNA, 21 nt, Yersinia pestis
caccaaaaaacggauuuccau

SEQ ID NO: 4133118 - RNA, 15 nt, Yersinia pestis
caccaaaacgucgug

SEQ ID NO: 4133119 - RNA, 20 nt, Yersinia pestis
caccaaagcaaugaauaccc

SEQ ID NO: 4133120 - RNA, 19 nt, Yersinia pestis
caccaaaugcucagccauc

SEQ ID NO: 4133121 - RNA, 14 nt, Yersinia pestis
caccaacaccacac

SEQ ID NO: 4133122 - RNA, 14 nt, Yersinia pestis
caccaacagcauua

SEQ ID NO: 4133123 - RNA, 15 nt, Yersinia pestis
caccaacagcauuac

SEQ ID NO: 4133124 - RNA, 18 nt, Yersinia pestis
caccaacagcauuaccaa

SEQ ID NO: 4133125 - RNA, 14 nt, Yersinia pestis
caccaaccaaccau

SEQ ID NO: 4133126 - RNA, 14 nt, Yersinia pestis
caccaacccgcccc

SEQ ID NO: 4133127 - RNA, 12 nt, Yersinia pestis
caccaaccgguu

SEQ ID NO: 4133128 - RNA, 15 nt, Yersinia pestis
caccaagacugaagu

SEQ ID NO: 4133129 - RNA, 19 nt, Yersinia pestis
caccaagaggaaaugccgc

SEQ ID NO: 4133130 - RNA, 18 nt, Yersinia pestis
caccaauagcgaucagca

SEQ ID NO: 4133131 - RNA, 21 nt, Yersinia pestis
caccaaucauuacaucaucuu

SEQ ID NO: 4133132 - RNA, 14 nt, Yersinia pestis
caccaaugcaucca

SEQ ID NO: 4133133 - RNA, 20 nt, Yersinia pestis
caccaaugcauccaagccau

SEQ ID NO: 4133134 - RNA, 13 nt, Yersinia pestis
caccacacauacc

SEQ ID NO: 4133135 - RNA, 13 nt, Yersinia pestis
caccacaucaucc

SEQ ID NO: 4133136 - RNA, 18 nt, Yersinia pestis
caccaccaacccgccccc

SEQ ID NO: 4133137 - RNA, 15 nt, Yersinia pestis
caccaccacaaacag

SEQ ID NO: 4133138 - RNA, 12 nt, Yersinia pestis
caccaccacacc

SEQ ID NO: 4133139 - RNA, 23 nt, Yersinia pestis
caccaccaucacuuccagcgccc

SEQ ID NO: 4133140 - RNA, 22 nt, Yersinia pestis
caccacgaaaaaauggcagccc

SEQ ID NO: 4133141 - RNA, 23 nt, Yersinia pestis
caccacggcuuucaauaaaacuc

SEQ ID NO: 4133142 - RNA, 16 nt, Yersinia pestis
caccagaaucaucaga

SEQ ID NO: 4133143 - RNA, 13 nt, Yersinia pestis
caccagacaacca

SEQ ID NO: 4133144 - RNA, 21 nt, Yersinia pestis
caccagacucugcuaccagga

SEQ ID NO: 4133145 - RNA, 21 nt, Yersinia pestis
caccagagaccacagauaaau

SEQ ID NO: 4133146 - RNA, 14 nt, Yersinia pestis
caccagagaugaua

SEQ ID NO: 4133147 - RNA, 17 nt, Yersinia pestis
caccagagaugauagca

SEQ ID NO: 4133148 - RNA, 18 nt, Yersinia pestis
caccagagaugauagcaa

SEQ ID NO: 4133149 - RNA, 21 nt, Yersinia pestis
caccagaucauuuuuuuccac

SEQ ID NO: 4133150 - RNA, 20 nt, Yersinia pestis
caccagauggcgaucaaggu

SEQ ID NO: 4133151 - RNA, 21 nt, Yersinia pestis
caccaggcucucauauccccc

SEQ ID NO: 4133152 - RNA, 16 nt, Yersinia pestis
caccaguaaacgccaa

SEQ ID NO: 4133153 - RNA, 16 nt, Yersinia pestis
caccaguucuaacccg

SEQ ID NO: 4133154 - RNA, 20 nt, Yersinia pestis
caccaguugaccauuuuuau

SEQ ID NO: 4133155 - RNA, 15 nt, Yersinia pestis
caccaguuuauuuuc

SEQ ID NO: 4133156 - RNA, 18 nt, Yersinia pestis
caccaguuuauuuucccu

SEQ ID NO: 4133157 - RNA, 22 nt, Yersinia pestis
caccauaaaaacuucagagcca

SEQ ID NO: 4133158 - RNA, 19 nt, Yersinia pestis
caccauaaccaauccaugc

SEQ ID NO: 4133159 - RNA, 16 nt, Yersinia pestis
caccauaaugugccuc

SEQ ID NO: 4133160 - RNA, 15 nt, Yersinia pestis
caccaucaacauggg

SEQ ID NO: 4133161 - RNA, 14 nt, Yersinia pestis
caccaucaauauaa

SEQ ID NO: 4133162 - RNA, 19 nt, Yersinia pestis
cacguuuaauuucacuucc

SEQ ID NO: 4133163 - RNA, 20 nt, Yersinia pestis
cacguuuuucagcuucuucu

SEQ ID NO: 4133164 - RNA, 15 nt, Yersinia pestis
cacuaaaacugaagc

SEQ ID NO: 4133165 - RNA, 16 nt, Yersinia pestis
cacuaaaauaucaaau

SEQ ID NO: 4133166 - RNA, 18 nt, Yersinia pestis
cacuaaaccauucagcca

SEQ ID NO: 4133167 - RNA, 18 nt, Yersinia pestis
cacuaaaccuugaauauc

SEQ ID NO: 4133168 - RNA, 20 nt, Yersinia pestis
cacuaauaccugauguuuug

SEQ ID NO: 4133169 - RNA, 22 nt, Yersinia pestis
cacuaauaccugauguuuugcu

SEQ ID NO: 4133170 - RNA, 19 nt, Yersinia pestis
cacuaauuagugacaguag

SEQ ID NO: 4133171 - RNA, 14 nt, Yersinia pestis
cacuacauucugau

SEQ ID NO: 4133172 - RNA, 18 nt, Yersinia pestis
cacuacccgaaucacuga

SEQ ID NO: 4133173 - RNA, 21 nt, Yersinia pestis
cacuaccgucuuggauauuug

SEQ ID NO: 4133174 - RNA, 18 nt, Yersinia pestis
cacuagagcguuacacau

SEQ ID NO: 4133175 - RNA, 20 nt, Yersinia pestis
cacuagagcguuacacauca

SEQ ID NO: 4133176 - RNA, 22 nt, Yersinia pestis
cacuagggggcaauugaaaaug

SEQ ID NO: 4133177 - RNA, 15 nt, Yersinia pestis
cacuauaauuauuuc

SEQ ID NO: 4133178 - RNA, 19 nt, Yersinia pestis
cacuauaauuauuucucug

SEQ ID NO: 4133179 - RNA, 17 nt, Yersinia pestis
cacuauaggcuauuuua

SEQ ID NO: 4133180 - RNA, 14 nt, Yersinia pestis
cacuaucacaucaa

SEQ ID NO: 4133181 - RNA, 18 nt, Yersinia pestis
cacuaucacaucaaauuu

SEQ ID NO: 4133182 - RNA, 20 nt, Yersinia pestis
cacuauucuccaacaacugc

SEQ ID NO: 4133183 - RNA, 21 nt, Yersinia pestis
cacuauucuccaacaacugcc

SEQ ID NO: 4133184 - RNA, 22 nt, Yersinia pestis
cacuauuucaggcauaucacua

SEQ ID NO: 4133185 - RNA, 22 nt, Yersinia pestis
cacuauuucguguauaucacua

SEQ ID NO: 4133186 - RNA, 23 nt, Yersinia pestis
cacuauuucguguauaucacuau

SEQ ID NO: 4133187 - RNA, 19 nt, Yersinia pestis
cacucaauaaguagccacu

SEQ ID NO: 4133188 - RNA, 14 nt, Yersinia pestis
cacucacauaagaa

SEQ ID NO: 4133189 - RNA, 17 nt, Yersinia pestis
cacucacauaagaaagu

SEQ ID NO: 4133190 - RNA, 19 nt, Yersinia pestis
cacucagaucccccugcug

SEQ ID NO: 4133191 - RNA, 19 nt, Yersinia pestis
cacucagauuuacccaaag

SEQ ID NO: 4133192 - RNA, 21 nt, Yersinia pestis
cacucagauuuacccaaaggc

SEQ ID NO: 4133193 - RNA, 23 nt, Yersinia pestis
cacucaggguuagggaugagugu

SEQ ID NO: 4133194 - RNA, 14 nt, Yersinia pestis
cacucauaauuuug

SEQ ID NO: 4133195 - RNA, 20 nt, Yersinia pestis
cacucauaauuuugaugcua

SEQ ID NO: 4133196 - RNA, 15 nt, Yersinia pestis
cacucauugccuggc

SEQ ID NO: 4133197 - RNA, 23 nt, Yersinia pestis
cacucauugccuggcccaucuau

SEQ ID NO: 4133198 - RNA, 16 nt, Yersinia pestis
cacuccccgucagcau

SEQ ID NO: 4133199 - RNA, 18 nt, Yersinia pestis
cacucguuguauuuuccu

SEQ ID NO: 4133200 - RNA, 12 nt, Yersinia pestis
cacucucugcuu

SEQ ID NO: 4133201 - RNA, 14 nt, Yersinia pestis
cacucugguuuugu

SEQ ID NO: 4133202 - RNA, 17 nt, Yersinia pestis
cacucuguacguaaaua

SEQ ID NO: 4133203 - RNA, 18 nt, Yersinia pestis
cacucuguuuuaaaaaaa

SEQ ID NO: 4133204 - RNA, 17 nt, Yersinia pestis
cacucuuuuuaauuuau

SEQ ID NO: 4133205 - RNA, 20 nt, Yersinia pestis
cacugaaaguguauuucuca

SEQ ID NO: 4133206 - RNA, 14 nt, Yersinia pestis
cacugaaucccaga

SEQ ID NO: 4133207 - RNA, 14 nt, Yersinia pestis
cacugacaucauca

SEQ ID NO: 4133208 - RNA, 16 nt, Yersinia pestis
cacugaccuauugaua

SEQ ID NO: 4133209 - RNA, 20 nt, Yersinia pestis
cacugacggcagacaaccau

SEQ ID NO: 4133210 - RNA, 16 nt, Yersinia pestis
cacugacugagugcca

SEQ ID NO: 4133211 - RNA, 19 nt, Yersinia pestis
cacugacugauguaagcuc

SEQ ID NO: 4133212 - RNA, 12 nt, Yersinia pestis
cacugagagaac

SEQ ID NO: 4133213 - RNA, 23 nt, Yersinia pestis
cacugagagaaccauuauuaccu

SEQ ID NO: 4133214 - RNA, 12 nt, Yersinia pestis
cacugagcaccg

SEQ ID NO: 4133215 - RNA, 14 nt, Yersinia pestis
cacugagcaccgca

SEQ ID NO: 4133216 - RNA, 22 nt, Yersinia pestis
cacugagucgucugucgggaac

SEQ ID NO: 4133217 - RNA, 13 nt, Yersinia pestis
cacugaguucugc

SEQ ID NO: 4133218 - RNA, 15 nt, Yersinia pestis
cacugaguucugcug

SEQ ID NO: 4133219 - RNA, 16 nt, Yersinia pestis
cacugaguucugcugc

SEQ ID NO: 4133220 - RNA, 22 nt, Yersinia pestis
cacugauagauucaucaccagu

SEQ ID NO: 4133221 - RNA, 21 nt, Yersinia pestis
cacugauauagccuucuucac

SEQ ID NO: 4133222 - RNA, 15 nt, Yersinia pestis
cacugaugagcuggc

SEQ ID NO: 4133223 - RNA, 19 nt, Yersinia pestis
cacugcacuuuaaucgcca

SEQ ID NO: 4133224 - RNA, 16 nt, Yersinia pestis
cacugccgucaaugcc

SEQ ID NO: 4133225 - RNA, 12 nt, Yersinia pestis
cacugccugcuc

SEQ ID NO: 4133226 - RNA, 23 nt, Yersinia pestis
cacugcgcgaucccagaauggca

SEQ ID NO: 4133227 - RNA, 23 nt, Yersinia pestis
cacugcgggagggauuucuucau

SEQ ID NO: 4133228 - RNA, 13 nt, Yersinia pestis
cacugcucugccc

SEQ ID NO: 4133229 - RNA, 15 nt, Yersinia pestis
cacuggaaaaagugu

SEQ ID NO: 4133230 - RNA, 13 nt, Yersinia pestis
cacuggaaacaaa

SEQ ID NO: 4133231 - RNA, 21 nt, Yersinia pestis
cacuggaguuaaaucccugug

SEQ ID NO: 4133232 - RNA, 17 nt, Yersinia pestis
cacuggcaccgcuucug

SEQ ID NO: 4133233 - RNA, 16 nt, Yersinia pestis
cacuggccgcaggcgc

SEQ ID NO: 4133234 - RNA, 16 nt, Yersinia pestis
cacuggccuauuaaga

SEQ ID NO: 4133235 - RNA, 18 nt, Yersinia pestis
cacuggcgguugaauaug

SEQ ID NO: 4133236 - RNA, 18 nt, Yersinia pestis
cacugggucaucacccag

SEQ ID NO: 4133237 - RNA, 12 nt, Yersinia pestis
cacugguagcau

SEQ ID NO: 4133238 - RNA, 13 nt, Yersinia pestis
cacuggucaguau

SEQ ID NO: 4133239 - RNA, 15 nt, Yersinia pestis
cacuguacugggaug

SEQ ID NO: 4133240 - RNA, 20 nt, Yersinia pestis
cacuguacugggaugaagaa

SEQ ID NO: 4133241 - RNA, 14 nt, Yersinia pestis
cacugucuauuuuu

SEQ ID NO: 4133242 - RNA, 19 nt, Yersinia pestis
cacugugcuuuucuuaaua

SEQ ID NO: 4133243 - RNA, 15 nt, Yersinia pestis
cacuguuuuucauua

SEQ ID NO: 4133244 - RNA, 18 nt, Yersinia pestis
cacuuaaacccuuucucg

SEQ ID NO: 4133245 - RNA, 22 nt, Yersinia pestis
cacuuaacacgaaccuucucug

SEQ ID NO: 4133246 - RNA, 13 nt, Yersinia pestis
cacuuacugccaa

SEQ ID NO: 4133247 - RNA, 12 nt, Yersinia pestis
cacuuauuggaa

SEQ ID NO: 4133248 - RNA, 12 nt, Yersinia pestis
cacuuauuugaa

SEQ ID NO: 4133249 - RNA, 21 nt, Yersinia pestis
cacuuauuugaaauacuuauu

SEQ ID NO: 4133250 - RNA, 22 nt, Yersinia pestis
cacuuauuugaaauacuuauuu

SEQ ID NO: 4133251 - RNA, 14 nt, Yersinia pestis
cacuucaagcagca

SEQ ID NO: 4133252 - RNA, 21 nt, Yersinia pestis
cacuucaaucacuuuauacgc

SEQ ID NO: 4133253 - RNA, 13 nt, Yersinia pestis
cacuucauuuucu

SEQ ID NO: 4133254 - RNA, 15 nt, Yersinia pestis
cacuuccucauucau

SEQ ID NO: 4133255 - RNA, 23 nt, Yersinia pestis
cacuuccugauggccguaucaug

SEQ ID NO: 4133256 - RNA, 20 nt, Yersinia pestis
cacuucgauacuacaaucau

SEQ ID NO: 4133257 - RNA, 16 nt, Yersinia pestis
cacuucgguggcccug

SEQ ID NO: 4133258 - RNA, 20 nt, Yersinia pestis
cacuucguagggcacuuuca

SEQ ID NO: 4133259 - RNA, 22 nt, Yersinia pestis
cacuucguagggcacuuucauc

SEQ ID NO: 4133260 - RNA, 16 nt, Yersinia pestis
cacuucucugacacac

SEQ ID NO: 4133261 - RNA, 14 nt, Yersinia pestis
cacuucuuucacua

SEQ ID NO: 4133262 - RNA, 14 nt, Yersinia pestis
cacuugagagaaac

SEQ ID NO: 4133263 - RNA, 11 nt, Yersinia pestis
cacuugcuacc

SEQ ID NO: 4133264 - RNA, 16 nt, Yersinia pestis
cacuugcucuaccacg

SEQ ID NO: 4133265 - RNA, 17 nt, Yersinia pestis
cacuuggcuaauuguca

SEQ ID NO: 4133266 - RNA, 22 nt, Yersinia pestis
cacuuggguagcagcccaacac

SEQ ID NO: 4133267 - RNA, 15 nt, Yersinia pestis
cacuuguaccugugc

SEQ ID NO: 4133268 - RNA, 20 nt, Yersinia pestis
cacuugugguaaccccgucg

SEQ ID NO: 4133269 - RNA, 12 nt, Yersinia pestis
cacuuuaaauac

SEQ ID NO: 4133270 - RNA, 19 nt, Yersinia pestis
cacuuuaaauacccagcuu

SEQ ID NO: 4133271 - RNA, 16 nt, Yersinia pestis
cacuuuacauaaccua

SEQ ID NO: 4133272 - RNA, 17 nt, Yersinia pestis
cacuuuagccaagguua

SEQ ID NO: 4133273 - RNA, 22 nt, Yersinia pestis
cacuuucagaauugugccccuu

SEQ ID NO: 4133274 - RNA, 20 nt, Yersinia pestis
cacuuucaucgccgucagcu

SEQ ID NO: 4133275 - RNA, 19 nt, Yersinia pestis
cacuuugggcugaucaucg

SEQ ID NO: 4133276 - RNA, 20 nt, Yersinia pestis
cacuuugucaauaaccucag

SEQ ID NO: 4133277 - RNA, 14 nt, Yersinia pestis
cacuuuucagauag

SEQ ID NO: 4133278 - RNA, 20 nt, Yersinia pestis
cacuuuugcuggugucacaa

SEQ ID NO: 4133279 - RNA, 18 nt, Yersinia pestis
cacuuuugucgcucaagc

SEQ ID NO: 4133280 - RNA, 16 nt, Yersinia pestis
cagaaaacccccugcu

SEQ ID NO: 4133281 - RNA, 20 nt, Yersinia pestis
cagaaaaccuucagcaaaga

SEQ ID NO: 4133282 - RNA, 21 nt, Yersinia pestis
cagaaaaccuucagcaaagag

SEQ ID NO: 4133283 - RNA, 21 nt, Yersinia pestis
cagaaaagagguguucuugaa

SEQ ID NO: 4133284 - RNA, 14 nt, Yersinia pestis
cagaucuauuugcu

SEQ ID NO: 4133285 - RNA, 19 nt, Yersinia pestis
cagaucuggguuagaaaua

SEQ ID NO: 4133286 - RNA, 23 nt, Yersinia pestis
cagaucuggguuagaaauauaac

SEQ ID NO: 4133287 - RNA, 15 nt, Yersinia pestis
cagaugaauauguuc

SEQ ID NO: 4133288 - RNA, 18 nt, Yersinia pestis
cagaugaauccagccaug

SEQ ID NO: 4133289 - RNA, 22 nt, Yersinia pestis
cagaugaauccagccaugcgac

SEQ ID NO: 4133290 - RNA, 21 nt, Yersinia pestis
cagaugacgggcgacccgcug

SEQ ID NO: 4133291 - RNA, 13 nt, Yersinia pestis
cagaugagaaucu

SEQ ID NO: 4133292 - RNA, 23 nt, Yersinia pestis
cagaugaucugaugaucaucugg

SEQ ID NO: 4133293 - RNA, 22 nt, Yersinia pestis
cagaugaugaugagaaguaaaa

SEQ ID NO: 4133294 - RNA, 17 nt, Yersinia pestis
cagaugcuggcuuuuuu

SEQ ID NO: 4133295 - RNA, 20 nt, Yersinia pestis
cagauggccagauucaccag

SEQ ID NO: 4133296 - RNA, 17 nt, Yersinia pestis
cagauggccccaauugu

SEQ ID NO: 4133297 - RNA, 14 nt, Yersinia pestis
cagaugggaagaca

SEQ ID NO: 4133298 - RNA, 20 nt, Yersinia pestis
cagaugucccagaaauauug

SEQ ID NO: 4133299 - RNA, 18 nt, Yersinia pestis
cagauguuaacuggcucc

SEQ ID NO: 4133300 - RNA, 18 nt, Yersinia pestis
cagauuauuguuauccac

SEQ ID NO: 4133301 - RNA, 17 nt, Yersinia pestis
cagauucaccaguagcc

SEQ ID NO: 4133302 - RNA, 17 nt, Yersinia pestis
cagauucccgcgccgcg

SEQ ID NO: 4133303 - RNA, 17 nt, Yersinia pestis
cagauucuagcaucgcc

SEQ ID NO: 4133304 - RNA, 15 nt, Yersinia pestis
cagauuggcuugcuu

SEQ ID NO: 4133305 - RNA, 19 nt, Yersinia pestis
cagauuguuuauaaauuaa

SEQ ID NO: 4133306 - RNA, 13 nt, Yersinia pestis
cagauuuacuccc

SEQ ID NO: 4133307 - RNA, 23 nt, Yersinia pestis
cagauuuacuccccaaagccuac

SEQ ID NO: 4133308 - RNA, 21 nt, Yersinia pestis
cagauuuggccacgcugccug

SEQ ID NO: 4133309 - RNA, 18 nt, Yersinia pestis
cagauuugguauuacgcu

SEQ ID NO: 4133310 - RNA, 18 nt, Yersinia pestis
cagcaaaaacaaauaauu

SEQ ID NO: 4133311 - RNA, 16 nt, Yersinia pestis
cagcaaaagaaccggu

SEQ ID NO: 4133312 - RNA, 14 nt, Yersinia pestis
cagcaaaagccucu

SEQ ID NO: 4133313 - RNA, 13 nt, Yersinia pestis
cagcaaacaguga

SEQ ID NO: 4133314 - RNA, 12 nt, Yersinia pestis
cagcaaacgucc

SEQ ID NO: 4133315 - RNA, 16 nt, Yersinia pestis
cagcaaacucagccaa

SEQ ID NO: 4133316 - RNA, 24 nt, Yersinia pestis
cagcaaacucagccaauccagcaa

SEQ ID NO: 4133317 - RNA, 19 nt, Yersinia pestis
cagcaaagccaaaaccauu

SEQ ID NO: 4133318 - RNA, 15 nt, Yersinia pestis
cagcaaaggccacca

SEQ ID NO: 4133319 - RNA, 14 nt, Yersinia pestis
cagcaaaguauuua

SEQ ID NO: 4133320 - RNA, 12 nt, Yersinia pestis
cagcaaaucaaa

SEQ ID NO: 4133321 - RNA, 15 nt, Yersinia pestis
cagcaaaucauuuaa

SEQ ID NO: 4133322 - RNA, 21 nt, Yersinia pestis
cagcaacaacaaaggcgccaa

SEQ ID NO: 4133323 - RNA, 14 nt, Yersinia pestis
cagcaacacaaaag

SEQ ID NO: 4133324 - RNA, 19 nt, Yersinia pestis
cagcaaccacgguaucaau

SEQ ID NO: 4133325 - RNA, 15 nt, Yersinia pestis
cagcaaccgcaucau

SEQ ID NO: 4133326 - RNA, 21 nt, Yersinia pestis
cagcaaccuggcggcccgaga

SEQ ID NO: 4133327 - RNA, 14 nt, Yersinia pestis
cagcaacgaauaaa

SEQ ID NO: 4133328 - RNA, 15 nt, Yersinia pestis
cagcaacgaauaaaa

SEQ ID NO: 4133329 - RNA, 17 nt, Yersinia pestis
cagcaacgaauaaaaaa

SEQ ID NO: 4133330 - RNA, 13 nt, Yersinia pestis
cagcaacuguuuu

SEQ ID NO: 4133331 - RNA, 17 nt, Yersinia pestis
cagcaagaacaauccau

SEQ ID NO: 4133332 - RNA, 16 nt, Yersinia pestis
cagcaagagcagccaa

SEQ ID NO: 4133333 - RNA, 17 nt, Yersinia pestis
cagcaaggcagcaagca

SEQ ID NO: 4133334 - RNA, 18 nt, Yersinia pestis
cagcaaggcagcaagcaa

SEQ ID NO: 4133335 - RNA, 18 nt, Yersinia pestis
cagcaaggcggcaagcaa

SEQ ID NO: 4133336 - RNA, 14 nt, Yersinia pestis
cagcaaguuaucaa

SEQ ID NO: 4133337 - RNA, 15 nt, Yersinia pestis
cagcaauaaaccacu

SEQ ID NO: 4133338 - RNA, 18 nt, Yersinia pestis
cagcaauaaaccacuggu

SEQ ID NO: 4133339 - RNA, 20 nt, Yersinia pestis
cagcaauaaaccacugguua

SEQ ID NO: 4133340 - RNA, 17 nt, Yersinia pestis
cagcaauacgccccuga

SEQ ID NO: 4133341 - RNA, 18 nt, Yersinia pestis
cagcaauaugaauacgaa

SEQ ID NO: 4133342 - RNA, 22 nt, Yersinia pestis
cagcaauugaguaguaaaaccu

SEQ ID NO: 4133343 - RNA, 23 nt, Yersinia pestis
cagcaauuuuuagcgcuaaauca

SEQ ID NO: 4133344 - RNA, 13 nt, Yersinia pestis
cagcacaaugacu

SEQ ID NO: 4133345 - RNA, 21 nt, Yersinia pestis
cagcacagagcacaacggaag

SEQ ID NO: 4133346 - RNA, 15 nt, Yersinia pestis
cagcacauccaugcc

SEQ ID NO: 4133347 - RNA, 14 nt, Yersinia pestis
cagcacauuuuuau

SEQ ID NO: 4133348 - RNA, 16 nt, Yersinia pestis
cagcacauuuuuauag

SEQ ID NO: 4133349 - RNA, 16 nt, Yersinia pestis
cagcaccaacaauaac

SEQ ID NO: 4133350 - RNA, 16 nt, Yersinia pestis
cagcaccaauaucaau

SEQ ID NO: 4133351 - RNA, 18 nt, Yersinia pestis
cagcaccacaauggcaga

SEQ ID NO: 4133352 - RNA, 11 nt, Yersinia pestis
cagcaccaccg

SEQ ID NO: 4133353 - RNA, 14 nt, Yersinia pestis
cagcaccaccgaug

SEQ ID NO: 4133354 - RNA, 13 nt, Yersinia pestis
cagcaccacuaag

SEQ ID NO: 4133355 - RNA, 13 nt, Yersinia pestis
cagcaccauacag

SEQ ID NO: 4133356 - RNA, 18 nt, Yersinia pestis
cagcacgaaccugagcga

SEQ ID NO: 4133357 - RNA, 19 nt, Yersinia pestis
cagcacggauaucuggguu

SEQ ID NO: 4133358 - RNA, 13 nt, Yersinia pestis
cagcacgguaacc

SEQ ID NO: 4133359 - RNA, 15 nt, Yersinia pestis
cagcacguucaccaa

SEQ ID NO: 4133360 - RNA, 22 nt, Yersinia pestis
cagcacguucaccaaagcaaug

SEQ ID NO: 4133361 - RNA, 23 nt, Yersinia pestis
cagcacuacguguuuuucaucug

SEQ ID NO: 4133362 - RNA, 12 nt, Yersinia pestis
cagcacucagua

SEQ ID NO: 4133363 - RNA, 15 nt, Yersinia pestis
cagcacuccccgccc

SEQ ID NO: 4133364 - RNA, 14 nt, Yersinia pestis
cagcagaaacccgu

SEQ ID NO: 4133365 - RNA, 16 nt, Yersinia pestis
cagcagaaccauggca

SEQ ID NO: 4133366 - RNA, 22 nt, Yersinia pestis
cagcagauugauaacaccggcu

SEQ ID NO: 4133367 - RNA, 13 nt, Yersinia pestis
cagcagcuuuugu

SEQ ID NO: 4133368 - RNA, 17 nt, Yersinia pestis
cagcaggcguagcgugu

SEQ ID NO: 4133369 - RNA, 22 nt, Yersinia pestis
cagcagggccaaauugaacucg

SEQ ID NO: 4133370 - RNA, 16 nt, Yersinia pestis
cagcagggcgguuaau

SEQ ID NO: 4133371 - RNA, 22 nt, Yersinia pestis
cagcaggggcaaccucuucuuc

SEQ ID NO: 4133372 - RNA, 20 nt, Yersinia pestis
cagcaggugguuaaacugac

SEQ ID NO: 4133373 - RNA, 17 nt, Yersinia pestis
cagcagucugaaacgcc

SEQ ID NO: 4133374 - RNA, 22 nt, Yersinia pestis
cagcagucugaaacgccagccu

SEQ ID NO: 4133375 - RNA, 16 nt, Yersinia pestis
cagcagucugacaccg

SEQ ID NO: 4133376 - RNA, 21 nt, Yersinia pestis
cagcagucugacagauacuuu

SEQ ID NO: 4133377 - RNA, 16 nt, Yersinia pestis
cagcagucugagccuc

SEQ ID NO: 4133378 - RNA, 21 nt, Yersinia pestis
cagcagucugagccucaugaa

SEQ ID NO: 4133379 - RNA, 17 nt, Yersinia pestis
cagcagucugaggggcg

SEQ ID NO: 4133380 - RNA, 17 nt, Yersinia pestis
cagcaguggcuuggcaa

SEQ ID NO: 4133381 - RNA, 17 nt, Yersinia pestis
cagcaguugucagcccu

SEQ ID NO: 4133382 - RNA, 20 nt, Yersinia pestis
cagcauaacgguuguauaca

SEQ ID NO: 4133383 - RNA, 13 nt, Yersinia pestis
cagcauaaggcgu

SEQ ID NO: 4133384 - RNA, 16 nt, Yersinia pestis
cagcauacgugccaaa

SEQ ID NO: 4133385 - RNA, 20 nt, Yersinia pestis
cagcauaguaagcuggcccu

SEQ ID NO: 4133386 - RNA, 21 nt, Yersinia pestis
cagcauaucccuguuuucuag

SEQ ID NO: 4133387 - RNA, 20 nt, Yersinia pestis
cagcauauuacccaguacug

SEQ ID NO: 4133388 - RNA, 14 nt, Yersinia pestis
cagcauauugagca

SEQ ID NO: 4133389 - RNA, 22 nt, Yersinia pestis
cagcauauugagcauacuguug

SEQ ID NO: 4133390 - RNA, 20 nt, Yersinia pestis
cagcauauuguaaacuucca

SEQ ID NO: 4133391 - RNA, 18 nt, Yersinia pestis
cagcaucacccguuuucc

SEQ ID NO: 4133392 - RNA, 19 nt, Yersinia pestis
cagcaucaguaacuucucu

SEQ ID NO: 4133393 - RNA, 15 nt, Yersinia pestis
cagcaucccaaugaa

SEQ ID NO: 4133394 - RNA, 16 nt, Yersinia pestis
cagcauccugaacuuc

SEQ ID NO: 4133395 - RNA, 13 nt, Yersinia pestis
cagcaugguagcc

SEQ ID NO: 4133396 - RNA, 15 nt, Yersinia pestis
cagcauguguuggcu

SEQ ID NO: 4133397 - RNA, 21 nt, Yersinia pestis
cagcauuaacccauauuacuc

SEQ ID NO: 4133398 - RNA, 18 nt, Yersinia pestis
cagcauucucacuuacua

SEQ ID NO: 4133399 - RNA, 13 nt, Yersinia pestis
cagcauucugcuu

SEQ ID NO: 4133400 - RNA, 22 nt, Yersinia pestis
cagcauuucaggaucgaucugg

SEQ ID NO: 4133401 - RNA, 17 nt, Yersinia pestis
cagccaaccaucaucaa

SEQ ID NO: 4133402 - RNA, 21 nt, Yersinia pestis
cagccaagacuuuccacaaca

SEQ ID NO: 4133403 - RNA, 15 nt, Yersinia pestis
cagccaagaucccaa

SEQ ID NO: 4133404 - RNA, 21 nt, Yersinia pestis
cagccaauguuucaaaucuac

SEQ ID NO: 4133405 - RNA, 15 nt, Yersinia pestis
cagccaccaugggua

SEQ ID NO: 4133406 - RNA, 18 nt, Yersinia pestis
caggcccugguugcagca

SEQ ID NO: 4133407 - RNA, 16 nt, Yersinia pestis
caggcccuuucaccgc

SEQ ID NO: 4133408 - RNA, 11 nt, Yersinia pestis
caggccgccuu

SEQ ID NO: 4133409 - RNA, 18 nt, Yersinia pestis
caggccgguauucagcca

SEQ ID NO: 4133410 - RNA, 18 nt, Yersinia pestis
caggccuagcccaguacc

SEQ ID NO: 4133411 - RNA, 20 nt, Yersinia pestis
caggcgaguuucccuuuucc

SEQ ID NO: 4133412 - RNA, 16 nt, Yersinia pestis
caggcgaugcaaggaa

SEQ ID NO: 4133413 - RNA, 14 nt, Yersinia pestis
caggcgcuacgcaa

SEQ ID NO: 4133414 - RNA, 14 nt, Yersinia pestis
caggcgcuucaccc

SEQ ID NO: 4133415 - RNA, 17 nt, Yersinia pestis
caggcgcuucacccugu

SEQ ID NO: 4133416 - RNA, 17 nt, Yersinia pestis
caggcggcccuuggcuu

SEQ ID NO: 4133417 - RNA, 19 nt, Yersinia pestis
caggcggguaacugugcag

SEQ ID NO: 4133418 - RNA, 17 nt, Yersinia pestis
caggcggucaaacuccc

SEQ ID NO: 4133419 - RNA, 16 nt, Yersinia pestis
caggcgugcugcuucc

SEQ ID NO: 4133420 - RNA, 17 nt, Yersinia pestis
caggcuaauacaugcug

SEQ ID NO: 4133421 - RNA, 17 nt, Yersinia pestis
caggcuacggcugaucu

SEQ ID NO: 4133422 - RNA, 15 nt, Yersinia pestis
caggcucccaagggu

SEQ ID NO: 4133423 - RNA, 18 nt, Yersinia pestis
caggcucuuuauacuuug

SEQ ID NO: 4133424 - RNA, 13 nt, Yersinia pestis
caggcugcauggg

SEQ ID NO: 4133425 - RNA, 23 nt, Yersinia pestis
caggcugcauggguaaagcccau

SEQ ID NO: 4133426 - RNA, 13 nt, Yersinia pestis
caggcuuauauuu

SEQ ID NO: 4133427 - RNA, 19 nt, Yersinia pestis
cagggaacgaaucaggcag

SEQ ID NO: 4133428 - RNA, 12 nt, Yersinia pestis
cagggagccgcc

SEQ ID NO: 4133429 - RNA, 19 nt, Yersinia pestis
cagggaugggcgccgcuuu

SEQ ID NO: 4133430 - RNA, 21 nt, Yersinia pestis
cagggcaaucaggaaaggccg

SEQ ID NO: 4133431 - RNA, 16 nt, Yersinia pestis
cagggcagcaucguca

SEQ ID NO: 4133432 - RNA, 21 nt, Yersinia pestis
cagggcaucgaaaagcgccuu

SEQ ID NO: 4133433 - RNA, 12 nt, Yersinia pestis
cagggccacuuc

SEQ ID NO: 4133434 - RNA, 19 nt, Yersinia pestis
cagggccgauaaaaaaccc

SEQ ID NO: 4133435 - RNA, 24 nt, Yersinia pestis
cagggcgauagcccuacuggcuga

SEQ ID NO: 4133436 - RNA, 15 nt, Yersinia pestis
cagggcgcaauggcg

SEQ ID NO: 4133437 - RNA, 21 nt, Yersinia pestis
cagggcgcuuucugggugacg

SEQ ID NO: 4133438 - RNA, 22 nt, Yersinia pestis
cagggcgguaacgcagauaaau

SEQ ID NO: 4133439 - RNA, 16 nt, Yersinia pestis
cagggcguauaaacag

SEQ ID NO: 4133440 - RNA, 17 nt, Yersinia pestis
cagggcuaagcaggaag

SEQ ID NO: 4133441 - RNA, 19 nt, Yersinia pestis
caggggaguauugcugagu

SEQ ID NO: 4133442 - RNA, 16 nt, Yersinia pestis
caggggcaauuaucuu

SEQ ID NO: 4133443 - RNA, 16 nt, Yersinia pestis
caggggcgaugucacc

SEQ ID NO: 4133444 - RNA, 15 nt, Yersinia pestis
caggguaaauuauuu

SEQ ID NO: 4133445 - RNA, 16 nt, Yersinia pestis
caggguaaauuauuuu

SEQ ID NO: 4133446 - RNA, 15 nt, Yersinia pestis
caggguaauaaccga

SEQ ID NO: 4133447 - RNA, 22 nt, Yersinia pestis
caggguauuccacccgcacaau

SEQ ID NO: 4133448 - RNA, 14 nt, Yersinia pestis
cagggucaccacca

SEQ ID NO: 4133449 - RNA, 24 nt, Yersinia pestis
cagggugaaagcccaacugacuga

SEQ ID NO: 4133450 - RNA, 20 nt, Yersinia pestis
cagggugaccgcacugccca

SEQ ID NO: 4133451 - RNA, 17 nt, Yersinia pestis
cagggugcgggccagaa

SEQ ID NO: 4133452 - RNA, 15 nt, Yersinia pestis
caggguuaucggugc

SEQ ID NO: 4133453 - RNA, 16 nt, Yersinia pestis
caggguuuugaaauca

SEQ ID NO: 4133454 - RNA, 13 nt, Yersinia pestis
cagguaagaaaga

SEQ ID NO: 4133455 - RNA, 19 nt, Yersinia pestis
cagguaauauugaagacaa

SEQ ID NO: 4133456 - RNA, 16 nt, Yersinia pestis
cagguaaugucacugc

SEQ ID NO: 4133457 - RNA, 22 nt, Yersinia pestis
cagguaccgggccauagcccau

SEQ ID NO: 4133458 - RNA, 19 nt, Yersinia pestis
cagguauucuccaguuggc

SEQ ID NO: 4133459 - RNA, 13 nt, Yersinia pestis
cagguauuucucc

SEQ ID NO: 4133460 - RNA, 13 nt, Yersinia pestis
caggucaaucaau

SEQ ID NO: 4133461 - RNA, 15 nt, Yersinia pestis
caggucaggaagaga

SEQ ID NO: 4133462 - RNA, 17 nt, Yersinia pestis
caggucaggaagagaaa

SEQ ID NO: 4133463 - RNA, 15 nt, Yersinia pestis
caggucgauuacaua

SEQ ID NO: 4133464 - RNA, 12 nt, Yersinia pestis
caggucugcaug

SEQ ID NO: 4133465 - RNA, 14 nt, Yersinia pestis
caggucugcauggu

SEQ ID NO: 4133466 - RNA, 20 nt, Yersinia pestis
caggugaacguuggcuucac

SEQ ID NO: 4133467 - RNA, 17 nt, Yersinia pestis
caggugaguaaacaccu

SEQ ID NO: 4133468 - RNA, 18 nt, Yersinia pestis
caggugcuuauuuauuuu

SEQ ID NO: 4133469 - RNA, 21 nt, Yersinia pestis
caggugcuuauuuauuuuuaa

SEQ ID NO: 4133470 - RNA, 15 nt, Yersinia pestis
caggugcuugacuaa

SEQ ID NO: 4133471 - RNA, 18 nt, Yersinia pestis
cagguggguacugauaaa

SEQ ID NO: 4133472 - RNA, 20 nt, Yersinia pestis
cagguguuaguguucuuacg

SEQ ID NO: 4133473 - RNA, 14 nt, Yersinia pestis
cagguucaauuccc

SEQ ID NO: 4133474 - RNA, 13 nt, Yersinia pestis
cagguucauuaca

SEQ ID NO: 4133475 - RNA, 13 nt, Yersinia pestis
cagguugaaauaa

SEQ ID NO: 4133476 - RNA, 17 nt, Yersinia pestis
cagguugaaauaaauaa

SEQ ID NO: 4133477 - RNA, 13 nt, Yersinia pestis
cagguugaagauc

SEQ ID NO: 4133478 - RNA, 21 nt, Yersinia pestis
cagguuguuauuacuaaugag

SEQ ID NO: 4133479 - RNA, 20 nt, Yersinia pestis
cagguuuuuuccccauggcg

SEQ ID NO: 4133480 - RNA, 13 nt, Yersinia pestis
caguaaaaaaaua

SEQ ID NO: 4133481 - RNA, 14 nt, Yersinia pestis
caguaaaaaaauag

SEQ ID NO: 4133482 - RNA, 12 nt, Yersinia pestis
caguaaaaacug

SEQ ID NO: 4133483 - RNA, 15 nt, Yersinia pestis
caguaaacagccagc

SEQ ID NO: 4133484 - RNA, 16 nt, Yersinia pestis
caguaaacauuuugac

SEQ ID NO: 4133485 - RNA, 17 nt, Yersinia pestis
caguaaacgccaaucac

SEQ ID NO: 4133486 - RNA, 18 nt, Yersinia pestis
caguaaacgcuaaaccau

SEQ ID NO: 4133487 - RNA, 22 nt, Yersinia pestis
caguaaagauuauguagauccc

SEQ ID NO: 4133488 - RNA, 18 nt, Yersinia pestis
caguaaccccuucgagca

SEQ ID NO: 4133489 - RNA, 22 nt, Yersinia pestis
caguaaccccuucgagcaccgc

SEQ ID NO: 4133490 - RNA, 21 nt, Yersinia pestis
caguaacgccugauucaucgc

SEQ ID NO: 4133491 - RNA, 18 nt, Yersinia pestis
caguaacgggucucaaug

SEQ ID NO: 4133492 - RNA, 16 nt, Yersinia pestis
caguaacugaucaaua

SEQ ID NO: 4133493 - RNA, 12 nt, Yersinia pestis
caguaagcucua

SEQ ID NO: 4133494 - RNA, 21 nt, Yersinia pestis
caguaagguauugauacagua

SEQ ID NO: 4133495 - RNA, 14 nt, Yersinia pestis
caguaauauuuuca

SEQ ID NO: 4133496 - RNA, 17 nt, Yersinia pestis
caguaaugcccauugcg

SEQ ID NO: 4133497 - RNA, 14 nt, Yersinia pestis
caguacagaauuuc

SEQ ID NO: 4133498 - RNA, 23 nt, Yersinia pestis
caguacagcgcaucggaucaauu

SEQ ID NO: 4133499 - RNA, 15 nt, Yersinia pestis
caguacauaaaccgu

SEQ ID NO: 4133500 - RNA, 19 nt, Yersinia pestis
caguaccgacaccaauacc

SEQ ID NO: 4133501 - RNA, 15 nt, Yersinia pestis
caguaccugcuaacc

SEQ ID NO: 4133502 - RNA, 21 nt, Yersinia pestis
caguacgacgacggauauucu

SEQ ID NO: 4133503 - RNA, 15 nt, Yersinia pestis
caguagcaggcgcac

SEQ ID NO: 4133504 - RNA, 14 nt, Yersinia pestis
caguagcccagccg

SEQ ID NO: 4133505 - RNA, 19 nt, Yersinia pestis
caguaggcugaaggccugc

SEQ ID NO: 4133506 - RNA, 15 nt, Yersinia pestis
caguaggggccacca

SEQ ID NO: 4133507 - RNA, 22 nt, Yersinia pestis
caguauagaaagugacacauug

SEQ ID NO: 4133508 - RNA, 13 nt, Yersinia pestis
caguaucaaccac

SEQ ID NO: 4133509 - RNA, 15 nt, Yersinia pestis
caguaucaaccaccg

SEQ ID NO: 4133510 - RNA, 17 nt, Yersinia pestis
caguaucaccagaugcc

SEQ ID NO: 4133511 - RNA, 17 nt, Yersinia pestis
caguaucgaagacaaac

SEQ ID NO: 4133512 - RNA, 20 nt, Yersinia pestis
caguaucgaagacaaacacg

SEQ ID NO: 4133513 - RNA, 16 nt, Yersinia pestis
caguaugcgaaacacc

SEQ ID NO: 4133514 - RNA, 16 nt, Yersinia pestis
caguauuagcuuuacu

SEQ ID NO: 4133515 - RNA, 17 nt, Yersinia pestis
caguauucgccagauac

SEQ ID NO: 4133516 - RNA, 13 nt, Yersinia pestis
caguauucugcuu

SEQ ID NO: 4133517 - RNA, 14 nt, Yersinia pestis
cagucaauaaacau

SEQ ID NO: 4133518 - RNA, 23 nt, Yersinia pestis
cagucaauauaccuuuguaucca

SEQ ID NO: 4133519 - RNA, 15 nt, Yersinia pestis
cagucaauugagaau

SEQ ID NO: 4133520 - RNA, 21 nt, Yersinia pestis
cagucaccgcuguaaaugcgu

SEQ ID NO: 4133521 - RNA, 16 nt, Yersinia pestis
cagucacuaaaccauu

SEQ ID NO: 4133522 - RNA, 18 nt, Yersinia pestis
cagucacuuacugaucaa

SEQ ID NO: 4133523 - RNA, 20 nt, Yersinia pestis
cagucacuuugggcugauca

SEQ ID NO: 4133524 - RNA, 18 nt, Yersinia pestis
cagucagccuuaauguuu

SEQ ID NO: 4133525 - RNA, 13 nt, Yersinia pestis
cagucaguaggcu

SEQ ID NO: 4133526 - RNA, 22 nt, Yersinia pestis
cagucauucaccugcccgucac

SEQ ID NO: 4133527 - RNA, 13 nt, Yersinia pestis
cagucauuuacug

SEQ ID NO: 4133528 - RNA, 14 nt, Yersinia pestis
caguccagccaccc

SEQ ID NO: 4133529 - RNA, 21 nt, Yersinia pestis
cauaaaucacaauuucacccc

SEQ ID NO: 4133530 - RNA, 18 nt, Yersinia pestis
cauaaauuaaaacugaaa

SEQ ID NO: 4133531 - RNA, 18 nt, Yersinia pestis
cauaaauucuagcaacau

SEQ ID NO: 4133532 - RNA, 12 nt, Yersinia pestis
cauaaauuuauc

SEQ ID NO: 4133533 - RNA, 21 nt, Yersinia pestis
cauaacaauuaauuggcucau

SEQ ID NO: 4133534 - RNA, 14 nt, Yersinia pestis
cauaacauccuaaa

SEQ ID NO: 4133535 - RNA, 15 nt, Yersinia pestis
cauaacauccuaaaa

SEQ ID NO: 4133536 - RNA, 17 nt, Yersinia pestis
cauaaccaucaaacaua

SEQ ID NO: 4133537 - RNA, 17 nt, Yersinia pestis
cauaaccgcuaaggcca

SEQ ID NO: 4133538 - RNA, 18 nt, Yersinia pestis
cauaaccgcuaaggccaa

SEQ ID NO: 4133539 - RNA, 21 nt, Yersinia pestis
cauaacuuaauggcaccgugg

SEQ ID NO: 4133540 - RNA, 24 nt, Yersinia pestis
cauaagacaccacaucacgcagcg

SEQ ID NO: 4133541 - RNA, 20 nt, Yersinia pestis
cauaagcacgaauuuuauuc

SEQ ID NO: 4133542 - RNA, 21 nt, Yersinia pestis
cauaagcccccguaucaugga

SEQ ID NO: 4133543 - RNA, 12 nt, Yersinia pestis
cauaagccgcag

SEQ ID NO: 4133544 - RNA, 13 nt, Yersinia pestis
cauaaguaaagcg

SEQ ID NO: 4133545 - RNA, 14 nt, Yersinia pestis
cauaaguauuuauu

SEQ ID NO: 4133546 - RNA, 13 nt, Yersinia pestis
cauaaguccuuaa

SEQ ID NO: 4133547 - RNA, 23 nt, Yersinia pestis
cauaaguccuuaaaaauccauaa

SEQ ID NO: 4133548 - RNA, 18 nt, Yersinia pestis
cauaauaaugauuauuga

SEQ ID NO: 4133549 - RNA, 23 nt, Yersinia pestis
cauaauaaugauuauugaccaga

SEQ ID NO: 4133550 - RNA, 14 nt, Yersinia pestis
cauaauaaugcgau

SEQ ID NO: 4133551 - RNA, 16 nt, Yersinia pestis
cauaauccagaagcca

SEQ ID NO: 4133552 - RNA, 19 nt, Yersinia pestis
cauaaucgauuacuggcua

SEQ ID NO: 4133553 - RNA, 17 nt, Yersinia pestis
cauaaucgcguucagag

SEQ ID NO: 4133554 - RNA, 15 nt, Yersinia pestis
cauaaucuuuacugc

SEQ ID NO: 4133555 - RNA, 22 nt, Yersinia pestis
cauaauggacgaacagugccaa

SEQ ID NO: 4133556 - RNA, 13 nt, Yersinia pestis
cauaauuaaauau

SEQ ID NO: 4133557 - RNA, 16 nt, Yersinia pestis
cauaauuaaauauuaa

SEQ ID NO: 4133558 - RNA, 17 nt, Yersinia pestis
cauaauuaaauauuaac

SEQ ID NO: 4133559 - RNA, 14 nt, Yersinia pestis
cauaauucugccga

SEQ ID NO: 4133560 - RNA, 23 nt, Yersinia pestis
cauaauucugccgacuaauauuu

SEQ ID NO: 4133561 - RNA, 13 nt, Yersinia pestis
cauacacggucug

SEQ ID NO: 4133562 - RNA, 14 nt, Yersinia pestis
cauacauagcaccc

SEQ ID NO: 4133563 - RNA, 15 nt, Yersinia pestis
cauacauaucaucau

SEQ ID NO: 4133564 - RNA, 24 nt, Yersinia pestis
cauacaucgcuggacgcaucagau

SEQ ID NO: 4133565 - RNA, 17 nt, Yersinia pestis
cauacauuggcuccccu

SEQ ID NO: 4133566 - RNA, 19 nt, Yersinia pestis
cauacauuggcuccccuuu

SEQ ID NO: 4133567 - RNA, 22 nt, Yersinia pestis
cauacauuggcuccccuuuggg

SEQ ID NO: 4133568 - RNA, 22 nt, Yersinia pestis
cauacccaaauuacggcucagu

SEQ ID NO: 4133569 - RNA, 21 nt, Yersinia pestis
cauacccgcugcuggaaugca

SEQ ID NO: 4133570 - RNA, 22 nt, Yersinia pestis
cauaccgaauaauaaauauccu

SEQ ID NO: 4133571 - RNA, 22 nt, Yersinia pestis
cauaccugaauguuuggcucau

SEQ ID NO: 4133572 - RNA, 14 nt, Yersinia pestis
cauacgaucagcaa

SEQ ID NO: 4133573 - RNA, 13 nt, Yersinia pestis
cauacgguccuga

SEQ ID NO: 4133574 - RNA, 23 nt, Yersinia pestis
cauacucagucaucgcuaacccu

SEQ ID NO: 4133575 - RNA, 21 nt, Yersinia pestis
cauacuccauuuuuuugaugc

SEQ ID NO: 4133576 - RNA, 23 nt, Yersinia pestis
cauacuccauuuuuuugaugcau

SEQ ID NO: 4133577 - RNA, 21 nt, Yersinia pestis
cauacucucgcccucuggugc

SEQ ID NO: 4133578 - RNA, 20 nt, Yersinia pestis
cauacuucgaugauuauuuu

SEQ ID NO: 4133579 - RNA, 13 nt, Yersinia pestis
cauacuuugccuu

SEQ ID NO: 4133580 - RNA, 21 nt, Yersinia pestis
cauagaagcucauaugcagca

SEQ ID NO: 4133581 - RNA, 15 nt, Yersinia pestis
cauagacaugagaca

SEQ ID NO: 4133582 - RNA, 20 nt, Yersinia pestis
cauagacaugagacagcgcg

SEQ ID NO: 4133583 - RNA, 15 nt, Yersinia pestis
cauagacgaaggcac

SEQ ID NO: 4133584 - RNA, 18 nt, Yersinia pestis
cauagauuauuuuuauac

SEQ ID NO: 4133585 - RNA, 19 nt, Yersinia pestis
cauagauuauuuuuauaca

SEQ ID NO: 4133586 - RNA, 13 nt, Yersinia pestis
cauagccauccca

SEQ ID NO: 4133587 - RNA, 11 nt, Yersinia pestis
cauagccaugg

SEQ ID NO: 4133588 - RNA, 15 nt, Yersinia pestis
cauagccauggcuuc

SEQ ID NO: 4133589 - RNA, 17 nt, Yersinia pestis
cauagcgaauaauggca

SEQ ID NO: 4133590 - RNA, 18 nt, Yersinia pestis
cauagcgguuuuguuguc

SEQ ID NO: 4133591 - RNA, 16 nt, Yersinia pestis
cauagcuggcuucaaa

SEQ ID NO: 4133592 - RNA, 17 nt, Yersinia pestis
cauagcuggcuucaaaa

SEQ ID NO: 4133593 - RNA, 19 nt, Yersinia pestis
cauagcuggcuucaaaauc

SEQ ID NO: 4133594 - RNA, 20 nt, Yersinia pestis
cauagcuggcuuucgcuuua

SEQ ID NO: 4133595 - RNA, 15 nt, Yersinia pestis
cauaguccaacgcac

SEQ ID NO: 4133596 - RNA, 19 nt, Yersinia pestis
cauagugauuauuuaaaca

SEQ ID NO: 4133597 - RNA, 23 nt, Yersinia pestis
cauaguugaacucgccuucaggu

SEQ ID NO: 4133598 - RNA, 15 nt, Yersinia pestis
cauauaaaaaacuaa

SEQ ID NO: 4133599 - RNA, 20 nt, Yersinia pestis
cauauaaaaaacuaauguuu

SEQ ID NO: 4133600 - RNA, 13 nt, Yersinia pestis
cauauaaccaugc

SEQ ID NO: 4133601 - RNA, 19 nt, Yersinia pestis
cauauaaccaugcgauacg

SEQ ID NO: 4133602 - RNA, 17 nt, Yersinia pestis
cauauaagcaauaccga

SEQ ID NO: 4133603 - RNA, 14 nt, Yersinia pestis
cauauaauccaaaa

SEQ ID NO: 4133604 - RNA, 13 nt, Yersinia pestis
cauauaucacuau

SEQ ID NO: 4133605 - RNA, 15 nt, Yersinia pestis
cauauaucacuauuu

SEQ ID NO: 4133606 - RNA, 19 nt, Yersinia pestis
cauauaucacuauuucagg

SEQ ID NO: 4133607 - RNA, 12 nt, Yersinia pestis
cauauauugauc

SEQ ID NO: 4133608 - RNA, 15 nt, Yersinia pestis
cauauauugcauuua

SEQ ID NO: 4133609 - RNA, 11 nt, Yersinia pestis
cauauauuuca

SEQ ID NO: 4133610 - RNA, 19 nt, Yersinia pestis
cauauauuuuucuuucucg

SEQ ID NO: 4133611 - RNA, 14 nt, Yersinia pestis
cauaucaaaauaaa

SEQ ID NO: 4133612 - RNA, 15 nt, Yersinia pestis
cauaucaaaauaaaa

SEQ ID NO: 4133613 - RNA, 21 nt, Yersinia pestis
cauaucaaaauaaaaauucac

SEQ ID NO: 4133614 - RNA, 14 nt, Yersinia pestis
cauaucaaccguuu

SEQ ID NO: 4133615 - RNA, 17 nt, Yersinia pestis
cauaucacaguuaaaaa

SEQ ID NO: 4133616 - RNA, 14 nt, Yersinia pestis
cauaucgaccauga

SEQ ID NO: 4133617 - RNA, 15 nt, Yersinia pestis
cauaucgaucaacca

SEQ ID NO: 4133618 - RNA, 16 nt, Yersinia pestis
cauaucgcuaaaacac

SEQ ID NO: 4133619 - RNA, 15 nt, Yersinia pestis
cauaucuugaaccaa

SEQ ID NO: 4133620 - RNA, 20 nt, Yersinia pestis
cauaucuugaaccaauuuuu

SEQ ID NO: 4133621 - RNA, 20 nt, Yersinia pestis
cauaucuuuaccuguuucaa

SEQ ID NO: 4133622 - RNA, 14 nt, Yersinia pestis
cauaugaaaaaccu

SEQ ID NO: 4133623 - RNA, 21 nt, Yersinia pestis
cauaugaaaaaccuccggcua

SEQ ID NO: 4133624 - RNA, 17 nt, Yersinia pestis
cauaugaacaucaaacc

SEQ ID NO: 4133625 - RNA, 11 nt, Yersinia pestis
cauaugacaaa

SEQ ID NO: 4133626 - RNA, 14 nt, Yersinia pestis
cauaugcagcaucc

SEQ ID NO: 4133627 - RNA, 21 nt, Yersinia pestis
cauauguucgaucaaaacaau

SEQ ID NO: 4133628 - RNA, 13 nt, Yersinia pestis
cauauguugaguc

SEQ ID NO: 4133629 - RNA, 13 nt, Yersinia pestis
cauauuacccagu

SEQ ID NO: 4133630 - RNA, 18 nt, Yersinia pestis
cauauucaccguuuccag

SEQ ID NO: 4133631 - RNA, 12 nt, Yersinia pestis
cauauucagccg

SEQ ID NO: 4133632 - RNA, 18 nt, Yersinia pestis
cauauucaguaacaacau

SEQ ID NO: 4133633 - RNA, 12 nt, Yersinia pestis
cauauucaucaa

SEQ ID NO: 4133634 - RNA, 19 nt, Yersinia pestis
cauauucaugguuucaaaa

SEQ ID NO: 4133635 - RNA, 19 nt, Yersinia pestis
cauauugcucugccgcagu

SEQ ID NO: 4133636 - RNA, 16 nt, Yersinia pestis
cauauuggcaauauuc

SEQ ID NO: 4133637 - RNA, 22 nt, Yersinia pestis
cauauuggccaguugccacuca

SEQ ID NO: 4133638 - RNA, 15 nt, Yersinia pestis
cauauuguccaaagg

SEQ ID NO: 4133639 - RNA, 17 nt, Yersinia pestis
cauauuguccaaaggaa

SEQ ID NO: 4133640 - RNA, 19 nt, Yersinia pestis
cauauuguccaaaggaagg

SEQ ID NO: 4133641 - RNA, 22 nt, Yersinia pestis
cauauuguccaacaucuccgcc

SEQ ID NO: 4133642 - RNA, 12 nt, Yersinia pestis
caucaaaacaau

SEQ ID NO: 4133643 - RNA, 22 nt, Yersinia pestis
caucaaaacugaugguuuccug

SEQ ID NO: 4133644 - RNA, 14 nt, Yersinia pestis
caucaaaauugaug

SEQ ID NO: 4133645 - RNA, 17 nt, Yersinia pestis
caucaaacccccacagc

SEQ ID NO: 4133646 - RNA, 13 nt, Yersinia pestis
caucaaaccggcu

SEQ ID NO: 4133647 - RNA, 17 nt, Yersinia pestis
caucaaacggcaacuuc

SEQ ID NO: 4133648 - RNA, 19 nt, Yersinia pestis
caucaaacggcaacuucua

SEQ ID NO: 4133649 - RNA, 23 nt, Yersinia pestis
caucaaacggcaacuucuacaua

SEQ ID NO: 4133650 - RNA, 21 nt, Yersinia pestis
caucaaauacacauaaccauc

SEQ ID NO: 4133651 - RNA, 19 nt, Yersinia pestis
caucgacuugaugaaguua

SEQ ID NO: 4133652 - RNA, 20 nt, Yersinia pestis
caucgaggaauagccagcgu

SEQ ID NO: 4133653 - RNA, 13 nt, Yersinia pestis
caucgccagcggg

SEQ ID NO: 4133654 - RNA, 16 nt, Yersinia pestis
caucgccauccgugcg

SEQ ID NO: 4133655 - RNA, 16 nt, Yersinia pestis
caucgccccaaagaua

SEQ ID NO: 4133656 - RNA, 14 nt, Yersinia pestis
caucgcccugcucu

SEQ ID NO: 4133657 - RNA, 17 nt, Yersinia pestis
caucgccguuuugccau

SEQ ID NO: 4133658 - RNA, 15 nt, Yersinia pestis
caucgccugaucacg

SEQ ID NO: 4133659 - RNA, 20 nt, Yersinia pestis
caucgccuguauuuuaaugc

SEQ ID NO: 4133660 - RNA, 20 nt, Yersinia pestis
caucgcgauugaaagucaca

SEQ ID NO: 4133661 - RNA, 21 nt, Yersinia pestis
caucgcgccuaccugccugcu

SEQ ID NO: 4133662 - RNA, 22 nt, Yersinia pestis
caucgcgccuaccugccugcug

SEQ ID NO: 4133663 - RNA, 23 nt, Yersinia pestis
caucgcggaugccuuuaauggca

SEQ ID NO: 4133664 - RNA, 20 nt, Yersinia pestis
caucgcggaugcgcgcguca

SEQ ID NO: 4133665 - RNA, 22 nt, Yersinia pestis
caucgcggaugcgcgcgucacu

SEQ ID NO: 4133666 - RNA, 22 nt, Yersinia pestis
caucgcgggcgcgcugcugcuc

SEQ ID NO: 4133667 - RNA, 15 nt, Yersinia pestis
caucgcucaucgcca

SEQ ID NO: 4133668 - RNA, 16 nt, Yersinia pestis
caucgcucaucgccaa

SEQ ID NO: 4133669 - RNA, 21 nt, Yersinia pestis
caucgcugcaauaaagcguca

SEQ ID NO: 4133670 - RNA, 21 nt, Yersinia pestis
caucgcuggacgcaucagauc

SEQ ID NO: 4133671 - RNA, 16 nt, Yersinia pestis
caucggauugcaacaa

SEQ ID NO: 4133672 - RNA, 21 nt, Yersinia pestis
caucggcaauaauaucuggcg

SEQ ID NO: 4133673 - RNA, 17 nt, Yersinia pestis
caucggccugcgcugcu

SEQ ID NO: 4133674 - RNA, 22 nt, Yersinia pestis
caucggcgaggcguuggcuucu

SEQ ID NO: 4133675 - RNA, 14 nt, Yersinia pestis
caucgggaacagga

SEQ ID NO: 4133676 - RNA, 20 nt, Yersinia pestis
caucgggauccgccugcugg

SEQ ID NO: 4133677 - RNA, 14 nt, Yersinia pestis
caucguaaccccca

SEQ ID NO: 4133678 - RNA, 22 nt, Yersinia pestis
caucgugcuccgcuuccaucac

SEQ ID NO: 4133679 - RNA, 23 nt, Yersinia pestis
caucguggucaccgccaaaugaa

SEQ ID NO: 4133680 - RNA, 20 nt, Yersinia pestis
caucuaacucauucauaauu

SEQ ID NO: 4133681 - RNA, 19 nt, Yersinia pestis
caucuaauguaauaaucua

SEQ ID NO: 4133682 - RNA, 20 nt, Yersinia pestis
caucuaauguaauaaucuaa

SEQ ID NO: 4133683 - RNA, 17 nt, Yersinia pestis
caucuacaacaucaucg

SEQ ID NO: 4133684 - RNA, 18 nt, Yersinia pestis
caucuagcagugauuuca

SEQ ID NO: 4133685 - RNA, 17 nt, Yersinia pestis
caucuauggauuacuua

SEQ ID NO: 4133686 - RNA, 12 nt, Yersinia pestis
caucucaauaac

SEQ ID NO: 4133687 - RNA, 15 nt, Yersinia pestis
caucucaauaacuau

SEQ ID NO: 4133688 - RNA, 21 nt, Yersinia pestis
caucucaauaacuauuuuuga

SEQ ID NO: 4133689 - RNA, 17 nt, Yersinia pestis
caucucaugacaaagaa

SEQ ID NO: 4133690 - RNA, 19 nt, Yersinia pestis
caucuccagaauauaaaag

SEQ ID NO: 4133691 - RNA, 19 nt, Yersinia pestis
caucuccgccaacccuuuu

SEQ ID NO: 4133692 - RNA, 16 nt, Yersinia pestis
caucuccgcuauuuuc

SEQ ID NO: 4133693 - RNA, 23 nt, Yersinia pestis
caucugaccagugagccaugugu

SEQ ID NO: 4133694 - RNA, 22 nt, Yersinia pestis
caucugcaauaacgugauggua

SEQ ID NO: 4133695 - RNA, 21 nt, Yersinia pestis
caucugcuuuacugcuuuucu

SEQ ID NO: 4133696 - RNA, 14 nt, Yersinia pestis
caucugucuaagug

SEQ ID NO: 4133697 - RNA, 16 nt, Yersinia pestis
caucuuaccggccucu

SEQ ID NO: 4133698 - RNA, 12 nt, Yersinia pestis
caucuuccagca

SEQ ID NO: 4133699 - RNA, 18 nt, Yersinia pestis
caucuucgcuuucaucuu

SEQ ID NO: 4133700 - RNA, 23 nt, Yersinia pestis
caucuugcgccgaaauaaaacca

SEQ ID NO: 4133701 - RNA, 19 nt, Yersinia pestis
caucuugggccgacucugc

SEQ ID NO: 4133702 - RNA, 20 nt, Yersinia pestis
caucuugucgucacccauuu

SEQ ID NO: 4133703 - RNA, 12 nt, Yersinia pestis
caucuuuaacaa

SEQ ID NO: 4133704 - RNA, 16 nt, Yersinia pestis
caucuuuaauuaaugg

SEQ ID NO: 4133705 - RNA, 16 nt, Yersinia pestis
caucuuuaccccauug

SEQ ID NO: 4133706 - RNA, 12 nt, Yersinia pestis
caucuuuuucug

SEQ ID NO: 4133707 - RNA, 20 nt, Yersinia pestis
caucuuuuuuuuuauuauca

SEQ ID NO: 4133708 - RNA, 17 nt, Yersinia pestis
caugaacggauacccag

SEQ ID NO: 4133709 - RNA, 15 nt, Yersinia pestis
caugaaguuuaacca

SEQ ID NO: 4133710 - RNA, 23 nt, Yersinia pestis
caugacaaagaauguuauugcuc

SEQ ID NO: 4133711 - RNA, 13 nt, Yersinia pestis
caugagaaccagu

SEQ ID NO: 4133712 - RNA, 23 nt, Yersinia pestis
caugagaauacuucaggccaaua

SEQ ID NO: 4133713 - RNA, 17 nt, Yersinia pestis
caugagugaaaauaugu

SEQ ID NO: 4133714 - RNA, 21 nt, Yersinia pestis
caugauaaaacuauucugcuu

SEQ ID NO: 4133715 - RNA, 16 nt, Yersinia pestis
caugauaaccacaacg

SEQ ID NO: 4133716 - RNA, 22 nt, Yersinia pestis
caugauaaugccaugcucucug

SEQ ID NO: 4133717 - RNA, 16 nt, Yersinia pestis
caugaugacaaugcgu

SEQ ID NO: 4133718 - RNA, 18 nt, Yersinia pestis
caugaugacaaugcguua

SEQ ID NO: 4133719 - RNA, 16 nt, Yersinia pestis
caugaugauaucaccu

SEQ ID NO: 4133720 - RNA, 21 nt, Yersinia pestis
caugauggcaccgugggcaaa

SEQ ID NO: 4133721 - RNA, 21 nt, Yersinia pestis
caugauggucguggcauugag

SEQ ID NO: 4133722 - RNA, 12 nt, Yersinia pestis
caugauucucua

SEQ ID NO: 4133723 - RNA, 15 nt, Yersinia pestis
caugauuuguugaug

SEQ ID NO: 4133724 - RNA, 11 nt, Yersinia pestis
caugcaacaga

SEQ ID NO: 4133725 - RNA, 15 nt, Yersinia pestis
caugcauuaaggcgc

SEQ ID NO: 4133726 - RNA, 23 nt, Yersinia pestis
caugcauuaaggcgcgacugauu

SEQ ID NO: 4133727 - RNA, 17 nt, Yersinia pestis
caugcauuggaaaaaau

SEQ ID NO: 4133728 - RNA, 23 nt, Yersinia pestis
caugccagaaacggcaucugcca

SEQ ID NO: 4133729 - RNA, 12 nt, Yersinia pestis
caugccauggcg

SEQ ID NO: 4133730 - RNA, 18 nt, Yersinia pestis
caugcccagccucuggau

SEQ ID NO: 4133731 - RNA, 18 nt, Yersinia pestis
caugccccaauguagaca

SEQ ID NO: 4133732 - RNA, 17 nt, Yersinia pestis
caugccggaugguauuc

SEQ ID NO: 4133733 - RNA, 23 nt, Yersinia pestis
caugccucguuggaucaucggga

SEQ ID NO: 4133734 - RNA, 16 nt, Yersinia pestis
caugccuugaaacuca

SEQ ID NO: 4133735 - RNA, 20 nt, Yersinia pestis
caugccuugaaacucaacga

SEQ ID NO: 4133736 - RNA, 15 nt, Yersinia pestis
caugcgaauacuuug

SEQ ID NO: 4133737 - RNA, 16 nt, Yersinia pestis
caugcgccauauaccc

SEQ ID NO: 4133738 - RNA, 20 nt, Yersinia pestis
caugcggauugaacugcgcu

SEQ ID NO: 4133739 - RNA, 16 nt, Yersinia pestis
caugcguaaaugaaau

SEQ ID NO: 4133740 - RNA, 19 nt, Yersinia pestis
caugcuaacuuguucagaa

SEQ ID NO: 4133741 - RNA, 17 nt, Yersinia pestis
caugcucaguuguauua

SEQ ID NO: 4133742 - RNA, 13 nt, Yersinia pestis
caugcucuucaua

SEQ ID NO: 4133743 - RNA, 19 nt, Yersinia pestis
caugcugaaucuguaaguc

SEQ ID NO: 4133744 - RNA, 15 nt, Yersinia pestis
caugcugucauuggu

SEQ ID NO: 4133745 - RNA, 12 nt, Yersinia pestis
caugcuguucac

SEQ ID NO: 4133746 - RNA, 23 nt, Yersinia pestis
cauggaaaauauucuaaguaaaa

SEQ ID NO: 4133747 - RNA, 15 nt, Yersinia pestis
cauggacggcauaua

SEQ ID NO: 4133748 - RNA, 17 nt, Yersinia pestis
cauggagagcagggccc

SEQ ID NO: 4133749 - RNA, 16 nt, Yersinia pestis
cauggaucacccguug

SEQ ID NO: 4133750 - RNA, 20 nt, Yersinia pestis
cauggaucacccguugcaag

SEQ ID NO: 4133751 - RNA, 20 nt, Yersinia pestis
cauggaugguauuugacaug

SEQ ID NO: 4133752 - RNA, 19 nt, Yersinia pestis
cauggcaaccccuaaucca

SEQ ID NO: 4133753 - RNA, 21 nt, Yersinia pestis
cauggcaaccccuaauccagc

SEQ ID NO: 4133754 - RNA, 22 nt, Yersinia pestis
cauggcaaccccuaauccagca

SEQ ID NO: 4133755 - RNA, 13 nt, Yersinia pestis
cauggcaugccau

SEQ ID NO: 4133756 - RNA, 19 nt, Yersinia pestis
cauggccaugaaucaaauu

SEQ ID NO: 4133757 - RNA, 16 nt, Yersinia pestis
cauggcgaaaauccuu

SEQ ID NO: 4133758 - RNA, 19 nt, Yersinia pestis
cauggcgaaaauccuucau

SEQ ID NO: 4133759 - RNA, 21 nt, Yersinia pestis
cauggcgaaaauccuucauuu

SEQ ID NO: 4133760 - RNA, 22 nt, Yersinia pestis
cauggcgaucaaaggcgaccaa

SEQ ID NO: 4133761 - RNA, 21 nt, Yersinia pestis
cauggcggcagcacagagcac

SEQ ID NO: 4133762 - RNA, 15 nt, Yersinia pestis
cauggcguaaccgcc

SEQ ID NO: 4133763 - RNA, 16 nt, Yersinia pestis
cauggcguaaccgccg

SEQ ID NO: 4133764 - RNA, 14 nt, Yersinia pestis
cauggcuaaaucca

SEQ ID NO: 4133765 - RNA, 16 nt, Yersinia pestis
cauggcucucuuuuuu

SEQ ID NO: 4133766 - RNA, 17 nt, Yersinia pestis
cauggcuuuaugaccaa

SEQ ID NO: 4133767 - RNA, 15 nt, Yersinia pestis
cauggcuuuuugccc

SEQ ID NO: 4133768 - RNA, 22 nt, Yersinia pestis
caugggcaagcucugggcugau

SEQ ID NO: 4133769 - RNA, 22 nt, Yersinia pestis
caugggcuugcauaucagcaau

SEQ ID NO: 4133770 - RNA, 16 nt, Yersinia pestis
caugguaagaauaaau

SEQ ID NO: 4133771 - RNA, 18 nt, Yersinia pestis
caugguuggcccaaucga

SEQ ID NO: 4133772 - RNA, 20 nt, Yersinia pestis
cauuggcugguaauucgcua

SEQ ID NO: 4133773 - RNA, 20 nt, Yersinia pestis
cauuggcuucaacuuuuuuc

SEQ ID NO: 4133774 - RNA, 13 nt, Yersinia pestis
cauuggcuuuuug

SEQ ID NO: 4133775 - RNA, 14 nt, Yersinia pestis
cauuguaaaauaag

SEQ ID NO: 4133776 - RNA, 16 nt, Yersinia pestis
cauuguagauggccau

SEQ ID NO: 4133777 - RNA, 13 nt, Yersinia pestis
cauugucaccuaa

SEQ ID NO: 4133778 - RNA, 23 nt, Yersinia pestis
cauugucaccuaaccaaacauug

SEQ ID NO: 4133779 - RNA, 20 nt, Yersinia pestis
cauugucagguuaauaccug

SEQ ID NO: 4133780 - RNA, 23 nt, Yersinia pestis
cauugucagguuaauaccugcac

SEQ ID NO: 4133781 - RNA, 14 nt, Yersinia pestis
cauugugcuuuuug

SEQ ID NO: 4133782 - RNA, 12 nt, Yersinia pestis
cauuguggagga

SEQ ID NO: 4133783 - RNA, 23 nt, Yersinia pestis
cauuguucucauuuacaggaacg

SEQ ID NO: 4133784 - RNA, 14 nt, Yersinia pestis
cauuuaaaauacuc

SEQ ID NO: 4133785 - RNA, 13 nt, Yersinia pestis
cauuuaauuaaau

SEQ ID NO: 4133786 - RNA, 17 nt, Yersinia pestis
cauuuaauuaaaugacu

SEQ ID NO: 4133787 - RNA, 14 nt, Yersinia pestis
cauuuaccaucagg

SEQ ID NO: 4133788 - RNA, 20 nt, Yersinia pestis
cauuuacccgucauccuuca

SEQ ID NO: 4133789 - RNA, 15 nt, Yersinia pestis
cauuuagcauuauuc

SEQ ID NO: 4133790 - RNA, 15 nt, Yersinia pestis
cauuuauauaacagc

SEQ ID NO: 4133791 - RNA, 17 nt, Yersinia pestis
cauuuauauaacagcca

SEQ ID NO: 4133792 - RNA, 21 nt, Yersinia pestis
cauuuaucaagccaaugaauc

SEQ ID NO: 4133793 - RNA, 19 nt, Yersinia pestis
cauuuaucuaaaacugccu

SEQ ID NO: 4133794 - RNA, 15 nt, Yersinia pestis
cauuuauuacauuua

SEQ ID NO: 4133795 - RNA, 13 nt, Yersinia pestis
cauuuauuuccac

SEQ ID NO: 4133796 - RNA, 23 nt, Yersinia pestis
cauuucacccucugcagcuugca

SEQ ID NO: 4133797 - RNA, 15 nt, Yersinia pestis
cauuucacggugcuc

SEQ ID NO: 4133798 - RNA, 21 nt, Yersinia pestis
cauuucaggacugucuucaac

SEQ ID NO: 4133799 - RNA, 14 nt, Yersinia pestis
cauuuccaauacca

SEQ ID NO: 4133800 - RNA, 23 nt, Yersinia pestis
cauuuccaauaccaauucuucau

SEQ ID NO: 4133801 - RNA, 12 nt, Yersinia pestis
cauuuccaucau

SEQ ID NO: 4133802 - RNA, 14 nt, Yersinia pestis
cauuucccgugcac

SEQ ID NO: 4133803 - RNA, 17 nt, Yersinia pestis
cauuucccgugcacugc

SEQ ID NO: 4133804 - RNA, 18 nt, Yersinia pestis
cauuucccgugcacugcg

SEQ ID NO: 4133805 - RNA, 19 nt, Yersinia pestis
cauuucccgugcacugcga

SEQ ID NO: 4133806 - RNA, 18 nt, Yersinia pestis
cauuuccuguauuuccug

SEQ ID NO: 4133807 - RNA, 23 nt, Yersinia pestis
cauuuccuguguuuugagcauca

SEQ ID NO: 4133808 - RNA, 16 nt, Yersinia pestis
cauuucgcuccaccag

SEQ ID NO: 4133809 - RNA, 19 nt, Yersinia pestis
cauuucgcuccaccagccc

SEQ ID NO: 4133810 - RNA, 14 nt, Yersinia pestis
cauuucguagccuu

SEQ ID NO: 4133811 - RNA, 23 nt, Yersinia pestis
cauuucugguugugcuucagaca

SEQ ID NO: 4133812 - RNA, 21 nt, Yersinia pestis
cauuucuugcucgaucagcgu

SEQ ID NO: 4133813 - RNA, 21 nt, Yersinia pestis
cauuugagcagguguaaauuu

SEQ ID NO: 4133814 - RNA, 15 nt, Yersinia pestis
cauuugagcuguuau

SEQ ID NO: 4133815 - RNA, 21 nt, Yersinia pestis
cauuugcgcaauacgucgcau

SEQ ID NO: 4133816 - RNA, 18 nt, Yersinia pestis
cauuugggcaauguugag

SEQ ID NO: 4133817 - RNA, 13 nt, Yersinia pestis
cauuuguauuuuu

SEQ ID NO: 4133818 - RNA, 14 nt, Yersinia pestis
cauuuguauuuuuu

SEQ ID NO: 4133819 - RNA, 19 nt, Yersinia pestis
cauuugucguuauaaacca

SEQ ID NO: 4133820 - RNA, 13 nt, Yersinia pestis
cauuuguuucuga

SEQ ID NO: 4133821 - RNA, 15 nt, Yersinia pestis
cauuuuaaaaaaauu

SEQ ID NO: 4133822 - RNA, 19 nt, Yersinia pestis
cauuuuaaucucuccauga

SEQ ID NO: 4133823 - RNA, 15 nt, Yersinia pestis
cauuuuacucccuga

SEQ ID NO: 4133824 - RNA, 14 nt, Yersinia pestis
cauuuuauccucuu

SEQ ID NO: 4133825 - RNA, 15 nt, Yersinia pestis
cauuuuauccucuuc

SEQ ID NO: 4133826 - RNA, 16 nt, Yersinia pestis
cauuuuauccucuucc

SEQ ID NO: 4133827 - RNA, 14 nt, Yersinia pestis
cauuuucaauacca

SEQ ID NO: 4133828 - RNA, 12 nt, Yersinia pestis
cauuuucaucac

SEQ ID NO: 4133829 - RNA, 17 nt, Yersinia pestis
cauuuuccaguuucauc

SEQ ID NO: 4133830 - RNA, 20 nt, Yersinia pestis
cauuuucccgaggagagaaa

SEQ ID NO: 4133831 - RNA, 16 nt, Yersinia pestis
cauuuuccugcauauu

SEQ ID NO: 4133832 - RNA, 21 nt, Yersinia pestis
cauuuuccugcauauuauuuu

SEQ ID NO: 4133833 - RNA, 13 nt, Yersinia pestis
cauuuugcugcca

SEQ ID NO: 4133834 - RNA, 23 nt, Yersinia pestis
cauuuugggcuugagcagugcgc

SEQ ID NO: 4133835 - RNA, 21 nt, Yersinia pestis
cauuuuguauuuuguuuuuuu

SEQ ID NO: 4133836 - RNA, 21 nt, Yersinia pestis
cauuuugugcucuggcuauau

SEQ ID NO: 4133837 - RNA, 13 nt, Yersinia pestis
cauuuuuaacauc

SEQ ID NO: 4133838 - RNA, 21 nt, Yersinia pestis
cauuuuuauuuuaucuacuuc

SEQ ID NO: 4133839 - RNA, 20 nt, Yersinia pestis
cauuuuuuaaaaccaaauua

SEQ ID NO: 4133840 - RNA, 17 nt, Yersinia pestis
cauuuuuuaccauuacc

SEQ ID NO: 4133841 - RNA, 19 nt, Yersinia pestis
cauuuuuuaucuuguaaau

SEQ ID NO: 4133842 - RNA, 23 nt, Yersinia pestis
cauuuuuuaucuuguaaauaguc

SEQ ID NO: 4133843 - RNA, 11 nt, Yersinia pestis
cauuuuuucuu

SEQ ID NO: 4133844 - RNA, 14 nt, Yersinia pestis
cauuuuuuguagug

SEQ ID NO: 4133845 - RNA, 12 nt, Yersinia pestis
ccaaaaaucuug

SEQ ID NO: 4133846 - RNA, 22 nt, Yersinia pestis
ccaaaaccgugacuaaaacaag

SEQ ID NO: 4133847 - RNA, 10 nt, Yersinia pestis
ccaaaaccuu

SEQ ID NO: 4133848 - RNA, 18 nt, Yersinia pestis
ccaaaacgaacaaaaugg

SEQ ID NO: 4133849 - RNA, 16 nt, Yersinia pestis
ccaaaacgacgggcca

SEQ ID NO: 4133850 - RNA, 13 nt, Yersinia pestis
ccaaaauaauaua

SEQ ID NO: 4133851 - RNA, 22 nt, Yersinia pestis
ccaaaauaugauaguguaaaaa

SEQ ID NO: 4133852 - RNA, 11 nt, Yersinia pestis
ccaaaaucaaa

SEQ ID NO: 4133853 - RNA, 15 nt, Yersinia pestis
ccaaaaucaaauacu

SEQ ID NO: 4133854 - RNA, 16 nt, Yersinia pestis
ccaaaauccaccagcg

SEQ ID NO: 4133855 - RNA, 17 nt, Yersinia pestis
ccaaaauuuagaagccc

SEQ ID NO: 4133856 - RNA, 12 nt, Yersinia pestis
ccaaaauuugcu

SEQ ID NO: 4133857 - RNA, 12 nt, Yersinia pestis
ccaaacaaacac

SEQ ID NO: 4133858 - RNA, 14 nt, Yersinia pestis
ccaaacaaaugaac

SEQ ID NO: 4133859 - RNA, 20 nt, Yersinia pestis
ccaaacaaaugaacccuuuc

SEQ ID NO: 4133860 - RNA, 22 nt, Yersinia pestis
ccaaacaacaacacaauuaaua

SEQ ID NO: 4133861 - RNA, 15 nt, Yersinia pestis
ccaaacaccacgcca

SEQ ID NO: 4133862 - RNA, 11 nt, Yersinia pestis
ccaaacagaau

SEQ ID NO: 4133863 - RNA, 18 nt, Yersinia pestis
ccaaacauugucaccuga

SEQ ID NO: 4133864 - RNA, 19 nt, Yersinia pestis
ccaaacauugucaccugaa

SEQ ID NO: 4133865 - RNA, 12 nt, Yersinia pestis
ccaaacauuuuc

SEQ ID NO: 4133866 - RNA, 14 nt, Yersinia pestis
ccaaacucuggaug

SEQ ID NO: 4133867 - RNA, 21 nt, Yersinia pestis
ccaaagcaguaaacauuuuga

SEQ ID NO: 4133868 - RNA, 22 nt, Yersinia pestis
ccaaagcccuuauccguuaacc

SEQ ID NO: 4133869 - RNA, 19 nt, Yersinia pestis
ccaaagccgucaguuccug

SEQ ID NO: 4133870 - RNA, 16 nt, Yersinia pestis
ccaaaguagaacuggc

SEQ ID NO: 4133871 - RNA, 12 nt, Yersinia pestis
ccaaauaaaaca

SEQ ID NO: 4133872 - RNA, 18 nt, Yersinia pestis
ccaaauacauauaaccau

SEQ ID NO: 4133873 - RNA, 23 nt, Yersinia pestis
ccaaauagcaagccaaaacagcc

SEQ ID NO: 4133874 - RNA, 18 nt, Yersinia pestis
ccaaaucucaucggcaua

SEQ ID NO: 4133875 - RNA, 13 nt, Yersinia pestis
ccaaaugagaugg

SEQ ID NO: 4133876 - RNA, 18 nt, Yersinia pestis
ccaaauggacgaacagcc

SEQ ID NO: 4133877 - RNA, 14 nt, Yersinia pestis
ccaaauucagaaug

SEQ ID NO: 4133878 - RNA, 15 nt, Yersinia pestis
ccaaauugugaguua

SEQ ID NO: 4133879 - RNA, 14 nt, Yersinia pestis
ccaacaacugcccc

SEQ ID NO: 4133880 - RNA, 17 nt, Yersinia pestis
ccaacaauugcuccagu

SEQ ID NO: 4133881 - RNA, 22 nt, Yersinia pestis
ccaacaccacacugagcaccgc

SEQ ID NO: 4133882 - RNA, 14 nt, Yersinia pestis
ccaacaccaccauc

SEQ ID NO: 4133883 - RNA, 23 nt, Yersinia pestis
ccaacacguggguauccaguguc

SEQ ID NO: 4133884 - RNA, 21 nt, Yersinia pestis
ccaacacucaugacaaaaugc

SEQ ID NO: 4133885 - RNA, 16 nt, Yersinia pestis
ccaacacuggggcgca

SEQ ID NO: 4133886 - RNA, 17 nt, Yersinia pestis
ccaacaguuauuuuaau

SEQ ID NO: 4133887 - RNA, 16 nt, Yersinia pestis
ccaacauaaucaaucc

SEQ ID NO: 4133888 - RNA, 16 nt, Yersinia pestis
ccaacaucuccgccaa

SEQ ID NO: 4133889 - RNA, 16 nt, Yersinia pestis
ccaacaucuuccaaug

SEQ ID NO: 4133890 - RNA, 15 nt, Yersinia pestis
ccaacauguugaaau

SEQ ID NO: 4133891 - RNA, 20 nt, Yersinia pestis
ccaacauguugaaaucuauu

SEQ ID NO: 4133892 - RNA, 14 nt, Yersinia pestis
ccaaccaggccgcc

SEQ ID NO: 4133893 - RNA, 21 nt, Yersinia pestis
ccaaccaggccgccaucauca

SEQ ID NO: 4133894 - RNA, 14 nt, Yersinia pestis
ccaaccaucaucaa

SEQ ID NO: 4133895 - RNA, 14 nt, Yersinia pestis
ccaccccguggcag

SEQ ID NO: 4133896 - RNA, 18 nt, Yersinia pestis
ccacccguagcccuugca

SEQ ID NO: 4133897 - RNA, 19 nt, Yersinia pestis
ccacccguugcauuuuucu

SEQ ID NO: 4133898 - RNA, 21 nt, Yersinia pestis
ccaccgagguuaucagccucu

SEQ ID NO: 4133899 - RNA, 16 nt, Yersinia pestis
ccaccggcaguucauu

SEQ ID NO: 4133900 - RNA, 19 nt, Yersinia pestis
ccaccggcaguucauuccc

SEQ ID NO: 4133901 - RNA, 20 nt, Yersinia pestis
ccaccgucaagacaacaaac

SEQ ID NO: 4133902 - RNA, 15 nt, Yersinia pestis
ccaccgucuguggug

SEQ ID NO: 4133903 - RNA, 21 nt, Yersinia pestis
ccaccguguccggguuuaccc

SEQ ID NO: 4133904 - RNA, 14 nt, Yersinia pestis
ccaccuacaaccua

SEQ ID NO: 4133905 - RNA, 19 nt, Yersinia pestis
ccaccuacaaccuaccacc

SEQ ID NO: 4133906 - RNA, 20 nt, Yersinia pestis
ccaccuacaaccuaccaccu

SEQ ID NO: 4133907 - RNA, 13 nt, Yersinia pestis
ccaccuaccaccu

SEQ ID NO: 4133908 - RNA, 19 nt, Yersinia pestis
ccaccuaccaccuaccacc

SEQ ID NO: 4133909 - RNA, 16 nt, Yersinia pestis
ccaccuaucuauuuuu

SEQ ID NO: 4133910 - RNA, 17 nt, Yersinia pestis
ccaccuaucuauuuuua

SEQ ID NO: 4133911 - RNA, 19 nt, Yersinia pestis
ccaccugaaucucgcgccc

SEQ ID NO: 4133912 - RNA, 14 nt, Yersinia pestis
ccaccuuaaaauaa

SEQ ID NO: 4133913 - RNA, 13 nt, Yersinia pestis
ccacgaggacagg

SEQ ID NO: 4133914 - RNA, 17 nt, Yersinia pestis
ccacgaggguucagggc

SEQ ID NO: 4133915 - RNA, 22 nt, Yersinia pestis
ccacgaguuuucccugcgccag

SEQ ID NO: 4133916 - RNA, 20 nt, Yersinia pestis
ccacgaucaucaacucgcca

SEQ ID NO: 4133917 - RNA, 18 nt, Yersinia pestis
ccacgauuacguuuucuu

SEQ ID NO: 4133918 - RNA, 17 nt, Yersinia pestis
ccacgauuuaaugguuu

SEQ ID NO: 4133919 - RNA, 17 nt, Yersinia pestis
ccacgccaacccucuuc

SEQ ID NO: 4133920 - RNA, 18 nt, Yersinia pestis
ccacgccaacccucuucc

SEQ ID NO: 4133921 - RNA, 17 nt, Yersinia pestis
ccacgccaauugauuug

SEQ ID NO: 4133922 - RNA, 19 nt, Yersinia pestis
ccacgccaguaaacagcca

SEQ ID NO: 4133923 - RNA, 12 nt, Yersinia pestis
ccacgcccaauu

SEQ ID NO: 4133924 - RNA, 17 nt, Yersinia pestis
ccacggauauccaacgg

SEQ ID NO: 4133925 - RNA, 16 nt, Yersinia pestis
ccacggccaaguagau

SEQ ID NO: 4133926 - RNA, 15 nt, Yersinia pestis
ccacgguaucaauca

SEQ ID NO: 4133927 - RNA, 18 nt, Yersinia pestis
ccacgucuaauugcugcc

SEQ ID NO: 4133928 - RNA, 13 nt, Yersinia pestis
ccacguuuguagc

SEQ ID NO: 4133929 - RNA, 20 nt, Yersinia pestis
ccacguuuguagcaaaccca

SEQ ID NO: 4133930 - RNA, 14 nt, Yersinia pestis
ccacuacggcgacu

SEQ ID NO: 4133931 - RNA, 14 nt, Yersinia pestis
ccacuagcagagca

SEQ ID NO: 4133932 - RNA, 17 nt, Yersinia pestis
ccacuagguccauaaug

SEQ ID NO: 4133933 - RNA, 15 nt, Yersinia pestis
ccacuauccaacugg

SEQ ID NO: 4133934 - RNA, 22 nt, Yersinia pestis
ccacuaugcccaguuuaccauc

SEQ ID NO: 4133935 - RNA, 19 nt, Yersinia pestis
ccacucaccuaaaucaaua

SEQ ID NO: 4133936 - RNA, 15 nt, Yersinia pestis
ccacucaguguggaa

SEQ ID NO: 4133937 - RNA, 18 nt, Yersinia pestis
ccacucggccaaacaaag

SEQ ID NO: 4133938 - RNA, 13 nt, Yersinia pestis
ccacucucccuca

SEQ ID NO: 4133939 - RNA, 21 nt, Yersinia pestis
ccacucuggggcaaucaaugu

SEQ ID NO: 4133940 - RNA, 20 nt, Yersinia pestis
ccacugacaaaaacagcacu

SEQ ID NO: 4133941 - RNA, 14 nt, Yersinia pestis
ccacugaccgggaa

SEQ ID NO: 4133942 - RNA, 21 nt, Yersinia pestis
ccacugaccuauugauaaaac

SEQ ID NO: 4133943 - RNA, 23 nt, Yersinia pestis
ccacugaccuauugauaaaaccg

SEQ ID NO: 4133944 - RNA, 19 nt, Yersinia pestis
ccacugacgguaauuguuc

SEQ ID NO: 4133945 - RNA, 18 nt, Yersinia pestis
ccacugcguacucacccc

SEQ ID NO: 4133946 - RNA, 19 nt, Yersinia pestis
ccacugcguacucacccca

SEQ ID NO: 4133947 - RNA, 14 nt, Yersinia pestis
ccacuggccugaga

SEQ ID NO: 4133948 - RNA, 19 nt, Yersinia pestis
ccacuggccugagaaccca

SEQ ID NO: 4133949 - RNA, 20 nt, Yersinia pestis
ccacuggguuacauccugaa

SEQ ID NO: 4133950 - RNA, 14 nt, Yersinia pestis
ccacugguugaaag

SEQ ID NO: 4133951 - RNA, 12 nt, Yersinia pestis
ccacuuauaucu

SEQ ID NO: 4133952 - RNA, 21 nt, Yersinia pestis
ccacuuauccagcucauuggc

SEQ ID NO: 4133953 - RNA, 21 nt, Yersinia pestis
ccacuucgcggggcguauuau

SEQ ID NO: 4133954 - RNA, 18 nt, Yersinia pestis
ccacuucuuucacuaaug

SEQ ID NO: 4133955 - RNA, 17 nt, Yersinia pestis
ccacuuggcccacuguu

SEQ ID NO: 4133956 - RNA, 17 nt, Yersinia pestis
ccacuuguaccugugcc

SEQ ID NO: 4133957 - RNA, 19 nt, Yersinia pestis
ccacuuuuugaauaauccg

SEQ ID NO: 4133958 - RNA, 16 nt, Yersinia pestis
ccagaacaauaccgcc

SEQ ID NO: 4133959 - RNA, 13 nt, Yersinia pestis
ccagaacaccaac

SEQ ID NO: 4133960 - RNA, 20 nt, Yersinia pestis
ccagaaccucaacauucuuu

SEQ ID NO: 4133961 - RNA, 17 nt, Yersinia pestis
ccagaagcauauggaug

SEQ ID NO: 4133962 - RNA, 16 nt, Yersinia pestis
ccagaauauaaaagca

SEQ ID NO: 4133963 - RNA, 16 nt, Yersinia pestis
ccagacaaccaauaca

SEQ ID NO: 4133964 - RNA, 15 nt, Yersinia pestis
ccagacccugcacca

SEQ ID NO: 4133965 - RNA, 18 nt, Yersinia pestis
ccagacccugcaccacgc

SEQ ID NO: 4133966 - RNA, 19 nt, Yersinia pestis
ccagacccugcaccacgcc

SEQ ID NO: 4133967 - RNA, 18 nt, Yersinia pestis
ccagaccgcguaagccgu

SEQ ID NO: 4133968 - RNA, 20 nt, Yersinia pestis
ccagaccgcguaagccgugc

SEQ ID NO: 4133969 - RNA, 20 nt, Yersinia pestis
ccagacguuaugaauaaacc

SEQ ID NO: 4133970 - RNA, 20 nt, Yersinia pestis
ccagacuguucacaagccaa

SEQ ID NO: 4133971 - RNA, 15 nt, Yersinia pestis
ccagagacagcaaca

SEQ ID NO: 4133972 - RNA, 20 nt, Yersinia pestis
ccagagacauaaagcccgcu

SEQ ID NO: 4133973 - RNA, 15 nt, Yersinia pestis
ccagagaugauagca

SEQ ID NO: 4133974 - RNA, 13 nt, Yersinia pestis
ccagagcccgggu

SEQ ID NO: 4133975 - RNA, 15 nt, Yersinia pestis
ccagagcgacuuaau

SEQ ID NO: 4133976 - RNA, 18 nt, Yersinia pestis
ccagagcggagccucagu

SEQ ID NO: 4133977 - RNA, 19 nt, Yersinia pestis
ccagagcguuucaguauug

SEQ ID NO: 4133978 - RNA, 23 nt, Yersinia pestis
ccagagcguuucaguauuguaua

SEQ ID NO: 4133979 - RNA, 15 nt, Yersinia pestis
ccagaggauaaucac

SEQ ID NO: 4133980 - RNA, 15 nt, Yersinia pestis
ccagauaacaacaaa

SEQ ID NO: 4133981 - RNA, 18 nt, Yersinia pestis
ccagauaugaucaaaaau

SEQ ID NO: 4133982 - RNA, 19 nt, Yersinia pestis
ccagaucacggaaguaagg

SEQ ID NO: 4133983 - RNA, 20 nt, Yersinia pestis
ccagaucuuuuucauucuga

SEQ ID NO: 4133984 - RNA, 17 nt, Yersinia pestis
ccagauggcaaucugca

SEQ ID NO: 4133985 - RNA, 20 nt, Yersinia pestis
ccagauggccagauucacca

SEQ ID NO: 4133986 - RNA, 20 nt, Yersinia pestis
ccagauucaccaguagccca

SEQ ID NO: 4133987 - RNA, 18 nt, Yersinia pestis
ccagauugacauucauau

SEQ ID NO: 4133988 - RNA, 20 nt, Yersinia pestis
ccagauugccaaucagaacu

SEQ ID NO: 4133989 - RNA, 17 nt, Yersinia pestis
ccagcaaaauagcacag

SEQ ID NO: 4133990 - RNA, 15 nt, Yersinia pestis
ccagcaaaggccacc

SEQ ID NO: 4133991 - RNA, 18 nt, Yersinia pestis
ccagcaacucaagccacu

SEQ ID NO: 4133992 - RNA, 22 nt, Yersinia pestis
ccagcaagagcagccaacacac

SEQ ID NO: 4133993 - RNA, 17 nt, Yersinia pestis
ccagcacacagaugcug

SEQ ID NO: 4133994 - RNA, 12 nt, Yersinia pestis
ccagcacagccu

SEQ ID NO: 4133995 - RNA, 23 nt, Yersinia pestis
ccagcagaaguuguugcccuuca

SEQ ID NO: 4133996 - RNA, 9 nt, Yersinia pestis
ccagcagca

SEQ ID NO: 4133997 - RNA, 21 nt, Yersinia pestis
ccagcagcauaaccagugccg

SEQ ID NO: 4133998 - RNA, 20 nt, Yersinia pestis
ccagcaggcgugcugcuucc

SEQ ID NO: 4133999 - RNA, 22 nt, Yersinia pestis
ccagcaggcgugcugcuuccug

SEQ ID NO: 4134000 - RNA, 15 nt, Yersinia pestis
ccagcauaguaagcu

SEQ ID NO: 4134001 - RNA, 13 nt, Yersinia pestis
ccagcaucaguag

SEQ ID NO: 4134002 - RNA, 15 nt, Yersinia pestis
ccagccauauccaaa

SEQ ID NO: 4134003 - RNA, 20 nt, Yersinia pestis
ccagccaugcgacaccaaga

SEQ ID NO: 4134004 - RNA, 14 nt, Yersinia pestis
ccagcccaucacca

SEQ ID NO: 4134005 - RNA, 18 nt, Yersinia pestis
ccagccccaaacacuuag

SEQ ID NO: 4134006 - RNA, 13 nt, Yersinia pestis
ccagcccuacugg

SEQ ID NO: 4134007 - RNA, 13 nt, Yersinia pestis
ccagccuggaagc

SEQ ID NO: 4134008 - RNA, 20 nt, Yersinia pestis
ccagccugguuuuuuaaaaa

SEQ ID NO: 4134009 - RNA, 20 nt, Yersinia pestis
ccagccuguuaauaauucag

SEQ ID NO: 4134010 - RNA, 18 nt, Yersinia pestis
ccagcgaagugccgccau

SEQ ID NO: 4134011 - RNA, 16 nt, Yersinia pestis
ccagcgaaucaaacag

SEQ ID NO: 4134012 - RNA, 17 nt, Yersinia pestis
ccagcgccgauauacac

SEQ ID NO: 4134013 - RNA, 21 nt, Yersinia pestis
ccagcgccgauauacacccca

SEQ ID NO: 4134014 - RNA, 14 nt, Yersinia pestis
ccagcgccuguucc

SEQ ID NO: 4134015 - RNA, 14 nt, Yersinia pestis
ccagcggcaccgcc

SEQ ID NO: 4134016 - RNA, 15 nt, Yersinia pestis
ccagcggcaccgccg

SEQ ID NO: 4134017 - RNA, 20 nt, Yersinia pestis
ccaucgacuaauuaaacaag

SEQ ID NO: 4134018 - RNA, 14 nt, Yersinia pestis
ccaucgaucugggc

SEQ ID NO: 4134019 - RNA, 21 nt, Yersinia pestis
ccaucgccccuguaguucauc

SEQ ID NO: 4134020 - RNA, 20 nt, Yersinia pestis
ccaucgcuuuggcuucugga

SEQ ID NO: 4134021 - RNA, 22 nt, Yersinia pestis
ccaucgcuuuggcuucuggaug

SEQ ID NO: 4134022 - RNA, 15 nt, Yersinia pestis
ccaucguauauccac

SEQ ID NO: 4134023 - RNA, 20 nt, Yersinia pestis
ccaucguauauccaccgauu

SEQ ID NO: 4134024 - RNA, 18 nt, Yersinia pestis
ccaucuaacugcacaauu

SEQ ID NO: 4134025 - RNA, 21 nt, Yersinia pestis
ccaucuaauagaauagauccc

SEQ ID NO: 4134026 - RNA, 13 nt, Yersinia pestis
ccaucucaauagc

SEQ ID NO: 4134027 - RNA, 18 nt, Yersinia pestis
ccaucucauguuaaauga

SEQ ID NO: 4134028 - RNA, 21 nt, Yersinia pestis
ccaucucuggcuuaucuucca

SEQ ID NO: 4134029 - RNA, 23 nt, Yersinia pestis
ccaucugaugaguguuuauucuc

SEQ ID NO: 4134030 - RNA, 22 nt, Yersinia pestis
ccaucuugggccgacucugcau

SEQ ID NO: 4134031 - RNA, 20 nt, Yersinia pestis
ccaucuugucgucacccauu

SEQ ID NO: 4134032 - RNA, 17 nt, Yersinia pestis
ccaugagguuuauuccu

SEQ ID NO: 4134033 - RNA, 18 nt, Yersinia pestis
ccaugaugacaaugcguu

SEQ ID NO: 4134034 - RNA, 18 nt, Yersinia pestis
ccaugcacuccacuaugc

SEQ ID NO: 4134035 - RNA, 17 nt, Yersinia pestis
ccaugcucagaaaccug

SEQ ID NO: 4134036 - RNA, 23 nt, Yersinia pestis
ccaugcuugucguauuuccagua

SEQ ID NO: 4134037 - RNA, 15 nt, Yersinia pestis
ccauggcuucugcuu

SEQ ID NO: 4134038 - RNA, 19 nt, Yersinia pestis
ccaugggccucaucugcgg

SEQ ID NO: 4134039 - RNA, 17 nt, Yersinia pestis
ccauguacuuaauacug

SEQ ID NO: 4134040 - RNA, 20 nt, Yersinia pestis
ccauguaggcucgagccgcg

SEQ ID NO: 4134041 - RNA, 23 nt, Yersinia pestis
ccaugucacuagagcguuacaca

SEQ ID NO: 4134042 - RNA, 17 nt, Yersinia pestis
ccaugucgaucauggca

SEQ ID NO: 4134043 - RNA, 13 nt, Yersinia pestis
ccauguucuucaa

SEQ ID NO: 4134044 - RNA, 23 nt, Yersinia pestis
ccauguugaguuuacgcagugcu

SEQ ID NO: 4134045 - RNA, 24 nt, Yersinia pestis
ccauguuggguaaaccaaucaagc

SEQ ID NO: 4134046 - RNA, 16 nt, Yersinia pestis
ccauguugugugugaa

SEQ ID NO: 4134047 - RNA, 17 nt, Yersinia pestis
ccauuaaccuaaaaacg

SEQ ID NO: 4134048 - RNA, 19 nt, Yersinia pestis
ccauuaaccuaaaaacguc

SEQ ID NO: 4134049 - RNA, 23 nt, Yersinia pestis
ccauuacgcaacguaauaucugc

SEQ ID NO: 4134050 - RNA, 14 nt, Yersinia pestis
ccauuacgccaccu

SEQ ID NO: 4134051 - RNA, 16 nt, Yersinia pestis
ccauuacuguccuuua

SEQ ID NO: 4134052 - RNA, 20 nt, Yersinia pestis
ccauucaaaaauuaaauuaa

SEQ ID NO: 4134053 - RNA, 22 nt, Yersinia pestis
ccauucaaaaauuaaauuaaua

SEQ ID NO: 4134054 - RNA, 20 nt, Yersinia pestis
ccauucacgccgcuccugau

SEQ ID NO: 4134055 - RNA, 16 nt, Yersinia pestis
ccauucagcagcaaga

SEQ ID NO: 4134056 - RNA, 15 nt, Yersinia pestis
ccauucauuuuuuau

SEQ ID NO: 4134057 - RNA, 16 nt, Yersinia pestis
ccauugauaauaauau

SEQ ID NO: 4134058 - RNA, 18 nt, Yersinia pestis
ccauugaugcaguacuca

SEQ ID NO: 4134059 - RNA, 19 nt, Yersinia pestis
ccauugauuggcuccuaua

SEQ ID NO: 4134060 - RNA, 16 nt, Yersinia pestis
ccauugcaccaauaac

SEQ ID NO: 4134061 - RNA, 18 nt, Yersinia pestis
ccauugcaccaauaacug

SEQ ID NO: 4134062 - RNA, 12 nt, Yersinia pestis
ccauugccagaa

SEQ ID NO: 4134063 - RNA, 23 nt, Yersinia pestis
ccauugcgguuacguucaccuaa

SEQ ID NO: 4134064 - RNA, 16 nt, Yersinia pestis
ccauuggcaaaggcca

SEQ ID NO: 4134065 - RNA, 20 nt, Yersinia pestis
ccauuggguauggucagcaa

SEQ ID NO: 4134066 - RNA, 21 nt, Yersinia pestis
ccauugguuuuuagcuuaaca

SEQ ID NO: 4134067 - RNA, 16 nt, Yersinia pestis
ccauuguggcuaaacc

SEQ ID NO: 4134068 - RNA, 23 nt, Yersinia pestis
ccauuguugaauaccaagccaaa

SEQ ID NO: 4134069 - RNA, 13 nt, Yersinia pestis
ccauuuauuucca

SEQ ID NO: 4134070 - RNA, 15 nt, Yersinia pestis
ccauuuccaauacca

SEQ ID NO: 4134071 - RNA, 15 nt, Yersinia pestis
ccauuuccaucaucu

SEQ ID NO: 4134072 - RNA, 13 nt, Yersinia pestis
ccauuuccuuaua

SEQ ID NO: 4134073 - RNA, 12 nt, Yersinia pestis
ccauuucucuga

SEQ ID NO: 4134074 - RNA, 19 nt, Yersinia pestis
ccauuucucugaugguauc

SEQ ID NO: 4134075 - RNA, 21 nt, Yersinia pestis
ccauuucugguugugcuucag

SEQ ID NO: 4134076 - RNA, 19 nt, Yersinia pestis
ccauuucuuauaucuguuu

SEQ ID NO: 4134077 - RNA, 14 nt, Yersinia pestis
ccauuugcucuggc

SEQ ID NO: 4134078 - RNA, 23 nt, Yersinia pestis
ccauuuggugauaagcugcguga

SEQ ID NO: 4134079 - RNA, 18 nt, Yersinia pestis
ccauuuucaauaccauau

SEQ ID NO: 4134080 - RNA, 18 nt, Yersinia pestis
ccauuuuuauaucagauu

SEQ ID NO: 4134081 - RNA, 21 nt, Yersinia pestis
cccaaaaccaccaccccagca

SEQ ID NO: 4134082 - RNA, 18 nt, Yersinia pestis
cccaaaaucaaauacugu

SEQ ID NO: 4134083 - RNA, 20 nt, Yersinia pestis
cccaaaaucaaauacugugc

SEQ ID NO: 4134084 - RNA, 14 nt, Yersinia pestis
cccaaaauuugcuu

SEQ ID NO: 4134085 - RNA, 18 nt, Yersinia pestis
cccaaagccuacgagaga

SEQ ID NO: 4134086 - RNA, 14 nt, Yersinia pestis
cccaaauacuguug

SEQ ID NO: 4134087 - RNA, 14 nt, Yersinia pestis
cccaacaauuugcg

SEQ ID NO: 4134088 - RNA, 17 nt, Yersinia pestis
cccaaccaucuccggcu

SEQ ID NO: 4134089 - RNA, 11 nt, Yersinia pestis
cccaacgguaa

SEQ ID NO: 4134090 - RNA, 15 nt, Yersinia pestis
cccaagaauaauaac

SEQ ID NO: 4134091 - RNA, 16 nt, Yersinia pestis
cccaagauacuggaag

SEQ ID NO: 4134092 - RNA, 18 nt, Yersinia pestis
cccaaggcgacuuugaug

SEQ ID NO: 4134093 - RNA, 17 nt, Yersinia pestis
cccaagggcuauugcug

SEQ ID NO: 4134094 - RNA, 22 nt, Yersinia pestis
cccaaggguauaacucaucagu

SEQ ID NO: 4134095 - RNA, 17 nt, Yersinia pestis
cccaauaauaaaaaaaa

SEQ ID NO: 4134096 - RNA, 20 nt, Yersinia pestis
cccaauaauaaaaaaaaaua

SEQ ID NO: 4134097 - RNA, 13 nt, Yersinia pestis
cccaauauugauc

SEQ ID NO: 4134098 - RNA, 13 nt, Yersinia pestis
cccaaucaucauc

SEQ ID NO: 4134099 - RNA, 13 nt, Yersinia pestis
cccaaucuugcaa

SEQ ID NO: 4134100 - RNA, 20 nt, Yersinia pestis
cccaaugccauagcugcugc

SEQ ID NO: 4134101 - RNA, 20 nt, Yersinia pestis
cccaaugcugucacugucaa

SEQ ID NO: 4134102 - RNA, 17 nt, Yersinia pestis
cccaauguauauguugg

SEQ ID NO: 4134103 - RNA, 16 nt, Yersinia pestis
cccaaugucaggaaau

SEQ ID NO: 4134104 - RNA, 12 nt, Yersinia pestis
cccacaaccagg

SEQ ID NO: 4134105 - RNA, 15 nt, Yersinia pestis
cccacaucggccccu

SEQ ID NO: 4134106 - RNA, 13 nt, Yersinia pestis
cccacauguucga

SEQ ID NO: 4134107 - RNA, 15 nt, Yersinia pestis
cccacauucaggccg

SEQ ID NO: 4134108 - RNA, 12 nt, Yersinia pestis
cccaccauaaug

SEQ ID NO: 4134109 - RNA, 16 nt, Yersinia pestis
cccacggcgacguuca

SEQ ID NO: 4134110 - RNA, 16 nt, Yersinia pestis
cccacguucccccgcc

SEQ ID NO: 4134111 - RNA, 18 nt, Yersinia pestis
cccacuauucuccaacaa

SEQ ID NO: 4134112 - RNA, 17 nt, Yersinia pestis
cccacucggccaaacaa

SEQ ID NO: 4134113 - RNA, 22 nt, Yersinia pestis
cccacuucguagggcacuuuca

SEQ ID NO: 4134114 - RNA, 19 nt, Yersinia pestis
cccacuugaccuucccucu

SEQ ID NO: 4134115 - RNA, 16 nt, Yersinia pestis
cccacuuuuugaauaa

SEQ ID NO: 4134116 - RNA, 16 nt, Yersinia pestis
cccagaaaggcaaaaa

SEQ ID NO: 4134117 - RNA, 21 nt, Yersinia pestis
cccagagauggcgaucaagcc

SEQ ID NO: 4134118 - RNA, 13 nt, Yersinia pestis
cccagaggguuaa

SEQ ID NO: 4134119 - RNA, 15 nt, Yersinia pestis
cccagcaucauaaga

SEQ ID NO: 4134120 - RNA, 15 nt, Yersinia pestis
cccagccagaaugaa

SEQ ID NO: 4134121 - RNA, 21 nt, Yersinia pestis
cccagccgggguaucauagaa

SEQ ID NO: 4134122 - RNA, 14 nt, Yersinia pestis
cccaggcaaucucu

SEQ ID NO: 4134123 - RNA, 22 nt, Yersinia pestis
cccaggcaaucucuccccaagc

SEQ ID NO: 4134124 - RNA, 19 nt, Yersinia pestis
cccaggugcuuauuuauuu

SEQ ID NO: 4134125 - RNA, 23 nt, Yersinia pestis
cccaggugcuuauuuauuuuuaa

SEQ ID NO: 4134126 - RNA, 15 nt, Yersinia pestis
cccagguuacugccc

SEQ ID NO: 4134127 - RNA, 18 nt, Yersinia pestis
cccagguuacugcccugg

SEQ ID NO: 4134128 - RNA, 22 nt, Yersinia pestis
cccaguaaagcaaauucccacc

SEQ ID NO: 4134129 - RNA, 12 nt, Yersinia pestis
cccaguaaugcc

SEQ ID NO: 4134130 - RNA, 16 nt, Yersinia pestis
cccaguaccgcuggug

SEQ ID NO: 4134131 - RNA, 14 nt, Yersinia pestis
cccauaaaucccga

SEQ ID NO: 4134132 - RNA, 11 nt, Yersinia pestis
cccauaacaau

SEQ ID NO: 4134133 - RNA, 20 nt, Yersinia pestis
cccauaagcgggguauuuua

SEQ ID NO: 4134134 - RNA, 21 nt, Yersinia pestis
cccauacaaauaguaauaauu

SEQ ID NO: 4134135 - RNA, 16 nt, Yersinia pestis
cccauagcuggcuuca

SEQ ID NO: 4134136 - RNA, 15 nt, Yersinia pestis
cccaucaaccaccgc

SEQ ID NO: 4134137 - RNA, 22 nt, Yersinia pestis
cccaucaacgacaacaucaaug

SEQ ID NO: 4134138 - RNA, 13 nt, Yersinia pestis
cccaucagcacuc

SEQ ID NO: 4134139 - RNA, 14 nt, Yersinia pestis
cccugacucccuga

SEQ ID NO: 4134140 - RNA, 23 nt, Yersinia pestis
cccugagugugccuuggucucag

SEQ ID NO: 4134141 - RNA, 16 nt, Yersinia pestis
cccugauccacuacuu

SEQ ID NO: 4134142 - RNA, 14 nt, Yersinia pestis
cccugcaagugggg

SEQ ID NO: 4134143 - RNA, 16 nt, Yersinia pestis
cccugcaauugcagac

SEQ ID NO: 4134144 - RNA, 13 nt, Yersinia pestis
cccugccaccuug

SEQ ID NO: 4134145 - RNA, 16 nt, Yersinia pestis
cccugcgaucugccuu

SEQ ID NO: 4134146 - RNA, 18 nt, Yersinia pestis
cccugcgcauugauaauc

SEQ ID NO: 4134147 - RNA, 21 nt, Yersinia pestis
cccugcgguauccuuagccaa

SEQ ID NO: 4134148 - RNA, 18 nt, Yersinia pestis
cccugcugauaauuuauu

SEQ ID NO: 4134149 - RNA, 16 nt, Yersinia pestis
cccugcuuguuacgua

SEQ ID NO: 4134150 - RNA, 15 nt, Yersinia pestis
cccuggcaggccagc

SEQ ID NO: 4134151 - RNA, 18 nt, Yersinia pestis
cccuggcucaucaaagga

SEQ ID NO: 4134152 - RNA, 17 nt, Yersinia pestis
cccuggcucuggccagc

SEQ ID NO: 4134153 - RNA, 20 nt, Yersinia pestis
cccugguugcagcacgccag

SEQ ID NO: 4134154 - RNA, 21 nt, Yersinia pestis
cccuguaguucaucauuauua

SEQ ID NO: 4134155 - RNA, 17 nt, Yersinia pestis
cccugucuugccagcgg

SEQ ID NO: 4134156 - RNA, 18 nt, Yersinia pestis
cccugugaaauaccgauu

SEQ ID NO: 4134157 - RNA, 15 nt, Yersinia pestis
cccuguugaucugag

SEQ ID NO: 4134158 - RNA, 17 nt, Yersinia pestis
cccuguugaucugaguu

SEQ ID NO: 4134159 - RNA, 12 nt, Yersinia pestis
cccuuacccugg

SEQ ID NO: 4134160 - RNA, 20 nt, Yersinia pestis
cccuucaaagccgcuuuaau

SEQ ID NO: 4134161 - RNA, 17 nt, Yersinia pestis
cccuucaacucuacauu

SEQ ID NO: 4134162 - RNA, 22 nt, Yersinia pestis
cccuucagaugaauccagccau

SEQ ID NO: 4134163 - RNA, 11 nt, Yersinia pestis
cccuucaguca

SEQ ID NO: 4134164 - RNA, 13 nt, Yersinia pestis
cccuucagucagu

SEQ ID NO: 4134165 - RNA, 18 nt, Yersinia pestis
cccuucaucuuucaagug

SEQ ID NO: 4134166 - RNA, 16 nt, Yersinia pestis
cccuucgagcaccgcg

SEQ ID NO: 4134167 - RNA, 18 nt, Yersinia pestis
cccuucggcaugcaacuu

SEQ ID NO: 4134168 - RNA, 15 nt, Yersinia pestis
cccuucguccuugau

SEQ ID NO: 4134169 - RNA, 16 nt, Yersinia pestis
cccuugauuuuaccaa

SEQ ID NO: 4134170 - RNA, 21 nt, Yersinia pestis
cccuuuaaaucuagcccuuca

SEQ ID NO: 4134171 - RNA, 22 nt, Yersinia pestis
cccuuuaaaucuagcccuucag

SEQ ID NO: 4134172 - RNA, 21 nt, Yersinia pestis
cccuuucaccaaccaaccauc

SEQ ID NO: 4134173 - RNA, 23 nt, Yersinia pestis
cccuuucaccaaccaaccaucac

SEQ ID NO: 4134174 - RNA, 17 nt, Yersinia pestis
cccuuucagcgcuuuuu

SEQ ID NO: 4134175 - RNA, 22 nt, Yersinia pestis
cccuuucucgccuaaguuugac

SEQ ID NO: 4134176 - RNA, 23 nt, Yersinia pestis
cccuuugaacugcaccccaaaug

SEQ ID NO: 4134177 - RNA, 14 nt, Yersinia pestis
cccuuugacagcau

SEQ ID NO: 4134178 - RNA, 16 nt, Yersinia pestis
cccuuugacauacagu

SEQ ID NO: 4134179 - RNA, 18 nt, Yersinia pestis
cccuuuggguuguuucaa

SEQ ID NO: 4134180 - RNA, 13 nt, Yersinia pestis
cccuuuuaccgaa

SEQ ID NO: 4134181 - RNA, 17 nt, Yersinia pestis
cccuuuuucaaucacuu

SEQ ID NO: 4134182 - RNA, 24 nt, Yersinia pestis
ccgaaaaaacagcgaucuauucuc

SEQ ID NO: 4134183 - RNA, 21 nt, Yersinia pestis
ccgaaagccaagcaagcggca

SEQ ID NO: 4134184 - RNA, 21 nt, Yersinia pestis
ccgaaccuuuugccaguaacg

SEQ ID NO: 4134185 - RNA, 22 nt, Yersinia pestis
ccgaacgcacgacugcggugau

SEQ ID NO: 4134186 - RNA, 16 nt, Yersinia pestis
ccgaacucgucauuca

SEQ ID NO: 4134187 - RNA, 16 nt, Yersinia pestis
ccgaacugauacccac

SEQ ID NO: 4134188 - RNA, 19 nt, Yersinia pestis
ccgaacugauacccacucg

SEQ ID NO: 4134189 - RNA, 13 nt, Yersinia pestis
ccgaauaaaaccu

SEQ ID NO: 4134190 - RNA, 15 nt, Yersinia pestis
ccgaauaauauuaaa

SEQ ID NO: 4134191 - RNA, 18 nt, Yersinia pestis
ccgaaucacugacugaug

SEQ ID NO: 4134192 - RNA, 23 nt, Yersinia pestis
ccgacaauaacgcugaauacacu

SEQ ID NO: 4134193 - RNA, 16 nt, Yersinia pestis
ccgacaccaauaccga

SEQ ID NO: 4134194 - RNA, 15 nt, Yersinia pestis
ccgacacccagccag

SEQ ID NO: 4134195 - RNA, 16 nt, Yersinia pestis
ccgacacccagccaga

SEQ ID NO: 4134196 - RNA, 14 nt, Yersinia pestis
ccgaccaaaggcca

SEQ ID NO: 4134197 - RNA, 13 nt, Yersinia pestis
ccgaccacugaca

SEQ ID NO: 4134198 - RNA, 16 nt, Yersinia pestis
ccgacgauauuaccga

SEQ ID NO: 4134199 - RNA, 19 nt, Yersinia pestis
ccgacgugugcuguaagaa

SEQ ID NO: 4134200 - RNA, 19 nt, Yersinia pestis
ccgacugagauuauuauua

SEQ ID NO: 4134201 - RNA, 15 nt, Yersinia pestis
ccgacuugcccaaug

SEQ ID NO: 4134202 - RNA, 14 nt, Yersinia pestis
ccgagaaacaaaac

SEQ ID NO: 4134203 - RNA, 12 nt, Yersinia pestis
ccgagaggcuga

SEQ ID NO: 4134204 - RNA, 13 nt, Yersinia pestis
ccgagccuguuga

SEQ ID NO: 4134205 - RNA, 15 nt, Yersinia pestis
ccgagcgccccgccu

SEQ ID NO: 4134206 - RNA, 19 nt, Yersinia pestis
ccgaggaauaugcccuuuu

SEQ ID NO: 4134207 - RNA, 16 nt, Yersinia pestis
ccgaggugaagacacc

SEQ ID NO: 4134208 - RNA, 17 nt, Yersinia pestis
ccgagucgaucacggaa

SEQ ID NO: 4134209 - RNA, 16 nt, Yersinia pestis
ccgauaaaccaacuga

SEQ ID NO: 4134210 - RNA, 14 nt, Yersinia pestis
ccgauaaacgccag

SEQ ID NO: 4134211 - RNA, 19 nt, Yersinia pestis
ccgauaagaaaucaucagc

SEQ ID NO: 4134212 - RNA, 20 nt, Yersinia pestis
ccgauaauaaauauccuccg

SEQ ID NO: 4134213 - RNA, 16 nt, Yersinia pestis
ccgauaaucaauuugu

SEQ ID NO: 4134214 - RNA, 18 nt, Yersinia pestis
ccgauacaggcucugaaa

SEQ ID NO: 4134215 - RNA, 20 nt, Yersinia pestis
ccgauauugauagccacauc

SEQ ID NO: 4134216 - RNA, 18 nt, Yersinia pestis
ccgaucaacaggccaccu

SEQ ID NO: 4134217 - RNA, 13 nt, Yersinia pestis
ccgaucaccgcaa

SEQ ID NO: 4134218 - RNA, 19 nt, Yersinia pestis
ccgaugaaccaaccgccaa

SEQ ID NO: 4134219 - RNA, 14 nt, Yersinia pestis
ccgaugagugaaau

SEQ ID NO: 4134220 - RNA, 16 nt, Yersinia pestis
ccgaugcuacaccauc

SEQ ID NO: 4134221 - RNA, 23 nt, Yersinia pestis
ccgauucagcucugccagcguca

SEQ ID NO: 4134222 - RNA, 20 nt, Yersinia pestis
ccgcaaccgggccggguuga

SEQ ID NO: 4134223 - RNA, 23 nt, Yersinia pestis
ccgcaaggcuucgacucugggcc

SEQ ID NO: 4134224 - RNA, 22 nt, Yersinia pestis
ccgcaauaucaaugaaaaaaag

SEQ ID NO: 4134225 - RNA, 19 nt, Yersinia pestis
ccgcaaucucuugacgccg

SEQ ID NO: 4134226 - RNA, 20 nt, Yersinia pestis
ccgcacugggucaucaccca

SEQ ID NO: 4134227 - RNA, 22 nt, Yersinia pestis
ccgcagacugaaauaaugguuu

SEQ ID NO: 4134228 - RNA, 18 nt, Yersinia pestis
ccgcagacugcugacaaa

SEQ ID NO: 4134229 - RNA, 19 nt, Yersinia pestis
ccgcagcggcuagcagcag

SEQ ID NO: 4134230 - RNA, 15 nt, Yersinia pestis
ccgcagcucaccuag

SEQ ID NO: 4134231 - RNA, 13 nt, Yersinia pestis
ccgcaggaagcaa

SEQ ID NO: 4134232 - RNA, 13 nt, Yersinia pestis
ccgcauccggcgg

SEQ ID NO: 4134233 - RNA, 16 nt, Yersinia pestis
ccgcaucgugcuccgc

SEQ ID NO: 4134234 - RNA, 18 nt, Yersinia pestis
ccgcauucaccaccauau

SEQ ID NO: 4134235 - RNA, 20 nt, Yersinia pestis
ccgcauugaccgcuguuuga

SEQ ID NO: 4134236 - RNA, 20 nt, Yersinia pestis
ccgcauuuucaaagguacgc

SEQ ID NO: 4134237 - RNA, 15 nt, Yersinia pestis
ccgccacacaauaca

SEQ ID NO: 4134238 - RNA, 21 nt, Yersinia pestis
ccgccacacaauacauagaag

SEQ ID NO: 4134239 - RNA, 16 nt, Yersinia pestis
ccgccagaauaaacga

SEQ ID NO: 4134240 - RNA, 19 nt, Yersinia pestis
ccgccagauuauccagccc

SEQ ID NO: 4134241 - RNA, 12 nt, Yersinia pestis
ccgccagcaagu

SEQ ID NO: 4134242 - RNA, 14 nt, Yersinia pestis
ccgccagccccgcu

SEQ ID NO: 4134243 - RNA, 21 nt, Yersinia pestis
ccgccagguuuacuggcgggc

SEQ ID NO: 4134244 - RNA, 15 nt, Yersinia pestis
ccgccaguaaaccug

SEQ ID NO: 4134245 - RNA, 15 nt, Yersinia pestis
ccgccaguaacuggc

SEQ ID NO: 4134246 - RNA, 14 nt, Yersinia pestis
ccgccaguugcuca

SEQ ID NO: 4134247 - RNA, 14 nt, Yersinia pestis
ccgccauccuucaa

SEQ ID NO: 4134248 - RNA, 17 nt, Yersinia pestis
ccgccaugagaaccagu

SEQ ID NO: 4134249 - RNA, 15 nt, Yersinia pestis
ccgccauugccagaa

SEQ ID NO: 4134250 - RNA, 14 nt, Yersinia pestis
ccgcccaauacggc

SEQ ID NO: 4134251 - RNA, 17 nt, Yersinia pestis
ccgcccgguaccgccga

SEQ ID NO: 4134252 - RNA, 14 nt, Yersinia pestis
ccgcccucuugaac

SEQ ID NO: 4134253 - RNA, 20 nt, Yersinia pestis
ccgccgcaggccauuacccu

SEQ ID NO: 4134254 - RNA, 23 nt, Yersinia pestis
ccgccgccaacagugaauaacug

SEQ ID NO: 4134255 - RNA, 14 nt, Yersinia pestis
ccgccgccagcccc

SEQ ID NO: 4134256 - RNA, 21 nt, Yersinia pestis
ccgccggguuuugcaucaagc

SEQ ID NO: 4134257 - RNA, 16 nt, Yersinia pestis
ccgccgguuuuugccc

SEQ ID NO: 4134258 - RNA, 19 nt, Yersinia pestis
ccgccgucaaaccaagccc

SEQ ID NO: 4134259 - RNA, 19 nt, Yersinia pestis
ccgccgugcggacugccgc

SEQ ID NO: 4134260 - RNA, 13 nt, Yersinia pestis
ccgccucaaugca

SEQ ID NO: 4134261 - RNA, 17 nt, Yersinia pestis
ccguggauaaacaaaua

SEQ ID NO: 4134262 - RNA, 19 nt, Yersinia pestis
ccguggcauaaucaacgcu

SEQ ID NO: 4134263 - RNA, 22 nt, Yersinia pestis
ccguggcauaaucaacgcucaa

SEQ ID NO: 4134264 - RNA, 21 nt, Yersinia pestis
ccguggcgacagcuauuuauu

SEQ ID NO: 4134265 - RNA, 16 nt, Yersinia pestis
ccgugguuauugcgcc

SEQ ID NO: 4134266 - RNA, 17 nt, Yersinia pestis
ccgugguuauugcgcca

SEQ ID NO: 4134267 - RNA, 20 nt, Yersinia pestis
ccguguccggguuuacccag

SEQ ID NO: 4134268 - RNA, 23 nt, Yersinia pestis
ccguguccggguuuacccagcca

SEQ ID NO: 4134269 - RNA, 13 nt, Yersinia pestis
ccgugucgggcca

SEQ ID NO: 4134270 - RNA, 18 nt, Yersinia pestis
ccgugucgggccaauaaa

SEQ ID NO: 4134271 - RNA, 21 nt, Yersinia pestis
ccguguuuuucccuaccguau

SEQ ID NO: 4134272 - RNA, 17 nt, Yersinia pestis
ccguuaacccaaagcca

SEQ ID NO: 4134273 - RNA, 17 nt, Yersinia pestis
ccguuaauggcaccauc

SEQ ID NO: 4134274 - RNA, 18 nt, Yersinia pestis
ccguuacaaccgccgccg

SEQ ID NO: 4134275 - RNA, 22 nt, Yersinia pestis
ccguuagcaccggauggucacc

SEQ ID NO: 4134276 - RNA, 20 nt, Yersinia pestis
ccguuauaccucaagcugca

SEQ ID NO: 4134277 - RNA, 18 nt, Yersinia pestis
ccguuaugccaaccggau

SEQ ID NO: 4134278 - RNA, 14 nt, Yersinia pestis
ccguucaauaauag

SEQ ID NO: 4134279 - RNA, 13 nt, Yersinia pestis
ccguucacccuuu

SEQ ID NO: 4134280 - RNA, 17 nt, Yersinia pestis
ccguucggucacacugg

SEQ ID NO: 4134281 - RNA, 18 nt, Yersinia pestis
ccguucuaguagugggca

SEQ ID NO: 4134282 - RNA, 14 nt, Yersinia pestis
ccguucuuauugaa

SEQ ID NO: 4134283 - RNA, 21 nt, Yersinia pestis
ccguucuugccacucugcucc

SEQ ID NO: 4134284 - RNA, 18 nt, Yersinia pestis
ccguugcauuuuucuguu

SEQ ID NO: 4134285 - RNA, 12 nt, Yersinia pestis
ccguugccugug

SEQ ID NO: 4134286 - RNA, 15 nt, Yersinia pestis
ccguugcucagcgca

SEQ ID NO: 4134287 - RNA, 19 nt, Yersinia pestis
ccguuguguaucagcaacu

SEQ ID NO: 4134288 - RNA, 16 nt, Yersinia pestis
ccguuuacucgcaaua

SEQ ID NO: 4134289 - RNA, 19 nt, Yersinia pestis
ccguuuaggauugcgucaa

SEQ ID NO: 4134290 - RNA, 23 nt, Yersinia pestis
ccguuuguaaccgacuugcccaa

SEQ ID NO: 4134291 - RNA, 21 nt, Yersinia pestis
ccguuuuaacgcugcccaaua

SEQ ID NO: 4134292 - RNA, 23 nt, Yersinia pestis
ccguuuuaacgcugcccaauaaa

SEQ ID NO: 4134293 - RNA, 11 nt, Yersinia pestis
ccuaaaaaaaa

SEQ ID NO: 4134294 - RNA, 14 nt, Yersinia pestis
ccuaaaauuaucgc

SEQ ID NO: 4134295 - RNA, 16 nt, Yersinia pestis
ccuaaaccccacagcg

SEQ ID NO: 4134296 - RNA, 21 nt, Yersinia pestis
ccuaaagauaauuaauucaau

SEQ ID NO: 4134297 - RNA, 18 nt, Yersinia pestis
ccuaaagccaucgccauc

SEQ ID NO: 4134298 - RNA, 15 nt, Yersinia pestis
ccuaaauaauuccag

SEQ ID NO: 4134299 - RNA, 13 nt, Yersinia pestis
ccuaaauccugca

SEQ ID NO: 4134300 - RNA, 22 nt, Yersinia pestis
ccuaaauccugcaaugcauaag

SEQ ID NO: 4134301 - RNA, 15 nt, Yersinia pestis
ccuaacacguuaaau

SEQ ID NO: 4134302 - RNA, 21 nt, Yersinia pestis
ccuaaccaaacauugucaccu

SEQ ID NO: 4134303 - RNA, 20 nt, Yersinia pestis
ccuaacgccaaaauguagua

SEQ ID NO: 4134304 - RNA, 23 nt, Yersinia pestis
ccuaacgccguggugaaaaauga

SEQ ID NO: 4134305 - RNA, 14 nt, Yersinia pestis
ccuaacuuccuaac

SEQ ID NO: 4134306 - RNA, 21 nt, Yersinia pestis
ccuaagguucacccugagugu

SEQ ID NO: 4134307 - RNA, 21 nt, Yersinia pestis
ccuaauaaauaauuuguauuc

SEQ ID NO: 4134308 - RNA, 17 nt, Yersinia pestis
ccuaauacagcaccacc

SEQ ID NO: 4134309 - RNA, 15 nt, Yersinia pestis
ccuaauaccaauacc

SEQ ID NO: 4134310 - RNA, 19 nt, Yersinia pestis
ccuaauaucauguucuuug

SEQ ID NO: 4134311 - RNA, 22 nt, Yersinia pestis
ccuaaugaacacuuaauuccau

SEQ ID NO: 4134312 - RNA, 13 nt, Yersinia pestis
ccuaaugcccccg

SEQ ID NO: 4134313 - RNA, 20 nt, Yersinia pestis
ccuacaaccuaccaccuacc

SEQ ID NO: 4134314 - RNA, 21 nt, Yersinia pestis
ccuacaaccuaucccccuucc

SEQ ID NO: 4134315 - RNA, 15 nt, Yersinia pestis
ccuacagaaaaauaa

SEQ ID NO: 4134316 - RNA, 23 nt, Yersinia pestis
ccuacauaaaaauagcuucccug

SEQ ID NO: 4134317 - RNA, 13 nt, Yersinia pestis
ccuacauggaugu

SEQ ID NO: 4134318 - RNA, 17 nt, Yersinia pestis
ccuaccaccuacaaccu

SEQ ID NO: 4134319 - RNA, 18 nt, Yersinia pestis
ccuaccaccuacaaccua

SEQ ID NO: 4134320 - RNA, 21 nt, Yersinia pestis
ccuaccaccuacaaccuacca

SEQ ID NO: 4134321 - RNA, 14 nt, Yersinia pestis
ccuaccaccuacca

SEQ ID NO: 4134322 - RNA, 14 nt, Yersinia pestis
ccuaccgcaccaau

SEQ ID NO: 4134323 - RNA, 17 nt, Yersinia pestis
ccuaccgcaccaaugcc

SEQ ID NO: 4134324 - RNA, 15 nt, Yersinia pestis
ccuaccguucucugc

SEQ ID NO: 4134325 - RNA, 21 nt, Yersinia pestis
ccuacgggaaauaacugguga

SEQ ID NO: 4134326 - RNA, 12 nt, Yersinia pestis
ccuacuaccaaa

SEQ ID NO: 4134327 - RNA, 16 nt, Yersinia pestis
ccuacugacauuucuu

SEQ ID NO: 4134328 - RNA, 17 nt, Yersinia pestis
ccuacugacauuucuua

SEQ ID NO: 4134329 - RNA, 12 nt, Yersinia pestis
ccuacugcauca

SEQ ID NO: 4134330 - RNA, 16 nt, Yersinia pestis
ccuacuggcugaaguu

SEQ ID NO: 4134331 - RNA, 12 nt, Yersinia pestis
ccuacugucaac

SEQ ID NO: 4134332 - RNA, 12 nt, Yersinia pestis
ccuagauaccgc

SEQ ID NO: 4134333 - RNA, 17 nt, Yersinia pestis
ccuagcaucauaaauac

SEQ ID NO: 4134334 - RNA, 15 nt, Yersinia pestis
ccuagccagccaccg

SEQ ID NO: 4134335 - RNA, 22 nt, Yersinia pestis
ccuaggcggugagggagucagg

SEQ ID NO: 4134336 - RNA, 21 nt, Yersinia pestis
ccuaguaaaggcgaugauuug

SEQ ID NO: 4134337 - RNA, 21 nt, Yersinia pestis
ccuauaaacuugauucaccag

SEQ ID NO: 4134338 - RNA, 13 nt, Yersinia pestis
ccuauaaauuuua

SEQ ID NO: 4134339 - RNA, 14 nt, Yersinia pestis
ccuauacgcucuau

SEQ ID NO: 4134340 - RNA, 19 nt, Yersinia pestis
ccuauagcucagaaaauaa

SEQ ID NO: 4134341 - RNA, 16 nt, Yersinia pestis
ccuauccacugugauu

SEQ ID NO: 4134342 - RNA, 17 nt, Yersinia pestis
ccuauccacugugauug

SEQ ID NO: 4134343 - RNA, 14 nt, Yersinia pestis
ccuauccucaccgu

SEQ ID NO: 4134344 - RNA, 22 nt, Yersinia pestis
ccuaucuauuuuuauuucuccu

SEQ ID NO: 4134345 - RNA, 18 nt, Yersinia pestis
ccuauggcgguuccaaag

SEQ ID NO: 4134346 - RNA, 18 nt, Yersinia pestis
ccuauucagcagcauuuc

SEQ ID NO: 4134347 - RNA, 19 nt, Yersinia pestis
ccuauucagcagcauuucu

SEQ ID NO: 4134348 - RNA, 16 nt, Yersinia pestis
ccuauugaauaacagc

SEQ ID NO: 4134349 - RNA, 14 nt, Yersinia pestis
ccuauuucaccgcu

SEQ ID NO: 4134350 - RNA, 23 nt, Yersinia pestis
ccuauuuucgcccuuaucuacug

SEQ ID NO: 4134351 - RNA, 12 nt, Yersinia pestis
ccucaaaaggau

SEQ ID NO: 4134352 - RNA, 21 nt, Yersinia pestis
ccucaaaauucgugcucauca

SEQ ID NO: 4134353 - RNA, 14 nt, Yersinia pestis
ccucaacgcacccc

SEQ ID NO: 4134354 - RNA, 16 nt, Yersinia pestis
ccucaacgcaccccac

SEQ ID NO: 4134355 - RNA, 17 nt, Yersinia pestis
ccucaacucaaaacaau

SEQ ID NO: 4134356 - RNA, 11 nt, Yersinia pestis
ccucaagaccg

SEQ ID NO: 4134357 - RNA, 18 nt, Yersinia pestis
ccucaaugacgcgaucug

SEQ ID NO: 4134358 - RNA, 14 nt, Yersinia pestis
ccucaauuuugccu

SEQ ID NO: 4134359 - RNA, 15 nt, Yersinia pestis
ccucacaagccacgc

SEQ ID NO: 4134360 - RNA, 17 nt, Yersinia pestis
ccucacacgauuuuuac

SEQ ID NO: 4134361 - RNA, 12 nt, Yersinia pestis
ccucaccauuua

SEQ ID NO: 4134362 - RNA, 12 nt, Yersinia pestis
ccucaccgccag

SEQ ID NO: 4134363 - RNA, 15 nt, Yersinia pestis
ccucaccguauacgc

SEQ ID NO: 4134364 - RNA, 12 nt, Yersinia pestis
ccucacgggcuu

SEQ ID NO: 4134365 - RNA, 16 nt, Yersinia pestis
ccucacgggcuuccau

SEQ ID NO: 4134366 - RNA, 22 nt, Yersinia pestis
ccucacguuuagccaugagguu

SEQ ID NO: 4134367 - RNA, 19 nt, Yersinia pestis
ccucacugaaacgcuuaau

SEQ ID NO: 4134368 - RNA, 19 nt, Yersinia pestis
ccucagacugcugacaaac

SEQ ID NO: 4134369 - RNA, 16 nt, Yersinia pestis
ccucagagacaucuuu

SEQ ID NO: 4134370 - RNA, 13 nt, Yersinia pestis
ccucagccucauu

SEQ ID NO: 4134371 - RNA, 22 nt, Yersinia pestis
ccucagccuuuuuugcuuaaaa

SEQ ID NO: 4134372 - RNA, 20 nt, Yersinia pestis
ccucaggcccgcuaucacua

SEQ ID NO: 4134373 - RNA, 18 nt, Yersinia pestis
ccucagggcgucucuacg

SEQ ID NO: 4134374 - RNA, 22 nt, Yersinia pestis
ccucaggugcauccacauauau

SEQ ID NO: 4134375 - RNA, 18 nt, Yersinia pestis
ccucaguaccugaagcua

SEQ ID NO: 4134376 - RNA, 20 nt, Yersinia pestis
ccucaguucuuggaacccgu

SEQ ID NO: 4134377 - RNA, 21 nt, Yersinia pestis
ccucaucucaugacaaagaau

SEQ ID NO: 4134378 - RNA, 23 nt, Yersinia pestis
ccucaugaaugaggcugagguug

SEQ ID NO: 4134379 - RNA, 19 nt, Yersinia pestis
ccucauuaaucagcauuaa

SEQ ID NO: 4134380 - RNA, 17 nt, Yersinia pestis
ccucauucaugaggcuc

SEQ ID NO: 4134381 - RNA, 20 nt, Yersinia pestis
ccucauucaugaggcucaga

SEQ ID NO: 4134382 - RNA, 17 nt, Yersinia pestis
ccucauucgggcauucc

SEQ ID NO: 4134383 - RNA, 15 nt, Yersinia pestis
ccuguauuuccugua

SEQ ID NO: 4134384 - RNA, 13 nt, Yersinia pestis
ccugucaccuacc

SEQ ID NO: 4134385 - RNA, 17 nt, Yersinia pestis
ccugucccuaucauuca

SEQ ID NO: 4134386 - RNA, 22 nt, Yersinia pestis
ccugucuaggguuauuuuauug

SEQ ID NO: 4134387 - RNA, 15 nt, Yersinia pestis
ccugugaugauggcg

SEQ ID NO: 4134388 - RNA, 22 nt, Yersinia pestis
ccugugauucagccaacagcug

SEQ ID NO: 4134389 - RNA, 23 nt, Yersinia pestis
ccugugcgcccacgccaacccuc

SEQ ID NO: 4134390 - RNA, 18 nt, Yersinia pestis
ccugugcgcuuugcagua

SEQ ID NO: 4134391 - RNA, 14 nt, Yersinia pestis
ccuguggaaauuua

SEQ ID NO: 4134392 - RNA, 22 nt, Yersinia pestis
ccuguguuuugagcaucacuuc

SEQ ID NO: 4134393 - RNA, 20 nt, Yersinia pestis
ccuguucgacauucucuacu

SEQ ID NO: 4134394 - RNA, 15 nt, Yersinia pestis
ccuguucucuccguc

SEQ ID NO: 4134395 - RNA, 22 nt, Yersinia pestis
ccuguugagguacggcucuauu

SEQ ID NO: 4134396 - RNA, 18 nt, Yersinia pestis
ccuguuguaacacuugac

SEQ ID NO: 4134397 - RNA, 18 nt, Yersinia pestis
ccuguuuacguaaauaga

SEQ ID NO: 4134398 - RNA, 18 nt, Yersinia pestis
ccuguuuuuguuguucuu

SEQ ID NO: 4134399 - RNA, 21 nt, Yersinia pestis
ccuuaaccccguagcacacac

SEQ ID NO: 4134400 - RNA, 16 nt, Yersinia pestis
ccuuaacgccccgccc

SEQ ID NO: 4134401 - RNA, 17 nt, Yersinia pestis
ccuuaacgccccgcccc

SEQ ID NO: 4134402 - RNA, 18 nt, Yersinia pestis
ccuuaacgccccgccccu

SEQ ID NO: 4134403 - RNA, 12 nt, Yersinia pestis
ccuuaauaccgu

SEQ ID NO: 4134404 - RNA, 18 nt, Yersinia pestis
ccuuacagugauaaucac

SEQ ID NO: 4134405 - RNA, 14 nt, Yersinia pestis
ccuuacuaucuuua

SEQ ID NO: 4134406 - RNA, 20 nt, Yersinia pestis
ccuuacuaucuuuauugcuc

SEQ ID NO: 4134407 - RNA, 13 nt, Yersinia pestis
ccuuacugcauca

SEQ ID NO: 4134408 - RNA, 20 nt, Yersinia pestis
ccuuacuucaaaacuaauau

SEQ ID NO: 4134409 - RNA, 17 nt, Yersinia pestis
ccuuacuuccaauaagu

SEQ ID NO: 4134410 - RNA, 22 nt, Yersinia pestis
ccuuagcacguuuuucagcuuc

SEQ ID NO: 4134411 - RNA, 20 nt, Yersinia pestis
ccuuauaggcgcauaugaaa

SEQ ID NO: 4134412 - RNA, 23 nt, Yersinia pestis
ccuuauaggcgcauaugaaaaac

SEQ ID NO: 4134413 - RNA, 13 nt, Yersinia pestis
ccuuaucuacugg

SEQ ID NO: 4134414 - RNA, 18 nt, Yersinia pestis
ccuuauucaaagaauaac

SEQ ID NO: 4134415 - RNA, 14 nt, Yersinia pestis
ccuuauucuuauuu

SEQ ID NO: 4134416 - RNA, 21 nt, Yersinia pestis
ccuucaaacgggugauguuua

SEQ ID NO: 4134417 - RNA, 16 nt, Yersinia pestis
ccuucaaagccgcuuu

SEQ ID NO: 4134418 - RNA, 19 nt, Yersinia pestis
ccuucaaagccgcuuuaau

SEQ ID NO: 4134419 - RNA, 14 nt, Yersinia pestis
ccuucaacuaauau

SEQ ID NO: 4134420 - RNA, 15 nt, Yersinia pestis
ccuucaacuaauauu

SEQ ID NO: 4134421 - RNA, 16 nt, Yersinia pestis
ccuucaacuaauauua

SEQ ID NO: 4134422 - RNA, 17 nt, Yersinia pestis
ccuucaacuaauauuaa

SEQ ID NO: 4134423 - RNA, 13 nt, Yersinia pestis
ccuucaaucagca

SEQ ID NO: 4134424 - RNA, 16 nt, Yersinia pestis
ccuucacauuuucucc

SEQ ID NO: 4134425 - RNA, 13 nt, Yersinia pestis
ccuucaccaauac

SEQ ID NO: 4134426 - RNA, 14 nt, Yersinia pestis
ccuucaccaauaca

SEQ ID NO: 4134427 - RNA, 17 nt, Yersinia pestis
ccuucaccaauacaaac

SEQ ID NO: 4134428 - RNA, 11 nt, Yersinia pestis
ccuucacccag

SEQ ID NO: 4134429 - RNA, 15 nt, Yersinia pestis
ccuucacccaggcug

SEQ ID NO: 4134430 - RNA, 13 nt, Yersinia pestis
ccuucacgcucuu

SEQ ID NO: 4134431 - RNA, 17 nt, Yersinia pestis
ccuucacgguaguaaua

SEQ ID NO: 4134432 - RNA, 19 nt, Yersinia pestis
ccuucacgguaguaauaau

SEQ ID NO: 4134433 - RNA, 20 nt, Yersinia pestis
ccuucagacugcugacaaac

SEQ ID NO: 4134434 - RNA, 18 nt, Yersinia pestis
ccuucagaugaauccagc

SEQ ID NO: 4134435 - RNA, 22 nt, Yersinia pestis
ccuucagaugaauccagccaug

SEQ ID NO: 4134436 - RNA, 16 nt, Yersinia pestis
ccuucagccaccagau

SEQ ID NO: 4134437 - RNA, 14 nt, Yersinia pestis
ccuucaggaauaaa

SEQ ID NO: 4134438 - RNA, 17 nt, Yersinia pestis
ccuucaggaauaaacag

SEQ ID NO: 4134439 - RNA, 19 nt, Yersinia pestis
ccuucaucgacaauggcug

SEQ ID NO: 4134440 - RNA, 14 nt, Yersinia pestis
ccuucauuucagga

SEQ ID NO: 4134441 - RNA, 23 nt, Yersinia pestis
ccuucccguccacuuucaccaaa

SEQ ID NO: 4134442 - RNA, 20 nt, Yersinia pestis
ccuucccuacagaaaaauaa

SEQ ID NO: 4134443 - RNA, 11 nt, Yersinia pestis
ccuucccuggg

SEQ ID NO: 4134444 - RNA, 21 nt, Yersinia pestis
ccuucgaaacugaucacuggc

SEQ ID NO: 4134445 - RNA, 21 nt, Yersinia pestis
ccuucgcaccacaaugauuuc

SEQ ID NO: 4134446 - RNA, 23 nt, Yersinia pestis
ccuucgccgucaaacucuucagc

SEQ ID NO: 4134447 - RNA, 22 nt, Yersinia pestis
ccuucguuaaacauuauuuuuc

SEQ ID NO: 4134448 - RNA, 22 nt, Yersinia pestis
ccuucugaaaccccaaagcgca

SEQ ID NO: 4134449 - RNA, 20 nt, Yersinia pestis
ccuucuggcaaaccggacau

SEQ ID NO: 4134450 - RNA, 21 nt, Yersinia pestis
ccuucuuauuuaucacauuuc

SEQ ID NO: 4134451 - RNA, 11 nt, Yersinia pestis
ccuucuucacc

SEQ ID NO: 4134452 - RNA, 18 nt, Yersinia pestis
ccuucuuucaaagugaca

SEQ ID NO: 4134453 - RNA, 20 nt, Yersinia pestis
ccuugagguuauugacaaag

SEQ ID NO: 4134454 - RNA, 22 nt, Yersinia pestis
ccuugaugguucagccaccauu

SEQ ID NO: 4134455 - RNA, 14 nt, Yersinia pestis
ccuugauucacuga

SEQ ID NO: 4134456 - RNA, 15 nt, Yersinia pestis
ccuugcacaccgugc

SEQ ID NO: 4134457 - RNA, 21 nt, Yersinia pestis
ccuugcauccggucaagcgca

SEQ ID NO: 4134458 - RNA, 22 nt, Yersinia pestis
ccuugcggaagguauccaauac

SEQ ID NO: 4134459 - RNA, 23 nt, Yersinia pestis
ccuugcggaagguauccaauacc

SEQ ID NO: 4134460 - RNA, 17 nt, Yersinia pestis
ccuugcugaucgagcau

SEQ ID NO: 4134461 - RNA, 13 nt, Yersinia pestis
ccuugcugcaacg

SEQ ID NO: 4134462 - RNA, 22 nt, Yersinia pestis
ccuuggcauugucugcuggccu

SEQ ID NO: 4134463 - RNA, 15 nt, Yersinia pestis
ccuuggcguuucuga

SEQ ID NO: 4134464 - RNA, 15 nt, Yersinia pestis
ccuuggggccucacu

SEQ ID NO: 4134465 - RNA, 13 nt, Yersinia pestis
ccuuguaacuuua

SEQ ID NO: 4134466 - RNA, 20 nt, Yersinia pestis
ccuuguaagauaccaaccca

SEQ ID NO: 4134467 - RNA, 17 nt, Yersinia pestis
ccuugugugaauaucag

SEQ ID NO: 4134468 - RNA, 15 nt, Yersinia pestis
ccuuguugccuuucu

SEQ ID NO: 4134469 - RNA, 13 nt, Yersinia pestis
ccuuuacuccccu

SEQ ID NO: 4134470 - RNA, 16 nt, Yersinia pestis
ccuuuauucauucaga

SEQ ID NO: 4134471 - RNA, 22 nt, Yersinia pestis
ccuuucgcuugcaggucugcau

SEQ ID NO: 4134472 - RNA, 11 nt, Yersinia pestis
ccuuucugggc

SEQ ID NO: 4134473 - RNA, 18 nt, Yersinia pestis
ccuuugacagcaucugca

SEQ ID NO: 4134474 - RNA, 19 nt, Yersinia pestis
ccuuugacagcaucugcaa

SEQ ID NO: 4134475 - RNA, 15 nt, Yersinia pestis
ccuuugcuuucagga

SEQ ID NO: 4134476 - RNA, 16 nt, Yersinia pestis
ccuuugcuuucaggau

SEQ ID NO: 4134477 - RNA, 21 nt, Yersinia pestis
ccuuuuaaaugaagcaguuca

SEQ ID NO: 4134478 - RNA, 20 nt, Yersinia pestis
ccuuuuacaccacuaguuaa

SEQ ID NO: 4134479 - RNA, 22 nt, Yersinia pestis
ccuuuuagccuucguuugucaa

SEQ ID NO: 4134480 - RNA, 19 nt, Yersinia pestis
ccuuuuccgucagcccaac

SEQ ID NO: 4134481 - RNA, 23 nt, Yersinia pestis
ccuuuuugaaucaagcauucagc

SEQ ID NO: 4134482 - RNA, 20 nt, Yersinia pestis
ccuuuuugguuuucuauuuc

SEQ ID NO: 4134483 - RNA, 18 nt, Yersinia pestis
cgaaaaaacagcgaucua

SEQ ID NO: 4134484 - RNA, 22 nt, Yersinia pestis
cgaaaaauuucacuggcaccgc

SEQ ID NO: 4134485 - RNA, 18 nt, Yersinia pestis
cgaaaaccuaauacuuuc

SEQ ID NO: 4134486 - RNA, 12 nt, Yersinia pestis
cgaaaacucaaa

SEQ ID NO: 4134487 - RNA, 12 nt, Yersinia pestis
cgaaaagcagca

SEQ ID NO: 4134488 - RNA, 12 nt, Yersinia pestis
cgaaaauaauga

SEQ ID NO: 4134489 - RNA, 17 nt, Yersinia pestis
cgaaacacauacaaaua

SEQ ID NO: 4134490 - RNA, 10 nt, Yersinia pestis
cgaaacacca

SEQ ID NO: 4134491 - RNA, 19 nt, Yersinia pestis
cgaaacaccuagccguuua

SEQ ID NO: 4134492 - RNA, 14 nt, Yersinia pestis
cgaaagaaauaaaa

SEQ ID NO: 4134493 - RNA, 18 nt, Yersinia pestis
cgaaagaaauaaaagaaa

SEQ ID NO: 4134494 - RNA, 15 nt, Yersinia pestis
cgaaagauagcaaaa

SEQ ID NO: 4134495 - RNA, 18 nt, Yersinia pestis
cgaaagauagcaaaagaa

SEQ ID NO: 4134496 - RNA, 14 nt, Yersinia pestis
cgaaauauaaaaca

SEQ ID NO: 4134497 - RNA, 15 nt, Yersinia pestis
cgaaauuaaggaaaa

SEQ ID NO: 4134498 - RNA, 19 nt, Yersinia pestis
cgaacacaguccuguuuau

SEQ ID NO: 4134499 - RNA, 21 nt, Yersinia pestis
cgaacagugccaacagcgaga

SEQ ID NO: 4134500 - RNA, 14 nt, Yersinia pestis
cgaacaugccgaca

SEQ ID NO: 4134501 - RNA, 23 nt, Yersinia pestis
cgaacggauagcgcuucagugau

SEQ ID NO: 4134502 - RNA, 21 nt, Yersinia pestis
cgaacguaaaaaguagauccc

SEQ ID NO: 4134503 - RNA, 22 nt, Yersinia pestis
cgaacucgauaauaaaacggcu

SEQ ID NO: 4134504 - RNA, 19 nt, Yersinia pestis
cgaacuucaucggauugaa

SEQ ID NO: 4134505 - RNA, 22 nt, Yersinia pestis
cgauccaaaacaucggccagcg

SEQ ID NO: 4134506 - RNA, 15 nt, Yersinia pestis
cgauccgcuuuuuag

SEQ ID NO: 4134507 - RNA, 14 nt, Yersinia pestis
cgaucgcuuuuuac

SEQ ID NO: 4134508 - RNA, 16 nt, Yersinia pestis
cgaucugaaacgguga

SEQ ID NO: 4134509 - RNA, 17 nt, Yersinia pestis
cgaucugaaacggugag

SEQ ID NO: 4134510 - RNA, 18 nt, Yersinia pestis
cgaucugauaucucuuua

SEQ ID NO: 4134511 - RNA, 20 nt, Yersinia pestis
cgaucugccuguucucuccc

SEQ ID NO: 4134512 - RNA, 20 nt, Yersinia pestis
cgaucugccuuaucuaaccg

SEQ ID NO: 4134513 - RNA, 16 nt, Yersinia pestis
cgaucuugaacgguga

SEQ ID NO: 4134514 - RNA, 14 nt, Yersinia pestis
cgaugaaaaacaga

SEQ ID NO: 4134515 - RNA, 19 nt, Yersinia pestis
cgaugaauaugcuucauca

SEQ ID NO: 4134516 - RNA, 19 nt, Yersinia pestis
cgaugaccauuuauuucca

SEQ ID NO: 4134517 - RNA, 19 nt, Yersinia pestis
cgaugagcuucuucaaaag

SEQ ID NO: 4134518 - RNA, 20 nt, Yersinia pestis
cgaugauauacccaccagag

SEQ ID NO: 4134519 - RNA, 15 nt, Yersinia pestis
cgaugaugauuauuu

SEQ ID NO: 4134520 - RNA, 21 nt, Yersinia pestis
cgaugcagcguauucaguaaa

SEQ ID NO: 4134521 - RNA, 14 nt, Yersinia pestis
cgaugccuuuuugu

SEQ ID NO: 4134522 - RNA, 13 nt, Yersinia pestis
cgaugcucaggcc

SEQ ID NO: 4134523 - RNA, 13 nt, Yersinia pestis
cgauggaaaaaau

SEQ ID NO: 4134524 - RNA, 16 nt, Yersinia pestis
cgauggaccaugccau

SEQ ID NO: 4134525 - RNA, 22 nt, Yersinia pestis
cgauggauaaauucagccgcuc

SEQ ID NO: 4134526 - RNA, 23 nt, Yersinia pestis
cgauggcaaaggauaaugauauu

SEQ ID NO: 4134527 - RNA, 16 nt, Yersinia pestis
cgauggcaaccccugc

SEQ ID NO: 4134528 - RNA, 23 nt, Yersinia pestis
cgauggggaguauucgugguggg

SEQ ID NO: 4134529 - RNA, 17 nt, Yersinia pestis
cgauggggggguaugau

SEQ ID NO: 4134530 - RNA, 22 nt, Yersinia pestis
cgaugugaagcaauuugaucac

SEQ ID NO: 4134531 - RNA, 14 nt, Yersinia pestis
cgauguggauaauu

SEQ ID NO: 4134532 - RNA, 18 nt, Yersinia pestis
cgauguguuucgacgguu

SEQ ID NO: 4134533 - RNA, 20 nt, Yersinia pestis
cgauuaaaauaaagcgaguu

SEQ ID NO: 4134534 - RNA, 22 nt, Yersinia pestis
cgauuaaacgucucuuuuucau

SEQ ID NO: 4134535 - RNA, 14 nt, Yersinia pestis
cgauuaccugcaua

SEQ ID NO: 4134536 - RNA, 18 nt, Yersinia pestis
cgauuaccugcauauccu

SEQ ID NO: 4134537 - RNA, 21 nt, Yersinia pestis
cgauuagccauaagauaacgg

SEQ ID NO: 4134538 - RNA, 16 nt, Yersinia pestis
cgauuaggacaaauag

SEQ ID NO: 4134539 - RNA, 20 nt, Yersinia pestis
cgauuccgcgagcaauacca

SEQ ID NO: 4134540 - RNA, 17 nt, Yersinia pestis
cgauuccuguugaccaa

SEQ ID NO: 4134541 - RNA, 18 nt, Yersinia pestis
cgauugcacuggcuaaua

SEQ ID NO: 4134542 - RNA, 18 nt, Yersinia pestis
cgauuggacccgucacca

SEQ ID NO: 4134543 - RNA, 14 nt, Yersinia pestis
cgauuuaugaaccg

SEQ ID NO: 4134544 - RNA, 22 nt, Yersinia pestis
cgauuugcgggcuaaaacuggc

SEQ ID NO: 4134545 - RNA, 17 nt, Yersinia pestis
cgauuuuagcuuugacc

SEQ ID NO: 4134546 - RNA, 11 nt, Yersinia pestis
cgauuuuauau

SEQ ID NO: 4134547 - RNA, 23 nt, Yersinia pestis
cgcaaaaagggcaaacggcccuc

SEQ ID NO: 4134548 - RNA, 13 nt, Yersinia pestis
cgcaaaaucagua

SEQ ID NO: 4134549 - RNA, 22 nt, Yersinia pestis
cgcaaaaugccaacaacugggu

SEQ ID NO: 4134550 - RNA, 18 nt, Yersinia pestis
cgcaaagcguuucgccaa

SEQ ID NO: 4134551 - RNA, 17 nt, Yersinia pestis
cgcaaagggcaacaaua

SEQ ID NO: 4134552 - RNA, 21 nt, Yersinia pestis
cgcaacacagucgcacugaua

SEQ ID NO: 4134553 - RNA, 15 nt, Yersinia pestis
cgcaaccagcguuga

SEQ ID NO: 4134554 - RNA, 19 nt, Yersinia pestis
cgcaaccauccgcccaaua

SEQ ID NO: 4134555 - RNA, 18 nt, Yersinia pestis
cgcaagaaagaaaaauag

SEQ ID NO: 4134556 - RNA, 19 nt, Yersinia pestis
cgcaaggauaccaaucccu

SEQ ID NO: 4134557 - RNA, 16 nt, Yersinia pestis
cgcaaggccagguuag

SEQ ID NO: 4134558 - RNA, 19 nt, Yersinia pestis
cgcaauaaauggcauuuuu

SEQ ID NO: 4134559 - RNA, 15 nt, Yersinia pestis
cgcaauaucaaaacu

SEQ ID NO: 4134560 - RNA, 20 nt, Yersinia pestis
cgcaauggaagaaucaccga

SEQ ID NO: 4134561 - RNA, 15 nt, Yersinia pestis
cgcaauggugauaaa

SEQ ID NO: 4134562 - RNA, 15 nt, Yersinia pestis
cgcaaugucaccuga

SEQ ID NO: 4134563 - RNA, 14 nt, Yersinia pestis
cgcaaugucaucag

SEQ ID NO: 4134564 - RNA, 12 nt, Yersinia pestis
cgcaauugcacc

SEQ ID NO: 4134565 - RNA, 15 nt, Yersinia pestis
cgcacaaacauggcu

SEQ ID NO: 4134566 - RNA, 21 nt, Yersinia pestis
cgcacaaacauggcugucccg

SEQ ID NO: 4134567 - RNA, 13 nt, Yersinia pestis
cgcacaacugcga

SEQ ID NO: 4134568 - RNA, 14 nt, Yersinia pestis
cgcacacagcccug

SEQ ID NO: 4134569 - RNA, 13 nt, Yersinia pestis
cgcacacugcaga

SEQ ID NO: 4134570 - RNA, 20 nt, Yersinia pestis
cgcacaguuuucuuaaaaua

SEQ ID NO: 4134571 - RNA, 12 nt, Yersinia pestis
cgcaccaaugcc

SEQ ID NO: 4134572 - RNA, 14 nt, Yersinia pestis
cgcaccacugucag

SEQ ID NO: 4134573 - RNA, 13 nt, Yersinia pestis
cgcaccagcucaa

SEQ ID NO: 4134574 - RNA, 14 nt, Yersinia pestis
cgcaccauaaccaa

SEQ ID NO: 4134575 - RNA, 18 nt, Yersinia pestis
cgcaccauaaccaaucca

SEQ ID NO: 4134576 - RNA, 20 nt, Yersinia pestis
cgcaccauccagcaaaucau

SEQ ID NO: 4134577 - RNA, 23 nt, Yersinia pestis
cgcacccaaacugucugcgacaa

SEQ ID NO: 4134578 - RNA, 16 nt, Yersinia pestis
cgcacccuuacccugg

SEQ ID NO: 4134579 - RNA, 18 nt, Yersinia pestis
cgcaccgaaauagucgcg

SEQ ID NO: 4134580 - RNA, 18 nt, Yersinia pestis
cgcaccggcuaaccacag

SEQ ID NO: 4134581 - RNA, 23 nt, Yersinia pestis
cgcaccggcuaaccacagcaaug

SEQ ID NO: 4134582 - RNA, 18 nt, Yersinia pestis
cgcacgaaaggcuggagc

SEQ ID NO: 4134583 - RNA, 23 nt, Yersinia pestis
cgcacgaauaucuagcaacacau

SEQ ID NO: 4134584 - RNA, 19 nt, Yersinia pestis
cgcacgacgagcuucaccu

SEQ ID NO: 4134585 - RNA, 16 nt, Yersinia pestis
cgcacgggucauuaac

SEQ ID NO: 4134586 - RNA, 14 nt, Yersinia pestis
cgcacuacccgaau

SEQ ID NO: 4134587 - RNA, 23 nt, Yersinia pestis
cgcacugagggugauaucgucag

SEQ ID NO: 4134588 - RNA, 18 nt, Yersinia pestis
cgcacugggaucugauca

SEQ ID NO: 4134589 - RNA, 20 nt, Yersinia pestis
cgcacugggucaucacccag

SEQ ID NO: 4134590 - RNA, 22 nt, Yersinia pestis
cgcacugggucaucacccagca

SEQ ID NO: 4134591 - RNA, 22 nt, Yersinia pestis
cgcacuuaaugccgcugaucag

SEQ ID NO: 4134592 - RNA, 23 nt, Yersinia pestis
cgcacuuacccgaaucacugacu

SEQ ID NO: 4134593 - RNA, 22 nt, Yersinia pestis
cgcacuugaucaggggacaacc

SEQ ID NO: 4134594 - RNA, 14 nt, Yersinia pestis
cgcagaacccaggg

SEQ ID NO: 4134595 - RNA, 20 nt, Yersinia pestis
cgcagacggcguaagccuuc

SEQ ID NO: 4134596 - RNA, 20 nt, Yersinia pestis
cgcagacugcugacaaaccc

SEQ ID NO: 4134597 - RNA, 18 nt, Yersinia pestis
cgcagaguccucucacca

SEQ ID NO: 4134598 - RNA, 14 nt, Yersinia pestis
cgcagauaaaucug

SEQ ID NO: 4134599 - RNA, 17 nt, Yersinia pestis
cgcagauccagaauuuc

SEQ ID NO: 4134600 - RNA, 18 nt, Yersinia pestis
cgcagauccagaauuuca

SEQ ID NO: 4134601 - RNA, 17 nt, Yersinia pestis
cgcagcaaauaaacaaa

SEQ ID NO: 4134602 - RNA, 22 nt, Yersinia pestis
cgcagccaacggagcguacacg

SEQ ID NO: 4134603 - RNA, 16 nt, Yersinia pestis
cgcagcguccauaaac

SEQ ID NO: 4134604 - RNA, 11 nt, Yersinia pestis
cgcagcuucca

SEQ ID NO: 4134605 - RNA, 23 nt, Yersinia pestis
cgcaggaacgaaguuagacccaa

SEQ ID NO: 4134606 - RNA, 13 nt, Yersinia pestis
cgcaggcggucaa

SEQ ID NO: 4134607 - RNA, 17 nt, Yersinia pestis
cgcagguaacgccgcug

SEQ ID NO: 4134608 - RNA, 16 nt, Yersinia pestis
cgcagguuggcggcaa

SEQ ID NO: 4134609 - RNA, 20 nt, Yersinia pestis
cgcaguacgugacggcagcg

SEQ ID NO: 4134610 - RNA, 24 nt, Yersinia pestis
cgcaguacgugacggcggcgagca

SEQ ID NO: 4134611 - RNA, 12 nt, Yersinia pestis
cgcagugcauug

SEQ ID NO: 4134612 - RNA, 15 nt, Yersinia pestis
cgcaguguaaaaccu

SEQ ID NO: 4134613 - RNA, 14 nt, Yersinia pestis
cgcaguugccaaac

SEQ ID NO: 4134614 - RNA, 17 nt, Yersinia pestis
cgcauaaaaugagccug

SEQ ID NO: 4134615 - RNA, 13 nt, Yersinia pestis
cgcauaagacacc

SEQ ID NO: 4134616 - RNA, 12 nt, Yersinia pestis
cgcauaggccaa

SEQ ID NO: 4134617 - RNA, 14 nt, Yersinia pestis
cgcauaugaaaaac

SEQ ID NO: 4134618 - RNA, 19 nt, Yersinia pestis
cgcauauuuuggcaacuca

SEQ ID NO: 4134619 - RNA, 21 nt, Yersinia pestis
cgcaucaaacggcaacuucua

SEQ ID NO: 4134620 - RNA, 12 nt, Yersinia pestis
cgcaucacaucu

SEQ ID NO: 4134621 - RNA, 16 nt, Yersinia pestis
cgcaucgaccacccgu

SEQ ID NO: 4134622 - RNA, 20 nt, Yersinia pestis
cgcaucgccuguaaaucuug

SEQ ID NO: 4134623 - RNA, 13 nt, Yersinia pestis
cgcaugacuagug

SEQ ID NO: 4134624 - RNA, 17 nt, Yersinia pestis
cgcauguaaauuaauac

SEQ ID NO: 4134625 - RNA, 17 nt, Yersinia pestis
cgcauuaauccgccuga

SEQ ID NO: 4134626 - RNA, 14 nt, Yersinia pestis
cgcauuacccgaau

SEQ ID NO: 4134627 - RNA, 17 nt, Yersinia pestis
cgcggaugcgcgcguca

SEQ ID NO: 4134628 - RNA, 15 nt, Yersinia pestis
cgcggcaaagucugg

SEQ ID NO: 4134629 - RNA, 13 nt, Yersinia pestis
cgcggcgccguca

SEQ ID NO: 4134630 - RNA, 22 nt, Yersinia pestis
cgcggcgguaaccccggcggcu

SEQ ID NO: 4134631 - RNA, 18 nt, Yersinia pestis
cgcgggcgcgcugcugcu

SEQ ID NO: 4134632 - RNA, 12 nt, Yersinia pestis
cgcggguauccu

SEQ ID NO: 4134633 - RNA, 17 nt, Yersinia pestis
cgcggguuuugccgggc

SEQ ID NO: 4134634 - RNA, 16 nt, Yersinia pestis
cgcgguucgcagcuuc

SEQ ID NO: 4134635 - RNA, 17 nt, Yersinia pestis
cgcgguucgcagcuucc

SEQ ID NO: 4134636 - RNA, 21 nt, Yersinia pestis
cgcgguuggcccuuuucaaac

SEQ ID NO: 4134637 - RNA, 17 nt, Yersinia pestis
cgcgguuuuuccgccgu

SEQ ID NO: 4134638 - RNA, 21 nt, Yersinia pestis
cgcguaauaaacacuuggcau

SEQ ID NO: 4134639 - RNA, 18 nt, Yersinia pestis
cgcguaucguccagcagc

SEQ ID NO: 4134640 - RNA, 12 nt, Yersinia pestis
cgcgucaaucgg

SEQ ID NO: 4134641 - RNA, 20 nt, Yersinia pestis
cgcgucaucgggguuuguca

SEQ ID NO: 4134642 - RNA, 20 nt, Yersinia pestis
cgcgugguuuccuggaacga

SEQ ID NO: 4134643 - RNA, 15 nt, Yersinia pestis
cgcguuaauaccuug

SEQ ID NO: 4134644 - RNA, 18 nt, Yersinia pestis
cgcguuaaugcuaaugcc

SEQ ID NO: 4134645 - RNA, 11 nt, Yersinia pestis
cgcguucacuu

SEQ ID NO: 4134646 - RNA, 14 nt, Yersinia pestis
cgcguugcccuucu

SEQ ID NO: 4134647 - RNA, 20 nt, Yersinia pestis
cgcguugucagccaugccug

SEQ ID NO: 4134648 - RNA, 23 nt, Yersinia pestis
cgcguuugcuugcugccugccug

SEQ ID NO: 4134649 - RNA, 21 nt, Yersinia pestis
cgcuaaccaacgcggcccccg

SEQ ID NO: 4134650 - RNA, 16 nt, Yersinia pestis
cgcuaaccaccgucac

SEQ ID NO: 4134651 - RNA, 20 nt, Yersinia pestis
cgcuaagucacgcacccacc

SEQ ID NO: 4134652 - RNA, 18 nt, Yersinia pestis
cgcuaauacggcuugcaa

SEQ ID NO: 4134653 - RNA, 14 nt, Yersinia pestis
cgcuaaugggugau

SEQ ID NO: 4134654 - RNA, 17 nt, Yersinia pestis
cgcuaccuccggggccu

SEQ ID NO: 4134655 - RNA, 16 nt, Yersinia pestis
cgcuacucccggcagc

SEQ ID NO: 4134656 - RNA, 15 nt, Yersinia pestis
cgcuacugagauaau

SEQ ID NO: 4134657 - RNA, 22 nt, Yersinia pestis
cgcuauaaaacagcuugauagg

SEQ ID NO: 4134658 - RNA, 22 nt, Yersinia pestis
cgcuauauugcgccgcauuguu

SEQ ID NO: 4134659 - RNA, 19 nt, Yersinia pestis
cgcuaucacuagcgggccu

SEQ ID NO: 4134660 - RNA, 21 nt, Yersinia pestis
cgcuauccccacggcgacguu

SEQ ID NO: 4134661 - RNA, 23 nt, Yersinia pestis
cgcuaucugcugaccauuacgua

SEQ ID NO: 4134662 - RNA, 13 nt, Yersinia pestis
cgcuaugcagccc

SEQ ID NO: 4134663 - RNA, 17 nt, Yersinia pestis
cgcuaugcucagcaacc

SEQ ID NO: 4134664 - RNA, 14 nt, Yersinia pestis
cgcuauuucucucu

SEQ ID NO: 4134665 - RNA, 16 nt, Yersinia pestis
cgcuauuucuucauac

SEQ ID NO: 4134666 - RNA, 19 nt, Yersinia pestis
cgcuauuuguaucaaugaa

SEQ ID NO: 4134667 - RNA, 15 nt, Yersinia pestis
cgcucaaucacgaca

SEQ ID NO: 4134668 - RNA, 22 nt, Yersinia pestis
cgcucacgcugggcgaucauuu

SEQ ID NO: 4134669 - RNA, 15 nt, Yersinia pestis
cgcucacuuuuauau

SEQ ID NO: 4134670 - RNA, 21 nt, Yersinia pestis
cgcucacuuuuauauccgcca

SEQ ID NO: 4134671 - RNA, 12 nt, Yersinia pestis
cgcucagcaaaa

SEQ ID NO: 4134672 - RNA, 13 nt, Yersinia pestis
cgcucaggcgguc

SEQ ID NO: 4134673 - RNA, 18 nt, Yersinia pestis
cgcucaguauucgccaga

SEQ ID NO: 4134674 - RNA, 22 nt, Yersinia pestis
cgcucaucaaccgggauaucaa

SEQ ID NO: 4134675 - RNA, 16 nt, Yersinia pestis
cgcucaucacggcggc

SEQ ID NO: 4134676 - RNA, 21 nt, Yersinia pestis
cgcucauccaacguaaacauu

SEQ ID NO: 4134677 - RNA, 13 nt, Yersinia pestis
cgcucaucgccaa

SEQ ID NO: 4134678 - RNA, 17 nt, Yersinia pestis
cgcucaucgccaaagcc

SEQ ID NO: 4134679 - RNA, 14 nt, Yersinia pestis
cgcuccacacaaaa

SEQ ID NO: 4134680 - RNA, 17 nt, Yersinia pestis
cgcuccacacccgccaa

SEQ ID NO: 4134681 - RNA, 17 nt, Yersinia pestis
cgcuccaccagcccauc

SEQ ID NO: 4134682 - RNA, 17 nt, Yersinia pestis
cgcuccagauugucaau

SEQ ID NO: 4134683 - RNA, 16 nt, Yersinia pestis
cgcucccuccgccagc

SEQ ID NO: 4134684 - RNA, 14 nt, Yersinia pestis
cgcuccgagcgugc

SEQ ID NO: 4134685 - RNA, 18 nt, Yersinia pestis
cgcuccggcaaccagcgu

SEQ ID NO: 4134686 - RNA, 14 nt, Yersinia pestis
cgcucgcuugcugc

SEQ ID NO: 4134687 - RNA, 23 nt, Yersinia pestis
cgcucggcucgaaccugaacgca

SEQ ID NO: 4134688 - RNA, 16 nt, Yersinia pestis
cgcucuacaacgucca

SEQ ID NO: 4134689 - RNA, 13 nt, Yersinia pestis
cgcucuacauuug

SEQ ID NO: 4134690 - RNA, 12 nt, Yersinia pestis
cgcucuggguua

SEQ ID NO: 4134691 - RNA, 15 nt, Yersinia pestis
cgcucuucagcauca

SEQ ID NO: 4134692 - RNA, 14 nt, Yersinia pestis
cgcugacagaguac

SEQ ID NO: 4134693 - RNA, 16 nt, Yersinia pestis
cgcugagcaacgguuu

SEQ ID NO: 4134694 - RNA, 11 nt, Yersinia pestis
cgcugagguuc

SEQ ID NO: 4134695 - RNA, 20 nt, Yersinia pestis
cgcugagguucuccaacaac

SEQ ID NO: 4134696 - RNA, 16 nt, Yersinia pestis
cgcugauaaccagcag

SEQ ID NO: 4134697 - RNA, 17 nt, Yersinia pestis
cgcugauaaccagcagc

SEQ ID NO: 4134698 - RNA, 16 nt, Yersinia pestis
cgcugauaacuuccuu

SEQ ID NO: 4134699 - RNA, 16 nt, Yersinia pestis
cgcugaucaucaucaa

SEQ ID NO: 4134700 - RNA, 23 nt, Yersinia pestis
cgcugauguaggcaauacaccgc

SEQ ID NO: 4134701 - RNA, 23 nt, Yersinia pestis
cgcugcaaacaggcccacugcaa

SEQ ID NO: 4134702 - RNA, 19 nt, Yersinia pestis
cgcugcaacuccuuaccac

SEQ ID NO: 4134703 - RNA, 13 nt, Yersinia pestis
cgcugcaauaaag

SEQ ID NO: 4134704 - RNA, 16 nt, Yersinia pestis
cgcugcaauuauaagc

SEQ ID NO: 4134705 - RNA, 17 nt, Yersinia pestis
cgcugcagcaucaagga

SEQ ID NO: 4134706 - RNA, 17 nt, Yersinia pestis
cgcugcucaaucaccga

SEQ ID NO: 4134707 - RNA, 17 nt, Yersinia pestis
cgcuggcacugccauca

SEQ ID NO: 4134708 - RNA, 20 nt, Yersinia pestis
cgcuggcgcgcauaguaucc

SEQ ID NO: 4134709 - RNA, 11 nt, Yersinia pestis
cgcuggcucua

SEQ ID NO: 4134710 - RNA, 21 nt, Yersinia pestis
cgcuggugcggaacagcgccc

SEQ ID NO: 4134711 - RNA, 18 nt, Yersinia pestis
cgcuguaggugucaccaa

SEQ ID NO: 4134712 - RNA, 15 nt, Yersinia pestis
cgcuguauacccgcc

SEQ ID NO: 4134713 - RNA, 24 nt, Yersinia pestis
cgcugucauuccaaccuuguaacu

SEQ ID NO: 4134714 - RNA, 16 nt, Yersinia pestis
cgcugugccuggauca

SEQ ID NO: 4134715 - RNA, 22 nt, Yersinia pestis
cgcuguggcuaauaaugcacca

SEQ ID NO: 4134716 - RNA, 16 nt, Yersinia pestis
cgcuguugaucgccgc

SEQ ID NO: 4134717 - RNA, 19 nt, Yersinia pestis
cgcuguuucucuucaucgc

SEQ ID NO: 4134718 - RNA, 18 nt, Yersinia pestis
cgcuuaaauaaaacaccc

SEQ ID NO: 4134719 - RNA, 12 nt, Yersinia pestis
cgcuuaccaaaa

SEQ ID NO: 4134720 - RNA, 22 nt, Yersinia pestis
cgcuuaccaaaacgccaccagc

SEQ ID NO: 4134721 - RNA, 18 nt, Yersinia pestis
cgcuuagucgccagaaga

SEQ ID NO: 4134722 - RNA, 20 nt, Yersinia pestis
cgcuucuuguugagugacca

SEQ ID NO: 4134723 - RNA, 15 nt, Yersinia pestis
cgcuuggucacuggu

SEQ ID NO: 4134724 - RNA, 14 nt, Yersinia pestis
cgcuugucacccca

SEQ ID NO: 4134725 - RNA, 17 nt, Yersinia pestis
cgcuugugcucacguca

SEQ ID NO: 4134726 - RNA, 22 nt, Yersinia pestis
cgcuuuaauggggagugcgcgc

SEQ ID NO: 4134727 - RNA, 19 nt, Yersinia pestis
cgcuuuacuccccugccua

SEQ ID NO: 4134728 - RNA, 19 nt, Yersinia pestis
cgcuuuacuccucugccua

SEQ ID NO: 4134729 - RNA, 17 nt, Yersinia pestis
cgcuuucuguucaucaa

SEQ ID NO: 4134730 - RNA, 14 nt, Yersinia pestis
cgcuuuuuacccag

SEQ ID NO: 4134731 - RNA, 11 nt, Yersinia pestis
cggaaaauaaa

SEQ ID NO: 4134732 - RNA, 20 nt, Yersinia pestis
cggaaacguucaggcuuucg

SEQ ID NO: 4134733 - RNA, 15 nt, Yersinia pestis
cggaaauaaggcgca

SEQ ID NO: 4134734 - RNA, 13 nt, Yersinia pestis
cggaaaucgguga

SEQ ID NO: 4134735 - RNA, 20 nt, Yersinia pestis
cggaaaugccgauaaaaacu

SEQ ID NO: 4134736 - RNA, 13 nt, Yersinia pestis
cggaacagcagcg

SEQ ID NO: 4134737 - RNA, 14 nt, Yersinia pestis
cggaacaguugcuu

SEQ ID NO: 4134738 - RNA, 14 nt, Yersinia pestis
cggaaccgccgccu

SEQ ID NO: 4134739 - RNA, 19 nt, Yersinia pestis
cggaaccuuucgaguugaa

SEQ ID NO: 4134740 - RNA, 16 nt, Yersinia pestis
cggaacucagacuucu

SEQ ID NO: 4134741 - RNA, 17 nt, Yersinia pestis
cggaacucaucuuucuc

SEQ ID NO: 4134742 - RNA, 19 nt, Yersinia pestis
cggaagacuuccagcacca

SEQ ID NO: 4134743 - RNA, 15 nt, Yersinia pestis
cggaagcaaucagga

SEQ ID NO: 4134744 - RNA, 16 nt, Yersinia pestis
cggaagcacguaaauc

SEQ ID NO: 4134745 - RNA, 22 nt, Yersinia pestis
cggaagcgccgacacccagcca

SEQ ID NO: 4134746 - RNA, 14 nt, Yersinia pestis
cggaagucaaucgg

SEQ ID NO: 4134747 - RNA, 20 nt, Yersinia pestis
cggaagugaguaucuucauc

SEQ ID NO: 4134748 - RNA, 14 nt, Yersinia pestis
cggaauaaaugaga

SEQ ID NO: 4134749 - RNA, 15 nt, Yersinia pestis
cggcuuucugccugu

SEQ ID NO: 4134750 - RNA, 22 nt, Yersinia pestis
cgggaaauaacuggugaugcuc

SEQ ID NO: 4134751 - RNA, 14 nt, Yersinia pestis
cgggaacgccaagu

SEQ ID NO: 4134752 - RNA, 15 nt, Yersinia pestis
cgggaauaaucaauu

SEQ ID NO: 4134753 - RNA, 23 nt, Yersinia pestis
cgggacgcguuugcuugcugccu

SEQ ID NO: 4134754 - RNA, 14 nt, Yersinia pestis
cgggagggauuucu

SEQ ID NO: 4134755 - RNA, 14 nt, Yersinia pestis
cgggauaucgaugg

SEQ ID NO: 4134756 - RNA, 19 nt, Yersinia pestis
cgggauaucgauggcaacc

SEQ ID NO: 4134757 - RNA, 15 nt, Yersinia pestis
cgggaucaccgcuuu

SEQ ID NO: 4134758 - RNA, 17 nt, Yersinia pestis
cgggauccgccugcugg

SEQ ID NO: 4134759 - RNA, 17 nt, Yersinia pestis
cgggaugcgcucgcuug

SEQ ID NO: 4134760 - RNA, 22 nt, Yersinia pestis
cgggauggaaauugaacgguuu

SEQ ID NO: 4134761 - RNA, 22 nt, Yersinia pestis
cgggcaaacgccagugcaaaau

SEQ ID NO: 4134762 - RNA, 11 nt, Yersinia pestis
cgggcaaccug

SEQ ID NO: 4134763 - RNA, 22 nt, Yersinia pestis
cgggcacgaauagucuguuuca

SEQ ID NO: 4134764 - RNA, 22 nt, Yersinia pestis
cgggcagacguuggccuuucac

SEQ ID NO: 4134765 - RNA, 16 nt, Yersinia pestis
cgggcagugcgggcaa

SEQ ID NO: 4134766 - RNA, 22 nt, Yersinia pestis
cgggcagugcgggcaacacagc

SEQ ID NO: 4134767 - RNA, 23 nt, Yersinia pestis
cgggccaaggggagccacacacu

SEQ ID NO: 4134768 - RNA, 17 nt, Yersinia pestis
cgggccgcauucaccac

SEQ ID NO: 4134769 - RNA, 21 nt, Yersinia pestis
cgggccgcauucaccaccaua

SEQ ID NO: 4134770 - RNA, 14 nt, Yersinia pestis
cgggccuaauuuaa

SEQ ID NO: 4134771 - RNA, 22 nt, Yersinia pestis
cgggccuuugcuuuucugccua

SEQ ID NO: 4134772 - RNA, 17 nt, Yersinia pestis
cgggcgaacagaaauca

SEQ ID NO: 4134773 - RNA, 23 nt, Yersinia pestis
cgggcgaaggucaauugcggcca

SEQ ID NO: 4134774 - RNA, 16 nt, Yersinia pestis
cgggcgcaauggaaga

SEQ ID NO: 4134775 - RNA, 22 nt, Yersinia pestis
cgggcgcagccacaugauuacc

SEQ ID NO: 4134776 - RNA, 19 nt, Yersinia pestis
cgggcggaaauaaggcgca

SEQ ID NO: 4134777 - RNA, 13 nt, Yersinia pestis
cgggcugauuaau

SEQ ID NO: 4134778 - RNA, 23 nt, Yersinia pestis
cgggcugcugcagccgggaugau

SEQ ID NO: 4134779 - RNA, 21 nt, Yersinia pestis
cgggcugucggcgaugaaaaa

SEQ ID NO: 4134780 - RNA, 18 nt, Yersinia pestis
cgggcuuccaucaggaag

SEQ ID NO: 4134781 - RNA, 20 nt, Yersinia pestis
cgggcuuuacagucgcugcu

SEQ ID NO: 4134782 - RNA, 22 nt, Yersinia pestis
cggggguugucagcagucugau

SEQ ID NO: 4134783 - RNA, 14 nt, Yersinia pestis
cgggguugcaguua

SEQ ID NO: 4134784 - RNA, 20 nt, Yersinia pestis
cggguaacugugcaggaaau

SEQ ID NO: 4134785 - RNA, 21 nt, Yersinia pestis
cggguaaugcuguuguagcgc

SEQ ID NO: 4134786 - RNA, 14 nt, Yersinia pestis
cggguauaucacuu

SEQ ID NO: 4134787 - RNA, 19 nt, Yersinia pestis
cggguauauuccuguccuu

SEQ ID NO: 4134788 - RNA, 15 nt, Yersinia pestis
cgggucacagccacg

SEQ ID NO: 4134789 - RNA, 15 nt, Yersinia pestis
cgggucagcucacca

SEQ ID NO: 4134790 - RNA, 14 nt, Yersinia pestis
cgggucagugaaaa

SEQ ID NO: 4134791 - RNA, 21 nt, Yersinia pestis
cgggucaugucgcuguagcgc

SEQ ID NO: 4134792 - RNA, 12 nt, Yersinia pestis
cgggugaaacca

SEQ ID NO: 4134793 - RNA, 18 nt, Yersinia pestis
cgggugaaaccacugcgg

SEQ ID NO: 4134794 - RNA, 16 nt, Yersinia pestis
cgggugcuuuaaugag

SEQ ID NO: 4134795 - RNA, 23 nt, Yersinia pestis
cggguggcccaaaugagcagcaa

SEQ ID NO: 4134796 - RNA, 18 nt, Yersinia pestis
cggguucgcgcucacgca

SEQ ID NO: 4134797 - RNA, 16 nt, Yersinia pestis
cggguuuacccagcca

SEQ ID NO: 4134798 - RNA, 23 nt, Yersinia pestis
cggguuuugccgggcaauuguga

SEQ ID NO: 4134799 - RNA, 23 nt, Yersinia pestis
cggguuuuuaacuuuaucagucu

SEQ ID NO: 4134800 - RNA, 23 nt, Yersinia pestis
cgguaacauauaaaccagccagu

SEQ ID NO: 4134801 - RNA, 14 nt, Yersinia pestis
cgguaaccaggcga

SEQ ID NO: 4134802 - RNA, 16 nt, Yersinia pestis
cgguaacgcagauaaa

SEQ ID NO: 4134803 - RNA, 22 nt, Yersinia pestis
cgguaacgcccguugcccaccg

SEQ ID NO: 4134804 - RNA, 22 nt, Yersinia pestis
cgguaacuuuuuguugcaccaa

SEQ ID NO: 4134805 - RNA, 12 nt, Yersinia pestis
cgguaagcuggc

SEQ ID NO: 4134806 - RNA, 22 nt, Yersinia pestis
cgguaaucccgauauaaauaaa

SEQ ID NO: 4134807 - RNA, 19 nt, Yersinia pestis
cgguaaucugagacgucca

SEQ ID NO: 4134808 - RNA, 14 nt, Yersinia pestis
cgguaccagcaaac

SEQ ID NO: 4134809 - RNA, 16 nt, Yersinia pestis
cgguaccgcaggucag

SEQ ID NO: 4134810 - RNA, 22 nt, Yersinia pestis
cgguaccggcugggaucagacg

SEQ ID NO: 4134811 - RNA, 13 nt, Yersinia pestis
cgguacgcaucac

SEQ ID NO: 4134812 - RNA, 17 nt, Yersinia pestis
cgguacgcugauagcca

SEQ ID NO: 4134813 - RNA, 13 nt, Yersinia pestis
cgguacugaggca

SEQ ID NO: 4134814 - RNA, 14 nt, Yersinia pestis
cgguagaccaccaa

SEQ ID NO: 4134815 - RNA, 13 nt, Yersinia pestis
cgguaucaaucag

SEQ ID NO: 4134816 - RNA, 15 nt, Yersinia pestis
cgguaucaaucagcg

SEQ ID NO: 4134817 - RNA, 18 nt, Yersinia pestis
cgguaucggccaauucag

SEQ ID NO: 4134818 - RNA, 23 nt, Yersinia pestis
cgguauguguguacuuaucgauu

SEQ ID NO: 4134819 - RNA, 20 nt, Yersinia pestis
cgguauugcucucgauuucu

SEQ ID NO: 4134820 - RNA, 17 nt, Yersinia pestis
cgguauuugaacuucaa

SEQ ID NO: 4134821 - RNA, 22 nt, Yersinia pestis
cgguauuuggcauucauaucuu

SEQ ID NO: 4134822 - RNA, 13 nt, Yersinia pestis
cggucacaccaga

SEQ ID NO: 4134823 - RNA, 15 nt, Yersinia pestis
cggucacacuggcac

SEQ ID NO: 4134824 - RNA, 23 nt, Yersinia pestis
cggucauucacuguggcggccag

SEQ ID NO: 4134825 - RNA, 20 nt, Yersinia pestis
cggucgaacccauucaucaa

SEQ ID NO: 4134826 - RNA, 18 nt, Yersinia pestis
cggucgccaaggaugccu

SEQ ID NO: 4134827 - RNA, 21 nt, Yersinia pestis
cggucuccacguagaucaaca

SEQ ID NO: 4134828 - RNA, 11 nt, Yersinia pestis
cggugaacaga

SEQ ID NO: 4134829 - RNA, 17 nt, Yersinia pestis
cggugacgcgaucgucg

SEQ ID NO: 4134830 - RNA, 19 nt, Yersinia pestis
cggugacucgggucaguga

SEQ ID NO: 4134831 - RNA, 18 nt, Yersinia pestis
cggugaggauaggcagag

SEQ ID NO: 4134832 - RNA, 16 nt, Yersinia pestis
cggugauuacugucau

SEQ ID NO: 4134833 - RNA, 16 nt, Yersinia pestis
cggugauuaucggugg

SEQ ID NO: 4134834 - RNA, 19 nt, Yersinia pestis
cgguguaauccaacccgca

SEQ ID NO: 4134835 - RNA, 15 nt, Yersinia pestis
cggugugcaaugcag

SEQ ID NO: 4134836 - RNA, 15 nt, Yersinia pestis
cgguuaaaacaguaa

SEQ ID NO: 4134837 - RNA, 22 nt, Yersinia pestis
cgguuaaagacauaucacaguu

SEQ ID NO: 4134838 - RNA, 22 nt, Yersinia pestis
cgguuaacgacgcauuaauccg

SEQ ID NO: 4134839 - RNA, 19 nt, Yersinia pestis
cgguuauaaaacagccacg

SEQ ID NO: 4134840 - RNA, 14 nt, Yersinia pestis
cgguuaucacauca

SEQ ID NO: 4134841 - RNA, 20 nt, Yersinia pestis
cgguuauucguggugaugau

SEQ ID NO: 4134842 - RNA, 22 nt, Yersinia pestis
cgguuauugaauauuuaaauua

SEQ ID NO: 4134843 - RNA, 14 nt, Yersinia pestis
cgguuccaaagcac

SEQ ID NO: 4134844 - RNA, 20 nt, Yersinia pestis
cgguucccacggauuaacuu

SEQ ID NO: 4134845 - RNA, 15 nt, Yersinia pestis
cgguucgcagcuucc

SEQ ID NO: 4134846 - RNA, 19 nt, Yersinia pestis
cgguucuaguauucaggaa

SEQ ID NO: 4134847 - RNA, 19 nt, Yersinia pestis
cgguugcuuuuaacuccuu

SEQ ID NO: 4134848 - RNA, 22 nt, Yersinia pestis
cgguuggucagcacuuccaacu

SEQ ID NO: 4134849 - RNA, 18 nt, Yersinia pestis
cgguuguccuucaauggc

SEQ ID NO: 4134850 - RNA, 16 nt, Yersinia pestis
cgguuuaaucaaugug

SEQ ID NO: 4134851 - RNA, 23 nt, Yersinia pestis
cgguuuaccggggcgaucccuga

SEQ ID NO: 4134852 - RNA, 12 nt, Yersinia pestis
cgguuuauauuu

SEQ ID NO: 4134853 - RNA, 16 nt, Yersinia pestis
cgguuuauauuuuugg

SEQ ID NO: 4134854 - RNA, 15 nt, Yersinia pestis
cgguuucaacaucca

SEQ ID NO: 4134855 - RNA, 21 nt, Yersinia pestis
cgguuucaaccccuucuucac

SEQ ID NO: 4134856 - RNA, 15 nt, Yersinia pestis
cgguuucaacuucaa

SEQ ID NO: 4134857 - RNA, 23 nt, Yersinia pestis
cgguuucacgaaacgcauaucca

SEQ ID NO: 4134858 - RNA, 16 nt, Yersinia pestis
cgguuucagcuugcaa

SEQ ID NO: 4134859 - RNA, 16 nt, Yersinia pestis
cgguuuccggcucuua

SEQ ID NO: 4134860 - RNA, 15 nt, Yersinia pestis
cgguuugagcuugcu

SEQ ID NO: 4134861 - RNA, 19 nt, Yersinia pestis
cgguuugagcuugcugcug

SEQ ID NO: 4134862 - RNA, 20 nt, Yersinia pestis
cgguuuucacccccacauca

SEQ ID NO: 4134863 - RNA, 20 nt, Yersinia pestis
cgguuuuuucuuucuucagc

SEQ ID NO: 4134864 - RNA, 12 nt, Yersinia pestis
cguaaaaagcag

SEQ ID NO: 4134865 - RNA, 21 nt, Yersinia pestis
cguaaaaaggcagugacagua

SEQ ID NO: 4134866 - RNA, 23 nt, Yersinia pestis
cguaaacauggcucucuuuuuuc

SEQ ID NO: 4134867 - RNA, 13 nt, Yersinia pestis
cguaaacauuggc

SEQ ID NO: 4134868 - RNA, 18 nt, Yersinia pestis
cguaaacugccguaaaca

SEQ ID NO: 4134869 - RNA, 21 nt, Yersinia pestis
cguaaagaggccagcuucccu

SEQ ID NO: 4134870 - RNA, 14 nt, Yersinia pestis
cgugcaauaaagcg

SEQ ID NO: 4134871 - RNA, 15 nt, Yersinia pestis
cgugcagcgcgcagc

SEQ ID NO: 4134872 - RNA, 20 nt, Yersinia pestis
cgugcauuagagguuguuga

SEQ ID NO: 4134873 - RNA, 24 nt, Yersinia pestis
cgugccagaaacagcccagauggc

SEQ ID NO: 4134874 - RNA, 19 nt, Yersinia pestis
cgugccaggugugcccaac

SEQ ID NO: 4134875 - RNA, 14 nt, Yersinia pestis
cgugccccaaugau

SEQ ID NO: 4134876 - RNA, 18 nt, Yersinia pestis
cgugccugcuggcaaacu

SEQ ID NO: 4134877 - RNA, 22 nt, Yersinia pestis
cgugcgcuccauuucugguugu

SEQ ID NO: 4134878 - RNA, 21 nt, Yersinia pestis
cgugcuauagaaaacaaaaag

SEQ ID NO: 4134879 - RNA, 20 nt, Yersinia pestis
cgugcucaucaaccucagcc

SEQ ID NO: 4134880 - RNA, 23 nt, Yersinia pestis
cgugcucaucaaccucagccuca

SEQ ID NO: 4134881 - RNA, 16 nt, Yersinia pestis
cguggauauccacauc

SEQ ID NO: 4134882 - RNA, 21 nt, Yersinia pestis
cguggcgcggaugcuuuauuc

SEQ ID NO: 4134883 - RNA, 16 nt, Yersinia pestis
cguggcguucccgcag

SEQ ID NO: 4134884 - RNA, 19 nt, Yersinia pestis
cguggguauccagugucau

SEQ ID NO: 4134885 - RNA, 13 nt, Yersinia pestis
cguggguucuuca

SEQ ID NO: 4134886 - RNA, 15 nt, Yersinia pestis
cguggguucuucaaa

SEQ ID NO: 4134887 - RNA, 13 nt, Yersinia pestis
cguggugauuaau

SEQ ID NO: 4134888 - RNA, 18 nt, Yersinia pestis
cguggugauuaauacacg

SEQ ID NO: 4134889 - RNA, 21 nt, Yersinia pestis
cguggugggcgguaguauuug

SEQ ID NO: 4134890 - RNA, 16 nt, Yersinia pestis
cgugguuguaucacaa

SEQ ID NO: 4134891 - RNA, 22 nt, Yersinia pestis
cgugguuguaucacaaaaguca

SEQ ID NO: 4134892 - RNA, 16 nt, Yersinia pestis
cguguaagaacuggcu

SEQ ID NO: 4134893 - RNA, 19 nt, Yersinia pestis
cguguauaucacuauuuca

SEQ ID NO: 4134894 - RNA, 19 nt, Yersinia pestis
cgugucagacugcugacaa

SEQ ID NO: 4134895 - RNA, 22 nt, Yersinia pestis
cguguccggguuuacccagcca

SEQ ID NO: 4134896 - RNA, 23 nt, Yersinia pestis
cguguuagcggcucuuacucauu

SEQ ID NO: 4134897 - RNA, 20 nt, Yersinia pestis
cguguugcaucauuggcuuc

SEQ ID NO: 4134898 - RNA, 17 nt, Yersinia pestis
cguguuuaacgccgcug

SEQ ID NO: 4134899 - RNA, 20 nt, Yersinia pestis
cguguuuuucaucugugccu

SEQ ID NO: 4134900 - RNA, 19 nt, Yersinia pestis
cguuaaacauuauuuuuca

SEQ ID NO: 4134901 - RNA, 16 nt, Yersinia pestis
cguuaaauuucuucaa

SEQ ID NO: 4134902 - RNA, 20 nt, Yersinia pestis
cguuaaauuucuucaauaau

SEQ ID NO: 4134903 - RNA, 15 nt, Yersinia pestis
cguuaaccaguagcg

SEQ ID NO: 4134904 - RNA, 16 nt, Yersinia pestis
cguuaauuacacccaa

SEQ ID NO: 4134905 - RNA, 16 nt, Yersinia pestis
cguuaauuauagugaa

SEQ ID NO: 4134906 - RNA, 21 nt, Yersinia pestis
cguuacacaucaggcuguuga

SEQ ID NO: 4134907 - RNA, 17 nt, Yersinia pestis
cguuacagaugggaaga

SEQ ID NO: 4134908 - RNA, 17 nt, Yersinia pestis
cguuacagggggcacuu

SEQ ID NO: 4134909 - RNA, 21 nt, Yersinia pestis
cguuaccugcaauaauguuga

SEQ ID NO: 4134910 - RNA, 13 nt, Yersinia pestis
cguuagguucaau

SEQ ID NO: 4134911 - RNA, 12 nt, Yersinia pestis
cguuaucaauaa

SEQ ID NO: 4134912 - RNA, 13 nt, Yersinia pestis
cguuaucaauaag

SEQ ID NO: 4134913 - RNA, 20 nt, Yersinia pestis
cguuaucaauaaguucgucu

SEQ ID NO: 4134914 - RNA, 14 nt, Yersinia pestis
cguuaucagccaca

SEQ ID NO: 4134915 - RNA, 19 nt, Yersinia pestis
cguuaucgcgccuuuugga

SEQ ID NO: 4134916 - RNA, 18 nt, Yersinia pestis
cguuaucggcgcaggcag

SEQ ID NO: 4134917 - RNA, 18 nt, Yersinia pestis
cguuaugaauaaaccagc

SEQ ID NO: 4134918 - RNA, 22 nt, Yersinia pestis
cguuaugaauaaaccagcaagc

SEQ ID NO: 4134919 - RNA, 15 nt, Yersinia pestis
cguuaugccaaccgg

SEQ ID NO: 4134920 - RNA, 15 nt, Yersinia pestis
cguuauuaaacaguc

SEQ ID NO: 4134921 - RNA, 13 nt, Yersinia pestis
cguuauugagaag

SEQ ID NO: 4134922 - RNA, 17 nt, Yersinia pestis
cguuauugcgacauaaa

SEQ ID NO: 4134923 - RNA, 23 nt, Yersinia pestis
cguucaacaguaucaaccaccgc

SEQ ID NO: 4134924 - RNA, 17 nt, Yersinia pestis
cguucaaccaacugauu

SEQ ID NO: 4134925 - RNA, 22 nt, Yersinia pestis
cguucaaucgugcacccccuuc

SEQ ID NO: 4134926 - RNA, 23 nt, Yersinia pestis
cguucaaucgugcacccccuucg

SEQ ID NO: 4134927 - RNA, 16 nt, Yersinia pestis
cguucaccgcaucgcc

SEQ ID NO: 4134928 - RNA, 21 nt, Yersinia pestis
cguucacugaccgauugaauc

SEQ ID NO: 4134929 - RNA, 14 nt, Yersinia pestis
cguucaucaauacc

SEQ ID NO: 4134930 - RNA, 16 nt, Yersinia pestis
cguuccaaucugcgcc

SEQ ID NO: 4134931 - RNA, 23 nt, Yersinia pestis
cguucgcgguuuacggcaauaau

SEQ ID NO: 4134932 - RNA, 21 nt, Yersinia pestis
cguucguagccacgaucgaug

SEQ ID NO: 4134933 - RNA, 16 nt, Yersinia pestis
cguucguuuacugccu

SEQ ID NO: 4134934 - RNA, 18 nt, Yersinia pestis
cguucuaguuuggugauc

SEQ ID NO: 4134935 - RNA, 17 nt, Yersinia pestis
cguucuaucaaugccuu

SEQ ID NO: 4134936 - RNA, 17 nt, Yersinia pestis
cguucucgauagagaac

SEQ ID NO: 4134937 - RNA, 16 nt, Yersinia pestis
cguugauuaugccacg

SEQ ID NO: 4134938 - RNA, 20 nt, Yersinia pestis
cguugccacggaaacguuca

SEQ ID NO: 4134939 - RNA, 18 nt, Yersinia pestis
cguugccccaucagcacu

SEQ ID NO: 4134940 - RNA, 17 nt, Yersinia pestis
cguugcccugagaauca

SEQ ID NO: 4134941 - RNA, 19 nt, Yersinia pestis
cguugcucagcgcaucaaa

SEQ ID NO: 4134942 - RNA, 21 nt, Yersinia pestis
cguugcuuuuugccagugguu

SEQ ID NO: 4134943 - RNA, 21 nt, Yersinia pestis
cguuggaucaucgggaacagg

SEQ ID NO: 4134944 - RNA, 16 nt, Yersinia pestis
cguuggcuaaauaacc

SEQ ID NO: 4134945 - RNA, 14 nt, Yersinia pestis
cguugggcggucau

SEQ ID NO: 4134946 - RNA, 19 nt, Yersinia pestis
cguuggucagcaaaucuug

SEQ ID NO: 4134947 - RNA, 23 nt, Yersinia pestis
cguuguauuuuccugaucaacug

SEQ ID NO: 4134948 - RNA, 15 nt, Yersinia pestis
cguugucagccaugc

SEQ ID NO: 4134949 - RNA, 18 nt, Yersinia pestis
cguuguuaucaucaccac

SEQ ID NO: 4134950 - RNA, 19 nt, Yersinia pestis
cguuguuaucaucaccacc

SEQ ID NO: 4134951 - RNA, 20 nt, Yersinia pestis
cguuguuaucaucaccaccc

SEQ ID NO: 4134952 - RNA, 17 nt, Yersinia pestis
cguuguucacccacuug

SEQ ID NO: 4134953 - RNA, 17 nt, Yersinia pestis
cguuguuguaugacaag

SEQ ID NO: 4134954 - RNA, 14 nt, Yersinia pestis
cguuuacugccuug

SEQ ID NO: 4134955 - RNA, 18 nt, Yersinia pestis
cguuuacugcuuaaacca

SEQ ID NO: 4134956 - RNA, 18 nt, Yersinia pestis
cguuuagccaguuuacgg

SEQ ID NO: 4134957 - RNA, 17 nt, Yersinia pestis
cguuuaguaaucaauaa

SEQ ID NO: 4134958 - RNA, 24 nt, Yersinia pestis
cguuucauuuuaacaauuuuauug

SEQ ID NO: 4134959 - RNA, 16 nt, Yersinia pestis
cguuuccagaaucaau

SEQ ID NO: 4134960 - RNA, 15 nt, Yersinia pestis
cguuuccagcggcgu

SEQ ID NO: 4134961 - RNA, 20 nt, Yersinia pestis
cguuuccagcggcguaucaa

SEQ ID NO: 4134962 - RNA, 22 nt, Yersinia pestis
cguuuccagugcggcauguaca

SEQ ID NO: 4134963 - RNA, 21 nt, Yersinia pestis
cguuucccccuguaaaacaag

SEQ ID NO: 4134964 - RNA, 21 nt, Yersinia pestis
cguuuccgguaaugucacguu

SEQ ID NO: 4134965 - RNA, 16 nt, Yersinia pestis
cguuucuacaauggcc

SEQ ID NO: 4134966 - RNA, 18 nt, Yersinia pestis
cguuuuaucgcauuacuc

SEQ ID NO: 4134967 - RNA, 21 nt, Yersinia pestis
cguuuucggugcauguaacug

SEQ ID NO: 4134968 - RNA, 19 nt, Yersinia pestis
cguuuugcagaucaaucgc

SEQ ID NO: 4134969 - RNA, 19 nt, Yersinia pestis
cguuuugggcuugagcagu

SEQ ID NO: 4134970 - RNA, 23 nt, Yersinia pestis
cguuuuuacaguggcuaagccgc

SEQ ID NO: 4134971 - RNA, 15 nt, Yersinia pestis
cguuuuucagcuucu

SEQ ID NO: 4134972 - RNA, 19 nt, Yersinia pestis
cguuuuugguuaaagaaga

SEQ ID NO: 4134973 - RNA, 16 nt, Yersinia pestis
cguuuuuuugccagug

SEQ ID NO: 4134974 - RNA, 13 nt, Yersinia pestis
cuaaaaaaaacaa

SEQ ID NO: 4134975 - RNA, 15 nt, Yersinia pestis
cuaaaaaugauuuca

SEQ ID NO: 4134976 - RNA, 12 nt, Yersinia pestis
cuaaaacugaag

SEQ ID NO: 4134977 - RNA, 20 nt, Yersinia pestis
cuaaaaucauugacguuaca

SEQ ID NO: 4134978 - RNA, 17 nt, Yersinia pestis
cuaaaaugaauaacgcc

SEQ ID NO: 4134979 - RNA, 13 nt, Yersinia pestis
cuaaaaugacgau

SEQ ID NO: 4134980 - RNA, 20 nt, Yersinia pestis
cuaaaauuaucgcaauuuca

SEQ ID NO: 4134981 - RNA, 13 nt, Yersinia pestis
cuaaaauuuuaag

SEQ ID NO: 4134982 - RNA, 12 nt, Yersinia pestis
cuaaacacggcg

SEQ ID NO: 4134983 - RNA, 13 nt, Yersinia pestis
cuaaaccacauaa

SEQ ID NO: 4134984 - RNA, 21 nt, Yersinia pestis
cuaaacccaaccccaucagca

SEQ ID NO: 4134985 - RNA, 16 nt, Yersinia pestis
cuaaacgcucaaacaa

SEQ ID NO: 4134986 - RNA, 22 nt, Yersinia pestis
cuaaacggcccugugaaucuuu

SEQ ID NO: 4134987 - RNA, 18 nt, Yersinia pestis
cuaaacucuggcacuggc

SEQ ID NO: 4134988 - RNA, 20 nt, Yersinia pestis
cuaaacucuggcacuggcaa

SEQ ID NO: 4134989 - RNA, 16 nt, Yersinia pestis
cuaaagauaauuaauu

SEQ ID NO: 4134990 - RNA, 18 nt, Yersinia pestis
cuaaagcgccuuccuuuu

SEQ ID NO: 4134991 - RNA, 13 nt, Yersinia pestis
cuacguucaggcc

SEQ ID NO: 4134992 - RNA, 13 nt, Yersinia pestis
cuacguucgcuuu

SEQ ID NO: 4134993 - RNA, 21 nt, Yersinia pestis
cuacguuguuaucaucaccac

SEQ ID NO: 4134994 - RNA, 21 nt, Yersinia pestis
cuacuauaagcgcucaaauac

SEQ ID NO: 4134995 - RNA, 19 nt, Yersinia pestis
cuacugaugugcaugugga

SEQ ID NO: 4134996 - RNA, 20 nt, Yersinia pestis
cuacugauuggauaaaauau

SEQ ID NO: 4134997 - RNA, 22 nt, Yersinia pestis
cuacugauuggauaaaauauua

SEQ ID NO: 4134998 - RNA, 15 nt, Yersinia pestis
cuacugcaucagcga

SEQ ID NO: 4134999 - RNA, 20 nt, Yersinia pestis
cuacugcuuuuuauugucuc

SEQ ID NO: 4135000 - RNA, 21 nt, Yersinia pestis
cuacuggcccgcccauaaauu

SEQ ID NO: 4135001 - RNA, 15 nt, Yersinia pestis
cuacuggcugaaguu

SEQ ID NO: 4135002 - RNA, 15 nt, Yersinia pestis
cuacuguuuugguuu

SEQ ID NO: 4135003 - RNA, 12 nt, Yersinia pestis
cuacuuauuucc

SEQ ID NO: 4135004 - RNA, 17 nt, Yersinia pestis
cuacuucuauuacccua

SEQ ID NO: 4135005 - RNA, 13 nt, Yersinia pestis
cuacuuuuuucac

SEQ ID NO: 4135006 - RNA, 22 nt, Yersinia pestis
cuagaaauaaguugaaccauaa

SEQ ID NO: 4135007 - RNA, 18 nt, Yersinia pestis
cuagacaguaaccgggcu

SEQ ID NO: 4135008 - RNA, 16 nt, Yersinia pestis
cuagagcauaacuggu

SEQ ID NO: 4135009 - RNA, 17 nt, Yersinia pestis
cuagauauaaugguggg

SEQ ID NO: 4135010 - RNA, 22 nt, Yersinia pestis
cuagaucacagacguuuaaaua

SEQ ID NO: 4135011 - RNA, 12 nt, Yersinia pestis
cuagaugcggca

SEQ ID NO: 4135012 - RNA, 18 nt, Yersinia pestis
cuagaugcggcaacuuuu

SEQ ID NO: 4135013 - RNA, 15 nt, Yersinia pestis
cuagauggaaaucac

SEQ ID NO: 4135014 - RNA, 21 nt, Yersinia pestis
cuagauuaaccuuaucaccaa

SEQ ID NO: 4135015 - RNA, 12 nt, Yersinia pestis
cuagcaaauucc

SEQ ID NO: 4135016 - RNA, 24 nt, Yersinia pestis
cuagcaucgccgggucuugcagca

SEQ ID NO: 4135017 - RNA, 22 nt, Yersinia pestis
cuagccuugagcgcuauucuga

SEQ ID NO: 4135018 - RNA, 15 nt, Yersinia pestis
cuagcgagcucugag

SEQ ID NO: 4135019 - RNA, 16 nt, Yersinia pestis
cuagcgccagcaauug

SEQ ID NO: 4135020 - RNA, 15 nt, Yersinia pestis
cuagcgccgcaucaa

SEQ ID NO: 4135021 - RNA, 18 nt, Yersinia pestis
cuagcucaagggcacagu

SEQ ID NO: 4135022 - RNA, 16 nt, Yersinia pestis
cuaggcuauugacaaa

SEQ ID NO: 4135023 - RNA, 19 nt, Yersinia pestis
cuaggcucagcauggaaga

SEQ ID NO: 4135024 - RNA, 17 nt, Yersinia pestis
cuagggauuuuaagcag

SEQ ID NO: 4135025 - RNA, 19 nt, Yersinia pestis
cuagggauuuuaagcagcc

SEQ ID NO: 4135026 - RNA, 22 nt, Yersinia pestis
cuagggauuuuaagcagccgcc

SEQ ID NO: 4135027 - RNA, 18 nt, Yersinia pestis
cuagucuguuaugcccaa

SEQ ID NO: 4135028 - RNA, 12 nt, Yersinia pestis
cuagugaugggg

SEQ ID NO: 4135029 - RNA, 11 nt, Yersinia pestis
cuauaaaaccg

SEQ ID NO: 4135030 - RNA, 15 nt, Yersinia pestis
cuauaaaaugccgcu

SEQ ID NO: 4135031 - RNA, 13 nt, Yersinia pestis
cuauaaauuuuaa

SEQ ID NO: 4135032 - RNA, 22 nt, Yersinia pestis
cuauaaauuuuaaguuaauguu

SEQ ID NO: 4135033 - RNA, 17 nt, Yersinia pestis
cuauaagcgcucaaaua

SEQ ID NO: 4135034 - RNA, 15 nt, Yersinia pestis
cuauaaggcucuguu

SEQ ID NO: 4135035 - RNA, 15 nt, Yersinia pestis
cuauaauuauuucuc

SEQ ID NO: 4135036 - RNA, 16 nt, Yersinia pestis
cuauaauuauuucucu

SEQ ID NO: 4135037 - RNA, 16 nt, Yersinia pestis
cuauacccaaguuacu

SEQ ID NO: 4135038 - RNA, 14 nt, Yersinia pestis
cuauagaaaacaaa

SEQ ID NO: 4135039 - RNA, 17 nt, Yersinia pestis
cuauagaaaacaaaaag

SEQ ID NO: 4135040 - RNA, 14 nt, Yersinia pestis
cuauaggcuauuuu

SEQ ID NO: 4135041 - RNA, 14 nt, Yersinia pestis
cuauagugccuaau

SEQ ID NO: 4135042 - RNA, 17 nt, Yersinia pestis
cuauagugccuaauaaa

SEQ ID NO: 4135043 - RNA, 18 nt, Yersinia pestis
cuauauaacugcccaauu

SEQ ID NO: 4135044 - RNA, 23 nt, Yersinia pestis
cuauaucacuucaauguuuuuau

SEQ ID NO: 4135045 - RNA, 16 nt, Yersinia pestis
cuauaucaucagcaga

SEQ ID NO: 4135046 - RNA, 13 nt, Yersinia pestis
cuauaugguaacg

SEQ ID NO: 4135047 - RNA, 17 nt, Yersinia pestis
cuauauucucauugccc

SEQ ID NO: 4135048 - RNA, 23 nt, Yersinia pestis
cuauauucucauugcccccuuca

SEQ ID NO: 4135049 - RNA, 15 nt, Yersinia pestis
cuaucaacuuucacc

SEQ ID NO: 4135050 - RNA, 21 nt, Yersinia pestis
cuaucaccccguuacggcugg

SEQ ID NO: 4135051 - RNA, 17 nt, Yersinia pestis
cuaucaccggcccaacu

SEQ ID NO: 4135052 - RNA, 20 nt, Yersinia pestis
cuaucaccggcccaacuggc

SEQ ID NO: 4135053 - RNA, 16 nt, Yersinia pestis
cuaucacuagcgggcc

SEQ ID NO: 4135054 - RNA, 18 nt, Yersinia pestis
cuaucaggcucauucagu

SEQ ID NO: 4135055 - RNA, 17 nt, Yersinia pestis
cuaucaucaccauucaa

SEQ ID NO: 4135056 - RNA, 14 nt, Yersinia pestis
cuaucauuaaaugg

SEQ ID NO: 4135057 - RNA, 15 nt, Yersinia pestis
cuauccgaaaaauau

SEQ ID NO: 4135058 - RNA, 14 nt, Yersinia pestis
cuaucgaaacaccc

SEQ ID NO: 4135059 - RNA, 14 nt, Yersinia pestis
cuaucgacuucacg

SEQ ID NO: 4135060 - RNA, 17 nt, Yersinia pestis
cuaucgccugggcgaga

SEQ ID NO: 4135061 - RNA, 13 nt, Yersinia pestis
cuaucgccuucau

SEQ ID NO: 4135062 - RNA, 16 nt, Yersinia pestis
cuaucgcgcuuuuuag

SEQ ID NO: 4135063 - RNA, 17 nt, Yersinia pestis
cuaucgcuguaugguau

SEQ ID NO: 4135064 - RNA, 18 nt, Yersinia pestis
cuaucgguaucucccgca

SEQ ID NO: 4135065 - RNA, 19 nt, Yersinia pestis
cuaucuauuuuuauuucuc

SEQ ID NO: 4135066 - RNA, 15 nt, Yersinia pestis
cuaucucacccuucu

SEQ ID NO: 4135067 - RNA, 16 nt, Yersinia pestis
cuaucucaucuuaauc

SEQ ID NO: 4135068 - RNA, 18 nt, Yersinia pestis
cuaucucgcaauauaugg

SEQ ID NO: 4135069 - RNA, 15 nt, Yersinia pestis
cuaucugaaugaauu

SEQ ID NO: 4135070 - RNA, 19 nt, Yersinia pestis
cuaucugcucuugcucagu

SEQ ID NO: 4135071 - RNA, 14 nt, Yersinia pestis
cuaucuguucaccg

SEQ ID NO: 4135072 - RNA, 16 nt, Yersinia pestis
cuaucuuaaaaauaac

SEQ ID NO: 4135073 - RNA, 19 nt, Yersinia pestis
cuaugcaguuaaggcuggc

SEQ ID NO: 4135074 - RNA, 22 nt, Yersinia pestis
cuaugcccaguuuaccauccac

SEQ ID NO: 4135075 - RNA, 20 nt, Yersinia pestis
cuaugccggaggauauuuau

SEQ ID NO: 4135076 - RNA, 23 nt, Yersinia pestis
cuaugccggaggauauuuauuuc

SEQ ID NO: 4135077 - RNA, 16 nt, Yersinia pestis
cuaugccuacuggcca

SEQ ID NO: 4135078 - RNA, 19 nt, Yersinia pestis
cuauggaagaacuggcaca

SEQ ID NO: 4135079 - RNA, 19 nt, Yersinia pestis
cuauggauuacuuacggcc

SEQ ID NO: 4135080 - RNA, 18 nt, Yersinia pestis
cuauggcgguuccaaagc

SEQ ID NO: 4135081 - RNA, 19 nt, Yersinia pestis
cuauuaacucuuuuuaaac

SEQ ID NO: 4135082 - RNA, 11 nt, Yersinia pestis
cuauuaauauc

SEQ ID NO: 4135083 - RNA, 13 nt, Yersinia pestis
cuauuaauuauua

SEQ ID NO: 4135084 - RNA, 19 nt, Yersinia pestis
cuauuaauuauuauuggug

SEQ ID NO: 4135085 - RNA, 19 nt, Yersinia pestis
cuauuacugucaaugcuca

SEQ ID NO: 4135086 - RNA, 18 nt, Yersinia pestis
cuauuauuaaagaugaug

SEQ ID NO: 4135087 - RNA, 18 nt, Yersinia pestis
cuauucacuauuuauuaa

SEQ ID NO: 4135088 - RNA, 14 nt, Yersinia pestis
cuauucauaaauca

SEQ ID NO: 4135089 - RNA, 12 nt, Yersinia pestis
cuauuccaguuu

SEQ ID NO: 4135090 - RNA, 18 nt, Yersinia pestis
cuauucccugcaauugca

SEQ ID NO: 4135091 - RNA, 13 nt, Yersinia pestis
cuauucucaaacu

SEQ ID NO: 4135092 - RNA, 16 nt, Yersinia pestis
cuauucucuguaaugg

SEQ ID NO: 4135093 - RNA, 15 nt, Yersinia pestis
cuauugaaaaaauaa

SEQ ID NO: 4135094 - RNA, 15 nt, Yersinia pestis
cuauugacaaaguac

SEQ ID NO: 4135095 - RNA, 19 nt, Yersinia pestis
cuauugaccuguacgugaa

SEQ ID NO: 4135096 - RNA, 15 nt, Yersinia pestis
cuauugauaaaacca

SEQ ID NO: 4135097 - RNA, 22 nt, Yersinia pestis
cuauugauaaaaccacugaccu

SEQ ID NO: 4135098 - RNA, 15 nt, Yersinia pestis
cuauugauaaaaccg

SEQ ID NO: 4135099 - RNA, 19 nt, Yersinia pestis
cuauugcccaucaugccag

SEQ ID NO: 4135100 - RNA, 21 nt, Yersinia pestis
cuauugcccaucaugccagca

SEQ ID NO: 4135101 - RNA, 14 nt, Yersinia pestis
cuauugcgacgguu

SEQ ID NO: 4135102 - RNA, 15 nt, Yersinia pestis
cuauuguuccgguuc

SEQ ID NO: 4135103 - RNA, 13 nt, Yersinia pestis
cuauuuaacaaaa

SEQ ID NO: 4135104 - RNA, 14 nt, Yersinia pestis
cuauuuaacaaaaa

SEQ ID NO: 4135105 - RNA, 16 nt, Yersinia pestis
cuauuuaacaaaaaau

SEQ ID NO: 4135106 - RNA, 14 nt, Yersinia pestis
cuauuuauuaaucu

SEQ ID NO: 4135107 - RNA, 21 nt, Yersinia pestis
cuauuuauuuauaaaaccacu

SEQ ID NO: 4135108 - RNA, 14 nt, Yersinia pestis
cuauuuccccgccg

SEQ ID NO: 4135109 - RNA, 20 nt, Yersinia pestis
cuauuucggcuuggcucaau

SEQ ID NO: 4135110 - RNA, 15 nt, Yersinia pestis
cuauuugaugcuaac

SEQ ID NO: 4135111 - RNA, 14 nt, Yersinia pestis
cuauuuuaaaacuc

SEQ ID NO: 4135112 - RNA, 12 nt, Yersinia pestis
cuauuuuacuug

SEQ ID NO: 4135113 - RNA, 23 nt, Yersinia pestis
cuauuuuauaucgaucugauauc

SEQ ID NO: 4135114 - RNA, 13 nt, Yersinia pestis
cucaugccccaau

SEQ ID NO: 4135115 - RNA, 20 nt, Yersinia pestis
cucaugcucuucauaagcca

SEQ ID NO: 4135116 - RNA, 18 nt, Yersinia pestis
cucauguucgcacugcuc

SEQ ID NO: 4135117 - RNA, 19 nt, Yersinia pestis
cucauguucgcacugcucu

SEQ ID NO: 4135118 - RNA, 14 nt, Yersinia pestis
cucauuaauaauga

SEQ ID NO: 4135119 - RNA, 20 nt, Yersinia pestis
cucauuaaucagcauuaacc

SEQ ID NO: 4135120 - RNA, 16 nt, Yersinia pestis
cucauuauggauaauu

SEQ ID NO: 4135121 - RNA, 19 nt, Yersinia pestis
cucauugccuggcccaucu

SEQ ID NO: 4135122 - RNA, 19 nt, Yersinia pestis
cucauuggcaaauugcugg

SEQ ID NO: 4135123 - RNA, 23 nt, Yersinia pestis
cucauuggcaaauugcuggcggu

SEQ ID NO: 4135124 - RNA, 20 nt, Yersinia pestis
cucauuuaaaauacucauuu

SEQ ID NO: 4135125 - RNA, 15 nt, Yersinia pestis
cucauuuaucuaaaa

SEQ ID NO: 4135126 - RNA, 22 nt, Yersinia pestis
cucauuugaccuccguaggcca

SEQ ID NO: 4135127 - RNA, 22 nt, Yersinia pestis
cuccaaagcuuccaauauugag

SEQ ID NO: 4135128 - RNA, 13 nt, Yersinia pestis
cuccaacaaccau

SEQ ID NO: 4135129 - RNA, 18 nt, Yersinia pestis
cuccaacaacugccccuc

SEQ ID NO: 4135130 - RNA, 17 nt, Yersinia pestis
cuccaagaugauaaaua

SEQ ID NO: 4135131 - RNA, 22 nt, Yersinia pestis
cuccaagcacacugguugaaac

SEQ ID NO: 4135132 - RNA, 19 nt, Yersinia pestis
cuccaauaaaaaauccagu

SEQ ID NO: 4135133 - RNA, 18 nt, Yersinia pestis
cuccacaccuccgcccuc

SEQ ID NO: 4135134 - RNA, 21 nt, Yersinia pestis
cuccaccaacggcccaauauu

SEQ ID NO: 4135135 - RNA, 15 nt, Yersinia pestis
cuccacgccccaacg

SEQ ID NO: 4135136 - RNA, 12 nt, Yersinia pestis
cuccagaagcau

SEQ ID NO: 4135137 - RNA, 19 nt, Yersinia pestis
cuccagaauaucuucaacu

SEQ ID NO: 4135138 - RNA, 16 nt, Yersinia pestis
cuccagaggguaugac

SEQ ID NO: 4135139 - RNA, 17 nt, Yersinia pestis
cuccagccuggaagcaa

SEQ ID NO: 4135140 - RNA, 18 nt, Yersinia pestis
cuccaggcauuaaaauca

SEQ ID NO: 4135141 - RNA, 14 nt, Yersinia pestis
cuccagucccccuc

SEQ ID NO: 4135142 - RNA, 16 nt, Yersinia pestis
cuccagugcaaauuua

SEQ ID NO: 4135143 - RNA, 16 nt, Yersinia pestis
cuccagugccugacgc

SEQ ID NO: 4135144 - RNA, 13 nt, Yersinia pestis
cuccaguucgacu

SEQ ID NO: 4135145 - RNA, 22 nt, Yersinia pestis
cuccaguugcacaccaucagua

SEQ ID NO: 4135146 - RNA, 20 nt, Yersinia pestis
cuccaguuggcgcacguucc

SEQ ID NO: 4135147 - RNA, 24 nt, Yersinia pestis
cuccauauuuuagcggccucuagc

SEQ ID NO: 4135148 - RNA, 12 nt, Yersinia pestis
cuccaucaauaa

SEQ ID NO: 4135149 - RNA, 14 nt, Yersinia pestis
cuccauucagagcg

SEQ ID NO: 4135150 - RNA, 13 nt, Yersinia pestis
cucccaaucaaug

SEQ ID NO: 4135151 - RNA, 20 nt, Yersinia pestis
cucccagaauaauaagccgu

SEQ ID NO: 4135152 - RNA, 15 nt, Yersinia pestis
cucccauuaauuaau

SEQ ID NO: 4135153 - RNA, 17 nt, Yersinia pestis
cucccauucgcgcccca

SEQ ID NO: 4135154 - RNA, 14 nt, Yersinia pestis
cucccauuuauuac

SEQ ID NO: 4135155 - RNA, 17 nt, Yersinia pestis
cuccccgcucggcccgc

SEQ ID NO: 4135156 - RNA, 19 nt, Yersinia pestis
cucccgauacucauugcac

SEQ ID NO: 4135157 - RNA, 23 nt, Yersinia pestis
cucccgauacucauugcaccuca

SEQ ID NO: 4135158 - RNA, 14 nt, Yersinia pestis
cucccggcaggcag

SEQ ID NO: 4135159 - RNA, 22 nt, Yersinia pestis
cucccuauaaugcgccuccacu

SEQ ID NO: 4135160 - RNA, 11 nt, Yersinia pestis
cucccugacuc

SEQ ID NO: 4135161 - RNA, 20 nt, Yersinia pestis
cucccuguuacgguauuuga

SEQ ID NO: 4135162 - RNA, 14 nt, Yersinia pestis
cucccuucaaucaa

SEQ ID NO: 4135163 - RNA, 16 nt, Yersinia pestis
cuccgcauccggcggu

SEQ ID NO: 4135164 - RNA, 18 nt, Yersinia pestis
cuccgcgccuuuaauccc

SEQ ID NO: 4135165 - RNA, 12 nt, Yersinia pestis
cuccggaaucag

SEQ ID NO: 4135166 - RNA, 16 nt, Yersinia pestis
cuccggcaucauccuc

SEQ ID NO: 4135167 - RNA, 14 nt, Yersinia pestis
cuccggccugccgg

SEQ ID NO: 4135168 - RNA, 19 nt, Yersinia pestis
cuccguaaucuguucgggc

SEQ ID NO: 4135169 - RNA, 19 nt, Yersinia pestis
cuccguguaguuauugauu

SEQ ID NO: 4135170 - RNA, 17 nt, Yersinia pestis
cuccguugcaggcacuu

SEQ ID NO: 4135171 - RNA, 13 nt, Yersinia pestis
cuccuaaaaucua

SEQ ID NO: 4135172 - RNA, 13 nt, Yersinia pestis
cuccuacaccauu

SEQ ID NO: 4135173 - RNA, 16 nt, Yersinia pestis
cuccuacaccauuaaa

SEQ ID NO: 4135174 - RNA, 13 nt, Yersinia pestis
cuccuauaucuca

SEQ ID NO: 4135175 - RNA, 17 nt, Yersinia pestis
cuccucagccuuuuuug

SEQ ID NO: 4135176 - RNA, 15 nt, Yersinia pestis
cuccucuuucuuaau

SEQ ID NO: 4135177 - RNA, 13 nt, Yersinia pestis
cuccugaggguga

SEQ ID NO: 4135178 - RNA, 18 nt, Yersinia pestis
cuccugagggugaugaca

SEQ ID NO: 4135179 - RNA, 21 nt, Yersinia pestis
cuccugcaacgccuucacauu

SEQ ID NO: 4135180 - RNA, 18 nt, Yersinia pestis
cuccuggcgauccaguga

SEQ ID NO: 4135181 - RNA, 21 nt, Yersinia pestis
cuccugucuaggguuauuuua

SEQ ID NO: 4135182 - RNA, 16 nt, Yersinia pestis
cuccuuacuaucuuua

SEQ ID NO: 4135183 - RNA, 19 nt, Yersinia pestis
cuccuuuguuauuucuggg

SEQ ID NO: 4135184 - RNA, 18 nt, Yersinia pestis
cucgaacgcuuguggaaa

SEQ ID NO: 4135185 - RNA, 21 nt, Yersinia pestis
cucgaauaaacggauuugucu

SEQ ID NO: 4135186 - RNA, 19 nt, Yersinia pestis
cucgaauuauuugggguau

SEQ ID NO: 4135187 - RNA, 13 nt, Yersinia pestis
cucgaauuauuuu

SEQ ID NO: 4135188 - RNA, 20 nt, Yersinia pestis
cucgacauccaauucaguac

SEQ ID NO: 4135189 - RNA, 19 nt, Yersinia pestis
cucgacucucaagcccagu

SEQ ID NO: 4135190 - RNA, 22 nt, Yersinia pestis
cucgagccgcgcccucccuggc

SEQ ID NO: 4135191 - RNA, 16 nt, Yersinia pestis
cucgagcgcuaauauu

SEQ ID NO: 4135192 - RNA, 19 nt, Yersinia pestis
cucgcacccuuacccuggu

SEQ ID NO: 4135193 - RNA, 16 nt, Yersinia pestis
cucgcacucaucuuug

SEQ ID NO: 4135194 - RNA, 17 nt, Yersinia pestis
cucgccacccgcuuuca

SEQ ID NO: 4135195 - RNA, 13 nt, Yersinia pestis
cucgcgcccugcc

SEQ ID NO: 4135196 - RNA, 20 nt, Yersinia pestis
cucgcgguucgcagcuucca

SEQ ID NO: 4135197 - RNA, 17 nt, Yersinia pestis
cucgcuaaucaagccuu

SEQ ID NO: 4135198 - RNA, 15 nt, Yersinia pestis
cucgcugugcccuuu

SEQ ID NO: 4135199 - RNA, 19 nt, Yersinia pestis
cucgcuguggcuaccauag

SEQ ID NO: 4135200 - RNA, 20 nt, Yersinia pestis
cucgcuuaacugugcagccc

SEQ ID NO: 4135201 - RNA, 21 nt, Yersinia pestis
cucggcagcugugagaucccc

SEQ ID NO: 4135202 - RNA, 22 nt, Yersinia pestis
cucggcgcgcuugccacgccag

SEQ ID NO: 4135203 - RNA, 23 nt, Yersinia pestis
cucggcgggauaucgauggcaac

SEQ ID NO: 4135204 - RNA, 21 nt, Yersinia pestis
cucggcgguuugagccaccgc

SEQ ID NO: 4135205 - RNA, 14 nt, Yersinia pestis
cucggcugacgaua

SEQ ID NO: 4135206 - RNA, 23 nt, Yersinia pestis
cucggcugacgauaguauaaaua

SEQ ID NO: 4135207 - RNA, 21 nt, Yersinia pestis
cucggcuuucaggugacugaa

SEQ ID NO: 4135208 - RNA, 21 nt, Yersinia pestis
cucggggcacuccgguggcuu

SEQ ID NO: 4135209 - RNA, 18 nt, Yersinia pestis
cucggucugaauaagaga

SEQ ID NO: 4135210 - RNA, 17 nt, Yersinia pestis
cucggucugauuggcac

SEQ ID NO: 4135211 - RNA, 14 nt, Yersinia pestis
cucguauaaaaaau

SEQ ID NO: 4135212 - RNA, 17 nt, Yersinia pestis
cucguuguauuuuccug

SEQ ID NO: 4135213 - RNA, 17 nt, Yersinia pestis
cucuacauugacuaauu

SEQ ID NO: 4135214 - RNA, 20 nt, Yersinia pestis
cucuagaccugaggauaaaa

SEQ ID NO: 4135215 - RNA, 24 nt, Yersinia pestis
cucuaucagcgcccuacugcauca

SEQ ID NO: 4135216 - RNA, 20 nt, Yersinia pestis
cucuaugcguguugccaccu

SEQ ID NO: 4135217 - RNA, 14 nt, Yersinia pestis
cucuauucugcuuu

SEQ ID NO: 4135218 - RNA, 17 nt, Yersinia pestis
cucuauucugcuuuuug

SEQ ID NO: 4135219 - RNA, 19 nt, Yersinia pestis
cucuauucugcuuuuugcu

SEQ ID NO: 4135220 - RNA, 20 nt, Yersinia pestis
cucuauucugcuuuuugcuu

SEQ ID NO: 4135221 - RNA, 13 nt, Yersinia pestis
cucucacccugcg

SEQ ID NO: 4135222 - RNA, 16 nt, Yersinia pestis
cucucauauccccccc

SEQ ID NO: 4135223 - RNA, 23 nt, Yersinia pestis
cucuccagccugcgauagcccca

SEQ ID NO: 4135224 - RNA, 14 nt, Yersinia pestis
cucuccgcaaugcc

SEQ ID NO: 4135225 - RNA, 15 nt, Yersinia pestis
cucuccguugcaggc

SEQ ID NO: 4135226 - RNA, 17 nt, Yersinia pestis
cucuccuaaaaucuauc

SEQ ID NO: 4135227 - RNA, 17 nt, Yersinia pestis
cucucgaaaauguguga

SEQ ID NO: 4135228 - RNA, 19 nt, Yersinia pestis
cucucuacuucgucugccc

SEQ ID NO: 4135229 - RNA, 16 nt, Yersinia pestis
cucucugagccaucca

SEQ ID NO: 4135230 - RNA, 15 nt, Yersinia pestis
cucucugcugcgaau

SEQ ID NO: 4135231 - RNA, 23 nt, Yersinia pestis
cucucuugaaaugauaacaauaa

SEQ ID NO: 4135232 - RNA, 14 nt, Yersinia pestis
cucucuuuccagca

SEQ ID NO: 4135233 - RNA, 23 nt, Yersinia pestis
cucucuuuccagcaaaagccucu

SEQ ID NO: 4135234 - RNA, 15 nt, Yersinia pestis
cucucuuuuuucucu

SEQ ID NO: 4135235 - RNA, 17 nt, Yersinia pestis
cucucuuuuuucucuuu

SEQ ID NO: 4135236 - RNA, 15 nt, Yersinia pestis
cugaauuucaauaac

SEQ ID NO: 4135237 - RNA, 12 nt, Yersinia pestis
cugacaaacccc

SEQ ID NO: 4135238 - RNA, 11 nt, Yersinia pestis
cugacaaccac

SEQ ID NO: 4135239 - RNA, 20 nt, Yersinia pestis
cugacacaacacauuacugc

SEQ ID NO: 4135240 - RNA, 16 nt, Yersinia pestis
cugacacacaccagug

SEQ ID NO: 4135241 - RNA, 13 nt, Yersinia pestis
cugacacuuucga

SEQ ID NO: 4135242 - RNA, 16 nt, Yersinia pestis
cugacagaacgcaauc

SEQ ID NO: 4135243 - RNA, 16 nt, Yersinia pestis
cugacagagcggguuu

SEQ ID NO: 4135244 - RNA, 19 nt, Yersinia pestis
cugacaggcucuuuauacu

SEQ ID NO: 4135245 - RNA, 12 nt, Yersinia pestis
cugacaucauca

SEQ ID NO: 4135246 - RNA, 14 nt, Yersinia pestis
cugacaucaucacc

SEQ ID NO: 4135247 - RNA, 15 nt, Yersinia pestis
cugacauuaucgcca

SEQ ID NO: 4135248 - RNA, 22 nt, Yersinia pestis
cugacauuugcaucuauggauu

SEQ ID NO: 4135249 - RNA, 17 nt, Yersinia pestis
cugacauuuucuaucuc

SEQ ID NO: 4135250 - RNA, 14 nt, Yersinia pestis
cugaccacaaaaac

SEQ ID NO: 4135251 - RNA, 15 nt, Yersinia pestis
cugacccaagguacu

SEQ ID NO: 4135252 - RNA, 21 nt, Yersinia pestis
cugacccccaauuucauuuac

SEQ ID NO: 4135253 - RNA, 22 nt, Yersinia pestis
cugaccgauaaacgccagucag

SEQ ID NO: 4135254 - RNA, 20 nt, Yersinia pestis
cugaccgauugaaucaaggc

SEQ ID NO: 4135255 - RNA, 18 nt, Yersinia pestis
cugaccggaagcaaucag

SEQ ID NO: 4135256 - RNA, 22 nt, Yersinia pestis
cugaccuauugauaaaaccgcu

SEQ ID NO: 4135257 - RNA, 21 nt, Yersinia pestis
cugaccuguuguaacacuuga

SEQ ID NO: 4135258 - RNA, 13 nt, Yersinia pestis
cugacgaaaugcc

SEQ ID NO: 4135259 - RNA, 14 nt, Yersinia pestis
cugacgaaaugccg

SEQ ID NO: 4135260 - RNA, 21 nt, Yersinia pestis
cugacgaaauuuaagaaaucu

SEQ ID NO: 4135261 - RNA, 15 nt, Yersinia pestis
cugacgauaacuuuu

SEQ ID NO: 4135262 - RNA, 13 nt, Yersinia pestis
cugacgaugacuc

SEQ ID NO: 4135263 - RNA, 16 nt, Yersinia pestis
cugacgaugauaaauc

SEQ ID NO: 4135264 - RNA, 19 nt, Yersinia pestis
cugacgcacagcacgguaa

SEQ ID NO: 4135265 - RNA, 13 nt, Yersinia pestis
cugacgcagcagg

SEQ ID NO: 4135266 - RNA, 16 nt, Yersinia pestis
cugacgccaugcucag

SEQ ID NO: 4135267 - RNA, 18 nt, Yersinia pestis
cugacgccaugcucagaa

SEQ ID NO: 4135268 - RNA, 22 nt, Yersinia pestis
cugacguaauaccggcaccaau

SEQ ID NO: 4135269 - RNA, 21 nt, Yersinia pestis
cugacguaguguauucaaacg

SEQ ID NO: 4135270 - RNA, 21 nt, Yersinia pestis
cugacuaacucuucuggcaaa

SEQ ID NO: 4135271 - RNA, 18 nt, Yersinia pestis
cugacucacguauuuuca

SEQ ID NO: 4135272 - RNA, 18 nt, Yersinia pestis
cugacucccugacucccu

SEQ ID NO: 4135273 - RNA, 19 nt, Yersinia pestis
cugacugagcguugaccuu

SEQ ID NO: 4135274 - RNA, 21 nt, Yersinia pestis
cugacugagugccagcaaaga

SEQ ID NO: 4135275 - RNA, 15 nt, Yersinia pestis
cugacuguggcugcu

SEQ ID NO: 4135276 - RNA, 14 nt, Yersinia pestis
cugacuguuuugcu

SEQ ID NO: 4135277 - RNA, 15 nt, Yersinia pestis
cugacuguuuugcua

SEQ ID NO: 4135278 - RNA, 12 nt, Yersinia pestis
cugagaacccau

SEQ ID NO: 4135279 - RNA, 14 nt, Yersinia pestis
cugagaaucaaaaa

SEQ ID NO: 4135280 - RNA, 12 nt, Yersinia pestis
cugagcaccaga

SEQ ID NO: 4135281 - RNA, 17 nt, Yersinia pestis
cugagcaccgcaggaac

SEQ ID NO: 4135282 - RNA, 20 nt, Yersinia pestis
cugagcagcaaacgccucgu

SEQ ID NO: 4135283 - RNA, 16 nt, Yersinia pestis
cugagcagcaacuguu

SEQ ID NO: 4135284 - RNA, 21 nt, Yersinia pestis
cugagccgccaguugggaauc

SEQ ID NO: 4135285 - RNA, 22 nt, Yersinia pestis
cugagccucaugaaugaggcug

SEQ ID NO: 4135286 - RNA, 23 nt, Yersinia pestis
cugagccucaugaaugaggcuga

SEQ ID NO: 4135287 - RNA, 19 nt, Yersinia pestis
cugagcgaacugaaugcgu

SEQ ID NO: 4135288 - RNA, 15 nt, Yersinia pestis
cugagcgggcggcaa

SEQ ID NO: 4135289 - RNA, 17 nt, Yersinia pestis
cugagcguagcugucac

SEQ ID NO: 4135290 - RNA, 19 nt, Yersinia pestis
cugagcguccgucauccaa

SEQ ID NO: 4135291 - RNA, 22 nt, Yersinia pestis
cugagcguccgucauccaauga

SEQ ID NO: 4135292 - RNA, 22 nt, Yersinia pestis
cugagcuuauagaacggcagug

SEQ ID NO: 4135293 - RNA, 23 nt, Yersinia pestis
cugaggagccauugauuggcucc

SEQ ID NO: 4135294 - RNA, 15 nt, Yersinia pestis
cugaggauaaaaacu

SEQ ID NO: 4135295 - RNA, 12 nt, Yersinia pestis
cugagggugaug

SEQ ID NO: 4135296 - RNA, 21 nt, Yersinia pestis
cugaggguuagcgaugacuga

SEQ ID NO: 4135297 - RNA, 18 nt, Yersinia pestis
cugaggucgaaagcucaa

SEQ ID NO: 4135298 - RNA, 20 nt, Yersinia pestis
cugagguuauugacaaagug

SEQ ID NO: 4135299 - RNA, 14 nt, Yersinia pestis
cugagguuccacuc

SEQ ID NO: 4135300 - RNA, 15 nt, Yersinia pestis
cugagguugaugagc

SEQ ID NO: 4135301 - RNA, 16 nt, Yersinia pestis
cugagguugcucagcg

SEQ ID NO: 4135302 - RNA, 14 nt, Yersinia pestis
cugaguaugagcgc

SEQ ID NO: 4135303 - RNA, 17 nt, Yersinia pestis
cugagucagucagggug

SEQ ID NO: 4135304 - RNA, 15 nt, Yersinia pestis
cugagucgucugucg

SEQ ID NO: 4135305 - RNA, 18 nt, Yersinia pestis
cugaguggacgauaaauu

SEQ ID NO: 4135306 - RNA, 18 nt, Yersinia pestis
cugaguggucgcuggcau

SEQ ID NO: 4135307 - RNA, 19 nt, Yersinia pestis
cugaguggucggccagcgc

SEQ ID NO: 4135308 - RNA, 19 nt, Yersinia pestis
cugagugugccuuggucuc

SEQ ID NO: 4135309 - RNA, 18 nt, Yersinia pestis
cugaguuaucuguuucaa

SEQ ID NO: 4135310 - RNA, 15 nt, Yersinia pestis
cugaguucugcugcc

SEQ ID NO: 4135311 - RNA, 11 nt, Yersinia pestis
cugauaaaauu

SEQ ID NO: 4135312 - RNA, 23 nt, Yersinia pestis
cugauaaaauuaccgccccuguu

SEQ ID NO: 4135313 - RNA, 22 nt, Yersinia pestis
cugauaaaccgcuauaucauca

SEQ ID NO: 4135314 - RNA, 12 nt, Yersinia pestis
cugauaaagcaa

SEQ ID NO: 4135315 - RNA, 15 nt, Yersinia pestis
cugauaaccagccaa

SEQ ID NO: 4135316 - RNA, 19 nt, Yersinia pestis
cugauaagccgucagcuua

SEQ ID NO: 4135317 - RNA, 18 nt, Yersinia pestis
cugauaaggagagaggcc

SEQ ID NO: 4135318 - RNA, 15 nt, Yersinia pestis
cugauacauuuccau

SEQ ID NO: 4135319 - RNA, 22 nt, Yersinia pestis
cugauacccuccgacuuugaua

SEQ ID NO: 4135320 - RNA, 17 nt, Yersinia pestis
cugauagcaaucccaaa

SEQ ID NO: 4135321 - RNA, 14 nt, Yersinia pestis
cugauagccaauaa

SEQ ID NO: 4135322 - RNA, 18 nt, Yersinia pestis
cugauagccaauaaccgg

SEQ ID NO: 4135323 - RNA, 18 nt, Yersinia pestis
cugauagugauuuuuuuc

SEQ ID NO: 4135324 - RNA, 15 nt, Yersinia pestis
cugauauaaagcauu

SEQ ID NO: 4135325 - RNA, 22 nt, Yersinia pestis
cugauauaacaaguuacauuuu

SEQ ID NO: 4135326 - RNA, 13 nt, Yersinia pestis
cugauaucuaaaa

SEQ ID NO: 4135327 - RNA, 18 nt, Yersinia pestis
cugauaucuucacucagc

SEQ ID NO: 4135328 - RNA, 20 nt, Yersinia pestis
cugauauuccggugaucuug

SEQ ID NO: 4135329 - RNA, 16 nt, Yersinia pestis
cugaucacuggcauug

SEQ ID NO: 4135330 - RNA, 14 nt, Yersinia pestis
cugaucaucaucaa

SEQ ID NO: 4135331 - RNA, 18 nt, Yersinia pestis
cugaucaucaucaaugga

SEQ ID NO: 4135332 - RNA, 13 nt, Yersinia pestis
cugaucaugccac

SEQ ID NO: 4135333 - RNA, 20 nt, Yersinia pestis
cugaucaugccacgaccauu

SEQ ID NO: 4135334 - RNA, 21 nt, Yersinia pestis
cugaucauuauuauccuccca

SEQ ID NO: 4135335 - RNA, 14 nt, Yersinia pestis
cugauccacuacuu

SEQ ID NO: 4135336 - RNA, 21 nt, Yersinia pestis
cugauccacuacuuauuuccg

SEQ ID NO: 4135337 - RNA, 22 nt, Yersinia pestis
cugauccucuaaggggcgagaa

SEQ ID NO: 4135338 - RNA, 14 nt, Yersinia pestis
cugaugaaaaaguc

SEQ ID NO: 4135339 - RNA, 18 nt, Yersinia pestis
cugaugaauagaggacua

SEQ ID NO: 4135340 - RNA, 23 nt, Yersinia pestis
cugaugacgccguacaaauauaa

SEQ ID NO: 4135341 - RNA, 16 nt, Yersinia pestis
cugaugagcuggcaaa

SEQ ID NO: 4135342 - RNA, 20 nt, Yersinia pestis
cugaugcgcgacauuuugug

SEQ ID NO: 4135343 - RNA, 21 nt, Yersinia pestis
cugaugcgcgacauuuugugc

SEQ ID NO: 4135344 - RNA, 14 nt, Yersinia pestis
cugaugcuuuucuu

SEQ ID NO: 4135345 - RNA, 14 nt, Yersinia pestis
cugauggucaugga

SEQ ID NO: 4135346 - RNA, 18 nt, Yersinia pestis
cugaugucagugcuccau

SEQ ID NO: 4135347 - RNA, 17 nt, Yersinia pestis
cugaugucaucaaguga

SEQ ID NO: 4135348 - RNA, 21 nt, Yersinia pestis
cugaugucaucaagugaacca

SEQ ID NO: 4135349 - RNA, 19 nt, Yersinia pestis
cugaugugcauguggaagc

SEQ ID NO: 4135350 - RNA, 17 nt, Yersinia pestis
cugauguucugccaacc

SEQ ID NO: 4135351 - RNA, 18 nt, Yersinia pestis
cugauguuuugcugccau

SEQ ID NO: 4135352 - RNA, 19 nt, Yersinia pestis
cugauguuuugcugccauu

SEQ ID NO: 4135353 - RNA, 22 nt, Yersinia pestis
cugauuaauauccaauuguuuu

SEQ ID NO: 4135354 - RNA, 16 nt, Yersinia pestis
cugauucucuucaccu

SEQ ID NO: 4135355 - RNA, 15 nt, Yersinia pestis
cugauugaccaucaa

SEQ ID NO: 4135356 - RNA, 16 nt, Yersinia pestis
cugauuggauaaaaua

SEQ ID NO: 4135357 - RNA, 20 nt, Yersinia pestis
cugauuucaggaauggugua

SEQ ID NO: 4135358 - RNA, 18 nt, Yersinia pestis
cugauuugggaacaacag

SEQ ID NO: 4135359 - RNA, 16 nt, Yersinia pestis
cugauuuuuauggcag

SEQ ID NO: 4135360 - RNA, 19 nt, Yersinia pestis
cugauuuuuuguucuuaau

SEQ ID NO: 4135361 - RNA, 21 nt, Yersinia pestis
cugcaaacggcucaucacacc

SEQ ID NO: 4135362 - RNA, 23 nt, Yersinia pestis
cugcaaccacuuauccagcucau

SEQ ID NO: 4135363 - RNA, 14 nt, Yersinia pestis
cugcaacgccuuca

SEQ ID NO: 4135364 - RNA, 21 nt, Yersinia pestis
cugcaacguuaaagaugaagg

SEQ ID NO: 4135365 - RNA, 14 nt, Yersinia pestis
cugcaacucauuaa

SEQ ID NO: 4135366 - RNA, 19 nt, Yersinia pestis
cugcaagcaauguucaaau

SEQ ID NO: 4135367 - RNA, 15 nt, Yersinia pestis
cugcaauaauguuga

SEQ ID NO: 4135368 - RNA, 14 nt, Yersinia pestis
cugcaauagcucau

SEQ ID NO: 4135369 - RNA, 14 nt, Yersinia pestis
cugcaaugcauaag

SEQ ID NO: 4135370 - RNA, 20 nt, Yersinia pestis
cugcacaauuugguagaacu

SEQ ID NO: 4135371 - RNA, 23 nt, Yersinia pestis
cugcaccaaucauuacaucaucu

SEQ ID NO: 4135372 - RNA, 13 nt, Yersinia pestis
cugcaccagugcc

SEQ ID NO: 4135373 - RNA, 22 nt, Yersinia pestis
cugcaccuaacaaacguucauu

SEQ ID NO: 4135374 - RNA, 18 nt, Yersinia pestis
cugcaccucaucaacgac

SEQ ID NO: 4135375 - RNA, 20 nt, Yersinia pestis
cugcaccucugcugauguca

SEQ ID NO: 4135376 - RNA, 17 nt, Yersinia pestis
cugcacgccuacggcuu

SEQ ID NO: 4135377 - RNA, 22 nt, Yersinia pestis
cugcacggaucacgcuguucac

SEQ ID NO: 4135378 - RNA, 19 nt, Yersinia pestis
cugcacugcucuaucuccc

SEQ ID NO: 4135379 - RNA, 13 nt, Yersinia pestis
cugcagaaaauca

SEQ ID NO: 4135380 - RNA, 21 nt, Yersinia pestis
cugcagaaaaugcggcggcug

SEQ ID NO: 4135381 - RNA, 17 nt, Yersinia pestis
cugcagaaucacuggca

SEQ ID NO: 4135382 - RNA, 20 nt, Yersinia pestis
cugcagaaugaaguuauccu

SEQ ID NO: 4135383 - RNA, 19 nt, Yersinia pestis
cugcagauguauuagcgcu

SEQ ID NO: 4135384 - RNA, 17 nt, Yersinia pestis
cugcagcgauauacauc

SEQ ID NO: 4135385 - RNA, 15 nt, Yersinia pestis
cugcaguacagauaa

SEQ ID NO: 4135386 - RNA, 12 nt, Yersinia pestis
cugcagugaaaa

SEQ ID NO: 4135387 - RNA, 13 nt, Yersinia pestis
cugcagugaaaag

SEQ ID NO: 4135388 - RNA, 18 nt, Yersinia pestis
cugcauaagcaucaguaa

SEQ ID NO: 4135389 - RNA, 14 nt, Yersinia pestis
cugcauuaaaauaa

SEQ ID NO: 4135390 - RNA, 23 nt, Yersinia pestis
cugcauuaaaauaacaauucacu

SEQ ID NO: 4135391 - RNA, 14 nt, Yersinia pestis
cugcauugauuaaa

SEQ ID NO: 4135392 - RNA, 17 nt, Yersinia pestis
cugcauuucaacaaaac

SEQ ID NO: 4135393 - RNA, 23 nt, Yersinia pestis
cugccaaaaaauaagggccacca

SEQ ID NO: 4135394 - RNA, 17 nt, Yersinia pestis
cugccaauucaaggcca

SEQ ID NO: 4135395 - RNA, 17 nt, Yersinia pestis
cugccaauuccuuagcg

SEQ ID NO: 4135396 - RNA, 18 nt, Yersinia pestis
cugccagaauuuugcagc

SEQ ID NO: 4135397 - RNA, 15 nt, Yersinia pestis
cugccagauagucau

SEQ ID NO: 4135398 - RNA, 13 nt, Yersinia pestis
cugccagccugau

SEQ ID NO: 4135399 - RNA, 18 nt, Yersinia pestis
cugccaggcgacaugguc

SEQ ID NO: 4135400 - RNA, 22 nt, Yersinia pestis
cugccaguaaaaucaucagccu

SEQ ID NO: 4135401 - RNA, 20 nt, Yersinia pestis
cugccauaauccagaagcca

SEQ ID NO: 4135402 - RNA, 22 nt, Yersinia pestis
cugccauaauccagaagccauu

SEQ ID NO: 4135403 - RNA, 22 nt, Yersinia pestis
cugccauacggcgucuugauca

SEQ ID NO: 4135404 - RNA, 12 nt, Yersinia pestis
cugcccaauucg

SEQ ID NO: 4135405 - RNA, 23 nt, Yersinia pestis
cugcccacagggugagucucagg

SEQ ID NO: 4135406 - RNA, 22 nt, Yersinia pestis
cugcccccccggguggcgcuga

SEQ ID NO: 4135407 - RNA, 19 nt, Yersinia pestis
cugcccccccuuucaccaa

SEQ ID NO: 4135408 - RNA, 12 nt, Yersinia pestis
cugcccccgacg

SEQ ID NO: 4135409 - RNA, 21 nt, Yersinia pestis
cugccccgaagcucaagcugg

SEQ ID NO: 4135410 - RNA, 18 nt, Yersinia pestis
cugcccgucacucagaaa

SEQ ID NO: 4135411 - RNA, 19 nt, Yersinia pestis
cugcccuaauaccaauacc

SEQ ID NO: 4135412 - RNA, 17 nt, Yersinia pestis
cugccgaaccuuuugcc

SEQ ID NO: 4135413 - RNA, 19 nt, Yersinia pestis
cugccgaaccuuuugccag

SEQ ID NO: 4135414 - RNA, 17 nt, Yersinia pestis
cugccgcaaacgcucag

SEQ ID NO: 4135415 - RNA, 15 nt, Yersinia pestis
cugccgcaacggcac

SEQ ID NO: 4135416 - RNA, 21 nt, Yersinia pestis
cugccgccagauuauccagcc

SEQ ID NO: 4135417 - RNA, 14 nt, Yersinia pestis
cugccgccucugcu

SEQ ID NO: 4135418 - RNA, 20 nt, Yersinia pestis
cugccggcguuaaugccacc

SEQ ID NO: 4135419 - RNA, 13 nt, Yersinia pestis
cugccuauccuca

SEQ ID NO: 4135420 - RNA, 17 nt, Yersinia pestis
cugccuauccucaccgu

SEQ ID NO: 4135421 - RNA, 22 nt, Yersinia pestis
cugccuaugcguuggcugccuu

SEQ ID NO: 4135422 - RNA, 18 nt, Yersinia pestis
cugccuauuuaucguuac

SEQ ID NO: 4135423 - RNA, 19 nt, Yersinia pestis
cugccugcaccagugccaa

SEQ ID NO: 4135424 - RNA, 17 nt, Yersinia pestis
cugccugcagcaacaau

SEQ ID NO: 4135425 - RNA, 17 nt, Yersinia pestis
cugccugccugcugcuc

SEQ ID NO: 4135426 - RNA, 12 nt, Yersinia pestis
cugccugcugcu

SEQ ID NO: 4135427 - RNA, 13 nt, Yersinia pestis
cugccugcugcuc

SEQ ID NO: 4135428 - RNA, 15 nt, Yersinia pestis
cugccugcugcucca

SEQ ID NO: 4135429 - RNA, 14 nt, Yersinia pestis
cugccuuccugcca

SEQ ID NO: 4135430 - RNA, 12 nt, Yersinia pestis
cugcgauaaucu

SEQ ID NO: 4135431 - RNA, 18 nt, Yersinia pestis
cugcgauaccuuuugcug

SEQ ID NO: 4135432 - RNA, 14 nt, Yersinia pestis
cugcgaucugccuu

SEQ ID NO: 4135433 - RNA, 20 nt, Yersinia pestis
cugcgauuuaugaaccguca

SEQ ID NO: 4135434 - RNA, 17 nt, Yersinia pestis
cugcgcaagcgcugcuu

SEQ ID NO: 4135435 - RNA, 22 nt, Yersinia pestis
cugcgcccuuaucuaucucagg

SEQ ID NO: 4135436 - RNA, 19 nt, Yersinia pestis
cugcgcggaaaaaaggauu

SEQ ID NO: 4135437 - RNA, 19 nt, Yersinia pestis
cugcgcuaaacggcccugu

SEQ ID NO: 4135438 - RNA, 21 nt, Yersinia pestis
cugcgcuaauacggcuugcaa

SEQ ID NO: 4135439 - RNA, 22 nt, Yersinia pestis
cugcgcuguaagcaccagcacc

SEQ ID NO: 4135440 - RNA, 19 nt, Yersinia pestis
cugcgcuguucaucgcaau

SEQ ID NO: 4135441 - RNA, 13 nt, Yersinia pestis
cugcgcuuaccaa

SEQ ID NO: 4135442 - RNA, 16 nt, Yersinia pestis
cugcggcaagcugugc

SEQ ID NO: 4135443 - RNA, 17 nt, Yersinia pestis
cugcggcaagcugugcc

SEQ ID NO: 4135444 - RNA, 13 nt, Yersinia pestis
cugcggcaauaag

SEQ ID NO: 4135445 - RNA, 16 nt, Yersinia pestis
cugcggcuuucugccu

SEQ ID NO: 4135446 - RNA, 16 nt, Yersinia pestis
cugcgguggccagagc

SEQ ID NO: 4135447 - RNA, 20 nt, Yersinia pestis
cugcgguuuguuugcaucug

SEQ ID NO: 4135448 - RNA, 22 nt, Yersinia pestis
cugcguuuuucccuguagaaca

SEQ ID NO: 4135449 - RNA, 17 nt, Yersinia pestis
cugcuaacaacagucaa

SEQ ID NO: 4135450 - RNA, 24 nt, Yersinia pestis
cugcuaauacgcuaucaacguagc

SEQ ID NO: 4135451 - RNA, 21 nt, Yersinia pestis
cugcuagcaaauuccgcuucu

SEQ ID NO: 4135452 - RNA, 17 nt, Yersinia pestis
cugcuaguauuaucgcu

SEQ ID NO: 4135453 - RNA, 16 nt, Yersinia pestis
cugcuaucaugauaaa

SEQ ID NO: 4135454 - RNA, 15 nt, Yersinia pestis
cugcucaacugcuca

SEQ ID NO: 4135455 - RNA, 20 nt, Yersinia pestis
cugcucaacugcucaacugc

SEQ ID NO: 4135456 - RNA, 22 nt, Yersinia pestis
cugcucaaucgaaugcaauaac

SEQ ID NO: 4135457 - RNA, 22 nt, Yersinia pestis
cugcucaaugcguuggcucaga

SEQ ID NO: 4135458 - RNA, 16 nt, Yersinia pestis
cugcucacgcaaauaa

SEQ ID NO: 4135459 - RNA, 17 nt, Yersinia pestis
cugcucacgcaaauaaa

SEQ ID NO: 4135460 - RNA, 14 nt, Yersinia pestis
cugcucauaaagca

SEQ ID NO: 4135461 - RNA, 19 nt, Yersinia pestis
cugcuccaaagcuuccaau

SEQ ID NO: 4135462 - RNA, 14 nt, Yersinia pestis
cugcucgcauuguu

SEQ ID NO: 4135463 - RNA, 22 nt, Yersinia pestis
cugcucugucaacgcuucagua

SEQ ID NO: 4135464 - RNA, 15 nt, Yersinia pestis
cugcucuuucccuuc

SEQ ID NO: 4135465 - RNA, 12 nt, Yersinia pestis
cugcugacaaac

SEQ ID NO: 4135466 - RNA, 19 nt, Yersinia pestis
cugcugauguuucuuugcg

SEQ ID NO: 4135467 - RNA, 14 nt, Yersinia pestis
cugcugcaacucau

SEQ ID NO: 4135468 - RNA, 14 nt, Yersinia pestis
cugcugcuguggca

SEQ ID NO: 4135469 - RNA, 19 nt, Yersinia pestis
cugcugcuuggguggucag

SEQ ID NO: 4135470 - RNA, 13 nt, Yersinia pestis
cugcugcuuuaau

SEQ ID NO: 4135471 - RNA, 15 nt, Yersinia pestis
cugcuggcaggguau

SEQ ID NO: 4135472 - RNA, 17 nt, Yersinia pestis
cugcugggcgauccaaa

SEQ ID NO: 4135473 - RNA, 15 nt, Yersinia pestis
cugcugguuuuacug

SEQ ID NO: 4135474 - RNA, 18 nt, Yersinia pestis
cugcuguggcacuaucug

SEQ ID NO: 4135475 - RNA, 20 nt, Yersinia pestis
cugcugugucgcuauuuccg

SEQ ID NO: 4135476 - RNA, 21 nt, Yersinia pestis
cugcugugucgcuauuuccga

SEQ ID NO: 4135477 - RNA, 22 nt, Yersinia pestis
cugcuguuuaccuaucucagug

SEQ ID NO: 4135478 - RNA, 14 nt, Yersinia pestis
cugcuuaaccgauu

SEQ ID NO: 4135479 - RNA, 23 nt, Yersinia pestis
cuguacugcugcaacucauuaac

SEQ ID NO: 4135480 - RNA, 16 nt, Yersinia pestis
cuguacugggaugaag

SEQ ID NO: 4135481 - RNA, 23 nt, Yersinia pestis
cuguacuuugauucaaaaugcca

SEQ ID NO: 4135482 - RNA, 18 nt, Yersinia pestis
cuguagaacaccugccuu

SEQ ID NO: 4135483 - RNA, 23 nt, Yersinia pestis
cuguagccgcaggcgaugcaagg

SEQ ID NO: 4135484 - RNA, 15 nt, Yersinia pestis
cuguagcucagccug

SEQ ID NO: 4135485 - RNA, 15 nt, Yersinia pestis
cuguagcucauacuc

SEQ ID NO: 4135486 - RNA, 14 nt, Yersinia pestis
cuguagcuuuuuaa

SEQ ID NO: 4135487 - RNA, 17 nt, Yersinia pestis
cuguagcuuuuuaaaua

SEQ ID NO: 4135488 - RNA, 23 nt, Yersinia pestis
cuguaguucaauggucaugcaca

SEQ ID NO: 4135489 - RNA, 23 nt, Yersinia pestis
cuguauacccgccgcaucuaaac

SEQ ID NO: 4135490 - RNA, 15 nt, Yersinia pestis
cuguauccagcagcg

SEQ ID NO: 4135491 - RNA, 14 nt, Yersinia pestis
cuguauguguuugu

SEQ ID NO: 4135492 - RNA, 20 nt, Yersinia pestis
cuguauuuccuguauuuccu

SEQ ID NO: 4135493 - RNA, 18 nt, Yersinia pestis
cugucaccuaccaccuac

SEQ ID NO: 4135494 - RNA, 14 nt, Yersinia pestis
cugucaccugucac

SEQ ID NO: 4135495 - RNA, 16 nt, Yersinia pestis
cugucaccugucaccu

SEQ ID NO: 4135496 - RNA, 16 nt, Yersinia pestis
cugucacugucaaaac

SEQ ID NO: 4135497 - RNA, 20 nt, Yersinia pestis
cugucacuguugcgggcauc

SEQ ID NO: 4135498 - RNA, 13 nt, Yersinia pestis
cugucagccaccg

SEQ ID NO: 4135499 - RNA, 17 nt, Yersinia pestis
cugucagcccuaauauc

SEQ ID NO: 4135500 - RNA, 20 nt, Yersinia pestis
cugucauuacacuuucuuug

SEQ ID NO: 4135501 - RNA, 15 nt, Yersinia pestis
cuguccaagaagcca

SEQ ID NO: 4135502 - RNA, 17 nt, Yersinia pestis
cuguccaagaagccaag

SEQ ID NO: 4135503 - RNA, 14 nt, Yersinia pestis
cuguccaguugcug

SEQ ID NO: 4135504 - RNA, 17 nt, Yersinia pestis
cuguccaguugcuggaa

SEQ ID NO: 4135505 - RNA, 15 nt, Yersinia pestis
cuguccuuuaacuca

SEQ ID NO: 4135506 - RNA, 19 nt, Yersinia pestis
cugucgauaauaaauugcg

SEQ ID NO: 4135507 - RNA, 22 nt, Yersinia pestis
cugucgcagaaaacaggccgcu

SEQ ID NO: 4135508 - RNA, 16 nt, Yersinia pestis
cugucgcauaagacaa

SEQ ID NO: 4135509 - RNA, 19 nt, Yersinia pestis
cugucuaggguuauuuuau

SEQ ID NO: 4135510 - RNA, 16 nt, Yersinia pestis
cugucugcuguugcca

SEQ ID NO: 4135511 - RNA, 12 nt, Yersinia pestis
cugucuguuacc

SEQ ID NO: 4135512 - RNA, 13 nt, Yersinia pestis
cugucuuauuuuu

SEQ ID NO: 4135513 - RNA, 15 nt, Yersinia pestis
cugucuuauuuuuug

SEQ ID NO: 4135514 - RNA, 17 nt, Yersinia pestis
cugugaaucuuuuugcu

SEQ ID NO: 4135515 - RNA, 16 nt, Yersinia pestis
cugugacacgagaagg

SEQ ID NO: 4135516 - RNA, 18 nt, Yersinia pestis
cugugagcggcauccagu

SEQ ID NO: 4135517 - RNA, 17 nt, Yersinia pestis
cugugaucgcugccgca

SEQ ID NO: 4135518 - RNA, 17 nt, Yersinia pestis
cugugauuucagccagg

SEQ ID NO: 4135519 - RNA, 20 nt, Yersinia pestis
cugugcauguagcugcagcc

SEQ ID NO: 4135520 - RNA, 23 nt, Yersinia pestis
cugugccugcagguaagaaggca

SEQ ID NO: 4135521 - RNA, 14 nt, Yersinia pestis
cugugcuuugccau

SEQ ID NO: 4135522 - RNA, 18 nt, Yersinia pestis
cugugcuuugccauucug

SEQ ID NO: 4135523 - RNA, 19 nt, Yersinia pestis
cuguggauuaacuucuucc

SEQ ID NO: 4135524 - RNA, 15 nt, Yersinia pestis
cuguggcaugacuga

SEQ ID NO: 4135525 - RNA, 18 nt, Yersinia pestis
cuguggcgauuuaaucca

SEQ ID NO: 4135526 - RNA, 23 nt, Yersinia pestis
cuguggcggcaagaacaccguca

SEQ ID NO: 4135527 - RNA, 15 nt, Yersinia pestis
cuguguaacugccac

SEQ ID NO: 4135528 - RNA, 21 nt, Yersinia pestis
cuguguaacugccaccguauu

SEQ ID NO: 4135529 - RNA, 23 nt, Yersinia pestis
cugugugggcacucgcaagacga

SEQ ID NO: 4135530 - RNA, 13 nt, Yersinia pestis
cuguguuuauacc

SEQ ID NO: 4135531 - RNA, 17 nt, Yersinia pestis
cuguguuuauaccaaag

SEQ ID NO: 4135532 - RNA, 21 nt, Yersinia pestis
cuguguuugauuaaugccucu

SEQ ID NO: 4135533 - RNA, 19 nt, Yersinia pestis
cuguguuuugagcaucacu

SEQ ID NO: 4135534 - RNA, 20 nt, Yersinia pestis
cuguguuuugagcaucacuu

SEQ ID NO: 4135535 - RNA, 21 nt, Yersinia pestis
cuguuaacuaacgucccauuc

SEQ ID NO: 4135536 - RNA, 18 nt, Yersinia pestis
cuguuacaucagagcuca

SEQ ID NO: 4135537 - RNA, 19 nt, Yersinia pestis
cuguuacaucagagcucaa

SEQ ID NO: 4135538 - RNA, 15 nt, Yersinia pestis
cuguuaccaaacauu

SEQ ID NO: 4135539 - RNA, 16 nt, Yersinia pestis
cuguuaccaaacauuu

SEQ ID NO: 4135540 - RNA, 20 nt, Yersinia pestis
cuguuacgguauuugaacuu

SEQ ID NO: 4135541 - RNA, 22 nt, Yersinia pestis
cuguuagggcgcggcugguaac

SEQ ID NO: 4135542 - RNA, 15 nt, Yersinia pestis
cuguuaguucagacg

SEQ ID NO: 4135543 - RNA, 21 nt, Yersinia pestis
cuguuaucugguuauauugac

SEQ ID NO: 4135544 - RNA, 19 nt, Yersinia pestis
cuguuauuggggacaggcu

SEQ ID NO: 4135545 - RNA, 13 nt, Yersinia pestis
cuguucaccgauu

SEQ ID NO: 4135546 - RNA, 14 nt, Yersinia pestis
cuguucagaugauc

SEQ ID NO: 4135547 - RNA, 15 nt, Yersinia pestis
cuguucagauuuacc

SEQ ID NO: 4135548 - RNA, 22 nt, Yersinia pestis
cuguucaucaauagguguugcc

SEQ ID NO: 4135549 - RNA, 12 nt, Yersinia pestis
cuguuccaggca

SEQ ID NO: 4135550 - RNA, 19 nt, Yersinia pestis
cuguucgggcugauuaaua

SEQ ID NO: 4135551 - RNA, 16 nt, Yersinia pestis
cuguucucuguuucca

SEQ ID NO: 4135552 - RNA, 15 nt, Yersinia pestis
cuguugaucugaguu

SEQ ID NO: 4135553 - RNA, 15 nt, Yersinia pestis
cuguugaugaguaaa

SEQ ID NO: 4135554 - RNA, 16 nt, Yersinia pestis
cuguugaugaguaaac

SEQ ID NO: 4135555 - RNA, 15 nt, Yersinia pestis
cuguugccacagacg

SEQ ID NO: 4135556 - RNA, 20 nt, Yersinia pestis
cuguugcccccugcuccaaa

SEQ ID NO: 4135557 - RNA, 20 nt, Yersinia pestis
cuguuggcuauuacugucaa

SEQ ID NO: 4135558 - RNA, 20 nt, Yersinia pestis
cuguuggugauauaaaucca

SEQ ID NO: 4135559 - RNA, 20 nt, Yersinia pestis
cuguuggugguggccuguga

SEQ ID NO: 4135560 - RNA, 19 nt, Yersinia pestis
cuguuguaacacuugacca

SEQ ID NO: 4135561 - RNA, 21 nt, Yersinia pestis
cuguuguaguuagaugacauc

SEQ ID NO: 4135562 - RNA, 14 nt, Yersinia pestis
cuguuguucugggg

SEQ ID NO: 4135563 - RNA, 17 nt, Yersinia pestis
cuguuguugugacaggc

SEQ ID NO: 4135564 - RNA, 18 nt, Yersinia pestis
cuguuuaccuaucucagu

SEQ ID NO: 4135565 - RNA, 14 nt, Yersinia pestis
cuguuuaguucacg

SEQ ID NO: 4135566 - RNA, 21 nt, Yersinia pestis
cuguuuaguucacgauggaaa

SEQ ID NO: 4135567 - RNA, 14 nt, Yersinia pestis
cuguuuauugagua

SEQ ID NO: 4135568 - RNA, 14 nt, Yersinia pestis
cuguuucaaauaag

SEQ ID NO: 4135569 - RNA, 22 nt, Yersinia pestis
cuguuuuaaaaaaaaagaaaau

SEQ ID NO: 4135570 - RNA, 16 nt, Yersinia pestis
cuguuuucauuauuuu

SEQ ID NO: 4135571 - RNA, 17 nt, Yersinia pestis
cuguuuugguuuccgcu

SEQ ID NO: 4135572 - RNA, 16 nt, Yersinia pestis
cuguuuuugaagauuc

SEQ ID NO: 4135573 - RNA, 14 nt, Yersinia pestis
cuguuuuuuuuaaa

SEQ ID NO: 4135574 - RNA, 16 nt, Yersinia pestis
cuuaaaaaucaaaagu

SEQ ID NO: 4135575 - RNA, 22 nt, Yersinia pestis
cuuaaaaaucaauaaacucuuu

SEQ ID NO: 4135576 - RNA, 16 nt, Yersinia pestis
cuuaaaccgugcggcu

SEQ ID NO: 4135577 - RNA, 21 nt, Yersinia pestis
cuuaaagaaaauuuacccugc

SEQ ID NO: 4135578 - RNA, 22 nt, Yersinia pestis
cuuaaagaaaauuuacccugcu

SEQ ID NO: 4135579 - RNA, 15 nt, Yersinia pestis
cuuaaagcccagguu

SEQ ID NO: 4135580 - RNA, 11 nt, Yersinia pestis
cuuaaauaaaa

SEQ ID NO: 4135581 - RNA, 11 nt, Yersinia pestis
cuuaaauaacu

SEQ ID NO: 4135582 - RNA, 16 nt, Yersinia pestis
cuuaacaaucagugca

SEQ ID NO: 4135583 - RNA, 21 nt, Yersinia pestis
cuuaacaaucagugcaauaaa

SEQ ID NO: 4135584 - RNA, 18 nt, Yersinia pestis
cuuaacgguaugacgggu

SEQ ID NO: 4135585 - RNA, 18 nt, Yersinia pestis
cuuaacguugcaaaugcu

SEQ ID NO: 4135586 - RNA, 18 nt, Yersinia pestis
cuuaacucgccacucaca

SEQ ID NO: 4135587 - RNA, 13 nt, Yersinia pestis
cuuaacugcauag

SEQ ID NO: 4135588 - RNA, 18 nt, Yersinia pestis
cuuaaguugaauaagauc

SEQ ID NO: 4135589 - RNA, 19 nt, Yersinia pestis
cuuaauaauaucaaauguc

SEQ ID NO: 4135590 - RNA, 13 nt, Yersinia pestis
cuuaauaccuaaa

SEQ ID NO: 4135591 - RNA, 19 nt, Yersinia pestis
cuuaaucauauuuuccugc

SEQ ID NO: 4135592 - RNA, 15 nt, Yersinia pestis
cuuaaucgccagcaa

SEQ ID NO: 4135593 - RNA, 19 nt, Yersinia pestis
cuuaaucuuauuuguaaau

SEQ ID NO: 4135594 - RNA, 23 nt, Yersinia pestis
cuuaauggcaccguggauaaaca

SEQ ID NO: 4135595 - RNA, 20 nt, Yersinia pestis
cuuaauggcuuuuugcugau

SEQ ID NO: 4135596 - RNA, 17 nt, Yersinia pestis
cuuaaugucuuuacuaa

SEQ ID NO: 4135597 - RNA, 22 nt, Yersinia pestis
cuuaauuggcggaagacuucca

SEQ ID NO: 4135598 - RNA, 16 nt, Yersinia pestis
cuuaauuuaaauaaga

SEQ ID NO: 4135599 - RNA, 18 nt, Yersinia pestis
cuuaauuuggcuauugag

SEQ ID NO: 4135600 - RNA, 11 nt, Yersinia pestis
cuuaauuuuau

SEQ ID NO: 4135601 - RNA, 18 nt, Yersinia pestis
cuucccauagacggcgaa

SEQ ID NO: 4135602 - RNA, 20 nt, Yersinia pestis
cuucccauagacggcgaacu

SEQ ID NO: 4135603 - RNA, 12 nt, Yersinia pestis
cuucccauccua

SEQ ID NO: 4135604 - RNA, 20 nt, Yersinia pestis
cuuccccuuuagugcgguua

SEQ ID NO: 4135605 - RNA, 19 nt, Yersinia pestis
cuucccgaguaauaccaaa

SEQ ID NO: 4135606 - RNA, 13 nt, Yersinia pestis
cuuccgccagcag

SEQ ID NO: 4135607 - RNA, 13 nt, Yersinia pestis
cuuccgccgccaa

SEQ ID NO: 4135608 - RNA, 22 nt, Yersinia pestis
cuuccgccucuuuuuccacacc

SEQ ID NO: 4135609 - RNA, 14 nt, Yersinia pestis
cuuccggcaucuuu

SEQ ID NO: 4135610 - RNA, 16 nt, Yersinia pestis
cuuccggcguaccaca

SEQ ID NO: 4135611 - RNA, 13 nt, Yersinia pestis
cuuccgucccaag

SEQ ID NO: 4135612 - RNA, 23 nt, Yersinia pestis
cuuccuacaacgugguuuauuua

SEQ ID NO: 4135613 - RNA, 14 nt, Yersinia pestis
cuuccuuuuauuua

SEQ ID NO: 4135614 - RNA, 20 nt, Yersinia pestis
cuuccuuuuuaugccauaaa

SEQ ID NO: 4135615 - RNA, 21 nt, Yersinia pestis
cuucgaaagaaauaaaagaaa

SEQ ID NO: 4135616 - RNA, 17 nt, Yersinia pestis
cuucgacaggcaauuau

SEQ ID NO: 4135617 - RNA, 21 nt, Yersinia pestis
cuucgacagucacuaauaccu

SEQ ID NO: 4135618 - RNA, 12 nt, Yersinia pestis
cuucgagcaccg

SEQ ID NO: 4135619 - RNA, 19 nt, Yersinia pestis
cuucgauuuuauauugaua

SEQ ID NO: 4135620 - RNA, 13 nt, Yersinia pestis
cuucgcaccacaa

SEQ ID NO: 4135621 - RNA, 14 nt, Yersinia pestis
cuucgcaccgccgc

SEQ ID NO: 4135622 - RNA, 17 nt, Yersinia pestis
cuucgcacgcccaucaa

SEQ ID NO: 4135623 - RNA, 18 nt, Yersinia pestis
cuucgccacuagucgccu

SEQ ID NO: 4135624 - RNA, 21 nt, Yersinia pestis
cuucgccaggucaggaagaga

SEQ ID NO: 4135625 - RNA, 22 nt, Yersinia pestis
cuucgccaggucaggaagagaa

SEQ ID NO: 4135626 - RNA, 23 nt, Yersinia pestis
cuucgccauuuccaucaucucug

SEQ ID NO: 4135627 - RNA, 21 nt, Yersinia pestis
cuucgccgggucaggaagaga

SEQ ID NO: 4135628 - RNA, 19 nt, Yersinia pestis
cuucgccgucaaacucuuc

SEQ ID NO: 4135629 - RNA, 15 nt, Yersinia pestis
cuucgcgaacacaau

SEQ ID NO: 4135630 - RNA, 17 nt, Yersinia pestis
cuucgcgaacacaauug

SEQ ID NO: 4135631 - RNA, 14 nt, Yersinia pestis
cuucgcucacaacc

SEQ ID NO: 4135632 - RNA, 14 nt, Yersinia pestis
cuucgcugacauuu

SEQ ID NO: 4135633 - RNA, 19 nt, Yersinia pestis
cuucgcuuucaucuucuuc

SEQ ID NO: 4135634 - RNA, 22 nt, Yersinia pestis
cuucgguauauuucccguugau

SEQ ID NO: 4135635 - RNA, 16 nt, Yersinia pestis
cuucggucucuggaug

SEQ ID NO: 4135636 - RNA, 18 nt, Yersinia pestis
cuucguagaguugcaguu

SEQ ID NO: 4135637 - RNA, 22 nt, Yersinia pestis
cuucguugccccaucagcacuc

SEQ ID NO: 4135638 - RNA, 22 nt, Yersinia pestis
cuucuacaaauuuuuuauauuc

SEQ ID NO: 4135639 - RNA, 19 nt, Yersinia pestis
cuucuagcucuuccagcaa

SEQ ID NO: 4135640 - RNA, 15 nt, Yersinia pestis
cuucuccuguauuug

SEQ ID NO: 4135641 - RNA, 18 nt, Yersinia pestis
cuucuccuuucuguucca

SEQ ID NO: 4135642 - RNA, 16 nt, Yersinia pestis
cuucucgugucacagu

SEQ ID NO: 4135643 - RNA, 19 nt, Yersinia pestis
cuucucucccgccaauuca

SEQ ID NO: 4135644 - RNA, 15 nt, Yersinia pestis
cuucugaacguauau

SEQ ID NO: 4135645 - RNA, 16 nt, Yersinia pestis
cuucugauucaauuuc

SEQ ID NO: 4135646 - RNA, 20 nt, Yersinia pestis
cuucugcaaaaucguuaccg

SEQ ID NO: 4135647 - RNA, 19 nt, Yersinia pestis
cuucugccuauccucaccg

SEQ ID NO: 4135648 - RNA, 15 nt, Yersinia pestis
cuucuggugguguca

SEQ ID NO: 4135649 - RNA, 22 nt, Yersinia pestis
cuucuggugguuuuguuaauau

SEQ ID NO: 4135650 - RNA, 19 nt, Yersinia pestis
cuucuguugcccccugcuc

SEQ ID NO: 4135651 - RNA, 20 nt, Yersinia pestis
cuucuuaauucccagccacu

SEQ ID NO: 4135652 - RNA, 12 nt, Yersinia pestis
cuucuuauuuau

SEQ ID NO: 4135653 - RNA, 13 nt, Yersinia pestis
cuucuucauccca

SEQ ID NO: 4135654 - RNA, 20 nt, Yersinia pestis
cuucuucauuuucaucacug

SEQ ID NO: 4135655 - RNA, 12 nt, Yersinia pestis
cuucuuccaucu

SEQ ID NO: 4135656 - RNA, 13 nt, Yersinia pestis
cuucuuccaucuu

SEQ ID NO: 4135657 - RNA, 21 nt, Yersinia pestis
cuucuuccaucuuacccaaca

SEQ ID NO: 4135658 - RNA, 14 nt, Yersinia pestis
cuucuuccauugau

SEQ ID NO: 4135659 - RNA, 20 nt, Yersinia pestis
cuucuucgauuuuagcuuug

SEQ ID NO: 4135660 - RNA, 18 nt, Yersinia pestis
cuucuuggguggcaauuu

SEQ ID NO: 4135661 - RNA, 21 nt, Yersinia pestis
cuucuugguguugcagucucc

SEQ ID NO: 4135662 - RNA, 22 nt, Yersinia pestis
cuucuuguggcaguucacccaa

SEQ ID NO: 4135663 - RNA, 22 nt, Yersinia pestis
cuucuuuaucuaaaauaucuuu

SEQ ID NO: 4135664 - RNA, 16 nt, Yersinia pestis
cuucuuuauuguuuug

SEQ ID NO: 4135665 - RNA, 16 nt, Yersinia pestis
cuugaaacagcagggg

SEQ ID NO: 4135666 - RNA, 20 nt, Yersinia pestis
cuugaaaugauaacaauaaa

SEQ ID NO: 4135667 - RNA, 23 nt, Yersinia pestis
cuugaaaugauaacaauaaaauc

SEQ ID NO: 4135668 - RNA, 14 nt, Yersinia pestis
cuugaaccaauuuu

SEQ ID NO: 4135669 - RNA, 16 nt, Yersinia pestis
cuugaaccaauuuuuc

SEQ ID NO: 4135670 - RNA, 11 nt, Yersinia pestis
cuugaagagug

SEQ ID NO: 4135671 - RNA, 21 nt, Yersinia pestis
cuugaaguacggugccagcag

SEQ ID NO: 4135672 - RNA, 17 nt, Yersinia pestis
cuugaaucaaaauaccc

SEQ ID NO: 4135673 - RNA, 13 nt, Yersinia pestis
cuugaccaaccug

SEQ ID NO: 4135674 - RNA, 15 nt, Yersinia pestis
cuugaccaaccuguu

SEQ ID NO: 4135675 - RNA, 16 nt, Yersinia pestis
cuugaccuucccucuu

SEQ ID NO: 4135676 - RNA, 20 nt, Yersinia pestis
cuugacgguucgaaaauaau

SEQ ID NO: 4135677 - RNA, 16 nt, Yersinia pestis
cuugacuaacacgacu

SEQ ID NO: 4135678 - RNA, 15 nt, Yersinia pestis
cuugacucuucagcg

SEQ ID NO: 4135679 - RNA, 19 nt, Yersinia pestis
cuugacucuucagcgggaa

SEQ ID NO: 4135680 - RNA, 14 nt, Yersinia pestis
cuugacugaccaua

SEQ ID NO: 4135681 - RNA, 14 nt, Yersinia pestis
cuugagauccucca

SEQ ID NO: 4135682 - RNA, 20 nt, Yersinia pestis
cuugagauccuccauauccu

SEQ ID NO: 4135683 - RNA, 18 nt, Yersinia pestis
cuugagcagugcgcggcg

SEQ ID NO: 4135684 - RNA, 17 nt, Yersinia pestis
cuugagcuagauggaaa

SEQ ID NO: 4135685 - RNA, 13 nt, Yersinia pestis
cuugagucagcac

SEQ ID NO: 4135686 - RNA, 20 nt, Yersinia pestis
cuugauagcgggcagacguu

SEQ ID NO: 4135687 - RNA, 21 nt, Yersinia pestis
cuugauagggcugaagaccca

SEQ ID NO: 4135688 - RNA, 22 nt, Yersinia pestis
cuugauaucuucggcggcuaaa

SEQ ID NO: 4135689 - RNA, 13 nt, Yersinia pestis
cuugaucaacuca

SEQ ID NO: 4135690 - RNA, 21 nt, Yersinia pestis
cuugaucggauaguuaucugg

SEQ ID NO: 4135691 - RNA, 22 nt, Yersinia pestis
cuugaugaaguuauuuuuauua

SEQ ID NO: 4135692 - RNA, 18 nt, Yersinia pestis
cuugaugugcucugcucc

SEQ ID NO: 4135693 - RNA, 12 nt, Yersinia pestis
cuugauuaaaug

SEQ ID NO: 4135694 - RNA, 13 nt, Yersinia pestis
cuugauucaccag

SEQ ID NO: 4135695 - RNA, 19 nt, Yersinia pestis
cuugauugccuacaacuug

SEQ ID NO: 4135696 - RNA, 21 nt, Yersinia pestis
cuugauuuuagccucuguagc

SEQ ID NO: 4135697 - RNA, 18 nt, Yersinia pestis
cuugcaacaaaauggccu

SEQ ID NO: 4135698 - RNA, 17 nt, Yersinia pestis
cuugcaacucggccgcu

SEQ ID NO: 4135699 - RNA, 20 nt, Yersinia pestis
cuugcaagguauuuuguauc

SEQ ID NO: 4135700 - RNA, 20 nt, Yersinia pestis
cuugcaauucauguugccaa

SEQ ID NO: 4135701 - RNA, 21 nt, Yersinia pestis
cuugcagcgaucacagauaaa

SEQ ID NO: 4135702 - RNA, 23 nt, Yersinia pestis
cuugcagcgaucacagauaaaca

SEQ ID NO: 4135703 - RNA, 19 nt, Yersinia pestis
cuugccacucugcuccgca

SEQ ID NO: 4135704 - RNA, 17 nt, Yersinia pestis
cuugccagagcaauaac

SEQ ID NO: 4135705 - RNA, 18 nt, Yersinia pestis
cuugccauaagugaacau

SEQ ID NO: 4135706 - RNA, 15 nt, Yersinia pestis
cuugccguuuugggc

SEQ ID NO: 4135707 - RNA, 22 nt, Yersinia pestis
cuugccguuuugggcuugagca

SEQ ID NO: 4135708 - RNA, 16 nt, Yersinia pestis
cuugccugacagccug

SEQ ID NO: 4135709 - RNA, 21 nt, Yersinia pestis
cuugcgccgaaauaaaaccau

SEQ ID NO: 4135710 - RNA, 20 nt, Yersinia pestis
cuugcgcgcugggacgcuua

SEQ ID NO: 4135711 - RNA, 22 nt, Yersinia pestis
cuugcgcgcugggacgcuuaau

SEQ ID NO: 4135712 - RNA, 21 nt, Yersinia pestis
cuugcuaccaagacuucauga

SEQ ID NO: 4135713 - RNA, 20 nt, Yersinia pestis
cuugcuccaauaaaaaaucc

SEQ ID NO: 4135714 - RNA, 13 nt, Yersinia pestis
cuugcugcaaccg

SEQ ID NO: 4135715 - RNA, 17 nt, Yersinia pestis
cuugcugccugccugcu

SEQ ID NO: 4135716 - RNA, 18 nt, Yersinia pestis
cuugcuggaggcuggcag

SEQ ID NO: 4135717 - RNA, 22 nt, Yersinia pestis
cuugcugguauucaucagcaau

SEQ ID NO: 4135718 - RNA, 18 nt, Yersinia pestis
cuuggaacuuacucccuu

SEQ ID NO: 4135719 - RNA, 19 nt, Yersinia pestis
cuuggaacuuacucccuug

SEQ ID NO: 4135720 - RNA, 20 nt, Yersinia pestis
cuuggacagaaaacaaucug

SEQ ID NO: 4135721 - RNA, 17 nt, Yersinia pestis
cuuggacaucugcuuua

SEQ ID NO: 4135722 - RNA, 17 nt, Yersinia pestis
cuuugaccgaaccaccg

SEQ ID NO: 4135723 - RNA, 14 nt, Yersinia pestis
cuuugauccccuua

SEQ ID NO: 4135724 - RNA, 17 nt, Yersinia pestis
cuuugaugccuaauaau

SEQ ID NO: 4135725 - RNA, 21 nt, Yersinia pestis
cuuugauuuaaauauuauuua

SEQ ID NO: 4135726 - RNA, 23 nt, Yersinia pestis
cuuugauuugaacgacaugugag

SEQ ID NO: 4135727 - RNA, 18 nt, Yersinia pestis
cuuugcccuuacuauuuu

SEQ ID NO: 4135728 - RNA, 14 nt, Yersinia pestis
cuuugcguaauagg

SEQ ID NO: 4135729 - RNA, 21 nt, Yersinia pestis
cuuugcugccaucagccggag

SEQ ID NO: 4135730 - RNA, 15 nt, Yersinia pestis
cuuuggaaccgccau

SEQ ID NO: 4135731 - RNA, 15 nt, Yersinia pestis
cuuuggacagucugg

SEQ ID NO: 4135732 - RNA, 17 nt, Yersinia pestis
cuuuggcaaagucauca

SEQ ID NO: 4135733 - RNA, 18 nt, Yersinia pestis
cuuuggccguuuuaccaa

SEQ ID NO: 4135734 - RNA, 19 nt, Yersinia pestis
cuuuggcgcggucuucuga

SEQ ID NO: 4135735 - RNA, 17 nt, Yersinia pestis
cuuuggcuucuggaugg

SEQ ID NO: 4135736 - RNA, 18 nt, Yersinia pestis
cuuuggguauaugacugu

SEQ ID NO: 4135737 - RNA, 16 nt, Yersinia pestis
cuuugggugguggacu

SEQ ID NO: 4135738 - RNA, 18 nt, Yersinia pestis
cuuuggguuguuucaaga

SEQ ID NO: 4135739 - RNA, 18 nt, Yersinia pestis
cuuugguugccagauaau

SEQ ID NO: 4135740 - RNA, 17 nt, Yersinia pestis
cuuuguauuuugcacaa

SEQ ID NO: 4135741 - RNA, 20 nt, Yersinia pestis
cuuugucaauaaccucagcc

SEQ ID NO: 4135742 - RNA, 21 nt, Yersinia pestis
cuuugucaauaaccucagccu

SEQ ID NO: 4135743 - RNA, 23 nt, Yersinia pestis
cuuugucaauaaccucagccuca

SEQ ID NO: 4135744 - RNA, 17 nt, Yersinia pestis
cuuuguguugaacuuua

SEQ ID NO: 4135745 - RNA, 22 nt, Yersinia pestis
cuuuuaaaacuucccgcacaau

SEQ ID NO: 4135746 - RNA, 22 nt, Yersinia pestis
cuuuuaaaugaagcaguucacu

SEQ ID NO: 4135747 - RNA, 18 nt, Yersinia pestis
cuuuuaacguuagagcac

SEQ ID NO: 4135748 - RNA, 14 nt, Yersinia pestis
cuuuuacugguuca

SEQ ID NO: 4135749 - RNA, 21 nt, Yersinia pestis
cuuuuacugguucauuuucca

SEQ ID NO: 4135750 - RNA, 18 nt, Yersinia pestis
cuuuuagugaggggaacc

SEQ ID NO: 4135751 - RNA, 17 nt, Yersinia pestis
cuuuuaucaacuucaug

SEQ ID NO: 4135752 - RNA, 19 nt, Yersinia pestis
cuuuuaugacggcaucgag

SEQ ID NO: 4135753 - RNA, 13 nt, Yersinia pestis
cuuuuauuuuuac

SEQ ID NO: 4135754 - RNA, 20 nt, Yersinia pestis
cuuuucaucgcauaggccaa

SEQ ID NO: 4135755 - RNA, 12 nt, Yersinia pestis
cuuuucccgucc

SEQ ID NO: 4135756 - RNA, 20 nt, Yersinia pestis
cuuuuccgccaugagaacca

SEQ ID NO: 4135757 - RNA, 21 nt, Yersinia pestis
cuuuucugccuaucuuaaaaa

SEQ ID NO: 4135758 - RNA, 21 nt, Yersinia pestis
cuuuucuuuaugucuuuuucu

SEQ ID NO: 4135759 - RNA, 22 nt, Yersinia pestis
cuuuucuuuaugucuuuuucuu

SEQ ID NO: 4135760 - RNA, 17 nt, Yersinia pestis
cuuuugcauauuucucu

SEQ ID NO: 4135761 - RNA, 18 nt, Yersinia pestis
cuuuugcauauuucucuu

SEQ ID NO: 4135762 - RNA, 14 nt, Yersinia pestis
cuuuugccacauuu

SEQ ID NO: 4135763 - RNA, 16 nt, Yersinia pestis
cuuuugccacauuucc

SEQ ID NO: 4135764 - RNA, 15 nt, Yersinia pestis
cuuuugcugcacugc

SEQ ID NO: 4135765 - RNA, 17 nt, Yersinia pestis
cuuuugcugcacugcuc

SEQ ID NO: 4135766 - RNA, 15 nt, Yersinia pestis
cuuuuggcagcacca

SEQ ID NO: 4135767 - RNA, 16 nt, Yersinia pestis
cuuuuggcagcaccag

SEQ ID NO: 4135768 - RNA, 13 nt, Yersinia pestis
cuuuuuauuucuu

SEQ ID NO: 4135769 - RNA, 19 nt, Yersinia pestis
cuuuuuauuucuuuuaaau

SEQ ID NO: 4135770 - RNA, 20 nt, Yersinia pestis
cuuuuucacacgcccaggcc

SEQ ID NO: 4135771 - RNA, 15 nt, Yersinia pestis
cuuuuuccacacccu

SEQ ID NO: 4135772 - RNA, 21 nt, Yersinia pestis
cuuuuugcaucaccaucauua

SEQ ID NO: 4135773 - RNA, 15 nt, Yersinia pestis
cuuuuugccaguggu

SEQ ID NO: 4135774 - RNA, 17 nt, Yersinia pestis
cuuuuugcccgcgcuuc

SEQ ID NO: 4135775 - RNA, 15 nt, Yersinia pestis
cuuuuugugcuucau

SEQ ID NO: 4135776 - RNA, 16 nt, Yersinia pestis
cuuuuugugcuucaua

SEQ ID NO: 4135777 - RNA, 22 nt, Yersinia pestis
cuuuuuuaaagccuuucagcgc

SEQ ID NO: 4135778 - RNA, 15 nt, Yersinia pestis
cuuuuuuaauaaaaa

SEQ ID NO: 4135779 - RNA, 16 nt, Yersinia pestis
cuuuuuuaauaaaaaa

SEQ ID NO: 4135780 - RNA, 14 nt, Yersinia pestis
cuuuuuuauaauaa

SEQ ID NO: 4135781 - RNA, 12 nt, Yersinia pestis
cuuuuuuguuuu

SEQ ID NO: 4135782 - RNA, 20 nt, Yersinia pestis
cuuuuuuuaaccaauuuugg

SEQ ID NO: 4135783 - RNA, 15 nt, Yersinia pestis
gaaaaaaacagacua

SEQ ID NO: 4135784 - RNA, 11 nt, Yersinia pestis
gaaaaaaauac

SEQ ID NO: 4135785 - RNA, 19 nt, Yersinia pestis
gaaaaaaaucaaguacacu

SEQ ID NO: 4135786 - RNA, 15 nt, Yersinia pestis
gaaaaaacaucacac

SEQ ID NO: 4135787 - RNA, 18 nt, Yersinia pestis
gaaaaaauaauggccaag

SEQ ID NO: 4135788 - RNA, 13 nt, Yersinia pestis
gaaaaaauaaugu

SEQ ID NO: 4135789 - RNA, 14 nt, Yersinia pestis
gaaaaaauaauguc

SEQ ID NO: 4135790 - RNA, 21 nt, Yersinia pestis
gaaaaacaccuauuuuauccc

SEQ ID NO: 4135791 - RNA, 13 nt, Yersinia pestis
gaaaaacacuggc

SEQ ID NO: 4135792 - RNA, 19 nt, Yersinia pestis
gaaaaaggcaccagcgcac

SEQ ID NO: 4135793 - RNA, 22 nt, Yersinia pestis
gaaaaagggccaugccuguuga

SEQ ID NO: 4135794 - RNA, 15 nt, Yersinia pestis
gaaaaauaacaggcu

SEQ ID NO: 4135795 - RNA, 18 nt, Yersinia pestis
gaaaaauaacaggcuggc

SEQ ID NO: 4135796 - RNA, 15 nt, Yersinia pestis
gaaaaauacaaauau

SEQ ID NO: 4135797 - RNA, 17 nt, Yersinia pestis
gaaaaaucacauacugg

SEQ ID NO: 4135798 - RNA, 14 nt, Yersinia pestis
gaaaaauguccauu

SEQ ID NO: 4135799 - RNA, 19 nt, Yersinia pestis
gaaaacaaaaaguuaaaua

SEQ ID NO: 4135800 - RNA, 23 nt, Yersinia pestis
gaaaacaguuacuccuacaccau

SEQ ID NO: 4135801 - RNA, 14 nt, Yersinia pestis
gaaaaccuaauacu

SEQ ID NO: 4135802 - RNA, 19 nt, Yersinia pestis
gaaaaccuucagcaaagag

SEQ ID NO: 4135803 - RNA, 24 nt, Yersinia pestis
gaaaacguuaacugcaguaaaaau

SEQ ID NO: 4135804 - RNA, 20 nt, Yersinia pestis
gaaaagagguguucuugaaa

SEQ ID NO: 4135805 - RNA, 19 nt, Yersinia pestis
gaaaagagucgcuuuggga

SEQ ID NO: 4135806 - RNA, 13 nt, Yersinia pestis
gaaaagcagacuu

SEQ ID NO: 4135807 - RNA, 22 nt, Yersinia pestis
gaaaaggcagagaggagaauua

SEQ ID NO: 4135808 - RNA, 16 nt, Yersinia pestis
gaaaagguaaacagac

SEQ ID NO: 4135809 - RNA, 17 nt, Yersinia pestis
gaaaagguuaacugcag

SEQ ID NO: 4135810 - RNA, 19 nt, Yersinia pestis
gaaaaguggcuaucugaaa

SEQ ID NO: 4135811 - RNA, 10 nt, Yersinia pestis
gaaaauaaug

SEQ ID NO: 4135812 - RNA, 11 nt, Yersinia pestis
gaaaauaauga

SEQ ID NO: 4135813 - RNA, 21 nt, Yersinia pestis
gaaaauaaugaauuauuagau

SEQ ID NO: 4135814 - RNA, 19 nt, Yersinia pestis
gaaaauaccgcgaucaaca

SEQ ID NO: 4135815 - RNA, 14 nt, Yersinia pestis
gaaaaucaugaaau

SEQ ID NO: 4135816 - RNA, 19 nt, Yersinia pestis
gaaaaugaucaucaagcca

SEQ ID NO: 4135817 - RNA, 16 nt, Yersinia pestis
gaaaauguccauaaua

SEQ ID NO: 4135818 - RNA, 19 nt, Yersinia pestis
gaaaauuuacccugcuaca

SEQ ID NO: 4135819 - RNA, 20 nt, Yersinia pestis
gaaaauuucucuuuuauucu

SEQ ID NO: 4135820 - RNA, 20 nt, Yersinia pestis
gaaacaaaaccaaccccacg

SEQ ID NO: 4135821 - RNA, 14 nt, Yersinia pestis
gaaacaaaaccuaa

SEQ ID NO: 4135822 - RNA, 19 nt, Yersinia pestis
gaaacaaaaccuaacgcca

SEQ ID NO: 4135823 - RNA, 11 nt, Yersinia pestis
gaaacaaauac

SEQ ID NO: 4135824 - RNA, 17 nt, Yersinia pestis
gaaacaccguguuccag

SEQ ID NO: 4135825 - RNA, 15 nt, Yersinia pestis
gaaacauaauuaaau

SEQ ID NO: 4135826 - RNA, 15 nt, Yersinia pestis
gaaacaucuucauuu

SEQ ID NO: 4135827 - RNA, 19 nt, Yersinia pestis
gaaacaugcugaagccagc

SEQ ID NO: 4135828 - RNA, 15 nt, Yersinia pestis
gaaaccaaaucugac

SEQ ID NO: 4135829 - RNA, 17 nt, Yersinia pestis
gaaacccacauaucucc

SEQ ID NO: 4135830 - RNA, 21 nt, Yersinia pestis
gaaaccgcugauaaccagcca

SEQ ID NO: 4135831 - RNA, 16 nt, Yersinia pestis
gaaacgauuacccacc

SEQ ID NO: 4135832 - RNA, 17 nt, Yersinia pestis
gaaacgauuacccacca

SEQ ID NO: 4135833 - RNA, 13 nt, Yersinia pestis
gaaacgcaauuuu

SEQ ID NO: 4135834 - RNA, 14 nt, Yersinia pestis
gaaacgccagccuc

SEQ ID NO: 4135835 - RNA, 20 nt, Yersinia pestis
gaaacgcccaaaucugccug

SEQ ID NO: 4135836 - RNA, 19 nt, Yersinia pestis
gaaacgccccgauaaacca

SEQ ID NO: 4135837 - RNA, 17 nt, Yersinia pestis
gaaacggugaggauagg

SEQ ID NO: 4135838 - RNA, 14 nt, Yersinia pestis
gaaacuaagagucc

SEQ ID NO: 4135839 - RNA, 16 nt, Yersinia pestis
gaaacucccuucaauc

SEQ ID NO: 4135840 - RNA, 23 nt, Yersinia pestis
gaaacuggagaucugcuguaggu

SEQ ID NO: 4135841 - RNA, 15 nt, Yersinia pestis
gaaacuucauuucag

SEQ ID NO: 4135842 - RNA, 14 nt, Yersinia pestis
gaaacuuugcuuug

SEQ ID NO: 4135843 - RNA, 13 nt, Yersinia pestis
gaaagaaaaauag

SEQ ID NO: 4135844 - RNA, 19 nt, Yersinia pestis
gaagccgcagagaugaagg

SEQ ID NO: 4135845 - RNA, 20 nt, Yersinia pestis
gaagccgcugcaagcaaugu

SEQ ID NO: 4135846 - RNA, 17 nt, Yersinia pestis
gaagccucaugaaugag

SEQ ID NO: 4135847 - RNA, 14 nt, Yersinia pestis
gaagcgcgcccucc

SEQ ID NO: 4135848 - RNA, 22 nt, Yersinia pestis
gaagcgggcggccucugcugcu

SEQ ID NO: 4135849 - RNA, 19 nt, Yersinia pestis
gaagcguggaguuuacgca

SEQ ID NO: 4135850 - RNA, 15 nt, Yersinia pestis
gaagcucauaugcag

SEQ ID NO: 4135851 - RNA, 20 nt, Yersinia pestis
gaagcugauaacgcacggcc

SEQ ID NO: 4135852 - RNA, 14 nt, Yersinia pestis
gaaggauugaccaa

SEQ ID NO: 4135853 - RNA, 14 nt, Yersinia pestis
gaaggccugcugug

SEQ ID NO: 4135854 - RNA, 17 nt, Yersinia pestis
gaaggcgguuaucugga

SEQ ID NO: 4135855 - RNA, 15 nt, Yersinia pestis
gaaggcugauuaaua

SEQ ID NO: 4135856 - RNA, 16 nt, Yersinia pestis
gaagggcggccagcaa

SEQ ID NO: 4135857 - RNA, 22 nt, Yersinia pestis
gaagggcggccagcaagagcag

SEQ ID NO: 4135858 - RNA, 20 nt, Yersinia pestis
gaaggggcguuuaaugcccc

SEQ ID NO: 4135859 - RNA, 14 nt, Yersinia pestis
gaagggggcuuauu

SEQ ID NO: 4135860 - RNA, 16 nt, Yersinia pestis
gaagggguucuuccaa

SEQ ID NO: 4135861 - RNA, 19 nt, Yersinia pestis
gaaggguauugaagauacc

SEQ ID NO: 4135862 - RNA, 13 nt, Yersinia pestis
gaagggucccgcu

SEQ ID NO: 4135863 - RNA, 17 nt, Yersinia pestis
gaagguaaucagacugc

SEQ ID NO: 4135864 - RNA, 18 nt, Yersinia pestis
gaagguaaucagacugcu

SEQ ID NO: 4135865 - RNA, 22 nt, Yersinia pestis
gaagguaaucagacugcugaca

SEQ ID NO: 4135866 - RNA, 12 nt, Yersinia pestis
gaagguaaugcg

SEQ ID NO: 4135867 - RNA, 21 nt, Yersinia pestis
gaaguaaagaaccccccacca

SEQ ID NO: 4135868 - RNA, 13 nt, Yersinia pestis
gaaguaauccaga

SEQ ID NO: 4135869 - RNA, 18 nt, Yersinia pestis
gaaguacaguaccugcua

SEQ ID NO: 4135870 - RNA, 16 nt, Yersinia pestis
gaagucauugggguaa

SEQ ID NO: 4135871 - RNA, 19 nt, Yersinia pestis
gaaguccuggccaaagccg

SEQ ID NO: 4135872 - RNA, 19 nt, Yersinia pestis
gaagucgauaugagucagu

SEQ ID NO: 4135873 - RNA, 16 nt, Yersinia pestis
gaagugagaagugaaa

SEQ ID NO: 4135874 - RNA, 17 nt, Yersinia pestis
gaagugagaagugaaaa

SEQ ID NO: 4135875 - RNA, 23 nt, Yersinia pestis
gaagugguagccggacucaaaau

SEQ ID NO: 4135876 - RNA, 18 nt, Yersinia pestis
gaaguuuaccgcaugaau

SEQ ID NO: 4135877 - RNA, 17 nt, Yersinia pestis
gaauaaaaaagcccggu

SEQ ID NO: 4135878 - RNA, 12 nt, Yersinia pestis
gaauaaaaauaa

SEQ ID NO: 4135879 - RNA, 23 nt, Yersinia pestis
gaauaaaaccuugcgccaagucc

SEQ ID NO: 4135880 - RNA, 13 nt, Yersinia pestis
gaauaaacagcag

SEQ ID NO: 4135881 - RNA, 17 nt, Yersinia pestis
gaauaaaggggguuuuc

SEQ ID NO: 4135882 - RNA, 12 nt, Yersinia pestis
gaauaaaucaaa

SEQ ID NO: 4135883 - RNA, 12 nt, Yersinia pestis
gaauaacgcuga

SEQ ID NO: 4135884 - RNA, 24 nt, Yersinia pestis
gaauaacugagccgcauacauagc

SEQ ID NO: 4135885 - RNA, 21 nt, Yersinia pestis
gaauaacuucgcgaacacaau

SEQ ID NO: 4135886 - RNA, 12 nt, Yersinia pestis
gaauaagauccc

SEQ ID NO: 4135887 - RNA, 17 nt, Yersinia pestis
gaauaagaucccagaga

SEQ ID NO: 4135888 - RNA, 16 nt, Yersinia pestis
gaauaccaccccuucg

SEQ ID NO: 4135889 - RNA, 18 nt, Yersinia pestis
gaauaccauaacgcugcu

SEQ ID NO: 4135890 - RNA, 18 nt, Yersinia pestis
gaauacccaaaauuugcu

SEQ ID NO: 4135891 - RNA, 21 nt, Yersinia pestis
gaauaccggccugauuuacug

SEQ ID NO: 4135892 - RNA, 16 nt, Yersinia pestis
gaauacuucaggccaa

SEQ ID NO: 4135893 - RNA, 22 nt, Yersinia pestis
gaauagagacggaaagagccag

SEQ ID NO: 4135894 - RNA, 14 nt, Yersinia pestis
gaauagagccucua

SEQ ID NO: 4135895 - RNA, 20 nt, Yersinia pestis
gaauagagccucuauuaccu

SEQ ID NO: 4135896 - RNA, 13 nt, Yersinia pestis
gaauagauaacac

SEQ ID NO: 4135897 - RNA, 19 nt, Yersinia pestis
gaauagaucccauacccac

SEQ ID NO: 4135898 - RNA, 19 nt, Yersinia pestis
gaauagccagaagccaggg

SEQ ID NO: 4135899 - RNA, 16 nt, Yersinia pestis
gaauagcgcugcauca

SEQ ID NO: 4135900 - RNA, 19 nt, Yersinia pestis
gaauagcgcugcaucagca

SEQ ID NO: 4135901 - RNA, 20 nt, Yersinia pestis
gaauagucacgcggcggcgu

SEQ ID NO: 4135902 - RNA, 23 nt, Yersinia pestis
gaauaguguguguauuuaaaaga

SEQ ID NO: 4135903 - RNA, 21 nt, Yersinia pestis
gaauauaaaagcacagacaaa

SEQ ID NO: 4135904 - RNA, 17 nt, Yersinia pestis
gaauauaaacauaaaaa

SEQ ID NO: 4135905 - RNA, 15 nt, Yersinia pestis
gaauauaaauuuaau

SEQ ID NO: 4135906 - RNA, 17 nt, Yersinia pestis
gaauaucaccauauuca

SEQ ID NO: 4135907 - RNA, 18 nt, Yersinia pestis
gaauaucaccauauucau

SEQ ID NO: 4135908 - RNA, 18 nt, Yersinia pestis
gaauaucuugcauacaac

SEQ ID NO: 4135909 - RNA, 15 nt, Yersinia pestis
gaauaugcuucauca

SEQ ID NO: 4135910 - RNA, 17 nt, Yersinia pestis
gaauaugucauuaccgc

SEQ ID NO: 4135911 - RNA, 12 nt, Yersinia pestis
gaauauuauuca

SEQ ID NO: 4135912 - RNA, 14 nt, Yersinia pestis
gaauauuuaaauua

SEQ ID NO: 4135913 - RNA, 20 nt, Yersinia pestis
gaauauuuaaauuacagaca

SEQ ID NO: 4135914 - RNA, 13 nt, Yersinia pestis
gaaucacugguga

SEQ ID NO: 4135915 - RNA, 20 nt, Yersinia pestis
gaaucacuggugugugucag

SEQ ID NO: 4135916 - RNA, 21 nt, Yersinia pestis
gaaucacugucaaaaagcacc

SEQ ID NO: 4135917 - RNA, 22 nt, Yersinia pestis
gaaucacuuauuggaaguacuu

SEQ ID NO: 4135918 - RNA, 14 nt, Yersinia pestis
gaauccaacccgua

SEQ ID NO: 4135919 - RNA, 13 nt, Yersinia pestis
gaauccgcuggcg

SEQ ID NO: 4135920 - RNA, 15 nt, Yersinia pestis
gaauccggauccagc

SEQ ID NO: 4135921 - RNA, 17 nt, Yersinia pestis
gaauccggauccagcgc

SEQ ID NO: 4135922 - RNA, 22 nt, Yersinia pestis
gaaucgccguagauuuaacccc

SEQ ID NO: 4135923 - RNA, 22 nt, Yersinia pestis
gaaucucuccagugcaaauuua

SEQ ID NO: 4135924 - RNA, 12 nt, Yersinia pestis
gaaugaaauauc

SEQ ID NO: 4135925 - RNA, 18 nt, Yersinia pestis
gaaugaaguucaccagcu

SEQ ID NO: 4135926 - RNA, 20 nt, Yersinia pestis
gaaugacgcggguuuugccg

SEQ ID NO: 4135927 - RNA, 16 nt, Yersinia pestis
gaaugaggcugagguu

SEQ ID NO: 4135928 - RNA, 19 nt, Yersinia pestis
gaaugaguugcccuaaaca

SEQ ID NO: 4135929 - RNA, 13 nt, Yersinia pestis
gaaugauugacuu

SEQ ID NO: 4135930 - RNA, 22 nt, Yersinia pestis
gaaugcgcccuuuuccgucagc

SEQ ID NO: 4135931 - RNA, 21 nt, Yersinia pestis
gaaugcgguucuguaucauau

SEQ ID NO: 4135932 - RNA, 19 nt, Yersinia pestis
gaaugcguugccgaaagcc

SEQ ID NO: 4135933 - RNA, 22 nt, Yersinia pestis
gaaugcguugccgaaagccaag

SEQ ID NO: 4135934 - RNA, 21 nt, Yersinia pestis
gaaugcuauauuuggcuuuca

SEQ ID NO: 4135935 - RNA, 13 nt, Yersinia pestis
gaauggaagauag

SEQ ID NO: 4135936 - RNA, 17 nt, Yersinia pestis
gaauggcaaagcacagu

SEQ ID NO: 4135937 - RNA, 13 nt, Yersinia pestis
gaauggcgcgacc

SEQ ID NO: 4135938 - RNA, 18 nt, Yersinia pestis
gaaugguacuugacgcug

SEQ ID NO: 4135939 - RNA, 20 nt, Yersinia pestis
gaaugguggguuacaggccg

SEQ ID NO: 4135940 - RNA, 21 nt, Yersinia pestis
gaaugucaugguuaaacugac

SEQ ID NO: 4135941 - RNA, 15 nt, Yersinia pestis
gaaugugaagagcgg

SEQ ID NO: 4135942 - RNA, 12 nt, Yersinia pestis
gaauuaaaacau

SEQ ID NO: 4135943 - RNA, 17 nt, Yersinia pestis
gaauuaacaauucucuc

SEQ ID NO: 4135944 - RNA, 17 nt, Yersinia pestis
gaauuaagaagccucau

SEQ ID NO: 4135945 - RNA, 10 nt, Yersinia pestis
gaauuaauaa

SEQ ID NO: 4135946 - RNA, 13 nt, Yersinia pestis
gaauuaucauauu

SEQ ID NO: 4135947 - RNA, 18 nt, Yersinia pestis
gaauuaucauauucauca

SEQ ID NO: 4135948 - RNA, 18 nt, Yersinia pestis
gaauuaucauccagauuc

SEQ ID NO: 4135949 - RNA, 20 nt, Yersinia pestis
gaauuauuugggguauauau

SEQ ID NO: 4135950 - RNA, 14 nt, Yersinia pestis
gaauucaccaaauu

SEQ ID NO: 4135951 - RNA, 17 nt, Yersinia pestis
gaauucaccaaauugca

SEQ ID NO: 4135952 - RNA, 13 nt, Yersinia pestis
gaauucagcagcg

SEQ ID NO: 4135953 - RNA, 19 nt, Yersinia pestis
gaauugucaucccaugcaa

SEQ ID NO: 4135954 - RNA, 19 nt, Yersinia pestis
gaauuuaagauaccagcga

SEQ ID NO: 4135955 - RNA, 19 nt, Yersinia pestis
gaauuuaugcaccaaauuc

SEQ ID NO: 4135956 - RNA, 12 nt, Yersinia pestis
gaauuugcuagc

SEQ ID NO: 4135957 - RNA, 23 nt, Yersinia pestis
gaauuuucuaacgcgccggauuc

SEQ ID NO: 4135958 - RNA, 20 nt, Yersinia pestis
gaauuuucucauuaauaaug

SEQ ID NO: 4135959 - RNA, 18 nt, Yersinia pestis
gacaaaccccgaugacgc

SEQ ID NO: 4135960 - RNA, 21 nt, Yersinia pestis
gacaaacggcgcgucgccaua

SEQ ID NO: 4135961 - RNA, 14 nt, Yersinia pestis
gacaaagagcccgc

SEQ ID NO: 4135962 - RNA, 18 nt, Yersinia pestis
gacaaauaaaacagaacc

SEQ ID NO: 4135963 - RNA, 21 nt, Yersinia pestis
gacaaauaaaacagaaccccc

SEQ ID NO: 4135964 - RNA, 16 nt, Yersinia pestis
gacaacaucaauggca

SEQ ID NO: 4135965 - RNA, 17 nt, Yersinia pestis
gacaacauugccaaauu

SEQ ID NO: 4135966 - RNA, 22 nt, Yersinia pestis
gacgauugcacuggcuaauacc

SEQ ID NO: 4135967 - RNA, 19 nt, Yersinia pestis
gacgcaaacggguggccgc

SEQ ID NO: 4135968 - RNA, 21 nt, Yersinia pestis
gacgcagcaggcguagcgugu

SEQ ID NO: 4135969 - RNA, 13 nt, Yersinia pestis
gacgcaguaagau

SEQ ID NO: 4135970 - RNA, 21 nt, Yersinia pestis
gacgcaguaaguuaguggugu

SEQ ID NO: 4135971 - RNA, 15 nt, Yersinia pestis
gacgccaacuucaag

SEQ ID NO: 4135972 - RNA, 23 nt, Yersinia pestis
gacgccccgaaccauuuaccauc

SEQ ID NO: 4135973 - RNA, 14 nt, Yersinia pestis
gacgcccgcagacu

SEQ ID NO: 4135974 - RNA, 14 nt, Yersinia pestis
gacgccggccgguu

SEQ ID NO: 4135975 - RNA, 18 nt, Yersinia pestis
gacgccguaaauacaucc

SEQ ID NO: 4135976 - RNA, 16 nt, Yersinia pestis
gacgccguacaaauau

SEQ ID NO: 4135977 - RNA, 15 nt, Yersinia pestis
gacgcgaucuugaac

SEQ ID NO: 4135978 - RNA, 18 nt, Yersinia pestis
gacgcguuugcuugcugc

SEQ ID NO: 4135979 - RNA, 23 nt, Yersinia pestis
gacgcuguauacggacaaugcca

SEQ ID NO: 4135980 - RNA, 13 nt, Yersinia pestis
gacgcuuauccug

SEQ ID NO: 4135981 - RNA, 22 nt, Yersinia pestis
gacgcuuuacuccucugccuau

SEQ ID NO: 4135982 - RNA, 12 nt, Yersinia pestis
gacggaacacgu

SEQ ID NO: 4135983 - RNA, 22 nt, Yersinia pestis
gacggacgugaauaugugcuug

SEQ ID NO: 4135984 - RNA, 19 nt, Yersinia pestis
gacggaugaaaagugaucc

SEQ ID NO: 4135985 - RNA, 19 nt, Yersinia pestis
gacggcggcgagcacugcc

SEQ ID NO: 4135986 - RNA, 17 nt, Yersinia pestis
gacggcgggguuuucag

SEQ ID NO: 4135987 - RNA, 20 nt, Yersinia pestis
gacguaaaaaggcagugaca

SEQ ID NO: 4135988 - RNA, 21 nt, Yersinia pestis
gacguaaaaaggcagugacag

SEQ ID NO: 4135989 - RNA, 19 nt, Yersinia pestis
gacguaauuuuaagccgca

SEQ ID NO: 4135990 - RNA, 13 nt, Yersinia pestis
gacgucauagaau

SEQ ID NO: 4135991 - RNA, 20 nt, Yersinia pestis
gacguccccggucaugagaa

SEQ ID NO: 4135992 - RNA, 18 nt, Yersinia pestis
gacgugagcguucaaaau

SEQ ID NO: 4135993 - RNA, 17 nt, Yersinia pestis
gacgugaggguucaagu

SEQ ID NO: 4135994 - RNA, 21 nt, Yersinia pestis
gacgugaggguucaagucccu

SEQ ID NO: 4135995 - RNA, 17 nt, Yersinia pestis
gacgugaugccaguaau

SEQ ID NO: 4135996 - RNA, 23 nt, Yersinia pestis
gacgugcagcgcgcagccaacgg

SEQ ID NO: 4135997 - RNA, 20 nt, Yersinia pestis
gacgugugcuguaagaaaaa

SEQ ID NO: 4135998 - RNA, 16 nt, Yersinia pestis
gacguuauuauugauu

SEQ ID NO: 4135999 - RNA, 22 nt, Yersinia pestis
gacguugcucccaucccucacg

SEQ ID NO: 4136000 - RNA, 14 nt, Yersinia pestis
gacuaaaaaccauc

SEQ ID NO: 4136001 - RNA, 18 nt, Yersinia pestis
gacuaaaaaccgccacag

SEQ ID NO: 4136002 - RNA, 16 nt, Yersinia pestis
gacuaaaauucaaaca

SEQ ID NO: 4136003 - RNA, 17 nt, Yersinia pestis
gacuaaacugaucauca

SEQ ID NO: 4136004 - RNA, 10 nt, Yersinia pestis
gacuaacucu

SEQ ID NO: 4136005 - RNA, 17 nt, Yersinia pestis
gacuaaggcaaccugag

SEQ ID NO: 4136006 - RNA, 21 nt, Yersinia pestis
gacuaauauuucaggcuguga

SEQ ID NO: 4136007 - RNA, 14 nt, Yersinia pestis
gacuaauuaaacaa

SEQ ID NO: 4136008 - RNA, 17 nt, Yersinia pestis
gacuaccaaccgcuuua

SEQ ID NO: 4136009 - RNA, 20 nt, Yersinia pestis
gacuaccggaaccgccgccu

SEQ ID NO: 4136010 - RNA, 22 nt, Yersinia pestis
gacuacgguguuuggugaagaa

SEQ ID NO: 4136011 - RNA, 15 nt, Yersinia pestis
gacuacuggcugggg

SEQ ID NO: 4136012 - RNA, 19 nt, Yersinia pestis
gacuauucccuuguuugcg

SEQ ID NO: 4136013 - RNA, 14 nt, Yersinia pestis
gacucaagccucua

SEQ ID NO: 4136014 - RNA, 16 nt, Yersinia pestis
gacucaauaaauccau

SEQ ID NO: 4136015 - RNA, 16 nt, Yersinia pestis
gacucaauaauauggg

SEQ ID NO: 4136016 - RNA, 16 nt, Yersinia pestis
gacucacgucaguaau

SEQ ID NO: 4136017 - RNA, 15 nt, Yersinia pestis
gacucaguaaauaua

SEQ ID NO: 4136018 - RNA, 14 nt, Yersinia pestis
gacuccaaauuagc

SEQ ID NO: 4136019 - RNA, 18 nt, Yersinia pestis
gacucccucaccgccuag

SEQ ID NO: 4136020 - RNA, 18 nt, Yersinia pestis
gacucccugacucccuca

SEQ ID NO: 4136021 - RNA, 15 nt, Yersinia pestis
gacuccugccccccc

SEQ ID NO: 4136022 - RNA, 23 nt, Yersinia pestis
gacucgauagaaaaagcaugguu

SEQ ID NO: 4136023 - RNA, 16 nt, Yersinia pestis
gacucgaucuugaacg

SEQ ID NO: 4136024 - RNA, 21 nt, Yersinia pestis
gacucugcgcucauacucagu

SEQ ID NO: 4136025 - RNA, 18 nt, Yersinia pestis
gacugaaaguagaaauaa

SEQ ID NO: 4136026 - RNA, 17 nt, Yersinia pestis
gacugaaauaaugguuu

SEQ ID NO: 4136027 - RNA, 21 nt, Yersinia pestis
gacugaacgggguuagcagac

SEQ ID NO: 4136028 - RNA, 21 nt, Yersinia pestis
gacugacaaccacuaaaccac

SEQ ID NO: 4136029 - RNA, 15 nt, Yersinia pestis
gacugagauuauuau

SEQ ID NO: 4136030 - RNA, 17 nt, Yersinia pestis
gacugauguaagcucau

SEQ ID NO: 4136031 - RNA, 18 nt, Yersinia pestis
gacugcagaaaaucacgu

SEQ ID NO: 4136032 - RNA, 16 nt, Yersinia pestis
gacugcccgccugcuu

SEQ ID NO: 4136033 - RNA, 21 nt, Yersinia pestis
gacugcuugccaaauauagca

SEQ ID NO: 4136034 - RNA, 14 nt, Yersinia pestis
gacugcuuuucaca

SEQ ID NO: 4136035 - RNA, 15 nt, Yersinia pestis
gacugcuuuucacau

SEQ ID NO: 4136036 - RNA, 15 nt, Yersinia pestis
gacuggacaaauaaa

SEQ ID NO: 4136037 - RNA, 22 nt, Yersinia pestis
gacuggcauuuuuauuuuaucu

SEQ ID NO: 4136038 - RNA, 19 nt, Yersinia pestis
gacuggucacucgaugacg

SEQ ID NO: 4136039 - RNA, 13 nt, Yersinia pestis
gacugguugcugg

SEQ ID NO: 4136040 - RNA, 14 nt, Yersinia pestis
gacugguugcuggu

SEQ ID NO: 4136041 - RNA, 23 nt, Yersinia pestis
gacugugguugccccaaaugcug

SEQ ID NO: 4136042 - RNA, 15 nt, Yersinia pestis
gacuguugaaguaca

SEQ ID NO: 4136043 - RNA, 22 nt, Yersinia pestis
gacuucuuacgcguaugcuggu

SEQ ID NO: 4136044 - RNA, 17 nt, Yersinia pestis
gacuucuuauuaaucaa

SEQ ID NO: 4136045 - RNA, 20 nt, Yersinia pestis
gacuuuaauuaaaaauagau

SEQ ID NO: 4136046 - RNA, 11 nt, Yersinia pestis
gacuuucaauc

SEQ ID NO: 4136047 - RNA, 15 nt, Yersinia pestis
gacuuuccacaacag

SEQ ID NO: 4136048 - RNA, 19 nt, Yersinia pestis
gacuuuccccagaugaaug

SEQ ID NO: 4136049 - RNA, 15 nt, Yersinia pestis
gacuuugauauuucu

SEQ ID NO: 4136050 - RNA, 21 nt, Yersinia pestis
gacuuuuuuuaaccaauuuug

SEQ ID NO: 4136051 - RNA, 21 nt, Yersinia pestis
gagaaauaaauacucuugaga

SEQ ID NO: 4136052 - RNA, 19 nt, Yersinia pestis
gagaacagcgaaucaagcu

SEQ ID NO: 4136053 - RNA, 13 nt, Yersinia pestis
gagaacaggcaga

SEQ ID NO: 4136054 - RNA, 22 nt, Yersinia pestis
gagaaccgauaacgccccggcc

SEQ ID NO: 4136055 - RNA, 22 nt, Yersinia pestis
gagaaccggggcgauacaccaa

SEQ ID NO: 4136056 - RNA, 16 nt, Yersinia pestis
gagaagugagaaguga

SEQ ID NO: 4136057 - RNA, 15 nt, Yersinia pestis
gagaauaaaaaugau

SEQ ID NO: 4136058 - RNA, 21 nt, Yersinia pestis
gagaauaccuggcgggucucc

SEQ ID NO: 4136059 - RNA, 20 nt, Yersinia pestis
gagaaucucuccagugcaaa

SEQ ID NO: 4136060 - RNA, 23 nt, Yersinia pestis
gagaaugguacuugacgcugcag

SEQ ID NO: 4136061 - RNA, 14 nt, Yersinia pestis
gagacaauuaacac

SEQ ID NO: 4136062 - RNA, 16 nt, Yersinia pestis
gagaccacagauaaau

SEQ ID NO: 4136063 - RNA, 13 nt, Yersinia pestis
gagaccagggcac

SEQ ID NO: 4136064 - RNA, 15 nt, Yersinia pestis
gagacccgauuucac

SEQ ID NO: 4136065 - RNA, 15 nt, Yersinia pestis
gagacccguuacugc

SEQ ID NO: 4136066 - RNA, 14 nt, Yersinia pestis
gagacggaaagagc

SEQ ID NO: 4136067 - RNA, 17 nt, Yersinia pestis
gagacgugcguuuuuga

SEQ ID NO: 4136068 - RNA, 14 nt, Yersinia pestis
gagagaaaauuucu

SEQ ID NO: 4136069 - RNA, 15 nt, Yersinia pestis
gagagaaccauuauu

SEQ ID NO: 4136070 - RNA, 16 nt, Yersinia pestis
gagagaggccagacac

SEQ ID NO: 4136071 - RNA, 11 nt, Yersinia pestis
gagagagugaa

SEQ ID NO: 4136072 - RNA, 13 nt, Yersinia pestis
gagagcaauagaa

SEQ ID NO: 4136073 - RNA, 13 nt, Yersinia pestis
gagagguugcaaa

SEQ ID NO: 4136074 - RNA, 12 nt, Yersinia pestis
gagagugaagau

SEQ ID NO: 4136075 - RNA, 17 nt, Yersinia pestis
gagagugauuauucugc

SEQ ID NO: 4136076 - RNA, 15 nt, Yersinia pestis
gagaguucacuuauu

SEQ ID NO: 4136077 - RNA, 19 nt, Yersinia pestis
gagauaacgcugauguagg

SEQ ID NO: 4136078 - RNA, 16 nt, Yersinia pestis
gagauauaaacuaaua

SEQ ID NO: 4136079 - RNA, 13 nt, Yersinia pestis
gagauaucaaaug

SEQ ID NO: 4136080 - RNA, 12 nt, Yersinia pestis
gagaucaguuca

SEQ ID NO: 4136081 - RNA, 17 nt, Yersinia pestis
gagaucaguucaguauu

SEQ ID NO: 4136082 - RNA, 20 nt, Yersinia pestis
gagaucugggcgacccaaag

SEQ ID NO: 4136083 - RNA, 13 nt, Yersinia pestis
gagaugcaguaag

SEQ ID NO: 4136084 - RNA, 21 nt, Yersinia pestis
gagauuauuggcgauuuaaug

SEQ ID NO: 4136085 - RNA, 14 nt, Yersinia pestis
gagauucaggagau

SEQ ID NO: 4136086 - RNA, 17 nt, Yersinia pestis
gagauuucagacugcug

SEQ ID NO: 4136087 - RNA, 19 nt, Yersinia pestis
gagauuucagacugcugac

SEQ ID NO: 4136088 - RNA, 21 nt, Yersinia pestis
gagucucaucaaggaaaaugg

SEQ ID NO: 4136089 - RNA, 23 nt, Yersinia pestis
gagugaaaucuccuguggcacau

SEQ ID NO: 4136090 - RNA, 17 nt, Yersinia pestis
gagugaagacaucgcca

SEQ ID NO: 4136091 - RNA, 17 nt, Yersinia pestis
gagugaagauuuuugau

SEQ ID NO: 4136092 - RNA, 19 nt, Yersinia pestis
gagugaaggguugaccgca

SEQ ID NO: 4136093 - RNA, 14 nt, Yersinia pestis
gagugaauagauaa

SEQ ID NO: 4136094 - RNA, 16 nt, Yersinia pestis
gagugaauuucuuccc

SEQ ID NO: 4136095 - RNA, 20 nt, Yersinia pestis
gagugccagcaaagacaaua

SEQ ID NO: 4136096 - RNA, 21 nt, Yersinia pestis
gagugcggccaucuaacugca

SEQ ID NO: 4136097 - RNA, 18 nt, Yersinia pestis
gaguggacgauaaauuca

SEQ ID NO: 4136098 - RNA, 19 nt, Yersinia pestis
gaguguucauaaauuaaaa

SEQ ID NO: 4136099 - RNA, 23 nt, Yersinia pestis
gaguguucggggguugucagcag

SEQ ID NO: 4136100 - RNA, 21 nt, Yersinia pestis
gaguuaucuguuucaaauaag

SEQ ID NO: 4136101 - RNA, 23 nt, Yersinia pestis
gaguuauucugauggucgucaug

SEQ ID NO: 4136102 - RNA, 14 nt, Yersinia pestis
gaguucucaccaag

SEQ ID NO: 4136103 - RNA, 22 nt, Yersinia pestis
gaguugauaaacaauaaacaga

SEQ ID NO: 4136104 - RNA, 17 nt, Yersinia pestis
gaguugaugcaauggca

SEQ ID NO: 4136105 - RNA, 20 nt, Yersinia pestis
gaguuugucgcucuggguua

SEQ ID NO: 4136106 - RNA, 14 nt, Yersinia pestis
gaguuuguggggag

SEQ ID NO: 4136107 - RNA, 14 nt, Yersinia pestis
gaguuuuagcccaa

SEQ ID NO: 4136108 - RNA, 18 nt, Yersinia pestis
gaguuuucagucgcaacu

SEQ ID NO: 4136109 - RNA, 18 nt, Yersinia pestis
gaguuuuuugcgccacaa

SEQ ID NO: 4136110 - RNA, 20 nt, Yersinia pestis
gauaaaaagaauaaguagcu

SEQ ID NO: 4136111 - RNA, 20 nt, Yersinia pestis
gauaaaaauaaucaaugacc

SEQ ID NO: 4136112 - RNA, 12 nt, Yersinia pestis
gauaaaaaugca

SEQ ID NO: 4136113 - RNA, 13 nt, Yersinia pestis
gauaaaacaauag

SEQ ID NO: 4136114 - RNA, 11 nt, Yersinia pestis
gauaaaaccac

SEQ ID NO: 4136115 - RNA, 14 nt, Yersinia pestis
gauaaaaccacuga

SEQ ID NO: 4136116 - RNA, 17 nt, Yersinia pestis
gauaaaacuauucugcu

SEQ ID NO: 4136117 - RNA, 18 nt, Yersinia pestis
gauaaaagaaagggcaac

SEQ ID NO: 4136118 - RNA, 23 nt, Yersinia pestis
gauaaaagaaagggcaacgacau

SEQ ID NO: 4136119 - RNA, 19 nt, Yersinia pestis
gauaaaaggcuauuuaaau

SEQ ID NO: 4136120 - RNA, 20 nt, Yersinia pestis
gauaaaaggcuauuuaaauu

SEQ ID NO: 4136121 - RNA, 15 nt, Yersinia pestis
gauaaacaaauauga

SEQ ID NO: 4136122 - RNA, 21 nt, Yersinia pestis
gauaaaccaacugaaacugga

SEQ ID NO: 4136123 - RNA, 22 nt, Yersinia pestis
gauaaacuguuuaagcuuuuua

SEQ ID NO: 4136124 - RNA, 15 nt, Yersinia pestis
gauaaagagugaaau

SEQ ID NO: 4136125 - RNA, 15 nt, Yersinia pestis
gauaaagcuggagcc

SEQ ID NO: 4136126 - RNA, 18 nt, Yersinia pestis
gauaaaggccgcagauaa

SEQ ID NO: 4136127 - RNA, 14 nt, Yersinia pestis
gauaaagucugaaa

SEQ ID NO: 4136128 - RNA, 17 nt, Yersinia pestis
gauaaagugaccgguaa

SEQ ID NO: 4136129 - RNA, 15 nt, Yersinia pestis
gauaaauaaccgagc

SEQ ID NO: 4136130 - RNA, 20 nt, Yersinia pestis
gauaaauaccgccaaauaca

SEQ ID NO: 4136131 - RNA, 14 nt, Yersinia pestis
gauaaauucaaaua

SEQ ID NO: 4136132 - RNA, 17 nt, Yersinia pestis
gauaacacgaguaauga

SEQ ID NO: 4136133 - RNA, 19 nt, Yersinia pestis
gauaacauuuuuucuuuua

SEQ ID NO: 4136134 - RNA, 23 nt, Yersinia pestis
gauaaccaaaucaccugacacca

SEQ ID NO: 4136135 - RNA, 23 nt, Yersinia pestis
gauaaccacaacgacagccaaau

SEQ ID NO: 4136136 - RNA, 15 nt, Yersinia pestis
gauaaccagagucag

SEQ ID NO: 4136137 - RNA, 22 nt, Yersinia pestis
gauaacccuaucgucagugcgg

SEQ ID NO: 4136138 - RNA, 19 nt, Yersinia pestis
gauaaccguuuuuucaacu

SEQ ID NO: 4136139 - RNA, 19 nt, Yersinia pestis
gauaaccucucgccgguua

SEQ ID NO: 4136140 - RNA, 19 nt, Yersinia pestis
gauaacgcuaagcgucuca

SEQ ID NO: 4136141 - RNA, 17 nt, Yersinia pestis
gauaacgggcagguuuu

SEQ ID NO: 4136142 - RNA, 21 nt, Yersinia pestis
gauaacgggcagguuuuucaa

SEQ ID NO: 4136143 - RNA, 16 nt, Yersinia pestis
gauaacuccaggguaa

SEQ ID NO: 4136144 - RNA, 14 nt, Yersinia pestis
gauaacuucauuuu

SEQ ID NO: 4136145 - RNA, 18 nt, Yersinia pestis
gauaacuuuuuauuucuu

SEQ ID NO: 4136146 - RNA, 15 nt, Yersinia pestis
gauaagaucucagca

SEQ ID NO: 4136147 - RNA, 18 nt, Yersinia pestis
gauaaggugcgggaugca

SEQ ID NO: 4136148 - RNA, 19 nt, Yersinia pestis
gauaaguuuuaauaucugc

SEQ ID NO: 4136149 - RNA, 20 nt, Yersinia pestis
gauaauaaauacccugcacc

SEQ ID NO: 4136150 - RNA, 13 nt, Yersinia pestis
gauaauaaauugc

SEQ ID NO: 4136151 - RNA, 17 nt, Yersinia pestis
gauaauaaccugauauu

SEQ ID NO: 4136152 - RNA, 20 nt, Yersinia pestis
gauaauagagaauagauagc

SEQ ID NO: 4136153 - RNA, 20 nt, Yersinia pestis
gauaaucaauuugucauguu

SEQ ID NO: 4136154 - RNA, 17 nt, Yersinia pestis
gauaaucacguucaacu

SEQ ID NO: 4136155 - RNA, 12 nt, Yersinia pestis
gauaaucuccau

SEQ ID NO: 4136156 - RNA, 20 nt, Yersinia pestis
gauaaucuccauugauucac

SEQ ID NO: 4136157 - RNA, 15 nt, Yersinia pestis
gauaaugccgcccau

SEQ ID NO: 4136158 - RNA, 20 nt, Yersinia pestis
gauaauggaugaauauccac

SEQ ID NO: 4136159 - RNA, 14 nt, Yersinia pestis
gauaauuaauucaa

SEQ ID NO: 4136160 - RNA, 18 nt, Yersinia pestis
gauaauuauccauuuucu

SEQ ID NO: 4136161 - RNA, 23 nt, Yersinia pestis
gauaauuauccauuuucugccaa

SEQ ID NO: 4136162 - RNA, 18 nt, Yersinia pestis
gauaauuggcaauaaugu

SEQ ID NO: 4136163 - RNA, 16 nt, Yersinia pestis
gauaauuucagcagca

SEQ ID NO: 4136164 - RNA, 19 nt, Yersinia pestis
gauaauuucagcagcacgu

SEQ ID NO: 4136165 - RNA, 23 nt, Yersinia pestis
gauacaaagugaaacccgcgcag

SEQ ID NO: 4136166 - RNA, 20 nt, Yersinia pestis
gauacaauucacccauacca

SEQ ID NO: 4136167 - RNA, 13 nt, Yersinia pestis
gauacaauuuuug

SEQ ID NO: 4136168 - RNA, 16 nt, Yersinia pestis
gauacagcccaagaga

SEQ ID NO: 4136169 - RNA, 14 nt, Yersinia pestis
gauacaucaaauca

SEQ ID NO: 4136170 - RNA, 15 nt, Yersinia pestis
gauacaucucggcuu

SEQ ID NO: 4136171 - RNA, 18 nt, Yersinia pestis
gauaccacaucaaaccgg

SEQ ID NO: 4136172 - RNA, 13 nt, Yersinia pestis
gauaccagcgacu

SEQ ID NO: 4136173 - RNA, 14 nt, Yersinia pestis
gauacccagcaggu

SEQ ID NO: 4136174 - RNA, 22 nt, Yersinia pestis
gauacccuccgacuuugauauu

SEQ ID NO: 4136175 - RNA, 22 nt, Yersinia pestis
gauaccgauaauaaauauccuc

SEQ ID NO: 4136176 - RNA, 13 nt, Yersinia pestis
gauacgacuucuu

SEQ ID NO: 4136177 - RNA, 13 nt, Yersinia pestis
gauacgcgcaccg

SEQ ID NO: 4136178 - RNA, 14 nt, Yersinia pestis
gauacgguccagca

SEQ ID NO: 4136179 - RNA, 18 nt, Yersinia pestis
gauacuacaaucaucggc

SEQ ID NO: 4136180 - RNA, 15 nt, Yersinia pestis
gauacugacccacau

SEQ ID NO: 4136181 - RNA, 14 nt, Yersinia pestis
gauacuggaagaaa

SEQ ID NO: 4136182 - RNA, 17 nt, Yersinia pestis
gauacuugaaacagcag

SEQ ID NO: 4136183 - RNA, 20 nt, Yersinia pestis
gauacuuucggguaucuguu

SEQ ID NO: 4136184 - RNA, 19 nt, Yersinia pestis
gauagacaguaacuaaagc

SEQ ID NO: 4136185 - RNA, 19 nt, Yersinia pestis
gauagagauaaaaaaaccg

SEQ ID NO: 4136186 - RNA, 13 nt, Yersinia pestis
gauagauuuucag

SEQ ID NO: 4136187 - RNA, 18 nt, Yersinia pestis
gauagcaacauucaacgc

SEQ ID NO: 4136188 - RNA, 16 nt, Yersinia pestis
gauagcaaucaauaag

SEQ ID NO: 4136189 - RNA, 16 nt, Yersinia pestis
gauagcaucauccagc

SEQ ID NO: 4136190 - RNA, 17 nt, Yersinia pestis
gauagcaucauccagcu

SEQ ID NO: 4136191 - RNA, 23 nt, Yersinia pestis
gauagccaaccccucugguguga

SEQ ID NO: 4136192 - RNA, 15 nt, Yersinia pestis
gauagccacuaacua

SEQ ID NO: 4136193 - RNA, 12 nt, Yersinia pestis
gauagccauaau

SEQ ID NO: 4136194 - RNA, 18 nt, Yersinia pestis
gauagccuauuucaccgc

SEQ ID NO: 4136195 - RNA, 18 nt, Yersinia pestis
gauagcgaaucacaucau

SEQ ID NO: 4136196 - RNA, 15 nt, Yersinia pestis
gauagcgcuucagug

SEQ ID NO: 4136197 - RNA, 18 nt, Yersinia pestis
gauagcuguuagccagau

SEQ ID NO: 4136198 - RNA, 15 nt, Yersinia pestis
gauaggcgaaauuga

SEQ ID NO: 4136199 - RNA, 14 nt, Yersinia pestis
gauagguuuuuccc

SEQ ID NO: 4136200 - RNA, 23 nt, Yersinia pestis
gauaguaacaccagcauccugca

SEQ ID NO: 4136201 - RNA, 13 nt, Yersinia pestis
gauaguacguagc

SEQ ID NO: 4136202 - RNA, 23 nt, Yersinia pestis
gauaguacguagcgauaacagau

SEQ ID NO: 4136203 - RNA, 13 nt, Yersinia pestis
gauaguacuuagc

SEQ ID NO: 4136204 - RNA, 21 nt, Yersinia pestis
gauagucauuuuauuuaggcu

SEQ ID NO: 4136205 - RNA, 16 nt, Yersinia pestis
gauagugaguauguau

SEQ ID NO: 4136206 - RNA, 22 nt, Yersinia pestis
gauagugauuuuuuucacccau

SEQ ID NO: 4136207 - RNA, 15 nt, Yersinia pestis
gauaguuaucuccca

SEQ ID NO: 4136208 - RNA, 13 nt, Yersinia pestis
gauaguuaucugg

SEQ ID NO: 4136209 - RNA, 12 nt, Yersinia pestis
gauauaaauaaa

SEQ ID NO: 4136210 - RNA, 21 nt, Yersinia pestis
gaugaacugacacacaccagu

SEQ ID NO: 4136211 - RNA, 18 nt, Yersinia pestis
gaugaagcauuaaacaga

SEQ ID NO: 4136212 - RNA, 19 nt, Yersinia pestis
gaugaagcauuaaacagau

SEQ ID NO: 4136213 - RNA, 20 nt, Yersinia pestis
gaugaauaugcuucaucacu

SEQ ID NO: 4136214 - RNA, 23 nt, Yersinia pestis
gaugaauaugcuucaucacuugc

SEQ ID NO: 4136215 - RNA, 16 nt, Yersinia pestis
gaugaaucaaugaaau

SEQ ID NO: 4136216 - RNA, 13 nt, Yersinia pestis
gaugaauccagcc

SEQ ID NO: 4136217 - RNA, 19 nt, Yersinia pestis
gaugaauguuccggacuuc

SEQ ID NO: 4136218 - RNA, 16 nt, Yersinia pestis
gaugacaaugcguuau

SEQ ID NO: 4136219 - RNA, 15 nt, Yersinia pestis
gaugacacaauuccc

SEQ ID NO: 4136220 - RNA, 14 nt, Yersinia pestis
gaugacacgaucuu

SEQ ID NO: 4136221 - RNA, 18 nt, Yersinia pestis
gaugacaggggauagcaa

SEQ ID NO: 4136222 - RNA, 16 nt, Yersinia pestis
gaugacguaauuuuaa

SEQ ID NO: 4136223 - RNA, 14 nt, Yersinia pestis
gaugagaaguaaaa

SEQ ID NO: 4136224 - RNA, 16 nt, Yersinia pestis
gaugagcguauucgga

SEQ ID NO: 4136225 - RNA, 18 nt, Yersinia pestis
gaugauaaguuugaugua

SEQ ID NO: 4136226 - RNA, 20 nt, Yersinia pestis
gaugauauacccaccagaga

SEQ ID NO: 4136227 - RNA, 13 nt, Yersinia pestis
gaugauaucaccu

SEQ ID NO: 4136228 - RNA, 16 nt, Yersinia pestis
gaugaucaaugugguu

SEQ ID NO: 4136229 - RNA, 21 nt, Yersinia pestis
gaugaugaagcauuaaacaga

SEQ ID NO: 4136230 - RNA, 17 nt, Yersinia pestis
gaugauuugucaauggg

SEQ ID NO: 4136231 - RNA, 18 nt, Yersinia pestis
gaugcacaguaggcugaa

SEQ ID NO: 4136232 - RNA, 16 nt, Yersinia pestis
gaugcaguagggcgcu

SEQ ID NO: 4136233 - RNA, 18 nt, Yersinia pestis
gaugcauccuugaucgcc

SEQ ID NO: 4136234 - RNA, 21 nt, Yersinia pestis
gaugcauguuauuggcuaaag

SEQ ID NO: 4136235 - RNA, 18 nt, Yersinia pestis
gaugcauuaagccucagu

SEQ ID NO: 4136236 - RNA, 19 nt, Yersinia pestis
gaugccaaauuaaucuugu

SEQ ID NO: 4136237 - RNA, 13 nt, Yersinia pestis
gaugccacuguuc

SEQ ID NO: 4136238 - RNA, 13 nt, Yersinia pestis
gaugccauuuacc

SEQ ID NO: 4136239 - RNA, 14 nt, Yersinia pestis
gaugccuaauaauu

SEQ ID NO: 4136240 - RNA, 18 nt, Yersinia pestis
gaugccuauuugcagaaa

SEQ ID NO: 4136241 - RNA, 15 nt, Yersinia pestis
gaugcgacaauuucc

SEQ ID NO: 4136242 - RNA, 17 nt, Yersinia pestis
gaugcgccuguuagggc

SEQ ID NO: 4136243 - RNA, 23 nt, Yersinia pestis
gaugcgcgacauuuugugcucug

SEQ ID NO: 4136244 - RNA, 18 nt, Yersinia pestis
gaugcgcgcgucacuaaa

SEQ ID NO: 4136245 - RNA, 14 nt, Yersinia pestis
gaugcgcuccgcca

SEQ ID NO: 4136246 - RNA, 13 nt, Yersinia pestis
gaugcguguaaug

SEQ ID NO: 4136247 - RNA, 17 nt, Yersinia pestis
gaugcuaaccgaauaaa

SEQ ID NO: 4136248 - RNA, 14 nt, Yersinia pestis
gaugcuuggcccga

SEQ ID NO: 4136249 - RNA, 21 nt, Yersinia pestis
gaugcuuucaucgaaaaaaau

SEQ ID NO: 4136250 - RNA, 14 nt, Yersinia pestis
gauggaguaaucau

SEQ ID NO: 4136251 - RNA, 13 nt, Yersinia pestis
gauggagugguca

SEQ ID NO: 4136252 - RNA, 16 nt, Yersinia pestis
gauggcauucguggug

SEQ ID NO: 4136253 - RNA, 14 nt, Yersinia pestis
gauggcccaagcca

SEQ ID NO: 4136254 - RNA, 16 nt, Yersinia pestis
gauggcgaucaagccc

SEQ ID NO: 4136255 - RNA, 18 nt, Yersinia pestis
gauggcgaucaagguuuc

SEQ ID NO: 4136256 - RNA, 19 nt, Yersinia pestis
gauggcuuuggugaucaug

SEQ ID NO: 4136257 - RNA, 16 nt, Yersinia pestis
gaugggaggaaacugc

SEQ ID NO: 4136258 - RNA, 12 nt, Yersinia pestis
gaugggccaaac

SEQ ID NO: 4136259 - RNA, 13 nt, Yersinia pestis
gauggucaacauu

SEQ ID NO: 4136260 - RNA, 22 nt, Yersinia pestis
gauggugcgccauuaaggccac

SEQ ID NO: 4136261 - RNA, 21 nt, Yersinia pestis
gaugguggcucugccaauaaa

SEQ ID NO: 4136262 - RNA, 17 nt, Yersinia pestis
gaugguguaacccgccu

SEQ ID NO: 4136263 - RNA, 20 nt, Yersinia pestis
gaugguuaacucauuuaucu

SEQ ID NO: 4136264 - RNA, 17 nt, Yersinia pestis
gaugguuaauccaccug

SEQ ID NO: 4136265 - RNA, 12 nt, Yersinia pestis
gauguaaaacac

SEQ ID NO: 4136266 - RNA, 14 nt, Yersinia pestis
gauguaaucugaau

SEQ ID NO: 4136267 - RNA, 13 nt, Yersinia pestis
gauguauccaagg

SEQ ID NO: 4136268 - RNA, 15 nt, Yersinia pestis
gaugucaucuuccgu

SEQ ID NO: 4136269 - RNA, 15 nt, Yersinia pestis
gaugucccagaaaua

SEQ ID NO: 4136270 - RNA, 17 nt, Yersinia pestis
gaugugauccacacagu

SEQ ID NO: 4136271 - RNA, 20 nt, Yersinia pestis
gaugugcucugcuccgccuu

SEQ ID NO: 4136272 - RNA, 23 nt, Yersinia pestis
gauguggauaauuucagcagcac

SEQ ID NO: 4136273 - RNA, 22 nt, Yersinia pestis
gauguguuuaaaucuuucucca

SEQ ID NO: 4136274 - RNA, 20 nt, Yersinia pestis
gauguuacgcuaucgcuaaa

SEQ ID NO: 4136275 - RNA, 14 nt, Yersinia pestis
gauguucgcuggug

SEQ ID NO: 4136276 - RNA, 14 nt, Yersinia pestis
gauguuuaaauugc

SEQ ID NO: 4136277 - RNA, 14 nt, Yersinia pestis
gauguuucuuugcg

SEQ ID NO: 4136278 - RNA, 18 nt, Yersinia pestis
gauguuuugcugccauuu

SEQ ID NO: 4136279 - RNA, 18 nt, Yersinia pestis
gauuaaauucuaccuggc

SEQ ID NO: 4136280 - RNA, 13 nt, Yersinia pestis
gauuaacauccau

SEQ ID NO: 4136281 - RNA, 19 nt, Yersinia pestis
gauuaaccuguaaaagcag

SEQ ID NO: 4136282 - RNA, 21 nt, Yersinia pestis
gauuaacuuuucuucauugcu

SEQ ID NO: 4136283 - RNA, 15 nt, Yersinia pestis
gauuaagacuuucuc

SEQ ID NO: 4136284 - RNA, 23 nt, Yersinia pestis
gauuaaggagcccucugucauua

SEQ ID NO: 4136285 - RNA, 15 nt, Yersinia pestis
gauuaauaaguaaau

SEQ ID NO: 4136286 - RNA, 16 nt, Yersinia pestis
gauuaauacaucauca

SEQ ID NO: 4136287 - RNA, 19 nt, Yersinia pestis
gauuaauaucaaaacugau

SEQ ID NO: 4136288 - RNA, 12 nt, Yersinia pestis
gauuaccaauaa

SEQ ID NO: 4136289 - RNA, 15 nt, Yersinia pestis
gauuaccaauaauua

SEQ ID NO: 4136290 - RNA, 15 nt, Yersinia pestis
gauuaccugcauauc

SEQ ID NO: 4136291 - RNA, 19 nt, Yersinia pestis
gauuacgggucagcucacc

SEQ ID NO: 4136292 - RNA, 11 nt, Yersinia pestis
gauuacuggcc

SEQ ID NO: 4136293 - RNA, 18 nt, Yersinia pestis
gauuacuggcuaucuuau

SEQ ID NO: 4136294 - RNA, 20 nt, Yersinia pestis
gauuagccugaccgguaaua

SEQ ID NO: 4136295 - RNA, 20 nt, Yersinia pestis
gauuagucuuagacgucaga

SEQ ID NO: 4136296 - RNA, 20 nt, Yersinia pestis
gauuaguuuuagacgucaga

SEQ ID NO: 4136297 - RNA, 13 nt, Yersinia pestis
gauuaugcugacc

SEQ ID NO: 4136298 - RNA, 22 nt, Yersinia pestis
gauuaugugcggcauauaacca

SEQ ID NO: 4136299 - RNA, 13 nt, Yersinia pestis
gauuauuaaacua

SEQ ID NO: 4136300 - RNA, 12 nt, Yersinia pestis
gauuauuauuca

SEQ ID NO: 4136301 - RNA, 16 nt, Yersinia pestis
gauuauuguuauccac

SEQ ID NO: 4136302 - RNA, 17 nt, Yersinia pestis
gauuauuuauuuacagc

SEQ ID NO: 4136303 - RNA, 15 nt, Yersinia pestis
gauucaagaaccgca

SEQ ID NO: 4136304 - RNA, 15 nt, Yersinia pestis
gauucaccuugauua

SEQ ID NO: 4136305 - RNA, 19 nt, Yersinia pestis
gauucagaaagguaugugc

SEQ ID NO: 4136306 - RNA, 15 nt, Yersinia pestis
gauucauuagccagc

SEQ ID NO: 4136307 - RNA, 19 nt, Yersinia pestis
gauucgcaaagcgggccag

SEQ ID NO: 4136308 - RNA, 21 nt, Yersinia pestis
gauucgcggcagagaucaugu

SEQ ID NO: 4136309 - RNA, 16 nt, Yersinia pestis
gauucgggugagugag

SEQ ID NO: 4136310 - RNA, 14 nt, Yersinia pestis
gauucguagaaaca

SEQ ID NO: 4136311 - RNA, 19 nt, Yersinia pestis
gauucguagaaacaucgcc

SEQ ID NO: 4136312 - RNA, 14 nt, Yersinia pestis
gauucgucugccau

SEQ ID NO: 4136313 - RNA, 18 nt, Yersinia pestis
gauugaccaucaaccgug

SEQ ID NO: 4136314 - RNA, 22 nt, Yersinia pestis
gauugacggaaaauuaacuuau

SEQ ID NO: 4136315 - RNA, 19 nt, Yersinia pestis
gauugagagaccagggcac

SEQ ID NO: 4136316 - RNA, 21 nt, Yersinia pestis
gauugcagaccaaucaauaca

SEQ ID NO: 4136317 - RNA, 22 nt, Yersinia pestis
gauugcuggcgcugaucaucau

SEQ ID NO: 4136318 - RNA, 14 nt, Yersinia pestis
gauugguuauccua

SEQ ID NO: 4136319 - RNA, 19 nt, Yersinia pestis
gauugguuuauccccuucg

SEQ ID NO: 4136320 - RNA, 13 nt, Yersinia pestis
gauuuaaacccuc

SEQ ID NO: 4136321 - RNA, 15 nt, Yersinia pestis
gauuuaaauaacagc

SEQ ID NO: 4136322 - RNA, 19 nt, Yersinia pestis
gauuuaaauauuauuuaau

SEQ ID NO: 4136323 - RNA, 12 nt, Yersinia pestis
gauuuaauccaa

SEQ ID NO: 4136324 - RNA, 19 nt, Yersinia pestis
gauuuacguguucuuaauu

SEQ ID NO: 4136325 - RNA, 24 nt, Yersinia pestis
gauuucaccuauaauuaacagcau

SEQ ID NO: 4136326 - RNA, 20 nt, Yersinia pestis
gauuucacggauaucaacau

SEQ ID NO: 4136327 - RNA, 14 nt, Yersinia pestis
gauuucacuuuccc

SEQ ID NO: 4136328 - RNA, 14 nt, Yersinia pestis
gauuucaucauuca

SEQ ID NO: 4136329 - RNA, 16 nt, Yersinia pestis
gauuugcggcaugaua

SEQ ID NO: 4136330 - RNA, 16 nt, Yersinia pestis
gauuugugcaaauaag

SEQ ID NO: 4136331 - RNA, 15 nt, Yersinia pestis
gauuuguugaugaau

SEQ ID NO: 4136332 - RNA, 22 nt, Yersinia pestis
gauuuguugaugaaugauggua

SEQ ID NO: 4136333 - RNA, 15 nt, Yersinia pestis
gcacacugacagcaa

SEQ ID NO: 4136334 - RNA, 17 nt, Yersinia pestis
gcacacugacagcaacg

SEQ ID NO: 4136335 - RNA, 17 nt, Yersinia pestis
gcacacuuuucacuccg

SEQ ID NO: 4136336 - RNA, 23 nt, Yersinia pestis
gcacacuuuucacuccggcauca

SEQ ID NO: 4136337 - RNA, 16 nt, Yersinia pestis
gcacagaaaaugucca

SEQ ID NO: 4136338 - RNA, 17 nt, Yersinia pestis
gcacagcgagauaaacu

SEQ ID NO: 4136339 - RNA, 21 nt, Yersinia pestis
gcacaggcaaaaagagucagu

SEQ ID NO: 4136340 - RNA, 15 nt, Yersinia pestis
gcacagguccaucag

SEQ ID NO: 4136341 - RNA, 18 nt, Yersinia pestis
gcacaguuaauuuucacc

SEQ ID NO: 4136342 - RNA, 13 nt, Yersinia pestis
gcacaguuuucuu

SEQ ID NO: 4136343 - RNA, 14 nt, Yersinia pestis
gcacauaaagcgca

SEQ ID NO: 4136344 - RNA, 16 nt, Yersinia pestis
gcacauacuaauagaa

SEQ ID NO: 4136345 - RNA, 18 nt, Yersinia pestis
gcacauacuaauagaaga

SEQ ID NO: 4136346 - RNA, 15 nt, Yersinia pestis
gcacauagggcucgg

SEQ ID NO: 4136347 - RNA, 18 nt, Yersinia pestis
gcacaucaaguacuucaa

SEQ ID NO: 4136348 - RNA, 24 nt, Yersinia pestis
gcacaucaauauaaaacaucucuu

SEQ ID NO: 4136349 - RNA, 19 nt, Yersinia pestis
gcacaucauuuauuuccaa

SEQ ID NO: 4136350 - RNA, 14 nt, Yersinia pestis
gcacaucgccauua

SEQ ID NO: 4136351 - RNA, 23 nt, Yersinia pestis
gcacaucgggauccgccugcugg

SEQ ID NO: 4136352 - RNA, 21 nt, Yersinia pestis
gcacauuacaagugccaaaug

SEQ ID NO: 4136353 - RNA, 14 nt, Yersinia pestis
gcaccaaugccggu

SEQ ID NO: 4136354 - RNA, 15 nt, Yersinia pestis
gcaccaccgacacca

SEQ ID NO: 4136355 - RNA, 14 nt, Yersinia pestis
gcaccacggucaga

SEQ ID NO: 4136356 - RNA, 12 nt, Yersinia pestis
gcaccagcacca

SEQ ID NO: 4136357 - RNA, 11 nt, Yersinia pestis
gcaccagcgca

SEQ ID NO: 4136358 - RNA, 14 nt, Yersinia pestis
gcaccagugccaau

SEQ ID NO: 4136359 - RNA, 22 nt, Yersinia pestis
gcaccaguugaccauuuuuauc

SEQ ID NO: 4136360 - RNA, 13 nt, Yersinia pestis
gcaccauccagca

SEQ ID NO: 4136361 - RNA, 14 nt, Yersinia pestis
gcaccauccagcaa

SEQ ID NO: 4136362 - RNA, 23 nt, Yersinia pestis
gcaccaugcugcuugauuugcug

SEQ ID NO: 4136363 - RNA, 14 nt, Yersinia pestis
gcaccauuugcccu

SEQ ID NO: 4136364 - RNA, 16 nt, Yersinia pestis
gcacccaauguauaug

SEQ ID NO: 4136365 - RNA, 14 nt, Yersinia pestis
gcacccuuacccug

SEQ ID NO: 4136366 - RNA, 13 nt, Yersinia pestis
gcaccgcccccuc

SEQ ID NO: 4136367 - RNA, 22 nt, Yersinia pestis
gcaccgccgucaaaccaagccc

SEQ ID NO: 4136368 - RNA, 13 nt, Yersinia pestis
gcaccgcgcuaua

SEQ ID NO: 4136369 - RNA, 21 nt, Yersinia pestis
gcaccgcgcuauaaaacagcu

SEQ ID NO: 4136370 - RNA, 21 nt, Yersinia pestis
gcaccgcugauaaccagcagc

SEQ ID NO: 4136371 - RNA, 15 nt, Yersinia pestis
gcaccggacaaacca

SEQ ID NO: 4136372 - RNA, 18 nt, Yersinia pestis
gcaccggauuuauugcuc

SEQ ID NO: 4136373 - RNA, 13 nt, Yersinia pestis
gcaccucaggguu

SEQ ID NO: 4136374 - RNA, 15 nt, Yersinia pestis
gcaccucggggcacu

SEQ ID NO: 4136375 - RNA, 16 nt, Yersinia pestis
gcaccugaucgugcca

SEQ ID NO: 4136376 - RNA, 12 nt, Yersinia pestis
gcaccuucacgc

SEQ ID NO: 4136377 - RNA, 16 nt, Yersinia pestis
gcaccuucugauuuuu

SEQ ID NO: 4136378 - RNA, 15 nt, Yersinia pestis
gcaccuuugucauug

SEQ ID NO: 4136379 - RNA, 19 nt, Yersinia pestis
gcaccuuugucauugagga

SEQ ID NO: 4136380 - RNA, 23 nt, Yersinia pestis
gcaccuuugucauugaggagcga

SEQ ID NO: 4136381 - RNA, 23 nt, Yersinia pestis
gcacgacggauuugguuggcuuu

SEQ ID NO: 4136382 - RNA, 16 nt, Yersinia pestis
gcacgcaggcggcggc

SEQ ID NO: 4136383 - RNA, 15 nt, Yersinia pestis
gcacgcuuucugcaa

SEQ ID NO: 4136384 - RNA, 16 nt, Yersinia pestis
gcacggccauuucuua

SEQ ID NO: 4136385 - RNA, 15 nt, Yersinia pestis
gcacggccgggugca

SEQ ID NO: 4136386 - RNA, 13 nt, Yersinia pestis
gcacgggccuugg

SEQ ID NO: 4136387 - RNA, 12 nt, Yersinia pestis
gcacgggcuauc

SEQ ID NO: 4136388 - RNA, 14 nt, Yersinia pestis
gcacguucagcagc

SEQ ID NO: 4136389 - RNA, 16 nt, Yersinia pestis
gcacguuuaauuucac

SEQ ID NO: 4136390 - RNA, 21 nt, Yersinia pestis
gcacguuuccccuucauuuga

SEQ ID NO: 4136391 - RNA, 18 nt, Yersinia pestis
gcacguuuuucagcuucu

SEQ ID NO: 4136392 - RNA, 22 nt, Yersinia pestis
gcacuaaaaucugcucccggca

SEQ ID NO: 4136393 - RNA, 16 nt, Yersinia pestis
gcacuaucacaucaaa

SEQ ID NO: 4136394 - RNA, 24 nt, Yersinia pestis
gcacucaaauagauagcaaucaau

SEQ ID NO: 4136395 - RNA, 15 nt, Yersinia pestis
gcacucauaaugcug

SEQ ID NO: 4136396 - RNA, 19 nt, Yersinia pestis
gcacuccacuaugcccagu

SEQ ID NO: 4136397 - RNA, 23 nt, Yersinia pestis
gcacuccagauaacauacaccau

SEQ ID NO: 4136398 - RNA, 22 nt, Yersinia pestis
gcacuccccgcccguagaaaau

SEQ ID NO: 4136399 - RNA, 16 nt, Yersinia pestis
gcacugacacuccccu

SEQ ID NO: 4136400 - RNA, 18 nt, Yersinia pestis
gcacugauagcaauccca

SEQ ID NO: 4136401 - RNA, 17 nt, Yersinia pestis
gcacugauucucuucac

SEQ ID NO: 4136402 - RNA, 18 nt, Yersinia pestis
gcacugauucucuucacc

SEQ ID NO: 4136403 - RNA, 19 nt, Yersinia pestis
gcacugauucucuucaccu

SEQ ID NO: 4136404 - RNA, 15 nt, Yersinia pestis
gcacugcagaaaaug

SEQ ID NO: 4136405 - RNA, 17 nt, Yersinia pestis
gcacugcagaaaaugcg

SEQ ID NO: 4136406 - RNA, 23 nt, Yersinia pestis
gcacugcagaaaaugcggcggcu

SEQ ID NO: 4136407 - RNA, 17 nt, Yersinia pestis
gcacugcaucugaccag

SEQ ID NO: 4136408 - RNA, 12 nt, Yersinia pestis
gcacugccacca

SEQ ID NO: 4136409 - RNA, 18 nt, Yersinia pestis
gcacugccccgaagcuca

SEQ ID NO: 4136410 - RNA, 20 nt, Yersinia pestis
gcacugccccgaagcucaag

SEQ ID NO: 4136411 - RNA, 18 nt, Yersinia pestis
gcacugcgcgaucccaga

SEQ ID NO: 4136412 - RNA, 21 nt, Yersinia pestis
gcacugcgcguugccauucag

SEQ ID NO: 4136413 - RNA, 16 nt, Yersinia pestis
gcacugcgggcaggua

SEQ ID NO: 4136414 - RNA, 23 nt, Yersinia pestis
gcacugggucaucacccagcaaa

SEQ ID NO: 4136415 - RNA, 22 nt, Yersinia pestis
gcacugugagcggcauccagua

SEQ ID NO: 4136416 - RNA, 14 nt, Yersinia pestis
gcacuucaaccuga

SEQ ID NO: 4136417 - RNA, 16 nt, Yersinia pestis
gcacuucaaccugauc

SEQ ID NO: 4136418 - RNA, 19 nt, Yersinia pestis
gcacuucaaccugauccag

SEQ ID NO: 4136419 - RNA, 17 nt, Yersinia pestis
gcacuuuaaauacccag

SEQ ID NO: 4136420 - RNA, 21 nt, Yersinia pestis
gcacuuuaaucgccaggccac

SEQ ID NO: 4136421 - RNA, 22 nt, Yersinia pestis
gcacuuuuacugguucauuuuc

SEQ ID NO: 4136422 - RNA, 14 nt, Yersinia pestis
gcacuuuuauacau

SEQ ID NO: 4136423 - RNA, 19 nt, Yersinia pestis
gcacuuuucgucauuauua

SEQ ID NO: 4136424 - RNA, 15 nt, Yersinia pestis
gcagaaaucagccau

SEQ ID NO: 4136425 - RNA, 22 nt, Yersinia pestis
gcagaaaucagccauaucaaaa

SEQ ID NO: 4136426 - RNA, 14 nt, Yersinia pestis
gcagaacaaaacaa

SEQ ID NO: 4136427 - RNA, 16 nt, Yersinia pestis
gcagaaccauggcacu

SEQ ID NO: 4136428 - RNA, 22 nt, Yersinia pestis
gcagaacuagcgccgcaucaaa

SEQ ID NO: 4136429 - RNA, 12 nt, Yersinia pestis
gcagaagagguu

SEQ ID NO: 4136430 - RNA, 17 nt, Yersinia pestis
gcagaagaguaaagcgu

SEQ ID NO: 4136431 - RNA, 20 nt, Yersinia pestis
gcagaaguccugauucgcga

SEQ ID NO: 4136432 - RNA, 15 nt, Yersinia pestis
gcagaaucacuggca

SEQ ID NO: 4136433 - RNA, 22 nt, Yersinia pestis
gcagaaucacuggcagaaguug

SEQ ID NO: 4136434 - RNA, 13 nt, Yersinia pestis
gcagacagcgagc

SEQ ID NO: 4136435 - RNA, 22 nt, Yersinia pestis
gcagacaugauuaaaucaagcu

SEQ ID NO: 4136436 - RNA, 23 nt, Yersinia pestis
gcagaccaaucaauacacuggca

SEQ ID NO: 4136437 - RNA, 22 nt, Yersinia pestis
gcagacccgugaacaucuggcg

SEQ ID NO: 4136438 - RNA, 21 nt, Yersinia pestis
gcagacucuuauauaaaucca

SEQ ID NO: 4136439 - RNA, 19 nt, Yersinia pestis
gcagacugcugacaaaccc

SEQ ID NO: 4136440 - RNA, 16 nt, Yersinia pestis
gcagacuuacgcgaug

SEQ ID NO: 4136441 - RNA, 20 nt, Yersinia pestis
gcagagagcgacucacgacg

SEQ ID NO: 4136442 - RNA, 14 nt, Yersinia pestis
gcagagaggagaau

SEQ ID NO: 4136443 - RNA, 21 nt, Yersinia pestis
gcagagaucauguaguacuua

SEQ ID NO: 4136444 - RNA, 15 nt, Yersinia pestis
gcagagcaaaacugg

SEQ ID NO: 4136445 - RNA, 18 nt, Yersinia pestis
gcagagccugacucacag

SEQ ID NO: 4136446 - RNA, 18 nt, Yersinia pestis
gcagaguccucucaccaa

SEQ ID NO: 4136447 - RNA, 19 nt, Yersinia pestis
gcagaguccucucaccaag

SEQ ID NO: 4136448 - RNA, 21 nt, Yersinia pestis
gcagaguucggucauaaaaac

SEQ ID NO: 4136449 - RNA, 15 nt, Yersinia pestis
gcagauaccacauca

SEQ ID NO: 4136450 - RNA, 19 nt, Yersinia pestis
gcagauaucagccagugcu

SEQ ID NO: 4136451 - RNA, 19 nt, Yersinia pestis
gcagauauuggcgaccauc

SEQ ID NO: 4136452 - RNA, 17 nt, Yersinia pestis
gcagaucggcauuauua

SEQ ID NO: 4136453 - RNA, 21 nt, Yersinia pestis
gcagaucguaaagacgccgua

SEQ ID NO: 4136454 - RNA, 23 nt, Yersinia pestis
gcagaucugcccccccuuucacc

SEQ ID NO: 4136455 - RNA, 15 nt, Yersinia pestis
gcaucccagccacca

SEQ ID NO: 4136456 - RNA, 19 nt, Yersinia pestis
gcauccccacuuguaccug

SEQ ID NO: 4136457 - RNA, 14 nt, Yersinia pestis
gcauccccaucgcc

SEQ ID NO: 4136458 - RNA, 22 nt, Yersinia pestis
gcauccgcgaugacacaauucc

SEQ ID NO: 4136459 - RNA, 15 nt, Yersinia pestis
gcauccguacccgcu

SEQ ID NO: 4136460 - RNA, 19 nt, Yersinia pestis
gcauccucagggcgaugca

SEQ ID NO: 4136461 - RNA, 22 nt, Yersinia pestis
gcauccuugaucgccaaauaaa

SEQ ID NO: 4136462 - RNA, 15 nt, Yersinia pestis
gcaucgagaacgggc

SEQ ID NO: 4136463 - RNA, 17 nt, Yersinia pestis
gcaucgccuguauuuua

SEQ ID NO: 4136464 - RNA, 20 nt, Yersinia pestis
gcaucgcgacugagaagcgg

SEQ ID NO: 4136465 - RNA, 20 nt, Yersinia pestis
gcaucgcgguuuuuccgccg

SEQ ID NO: 4136466 - RNA, 12 nt, Yersinia pestis
gcaucgcugagg

SEQ ID NO: 4136467 - RNA, 19 nt, Yersinia pestis
gcaucgucaaauuccccca

SEQ ID NO: 4136468 - RNA, 14 nt, Yersinia pestis
gcaucuaaucggcu

SEQ ID NO: 4136469 - RNA, 19 nt, Yersinia pestis
gcaucuccgcgaccacaug

SEQ ID NO: 4136470 - RNA, 16 nt, Yersinia pestis
gcaucugaaagcuuca

SEQ ID NO: 4136471 - RNA, 21 nt, Yersinia pestis
gcaucugcaauggcuggcaag

SEQ ID NO: 4136472 - RNA, 15 nt, Yersinia pestis
gcaucuuccaaagga

SEQ ID NO: 4136473 - RNA, 18 nt, Yersinia pestis
gcaucuuuugcuauugaa

SEQ ID NO: 4136474 - RNA, 13 nt, Yersinia pestis
gcaugaaacacag

SEQ ID NO: 4136475 - RNA, 16 nt, Yersinia pestis
gcaugaaguuuaacca

SEQ ID NO: 4136476 - RNA, 16 nt, Yersinia pestis
gcaugaauauucacca

SEQ ID NO: 4136477 - RNA, 13 nt, Yersinia pestis
gcaugaccaagca

SEQ ID NO: 4136478 - RNA, 24 nt, Yersinia pestis
gcaugacuagugccacaacaagcc

SEQ ID NO: 4136479 - RNA, 21 nt, Yersinia pestis
gcaugauagacgcaucgacca

SEQ ID NO: 4136480 - RNA, 14 nt, Yersinia pestis
gcaugccauccugc

SEQ ID NO: 4136481 - RNA, 14 nt, Yersinia pestis
gcaugcccagccuc

SEQ ID NO: 4136482 - RNA, 20 nt, Yersinia pestis
gcauggaagauaucuaauuu

SEQ ID NO: 4136483 - RNA, 15 nt, Yersinia pestis
gcaugggcuugcaua

SEQ ID NO: 4136484 - RNA, 23 nt, Yersinia pestis
gcaugguguagcugaacaaacuu

SEQ ID NO: 4136485 - RNA, 22 nt, Yersinia pestis
gcauguagcugcagccgcgaug

SEQ ID NO: 4136486 - RNA, 16 nt, Yersinia pestis
gcauguggaagcgggc

SEQ ID NO: 4136487 - RNA, 23 nt, Yersinia pestis
gcauguuauuggcuaaaguguac

SEQ ID NO: 4136488 - RNA, 23 nt, Yersinia pestis
gcauguuccuguugcuggccagu

SEQ ID NO: 4136489 - RNA, 15 nt, Yersinia pestis
gcauuaaaaucaccc

SEQ ID NO: 4136490 - RNA, 22 nt, Yersinia pestis
gcauuaaggcgcgacugauuga

SEQ ID NO: 4136491 - RNA, 19 nt, Yersinia pestis
gcauuagacauucaagccu

SEQ ID NO: 4136492 - RNA, 15 nt, Yersinia pestis
gcauuagugaaucau

SEQ ID NO: 4136493 - RNA, 22 nt, Yersinia pestis
gcauucagguguucagccaagu

SEQ ID NO: 4136494 - RNA, 21 nt, Yersinia pestis
gcauucauaucguccaaaggg

SEQ ID NO: 4136495 - RNA, 21 nt, Yersinia pestis
gcauucgugccauaaaguuuu

SEQ ID NO: 4136496 - RNA, 14 nt, Yersinia pestis
gcauuggauaauuu

SEQ ID NO: 4136497 - RNA, 20 nt, Yersinia pestis
gcauuggguaauaucaccau

SEQ ID NO: 4136498 - RNA, 16 nt, Yersinia pestis
gcauuguuggcccgca

SEQ ID NO: 4136499 - RNA, 21 nt, Yersinia pestis
gcauuguuggcccgcaucuuu

SEQ ID NO: 4136500 - RNA, 19 nt, Yersinia pestis
gcauuguuggguaaucauc

SEQ ID NO: 4136501 - RNA, 19 nt, Yersinia pestis
gcauuuaauguucgcugac

SEQ ID NO: 4136502 - RNA, 20 nt, Yersinia pestis
gcauuuaucauauuaacaua

SEQ ID NO: 4136503 - RNA, 16 nt, Yersinia pestis
gcauuuaugaugcauu

SEQ ID NO: 4136504 - RNA, 14 nt, Yersinia pestis
gcauuucaacaaaa

SEQ ID NO: 4136505 - RNA, 13 nt, Yersinia pestis
gcauuucacccuc

SEQ ID NO: 4136506 - RNA, 21 nt, Yersinia pestis
gcauuucacccucugcagcuu

SEQ ID NO: 4136507 - RNA, 23 nt, Yersinia pestis
gcauuugggugagggcaauuaaa

SEQ ID NO: 4136508 - RNA, 23 nt, Yersinia pestis
gcauuuuaguuuuauacccguua

SEQ ID NO: 4136509 - RNA, 16 nt, Yersinia pestis
gcauuuuaucgugaau

SEQ ID NO: 4136510 - RNA, 22 nt, Yersinia pestis
gcauuuuuuucacaccacggcg

SEQ ID NO: 4136511 - RNA, 20 nt, Yersinia pestis
gccaaaaaauaagggccacc

SEQ ID NO: 4136512 - RNA, 15 nt, Yersinia pestis
gccaaaacagccuaa

SEQ ID NO: 4136513 - RNA, 20 nt, Yersinia pestis
gccaaaauaaacaucaaugu

SEQ ID NO: 4136514 - RNA, 14 nt, Yersinia pestis
gccaaacaaaugaa

SEQ ID NO: 4136515 - RNA, 16 nt, Yersinia pestis
gccaaacaaauguuua

SEQ ID NO: 4136516 - RNA, 16 nt, Yersinia pestis
gccaaaccauggcuca

SEQ ID NO: 4136517 - RNA, 19 nt, Yersinia pestis
gccaaaccauggcucacca

SEQ ID NO: 4136518 - RNA, 12 nt, Yersinia pestis
gccaaacugcuc

SEQ ID NO: 4136519 - RNA, 15 nt, Yersinia pestis
gccaaauuauucauc

SEQ ID NO: 4136520 - RNA, 20 nt, Yersinia pestis
gccaaauugugaguuaaaaa

SEQ ID NO: 4136521 - RNA, 22 nt, Yersinia pestis
gccaaauugugaguuaaaaaua

SEQ ID NO: 4136522 - RNA, 19 nt, Yersinia pestis
gccaacacucaugacaaaa

SEQ ID NO: 4136523 - RNA, 13 nt, Yersinia pestis
gccaacaggcccc

SEQ ID NO: 4136524 - RNA, 14 nt, Yersinia pestis
gccaacaggccccu

SEQ ID NO: 4136525 - RNA, 18 nt, Yersinia pestis
gccaacagugaauaacug

SEQ ID NO: 4136526 - RNA, 16 nt, Yersinia pestis
gccaaccagcucaccg

SEQ ID NO: 4136527 - RNA, 21 nt, Yersinia pestis
gccaaccggcgaagggcgcag

SEQ ID NO: 4136528 - RNA, 22 nt, Yersinia pestis
gccaaccggcgaagggcgcagc

SEQ ID NO: 4136529 - RNA, 20 nt, Yersinia pestis
gccaacgggguauuuaaccc

SEQ ID NO: 4136530 - RNA, 11 nt, Yersinia pestis
gccaacgugua

SEQ ID NO: 4136531 - RNA, 20 nt, Yersinia pestis
gccaagcaagcggcagcgcu

SEQ ID NO: 4136532 - RNA, 13 nt, Yersinia pestis
gccaagccaguaa

SEQ ID NO: 4136533 - RNA, 20 nt, Yersinia pestis
gccaagcgccgugcauaaug

SEQ ID NO: 4136534 - RNA, 23 nt, Yersinia pestis
gccaagcuacggccuguaccacc

SEQ ID NO: 4136535 - RNA, 21 nt, Yersinia pestis
gccaaggcaaggauggcgcgg

SEQ ID NO: 4136536 - RNA, 20 nt, Yersinia pestis
gccaaggccagcgccccauc

SEQ ID NO: 4136537 - RNA, 14 nt, Yersinia pestis
gccaauaaaacgcc

SEQ ID NO: 4136538 - RNA, 14 nt, Yersinia pestis
gccaauaaagucca

SEQ ID NO: 4136539 - RNA, 22 nt, Yersinia pestis
gccaauaaccgcagcaggcaga

SEQ ID NO: 4136540 - RNA, 13 nt, Yersinia pestis
gccaauaggcccc

SEQ ID NO: 4136541 - RNA, 14 nt, Yersinia pestis
gccaauaggccccu

SEQ ID NO: 4136542 - RNA, 19 nt, Yersinia pestis
gccaauauguuagcagcac

SEQ ID NO: 4136543 - RNA, 15 nt, Yersinia pestis
gccaauauugaccaa

SEQ ID NO: 4136544 - RNA, 18 nt, Yersinia pestis
gccaauauugccuucacc

SEQ ID NO: 4136545 - RNA, 21 nt, Yersinia pestis
gccaaucggccuuaaccaagc

SEQ ID NO: 4136546 - RNA, 22 nt, Yersinia pestis
gccaaugacaaaggguaauuaa

SEQ ID NO: 4136547 - RNA, 22 nt, Yersinia pestis
gccaaugccaagaauaauuacu

SEQ ID NO: 4136548 - RNA, 18 nt, Yersinia pestis
gccaaugccucuucaaua

SEQ ID NO: 4136549 - RNA, 22 nt, Yersinia pestis
gccaaugcgguuuuucuugcca

SEQ ID NO: 4136550 - RNA, 20 nt, Yersinia pestis
gccaauggccacugcgggca

SEQ ID NO: 4136551 - RNA, 23 nt, Yersinia pestis
gccaauggccacugcgggcagua

SEQ ID NO: 4136552 - RNA, 18 nt, Yersinia pestis
gccaauuuggggcugcuu

SEQ ID NO: 4136553 - RNA, 21 nt, Yersinia pestis
gccacacaaaucgucgucagc

SEQ ID NO: 4136554 - RNA, 18 nt, Yersinia pestis
gccacacaauacauagaa

SEQ ID NO: 4136555 - RNA, 16 nt, Yersinia pestis
gccacaggcugcaugg

SEQ ID NO: 4136556 - RNA, 18 nt, Yersinia pestis
gccacaggcugcaugggu

SEQ ID NO: 4136557 - RNA, 16 nt, Yersinia pestis
gccacagucgccguca

SEQ ID NO: 4136558 - RNA, 17 nt, Yersinia pestis
gccaccaaauaaaacaa

SEQ ID NO: 4136559 - RNA, 13 nt, Yersinia pestis
gccaccagacuga

SEQ ID NO: 4136560 - RNA, 13 nt, Yersinia pestis
gccaccagcgcca

SEQ ID NO: 4136561 - RNA, 17 nt, Yersinia pestis
gccaccgcauuccagcg

SEQ ID NO: 4136562 - RNA, 13 nt, Yersinia pestis
gccaccgcuggug

SEQ ID NO: 4136563 - RNA, 15 nt, Yersinia pestis
gccaccggcaguuca

SEQ ID NO: 4136564 - RNA, 14 nt, Yersinia pestis
gccaccucuuccuc

SEQ ID NO: 4136565 - RNA, 13 nt, Yersinia pestis
gccaccuucuuau

SEQ ID NO: 4136566 - RNA, 15 nt, Yersinia pestis
gccacgaugugaagc

SEQ ID NO: 4136567 - RNA, 13 nt, Yersinia pestis
gccacgccaguaa

SEQ ID NO: 4136568 - RNA, 17 nt, Yersinia pestis
gccacgccaguaaacag

SEQ ID NO: 4136569 - RNA, 22 nt, Yersinia pestis
gccacggaaacguucaggcuuu

SEQ ID NO: 4136570 - RNA, 20 nt, Yersinia pestis
gccacggccgccuucaacug

SEQ ID NO: 4136571 - RNA, 21 nt, Yersinia pestis
gccacggcgagaccuacucgc

SEQ ID NO: 4136572 - RNA, 15 nt, Yersinia pestis
gccacguaauaccac

SEQ ID NO: 4136573 - RNA, 17 nt, Yersinia pestis
gccacuacgaccccaac

SEQ ID NO: 4136574 - RNA, 21 nt, Yersinia pestis
gccacuacggcgacuugccgu

SEQ ID NO: 4136575 - RNA, 12 nt, Yersinia pestis
gccacuggccug

SEQ ID NO: 4136576 - RNA, 16 nt, Yersinia pestis
gcccagccucuggaua

SEQ ID NO: 4136577 - RNA, 16 nt, Yersinia pestis
gcccagcguucucugg

SEQ ID NO: 4136578 - RNA, 21 nt, Yersinia pestis
gcccagcguuggcagaaagug

SEQ ID NO: 4136579 - RNA, 18 nt, Yersinia pestis
gcccauaaauuuaucgau

SEQ ID NO: 4136580 - RNA, 20 nt, Yersinia pestis
gcccaucaugccagcaauau

SEQ ID NO: 4136581 - RNA, 18 nt, Yersinia pestis
gcccauccgcaggaagca

SEQ ID NO: 4136582 - RNA, 19 nt, Yersinia pestis
gcccauccuguucaaaagg

SEQ ID NO: 4136583 - RNA, 19 nt, Yersinia pestis
gcccaucuauggaccucac

SEQ ID NO: 4136584 - RNA, 21 nt, Yersinia pestis
gcccaucuaugggcuucgcca

SEQ ID NO: 4136585 - RNA, 14 nt, Yersinia pestis
gcccaugaccacuu

SEQ ID NO: 4136586 - RNA, 20 nt, Yersinia pestis
gcccauggcugaaauaacuu

SEQ ID NO: 4136587 - RNA, 16 nt, Yersinia pestis
gcccauuaguaauggg

SEQ ID NO: 4136588 - RNA, 22 nt, Yersinia pestis
gccccaaauaaucagcucauua

SEQ ID NO: 4136589 - RNA, 13 nt, Yersinia pestis
gccccaaaugcca

SEQ ID NO: 4136590 - RNA, 14 nt, Yersinia pestis
gccccaaaugccag

SEQ ID NO: 4136591 - RNA, 15 nt, Yersinia pestis
gccccaaaugccagc

SEQ ID NO: 4136592 - RNA, 22 nt, Yersinia pestis
gccccaaccaucuccggcugac

SEQ ID NO: 4136593 - RNA, 15 nt, Yersinia pestis
gccccaagcauagaa

SEQ ID NO: 4136594 - RNA, 17 nt, Yersinia pestis
gccccaauagauagaga

SEQ ID NO: 4136595 - RNA, 17 nt, Yersinia pestis
gccccagcccagcaggc

SEQ ID NO: 4136596 - RNA, 12 nt, Yersinia pestis
gccccaucagca

SEQ ID NO: 4136597 - RNA, 22 nt, Yersinia pestis
gccccauccugacgaaugacuc

SEQ ID NO: 4136598 - RNA, 22 nt, Yersinia pestis
gccccaugguuacgccagcagc

SEQ ID NO: 4136599 - RNA, 14 nt, Yersinia pestis
gcccccaaugacac

SEQ ID NO: 4136600 - RNA, 17 nt, Yersinia pestis
gcccccccuuucaccaa

SEQ ID NO: 4136601 - RNA, 18 nt, Yersinia pestis
gcccccuagugauggggg

SEQ ID NO: 4136602 - RNA, 14 nt, Yersinia pestis
gccccgauaaacca

SEQ ID NO: 4136603 - RNA, 14 nt, Yersinia pestis
gccccgccuaucag

SEQ ID NO: 4136604 - RNA, 18 nt, Yersinia pestis
gccccgcgcuaaccaacg

SEQ ID NO: 4136605 - RNA, 22 nt, Yersinia pestis
gccccggcaaguugaucacccg

SEQ ID NO: 4136606 - RNA, 17 nt, Yersinia pestis
gccccucagacugcuga

SEQ ID NO: 4136607 - RNA, 15 nt, Yersinia pestis
gccccuugcuucagu

SEQ ID NO: 4136608 - RNA, 21 nt, Yersinia pestis
gcccgaucaggugaugucagc

SEQ ID NO: 4136609 - RNA, 16 nt, Yersinia pestis
gcccgauccccugcuu

SEQ ID NO: 4136610 - RNA, 20 nt, Yersinia pestis
gcccgaugguggcagccugc

SEQ ID NO: 4136611 - RNA, 16 nt, Yersinia pestis
gcccgcaacgggagag

SEQ ID NO: 4136612 - RNA, 21 nt, Yersinia pestis
gcccgcaauuuuaaaggcaac

SEQ ID NO: 4136613 - RNA, 13 nt, Yersinia pestis
gcccgcagacugc

SEQ ID NO: 4136614 - RNA, 16 nt, Yersinia pestis
gcccgccccaauagau

SEQ ID NO: 4136615 - RNA, 14 nt, Yersinia pestis
gcccgcgcauauag

SEQ ID NO: 4136616 - RNA, 12 nt, Yersinia pestis
gcccgcuaucac

SEQ ID NO: 4136617 - RNA, 14 nt, Yersinia pestis
gcccggaagguuuc

SEQ ID NO: 4136618 - RNA, 18 nt, Yersinia pestis
gcccggcucauccgccaa

SEQ ID NO: 4136619 - RNA, 22 nt, Yersinia pestis
gcccggcugauauaacaaguua

SEQ ID NO: 4136620 - RNA, 16 nt, Yersinia pestis
gcccgguaucaccuuu

SEQ ID NO: 4136621 - RNA, 15 nt, Yersinia pestis
gcccgguugagugag

SEQ ID NO: 4136622 - RNA, 17 nt, Yersinia pestis
gcccguugcccaccgag

SEQ ID NO: 4136623 - RNA, 14 nt, Yersinia pestis
gcccuaacauugag

SEQ ID NO: 4136624 - RNA, 23 nt, Yersinia pestis
gcccuaaccgcuuuuuacccagu

SEQ ID NO: 4136625 - RNA, 16 nt, Yersinia pestis
gcccuaauaaccgaca

SEQ ID NO: 4136626 - RNA, 12 nt, Yersinia pestis
gcccuacuggcu

SEQ ID NO: 4136627 - RNA, 15 nt, Yersinia pestis
gcccuacuggcugaa

SEQ ID NO: 4136628 - RNA, 22 nt, Yersinia pestis
gcccucguuguuguaugacaag

SEQ ID NO: 4136629 - RNA, 13 nt, Yersinia pestis
gcccucuugaacg

SEQ ID NO: 4136630 - RNA, 16 nt, Yersinia pestis
gcccugaauuucaaua

SEQ ID NO: 4136631 - RNA, 17 nt, Yersinia pestis
gcccugccauaaccgcu

SEQ ID NO: 4136632 - RNA, 20 nt, Yersinia pestis
gcccugccugguauuuucua

SEQ ID NO: 4136633 - RNA, 23 nt, Yersinia pestis
gcccugcuaauuugacgccgccg

SEQ ID NO: 4136634 - RNA, 13 nt, Yersinia pestis
gcccugcucuucu

SEQ ID NO: 4136635 - RNA, 15 nt, Yersinia pestis
gcccugcucuucugg

SEQ ID NO: 4136636 - RNA, 15 nt, Yersinia pestis
gcccugugaaucuuu

SEQ ID NO: 4136637 - RNA, 14 nt, Yersinia pestis
gcccuguuucauuu

SEQ ID NO: 4136638 - RNA, 15 nt, Yersinia pestis
gcccuguuucauuuc

SEQ ID NO: 4136639 - RNA, 19 nt, Yersinia pestis
gcccuuacuauuuuucuca

SEQ ID NO: 4136640 - RNA, 19 nt, Yersinia pestis
gcccuuaucuacugggcca

SEQ ID NO: 4136641 - RNA, 19 nt, Yersinia pestis
gcccuucgggucaacgcug

SEQ ID NO: 4136642 - RNA, 20 nt, Yersinia pestis
gcccuugagggucgcccgga

SEQ ID NO: 4136643 - RNA, 17 nt, Yersinia pestis
gcccuugccauaaaugg

SEQ ID NO: 4136644 - RNA, 15 nt, Yersinia pestis
gcccuuggcugguga

SEQ ID NO: 4136645 - RNA, 14 nt, Yersinia pestis
gcccuuguaagaua

SEQ ID NO: 4136646 - RNA, 19 nt, Yersinia pestis
gcccuuuuugguuuucuau

SEQ ID NO: 4136647 - RNA, 17 nt, Yersinia pestis
gccgaaccccuagccag

SEQ ID NO: 4136648 - RNA, 14 nt, Yersinia pestis
gccgaaccugcaug

SEQ ID NO: 4136649 - RNA, 18 nt, Yersinia pestis
gccgaaccuuuugccagu

SEQ ID NO: 4136650 - RNA, 22 nt, Yersinia pestis
gccgaaccuuuugccaguaacg

SEQ ID NO: 4136651 - RNA, 21 nt, Yersinia pestis
gccgaacucgucauucaccac

SEQ ID NO: 4136652 - RNA, 18 nt, Yersinia pestis
gccgaaugauucauugag

SEQ ID NO: 4136653 - RNA, 12 nt, Yersinia pestis
gccgacaaaccc

SEQ ID NO: 4136654 - RNA, 22 nt, Yersinia pestis
gccgacaauaccgccacacaau

SEQ ID NO: 4136655 - RNA, 13 nt, Yersinia pestis
gccgacaauacug

SEQ ID NO: 4136656 - RNA, 20 nt, Yersinia pestis
gccgacgaucuugcccaaug

SEQ ID NO: 4136657 - RNA, 13 nt, Yersinia pestis
gccgagaacagaa

SEQ ID NO: 4136658 - RNA, 15 nt, Yersinia pestis
gccgaguaaucagag

SEQ ID NO: 4136659 - RNA, 23 nt, Yersinia pestis
gccgaguugacuuuuuuuaacca

SEQ ID NO: 4136660 - RNA, 19 nt, Yersinia pestis
gccgauacgcgccgcagca

SEQ ID NO: 4136661 - RNA, 16 nt, Yersinia pestis
gccgauauacacccca

SEQ ID NO: 4136662 - RNA, 23 nt, Yersinia pestis
gccgaucauaaaucacaauuuca

SEQ ID NO: 4136663 - RNA, 19 nt, Yersinia pestis
gccgauccgggaaaaaaua

SEQ ID NO: 4136664 - RNA, 19 nt, Yersinia pestis
gccgaugaauaugcuucau

SEQ ID NO: 4136665 - RNA, 22 nt, Yersinia pestis
gccgaugagcuucuucaaaagc

SEQ ID NO: 4136666 - RNA, 20 nt, Yersinia pestis
gccgaugaucucuggccgug

SEQ ID NO: 4136667 - RNA, 15 nt, Yersinia pestis
gccgaugcgacaauu

SEQ ID NO: 4136668 - RNA, 20 nt, Yersinia pestis
gccgauggugugcagcaaga

SEQ ID NO: 4136669 - RNA, 20 nt, Yersinia pestis
gccgauugcgcuucuuguug

SEQ ID NO: 4136670 - RNA, 23 nt, Yersinia pestis
gccgcaacagugacgggugagag

SEQ ID NO: 4136671 - RNA, 15 nt, Yersinia pestis
gccgcacacagcccu

SEQ ID NO: 4136672 - RNA, 16 nt, Yersinia pestis
gccgcacacaucuguc

SEQ ID NO: 4136673 - RNA, 12 nt, Yersinia pestis
gccgcauacaua

SEQ ID NO: 4136674 - RNA, 14 nt, Yersinia pestis
gccgcaucaaagcg

SEQ ID NO: 4136675 - RNA, 18 nt, Yersinia pestis
gccgcauugauccucguu

SEQ ID NO: 4136676 - RNA, 14 nt, Yersinia pestis
gccgcauuguucuc

SEQ ID NO: 4136677 - RNA, 14 nt, Yersinia pestis
gccgccacaggcga

SEQ ID NO: 4136678 - RNA, 21 nt, Yersinia pestis
gccgccagauuauccagcccu

SEQ ID NO: 4136679 - RNA, 22 nt, Yersinia pestis
gccgccagucauucaccugccc

SEQ ID NO: 4136680 - RNA, 13 nt, Yersinia pestis
gccgccgccagcc

SEQ ID NO: 4136681 - RNA, 14 nt, Yersinia pestis
gccgccgccagccc

SEQ ID NO: 4136682 - RNA, 18 nt, Yersinia pestis
gccgccuucaacugugga

SEQ ID NO: 4136683 - RNA, 14 nt, Yersinia pestis
gccgcgaaaaacca

SEQ ID NO: 4136684 - RNA, 15 nt, Yersinia pestis
gccgcgaauaacaga

SEQ ID NO: 4136685 - RNA, 16 nt, Yersinia pestis
gccgcgauaaaaaaua

SEQ ID NO: 4136686 - RNA, 12 nt, Yersinia pestis
gccgcgccaucc

SEQ ID NO: 4136687 - RNA, 16 nt, Yersinia pestis
gccgcgccauccuugg

SEQ ID NO: 4136688 - RNA, 17 nt, Yersinia pestis
gccgcgguuaagcuagc

SEQ ID NO: 4136689 - RNA, 17 nt, Yersinia pestis
gccgcuaguuugacgcu

SEQ ID NO: 4136690 - RNA, 21 nt, Yersinia pestis
gccgcuauuggcgagcaugac

SEQ ID NO: 4136691 - RNA, 14 nt, Yersinia pestis
gccgcucgcggaca

SEQ ID NO: 4136692 - RNA, 19 nt, Yersinia pestis
gccgcuggcgauccccuuc

SEQ ID NO: 4136693 - RNA, 21 nt, Yersinia pestis
gccgcuucggucucuggaugc

SEQ ID NO: 4136694 - RNA, 17 nt, Yersinia pestis
gccgcuuguugccaccc

SEQ ID NO: 4136695 - RNA, 18 nt, Yersinia pestis
gccgcuuguugccacccu

SEQ ID NO: 4136696 - RNA, 19 nt, Yersinia pestis
gccgcuuuagcgaugacca

SEQ ID NO: 4136697 - RNA, 23 nt, Yersinia pestis
gccggaauugcgcuucgcgcagc

SEQ ID NO: 4136698 - RNA, 23 nt, Yersinia pestis
gcgaauuaucauccagauucaga

SEQ ID NO: 4136699 - RNA, 13 nt, Yersinia pestis
gcgacaaccugua

SEQ ID NO: 4136700 - RNA, 19 nt, Yersinia pestis
gcgacaccaagaggcugcg

SEQ ID NO: 4136701 - RNA, 17 nt, Yersinia pestis
gcgacauuuugugcucu

SEQ ID NO: 4136702 - RNA, 13 nt, Yersinia pestis
gcgacccaaagcu

SEQ ID NO: 4136703 - RNA, 13 nt, Yersinia pestis
gcgacuuuuauuu

SEQ ID NO: 4136704 - RNA, 19 nt, Yersinia pestis
gcgagaaagucaaagcgcu

SEQ ID NO: 4136705 - RNA, 20 nt, Yersinia pestis
gcgagauauaaacuaauauc

SEQ ID NO: 4136706 - RNA, 13 nt, Yersinia pestis
gcgagcacugccc

SEQ ID NO: 4136707 - RNA, 14 nt, Yersinia pestis
gcgagcacugcccc

SEQ ID NO: 4136708 - RNA, 13 nt, Yersinia pestis
gcgagcaugacac

SEQ ID NO: 4136709 - RNA, 23 nt, Yersinia pestis
gcgaggagguaugacgagcggua

SEQ ID NO: 4136710 - RNA, 15 nt, Yersinia pestis
gcgaggcuucucagc

SEQ ID NO: 4136711 - RNA, 22 nt, Yersinia pestis
gcgagggccuuucugaacaaaa

SEQ ID NO: 4136712 - RNA, 23 nt, Yersinia pestis
gcgaguaguugucaagagugcga

SEQ ID NO: 4136713 - RNA, 17 nt, Yersinia pestis
gcgagucagcacagaac

SEQ ID NO: 4136714 - RNA, 21 nt, Yersinia pestis
gcgagugaaccgcgcucugcu

SEQ ID NO: 4136715 - RNA, 23 nt, Yersinia pestis
gcgauaaaagauuuccuuucgca

SEQ ID NO: 4136716 - RNA, 19 nt, Yersinia pestis
gcgauaaagagugaaauau

SEQ ID NO: 4136717 - RNA, 17 nt, Yersinia pestis
gcgauaaauuagauaug

SEQ ID NO: 4136718 - RNA, 21 nt, Yersinia pestis
gcgauacaccauuuccaggcu

SEQ ID NO: 4136719 - RNA, 18 nt, Yersinia pestis
gcgauaccuuuugcugca

SEQ ID NO: 4136720 - RNA, 16 nt, Yersinia pestis
gcgauagauuuucagc

SEQ ID NO: 4136721 - RNA, 17 nt, Yersinia pestis
gcgaucaauacaccaga

SEQ ID NO: 4136722 - RNA, 14 nt, Yersinia pestis
gcgaucacaauaca

SEQ ID NO: 4136723 - RNA, 21 nt, Yersinia pestis
gcgaucacaauacagcaaaua

SEQ ID NO: 4136724 - RNA, 23 nt, Yersinia pestis
gcgaucaccaguacgccgacaau

SEQ ID NO: 4136725 - RNA, 17 nt, Yersinia pestis
gcgauccagugaaauca

SEQ ID NO: 4136726 - RNA, 19 nt, Yersinia pestis
gcgaucccagaauggcaaa

SEQ ID NO: 4136727 - RNA, 20 nt, Yersinia pestis
gcgaucuauucucuguaaug

SEQ ID NO: 4136728 - RNA, 20 nt, Yersinia pestis
gcgaugaggcucuucugggc

SEQ ID NO: 4136729 - RNA, 19 nt, Yersinia pestis
gcgcaaaugcguagcgggg

SEQ ID NO: 4136730 - RNA, 14 nt, Yersinia pestis
gcgcaagcgcugcu

SEQ ID NO: 4136731 - RNA, 17 nt, Yersinia pestis
gcgcacauagggcucgg

SEQ ID NO: 4136732 - RNA, 14 nt, Yersinia pestis
gcgcaccagcucaa

SEQ ID NO: 4136733 - RNA, 22 nt, Yersinia pestis
gcgcaccgaaauagucgcgcug

SEQ ID NO: 4136734 - RNA, 22 nt, Yersinia pestis
gcgcacguucccaggccaaggu

SEQ ID NO: 4136735 - RNA, 16 nt, Yersinia pestis
gcgcacucauccucug

SEQ ID NO: 4136736 - RNA, 15 nt, Yersinia pestis
gcgcagaguauccag

SEQ ID NO: 4136737 - RNA, 21 nt, Yersinia pestis
gcgcagaguccucucaccaag

SEQ ID NO: 4136738 - RNA, 18 nt, Yersinia pestis
gcgcagauuauggguggu

SEQ ID NO: 4136739 - RNA, 19 nt, Yersinia pestis
gcgcaggcagauugagugc

SEQ ID NO: 4136740 - RNA, 20 nt, Yersinia pestis
gcgcagguaaugucacugcc

SEQ ID NO: 4136741 - RNA, 16 nt, Yersinia pestis
gcgcagguuaugcagc

SEQ ID NO: 4136742 - RNA, 15 nt, Yersinia pestis
gcgcagguucaucag

SEQ ID NO: 4136743 - RNA, 19 nt, Yersinia pestis
gcgcaguaacuguguuuga

SEQ ID NO: 4136744 - RNA, 14 nt, Yersinia pestis
gcgcagucaucauu

SEQ ID NO: 4136745 - RNA, 23 nt, Yersinia pestis
gcgcagugcauugcagaaagcug

SEQ ID NO: 4136746 - RNA, 23 nt, Yersinia pestis
gcgcagugcucgggugccucacg

SEQ ID NO: 4136747 - RNA, 16 nt, Yersinia pestis
gcgcauaugaaaaacc

SEQ ID NO: 4136748 - RNA, 20 nt, Yersinia pestis
gcgcaucgacuugcucuuga

SEQ ID NO: 4136749 - RNA, 12 nt, Yersinia pestis
gcgcaucgccau

SEQ ID NO: 4136750 - RNA, 14 nt, Yersinia pestis
gcgcaucgccaucc

SEQ ID NO: 4136751 - RNA, 20 nt, Yersinia pestis
gcgcaucugcugcacuuaac

SEQ ID NO: 4136752 - RNA, 17 nt, Yersinia pestis
gcgcauuucacccucug

SEQ ID NO: 4136753 - RNA, 18 nt, Yersinia pestis
gcgccaaauguagagcgu

SEQ ID NO: 4136754 - RNA, 18 nt, Yersinia pestis
gcgccaaugacaaagggu

SEQ ID NO: 4136755 - RNA, 12 nt, Yersinia pestis
gcgccacaaccc

SEQ ID NO: 4136756 - RNA, 14 nt, Yersinia pestis
gcgccacaucggcg

SEQ ID NO: 4136757 - RNA, 15 nt, Yersinia pestis
gcgccagacuggccg

SEQ ID NO: 4136758 - RNA, 17 nt, Yersinia pestis
gcgccagggagggcgcg

SEQ ID NO: 4136759 - RNA, 14 nt, Yersinia pestis
gcgccauacugcag

SEQ ID NO: 4136760 - RNA, 16 nt, Yersinia pestis
gcgccauauauugauc

SEQ ID NO: 4136761 - RNA, 23 nt, Yersinia pestis
gcgccaucgcuaaucauauccau

SEQ ID NO: 4136762 - RNA, 14 nt, Yersinia pestis
gcgcccauccgcag

SEQ ID NO: 4136763 - RNA, 16 nt, Yersinia pestis
gcgcccauccgcagga

SEQ ID NO: 4136764 - RNA, 18 nt, Yersinia pestis
gcgcccaugccggauggu

SEQ ID NO: 4136765 - RNA, 18 nt, Yersinia pestis
gcgcccggcccacuucgu

SEQ ID NO: 4136766 - RNA, 13 nt, Yersinia pestis
gcgccgacugcug

SEQ ID NO: 4136767 - RNA, 14 nt, Yersinia pestis
gcgccgacugcuga

SEQ ID NO: 4136768 - RNA, 17 nt, Yersinia pestis
gcgccgcggcccugagg

SEQ ID NO: 4136769 - RNA, 23 nt, Yersinia pestis
gcgccgcuucggucucuggaugc

SEQ ID NO: 4136770 - RNA, 19 nt, Yersinia pestis
gcgccguaaaaagcagcaa

SEQ ID NO: 4136771 - RNA, 20 nt, Yersinia pestis
gcgccuaccugccugcugcu

SEQ ID NO: 4136772 - RNA, 18 nt, Yersinia pestis
gcgccuccagucccccuc

SEQ ID NO: 4136773 - RNA, 23 nt, Yersinia pestis
gcgccuccagucccccucacaag

SEQ ID NO: 4136774 - RNA, 22 nt, Yersinia pestis
gcgccuccaguuuuccagagcc

SEQ ID NO: 4136775 - RNA, 12 nt, Yersinia pestis
gcgccugauugg

SEQ ID NO: 4136776 - RNA, 12 nt, Yersinia pestis
gcgccugcgcua

SEQ ID NO: 4136777 - RNA, 15 nt, Yersinia pestis
gcgccugugggcggc

SEQ ID NO: 4136778 - RNA, 16 nt, Yersinia pestis
gcgccuguuagggcgc

SEQ ID NO: 4136779 - RNA, 17 nt, Yersinia pestis
gcgccuguuagggcgcg

SEQ ID NO: 4136780 - RNA, 19 nt, Yersinia pestis
gcgccuguuagggcgcggc

SEQ ID NO: 4136781 - RNA, 17 nt, Yersinia pestis
gcgccuuccuuuuauuu

SEQ ID NO: 4136782 - RNA, 12 nt, Yersinia pestis
gcgcgauaguca

SEQ ID NO: 4136783 - RNA, 22 nt, Yersinia pestis
gcgcgaucccagaauggcaaag

SEQ ID NO: 4136784 - RNA, 20 nt, Yersinia pestis
gcgcgcacuuacccgaauca

SEQ ID NO: 4136785 - RNA, 19 nt, Yersinia pestis
gcgcgcauuacccgaauca

SEQ ID NO: 4136786 - RNA, 19 nt, Yersinia pestis
gcgcgcccagacgccggcc

SEQ ID NO: 4136787 - RNA, 22 nt, Yersinia pestis
gcgcggcuaaauauaaccaaag

SEQ ID NO: 4136788 - RNA, 21 nt, Yersinia pestis
gcgcggcugguaacagagccu

SEQ ID NO: 4136789 - RNA, 18 nt, Yersinia pestis
gcgcguaucguccagcag

SEQ ID NO: 4136790 - RNA, 19 nt, Yersinia pestis
gcgcguaucguccagcagc

SEQ ID NO: 4136791 - RNA, 22 nt, Yersinia pestis
gcgcgugguuuccuggaacgaa

SEQ ID NO: 4136792 - RNA, 19 nt, Yersinia pestis
gcgcuaaaggcaucgccug

SEQ ID NO: 4136793 - RNA, 15 nt, Yersinia pestis
gcgcucauacucagu

SEQ ID NO: 4136794 - RNA, 14 nt, Yersinia pestis
gcgcucauuucccg

SEQ ID NO: 4136795 - RNA, 18 nt, Yersinia pestis
gcgcugagcgggcggcaa

SEQ ID NO: 4136796 - RNA, 13 nt, Yersinia pestis
gcgcugcagcgau

SEQ ID NO: 4136797 - RNA, 13 nt, Yersinia pestis
gcgcuuaaauaaa

SEQ ID NO: 4136798 - RNA, 16 nt, Yersinia pestis
gcgcuuaauucuggcc

SEQ ID NO: 4136799 - RNA, 20 nt, Yersinia pestis
gcgcuuacuuacccgaauca

SEQ ID NO: 4136800 - RNA, 19 nt, Yersinia pestis
gcgcuucacccugugcuuu

SEQ ID NO: 4136801 - RNA, 16 nt, Yersinia pestis
gcgcuuccagcucugg

SEQ ID NO: 4136802 - RNA, 21 nt, Yersinia pestis
gcgcuucgagcccccagggaa

SEQ ID NO: 4136803 - RNA, 13 nt, Yersinia pestis
gcgcuuugcagua

SEQ ID NO: 4136804 - RNA, 15 nt, Yersinia pestis
gcggaaauaaacauc

SEQ ID NO: 4136805 - RNA, 22 nt, Yersinia pestis
gcggaauauuuaaccagagauu

SEQ ID NO: 4136806 - RNA, 15 nt, Yersinia pestis
gcggacauggcaaca

SEQ ID NO: 4136807 - RNA, 18 nt, Yersinia pestis
gcggacgcuuuacuccuc

SEQ ID NO: 4136808 - RNA, 16 nt, Yersinia pestis
gcggauaacggcggca

SEQ ID NO: 4136809 - RNA, 20 nt, Yersinia pestis
gcggcaccgccgucaaacca

SEQ ID NO: 4136810 - RNA, 22 nt, Yersinia pestis
gcggcaccuucacgcaucacau

SEQ ID NO: 4136811 - RNA, 13 nt, Yersinia pestis
gcggcagagccaa

SEQ ID NO: 4136812 - RNA, 22 nt, Yersinia pestis
gcggcagcgaagaacaacgggc

SEQ ID NO: 4136813 - RNA, 23 nt, Yersinia pestis
gcggcaggcaugguaagaauaaa

SEQ ID NO: 4136814 - RNA, 17 nt, Yersinia pestis
gcggcauauaaccaugc

SEQ ID NO: 4136815 - RNA, 13 nt, Yersinia pestis
gcggcaucaccaa

SEQ ID NO: 4136816 - RNA, 14 nt, Yersinia pestis
gcggcaucaccaaa

SEQ ID NO: 4136817 - RNA, 12 nt, Yersinia pestis
gcggcauccagu

SEQ ID NO: 4136818 - RNA, 11 nt, Yersinia pestis
gcggccaauag

SEQ ID NO: 4136819 - RNA, 16 nt, Yersinia pestis
gcggccaugucaggcc

SEQ ID NO: 4136820 - RNA, 17 nt, Yersinia pestis
gcuacagcucagacugg

SEQ ID NO: 4136821 - RNA, 21 nt, Yersinia pestis
gcuacaggcgcaacugccaug

SEQ ID NO: 4136822 - RNA, 17 nt, Yersinia pestis
gcuacagguagcgguga

SEQ ID NO: 4136823 - RNA, 22 nt, Yersinia pestis
gcuaccaagacuucaugacuac

SEQ ID NO: 4136824 - RNA, 19 nt, Yersinia pestis
gcuaccagagaaccgacag

SEQ ID NO: 4136825 - RNA, 19 nt, Yersinia pestis
gcuaccaggaagcggccag

SEQ ID NO: 4136826 - RNA, 21 nt, Yersinia pestis
gcuaccaggaagcggccaggu

SEQ ID NO: 4136827 - RNA, 14 nt, Yersinia pestis
gcuaccaugaguga

SEQ ID NO: 4136828 - RNA, 19 nt, Yersinia pestis
gcuaccgcgcugcuugcaa

SEQ ID NO: 4136829 - RNA, 21 nt, Yersinia pestis
gcuaccgcgcugcuugcaaca

SEQ ID NO: 4136830 - RNA, 14 nt, Yersinia pestis
gcuaccggaaccaa

SEQ ID NO: 4136831 - RNA, 24 nt, Yersinia pestis
gcuaccgguuaaacuucuuuaucu

SEQ ID NO: 4136832 - RNA, 19 nt, Yersinia pestis
gcuaccucguaguaaugac

SEQ ID NO: 4136833 - RNA, 18 nt, Yersinia pestis
gcuacggcaccuuuuuug

SEQ ID NO: 4136834 - RNA, 18 nt, Yersinia pestis
gcuacggucguuacuugg

SEQ ID NO: 4136835 - RNA, 15 nt, Yersinia pestis
gcuacgguucaucau

SEQ ID NO: 4136836 - RNA, 14 nt, Yersinia pestis
gcuacguacuaucu

SEQ ID NO: 4136837 - RNA, 23 nt, Yersinia pestis
gcuacguuuaucgugcaguaaug

SEQ ID NO: 4136838 - RNA, 17 nt, Yersinia pestis
gcuacugcgagucuugg

SEQ ID NO: 4136839 - RNA, 21 nt, Yersinia pestis
gcuacugcgagucuugguaga

SEQ ID NO: 4136840 - RNA, 16 nt, Yersinia pestis
gcuacugguagcagcc

SEQ ID NO: 4136841 - RNA, 21 nt, Yersinia pestis
gcuacuuaauaucuaacugau

SEQ ID NO: 4136842 - RNA, 15 nt, Yersinia pestis
gcuacuuuuuucaca

SEQ ID NO: 4136843 - RNA, 20 nt, Yersinia pestis
gcuagaauaaguugaugcag

SEQ ID NO: 4136844 - RNA, 13 nt, Yersinia pestis
gcuagcuucaggu

SEQ ID NO: 4136845 - RNA, 17 nt, Yersinia pestis
gcuaggaggccaggacu

SEQ ID NO: 4136846 - RNA, 18 nt, Yersinia pestis
gcuaggaggccaggacuu

SEQ ID NO: 4136847 - RNA, 20 nt, Yersinia pestis
gcuagucuguuaugcccaac

SEQ ID NO: 4136848 - RNA, 15 nt, Yersinia pestis
gcuaguuugacgcug

SEQ ID NO: 4136849 - RNA, 19 nt, Yersinia pestis
gcuauauacccgucauaaa

SEQ ID NO: 4136850 - RNA, 11 nt, Yersinia pestis
gcuauauagac

SEQ ID NO: 4136851 - RNA, 17 nt, Yersinia pestis
gcuauaucaucagcaga

SEQ ID NO: 4136852 - RNA, 23 nt, Yersinia pestis
gcuauauugcgcugcgccaauac

SEQ ID NO: 4136853 - RNA, 11 nt, Yersinia pestis
gcuaucacuag

SEQ ID NO: 4136854 - RNA, 22 nt, Yersinia pestis
gcuaucauccauaaugagugac

SEQ ID NO: 4136855 - RNA, 17 nt, Yersinia pestis
gcuauccgcgccgagcg

SEQ ID NO: 4136856 - RNA, 17 nt, Yersinia pestis
gcuaucgcgaaaaugaa

SEQ ID NO: 4136857 - RNA, 11 nt, Yersinia pestis
gcuaucugcug

SEQ ID NO: 4136858 - RNA, 16 nt, Yersinia pestis
gcuaucugugucagua

SEQ ID NO: 4136859 - RNA, 11 nt, Yersinia pestis
gcuaucuguua

SEQ ID NO: 4136860 - RNA, 14 nt, Yersinia pestis
gcuaucuguuaucu

SEQ ID NO: 4136861 - RNA, 15 nt, Yersinia pestis
gcuaugcagcccaga

SEQ ID NO: 4136862 - RNA, 14 nt, Yersinia pestis
gcuaugcaguuaag

SEQ ID NO: 4136863 - RNA, 14 nt, Yersinia pestis
gcuaugccggagga

SEQ ID NO: 4136864 - RNA, 18 nt, Yersinia pestis
gcuaugccuacuggccac

SEQ ID NO: 4136865 - RNA, 13 nt, Yersinia pestis
gcuaugcgcaauc

SEQ ID NO: 4136866 - RNA, 15 nt, Yersinia pestis
gcuauggauaaaucc

SEQ ID NO: 4136867 - RNA, 22 nt, Yersinia pestis
gcuauggauaaauccugaacau

SEQ ID NO: 4136868 - RNA, 18 nt, Yersinia pestis
gcuauguuggcaaauaau

SEQ ID NO: 4136869 - RNA, 18 nt, Yersinia pestis
gcuauuaaacauuuaugu

SEQ ID NO: 4136870 - RNA, 17 nt, Yersinia pestis
gcuauuaaagcccgcuu

SEQ ID NO: 4136871 - RNA, 14 nt, Yersinia pestis
gcuauuaagaaacc

SEQ ID NO: 4136872 - RNA, 14 nt, Yersinia pestis
gcuauuaggcuuua

SEQ ID NO: 4136873 - RNA, 13 nt, Yersinia pestis
gcuauucauaaau

SEQ ID NO: 4136874 - RNA, 13 nt, Yersinia pestis
gcuauugacaaag

SEQ ID NO: 4136875 - RNA, 19 nt, Yersinia pestis
gcuauuggcugauucaaca

SEQ ID NO: 4136876 - RNA, 11 nt, Yersinia pestis
gcuauuuaucg

SEQ ID NO: 4136877 - RNA, 16 nt, Yersinia pestis
gcuauuucucucuacu

SEQ ID NO: 4136878 - RNA, 15 nt, Yersinia pestis
gcuauuuuuucucac

SEQ ID NO: 4136879 - RNA, 17 nt, Yersinia pestis
gcucaaauauuugcaca

SEQ ID NO: 4136880 - RNA, 10 nt, Yersinia pestis
gcucaacaug

SEQ ID NO: 4136881 - RNA, 14 nt, Yersinia pestis
gcucaacugcucaa

SEQ ID NO: 4136882 - RNA, 15 nt, Yersinia pestis
gcucaacugcucaac

SEQ ID NO: 4136883 - RNA, 17 nt, Yersinia pestis
gcucaacugcucaacug

SEQ ID NO: 4136884 - RNA, 18 nt, Yersinia pestis
gcucaacugcucaacugc

SEQ ID NO: 4136885 - RNA, 20 nt, Yersinia pestis
gcucaacugcucaacugcuc

SEQ ID NO: 4136886 - RNA, 12 nt, Yersinia pestis
gcucaagcuggu

SEQ ID NO: 4136887 - RNA, 15 nt, Yersinia pestis
gcucaagcuggucgc

SEQ ID NO: 4136888 - RNA, 23 nt, Yersinia pestis
gcucaagggcacaguuuaucucg

SEQ ID NO: 4136889 - RNA, 19 nt, Yersinia pestis
gcucaaugccgcugucuga

SEQ ID NO: 4136890 - RNA, 19 nt, Yersinia pestis
gcucaaugcgaaaaaauau

SEQ ID NO: 4136891 - RNA, 20 nt, Yersinia pestis
gcucaaugcguuggcucaga

SEQ ID NO: 4136892 - RNA, 12 nt, Yersinia pestis
gcucaauguucc

SEQ ID NO: 4136893 - RNA, 16 nt, Yersinia pestis
gcucaccuuucaacaa

SEQ ID NO: 4136894 - RNA, 22 nt, Yersinia pestis
gcucacgcaaagggcaacaaua

SEQ ID NO: 4136895 - RNA, 15 nt, Yersinia pestis
gcucacgucaccacg

SEQ ID NO: 4136896 - RNA, 18 nt, Yersinia pestis
gcucacucgguaaugagc

SEQ ID NO: 4136897 - RNA, 20 nt, Yersinia pestis
gcucacucgguacaaucucu

SEQ ID NO: 4136898 - RNA, 18 nt, Yersinia pestis
gcucacuuuuauauccgc

SEQ ID NO: 4136899 - RNA, 21 nt, Yersinia pestis
gcucacuuuuauauccgccau

SEQ ID NO: 4136900 - RNA, 16 nt, Yersinia pestis
gcucacuuuuauccag

SEQ ID NO: 4136901 - RNA, 19 nt, Yersinia pestis
gcucagcgccauauccaac

SEQ ID NO: 4136902 - RNA, 15 nt, Yersinia pestis
gcucagcgggcuaaa

SEQ ID NO: 4136903 - RNA, 14 nt, Yersinia pestis
gcucaggccuugcg

SEQ ID NO: 4136904 - RNA, 20 nt, Yersinia pestis
gcucaggcucaucaccuucc

SEQ ID NO: 4136905 - RNA, 13 nt, Yersinia pestis
gcucagggccacu

SEQ ID NO: 4136906 - RNA, 17 nt, Yersinia pestis
gcucagggccacuucgg

SEQ ID NO: 4136907 - RNA, 16 nt, Yersinia pestis
gcucaguauucgccag

SEQ ID NO: 4136908 - RNA, 20 nt, Yersinia pestis
gcucaguucgguugccaaaa

SEQ ID NO: 4136909 - RNA, 19 nt, Yersinia pestis
gcucauaaagcaucagacu

SEQ ID NO: 4136910 - RNA, 22 nt, Yersinia pestis
gcucaucaaaggagugcccggc

SEQ ID NO: 4136911 - RNA, 18 nt, Yersinia pestis
gcucaucaaccucagccu

SEQ ID NO: 4136912 - RNA, 22 nt, Yersinia pestis
gcucaucaaccucagccucauu

SEQ ID NO: 4136913 - RNA, 16 nt, Yersinia pestis
gcucaucauaaaaaua

SEQ ID NO: 4136914 - RNA, 14 nt, Yersinia pestis
gcucauuuuguaug

SEQ ID NO: 4136915 - RNA, 23 nt, Yersinia pestis
gcuccaaauuaauagguuggcau

SEQ ID NO: 4136916 - RNA, 19 nt, Yersinia pestis
gcuccaccguucagguuua

SEQ ID NO: 4136917 - RNA, 15 nt, Yersinia pestis
gcuccagccuggaag

SEQ ID NO: 4136918 - RNA, 17 nt, Yersinia pestis
gcuccagcgucacuuca

SEQ ID NO: 4136919 - RNA, 17 nt, Yersinia pestis
gcuccagguucauuauu

SEQ ID NO: 4136920 - RNA, 19 nt, Yersinia pestis
gcuccagugcaucgcugag

SEQ ID NO: 4136921 - RNA, 21 nt, Yersinia pestis
gcuccaucuuuuacaaauuug

SEQ ID NO: 4136922 - RNA, 20 nt, Yersinia pestis
gcucccccggaucacuggcu

SEQ ID NO: 4136923 - RNA, 18 nt, Yersinia pestis
gcucccggcacuaagugu

SEQ ID NO: 4136924 - RNA, 15 nt, Yersinia pestis
gcucccuccgccagc

SEQ ID NO: 4136925 - RNA, 21 nt, Yersinia pestis
gcuccuauagcucagaaaaua

SEQ ID NO: 4136926 - RNA, 14 nt, Yersinia pestis
gcuccucaaccccu

SEQ ID NO: 4136927 - RNA, 14 nt, Yersinia pestis
gcuccucagccuuu

SEQ ID NO: 4136928 - RNA, 18 nt, Yersinia pestis
gcuccuccuuggggccuc

SEQ ID NO: 4136929 - RNA, 17 nt, Yersinia pestis
gcuccugacgggucagc

SEQ ID NO: 4136930 - RNA, 21 nt, Yersinia pestis
gcuccugagggugaugacaau

SEQ ID NO: 4136931 - RNA, 13 nt, Yersinia pestis
gcucgaaccugaa

SEQ ID NO: 4136932 - RNA, 20 nt, Yersinia pestis
gcucgaaccugaacgcagga

SEQ ID NO: 4136933 - RNA, 14 nt, Yersinia pestis
gcucgacggccaau

SEQ ID NO: 4136934 - RNA, 20 nt, Yersinia pestis
gcucgaucagcgucagcaga

SEQ ID NO: 4136935 - RNA, 15 nt, Yersinia pestis
gcucgauucuauaua

SEQ ID NO: 4136936 - RNA, 19 nt, Yersinia pestis
gcucgcacccuuacccugg

SEQ ID NO: 4136937 - RNA, 13 nt, Yersinia pestis
gcucgcuugcugc

SEQ ID NO: 4136938 - RNA, 22 nt, Yersinia pestis
gcucggcgcucaauguuccuca

SEQ ID NO: 4136939 - RNA, 23 nt, Yersinia pestis
gcucggcgggauaucgauggcaa

SEQ ID NO: 4136940 - RNA, 16 nt, Yersinia pestis
gcucggcucgaaccug

SEQ ID NO: 4136941 - RNA, 22 nt, Yersinia pestis
gcucgggcguaauaccggccug

SEQ ID NO: 4136942 - RNA, 17 nt, Yersinia pestis
gcuguaaacuggcagau

SEQ ID NO: 4136943 - RNA, 18 nt, Yersinia pestis
gcuguaaauauaaaauaa

SEQ ID NO: 4136944 - RNA, 16 nt, Yersinia pestis
gcuguaagcaccagca

SEQ ID NO: 4136945 - RNA, 15 nt, Yersinia pestis
gcuguaaucuuggca

SEQ ID NO: 4136946 - RNA, 20 nt, Yersinia pestis
gcuguacaacaagaucccaa

SEQ ID NO: 4136947 - RNA, 15 nt, Yersinia pestis
gcuguauacccgccg

SEQ ID NO: 4136948 - RNA, 15 nt, Yersinia pestis
gcugucagccaccgu

SEQ ID NO: 4136949 - RNA, 16 nt, Yersinia pestis
gcugucauuggugcug

SEQ ID NO: 4136950 - RNA, 22 nt, Yersinia pestis
gcugucggcgaugaaaaacaga

SEQ ID NO: 4136951 - RNA, 17 nt, Yersinia pestis
gcugugagauccccgcc

SEQ ID NO: 4136952 - RNA, 21 nt, Yersinia pestis
gcugugccaugucggcaggua

SEQ ID NO: 4136953 - RNA, 18 nt, Yersinia pestis
gcuguggcacuaucuggc

SEQ ID NO: 4136954 - RNA, 16 nt, Yersinia pestis
gcuguuaccaaacauu

SEQ ID NO: 4136955 - RNA, 13 nt, Yersinia pestis
gcuguuacccaug

SEQ ID NO: 4136956 - RNA, 18 nt, Yersinia pestis
gcuguuacccauggcaac

SEQ ID NO: 4136957 - RNA, 21 nt, Yersinia pestis
gcuguuauuacugucauugcu

SEQ ID NO: 4136958 - RNA, 20 nt, Yersinia pestis
gcuguucagaugaucaaauu

SEQ ID NO: 4136959 - RNA, 22 nt, Yersinia pestis
gcuguuguaguuagaugacauc

SEQ ID NO: 4136960 - RNA, 16 nt, Yersinia pestis
gcuguuguuguugauu

SEQ ID NO: 4136961 - RNA, 11 nt, Yersinia pestis
gcuuaaaacag

SEQ ID NO: 4136962 - RNA, 16 nt, Yersinia pestis
gcuuaaauaaaacacc

SEQ ID NO: 4136963 - RNA, 16 nt, Yersinia pestis
gcuuaacugcacgacg

SEQ ID NO: 4136964 - RNA, 20 nt, Yersinia pestis
gcuuaacugugcagcccauu

SEQ ID NO: 4136965 - RNA, 16 nt, Yersinia pestis
gcuuaauaccgcucuc

SEQ ID NO: 4136966 - RNA, 19 nt, Yersinia pestis
gcuuacaccauguucuuca

SEQ ID NO: 4136967 - RNA, 14 nt, Yersinia pestis
gcuuacauaaguaa

SEQ ID NO: 4136968 - RNA, 15 nt, Yersinia pestis
gcuuaccaaaacgcc

SEQ ID NO: 4136969 - RNA, 18 nt, Yersinia pestis
gcuuaccaaaacgccacc

SEQ ID NO: 4136970 - RNA, 15 nt, Yersinia pestis
gcuuaccgccugccc

SEQ ID NO: 4136971 - RNA, 17 nt, Yersinia pestis
gcuuacucuuccaacuc

SEQ ID NO: 4136972 - RNA, 22 nt, Yersinia pestis
gcuuacuuuuauaccgcagcau

SEQ ID NO: 4136973 - RNA, 11 nt, Yersinia pestis
gcuuagacaga

SEQ ID NO: 4136974 - RNA, 15 nt, Yersinia pestis
gcuuagaguaaguaa

SEQ ID NO: 4136975 - RNA, 22 nt, Yersinia pestis
gcuuaucccuccaucaagccac

SEQ ID NO: 4136976 - RNA, 21 nt, Yersinia pestis
gcuuauccgcuuuggucaaca

SEQ ID NO: 4136977 - RNA, 15 nt, Yersinia pestis
gcuuauccgggugau

SEQ ID NO: 4136978 - RNA, 12 nt, Yersinia pestis
gcuuauggccuu

SEQ ID NO: 4136979 - RNA, 16 nt, Yersinia pestis
gcuuauuaugacaacu

SEQ ID NO: 4136980 - RNA, 18 nt, Yersinia pestis
gcuuauuaugacaacuga

SEQ ID NO: 4136981 - RNA, 15 nt, Yersinia pestis
gcuuauuuauuuuua

SEQ ID NO: 4136982 - RNA, 18 nt, Yersinia pestis
gcuucaaaaucaccuggc

SEQ ID NO: 4136983 - RNA, 20 nt, Yersinia pestis
gcuucaaaaucaccuggcca

SEQ ID NO: 4136984 - RNA, 23 nt, Yersinia pestis
gcuucaaagaagacaucuggcug

SEQ ID NO: 4136985 - RNA, 18 nt, Yersinia pestis
gcuucaauuucaaacucc

SEQ ID NO: 4136986 - RNA, 15 nt, Yersinia pestis
gcuucacaucauaau

SEQ ID NO: 4136987 - RNA, 17 nt, Yersinia pestis
gcuucacccuggcucug

SEQ ID NO: 4136988 - RNA, 22 nt, Yersinia pestis
gcuucacccuggcucuggccag

SEQ ID NO: 4136989 - RNA, 16 nt, Yersinia pestis
gcuucacggguaaaaa

SEQ ID NO: 4136990 - RNA, 12 nt, Yersinia pestis
gcuucagccacu

SEQ ID NO: 4136991 - RNA, 13 nt, Yersinia pestis
gcuucauauccua

SEQ ID NO: 4136992 - RNA, 18 nt, Yersinia pestis
gcuucaucauggauaaag

SEQ ID NO: 4136993 - RNA, 16 nt, Yersinia pestis
gcuucauccaacuuac

SEQ ID NO: 4136994 - RNA, 16 nt, Yersinia pestis
gcuuccaauauugagc

SEQ ID NO: 4136995 - RNA, 19 nt, Yersinia pestis
gcuuccaauauugagcagu

SEQ ID NO: 4136996 - RNA, 23 nt, Yersinia pestis
gcuuccagcucugggaucgauug

SEQ ID NO: 4136997 - RNA, 21 nt, Yersinia pestis
gcuuccaggacauccagcggu

SEQ ID NO: 4136998 - RNA, 19 nt, Yersinia pestis
gcuucccuguauaaaaaua

SEQ ID NO: 4136999 - RNA, 13 nt, Yersinia pestis
gcuuccugcgcca

SEQ ID NO: 4137000 - RNA, 13 nt, Yersinia pestis
gcuucgauggcuu

SEQ ID NO: 4137001 - RNA, 23 nt, Yersinia pestis
gcuucgcucggcucgaaccugaa

SEQ ID NO: 4137002 - RNA, 14 nt, Yersinia pestis
gcuucgcuggcuuu

SEQ ID NO: 4137003 - RNA, 17 nt, Yersinia pestis
gcuucguagccauuggg

SEQ ID NO: 4137004 - RNA, 16 nt, Yersinia pestis
gcuucucgcaccagau

SEQ ID NO: 4137005 - RNA, 22 nt, Yersinia pestis
gcuucugaaccaccguaaacga

SEQ ID NO: 4137006 - RNA, 15 nt, Yersinia pestis
gcuucugccaugguu

SEQ ID NO: 4137007 - RNA, 21 nt, Yersinia pestis
gcuucuggaugggcauagaaa

SEQ ID NO: 4137008 - RNA, 17 nt, Yersinia pestis
gcuucugggccaaagcg

SEQ ID NO: 4137009 - RNA, 17 nt, Yersinia pestis
gcuucuguggcggcaag

SEQ ID NO: 4137010 - RNA, 23 nt, Yersinia pestis
gcuucuuguugagugaccaagcc

SEQ ID NO: 4137011 - RNA, 13 nt, Yersinia pestis
gcuucuuuaauca

SEQ ID NO: 4137012 - RNA, 13 nt, Yersinia pestis
gcuucuuuuaaag

SEQ ID NO: 4137013 - RNA, 16 nt, Yersinia pestis
gcuucuuuuguauaug

SEQ ID NO: 4137014 - RNA, 14 nt, Yersinia pestis
gcuugaucacaauc

SEQ ID NO: 4137015 - RNA, 18 nt, Yersinia pestis
gcuugcaggucugcaugg

SEQ ID NO: 4137016 - RNA, 12 nt, Yersinia pestis
gcuugccaaaua

SEQ ID NO: 4137017 - RNA, 19 nt, Yersinia pestis
gcuugccgcacgacgagcu

SEQ ID NO: 4137018 - RNA, 19 nt, Yersinia pestis
gcuugcgcguuaaucugcu

SEQ ID NO: 4137019 - RNA, 20 nt, Yersinia pestis
gcuugcgcguuaaucugcug

SEQ ID NO: 4137020 - RNA, 19 nt, Yersinia pestis
gcuugcggaauuucuucua

SEQ ID NO: 4137021 - RNA, 15 nt, Yersinia pestis
gcuugcugccugccu

SEQ ID NO: 4137022 - RNA, 17 nt, Yersinia pestis
gcuugcugccuugcugc

SEQ ID NO: 4137023 - RNA, 21 nt, Yersinia pestis
gcuugcugccuugcugcaacg

SEQ ID NO: 4137024 - RNA, 23 nt, Yersinia pestis
gcuuggacagaaaacaaucuggc

SEQ ID NO: 4137025 - RNA, 14 nt, Yersinia pestis
gcuuggcaaccgag

SEQ ID NO: 4137026 - RNA, 16 nt, Yersinia pestis
gcuuggcccgauggug

SEQ ID NO: 4137027 - RNA, 23 nt, Yersinia pestis
gcuuggcgguuuagcgcuaagcc

SEQ ID NO: 4137028 - RNA, 15 nt, Yersinia pestis
gcuuggcucaaugug

SEQ ID NO: 4137029 - RNA, 16 nt, Yersinia pestis
gcuuggcucaaugugc

SEQ ID NO: 4137030 - RNA, 17 nt, Yersinia pestis
gcuugggcuucacaucc

SEQ ID NO: 4137031 - RNA, 20 nt, Yersinia pestis
gcuugguaaugcgcaccagc

SEQ ID NO: 4137032 - RNA, 14 nt, Yersinia pestis
gcuugugcgccaac

SEQ ID NO: 4137033 - RNA, 20 nt, Yersinia pestis
gcuugugcucacgucaccac

SEQ ID NO: 4137034 - RNA, 19 nt, Yersinia pestis
gcuuguucuguuagcgacu

SEQ ID NO: 4137035 - RNA, 20 nt, Yersinia pestis
gcuuuaaaggcuucgcuggc

SEQ ID NO: 4137036 - RNA, 17 nt, Yersinia pestis
gcuuuaagcuaauucug

SEQ ID NO: 4137037 - RNA, 16 nt, Yersinia pestis
gcuuuaaucugcauca

SEQ ID NO: 4137038 - RNA, 18 nt, Yersinia pestis
gcuuuacgcgcaccggau

SEQ ID NO: 4137039 - RNA, 13 nt, Yersinia pestis
gcuuuacuccucu

SEQ ID NO: 4137040 - RNA, 20 nt, Yersinia pestis
gcuuuacuccucugccuauc

SEQ ID NO: 4137041 - RNA, 16 nt, Yersinia pestis
gcuuuacugcuuuucu

SEQ ID NO: 4137042 - RNA, 18 nt, Yersinia pestis
gcuuuacugcuuuucuac

SEQ ID NO: 4137043 - RNA, 16 nt, Yersinia pestis
gcuuuagcuguacuaa

SEQ ID NO: 4137044 - RNA, 18 nt, Yersinia pestis
gcuuuauaguccuuccau

SEQ ID NO: 4137045 - RNA, 14 nt, Yersinia pestis
gcuuuaucaccagu

SEQ ID NO: 4137046 - RNA, 18 nt, Yersinia pestis
gcuuuaucgguuguccuu

SEQ ID NO: 4137047 - RNA, 15 nt, Yersinia pestis
gcuuucaauaaaacu

SEQ ID NO: 4137048 - RNA, 16 nt, Yersinia pestis
gcuuucaauaaaacuc

SEQ ID NO: 4137049 - RNA, 20 nt, Yersinia pestis
gcuuucagauaaugccuaag

SEQ ID NO: 4137050 - RNA, 21 nt, Yersinia pestis
gcuuucaggagugaauuucuu

SEQ ID NO: 4137051 - RNA, 14 nt, Yersinia pestis
gcuuucaucuucuu

SEQ ID NO: 4137052 - RNA, 15 nt, Yersinia pestis
gcuuucaucuucuuc

SEQ ID NO: 4137053 - RNA, 17 nt, Yersinia pestis
gcuuuccgcauucgcca

SEQ ID NO: 4137054 - RNA, 17 nt, Yersinia pestis
gcuuucuugccauaagc

SEQ ID NO: 4137055 - RNA, 16 nt, Yersinia pestis
gcuuugacuaauacug

SEQ ID NO: 4137056 - RNA, 19 nt, Yersinia pestis
gcuuugcgauacaccauuu

SEQ ID NO: 4137057 - RNA, 19 nt, Yersinia pestis
gcuuuuaucguugcuacca

SEQ ID NO: 4137058 - RNA, 12 nt, Yersinia pestis
gcuuuucacauu

SEQ ID NO: 4137059 - RNA, 16 nt, Yersinia pestis
gcuuuucugccuaucu

SEQ ID NO: 4137060 - RNA, 18 nt, Yersinia pestis
gcuuuugauuuucuuacc

SEQ ID NO: 4137061 - RNA, 23 nt, Yersinia pestis
gcuuuuguacgaaauugauauga

SEQ ID NO: 4137062 - RNA, 14 nt, Yersinia pestis
gcuuuuuacccagu

SEQ ID NO: 4137063 - RNA, 19 nt, Yersinia pestis
gcuuuuuauugucucuacu

SEQ ID NO: 4137064 - RNA, 19 nt, Yersinia pestis
ggcaaaacucaggugagua

SEQ ID NO: 4137065 - RNA, 16 nt, Yersinia pestis
ggcaaaagcaucacca

SEQ ID NO: 4137066 - RNA, 17 nt, Yersinia pestis
ggcaaaauaaucggcaa

SEQ ID NO: 4137067 - RNA, 20 nt, Yersinia pestis
ggcaaacgcuuuuaacugug

SEQ ID NO: 4137068 - RNA, 19 nt, Yersinia pestis
ggcaaacucagccaucagu

SEQ ID NO: 4137069 - RNA, 12 nt, Yersinia pestis
ggcaaagaagaa

SEQ ID NO: 4137070 - RNA, 22 nt, Yersinia pestis
ggcaaagaauugagguaaacca

SEQ ID NO: 4137071 - RNA, 17 nt, Yersinia pestis
ggcaaauucaacaauca

SEQ ID NO: 4137072 - RNA, 21 nt, Yersinia pestis
ggcaacagcauggaaacggug

SEQ ID NO: 4137073 - RNA, 20 nt, Yersinia pestis
ggcaacgaaggcaacaacac

SEQ ID NO: 4137074 - RNA, 18 nt, Yersinia pestis
ggcaacgacagcaacaac

SEQ ID NO: 4137075 - RNA, 17 nt, Yersinia pestis
ggcaacgcgcagugccg

SEQ ID NO: 4137076 - RNA, 18 nt, Yersinia pestis
ggcaacugccgcuucagu

SEQ ID NO: 4137077 - RNA, 21 nt, Yersinia pestis
ggcaagaaacuucauuucagg

SEQ ID NO: 4137078 - RNA, 18 nt, Yersinia pestis
ggcaagacgguaucuagg

SEQ ID NO: 4137079 - RNA, 14 nt, Yersinia pestis
ggcaagauuucucu

SEQ ID NO: 4137080 - RNA, 14 nt, Yersinia pestis
ggcaagcucugggc

SEQ ID NO: 4137081 - RNA, 12 nt, Yersinia pestis
ggcaaggcacga

SEQ ID NO: 4137082 - RNA, 15 nt, Yersinia pestis
ggcaaggcacgagcg

SEQ ID NO: 4137083 - RNA, 15 nt, Yersinia pestis
ggcaaguucagcauc

SEQ ID NO: 4137084 - RNA, 16 nt, Yersinia pestis
ggcaauaacaaacaca

SEQ ID NO: 4137085 - RNA, 23 nt, Yersinia pestis
ggcaauaacacggccuauugaau

SEQ ID NO: 4137086 - RNA, 15 nt, Yersinia pestis
ggcaauacaccgcca

SEQ ID NO: 4137087 - RNA, 17 nt, Yersinia pestis
ggcaauacguguagcca

SEQ ID NO: 4137088 - RNA, 15 nt, Yersinia pestis
ggcaauauaggcguc

SEQ ID NO: 4137089 - RNA, 18 nt, Yersinia pestis
ggcaauauuggcgcacaa

SEQ ID NO: 4137090 - RNA, 14 nt, Yersinia pestis
ggcaaucacaaccc

SEQ ID NO: 4137091 - RNA, 13 nt, Yersinia pestis
ggcaaucuccagu

SEQ ID NO: 4137092 - RNA, 20 nt, Yersinia pestis
ggcaaucucuccccaagcgg

SEQ ID NO: 4137093 - RNA, 19 nt, Yersinia pestis
ggcaaugaccaucaacuca

SEQ ID NO: 4137094 - RNA, 14 nt, Yersinia pestis
ggcaauggcucagg

SEQ ID NO: 4137095 - RNA, 21 nt, Yersinia pestis
ggcaauggcucaggcucauca

SEQ ID NO: 4137096 - RNA, 18 nt, Yersinia pestis
ggcaauguugagaaauau

SEQ ID NO: 4137097 - RNA, 14 nt, Yersinia pestis
ggcaauuaaaggua

SEQ ID NO: 4137098 - RNA, 12 nt, Yersinia pestis
ggcacaccagaa

SEQ ID NO: 4137099 - RNA, 14 nt, Yersinia pestis
ggcacaguuuaucu

SEQ ID NO: 4137100 - RNA, 15 nt, Yersinia pestis
ggcacauaacguuau

SEQ ID NO: 4137101 - RNA, 16 nt, Yersinia pestis
ggcacauacuaauaga

SEQ ID NO: 4137102 - RNA, 17 nt, Yersinia pestis
ggcaccaaaacgucgug

SEQ ID NO: 4137103 - RNA, 17 nt, Yersinia pestis
ggcaccacggucagaga

SEQ ID NO: 4137104 - RNA, 19 nt, Yersinia pestis
ggcaccgugggcaaagaau

SEQ ID NO: 4137105 - RNA, 15 nt, Yersinia pestis
ggcacgggcgaucac

SEQ ID NO: 4137106 - RNA, 23 nt, Yersinia pestis
ggcacuaaaaucugcucccggca

SEQ ID NO: 4137107 - RNA, 15 nt, Yersinia pestis
ggcacugcagaaaau

SEQ ID NO: 4137108 - RNA, 23 nt, Yersinia pestis
ggcacugcagaaaaugcggcggc

SEQ ID NO: 4137109 - RNA, 20 nt, Yersinia pestis
ggcacugcccugccugguau

SEQ ID NO: 4137110 - RNA, 17 nt, Yersinia pestis
ggcacuggaaacaaaac

SEQ ID NO: 4137111 - RNA, 23 nt, Yersinia pestis
ggcagaaaagcaaaggcccgcua

SEQ ID NO: 4137112 - RNA, 12 nt, Yersinia pestis
ggcagaaaucag

SEQ ID NO: 4137113 - RNA, 21 nt, Yersinia pestis
ggcagauaugccaggcaucau

SEQ ID NO: 4137114 - RNA, 18 nt, Yersinia pestis
ggcagauguaaccaccca

SEQ ID NO: 4137115 - RNA, 12 nt, Yersinia pestis
ggcagcaagcaa

SEQ ID NO: 4137116 - RNA, 15 nt, Yersinia pestis
ggcagccuuuaucca

SEQ ID NO: 4137117 - RNA, 16 nt, Yersinia pestis
ggcagcgacaaccugu

SEQ ID NO: 4137118 - RNA, 14 nt, Yersinia pestis
ggcagcgagcacug

SEQ ID NO: 4137119 - RNA, 12 nt, Yersinia pestis
ggcaggccccau

SEQ ID NO: 4137120 - RNA, 13 nt, Yersinia pestis
ggcaggggcgcgu

SEQ ID NO: 4137121 - RNA, 18 nt, Yersinia pestis
ggcaggguauuuucuccu

SEQ ID NO: 4137122 - RNA, 21 nt, Yersinia pestis
ggcagguagggcggcccacuu

SEQ ID NO: 4137123 - RNA, 20 nt, Yersinia pestis
ggcagguuaaaguugauaaa

SEQ ID NO: 4137124 - RNA, 18 nt, Yersinia pestis
ggcagugacaguagugag

SEQ ID NO: 4137125 - RNA, 22 nt, Yersinia pestis
ggcaguucauuccccaucgcca

SEQ ID NO: 4137126 - RNA, 14 nt, Yersinia pestis
ggcauaaagguuug

SEQ ID NO: 4137127 - RNA, 21 nt, Yersinia pestis
ggcauaaucaacgcucaauca

SEQ ID NO: 4137128 - RNA, 11 nt, Yersinia pestis
ggcauagagag

SEQ ID NO: 4137129 - RNA, 12 nt, Yersinia pestis
ggcaucaccaaa

SEQ ID NO: 4137130 - RNA, 19 nt, Yersinia pestis
ggcaucaccgcuaucacug

SEQ ID NO: 4137131 - RNA, 13 nt, Yersinia pestis
ggcaucauccuca

SEQ ID NO: 4137132 - RNA, 16 nt, Yersinia pestis
ggcauccgccagccac

SEQ ID NO: 4137133 - RNA, 22 nt, Yersinia pestis
ggcaucuaccuguguugcgcca

SEQ ID NO: 4137134 - RNA, 19 nt, Yersinia pestis
ggcaucugcuguaagggaa

SEQ ID NO: 4137135 - RNA, 20 nt, Yersinia pestis
ggcaucuuucaguuuuauug

SEQ ID NO: 4137136 - RNA, 17 nt, Yersinia pestis
ggcaugaaguuuaacca

SEQ ID NO: 4137137 - RNA, 12 nt, Yersinia pestis
ggcaugcaacuu

SEQ ID NO: 4137138 - RNA, 20 nt, Yersinia pestis
ggcauggauggucauaaaau

SEQ ID NO: 4137139 - RNA, 20 nt, Yersinia pestis
ggcauguucacaucggucaa

SEQ ID NO: 4137140 - RNA, 14 nt, Yersinia pestis
ggcauuaaacugaa

SEQ ID NO: 4137141 - RNA, 16 nt, Yersinia pestis
ggcauuaaacugaaua

SEQ ID NO: 4137142 - RNA, 19 nt, Yersinia pestis
ggcauuaaguggcgguuca

SEQ ID NO: 4137143 - RNA, 21 nt, Yersinia pestis
ggcauugaccaaagcggaucg

SEQ ID NO: 4137144 - RNA, 22 nt, Yersinia pestis
ggcauuggauaauuugccuggc

SEQ ID NO: 4137145 - RNA, 19 nt, Yersinia pestis
ggcauuuuuauuuaccgaa

SEQ ID NO: 4137146 - RNA, 22 nt, Yersinia pestis
ggcauuuuuuauguuuauauuc

SEQ ID NO: 4137147 - RNA, 12 nt, Yersinia pestis
ggccaacauaau

SEQ ID NO: 4137148 - RNA, 22 nt, Yersinia pestis
ggccaaccggcgaagggcgcag

SEQ ID NO: 4137149 - RNA, 18 nt, Yersinia pestis
ggccaaccguagugaguc

SEQ ID NO: 4137150 - RNA, 19 nt, Yersinia pestis
ggccaaggggagccacaca

SEQ ID NO: 4137151 - RNA, 14 nt, Yersinia pestis
ggccaauaggcccc

SEQ ID NO: 4137152 - RNA, 23 nt, Yersinia pestis
ggccacacaccagucugcauaca

SEQ ID NO: 4137153 - RNA, 14 nt, Yersinia pestis
ggccacaggcugca

SEQ ID NO: 4137154 - RNA, 15 nt, Yersinia pestis
ggccacaggcugcau

SEQ ID NO: 4137155 - RNA, 14 nt, Yersinia pestis
ggccaccacgaaaa

SEQ ID NO: 4137156 - RNA, 16 nt, Yersinia pestis
ggccaccagacugaca

SEQ ID NO: 4137157 - RNA, 15 nt, Yersinia pestis
ggccaccucuuccuc

SEQ ID NO: 4137158 - RNA, 21 nt, Yersinia pestis
ggccacggcucacacacuaau

SEQ ID NO: 4137159 - RNA, 14 nt, Yersinia pestis
ggccacucaccuca

SEQ ID NO: 4137160 - RNA, 16 nt, Yersinia pestis
ggccacuucgguggcc

SEQ ID NO: 4137161 - RNA, 22 nt, Yersinia pestis
ggccacuucgguggcccuuauu

SEQ ID NO: 4137162 - RNA, 14 nt, Yersinia pestis
ggccagagcauaga

SEQ ID NO: 4137163 - RNA, 15 nt, Yersinia pestis
ggccagcauucaggc

SEQ ID NO: 4137164 - RNA, 18 nt, Yersinia pestis
ggccagccuugagccugc

SEQ ID NO: 4137165 - RNA, 22 nt, Yersinia pestis
ggccagcgcuaacgguggcauu

SEQ ID NO: 4137166 - RNA, 20 nt, Yersinia pestis
ggccagcuuuuuaucauuua

SEQ ID NO: 4137167 - RNA, 22 nt, Yersinia pestis
ggccaguaacgcuucaucaugg

SEQ ID NO: 4137168 - RNA, 22 nt, Yersinia pestis
ggccagugauguuggcagguga

SEQ ID NO: 4137169 - RNA, 14 nt, Yersinia pestis
ggccaguguuuucu

SEQ ID NO: 4137170 - RNA, 23 nt, Yersinia pestis
ggccauacuggguuuaaaggugg

SEQ ID NO: 4137171 - RNA, 21 nt, Yersinia pestis
ggccauauacgcauaaugcgc

SEQ ID NO: 4137172 - RNA, 18 nt, Yersinia pestis
ggccaucuaacugcacaa

SEQ ID NO: 4137173 - RNA, 19 nt, Yersinia pestis
ggccauguacuuaauacug

SEQ ID NO: 4137174 - RNA, 20 nt, Yersinia pestis
ggccauguacuuaauacuga

SEQ ID NO: 4137175 - RNA, 16 nt, Yersinia pestis
ggccaugucgaucaug

SEQ ID NO: 4137176 - RNA, 16 nt, Yersinia pestis
ggccauguguguucuu

SEQ ID NO: 4137177 - RNA, 13 nt, Yersinia pestis
ggccauuacgcca

SEQ ID NO: 4137178 - RNA, 15 nt, Yersinia pestis
ggccauuacgccacc

SEQ ID NO: 4137179 - RNA, 15 nt, Yersinia pestis
ggccauuagcgcggg

SEQ ID NO: 4137180 - RNA, 23 nt, Yersinia pestis
ggccauugaacauaacuuugcca

SEQ ID NO: 4137181 - RNA, 13 nt, Yersinia pestis
ggccauuucuuag

SEQ ID NO: 4137182 - RNA, 16 nt, Yersinia pestis
ggccauuugcucuggc

SEQ ID NO: 4137183 - RNA, 18 nt, Yersinia pestis
ggcccaaaugagcagcaa

SEQ ID NO: 4137184 - RNA, 14 nt, Yersinia pestis
ggcccaagccaucc

SEQ ID NO: 4137185 - RNA, 18 nt, Yersinia pestis
ggcccaagccauccuuuu

SEQ ID NO: 4137186 - RNA, 17 nt, Yersinia pestis
ggcuggcauauuucucu

SEQ ID NO: 4137187 - RNA, 18 nt, Yersinia pestis
ggcuggcauuuuuuaugu

SEQ ID NO: 4137188 - RNA, 21 nt, Yersinia pestis
ggcuggcccaaugcugucacu

SEQ ID NO: 4137189 - RNA, 14 nt, Yersinia pestis
ggcuggggcaagcu

SEQ ID NO: 4137190 - RNA, 18 nt, Yersinia pestis
ggcugguugaguuuaugg

SEQ ID NO: 4137191 - RNA, 22 nt, Yersinia pestis
ggcuguauuguugcucaacaua

SEQ ID NO: 4137192 - RNA, 21 nt, Yersinia pestis
ggcuguuguaguuagaugaca

SEQ ID NO: 4137193 - RNA, 19 nt, Yersinia pestis
ggcuuaacucgccacucac

SEQ ID NO: 4137194 - RNA, 15 nt, Yersinia pestis
ggcuuagucauuaag

SEQ ID NO: 4137195 - RNA, 20 nt, Yersinia pestis
ggcuuauuugcuaucaccgg

SEQ ID NO: 4137196 - RNA, 19 nt, Yersinia pestis
ggcuucaaaaucaccuggc

SEQ ID NO: 4137197 - RNA, 15 nt, Yersinia pestis
ggcuucgcuguagga

SEQ ID NO: 4137198 - RNA, 13 nt, Yersinia pestis
ggcuucuggaugg

SEQ ID NO: 4137199 - RNA, 23 nt, Yersinia pestis
ggcuugagcgacaaaagugucau

SEQ ID NO: 4137200 - RNA, 22 nt, Yersinia pestis
ggcuugcaaucagaggccauca

SEQ ID NO: 4137201 - RNA, 12 nt, Yersinia pestis
ggcuugcggcaa

SEQ ID NO: 4137202 - RNA, 12 nt, Yersinia pestis
ggcuugcugcaa

SEQ ID NO: 4137203 - RNA, 16 nt, Yersinia pestis
ggcuuggcaugacauc

SEQ ID NO: 4137204 - RNA, 15 nt, Yersinia pestis
ggcuugggagucaga

SEQ ID NO: 4137205 - RNA, 15 nt, Yersinia pestis
ggcuugguuguuucu

SEQ ID NO: 4137206 - RNA, 17 nt, Yersinia pestis
ggcuuuaagauccaguu

SEQ ID NO: 4137207 - RNA, 19 nt, Yersinia pestis
ggcuuuaagauccaguuca

SEQ ID NO: 4137208 - RNA, 16 nt, Yersinia pestis
ggcuuucaauaaaacu

SEQ ID NO: 4137209 - RNA, 13 nt, Yersinia pestis
ggcuuucagcaua

SEQ ID NO: 4137210 - RNA, 17 nt, Yersinia pestis
ggcuuucaggugacuga

SEQ ID NO: 4137211 - RNA, 17 nt, Yersinia pestis
ggcuuuugggucagggu

SEQ ID NO: 4137212 - RNA, 21 nt, Yersinia pestis
ggcuuuuucacacgcccaggc

SEQ ID NO: 4137213 - RNA, 14 nt, Yersinia pestis
ggcuuuuucuucca

SEQ ID NO: 4137214 - RNA, 23 nt, Yersinia pestis
ggcuuuuucuuccagcagggcca

SEQ ID NO: 4137215 - RNA, 19 nt, Yersinia pestis
ggcuuuuuuacgcgccugc

SEQ ID NO: 4137216 - RNA, 23 nt, Yersinia pestis
gggaaaaguggcuaucugaaacu

SEQ ID NO: 4137217 - RNA, 22 nt, Yersinia pestis
gggaaauagcaacuaaacacga

SEQ ID NO: 4137218 - RNA, 21 nt, Yersinia pestis
gggaaccccucugcagcguca

SEQ ID NO: 4137219 - RNA, 22 nt, Yersinia pestis
gggaagagauaaaucggcggcc

SEQ ID NO: 4137220 - RNA, 12 nt, Yersinia pestis
gggaagggcgcc

SEQ ID NO: 4137221 - RNA, 13 nt, Yersinia pestis
gggaagggcgccg

SEQ ID NO: 4137222 - RNA, 14 nt, Yersinia pestis
gggaauaaugguau

SEQ ID NO: 4137223 - RNA, 22 nt, Yersinia pestis
gggaauuaagaagccucaugaa

SEQ ID NO: 4137224 - RNA, 16 nt, Yersinia pestis
gggacgcguuugcuug

SEQ ID NO: 4137225 - RNA, 15 nt, Yersinia pestis
gggagccgcccugca

SEQ ID NO: 4137226 - RNA, 14 nt, Yersinia pestis
gggaguuacucagc

SEQ ID NO: 4137227 - RNA, 21 nt, Yersinia pestis
gggaguuacucagcauccucc

SEQ ID NO: 4137228 - RNA, 14 nt, Yersinia pestis
gggaguucaucaaa

SEQ ID NO: 4137229 - RNA, 18 nt, Yersinia pestis
gggauagcauaaauacgg

SEQ ID NO: 4137230 - RNA, 13 nt, Yersinia pestis
gggaucaacaugg

SEQ ID NO: 4137231 - RNA, 17 nt, Yersinia pestis
gggaucaccucuucagg

SEQ ID NO: 4137232 - RNA, 19 nt, Yersinia pestis
gggaucuccagaagcauau

SEQ ID NO: 4137233 - RNA, 22 nt, Yersinia pestis
gggauucaauaaguugcagagg

SEQ ID NO: 4137234 - RNA, 14 nt, Yersinia pestis
gggauucgaaccug

SEQ ID NO: 4137235 - RNA, 12 nt, Yersinia pestis
gggcaaaaaaau

SEQ ID NO: 4137236 - RNA, 18 nt, Yersinia pestis
gggcaacgguaaaagguu

SEQ ID NO: 4137237 - RNA, 19 nt, Yersinia pestis
gggcaacuccccacucaaa

SEQ ID NO: 4137238 - RNA, 21 nt, Yersinia pestis
gggcaauaacaaacacaucca

SEQ ID NO: 4137239 - RNA, 12 nt, Yersinia pestis
gggcacuuucau

SEQ ID NO: 4137240 - RNA, 12 nt, Yersinia pestis
gggcagaaaaua

SEQ ID NO: 4137241 - RNA, 16 nt, Yersinia pestis
gggcagcgacaaccug

SEQ ID NO: 4137242 - RNA, 17 nt, Yersinia pestis
gggcagguaaauagcca

SEQ ID NO: 4137243 - RNA, 13 nt, Yersinia pestis
gggcaguauaauu

SEQ ID NO: 4137244 - RNA, 18 nt, Yersinia pestis
gggcaucgaaaagcgccu

SEQ ID NO: 4137245 - RNA, 23 nt, Yersinia pestis
gggcauucauuucuuuggcugag

SEQ ID NO: 4137246 - RNA, 21 nt, Yersinia pestis
gggccaaggggagccacacac

SEQ ID NO: 4137247 - RNA, 16 nt, Yersinia pestis
gggccgacucugcaug

SEQ ID NO: 4137248 - RNA, 13 nt, Yersinia pestis
gggccgugcggga

SEQ ID NO: 4137249 - RNA, 17 nt, Yersinia pestis
gggccuguuugcagcga

SEQ ID NO: 4137250 - RNA, 18 nt, Yersinia pestis
gggccuuuauucauucag

SEQ ID NO: 4137251 - RNA, 15 nt, Yersinia pestis
gggcgauggcaacau

SEQ ID NO: 4137252 - RNA, 20 nt, Yersinia pestis
gggcgauggggaguauucgu

SEQ ID NO: 4137253 - RNA, 13 nt, Yersinia pestis
gggcgcagccccc

SEQ ID NO: 4137254 - RNA, 10 nt, Yersinia pestis
gggcgccccg

SEQ ID NO: 4137255 - RNA, 12 nt, Yersinia pestis
gggcgcggcugg

SEQ ID NO: 4137256 - RNA, 16 nt, Yersinia pestis
gggcgcuuacaugaug

SEQ ID NO: 4137257 - RNA, 14 nt, Yersinia pestis
gggcggcaaugacu

SEQ ID NO: 4137258 - RNA, 14 nt, Yersinia pestis
gggcggccagcaag

SEQ ID NO: 4137259 - RNA, 14 nt, Yersinia pestis
gggcggcggcuacg

SEQ ID NO: 4137260 - RNA, 16 nt, Yersinia pestis
gggcgguaguauuugu

SEQ ID NO: 4137261 - RNA, 13 nt, Yersinia pestis
gggcguucuguca

SEQ ID NO: 4137262 - RNA, 19 nt, Yersinia pestis
gggcguuuaccauccagug

SEQ ID NO: 4137263 - RNA, 21 nt, Yersinia pestis
gggcuaaaagggaguucauca

SEQ ID NO: 4137264 - RNA, 14 nt, Yersinia pestis
gggcuaaaauggca

SEQ ID NO: 4137265 - RNA, 22 nt, Yersinia pestis
gggcuaucaucaaaggcaauac

SEQ ID NO: 4137266 - RNA, 20 nt, Yersinia pestis
gggcugcacuuuuacgggcc

SEQ ID NO: 4137267 - RNA, 16 nt, Yersinia pestis
gggcuuccaucaggaa

SEQ ID NO: 4137268 - RNA, 15 nt, Yersinia pestis
gggcuuuaauacaau

SEQ ID NO: 4137269 - RNA, 21 nt, Yersinia pestis
gggcuuuaauacaauagagaa

SEQ ID NO: 4137270 - RNA, 16 nt, Yersinia pestis
gggcuuuuggggcgcu

SEQ ID NO: 4137271 - RNA, 18 nt, Yersinia pestis
ggggaaagcaauacgcca

SEQ ID NO: 4137272 - RNA, 15 nt, Yersinia pestis
ggggauugcugccaa

SEQ ID NO: 4137273 - RNA, 19 nt, Yersinia pestis
ggggcgagguuaccguuag

SEQ ID NO: 4137274 - RNA, 12 nt, Yersinia pestis
ggggcgguuggg

SEQ ID NO: 4137275 - RNA, 23 nt, Yersinia pestis
ggggcguuuaaugccccugaggu

SEQ ID NO: 4137276 - RNA, 21 nt, Yersinia pestis
ggggcuuguugauaugagcga

SEQ ID NO: 4137277 - RNA, 16 nt, Yersinia pestis
gggggcaauugauuga

SEQ ID NO: 4137278 - RNA, 12 nt, Yersinia pestis
gggggcaccgca

SEQ ID NO: 4137279 - RNA, 12 nt, Yersinia pestis
gggggcgacgau

SEQ ID NO: 4137280 - RNA, 19 nt, Yersinia pestis
gggggcgcucggcagcugu

SEQ ID NO: 4137281 - RNA, 17 nt, Yersinia pestis
ggggguugucagcaguc

SEQ ID NO: 4137282 - RNA, 14 nt, Yersinia pestis
gggguaagauccac

SEQ ID NO: 4137283 - RNA, 17 nt, Yersinia pestis
gggguuagcagaccggu

SEQ ID NO: 4137284 - RNA, 18 nt, Yersinia pestis
gggguucgcuauccccac

SEQ ID NO: 4137285 - RNA, 13 nt, Yersinia pestis
gggguugcaguua

SEQ ID NO: 4137286 - RNA, 21 nt, Yersinia pestis
ggguaacucccggcaggcagg

SEQ ID NO: 4137287 - RNA, 14 nt, Yersinia pestis
ggguaagaacagag

SEQ ID NO: 4137288 - RNA, 16 nt, Yersinia pestis
ggguaucagcgaccaa

SEQ ID NO: 4137289 - RNA, 12 nt, Yersinia pestis
ggguauccagug

SEQ ID NO: 4137290 - RNA, 21 nt, Yersinia pestis
ggguauccguguauuuaucaa

SEQ ID NO: 4137291 - RNA, 16 nt, Yersinia pestis
ggguauuccacccgca

SEQ ID NO: 4137292 - RNA, 15 nt, Yersinia pestis
gggucagggcggcgg

SEQ ID NO: 4137293 - RNA, 14 nt, Yersinia pestis
gggucgguaaccug

SEQ ID NO: 4137294 - RNA, 12 nt, Yersinia pestis
gggugagugagc

SEQ ID NO: 4137295 - RNA, 17 nt, Yersinia pestis
gggugagugagcgcagg

SEQ ID NO: 4137296 - RNA, 16 nt, Yersinia pestis
gggugagugagcgcgg

SEQ ID NO: 4137297 - RNA, 23 nt, Yersinia pestis
ggguggcagauagccagugggca

SEQ ID NO: 4137298 - RNA, 20 nt, Yersinia pestis
gggugguuagcagauaauaa

SEQ ID NO: 4137299 - RNA, 12 nt, Yersinia pestis
ggguuaaauagu

SEQ ID NO: 4137300 - RNA, 20 nt, Yersinia pestis
ggguuauaggccuaaacccc

SEQ ID NO: 4137301 - RNA, 14 nt, Yersinia pestis
ggguuccaacugau

SEQ ID NO: 4137302 - RNA, 19 nt, Yersinia pestis
ggguucuaaauccugcaaa

SEQ ID NO: 4137303 - RNA, 15 nt, Yersinia pestis
ggguuugagcagugc

SEQ ID NO: 4137304 - RNA, 23 nt, Yersinia pestis
gguaaaaucacguuuccaaaacu

SEQ ID NO: 4137305 - RNA, 20 nt, Yersinia pestis
gguaaacgcaucccaggcau

SEQ ID NO: 4137306 - RNA, 17 nt, Yersinia pestis
gguaaagcccauagcca

SEQ ID NO: 4137307 - RNA, 22 nt, Yersinia pestis
gguaacagagccuuauaggcgc

SEQ ID NO: 4137308 - RNA, 13 nt, Yersinia pestis
gguaacauauaaa

SEQ ID NO: 4137309 - RNA, 16 nt, Yersinia pestis
gguuaucacaucaucc

SEQ ID NO: 4137310 - RNA, 15 nt, Yersinia pestis
gguuaucuggaauuu

SEQ ID NO: 4137311 - RNA, 18 nt, Yersinia pestis
gguucaaguccaguaggg

SEQ ID NO: 4137312 - RNA, 16 nt, Yersinia pestis
gguucaagucccuccc

SEQ ID NO: 4137313 - RNA, 14 nt, Yersinia pestis
gguucaccccucac

SEQ ID NO: 4137314 - RNA, 19 nt, Yersinia pestis
gguucacccgcacgcccau

SEQ ID NO: 4137315 - RNA, 15 nt, Yersinia pestis
gguucauauuggcca

SEQ ID NO: 4137316 - RNA, 18 nt, Yersinia pestis
gguucgagacaacguuuc

SEQ ID NO: 4137317 - RNA, 18 nt, Yersinia pestis
gguucuaaauccugcaaa

SEQ ID NO: 4137318 - RNA, 15 nt, Yersinia pestis
gguugaaauaaauaa

SEQ ID NO: 4137319 - RNA, 20 nt, Yersinia pestis
gguugagcaucugaaagcuu

SEQ ID NO: 4137320 - RNA, 19 nt, Yersinia pestis
gguugccaaagcugcgcca

SEQ ID NO: 4137321 - RNA, 23 nt, Yersinia pestis
gguugccauuaauuggccgggac

SEQ ID NO: 4137322 - RNA, 20 nt, Yersinia pestis
gguugccgguuuauuauuca

SEQ ID NO: 4137323 - RNA, 22 nt, Yersinia pestis
gguugcucccguagcaaauaac

SEQ ID NO: 4137324 - RNA, 13 nt, Yersinia pestis
gguugcuguaaug

SEQ ID NO: 4137325 - RNA, 17 nt, Yersinia pestis
gguuguccuucaauggc

SEQ ID NO: 4137326 - RNA, 17 nt, Yersinia pestis
gguuuaacaauguggua

SEQ ID NO: 4137327 - RNA, 20 nt, Yersinia pestis
gguuuaccuauuuuaaaacu

SEQ ID NO: 4137328 - RNA, 15 nt, Yersinia pestis
gguuuaucaggugaa

SEQ ID NO: 4137329 - RNA, 13 nt, Yersinia pestis
gguuucaaauagc

SEQ ID NO: 4137330 - RNA, 20 nt, Yersinia pestis
gguuucacaugugcaauuaa

SEQ ID NO: 4137331 - RNA, 22 nt, Yersinia pestis
gguuucaccuaucgguaucucc

SEQ ID NO: 4137332 - RNA, 18 nt, Yersinia pestis
gguuucgcccaagccgac

SEQ ID NO: 4137333 - RNA, 17 nt, Yersinia pestis
gguuucugccuuaucaa

SEQ ID NO: 4137334 - RNA, 15 nt, Yersinia pestis
gguuugaauccagug

SEQ ID NO: 4137335 - RNA, 13 nt, Yersinia pestis
gguuugucagcag

SEQ ID NO: 4137336 - RNA, 10 nt, Yersinia pestis
gguuuuaauc

SEQ ID NO: 4137337 - RNA, 20 nt, Yersinia pestis
gguuuuaucaauaggucagu

SEQ ID NO: 4137338 - RNA, 14 nt, Yersinia pestis
gguuuucaccccca

SEQ ID NO: 4137339 - RNA, 12 nt, Yersinia pestis
gguuuuccccuc

SEQ ID NO: 4137340 - RNA, 17 nt, Yersinia pestis
gguuuuguuaauauuua

SEQ ID NO: 4137341 - RNA, 15 nt, Yersinia pestis
gguuuuuaacagcuu

SEQ ID NO: 4137342 - RNA, 23 nt, Yersinia pestis
gguuuuuauauuuaccugcucaa

SEQ ID NO: 4137343 - RNA, 12 nt, Yersinia pestis
guaaaaaaauag

SEQ ID NO: 4137344 - RNA, 15 nt, Yersinia pestis
guaaaaagcagcaaa

SEQ ID NO: 4137345 - RNA, 14 nt, Yersinia pestis
guaaaacagggagc

SEQ ID NO: 4137346 - RNA, 14 nt, Yersinia pestis
guaaaacauuucau

SEQ ID NO: 4137347 - RNA, 17 nt, Yersinia pestis
guaaaagauagauaacu

SEQ ID NO: 4137348 - RNA, 22 nt, Yersinia pestis
guaaaagcagccgugcuugauu

SEQ ID NO: 4137349 - RNA, 18 nt, Yersinia pestis
guaaaagucagcaaauca

SEQ ID NO: 4137350 - RNA, 16 nt, Yersinia pestis
guaaaauaaaaaagua

SEQ ID NO: 4137351 - RNA, 19 nt, Yersinia pestis
guaaaauuauugccgcaga

SEQ ID NO: 4137352 - RNA, 13 nt, Yersinia pestis
guaaaauuuaaag

SEQ ID NO: 4137353 - RNA, 14 nt, Yersinia pestis
guaaaauuuaaagu

SEQ ID NO: 4137354 - RNA, 19 nt, Yersinia pestis
guaaacagacacagcaaca

SEQ ID NO: 4137355 - RNA, 16 nt, Yersinia pestis
guaaacauccggcuga

SEQ ID NO: 4137356 - RNA, 15 nt, Yersinia pestis
guaaaccaauuuuaa

SEQ ID NO: 4137357 - RNA, 21 nt, Yersinia pestis
guaaacuuggccgauaugaag

SEQ ID NO: 4137358 - RNA, 12 nt, Yersinia pestis
guaaagaaaaaa

SEQ ID NO: 4137359 - RNA, 19 nt, Yersinia pestis
guaaagacgcuaauuaaag

SEQ ID NO: 4137360 - RNA, 23 nt, Yersinia pestis
guaaagcaaauucccaccauaau

SEQ ID NO: 4137361 - RNA, 17 nt, Yersinia pestis
guaaagguauagcgaua

SEQ ID NO: 4137362 - RNA, 16 nt, Yersinia pestis
guaaagguuucugccu

SEQ ID NO: 4137363 - RNA, 18 nt, Yersinia pestis
guaaagguuucugccuua

SEQ ID NO: 4137364 - RNA, 12 nt, Yersinia pestis
guaaauacaugg

SEQ ID NO: 4137365 - RNA, 18 nt, Yersinia pestis
guaaauagucauauauuu

SEQ ID NO: 4137366 - RNA, 13 nt, Yersinia pestis
guaaauauaaaau

SEQ ID NO: 4137367 - RNA, 19 nt, Yersinia pestis
guaaauauaauuucaaagu

SEQ ID NO: 4137368 - RNA, 18 nt, Yersinia pestis
guaaaugcuguaagaauu

SEQ ID NO: 4137369 - RNA, 21 nt, Yersinia pestis
guaaauguacagucauuuacu

SEQ ID NO: 4137370 - RNA, 13 nt, Yersinia pestis
guaaauuaaauuu

SEQ ID NO: 4137371 - RNA, 19 nt, Yersinia pestis
guaaauuagccacugguug

SEQ ID NO: 4137372 - RNA, 23 nt, Yersinia pestis
guaaauuauuuuccagaugaaua

SEQ ID NO: 4137373 - RNA, 22 nt, Yersinia pestis
guaaauucgggcuuuaauacaa

SEQ ID NO: 4137374 - RNA, 18 nt, Yersinia pestis
guaaauugcgagucucau

SEQ ID NO: 4137375 - RNA, 20 nt, Yersinia pestis
guaacaauaauaucguguug

SEQ ID NO: 4137376 - RNA, 13 nt, Yersinia pestis
guaacacacagca

SEQ ID NO: 4137377 - RNA, 20 nt, Yersinia pestis
guaacacacagcagacagcg

SEQ ID NO: 4137378 - RNA, 22 nt, Yersinia pestis
guaacacuucagacugaaagua

SEQ ID NO: 4137379 - RNA, 13 nt, Yersinia pestis
guaacagagcaga

SEQ ID NO: 4137380 - RNA, 22 nt, Yersinia pestis
guaacagagcagaaagcagcag

SEQ ID NO: 4137381 - RNA, 14 nt, Yersinia pestis
guaacagagccuua

SEQ ID NO: 4137382 - RNA, 15 nt, Yersinia pestis
guaacagagccuuau

SEQ ID NO: 4137383 - RNA, 24 nt, Yersinia pestis
guaacagagccuuauaggcgcaua

SEQ ID NO: 4137384 - RNA, 13 nt, Yersinia pestis
guaacagcggcga

SEQ ID NO: 4137385 - RNA, 17 nt, Yersinia pestis
guaacaggccauacugg

SEQ ID NO: 4137386 - RNA, 17 nt, Yersinia pestis
guaacauuuguauuuuu

SEQ ID NO: 4137387 - RNA, 19 nt, Yersinia pestis
guaacccgccucgcuuacu

SEQ ID NO: 4137388 - RNA, 12 nt, Yersinia pestis
guaaccuccacu

SEQ ID NO: 4137389 - RNA, 17 nt, Yersinia pestis
guaaccugaaagucagg

SEQ ID NO: 4137390 - RNA, 21 nt, Yersinia pestis
guaacgaacgcucuuuaacaa

SEQ ID NO: 4137391 - RNA, 18 nt, Yersinia pestis
guaacgaauucagcagcg

SEQ ID NO: 4137392 - RNA, 22 nt, Yersinia pestis
guaacgacgaaauagcgccugc

SEQ ID NO: 4137393 - RNA, 19 nt, Yersinia pestis
guaacgcagauaaaucagu

SEQ ID NO: 4137394 - RNA, 22 nt, Yersinia pestis
guaacgcagauaaaucaguggg

SEQ ID NO: 4137395 - RNA, 18 nt, Yersinia pestis
guaacgccgcuaaaucau

SEQ ID NO: 4137396 - RNA, 17 nt, Yersinia pestis
guaacguccaacugacg

SEQ ID NO: 4137397 - RNA, 13 nt, Yersinia pestis
guaacuaaagccg

SEQ ID NO: 4137398 - RNA, 18 nt, Yersinia pestis
guaacuauuuacauaaua

SEQ ID NO: 4137399 - RNA, 17 nt, Yersinia pestis
guaacucccggcaggca

SEQ ID NO: 4137400 - RNA, 18 nt, Yersinia pestis
guaacucuuguuaucacc

SEQ ID NO: 4137401 - RNA, 20 nt, Yersinia pestis
guaacugaguuggaaaugac

SEQ ID NO: 4137402 - RNA, 18 nt, Yersinia pestis
guaacuguguuugauuaa

SEQ ID NO: 4137403 - RNA, 17 nt, Yersinia pestis
guaacuuacaggcugcc

SEQ ID NO: 4137404 - RNA, 18 nt, Yersinia pestis
guaacuugccguaaaauu

SEQ ID NO: 4137405 - RNA, 19 nt, Yersinia pestis
guaacuuuuuguugcacca

SEQ ID NO: 4137406 - RNA, 20 nt, Yersinia pestis
guaagaaagagaugacccaa

SEQ ID NO: 4137407 - RNA, 16 nt, Yersinia pestis
guaagaauaaauaaua

SEQ ID NO: 4137408 - RNA, 17 nt, Yersinia pestis
guaagacucaugauauu

SEQ ID NO: 4137409 - RNA, 21 nt, Yersinia pestis
guaagauaccaacccacucuu

SEQ ID NO: 4137410 - RNA, 19 nt, Yersinia pestis
guaagauccaccacaucau

SEQ ID NO: 4137411 - RNA, 22 nt, Yersinia pestis
guaagcacgcuugauggccaca

SEQ ID NO: 4137412 - RNA, 15 nt, Yersinia pestis
guaagcaucuuuuca

SEQ ID NO: 4137413 - RNA, 14 nt, Yersinia pestis
guaagcaugccauc

SEQ ID NO: 4137414 - RNA, 20 nt, Yersinia pestis
guaagccuucaaccugaauc

SEQ ID NO: 4137415 - RNA, 20 nt, Yersinia pestis
guaagcggguuagcgccgcu

SEQ ID NO: 4137416 - RNA, 18 nt, Yersinia pestis
guaagcucuacuaauauu

SEQ ID NO: 4137417 - RNA, 15 nt, Yersinia pestis
guaaggcaauaccaa

SEQ ID NO: 4137418 - RNA, 15 nt, Yersinia pestis
guaaggccaaacccg

SEQ ID NO: 4137419 - RNA, 18 nt, Yersinia pestis
guaagggaaauugucugg

SEQ ID NO: 4137420 - RNA, 14 nt, Yersinia pestis
guaagugauucggg

SEQ ID NO: 4137421 - RNA, 12 nt, Yersinia pestis
guaauaaaucau

SEQ ID NO: 4137422 - RNA, 18 nt, Yersinia pestis
guaauaaaucaugucccu

SEQ ID NO: 4137423 - RNA, 15 nt, Yersinia pestis
guaauaacgggcggc

SEQ ID NO: 4137424 - RNA, 20 nt, Yersinia pestis
guaauaacucagccauugcu

SEQ ID NO: 4137425 - RNA, 15 nt, Yersinia pestis
guaauaaggucacug

SEQ ID NO: 4137426 - RNA, 17 nt, Yersinia pestis
guaauaaggucacuguu

SEQ ID NO: 4137427 - RNA, 16 nt, Yersinia pestis
guaauaaguagaaaaa

SEQ ID NO: 4137428 - RNA, 23 nt, Yersinia pestis
guaauaauaauucauaugacaaa

SEQ ID NO: 4137429 - RNA, 18 nt, Yersinia pestis
guaauaccacaccuuauc

SEQ ID NO: 4137430 - RNA, 23 nt, Yersinia pestis
guaauaccccacccagagcguuu

SEQ ID NO: 4137431 - RNA, 21 nt, Yersinia pestis
guaucgcccuggcuaauuuua

SEQ ID NO: 4137432 - RNA, 16 nt, Yersinia pestis
guaucggguagcaucc

SEQ ID NO: 4137433 - RNA, 16 nt, Yersinia pestis
guaucguccagcagca

SEQ ID NO: 4137434 - RNA, 16 nt, Yersinia pestis
guaucgucuauagugc

SEQ ID NO: 4137435 - RNA, 22 nt, Yersinia pestis
guaucucacucaggcgugucau

SEQ ID NO: 4137436 - RNA, 19 nt, Yersinia pestis
guaucuguuuuugccaccu

SEQ ID NO: 4137437 - RNA, 21 nt, Yersinia pestis
guaucuguuuuuuaucccuac

SEQ ID NO: 4137438 - RNA, 17 nt, Yersinia pestis
guaucuucauccgcucc

SEQ ID NO: 4137439 - RNA, 19 nt, Yersinia pestis
guaugagcgcagaguccuc

SEQ ID NO: 4137440 - RNA, 11 nt, Yersinia pestis
guaugauccuu

SEQ ID NO: 4137441 - RNA, 21 nt, Yersinia pestis
guaugcgcaccgaaauagucg

SEQ ID NO: 4137442 - RNA, 15 nt, Yersinia pestis
guaugcuuucaucuu

SEQ ID NO: 4137443 - RNA, 21 nt, Yersinia pestis
guauggcgcuuaacugcacga

SEQ ID NO: 4137444 - RNA, 17 nt, Yersinia pestis
guauguuccugaauggc

SEQ ID NO: 4137445 - RNA, 19 nt, Yersinia pestis
guauguuuucggcuugcaa

SEQ ID NO: 4137446 - RNA, 19 nt, Yersinia pestis
guauuaagacaaggaaaag

SEQ ID NO: 4137447 - RNA, 23 nt, Yersinia pestis
guauuaaucaacagauaugcauu

SEQ ID NO: 4137448 - RNA, 17 nt, Yersinia pestis
guauuacaggccccuuc

SEQ ID NO: 4137449 - RNA, 16 nt, Yersinia pestis
guauuaccaaucagcg

SEQ ID NO: 4137450 - RNA, 11 nt, Yersinia pestis
guauuacccac

SEQ ID NO: 4137451 - RNA, 22 nt, Yersinia pestis
guauuaccgauaaaggccgcag

SEQ ID NO: 4137452 - RNA, 19 nt, Yersinia pestis
guauucauaucgcuaaaac

SEQ ID NO: 4137453 - RNA, 17 nt, Yersinia pestis
guauucugccggacuca

SEQ ID NO: 4137454 - RNA, 12 nt, Yersinia pestis
guauucuuauca

SEQ ID NO: 4137455 - RNA, 19 nt, Yersinia pestis
guauugaccagauaggcuu

SEQ ID NO: 4137456 - RNA, 12 nt, Yersinia pestis
guauugcacuga

SEQ ID NO: 4137457 - RNA, 19 nt, Yersinia pestis
guauugcagagcaaaacug

SEQ ID NO: 4137458 - RNA, 19 nt, Yersinia pestis
guauugguaacgcagaaau

SEQ ID NO: 4137459 - RNA, 13 nt, Yersinia pestis
guauuuauuccac

SEQ ID NO: 4137460 - RNA, 17 nt, Yersinia pestis
guauuucaaauaagugu

SEQ ID NO: 4137461 - RNA, 15 nt, Yersinia pestis
guauuugaacuucaa

SEQ ID NO: 4137462 - RNA, 14 nt, Yersinia pestis
guauuugguuauau

SEQ ID NO: 4137463 - RNA, 20 nt, Yersinia pestis
guauuuguagugaaugacag

SEQ ID NO: 4137464 - RNA, 13 nt, Yersinia pestis
guauuuguauuua

SEQ ID NO: 4137465 - RNA, 15 nt, Yersinia pestis
guauuuucaaucgcu

SEQ ID NO: 4137466 - RNA, 23 nt, Yersinia pestis
guauuuugcacaaagcuuacugu

SEQ ID NO: 4137467 - RNA, 16 nt, Yersinia pestis
guauuuugucaugaaa

SEQ ID NO: 4137468 - RNA, 23 nt, Yersinia pestis
gucaaaaacccauuaaaaacaaa

SEQ ID NO: 4137469 - RNA, 21 nt, Yersinia pestis
gucaaacucagcgaauaaaua

SEQ ID NO: 4137470 - RNA, 21 nt, Yersinia pestis
gucaaacuccccuggcaggcc

SEQ ID NO: 4137471 - RNA, 22 nt, Yersinia pestis
gucaaauucccccaaaaccucu

SEQ ID NO: 4137472 - RNA, 16 nt, Yersinia pestis
gucaaauuuaaaguuu

SEQ ID NO: 4137473 - RNA, 22 nt, Yersinia pestis
gucaaccguuguguaucagcaa

SEQ ID NO: 4137474 - RNA, 20 nt, Yersinia pestis
gucaacuaaacagaucaccc

SEQ ID NO: 4137475 - RNA, 14 nt, Yersinia pestis
gucaagacaacaaa

SEQ ID NO: 4137476 - RNA, 17 nt, Yersinia pestis
gucaagacaacaaacag

SEQ ID NO: 4137477 - RNA, 15 nt, Yersinia pestis
gucaagaugcauauu

SEQ ID NO: 4137478 - RNA, 18 nt, Yersinia pestis
gucaagcgacccggcugc

SEQ ID NO: 4137479 - RNA, 18 nt, Yersinia pestis
gucaagguacccauuauu

SEQ ID NO: 4137480 - RNA, 17 nt, Yersinia pestis
gucaaggugauuucaaa

SEQ ID NO: 4137481 - RNA, 20 nt, Yersinia pestis
gucaauaaaacagagcgcga

SEQ ID NO: 4137482 - RNA, 23 nt, Yersinia pestis
gucaauaaaaugggccugagugg

SEQ ID NO: 4137483 - RNA, 17 nt, Yersinia pestis
gucaauaaccucagccu

SEQ ID NO: 4137484 - RNA, 19 nt, Yersinia pestis
gucaauaaccucagccuca

SEQ ID NO: 4137485 - RNA, 21 nt, Yersinia pestis
gucaauaaccucagccucauu

SEQ ID NO: 4137486 - RNA, 13 nt, Yersinia pestis
gucaauaccuuac

SEQ ID NO: 4137487 - RNA, 15 nt, Yersinia pestis
gucaauauaacguuu

SEQ ID NO: 4137488 - RNA, 21 nt, Yersinia pestis
gucaauauaccuuuguaucca

SEQ ID NO: 4137489 - RNA, 16 nt, Yersinia pestis
gucaaucauuuuuuua

SEQ ID NO: 4137490 - RNA, 18 nt, Yersinia pestis
gucaaugcucaaguguaa

SEQ ID NO: 4137491 - RNA, 21 nt, Yersinia pestis
gucaauguguugaauauccaa

SEQ ID NO: 4137492 - RNA, 16 nt, Yersinia pestis
gucaauguucucuggg

SEQ ID NO: 4137493 - RNA, 18 nt, Yersinia pestis
gucaauugagaauaacgc

SEQ ID NO: 4137494 - RNA, 22 nt, Yersinia pestis
gucaauuuuugccuuucugggc

SEQ ID NO: 4137495 - RNA, 10 nt, Yersinia pestis
gucacagcau

SEQ ID NO: 4137496 - RNA, 15 nt, Yersinia pestis
gucacaggggcaauu

SEQ ID NO: 4137497 - RNA, 13 nt, Yersinia pestis
gucacauuuuuaa

SEQ ID NO: 4137498 - RNA, 22 nt, Yersinia pestis
gucaccaaaaucccaaaauaug

SEQ ID NO: 4137499 - RNA, 15 nt, Yersinia pestis
gucaccaaauauuac

SEQ ID NO: 4137500 - RNA, 16 nt, Yersinia pestis
gucaccaucaauauaa

SEQ ID NO: 4137501 - RNA, 13 nt, Yersinia pestis
gucacccacuaau

SEQ ID NO: 4137502 - RNA, 19 nt, Yersinia pestis
gucacccgcacguagcaca

SEQ ID NO: 4137503 - RNA, 22 nt, Yersinia pestis
gucacccuuuugaauucaccaa

SEQ ID NO: 4137504 - RNA, 14 nt, Yersinia pestis
gucaccuaccaccu

SEQ ID NO: 4137505 - RNA, 16 nt, Yersinia pestis
gucaccugucaccugu

SEQ ID NO: 4137506 - RNA, 18 nt, Yersinia pestis
gucaccugucaccuguca

SEQ ID NO: 4137507 - RNA, 12 nt, Yersinia pestis
gucacggaaagc

SEQ ID NO: 4137508 - RNA, 17 nt, Yersinia pestis
gucacggaaagcagguc

SEQ ID NO: 4137509 - RNA, 13 nt, Yersinia pestis
gucacgucuucac

SEQ ID NO: 4137510 - RNA, 16 nt, Yersinia pestis
gucacuaaaacugaag

SEQ ID NO: 4137511 - RNA, 15 nt, Yersinia pestis
gucacucagaaaaca

SEQ ID NO: 4137512 - RNA, 16 nt, Yersinia pestis
gucacugccaucucau

SEQ ID NO: 4137513 - RNA, 22 nt, Yersinia pestis
gucacuggcaccauuugcccug

SEQ ID NO: 4137514 - RNA, 20 nt, Yersinia pestis
gucacuuaaauaacucagug

SEQ ID NO: 4137515 - RNA, 20 nt, Yersinia pestis
gucacuuacugaucaauaaa

SEQ ID NO: 4137516 - RNA, 17 nt, Yersinia pestis
gucacuuugggcugauc

SEQ ID NO: 4137517 - RNA, 13 nt, Yersinia pestis
gucagaaauaaau

SEQ ID NO: 4137518 - RNA, 13 nt, Yersinia pestis
gucagaaccuguu

SEQ ID NO: 4137519 - RNA, 22 nt, Yersinia pestis
gucagacacgguauucaggaug

SEQ ID NO: 4137520 - RNA, 13 nt, Yersinia pestis
gucagacugcuga

SEQ ID NO: 4137521 - RNA, 15 nt, Yersinia pestis
gucagacugcugaca

SEQ ID NO: 4137522 - RNA, 15 nt, Yersinia pestis
gucagauaucugcuc

SEQ ID NO: 4137523 - RNA, 13 nt, Yersinia pestis
gucagaucgcgau

SEQ ID NO: 4137524 - RNA, 20 nt, Yersinia pestis
gucagaucgcgaugcgccug

SEQ ID NO: 4137525 - RNA, 20 nt, Yersinia pestis
gucagauuagucuuagacgu

SEQ ID NO: 4137526 - RNA, 20 nt, Yersinia pestis
gucagauuaguuuuagacgu

SEQ ID NO: 4137527 - RNA, 17 nt, Yersinia pestis
gucagcaaaucaaacaa

SEQ ID NO: 4137528 - RNA, 13 nt, Yersinia pestis
gucagcacuucca

SEQ ID NO: 4137529 - RNA, 18 nt, Yersinia pestis
gucagcagacgaaccgcu

SEQ ID NO: 4137530 - RNA, 16 nt, Yersinia pestis
gucagcagucugagcc

SEQ ID NO: 4137531 - RNA, 22 nt, Yersinia pestis
gucagcccaacgucauuuccgu

SEQ ID NO: 4137532 - RNA, 15 nt, Yersinia pestis
gucagccccugccag

SEQ ID NO: 4137533 - RNA, 16 nt, Yersinia pestis
gucagcugacgcagca

SEQ ID NO: 4137534 - RNA, 20 nt, Yersinia pestis
gucagcuggaacaagagauc

SEQ ID NO: 4137535 - RNA, 20 nt, Yersinia pestis
gucaggaaacuggccaacuc

SEQ ID NO: 4137536 - RNA, 16 nt, Yersinia pestis
gucaggaacccauuug

SEQ ID NO: 4137537 - RNA, 18 nt, Yersinia pestis
gucaggccaccaaucaca

SEQ ID NO: 4137538 - RNA, 22 nt, Yersinia pestis
gucaggccaccaaucacacugg

SEQ ID NO: 4137539 - RNA, 15 nt, Yersinia pestis
gucaggguaagcuga

SEQ ID NO: 4137540 - RNA, 15 nt, Yersinia pestis
gucagggugaaagcc

SEQ ID NO: 4137541 - RNA, 18 nt, Yersinia pestis
gucagguuaauaccugca

SEQ ID NO: 4137542 - RNA, 15 nt, Yersinia pestis
gucagguuuaucagg

SEQ ID NO: 4137543 - RNA, 12 nt, Yersinia pestis
gucagucagggu

SEQ ID NO: 4137544 - RNA, 15 nt, Yersinia pestis
gucagucagggugaa

SEQ ID NO: 4137545 - RNA, 14 nt, Yersinia pestis
gucagucuugcugc

SEQ ID NO: 4137546 - RNA, 23 nt, Yersinia pestis
gucagugauucgggugagugagc

SEQ ID NO: 4137547 - RNA, 15 nt, Yersinia pestis
gucagugguuuuaua

SEQ ID NO: 4137548 - RNA, 16 nt, Yersinia pestis
gucagugguuuuauca

SEQ ID NO: 4137549 - RNA, 12 nt, Yersinia pestis
gucaguucaucg

SEQ ID NO: 4137550 - RNA, 15 nt, Yersinia pestis
gucauaauugccaaa

SEQ ID NO: 4137551 - RNA, 14 nt, Yersinia pestis
gucauauauuuuuc

SEQ ID NO: 4137552 - RNA, 14 nt, Yersinia pestis
gucaucacccagca

SEQ ID NO: 4137553 - RNA, 13 nt, Yersinia pestis
gugaacauuuauc

SEQ ID NO: 4137554 - RNA, 21 nt, Yersinia pestis
gugaaccgcgcucugcuggga

SEQ ID NO: 4137555 - RNA, 19 nt, Yersinia pestis
gugaacguacuuugguugu

SEQ ID NO: 4137556 - RNA, 12 nt, Yersinia pestis
gugaagaacagc

SEQ ID NO: 4137557 - RNA, 17 nt, Yersinia pestis
gugaagacaucgccaga

SEQ ID NO: 4137558 - RNA, 21 nt, Yersinia pestis
gugaagcaauuugaucaccaa

SEQ ID NO: 4137559 - RNA, 18 nt, Yersinia pestis
gugaaggggggcggauca

SEQ ID NO: 4137560 - RNA, 17 nt, Yersinia pestis
gugaauaacgcuggaua

SEQ ID NO: 4137561 - RNA, 16 nt, Yersinia pestis
gugaauaccauuucac

SEQ ID NO: 4137562 - RNA, 14 nt, Yersinia pestis
gugaaucagccaga

SEQ ID NO: 4137563 - RNA, 13 nt, Yersinia pestis
gugaauuagguaa

SEQ ID NO: 4137564 - RNA, 16 nt, Yersinia pestis
gugaauucacucagau

SEQ ID NO: 4137565 - RNA, 13 nt, Yersinia pestis
gugacaaacgcuu

SEQ ID NO: 4137566 - RNA, 13 nt, Yersinia pestis
gugacaggcaaag

SEQ ID NO: 4137567 - RNA, 15 nt, Yersinia pestis
gugacaggcaaagac

SEQ ID NO: 4137568 - RNA, 23 nt, Yersinia pestis
gugacaguagaauaccucacugg

SEQ ID NO: 4137569 - RNA, 18 nt, Yersinia pestis
gugaccaaagcaguaaac

SEQ ID NO: 4137570 - RNA, 21 nt, Yersinia pestis
gugaccaaagcaguaaacauu

SEQ ID NO: 4137571 - RNA, 17 nt, Yersinia pestis
gugacccaagaugacca

SEQ ID NO: 4137572 - RNA, 20 nt, Yersinia pestis
gugacgcagugacgcaguga

SEQ ID NO: 4137573 - RNA, 12 nt, Yersinia pestis
gugacgcugggc

SEQ ID NO: 4137574 - RNA, 15 nt, Yersinia pestis
gugacuaaaacaagc

SEQ ID NO: 4137575 - RNA, 14 nt, Yersinia pestis
gugacuaacacggu

SEQ ID NO: 4137576 - RNA, 22 nt, Yersinia pestis
gugagagaagaucacgcuaccg

SEQ ID NO: 4137577 - RNA, 12 nt, Yersinia pestis
gugagcgucauu

SEQ ID NO: 4137578 - RNA, 20 nt, Yersinia pestis
gugaggcucauuaaucccca

SEQ ID NO: 4137579 - RNA, 15 nt, Yersinia pestis
gugagggcaauuaaa

SEQ ID NO: 4137580 - RNA, 21 nt, Yersinia pestis
gugaguaauucgcagacagau

SEQ ID NO: 4137581 - RNA, 22 nt, Yersinia pestis
gugaguaucuucauccgcucca

SEQ ID NO: 4137582 - RNA, 11 nt, Yersinia pestis
gugagugacau

SEQ ID NO: 4137583 - RNA, 13 nt, Yersinia pestis
gugagugagcgca

SEQ ID NO: 4137584 - RNA, 14 nt, Yersinia pestis
gugaguggcuggga

SEQ ID NO: 4137585 - RNA, 21 nt, Yersinia pestis
gugaguuacgugagcaucugg

SEQ ID NO: 4137586 - RNA, 16 nt, Yersinia pestis
gugaguuccagcccca

SEQ ID NO: 4137587 - RNA, 17 nt, Yersinia pestis
gugauaaacuuaucggu

SEQ ID NO: 4137588 - RNA, 16 nt, Yersinia pestis
gugauaaguuuuaaua

SEQ ID NO: 4137589 - RNA, 17 nt, Yersinia pestis
gugauauaaauccaagg

SEQ ID NO: 4137590 - RNA, 20 nt, Yersinia pestis
gugauauuauuuauuuuaua

SEQ ID NO: 4137591 - RNA, 14 nt, Yersinia pestis
gugaucaccugagc

SEQ ID NO: 4137592 - RNA, 19 nt, Yersinia pestis
gugaucaguccuuagcaug

SEQ ID NO: 4137593 - RNA, 21 nt, Yersinia pestis
gugaucauauuaggcagguga

SEQ ID NO: 4137594 - RNA, 15 nt, Yersinia pestis
gugaucaucuuuuuu

SEQ ID NO: 4137595 - RNA, 21 nt, Yersinia pestis
gugauccacuuauaucuccac

SEQ ID NO: 4137596 - RNA, 22 nt, Yersinia pestis
gugaucgcucaggcggucaccg

SEQ ID NO: 4137597 - RNA, 16 nt, Yersinia pestis
gugaucgcugccaccg

SEQ ID NO: 4137598 - RNA, 19 nt, Yersinia pestis
gugaugaaaccaaaaccuu

SEQ ID NO: 4137599 - RNA, 22 nt, Yersinia pestis
gugaugaaauccagaucagcgc

SEQ ID NO: 4137600 - RNA, 21 nt, Yersinia pestis
gugaugaagguagucccucaa

SEQ ID NO: 4137601 - RNA, 16 nt, Yersinia pestis
gugaugaugcuaguga

SEQ ID NO: 4137602 - RNA, 14 nt, Yersinia pestis
gugaugcaguaaau

SEQ ID NO: 4137603 - RNA, 14 nt, Yersinia pestis
gugauggcggcugg

SEQ ID NO: 4137604 - RNA, 18 nt, Yersinia pestis
gugauggcugucugauga

SEQ ID NO: 4137605 - RNA, 20 nt, Yersinia pestis
gugauguggcuugcaaucag

SEQ ID NO: 4137606 - RNA, 22 nt, Yersinia pestis
gugauuaauacacgcuuccagu

SEQ ID NO: 4137607 - RNA, 14 nt, Yersinia pestis
gugauuacugucau

SEQ ID NO: 4137608 - RNA, 15 nt, Yersinia pestis
gugauuagcaguaau

SEQ ID NO: 4137609 - RNA, 16 nt, Yersinia pestis
gugauuauagcggcaa

SEQ ID NO: 4137610 - RNA, 19 nt, Yersinia pestis
gugauucgcucgcauaaau

SEQ ID NO: 4137611 - RNA, 15 nt, Yersinia pestis
gugauuucagccagg

SEQ ID NO: 4137612 - RNA, 16 nt, Yersinia pestis
gugauuuuaaccacuc

SEQ ID NO: 4137613 - RNA, 12 nt, Yersinia pestis
gugauuuuuaua

SEQ ID NO: 4137614 - RNA, 20 nt, Yersinia pestis
gugcaacaucaggccuucuu

SEQ ID NO: 4137615 - RNA, 17 nt, Yersinia pestis
gugcaacauuaaaaaua

SEQ ID NO: 4137616 - RNA, 18 nt, Yersinia pestis
gugcacggcagugaucaa

SEQ ID NO: 4137617 - RNA, 14 nt, Yersinia pestis
gugcagcaucaccc

SEQ ID NO: 4137618 - RNA, 19 nt, Yersinia pestis
gugcagcgcgcagccaacg

SEQ ID NO: 4137619 - RNA, 20 nt, Yersinia pestis
gugcaguaauggaaauagcu

SEQ ID NO: 4137620 - RNA, 15 nt, Yersinia pestis
gugcauaaaacgauu

SEQ ID NO: 4137621 - RNA, 18 nt, Yersinia pestis
gugcauaaaacgauuuuc

SEQ ID NO: 4137622 - RNA, 13 nt, Yersinia pestis
gugcauccccacu

SEQ ID NO: 4137623 - RNA, 14 nt, Yersinia pestis
gugcauguagcugc

SEQ ID NO: 4137624 - RNA, 19 nt, Yersinia pestis
gugcauguggaagcgggcg

SEQ ID NO: 4137625 - RNA, 16 nt, Yersinia pestis
gugccaacccuugaua

SEQ ID NO: 4137626 - RNA, 15 nt, Yersinia pestis
gugccaauccccacc

SEQ ID NO: 4137627 - RNA, 15 nt, Yersinia pestis
gugccaaugccucuu

SEQ ID NO: 4137628 - RNA, 22 nt, Yersinia pestis
gugccagcaaagacaauaacgg

SEQ ID NO: 4137629 - RNA, 13 nt, Yersinia pestis
gugccagcagcaa

SEQ ID NO: 4137630 - RNA, 21 nt, Yersinia pestis
gugccauaaauaccaauuuca

SEQ ID NO: 4137631 - RNA, 13 nt, Yersinia pestis
gugccaucgccaa

SEQ ID NO: 4137632 - RNA, 14 nt, Yersinia pestis
gugccauggucagu

SEQ ID NO: 4137633 - RNA, 13 nt, Yersinia pestis
gugccccauggcu

SEQ ID NO: 4137634 - RNA, 19 nt, Yersinia pestis
gugcccgguaaagugacuc

SEQ ID NO: 4137635 - RNA, 13 nt, Yersinia pestis
gugccgcggcggc

SEQ ID NO: 4137636 - RNA, 22 nt, Yersinia pestis
gugccguagguaauuaaacgcu

SEQ ID NO: 4137637 - RNA, 19 nt, Yersinia pestis
gugccgugucuuccagaca

SEQ ID NO: 4137638 - RNA, 12 nt, Yersinia pestis
gugccugacuga

SEQ ID NO: 4137639 - RNA, 14 nt, Yersinia pestis
gugccugcggcgga

SEQ ID NO: 4137640 - RNA, 13 nt, Yersinia pestis
gugccugcuggca

SEQ ID NO: 4137641 - RNA, 19 nt, Yersinia pestis
gugcgacacgcucauccaa

SEQ ID NO: 4137642 - RNA, 14 nt, Yersinia pestis
gugcgcaucaauga

SEQ ID NO: 4137643 - RNA, 16 nt, Yersinia pestis
gugcgcaucagccagc

SEQ ID NO: 4137644 - RNA, 13 nt, Yersinia pestis
gugcgccaaccgc

SEQ ID NO: 4137645 - RNA, 15 nt, Yersinia pestis
gugcgcuuugcagua

SEQ ID NO: 4137646 - RNA, 15 nt, Yersinia pestis
gugcggauggcugcu

SEQ ID NO: 4137647 - RNA, 13 nt, Yersinia pestis
gugcggcuggcga

SEQ ID NO: 4137648 - RNA, 16 nt, Yersinia pestis
gugcgggccagaauaa

SEQ ID NO: 4137649 - RNA, 13 nt, Yersinia pestis
gugcguaaagaaa

SEQ ID NO: 4137650 - RNA, 16 nt, Yersinia pestis
gugcguaaagaaaaaa

SEQ ID NO: 4137651 - RNA, 12 nt, Yersinia pestis
gugcguaggcaa

SEQ ID NO: 4137652 - RNA, 14 nt, Yersinia pestis
gugcuagugcuggu

SEQ ID NO: 4137653 - RNA, 16 nt, Yersinia pestis
gugcuauucauaaauc

SEQ ID NO: 4137654 - RNA, 21 nt, Yersinia pestis
gugcucacaaucuucuucagu

SEQ ID NO: 4137655 - RNA, 15 nt, Yersinia pestis
gugcucacgucacca

SEQ ID NO: 4137656 - RNA, 14 nt, Yersinia pestis
gugcucauuaaaac

SEQ ID NO: 4137657 - RNA, 19 nt, Yersinia pestis
gugcucauuaaaaccacgc

SEQ ID NO: 4137658 - RNA, 16 nt, Yersinia pestis
gugcucccaaucaaug

SEQ ID NO: 4137659 - RNA, 20 nt, Yersinia pestis
gugcucgggugccucacgua

SEQ ID NO: 4137660 - RNA, 21 nt, Yersinia pestis
gugcucgggugccucacguau

SEQ ID NO: 4137661 - RNA, 17 nt, Yersinia pestis
gugcugccauauauucu

SEQ ID NO: 4137662 - RNA, 19 nt, Yersinia pestis
gugcugcuaauauuuauaa

SEQ ID NO: 4137663 - RNA, 15 nt, Yersinia pestis
gugcuucucugccgc

SEQ ID NO: 4137664 - RNA, 23 nt, Yersinia pestis
gugcuuuauccaauggcucaccu

SEQ ID NO: 4137665 - RNA, 14 nt, Yersinia pestis
guggaacaacaggc

SEQ ID NO: 4137666 - RNA, 14 nt, Yersinia pestis
guggaaucggccuu

SEQ ID NO: 4137667 - RNA, 13 nt, Yersinia pestis
guggauaaacaaa

SEQ ID NO: 4137668 - RNA, 13 nt, Yersinia pestis
guggauccagcac

SEQ ID NO: 4137669 - RNA, 22 nt, Yersinia pestis
guggcaacucuagcgccagcaa

SEQ ID NO: 4137670 - RNA, 14 nt, Yersinia pestis
guggcagagaacau

SEQ ID NO: 4137671 - RNA, 23 nt, Yersinia pestis
guggcagauuggcuugcuugaug

SEQ ID NO: 4137672 - RNA, 19 nt, Yersinia pestis
guggcagccugcggcggcu

SEQ ID NO: 4137673 - RNA, 16 nt, Yersinia pestis
guggcaguacaaauug

SEQ ID NO: 4137674 - RNA, 15 nt, Yersinia pestis
guggcauguucagca

SEQ ID NO: 4137675 - RNA, 15 nt, Yersinia pestis
guggccacucaccuc

SEQ ID NO: 4137676 - RNA, 13 nt, Yersinia pestis
guuauuugcuauc

SEQ ID NO: 4137677 - RNA, 13 nt, Yersinia pestis
guuauuuucuaua

SEQ ID NO: 4137678 - RNA, 13 nt, Yersinia pestis
guucaaaaaauag

SEQ ID NO: 4137679 - RNA, 15 nt, Yersinia pestis
guucaaaaaauaggc

SEQ ID NO: 4137680 - RNA, 21 nt, Yersinia pestis
guucaaaucaguuccugauuc

SEQ ID NO: 4137681 - RNA, 14 nt, Yersinia pestis
guucaaaucugcuc

SEQ ID NO: 4137682 - RNA, 22 nt, Yersinia pestis
guucaagagcgauagaucgaua

SEQ ID NO: 4137683 - RNA, 13 nt, Yersinia pestis
guucaagagugag

SEQ ID NO: 4137684 - RNA, 19 nt, Yersinia pestis
guucaagauaaaguucuuc

SEQ ID NO: 4137685 - RNA, 18 nt, Yersinia pestis
guucaagucccucccuuc

SEQ ID NO: 4137686 - RNA, 12 nt, Yersinia pestis
guucaauaauua

SEQ ID NO: 4137687 - RNA, 19 nt, Yersinia pestis
guucaauggucaugcacag

SEQ ID NO: 4137688 - RNA, 18 nt, Yersinia pestis
guucacaugaugaaugcg

SEQ ID NO: 4137689 - RNA, 16 nt, Yersinia pestis
guucaccaaagcaaug

SEQ ID NO: 4137690 - RNA, 14 nt, Yersinia pestis
guucaccccagcaa

SEQ ID NO: 4137691 - RNA, 22 nt, Yersinia pestis
guucaccccagucacuuacuga

SEQ ID NO: 4137692 - RNA, 15 nt, Yersinia pestis
guucaccgcaucgcc

SEQ ID NO: 4137693 - RNA, 21 nt, Yersinia pestis
guucacuucgcggacgcuggc

SEQ ID NO: 4137694 - RNA, 23 nt, Yersinia pestis
guucacuucgcggacgcuggcac

SEQ ID NO: 4137695 - RNA, 16 nt, Yersinia pestis
guucagaucggcucca

SEQ ID NO: 4137696 - RNA, 13 nt, Yersinia pestis
guucagcaccagu

SEQ ID NO: 4137697 - RNA, 23 nt, Yersinia pestis
guucagcgacgauaauuugcagc

SEQ ID NO: 4137698 - RNA, 21 nt, Yersinia pestis
guucagugcucccugaacgcc

SEQ ID NO: 4137699 - RNA, 15 nt, Yersinia pestis
guucauaaauuaaaa

SEQ ID NO: 4137700 - RNA, 18 nt, Yersinia pestis
guucauaaauuaaaacug

SEQ ID NO: 4137701 - RNA, 20 nt, Yersinia pestis
guucauaaauuaaaacugaa

SEQ ID NO: 4137702 - RNA, 22 nt, Yersinia pestis
guucauauaguugcuuaucguc

SEQ ID NO: 4137703 - RNA, 14 nt, Yersinia pestis
guucauauuggcca

SEQ ID NO: 4137704 - RNA, 15 nt, Yersinia pestis
guucauauuggccag

SEQ ID NO: 4137705 - RNA, 19 nt, Yersinia pestis
guucaucaauaccgugacu

SEQ ID NO: 4137706 - RNA, 19 nt, Yersinia pestis
guucauggccaugaaucaa

SEQ ID NO: 4137707 - RNA, 20 nt, Yersinia pestis
guucauuuugaccagcauac

SEQ ID NO: 4137708 - RNA, 17 nt, Yersinia pestis
guucauuuuguauuuug

SEQ ID NO: 4137709 - RNA, 18 nt, Yersinia pestis
guuccaacgcacaccccc

SEQ ID NO: 4137710 - RNA, 22 nt, Yersinia pestis
guuccacaauguugauacucca

SEQ ID NO: 4137711 - RNA, 14 nt, Yersinia pestis
guucccaugacgau

SEQ ID NO: 4137712 - RNA, 19 nt, Yersinia pestis
guuccccuucuucuccuau

SEQ ID NO: 4137713 - RNA, 23 nt, Yersinia pestis
guucccgauuauugugccgccuu

SEQ ID NO: 4137714 - RNA, 19 nt, Yersinia pestis
guuccuggaaccagugaau

SEQ ID NO: 4137715 - RNA, 18 nt, Yersinia pestis
guuccuguugcuggccag

SEQ ID NO: 4137716 - RNA, 19 nt, Yersinia pestis
guuccuucagccaccagau

SEQ ID NO: 4137717 - RNA, 15 nt, Yersinia pestis
guucgacuaucccac

SEQ ID NO: 4137718 - RNA, 17 nt, Yersinia pestis
guucgcguggcagauug

SEQ ID NO: 4137719 - RNA, 19 nt, Yersinia pestis
guucguagccacgaucgau

SEQ ID NO: 4137720 - RNA, 19 nt, Yersinia pestis
guucguauguuuuuaacaa

SEQ ID NO: 4137721 - RNA, 13 nt, Yersinia pestis
guucgugaaagca

SEQ ID NO: 4137722 - RNA, 15 nt, Yersinia pestis
guucuaaaacgucuc

SEQ ID NO: 4137723 - RNA, 18 nt, Yersinia pestis
guucuauauagacuuuua

SEQ ID NO: 4137724 - RNA, 23 nt, Yersinia pestis
guucucacuuggguagcagccca

SEQ ID NO: 4137725 - RNA, 16 nt, Yersinia pestis
guucucuccuaaaauc

SEQ ID NO: 4137726 - RNA, 19 nt, Yersinia pestis
guucucuggguaagaacag

SEQ ID NO: 4137727 - RNA, 19 nt, Yersinia pestis
guucugccaauuuggggcu

SEQ ID NO: 4137728 - RNA, 11 nt, Yersinia pestis
guucugcgccc

SEQ ID NO: 4137729 - RNA, 13 nt, Yersinia pestis
guucugcugccag

SEQ ID NO: 4137730 - RNA, 19 nt, Yersinia pestis
guucugguagcugcucacg

SEQ ID NO: 4137731 - RNA, 20 nt, Yersinia pestis
guucuuauugcuaucuguua

SEQ ID NO: 4137732 - RNA, 20 nt, Yersinia pestis
guucuuccugugcgccacgc

SEQ ID NO: 4137733 - RNA, 18 nt, Yersinia pestis
guucuucugauaaaacag

SEQ ID NO: 4137734 - RNA, 19 nt, Yersinia pestis
guucuucugauaaaacagu

SEQ ID NO: 4137735 - RNA, 18 nt, Yersinia pestis
guucuugaaaaaauaaau

SEQ ID NO: 4137736 - RNA, 17 nt, Yersinia pestis
guugaaaccucaucauc

SEQ ID NO: 4137737 - RNA, 19 nt, Yersinia pestis
guugaaauaaauaaguuca

SEQ ID NO: 4137738 - RNA, 12 nt, Yersinia pestis
guugaacucaua

SEQ ID NO: 4137739 - RNA, 20 nt, Yersinia pestis
guugaauaccaagccaaauu

SEQ ID NO: 4137740 - RNA, 21 nt, Yersinia pestis
guugaauaccaagccaaauua

SEQ ID NO: 4137741 - RNA, 17 nt, Yersinia pestis
guugaauuugacgugaa

SEQ ID NO: 4137742 - RNA, 15 nt, Yersinia pestis
guugaccaaacagaa

SEQ ID NO: 4137743 - RNA, 20 nt, Yersinia pestis
guugaccuugguaaauacca

SEQ ID NO: 4137744 - RNA, 12 nt, Yersinia pestis
guugacgccauu

SEQ ID NO: 4137745 - RNA, 21 nt, Yersinia pestis
guugagaauuaaggaaacuca

SEQ ID NO: 4137746 - RNA, 15 nt, Yersinia pestis
guugagguacggcuc

SEQ ID NO: 4137747 - RNA, 20 nt, Yersinia pestis
guugaguaauuuucgcccua

SEQ ID NO: 4137748 - RNA, 14 nt, Yersinia pestis
guugaguauacuaa

SEQ ID NO: 4137749 - RNA, 20 nt, Yersinia pestis
guugauaaacaauaaacaga

SEQ ID NO: 4137750 - RNA, 15 nt, Yersinia pestis
guugauaaagcugga

SEQ ID NO: 4137751 - RNA, 15 nt, Yersinia pestis
guugauacggccuau

SEQ ID NO: 4137752 - RNA, 22 nt, Yersinia pestis
guugauacuccauuugaacugu

SEQ ID NO: 4137753 - RNA, 19 nt, Yersinia pestis
guugauauaagcagcacca

SEQ ID NO: 4137754 - RNA, 17 nt, Yersinia pestis
guugauccgauaaacuu

SEQ ID NO: 4137755 - RNA, 20 nt, Yersinia pestis
guugauccgauaaacuucac

SEQ ID NO: 4137756 - RNA, 16 nt, Yersinia pestis
guugaugaguaaacag

SEQ ID NO: 4137757 - RNA, 14 nt, Yersinia pestis
guugaugcaaaacc

SEQ ID NO: 4137758 - RNA, 20 nt, Yersinia pestis
guugaugcucauuuaaaaua

SEQ ID NO: 4137759 - RNA, 15 nt, Yersinia pestis
guugcaaauuuccag

SEQ ID NO: 4137760 - RNA, 15 nt, Yersinia pestis
guugcaacggucauu

SEQ ID NO: 4137761 - RNA, 13 nt, Yersinia pestis
guugcacccugcu

SEQ ID NO: 4137762 - RNA, 23 nt, Yersinia pestis
guugcacgugaggauucaagaac

SEQ ID NO: 4137763 - RNA, 19 nt, Yersinia pestis
guugcacugacggcagaca

SEQ ID NO: 4137764 - RNA, 15 nt, Yersinia pestis
guugcagcacgccag

SEQ ID NO: 4137765 - RNA, 15 nt, Yersinia pestis
guugccaauguugcu

SEQ ID NO: 4137766 - RNA, 20 nt, Yersinia pestis
guugccacccuaucugcucu

SEQ ID NO: 4137767 - RNA, 18 nt, Yersinia pestis
guugccacggaaacguuc

SEQ ID NO: 4137768 - RNA, 19 nt, Yersinia pestis
guugccauguugaguuuac

SEQ ID NO: 4137769 - RNA, 23 nt, Yersinia pestis
guugcccccugcuccaaagcuuc

SEQ ID NO: 4137770 - RNA, 18 nt, Yersinia pestis
guugcccguuaauauuaa

SEQ ID NO: 4137771 - RNA, 18 nt, Yersinia pestis
guugccgccuuccuacaa

SEQ ID NO: 4137772 - RNA, 14 nt, Yersinia pestis
guugccgcuucaua

SEQ ID NO: 4137773 - RNA, 19 nt, Yersinia pestis
guugccugugcgcuggucg

SEQ ID NO: 4137774 - RNA, 21 nt, Yersinia pestis
guugcgcaggguuuccaagcu

SEQ ID NO: 4137775 - RNA, 14 nt, Yersinia pestis
guugcgccgcuuug

SEQ ID NO: 4137776 - RNA, 18 nt, Yersinia pestis
guugcuauuuccccgccg

SEQ ID NO: 4137777 - RNA, 16 nt, Yersinia pestis
guugcucacccauuuu

SEQ ID NO: 4137778 - RNA, 15 nt, Yersinia pestis
guugcugucucgcuu

SEQ ID NO: 4137779 - RNA, 14 nt, Yersinia pestis
guuggauaaccccc

SEQ ID NO: 4137780 - RNA, 17 nt, Yersinia pestis
guuggauacugcauuuc

SEQ ID NO: 4137781 - RNA, 22 nt, Yersinia pestis
guuggaucauccgcucagcaaa

SEQ ID NO: 4137782 - RNA, 13 nt, Yersinia pestis
guuggcaaauaau

SEQ ID NO: 4137783 - RNA, 21 nt, Yersinia pestis
guuggcaauaaauauccuccg

SEQ ID NO: 4137784 - RNA, 12 nt, Yersinia pestis
guuggcagagac

SEQ ID NO: 4137785 - RNA, 14 nt, Yersinia pestis
guuggcauauggcc

SEQ ID NO: 4137786 - RNA, 16 nt, Yersinia pestis
guuggcuuuaucucac

SEQ ID NO: 4137787 - RNA, 15 nt, Yersinia pestis
guugggaaaaguggc

SEQ ID NO: 4137788 - RNA, 14 nt, Yersinia pestis
guugggcaguaacg

SEQ ID NO: 4137789 - RNA, 17 nt, Yersinia pestis
guugggccuugcuucug

SEQ ID NO: 4137790 - RNA, 14 nt, Yersinia pestis
guuggucaccacuu

SEQ ID NO: 4137791 - RNA, 13 nt, Yersinia pestis
guuggucagcacu

SEQ ID NO: 4137792 - RNA, 22 nt, Yersinia pestis
guuggugaucuggcuuucucaa

SEQ ID NO: 4137793 - RNA, 15 nt, Yersinia pestis
guugguuagagcacg

SEQ ID NO: 4137794 - RNA, 23 nt, Yersinia pestis
guuguaauacgcaugagccuuug

SEQ ID NO: 4137795 - RNA, 13 nt, Yersinia pestis
guuguaugucaau

SEQ ID NO: 4137796 - RNA, 14 nt, Yersinia pestis
guugucagcagucu

SEQ ID NO: 4137797 - RNA, 17 nt, Yersinia pestis
guugucuauguuugaug

SEQ ID NO: 4137798 - RNA, 16 nt, Yersinia pestis
uaaaaauaaucaauga

SEQ ID NO: 4137799 - RNA, 14 nt, Yersinia pestis
uaaaaauacaacca

SEQ ID NO: 4137800 - RNA, 21 nt, Yersinia pestis
uaaaaauacauaucaacacug

SEQ ID NO: 4137801 - RNA, 16 nt, Yersinia pestis
uaaaaauagauuaaaa

SEQ ID NO: 4137802 - RNA, 19 nt, Yersinia pestis
uaaaaauagauuaaaaguc

SEQ ID NO: 4137803 - RNA, 13 nt, Yersinia pestis
uaaaaauauuaac

SEQ ID NO: 4137804 - RNA, 18 nt, Yersinia pestis
uaaaaaucaauacguuga

SEQ ID NO: 4137805 - RNA, 20 nt, Yersinia pestis
uaaaaaucaccucaaacuga

SEQ ID NO: 4137806 - RNA, 21 nt, Yersinia pestis
uaaaaaucagagauaacggcg

SEQ ID NO: 4137807 - RNA, 20 nt, Yersinia pestis
uaaaaaucccggcauauuau

SEQ ID NO: 4137808 - RNA, 12 nt, Yersinia pestis
uaaaaauuaauu

SEQ ID NO: 4137809 - RNA, 15 nt, Yersinia pestis
uaaaaauucacaaca

SEQ ID NO: 4137810 - RNA, 14 nt, Yersinia pestis
uaaaacaaaguagu

SEQ ID NO: 4137811 - RNA, 21 nt, Yersinia pestis
uaaaacacagucugucguacu

SEQ ID NO: 4137812 - RNA, 21 nt, Yersinia pestis
uaaaacagcagccaccaaaaa

SEQ ID NO: 4137813 - RNA, 14 nt, Yersinia pestis
uaaaacauauuaag

SEQ ID NO: 4137814 - RNA, 19 nt, Yersinia pestis
uaaaacauuucauuccaga

SEQ ID NO: 4137815 - RNA, 18 nt, Yersinia pestis
uaaaaccaagaagacuaa

SEQ ID NO: 4137816 - RNA, 10 nt, Yersinia pestis
uaaaaccaau

SEQ ID NO: 4137817 - RNA, 14 nt, Yersinia pestis
uaaaaccaccugac

SEQ ID NO: 4137818 - RNA, 16 nt, Yersinia pestis
uaaaaccacugaccua

SEQ ID NO: 4137819 - RNA, 21 nt, Yersinia pestis
uaaaaccacugaccuauugau

SEQ ID NO: 4137820 - RNA, 22 nt, Yersinia pestis
uaaaaccacugaccuauugaua

SEQ ID NO: 4137821 - RNA, 19 nt, Yersinia pestis
uaaaaccuaauaacgcuca

SEQ ID NO: 4137822 - RNA, 20 nt, Yersinia pestis
uaaaaccuaaucucuacauu

SEQ ID NO: 4137823 - RNA, 21 nt, Yersinia pestis
uaaaaccuaaucucuacauuu

SEQ ID NO: 4137824 - RNA, 20 nt, Yersinia pestis
uaaaaccugcuugaaagcac

SEQ ID NO: 4137825 - RNA, 23 nt, Yersinia pestis
uaaaaccuucgccuuucaguuca

SEQ ID NO: 4137826 - RNA, 19 nt, Yersinia pestis
uaaaaccuuuacaauuaca

SEQ ID NO: 4137827 - RNA, 15 nt, Yersinia pestis
uaaaacgaguaaaua

SEQ ID NO: 4137828 - RNA, 18 nt, Yersinia pestis
uaaaacgcacacugcaga

SEQ ID NO: 4137829 - RNA, 15 nt, Yersinia pestis
uaaaacucaaauaga

SEQ ID NO: 4137830 - RNA, 14 nt, Yersinia pestis
uaaaacugaagcau

SEQ ID NO: 4137831 - RNA, 19 nt, Yersinia pestis
uaaaacuggcgauagcggc

SEQ ID NO: 4137832 - RNA, 15 nt, Yersinia pestis
uaaaagaaaaccuug

SEQ ID NO: 4137833 - RNA, 17 nt, Yersinia pestis
uaaaagaaaaccuugac

SEQ ID NO: 4137834 - RNA, 21 nt, Yersinia pestis
uaaaagaaaaccuugacucuu

SEQ ID NO: 4137835 - RNA, 14 nt, Yersinia pestis
uaaaagaaagggca

SEQ ID NO: 4137836 - RNA, 19 nt, Yersinia pestis
uaaaagaauaaaugucacu

SEQ ID NO: 4137837 - RNA, 17 nt, Yersinia pestis
uaaaagauucauaaaaa

SEQ ID NO: 4137838 - RNA, 17 nt, Yersinia pestis
uaaaagcacagacaaac

SEQ ID NO: 4137839 - RNA, 14 nt, Yersinia pestis
uaaaagccagucag

SEQ ID NO: 4137840 - RNA, 15 nt, Yersinia pestis
uaaaagccagucagg

SEQ ID NO: 4137841 - RNA, 22 nt, Yersinia pestis
uaaaagcggguuaccaguaacu

SEQ ID NO: 4137842 - RNA, 18 nt, Yersinia pestis
uaaaaggauggcccaagc

SEQ ID NO: 4137843 - RNA, 15 nt, Yersinia pestis
uaaaaggcuauuuaa

SEQ ID NO: 4137844 - RNA, 15 nt, Yersinia pestis
uaaaauaaauuggcc

SEQ ID NO: 4137845 - RNA, 12 nt, Yersinia pestis
uaaaauaaauuu

SEQ ID NO: 4137846 - RNA, 17 nt, Yersinia pestis
uaaaauaacaauucacu

SEQ ID NO: 4137847 - RNA, 21 nt, Yersinia pestis
uaaaauaaugaguuaaugaga

SEQ ID NO: 4137848 - RNA, 14 nt, Yersinia pestis
uaaaauagcccagu

SEQ ID NO: 4137849 - RNA, 20 nt, Yersinia pestis
uaaaauaguggcacaaauaa

SEQ ID NO: 4137850 - RNA, 18 nt, Yersinia pestis
uaaaauauccccugcaag

SEQ ID NO: 4137851 - RNA, 19 nt, Yersinia pestis
uaaaauaucuuucaagucc

SEQ ID NO: 4137852 - RNA, 20 nt, Yersinia pestis
uaaaauaucuuucaaguccu

SEQ ID NO: 4137853 - RNA, 14 nt, Yersinia pestis
uaaaaucaaaacag

SEQ ID NO: 4137854 - RNA, 19 nt, Yersinia pestis
uaaaaucacccgcaagaau

SEQ ID NO: 4137855 - RNA, 23 nt, Yersinia pestis
uaaaaucacguuuccaaaacuca

SEQ ID NO: 4137856 - RNA, 12 nt, Yersinia pestis
uaaaaucaucag

SEQ ID NO: 4137857 - RNA, 12 nt, Yersinia pestis
uaaaauccccau

SEQ ID NO: 4137858 - RNA, 15 nt, Yersinia pestis
uaaaaucuaucgaua

SEQ ID NO: 4137859 - RNA, 13 nt, Yersinia pestis
uaaaaucuuaauc

SEQ ID NO: 4137860 - RNA, 23 nt, Yersinia pestis
uaaaaugagcacggacagcagca

SEQ ID NO: 4137861 - RNA, 15 nt, Yersinia pestis
uaaaauuaauuacuu

SEQ ID NO: 4137862 - RNA, 22 nt, Yersinia pestis
uaaaauucguuucucuaaaauu

SEQ ID NO: 4137863 - RNA, 12 nt, Yersinia pestis
uaaaauuuuaag

SEQ ID NO: 4137864 - RNA, 14 nt, Yersinia pestis
uaaacaaauaugac

SEQ ID NO: 4137865 - RNA, 17 nt, Yersinia pestis
uaaacaaggcagaagua

SEQ ID NO: 4137866 - RNA, 16 nt, Yersinia pestis
uaaacaaguugaacca

SEQ ID NO: 4137867 - RNA, 15 nt, Yersinia pestis
uaaacaaguugcuua

SEQ ID NO: 4137868 - RNA, 20 nt, Yersinia pestis
uaaacaaucugaugaauuaa

SEQ ID NO: 4137869 - RNA, 14 nt, Yersinia pestis
uaaacaaugaaauu

SEQ ID NO: 4137870 - RNA, 15 nt, Yersinia pestis
uaaacacucaauaag

SEQ ID NO: 4137871 - RNA, 19 nt, Yersinia pestis
uaaacagacacagcaacaa

SEQ ID NO: 4137872 - RNA, 14 nt, Yersinia pestis
uaaacagccagcau

SEQ ID NO: 4137873 - RNA, 22 nt, Yersinia pestis
uaaacagccguauaucuuaccu

SEQ ID NO: 4137874 - RNA, 18 nt, Yersinia pestis
uaaacagucuuauuacuc

SEQ ID NO: 4137875 - RNA, 20 nt, Yersinia pestis
uaaacauaaaaaaugccagc

SEQ ID NO: 4137876 - RNA, 19 nt, Yersinia pestis
uaaacaucaugacaaaaau

SEQ ID NO: 4137877 - RNA, 13 nt, Yersinia pestis
uaaaccaaauggu

SEQ ID NO: 4137878 - RNA, 16 nt, Yersinia pestis
uaaaccaaucaagcau

SEQ ID NO: 4137879 - RNA, 12 nt, Yersinia pestis
uaaaccagcaag

SEQ ID NO: 4137880 - RNA, 14 nt, Yersinia pestis
uaaaccagccagug

SEQ ID NO: 4137881 - RNA, 15 nt, Yersinia pestis
uaaaccagccaguga

SEQ ID NO: 4137882 - RNA, 14 nt, Yersinia pestis
uaaacccggcauca

SEQ ID NO: 4137883 - RNA, 21 nt, Yersinia pestis
uaaaccgagccugcuuuaaug

SEQ ID NO: 4137884 - RNA, 15 nt, Yersinia pestis
uaaaccgugauuggu

SEQ ID NO: 4137885 - RNA, 16 nt, Yersinia pestis
uaaaccgugauugguu

SEQ ID NO: 4137886 - RNA, 20 nt, Yersinia pestis
uaaaccuugaauaucaccau

SEQ ID NO: 4137887 - RNA, 17 nt, Yersinia pestis
uaaacgaccauuucucu

SEQ ID NO: 4137888 - RNA, 16 nt, Yersinia pestis
uaaacgccagucagcu

SEQ ID NO: 4137889 - RNA, 22 nt, Yersinia pestis
uaaacgccgaucauaaaucaca

SEQ ID NO: 4137890 - RNA, 20 nt, Yersinia pestis
uaaacgcgaguuaggaaaaa

SEQ ID NO: 4137891 - RNA, 18 nt, Yersinia pestis
uaaacggcgguuaaucgg

SEQ ID NO: 4137892 - RNA, 13 nt, Yersinia pestis
uaaacgggccgcg

SEQ ID NO: 4137893 - RNA, 14 nt, Yersinia pestis
uaaacgguaaccau

SEQ ID NO: 4137894 - RNA, 18 nt, Yersinia pestis
uaaacgguaaccauccau

SEQ ID NO: 4137895 - RNA, 23 nt, Yersinia pestis
uaaacgguaaccauccauauuug

SEQ ID NO: 4137896 - RNA, 15 nt, Yersinia pestis
uaaacgguugcugua

SEQ ID NO: 4137897 - RNA, 13 nt, Yersinia pestis
uaaacgucagauu

SEQ ID NO: 4137898 - RNA, 14 nt, Yersinia pestis
uaaacguucugcca

SEQ ID NO: 4137899 - RNA, 16 nt, Yersinia pestis
uaaacuauuagcgcuu

SEQ ID NO: 4137900 - RNA, 15 nt, Yersinia pestis
uaaacucuuuaaguu

SEQ ID NO: 4137901 - RNA, 23 nt, Yersinia pestis
uaaacugaauaucccccuccgga

SEQ ID NO: 4137902 - RNA, 18 nt, Yersinia pestis
uaaacugacauuaucgcc

SEQ ID NO: 4137903 - RNA, 15 nt, Yersinia pestis
uaaacugaucaucaa

SEQ ID NO: 4137904 - RNA, 16 nt, Yersinia pestis
uaaacuuccagcguau

SEQ ID NO: 4137905 - RNA, 15 nt, Yersinia pestis
uaaagaaaaaacguu

SEQ ID NO: 4137906 - RNA, 14 nt, Yersinia pestis
uaaagaaaauuuac

SEQ ID NO: 4137907 - RNA, 20 nt, Yersinia pestis
uaaagaaauaaucauaucaa

SEQ ID NO: 4137908 - RNA, 21 nt, Yersinia pestis
uaaagacauaucacaguuaaa

SEQ ID NO: 4137909 - RNA, 13 nt, Yersinia pestis
uaaagacccaaua

SEQ ID NO: 4137910 - RNA, 20 nt, Yersinia pestis
uaaagacgccggcuucccug

SEQ ID NO: 4137911 - RNA, 17 nt, Yersinia pestis
uaaagacgccguaaaua

SEQ ID NO: 4137912 - RNA, 19 nt, Yersinia pestis
uaaagacgccguaaauaca

SEQ ID NO: 4137913 - RNA, 21 nt, Yersinia pestis
uaaagacgccguaaauacauc

SEQ ID NO: 4137914 - RNA, 17 nt, Yersinia pestis
uaaagacgucauaaaua

SEQ ID NO: 4137915 - RNA, 17 nt, Yersinia pestis
uaaagagugaaauauac

SEQ ID NO: 4137916 - RNA, 16 nt, Yersinia pestis
uaaagauaauuaauuc

SEQ ID NO: 4137917 - RNA, 19 nt, Yersinia pestis
uaaagauaauuaauucaau

SEQ ID NO: 4137918 - RNA, 17 nt, Yersinia pestis
uaaagauagccacuaac

SEQ ID NO: 4137919 - RNA, 16 nt, Yersinia pestis
uaaagauuucaucauu

SEQ ID NO: 4137920 - RNA, 15 nt, Yersinia pestis
uaacaacagucaaua

SEQ ID NO: 4137921 - RNA, 19 nt, Yersinia pestis
uaacaacaucgagcgggcu

SEQ ID NO: 4137922 - RNA, 21 nt, Yersinia pestis
uaacaacccuaacaccgagua

SEQ ID NO: 4137923 - RNA, 11 nt, Yersinia pestis
uaacaacugcc

SEQ ID NO: 4137924 - RNA, 21 nt, Yersinia pestis
uaacaacugguuaucacuguc

SEQ ID NO: 4137925 - RNA, 17 nt, Yersinia pestis
uaacaacuuccacacaa

SEQ ID NO: 4137926 - RNA, 21 nt, Yersinia pestis
uaacaagcgaccaucaugaau

SEQ ID NO: 4137927 - RNA, 15 nt, Yersinia pestis
uaacaaguuacauuu

SEQ ID NO: 4137928 - RNA, 14 nt, Yersinia pestis
uaacaauaaaaucu

SEQ ID NO: 4137929 - RNA, 15 nt, Yersinia pestis
uaacaauauuauauu

SEQ ID NO: 4137930 - RNA, 16 nt, Yersinia pestis
uaacaauccgaacaaa

SEQ ID NO: 4137931 - RNA, 19 nt, Yersinia pestis
uaacaauguuauauuucuu

SEQ ID NO: 4137932 - RNA, 18 nt, Yersinia pestis
uaacaauuaauuggcuca

SEQ ID NO: 4137933 - RNA, 17 nt, Yersinia pestis
uaacaauuacuuuggca

SEQ ID NO: 4137934 - RNA, 21 nt, Yersinia pestis
uaacaauucaaugcuuuccgc

SEQ ID NO: 4137935 - RNA, 12 nt, Yersinia pestis
uaacaauucucu

SEQ ID NO: 4137936 - RNA, 14 nt, Yersinia pestis
uaacaauucucucg

SEQ ID NO: 4137937 - RNA, 15 nt, Yersinia pestis
uaacaauuuuauugu

SEQ ID NO: 4137938 - RNA, 17 nt, Yersinia pestis
uaacaauuuuauuguuu

SEQ ID NO: 4137939 - RNA, 20 nt, Yersinia pestis
uaacaauuuuauuguuuucg

SEQ ID NO: 4137940 - RNA, 20 nt, Yersinia pestis
uaacacauuccaguaaaaaa

SEQ ID NO: 4137941 - RNA, 22 nt, Yersinia pestis
uaacacauuccaguaaaaaaau

SEQ ID NO: 4137942 - RNA, 18 nt, Yersinia pestis
uaacaccagcauccugca

SEQ ID NO: 4137943 - RNA, 19 nt, Yersinia pestis
uaacaccagcauccugcaa

SEQ ID NO: 4137944 - RNA, 20 nt, Yersinia pestis
uaacacccaauaauaaaaaa

SEQ ID NO: 4137945 - RNA, 19 nt, Yersinia pestis
uaacacgaaaagcagcagu

SEQ ID NO: 4137946 - RNA, 20 nt, Yersinia pestis
uaacacgaaaagcagcaguu

SEQ ID NO: 4137947 - RNA, 18 nt, Yersinia pestis
uaacacgaggcgcuacug

SEQ ID NO: 4137948 - RNA, 21 nt, Yersinia pestis
uaacacguuaaauuucuucaa

SEQ ID NO: 4137949 - RNA, 16 nt, Yersinia pestis
uaacacuucagacuga

SEQ ID NO: 4137950 - RNA, 21 nt, Yersinia pestis
uaacagagcagaaagcagcag

SEQ ID NO: 4137951 - RNA, 23 nt, Yersinia pestis
uaacagagcagaaagcagcagcu

SEQ ID NO: 4137952 - RNA, 22 nt, Yersinia pestis
uaacagagccuuauaggcgcau

SEQ ID NO: 4137953 - RNA, 22 nt, Yersinia pestis
uaacagauauuacgcagccaua

SEQ ID NO: 4137954 - RNA, 22 nt, Yersinia pestis
uaacagauuugguauuacgcuc

SEQ ID NO: 4137955 - RNA, 13 nt, Yersinia pestis
uaacagcaucacu

SEQ ID NO: 4137956 - RNA, 19 nt, Yersinia pestis
uaacagcaucacugucuau

SEQ ID NO: 4137957 - RNA, 19 nt, Yersinia pestis
uaacagcgugcgcuccauu

SEQ ID NO: 4137958 - RNA, 19 nt, Yersinia pestis
uaacauauaaaccagccag

SEQ ID NO: 4137959 - RNA, 18 nt, Yersinia pestis
uaacaucagcgauucauu

SEQ ID NO: 4137960 - RNA, 20 nt, Yersinia pestis
uaacaucagcgauucauuga

SEQ ID NO: 4137961 - RNA, 15 nt, Yersinia pestis
uaacauccuaaaaag

SEQ ID NO: 4137962 - RNA, 16 nt, Yersinia pestis
uaacaugcugauagca

SEQ ID NO: 4137963 - RNA, 13 nt, Yersinia pestis
uaacauguagcac

SEQ ID NO: 4137964 - RNA, 11 nt, Yersinia pestis
uaacauuuuuu

SEQ ID NO: 4137965 - RNA, 14 nt, Yersinia pestis
uaacauuuuuucuu

SEQ ID NO: 4137966 - RNA, 16 nt, Yersinia pestis
uaaccaaaagccccau

SEQ ID NO: 4137967 - RNA, 22 nt, Yersinia pestis
uaaccaacaguuauuuuaauug

SEQ ID NO: 4137968 - RNA, 20 nt, Yersinia pestis
uaaccaagccagugcgggag

SEQ ID NO: 4137969 - RNA, 15 nt, Yersinia pestis
uaaccaaucacauca

SEQ ID NO: 4137970 - RNA, 24 nt, Yersinia pestis
uaaccacaacgacagccaaaucag

SEQ ID NO: 4137971 - RNA, 20 nt, Yersinia pestis
uaaccaccgucaccaaauau

SEQ ID NO: 4137972 - RNA, 16 nt, Yersinia pestis
uaaccaccucggaagg

SEQ ID NO: 4137973 - RNA, 17 nt, Yersinia pestis
uaaccagaccgauagcc

SEQ ID NO: 4137974 - RNA, 23 nt, Yersinia pestis
uaaccagagcggagccucaguuc

SEQ ID NO: 4137975 - RNA, 17 nt, Yersinia pestis
uaaccagccaaccauca

SEQ ID NO: 4137976 - RNA, 19 nt, Yersinia pestis
uaaccaggugcagauaaac

SEQ ID NO: 4137977 - RNA, 16 nt, Yersinia pestis
uaaccaguuaucgaua

SEQ ID NO: 4137978 - RNA, 13 nt, Yersinia pestis
uaaccauaaaaua

SEQ ID NO: 4137979 - RNA, 14 nt, Yersinia pestis
uaaccaucaaauac

SEQ ID NO: 4137980 - RNA, 15 nt, Yersinia pestis
uaaccaugaugacaa

SEQ ID NO: 4137981 - RNA, 16 nt, Yersinia pestis
uaaccaugaugacaau

SEQ ID NO: 4137982 - RNA, 13 nt, Yersinia pestis
uaacccaaagcca

SEQ ID NO: 4137983 - RNA, 13 nt, Yersinia pestis
uaacccaaagccc

SEQ ID NO: 4137984 - RNA, 21 nt, Yersinia pestis
uaacccauugguuuuuagcuu

SEQ ID NO: 4137985 - RNA, 22 nt, Yersinia pestis
uaaccccauauugcucgcgaua

SEQ ID NO: 4137986 - RNA, 15 nt, Yersinia pestis
uaacccccaagcuuu

SEQ ID NO: 4137987 - RNA, 15 nt, Yersinia pestis
uaaccccguagcaca

SEQ ID NO: 4137988 - RNA, 19 nt, Yersinia pestis
uaaccccguagcacacaca

SEQ ID NO: 4137989 - RNA, 21 nt, Yersinia pestis
uaacccuaccuaggccagcac

SEQ ID NO: 4137990 - RNA, 22 nt, Yersinia pestis
uaacccuuuggcaaccagcuua

SEQ ID NO: 4137991 - RNA, 17 nt, Yersinia pestis
uaaccgaagauaaccgg

SEQ ID NO: 4137992 - RNA, 16 nt, Yersinia pestis
uaaccgaauaaaaccu

SEQ ID NO: 4137993 - RNA, 21 nt, Yersinia pestis
uaaccgacuugcccaauggca

SEQ ID NO: 4137994 - RNA, 17 nt, Yersinia pestis
uaaccgauuucagcacc

SEQ ID NO: 4137995 - RNA, 15 nt, Yersinia pestis
uaaccgcagcaggca

SEQ ID NO: 4137996 - RNA, 12 nt, Yersinia pestis
uaaccgccaguu

SEQ ID NO: 4137997 - RNA, 23 nt, Yersinia pestis
uaaccgccgauauucaagcagug

SEQ ID NO: 4137998 - RNA, 21 nt, Yersinia pestis
uaaccgggcuugauuaaauga

SEQ ID NO: 4137999 - RNA, 19 nt, Yersinia pestis
uaaccggguaaauuccgua

SEQ ID NO: 4138000 - RNA, 15 nt, Yersinia pestis
uaaccggguggccca

SEQ ID NO: 4138001 - RNA, 17 nt, Yersinia pestis
uaaccgguauauuggcc

SEQ ID NO: 4138002 - RNA, 13 nt, Yersinia pestis
uaaccuacuccaa

SEQ ID NO: 4138003 - RNA, 15 nt, Yersinia pestis
uaaccucaaaaggau

SEQ ID NO: 4138004 - RNA, 22 nt, Yersinia pestis
uaaccugcuggcgcaacuguag

SEQ ID NO: 4138005 - RNA, 23 nt, Yersinia pestis
uaaccugcuggcgcaacuguagu

SEQ ID NO: 4138006 - RNA, 15 nt, Yersinia pestis
uaaccuguauuuguu

SEQ ID NO: 4138007 - RNA, 22 nt, Yersinia pestis
uaaccuguucccguucagccuc

SEQ ID NO: 4138008 - RNA, 14 nt, Yersinia pestis
uaaccuuaacugca

SEQ ID NO: 4138009 - RNA, 16 nt, Yersinia pestis
uaacgaagguaacuua

SEQ ID NO: 4138010 - RNA, 14 nt, Yersinia pestis
uaacgaauucagca

SEQ ID NO: 4138011 - RNA, 16 nt, Yersinia pestis
uaacgaauucagcagc

SEQ ID NO: 4138012 - RNA, 17 nt, Yersinia pestis
uaacgaauucagcagcg

SEQ ID NO: 4138013 - RNA, 14 nt, Yersinia pestis
uaacgaauuucauu

SEQ ID NO: 4138014 - RNA, 21 nt, Yersinia pestis
uaacgaauuucauuuuaaaau

SEQ ID NO: 4138015 - RNA, 21 nt, Yersinia pestis
uaacgauaaccaaaucaccug

SEQ ID NO: 4138016 - RNA, 18 nt, Yersinia pestis
uaacgauauaauagcugg

SEQ ID NO: 4138017 - RNA, 22 nt, Yersinia pestis
uaacgaucgcuuaacgaggcgc

SEQ ID NO: 4138018 - RNA, 19 nt, Yersinia pestis
uaacgauuauuaaacuauu

SEQ ID NO: 4138019 - RNA, 23 nt, Yersinia pestis
uaacgcaauaggcuauuuuacuu

SEQ ID NO: 4138020 - RNA, 13 nt, Yersinia pestis
uaacgcagaaaua

SEQ ID NO: 4138021 - RNA, 22 nt, Yersinia pestis
uaacgccaccaaugcauccaag

SEQ ID NO: 4138022 - RNA, 20 nt, Yersinia pestis
uaacgccgcuaaaucaucaa

SEQ ID NO: 4138023 - RNA, 15 nt, Yersinia pestis
uaacgccgcugaccu

SEQ ID NO: 4138024 - RNA, 17 nt, Yersinia pestis
uaacgccgcuguagcgc

SEQ ID NO: 4138025 - RNA, 19 nt, Yersinia pestis
uaacgccggauaaauuaau

SEQ ID NO: 4138026 - RNA, 21 nt, Yersinia pestis
uaacgcuaauaacauggggua

SEQ ID NO: 4138027 - RNA, 22 nt, Yersinia pestis
uaacgcucccuccgccagcaag

SEQ ID NO: 4138028 - RNA, 19 nt, Yersinia pestis
uaacgcuggauaagugaau

SEQ ID NO: 4138029 - RNA, 15 nt, Yersinia pestis
uaacgcuucaucaug

SEQ ID NO: 4138030 - RNA, 19 nt, Yersinia pestis
uaacgcuucaucauggaua

SEQ ID NO: 4138031 - RNA, 14 nt, Yersinia pestis
uaacggaaaaucau

SEQ ID NO: 4138032 - RNA, 14 nt, Yersinia pestis
uaacggauccugcc

SEQ ID NO: 4138033 - RNA, 22 nt, Yersinia pestis
uaacggccgccuguauuauuaa

SEQ ID NO: 4138034 - RNA, 15 nt, Yersinia pestis
uaacguaaauagacu

SEQ ID NO: 4138035 - RNA, 14 nt, Yersinia pestis
uaacguagagagac

SEQ ID NO: 4138036 - RNA, 18 nt, Yersinia pestis
uaacguggagccugugca

SEQ ID NO: 4138037 - RNA, 23 nt, Yersinia pestis
uaacguguccccgagaggcuauu

SEQ ID NO: 4138038 - RNA, 22 nt, Yersinia pestis
uaacguguuuaucgaucaaacc

SEQ ID NO: 4138039 - RNA, 23 nt, Yersinia pestis
uaacuaacaucagcgauucauug

SEQ ID NO: 4138040 - RNA, 21 nt, Yersinia pestis
uaacuauuuuugacuuuaauu

SEQ ID NO: 4138041 - RNA, 22 nt, Yersinia pestis
uaauaagugaucagcuaacaaa

SEQ ID NO: 4138042 - RNA, 16 nt, Yersinia pestis
uaauaaguuaauaaug

SEQ ID NO: 4138043 - RNA, 18 nt, Yersinia pestis
uaauaaucuaaauuaaua

SEQ ID NO: 4138044 - RNA, 16 nt, Yersinia pestis
uaauaaucuuaaguaa

SEQ ID NO: 4138045 - RNA, 19 nt, Yersinia pestis
uaauaaucuuaaguaaauu

SEQ ID NO: 4138046 - RNA, 21 nt, Yersinia pestis
uaauaaugaacguugucaggc

SEQ ID NO: 4138047 - RNA, 22 nt, Yersinia pestis
uaauaaugccguuaauugugau

SEQ ID NO: 4138048 - RNA, 20 nt, Yersinia pestis
uaauaauucagguugagcau

SEQ ID NO: 4138049 - RNA, 14 nt, Yersinia pestis
uaauaauuccauga

SEQ ID NO: 4138050 - RNA, 18 nt, Yersinia pestis
uaauacacccgaaggcca

SEQ ID NO: 4138051 - RNA, 13 nt, Yersinia pestis
uaauacaucauca

SEQ ID NO: 4138052 - RNA, 14 nt, Yersinia pestis
uaauaccacaacau

SEQ ID NO: 4138053 - RNA, 15 nt, Yersinia pestis
uaauaccacaacauu

SEQ ID NO: 4138054 - RNA, 18 nt, Yersinia pestis
uaauaccguuuucuuuca

SEQ ID NO: 4138055 - RNA, 14 nt, Yersinia pestis
uaauaccuaaaauu

SEQ ID NO: 4138056 - RNA, 14 nt, Yersinia pestis
uaauacgaaauacu

SEQ ID NO: 4138057 - RNA, 22 nt, Yersinia pestis
uaauacggcuugcaauuggggu

SEQ ID NO: 4138058 - RNA, 13 nt, Yersinia pestis
uaauacugacauu

SEQ ID NO: 4138059 - RNA, 16 nt, Yersinia pestis
uaauacugucaaaauc

SEQ ID NO: 4138060 - RNA, 18 nt, Yersinia pestis
uaauacuuaagucaaauu

SEQ ID NO: 4138061 - RNA, 20 nt, Yersinia pestis
uaauacuuucccauagcugg

SEQ ID NO: 4138062 - RNA, 14 nt, Yersinia pestis
uaauagauaguacg

SEQ ID NO: 4138063 - RNA, 15 nt, Yersinia pestis
uaauagccucugucu

SEQ ID NO: 4138064 - RNA, 17 nt, Yersinia pestis
uaauagcuuaaucauca

SEQ ID NO: 4138065 - RNA, 21 nt, Yersinia pestis
uaauagguggucccuaacgca

SEQ ID NO: 4138066 - RNA, 19 nt, Yersinia pestis
uaauaguguuguaagauuu

SEQ ID NO: 4138067 - RNA, 18 nt, Yersinia pestis
uaauaguuaaucgcagca

SEQ ID NO: 4138068 - RNA, 12 nt, Yersinia pestis
uaauaguucauu

SEQ ID NO: 4138069 - RNA, 20 nt, Yersinia pestis
uaauaguucauuuuguauuu

SEQ ID NO: 4138070 - RNA, 15 nt, Yersinia pestis
uaauauaauucaaua

SEQ ID NO: 4138071 - RNA, 18 nt, Yersinia pestis
uaauauaauucaauauau

SEQ ID NO: 4138072 - RNA, 15 nt, Yersinia pestis
uaauauaccaacucu

SEQ ID NO: 4138073 - RNA, 15 nt, Yersinia pestis
uaauaucaaaacuga

SEQ ID NO: 4138074 - RNA, 12 nt, Yersinia pestis
uaauaucaccau

SEQ ID NO: 4138075 - RNA, 16 nt, Yersinia pestis
uaauaucuuuaaauua

SEQ ID NO: 4138076 - RNA, 22 nt, Yersinia pestis
uaauaugcaaaaaaagacacua

SEQ ID NO: 4138077 - RNA, 19 nt, Yersinia pestis
uaauauuacguaauaucag

SEQ ID NO: 4138078 - RNA, 15 nt, Yersinia pestis
uaauauugaauaacc

SEQ ID NO: 4138079 - RNA, 14 nt, Yersinia pestis
uaauauugccgcag

SEQ ID NO: 4138080 - RNA, 14 nt, Yersinia pestis
uaauauuuauaaaa

SEQ ID NO: 4138081 - RNA, 21 nt, Yersinia pestis
uaauauuuaucugcauuaaaa

SEQ ID NO: 4138082 - RNA, 13 nt, Yersinia pestis
uaauauuuucauc

SEQ ID NO: 4138083 - RNA, 12 nt, Yersinia pestis
uaaucaaacgau

SEQ ID NO: 4138084 - RNA, 16 nt, Yersinia pestis
uaaucaagccuucauu

SEQ ID NO: 4138085 - RNA, 21 nt, Yersinia pestis
uaaucaauccuacauucagua

SEQ ID NO: 4138086 - RNA, 18 nt, Yersinia pestis
uaaucaaugugcguuuau

SEQ ID NO: 4138087 - RNA, 14 nt, Yersinia pestis
uaaucaauuaaaua

SEQ ID NO: 4138088 - RNA, 20 nt, Yersinia pestis
uaaucaccagacaaccaaua

SEQ ID NO: 4138089 - RNA, 12 nt, Yersinia pestis
uaaucaccuuca

SEQ ID NO: 4138090 - RNA, 17 nt, Yersinia pestis
uaaucacgauacgacuu

SEQ ID NO: 4138091 - RNA, 23 nt, Yersinia pestis
uaaucacgauacgacuucuuauu

SEQ ID NO: 4138092 - RNA, 15 nt, Yersinia pestis
uaaucauaucaaaau

SEQ ID NO: 4138093 - RNA, 17 nt, Yersinia pestis
uaaucauaucaaaauaa

SEQ ID NO: 4138094 - RNA, 13 nt, Yersinia pestis
uaaucaucgcccu

SEQ ID NO: 4138095 - RNA, 18 nt, Yersinia pestis
uaaucaucuacaacauca

SEQ ID NO: 4138096 - RNA, 23 nt, Yersinia pestis
uaaucaugggguuuauugguuau

SEQ ID NO: 4138097 - RNA, 18 nt, Yersinia pestis
uaauccaaaauaauauaa

SEQ ID NO: 4138098 - RNA, 13 nt, Yersinia pestis
uaauccacccggc

SEQ ID NO: 4138099 - RNA, 20 nt, Yersinia pestis
uaauccccggucacuuaaau

SEQ ID NO: 4138100 - RNA, 17 nt, Yersinia pestis
uaaucccgaaucaagcu

SEQ ID NO: 4138101 - RNA, 19 nt, Yersinia pestis
uaauccuaaugaacacuua

SEQ ID NO: 4138102 - RNA, 16 nt, Yersinia pestis
uaaucgauaaaaagaa

SEQ ID NO: 4138103 - RNA, 17 nt, Yersinia pestis
uaaucgauaaaaagaau

SEQ ID NO: 4138104 - RNA, 14 nt, Yersinia pestis
uaaucgauaaugga

SEQ ID NO: 4138105 - RNA, 15 nt, Yersinia pestis
uaaucgcagcagaga

SEQ ID NO: 4138106 - RNA, 17 nt, Yersinia pestis
uaaucgccaauaaccgc

SEQ ID NO: 4138107 - RNA, 21 nt, Yersinia pestis
uaaucgccagcaaaucacauu

SEQ ID NO: 4138108 - RNA, 21 nt, Yersinia pestis
uaaucgccaggcgcuacgcaa

SEQ ID NO: 4138109 - RNA, 22 nt, Yersinia pestis
uaaucgccucgaccuuaaccgc

SEQ ID NO: 4138110 - RNA, 21 nt, Yersinia pestis
uaaucgccugcugagccaaau

SEQ ID NO: 4138111 - RNA, 18 nt, Yersinia pestis
uaaucgcgcauuucuucu

SEQ ID NO: 4138112 - RNA, 22 nt, Yersinia pestis
uaaucgcgcauuucuucucuca

SEQ ID NO: 4138113 - RNA, 21 nt, Yersinia pestis
uaaucgcguucagagcagcau

SEQ ID NO: 4138114 - RNA, 16 nt, Yersinia pestis
uaaucgcugaacagac

SEQ ID NO: 4138115 - RNA, 18 nt, Yersinia pestis
uaaucgggaaauugugau

SEQ ID NO: 4138116 - RNA, 22 nt, Yersinia pestis
uaaucgucccacaugaacucaa

SEQ ID NO: 4138117 - RNA, 23 nt, Yersinia pestis
uaaucgucuuguuggucaccacu

SEQ ID NO: 4138118 - RNA, 17 nt, Yersinia pestis
uaaucguggugaagaau

SEQ ID NO: 4138119 - RNA, 15 nt, Yersinia pestis
uaaucuccaucaugg

SEQ ID NO: 4138120 - RNA, 14 nt, Yersinia pestis
uaaucucuccauga

SEQ ID NO: 4138121 - RNA, 14 nt, Yersinia pestis
uaaucugaucuguu

SEQ ID NO: 4138122 - RNA, 23 nt, Yersinia pestis
uaaucuucuuuaaaacaggaucu

SEQ ID NO: 4138123 - RNA, 15 nt, Yersinia pestis
uaaucuuuacugcau

SEQ ID NO: 4138124 - RNA, 19 nt, Yersinia pestis
uaaugaacgaguaaaaaga

SEQ ID NO: 4138125 - RNA, 14 nt, Yersinia pestis
uaaugaagauuuaa

SEQ ID NO: 4138126 - RNA, 16 nt, Yersinia pestis
uaaugaauuauuagau

SEQ ID NO: 4138127 - RNA, 14 nt, Yersinia pestis
uaaugacauaauca

SEQ ID NO: 4138128 - RNA, 15 nt, Yersinia pestis
uaaugacauaaucag

SEQ ID NO: 4138129 - RNA, 17 nt, Yersinia pestis
uaaugagaaucaaucaa

SEQ ID NO: 4138130 - RNA, 18 nt, Yersinia pestis
uaaugagccgcauugauc

SEQ ID NO: 4138131 - RNA, 20 nt, Yersinia pestis
uaaugagccgcauugauccu

SEQ ID NO: 4138132 - RNA, 19 nt, Yersinia pestis
uaaugaggguaagugaaua

SEQ ID NO: 4138133 - RNA, 22 nt, Yersinia pestis
uaaugaguaagcgcggucauau

SEQ ID NO: 4138134 - RNA, 22 nt, Yersinia pestis
uaaugauacgugcuauagaaaa

SEQ ID NO: 4138135 - RNA, 20 nt, Yersinia pestis
uaaugauagcgagggccuuu

SEQ ID NO: 4138136 - RNA, 19 nt, Yersinia pestis
uaaugauuauugaccagau

SEQ ID NO: 4138137 - RNA, 14 nt, Yersinia pestis
uaaugauugauuau

SEQ ID NO: 4138138 - RNA, 23 nt, Yersinia pestis
uaaugauugauuaucaaguuaaa

SEQ ID NO: 4138139 - RNA, 20 nt, Yersinia pestis
uaaugauugccguagcguca

SEQ ID NO: 4138140 - RNA, 15 nt, Yersinia pestis
uaaugcaccaaucaa

SEQ ID NO: 4138141 - RNA, 17 nt, Yersinia pestis
uaaugcagguuuugcca

SEQ ID NO: 4138142 - RNA, 13 nt, Yersinia pestis
uaaugccaauuga

SEQ ID NO: 4138143 - RNA, 19 nt, Yersinia pestis
uaaugccacccccagugcu

SEQ ID NO: 4138144 - RNA, 18 nt, Yersinia pestis
uaaugcccgucauauuua

SEQ ID NO: 4138145 - RNA, 17 nt, Yersinia pestis
uaaugccgaaugauuca

SEQ ID NO: 4138146 - RNA, 21 nt, Yersinia pestis
uaaugccggcggcccauaucc

SEQ ID NO: 4138147 - RNA, 18 nt, Yersinia pestis
uaaugccuggugcaaccg

SEQ ID NO: 4138148 - RNA, 12 nt, Yersinia pestis
uaaugcggcucu

SEQ ID NO: 4138149 - RNA, 20 nt, Yersinia pestis
uaaugcggugguuaacagcg

SEQ ID NO: 4138150 - RNA, 19 nt, Yersinia pestis
uaaugcuauccacaaacuc

SEQ ID NO: 4138151 - RNA, 12 nt, Yersinia pestis
uaauggauagcu

SEQ ID NO: 4138152 - RNA, 17 nt, Yersinia pestis
uaauggcgcacauuaca

SEQ ID NO: 4138153 - RNA, 22 nt, Yersinia pestis
uaauggguuagcgguuaaaaac

SEQ ID NO: 4138154 - RNA, 19 nt, Yersinia pestis
uaaugguuuccauaauggu

SEQ ID NO: 4138155 - RNA, 21 nt, Yersinia pestis
uaauguacaccuaaaacauac

SEQ ID NO: 4138156 - RNA, 17 nt, Yersinia pestis
uaaugucgccauaacgc

SEQ ID NO: 4138157 - RNA, 18 nt, Yersinia pestis
uaauguguuuuugucauu

SEQ ID NO: 4138158 - RNA, 21 nt, Yersinia pestis
uaauguguuuuugucauuuaa

SEQ ID NO: 4138159 - RNA, 23 nt, Yersinia pestis
uaauguguuuuugucauuuaauu

SEQ ID NO: 4138160 - RNA, 18 nt, Yersinia pestis
uaauguuucuauccgaaa

SEQ ID NO: 4138161 - RNA, 17 nt, Yersinia pestis
uaauuaaacgcucauca

SEQ ID NO: 4138162 - RNA, 13 nt, Yersinia pestis
uaauuaaaugacu

SEQ ID NO: 4138163 - RNA, 17 nt, Yersinia pestis
uacauaaguaagugauu

SEQ ID NO: 4138164 - RNA, 22 nt, Yersinia pestis
uacauaccacuuaguggcauug

SEQ ID NO: 4138165 - RNA, 15 nt, Yersinia pestis
uacauagaaacggug

SEQ ID NO: 4138166 - RNA, 22 nt, Yersinia pestis
uacauagaagcucauaugcagc

SEQ ID NO: 4138167 - RNA, 12 nt, Yersinia pestis
uacauagaugua

SEQ ID NO: 4138168 - RNA, 22 nt, Yersinia pestis
uacauauaauccaaaauaauau

SEQ ID NO: 4138169 - RNA, 18 nt, Yersinia pestis
uacauauaggaaaugucg

SEQ ID NO: 4138170 - RNA, 14 nt, Yersinia pestis
uacauauaucacua

SEQ ID NO: 4138171 - RNA, 18 nt, Yersinia pestis
uacauauaucacuauuuc

SEQ ID NO: 4138172 - RNA, 22 nt, Yersinia pestis
uacauaucuuuauuaucaaugg

SEQ ID NO: 4138173 - RNA, 15 nt, Yersinia pestis
uacaucaucuucuau

SEQ ID NO: 4138174 - RNA, 22 nt, Yersinia pestis
uacauccaauuuuuucaucaua

SEQ ID NO: 4138175 - RNA, 18 nt, Yersinia pestis
uacaucccgccauggcau

SEQ ID NO: 4138176 - RNA, 13 nt, Yersinia pestis
uacauccuaaaua

SEQ ID NO: 4138177 - RNA, 16 nt, Yersinia pestis
uacauccuaaauaauu

SEQ ID NO: 4138178 - RNA, 21 nt, Yersinia pestis
uacaucuccgcuauuuuccac

SEQ ID NO: 4138179 - RNA, 17 nt, Yersinia pestis
uacaugauugaaaaaca

SEQ ID NO: 4138180 - RNA, 16 nt, Yersinia pestis
uacauuauuauuuaca

SEQ ID NO: 4138181 - RNA, 22 nt, Yersinia pestis
uacauuauuauuuacaaaccau

SEQ ID NO: 4138182 - RNA, 12 nt, Yersinia pestis
uacauuccacaa

SEQ ID NO: 4138183 - RNA, 23 nt, Yersinia pestis
uacauuccacaaauuuuuaccuu

SEQ ID NO: 4138184 - RNA, 18 nt, Yersinia pestis
uacauuuaaacacucaau

SEQ ID NO: 4138185 - RNA, 13 nt, Yersinia pestis
uacauuuuuaaca

SEQ ID NO: 4138186 - RNA, 16 nt, Yersinia pestis
uaccaaaacgccacca

SEQ ID NO: 4138187 - RNA, 12 nt, Yersinia pestis
uaccaaacauuu

SEQ ID NO: 4138188 - RNA, 16 nt, Yersinia pestis
uaccaaaucagcaagc

SEQ ID NO: 4138189 - RNA, 17 nt, Yersinia pestis
uaccaaaucagcaagcu

SEQ ID NO: 4138190 - RNA, 15 nt, Yersinia pestis
uaccaagccaaauua

SEQ ID NO: 4138191 - RNA, 24 nt, Yersinia pestis
uaccaaggcaugauaggcacggca

SEQ ID NO: 4138192 - RNA, 14 nt, Yersinia pestis
uaccaauaaaaccu

SEQ ID NO: 4138193 - RNA, 15 nt, Yersinia pestis
uaccaauaauuaauu

SEQ ID NO: 4138194 - RNA, 16 nt, Yersinia pestis
uaccaauaccauuuua

SEQ ID NO: 4138195 - RNA, 16 nt, Yersinia pestis
uaccaauggugcccau

SEQ ID NO: 4138196 - RNA, 14 nt, Yersinia pestis
uaccaauucuucau

SEQ ID NO: 4138197 - RNA, 12 nt, Yersinia pestis
uaccaauugaug

SEQ ID NO: 4138198 - RNA, 18 nt, Yersinia pestis
uaccaauuucauacaggc

SEQ ID NO: 4138199 - RNA, 13 nt, Yersinia pestis
uaccaccaccaac

SEQ ID NO: 4138200 - RNA, 15 nt, Yersinia pestis
uaccaccaccaacag

SEQ ID NO: 4138201 - RNA, 18 nt, Yersinia pestis
uaccaccaccacaaacag

SEQ ID NO: 4138202 - RNA, 20 nt, Yersinia pestis
uaccaccuacaaccuaccac

SEQ ID NO: 4138203 - RNA, 16 nt, Yersinia pestis
uaccaccuaccaccua

SEQ ID NO: 4138204 - RNA, 19 nt, Yersinia pestis
uaccacggcaccuucugau

SEQ ID NO: 4138205 - RNA, 22 nt, Yersinia pestis
uaccagaaaguuuaaucaguuc

SEQ ID NO: 4138206 - RNA, 17 nt, Yersinia pestis
uaccaggaagcggccag

SEQ ID NO: 4138207 - RNA, 13 nt, Yersinia pestis
uaccagugccaug

SEQ ID NO: 4138208 - RNA, 22 nt, Yersinia pestis
uaccaguuuuuuccugcugcug

SEQ ID NO: 4138209 - RNA, 15 nt, Yersinia pestis
uaccauaacaauggc

SEQ ID NO: 4138210 - RNA, 18 nt, Yersinia pestis
uaccauaguuuuucuccu

SEQ ID NO: 4138211 - RNA, 24 nt, Yersinia pestis
uaccauauccacgguauuaguauu

SEQ ID NO: 4138212 - RNA, 22 nt, Yersinia pestis
uaccauauggaugaugcacagc

SEQ ID NO: 4138213 - RNA, 21 nt, Yersinia pestis
uaccauuucacgguucacccc

SEQ ID NO: 4138214 - RNA, 20 nt, Yersinia pestis
uaccauuuucagacugaaau

SEQ ID NO: 4138215 - RNA, 13 nt, Yersinia pestis
uacccaaaccaac

SEQ ID NO: 4138216 - RNA, 14 nt, Yersinia pestis
uacccacggguuaa

SEQ ID NO: 4138217 - RNA, 22 nt, Yersinia pestis
uacccagcuucuuuuaaagaag

SEQ ID NO: 4138218 - RNA, 21 nt, Yersinia pestis
uacccauaacuugagcacaua

SEQ ID NO: 4138219 - RNA, 13 nt, Yersinia pestis
uacccauuuuaau

SEQ ID NO: 4138220 - RNA, 20 nt, Yersinia pestis
uacccccgacgacuuguuca

SEQ ID NO: 4138221 - RNA, 11 nt, Yersinia pestis
uacccgaauca

SEQ ID NO: 4138222 - RNA, 16 nt, Yersinia pestis
uacccgaaucacugac

SEQ ID NO: 4138223 - RNA, 19 nt, Yersinia pestis
uacccgaaucacugacuga

SEQ ID NO: 4138224 - RNA, 23 nt, Yersinia pestis
uacccggccaaccguagugaguc

SEQ ID NO: 4138225 - RNA, 17 nt, Yersinia pestis
uacccguaauauuucaa

SEQ ID NO: 4138226 - RNA, 22 nt, Yersinia pestis
uacccgucguacuuuaagcugc

SEQ ID NO: 4138227 - RNA, 21 nt, Yersinia pestis
uacccuaacucuuuggauggg

SEQ ID NO: 4138228 - RNA, 20 nt, Yersinia pestis
uacccuaucgucacagcaau

SEQ ID NO: 4138229 - RNA, 18 nt, Yersinia pestis
uacccuccgacuuugaua

SEQ ID NO: 4138230 - RNA, 19 nt, Yersinia pestis
uacccucgacaccaaaacu

SEQ ID NO: 4138231 - RNA, 13 nt, Yersinia pestis
uacccugcaccau

SEQ ID NO: 4138232 - RNA, 14 nt, Yersinia pestis
uacccugcaccaua

SEQ ID NO: 4138233 - RNA, 13 nt, Yersinia pestis
uacccuuugagaa

SEQ ID NO: 4138234 - RNA, 17 nt, Yersinia pestis
uaccgaacgaacacagu

SEQ ID NO: 4138235 - RNA, 20 nt, Yersinia pestis
uaccgaucaaacagguaaaa

SEQ ID NO: 4138236 - RNA, 22 nt, Yersinia pestis
uaccgaugcaaucgcauugcgu

SEQ ID NO: 4138237 - RNA, 17 nt, Yersinia pestis
uaccgauuucaggucgc

SEQ ID NO: 4138238 - RNA, 16 nt, Yersinia pestis
uaccgccaauaucugu

SEQ ID NO: 4138239 - RNA, 17 nt, Yersinia pestis
uaccgccauaguacaua

SEQ ID NO: 4138240 - RNA, 13 nt, Yersinia pestis
uaccgcccguuga

SEQ ID NO: 4138241 - RNA, 14 nt, Yersinia pestis
uaccgcgaucaaca

SEQ ID NO: 4138242 - RNA, 15 nt, Yersinia pestis
uaccgcuaugcuaaa

SEQ ID NO: 4138243 - RNA, 22 nt, Yersinia pestis
uaccgcugcccggcucaucaag

SEQ ID NO: 4138244 - RNA, 16 nt, Yersinia pestis
uaccggcauuggcugg

SEQ ID NO: 4138245 - RNA, 23 nt, Yersinia pestis
uaccgguaaaauuauugccgcag

SEQ ID NO: 4138246 - RNA, 17 nt, Yersinia pestis
uaccgguauccauccca

SEQ ID NO: 4138247 - RNA, 23 nt, Yersinia pestis
uaccgguucauuuagcagcgcac

SEQ ID NO: 4138248 - RNA, 15 nt, Yersinia pestis
uaccgucauccagca

SEQ ID NO: 4138249 - RNA, 22 nt, Yersinia pestis
uaccgucgaacauaaaaaugca

SEQ ID NO: 4138250 - RNA, 14 nt, Yersinia pestis
uaccguugggcuuu

SEQ ID NO: 4138251 - RNA, 23 nt, Yersinia pestis
uaccuaaccaaacauugucaccu

SEQ ID NO: 4138252 - RNA, 18 nt, Yersinia pestis
uaccuauggcgaagagaa

SEQ ID NO: 4138253 - RNA, 19 nt, Yersinia pestis
uaccucaagcugcauguac

SEQ ID NO: 4138254 - RNA, 20 nt, Yersinia pestis
uaccucaguuaucagggccu

SEQ ID NO: 4138255 - RNA, 16 nt, Yersinia pestis
uaccugccugcugcug

SEQ ID NO: 4138256 - RNA, 19 nt, Yersinia pestis
uaccugccugcugcugugg

SEQ ID NO: 4138257 - RNA, 18 nt, Yersinia pestis
uaccugcgacaccguuga

SEQ ID NO: 4138258 - RNA, 13 nt, Yersinia pestis
uaccugcucaacu

SEQ ID NO: 4138259 - RNA, 22 nt, Yersinia pestis
uaccuggacgcuggcagccuuu

SEQ ID NO: 4138260 - RNA, 21 nt, Yersinia pestis
uaccugucccguuccaaccgg

SEQ ID NO: 4138261 - RNA, 21 nt, Yersinia pestis
uaccuuaauuaacucuucugu

SEQ ID NO: 4138262 - RNA, 14 nt, Yersinia pestis
uaccuuacuguauc

SEQ ID NO: 4138263 - RNA, 13 nt, Yersinia pestis
uaccuuaggcuug

SEQ ID NO: 4138264 - RNA, 18 nt, Yersinia pestis
uaccuucacauuuucucc

SEQ ID NO: 4138265 - RNA, 21 nt, Yersinia pestis
uaccuucaggccuuuacuguu

SEQ ID NO: 4138266 - RNA, 13 nt, Yersinia pestis
uaccuucccaucc

SEQ ID NO: 4138267 - RNA, 15 nt, Yersinia pestis
uaccuugugucacca

SEQ ID NO: 4138268 - RNA, 16 nt, Yersinia pestis
uaccuuguuacucaua

SEQ ID NO: 4138269 - RNA, 19 nt, Yersinia pestis
uaccuuuaacuguuuuaua

SEQ ID NO: 4138270 - RNA, 18 nt, Yersinia pestis
uaccuuuugcauauuucu

SEQ ID NO: 4138271 - RNA, 18 nt, Yersinia pestis
uaccuuuugcugcacugc

SEQ ID NO: 4138272 - RNA, 18 nt, Yersinia pestis
uacgaauuuuucccugcu

SEQ ID NO: 4138273 - RNA, 20 nt, Yersinia pestis
uacgagagaucguaggcuuu

SEQ ID NO: 4138274 - RNA, 15 nt, Yersinia pestis
uacgagcuaaugcua

SEQ ID NO: 4138275 - RNA, 13 nt, Yersinia pestis
uacgcaacaagcc

SEQ ID NO: 4138276 - RNA, 13 nt, Yersinia pestis
uacgcaauaccga

SEQ ID NO: 4138277 - RNA, 19 nt, Yersinia pestis
uacgcagcuuguugauauc

SEQ ID NO: 4138278 - RNA, 12 nt, Yersinia pestis
uacgcagguuau

SEQ ID NO: 4138279 - RNA, 14 nt, Yersinia pestis
uacgcaucacgccc

SEQ ID NO: 4138280 - RNA, 23 nt, Yersinia pestis
uacgcaugaucccugguuugcca

SEQ ID NO: 4138281 - RNA, 13 nt, Yersinia pestis
uacgcauuuuacc

SEQ ID NO: 4138282 - RNA, 22 nt, Yersinia pestis
uacgcauuuuaccggagauaug

SEQ ID NO: 4138283 - RNA, 22 nt, Yersinia pestis
uacgccaccugagguuauugac

SEQ ID NO: 4138284 - RNA, 13 nt, Yersinia pestis
uacgccaccuucu

SEQ ID NO: 4138285 - RNA, 15 nt, Yersinia pestis
uagagcagugcagca

SEQ ID NO: 4138286 - RNA, 17 nt, Yersinia pestis
uagagccuuuacgggcu

SEQ ID NO: 4138287 - RNA, 14 nt, Yersinia pestis
uagaguaaguaaaa

SEQ ID NO: 4138288 - RNA, 16 nt, Yersinia pestis
uagagugcauccagcg

SEQ ID NO: 4138289 - RNA, 15 nt, Yersinia pestis
uagaguugauaaaca

SEQ ID NO: 4138290 - RNA, 17 nt, Yersinia pestis
uagauacaauucaccca

SEQ ID NO: 4138291 - RNA, 18 nt, Yersinia pestis
uagauaccgcaaccauug

SEQ ID NO: 4138292 - RNA, 20 nt, Yersinia pestis
uagauaccgcaaccauugcu

SEQ ID NO: 4138293 - RNA, 16 nt, Yersinia pestis
uagauagcaaucaaua

SEQ ID NO: 4138294 - RNA, 14 nt, Yersinia pestis
uagauagccauaau

SEQ ID NO: 4138295 - RNA, 17 nt, Yersinia pestis
uagauagccauaauaau

SEQ ID NO: 4138296 - RNA, 18 nt, Yersinia pestis
uagauaggcaguauucca

SEQ ID NO: 4138297 - RNA, 17 nt, Yersinia pestis
uagauaguacguagcga

SEQ ID NO: 4138298 - RNA, 20 nt, Yersinia pestis
uagauaugaucgcggcaauc

SEQ ID NO: 4138299 - RNA, 22 nt, Yersinia pestis
uagauauuguuuugacuaaaau

SEQ ID NO: 4138300 - RNA, 21 nt, Yersinia pestis
uagaucacagacguuuaaaua

SEQ ID NO: 4138301 - RNA, 18 nt, Yersinia pestis
uagauccacuccagugcc

SEQ ID NO: 4138302 - RNA, 20 nt, Yersinia pestis
uagaucccauacccacuaau

SEQ ID NO: 4138303 - RNA, 21 nt, Yersinia pestis
uagaucccauacccacuaaua

SEQ ID NO: 4138304 - RNA, 18 nt, Yersinia pestis
uagaucggccaaugcuuu

SEQ ID NO: 4138305 - RNA, 16 nt, Yersinia pestis
uagauggaaaucacac

SEQ ID NO: 4138306 - RNA, 13 nt, Yersinia pestis
uagauuaaucgaa

SEQ ID NO: 4138307 - RNA, 19 nt, Yersinia pestis
uagauuaaugaaaaggcau

SEQ ID NO: 4138308 - RNA, 14 nt, Yersinia pestis
uagauuauuuucuu

SEQ ID NO: 4138309 - RNA, 17 nt, Yersinia pestis
uagauucaucaccaguc

SEQ ID NO: 4138310 - RNA, 23 nt, Yersinia pestis
uagauucggugacuaaaaucgau

SEQ ID NO: 4138311 - RNA, 17 nt, Yersinia pestis
uagauuuauucaacauu

SEQ ID NO: 4138312 - RNA, 23 nt, Yersinia pestis
uagauuucaccuauaauuaacag

SEQ ID NO: 4138313 - RNA, 19 nt, Yersinia pestis
uagauuucacugccgaacc

SEQ ID NO: 4138314 - RNA, 23 nt, Yersinia pestis
uagauuucugcacccauggagau

SEQ ID NO: 4138315 - RNA, 19 nt, Yersinia pestis
uagauuuuaugaauuaauu

SEQ ID NO: 4138316 - RNA, 14 nt, Yersinia pestis
uagcaaaaaaaaag

SEQ ID NO: 4138317 - RNA, 19 nt, Yersinia pestis
uagcaaaaggauuaauaau

SEQ ID NO: 4138318 - RNA, 22 nt, Yersinia pestis
uagcaaaaggauuaauaauaau

SEQ ID NO: 4138319 - RNA, 18 nt, Yersinia pestis
uagcaaacccaccugaau

SEQ ID NO: 4138320 - RNA, 17 nt, Yersinia pestis
uagcaaagcgauaucgu

SEQ ID NO: 4138321 - RNA, 22 nt, Yersinia pestis
uagcaaagcgauaucguuauca

SEQ ID NO: 4138322 - RNA, 19 nt, Yersinia pestis
uagcaagccaaaacagccu

SEQ ID NO: 4138323 - RNA, 18 nt, Yersinia pestis
uagcaaggcguacaucuc

SEQ ID NO: 4138324 - RNA, 21 nt, Yersinia pestis
uagcaauaccagccgauaauc

SEQ ID NO: 4138325 - RNA, 22 nt, Yersinia pestis
uagcaauaccuugcccuaggcc

SEQ ID NO: 4138326 - RNA, 14 nt, Yersinia pestis
uagcaauagaacug

SEQ ID NO: 4138327 - RNA, 13 nt, Yersinia pestis
uagcaauuugagg

SEQ ID NO: 4138328 - RNA, 14 nt, Yersinia pestis
uagcacauaugcag

SEQ ID NO: 4138329 - RNA, 21 nt, Yersinia pestis
uagcacccaauguauauguug

SEQ ID NO: 4138330 - RNA, 19 nt, Yersinia pestis
uagcacguuuuucagcuuc

SEQ ID NO: 4138331 - RNA, 16 nt, Yersinia pestis
uagcagagcacgcaga

SEQ ID NO: 4138332 - RNA, 12 nt, Yersinia pestis
uagcagcaccau

SEQ ID NO: 4138333 - RNA, 19 nt, Yersinia pestis
uagcagccacaugguuuca

SEQ ID NO: 4138334 - RNA, 14 nt, Yersinia pestis
uagcagcgcacugg

SEQ ID NO: 4138335 - RNA, 12 nt, Yersinia pestis
uagcagggccgc

SEQ ID NO: 4138336 - RNA, 20 nt, Yersinia pestis
uagcagggucaccaccacuu

SEQ ID NO: 4138337 - RNA, 15 nt, Yersinia pestis
uagcagugauuucag

SEQ ID NO: 4138338 - RNA, 13 nt, Yersinia pestis
uagcaucauccag

SEQ ID NO: 4138339 - RNA, 18 nt, Yersinia pestis
uagcauggcuuuaugacc

SEQ ID NO: 4138340 - RNA, 20 nt, Yersinia pestis
uagcauugcagauuucuucu

SEQ ID NO: 4138341 - RNA, 20 nt, Yersinia pestis
uagccaaauacauauaacca

SEQ ID NO: 4138342 - RNA, 21 nt, Yersinia pestis
uagccaaauacccuaauucag

SEQ ID NO: 4138343 - RNA, 23 nt, Yersinia pestis
uagccaaaucuggauaaugucgu

SEQ ID NO: 4138344 - RNA, 22 nt, Yersinia pestis
uagccaccaguuuauuuucccu

SEQ ID NO: 4138345 - RNA, 23 nt, Yersinia pestis
uagccaccaguuuauuuucccuu

SEQ ID NO: 4138346 - RNA, 14 nt, Yersinia pestis
uagccacuaacuaa

SEQ ID NO: 4138347 - RNA, 15 nt, Yersinia pestis
uagccagauaaaacu

SEQ ID NO: 4138348 - RNA, 16 nt, Yersinia pestis
uagccagccaauggcc

SEQ ID NO: 4138349 - RNA, 21 nt, Yersinia pestis
uagccagccaccgcacacuga

SEQ ID NO: 4138350 - RNA, 22 nt, Yersinia pestis
uagccagcgugguguuggcugu

SEQ ID NO: 4138351 - RNA, 15 nt, Yersinia pestis
uagccauucaaaaau

SEQ ID NO: 4138352 - RNA, 16 nt, Yersinia pestis
uagccauucaaaaauu

SEQ ID NO: 4138353 - RNA, 15 nt, Yersinia pestis
uagcccaaagcaaua

SEQ ID NO: 4138354 - RNA, 16 nt, Yersinia pestis
uagcccaaggcgacuu

SEQ ID NO: 4138355 - RNA, 21 nt, Yersinia pestis
uagccccggcaaguugaucac

SEQ ID NO: 4138356 - RNA, 20 nt, Yersinia pestis
uagcccggcucauccgccaa

SEQ ID NO: 4138357 - RNA, 12 nt, Yersinia pestis
uagcccucccug

SEQ ID NO: 4138358 - RNA, 23 nt, Yersinia pestis
uagcccuucagcaaaugauugca

SEQ ID NO: 4138359 - RNA, 19 nt, Yersinia pestis
uagccgaugcuacaccauc

SEQ ID NO: 4138360 - RNA, 20 nt, Yersinia pestis
uagccgcaggcgaugcaagg

SEQ ID NO: 4138361 - RNA, 14 nt, Yersinia pestis
uagccgcgccaucc

SEQ ID NO: 4138362 - RNA, 17 nt, Yersinia pestis
uagccgcuuucaucgau

SEQ ID NO: 4138363 - RNA, 18 nt, Yersinia pestis
uagccgucacuuaaaaau

SEQ ID NO: 4138364 - RNA, 23 nt, Yersinia pestis
uagccgucacuuaaaaaucaaua

SEQ ID NO: 4138365 - RNA, 18 nt, Yersinia pestis
uagccugagcaauauguu

SEQ ID NO: 4138366 - RNA, 19 nt, Yersinia pestis
uagccugcaccucaucaac

SEQ ID NO: 4138367 - RNA, 21 nt, Yersinia pestis
uagccuucguuugucaaugga

SEQ ID NO: 4138368 - RNA, 14 nt, Yersinia pestis
uagcgaaccuuagc

SEQ ID NO: 4138369 - RNA, 13 nt, Yersinia pestis
uagcgagaaaguc

SEQ ID NO: 4138370 - RNA, 14 nt, Yersinia pestis
uagcgauagaguug

SEQ ID NO: 4138371 - RNA, 14 nt, Yersinia pestis
uagcgauauccuua

SEQ ID NO: 4138372 - RNA, 14 nt, Yersinia pestis
uagcgaugacugag

SEQ ID NO: 4138373 - RNA, 19 nt, Yersinia pestis
uagcgaugacugaguauga

SEQ ID NO: 4138374 - RNA, 12 nt, Yersinia pestis
uagcgccagcaa

SEQ ID NO: 4138375 - RNA, 13 nt, Yersinia pestis
uagcgccuuuuuu

SEQ ID NO: 4138376 - RNA, 22 nt, Yersinia pestis
uagcgccuuuuuuauaauaaug

SEQ ID NO: 4138377 - RNA, 20 nt, Yersinia pestis
uagcgcgcguuuaaucgaua

SEQ ID NO: 4138378 - RNA, 23 nt, Yersinia pestis
uagcgcgggugaucgucaucagc

SEQ ID NO: 4138379 - RNA, 16 nt, Yersinia pestis
uagcgcugcaucagca

SEQ ID NO: 4138380 - RNA, 18 nt, Yersinia pestis
uagcgcugcaucagcagu

SEQ ID NO: 4138381 - RNA, 19 nt, Yersinia pestis
uagcgcuucagugauuuua

SEQ ID NO: 4138382 - RNA, 22 nt, Yersinia pestis
uagcgcuuuuacaucaaccccu

SEQ ID NO: 4138383 - RNA, 18 nt, Yersinia pestis
uagcggaaggguuuugug

SEQ ID NO: 4138384 - RNA, 16 nt, Yersinia pestis
uagcggcguucagcaa

SEQ ID NO: 4138385 - RNA, 17 nt, Yersinia pestis
uagcgugagaauaauaa

SEQ ID NO: 4138386 - RNA, 17 nt, Yersinia pestis
uagcgugauuuuuauau

SEQ ID NO: 4138387 - RNA, 22 nt, Yersinia pestis
uagcguucaucgcccuguaacu

SEQ ID NO: 4138388 - RNA, 22 nt, Yersinia pestis
uagcguugccgccgggcagcaa

SEQ ID NO: 4138389 - RNA, 13 nt, Yersinia pestis
uagcuaaauuuaa

SEQ ID NO: 4138390 - RNA, 17 nt, Yersinia pestis
uagcuacagcaccauua

SEQ ID NO: 4138391 - RNA, 12 nt, Yersinia pestis
uagcuacugaug

SEQ ID NO: 4138392 - RNA, 21 nt, Yersinia pestis
uagcuagccccaaucaagcaa

SEQ ID NO: 4138393 - RNA, 12 nt, Yersinia pestis
uagcuaugcagu

SEQ ID NO: 4138394 - RNA, 12 nt, Yersinia pestis
uagcucaaauau

SEQ ID NO: 4138395 - RNA, 18 nt, Yersinia pestis
uagcucaucguauuggcc

SEQ ID NO: 4138396 - RNA, 15 nt, Yersinia pestis
uagcucgcuacgccu

SEQ ID NO: 4138397 - RNA, 15 nt, Yersinia pestis
uagcucgcucaacau

SEQ ID NO: 4138398 - RNA, 16 nt, Yersinia pestis
uagcucgcuguggcua

SEQ ID NO: 4138399 - RNA, 12 nt, Yersinia pestis
uagcucuucacg

SEQ ID NO: 4138400 - RNA, 21 nt, Yersinia pestis
uagcugaauacgguuuugcca

SEQ ID NO: 4138401 - RNA, 14 nt, Yersinia pestis
uagcugcuuuugcu

SEQ ID NO: 4138402 - RNA, 17 nt, Yersinia pestis
uagcuggcugaacgcuc

SEQ ID NO: 4138403 - RNA, 21 nt, Yersinia pestis
uagcuggcuucaaaaucaccu

SEQ ID NO: 4138404 - RNA, 22 nt, Yersinia pestis
uagcuuauccccugagaaacau

SEQ ID NO: 4138405 - RNA, 17 nt, Yersinia pestis
uagcuuucuccuuugau

SEQ ID NO: 4138406 - RNA, 14 nt, Yersinia pestis
uauacauaccacuu

SEQ ID NO: 4138407 - RNA, 15 nt, Yersinia pestis
uauacauaccacuua

SEQ ID NO: 4138408 - RNA, 15 nt, Yersinia pestis
uauacauuauuauuu

SEQ ID NO: 4138409 - RNA, 15 nt, Yersinia pestis
uauaccaacucugaa

SEQ ID NO: 4138410 - RNA, 14 nt, Yersinia pestis
uauacccaccagag

SEQ ID NO: 4138411 - RNA, 16 nt, Yersinia pestis
uauacccaccagagac

SEQ ID NO: 4138412 - RNA, 21 nt, Yersinia pestis
uauacccagcaucauaagacu

SEQ ID NO: 4138413 - RNA, 16 nt, Yersinia pestis
uauaccggggccauca

SEQ ID NO: 4138414 - RNA, 16 nt, Yersinia pestis
uauacggacaaugcca

SEQ ID NO: 4138415 - RNA, 18 nt, Yersinia pestis
uauacguaugcgcaccga

SEQ ID NO: 4138416 - RNA, 21 nt, Yersinia pestis
uauacuguuaacucgccaaca

SEQ ID NO: 4138417 - RNA, 18 nt, Yersinia pestis
uauagaaagugacacauu

SEQ ID NO: 4138418 - RNA, 13 nt, Yersinia pestis
uauagagaaaucu

SEQ ID NO: 4138419 - RNA, 22 nt, Yersinia pestis
uauagcagggccgguuaauuga

SEQ ID NO: 4138420 - RNA, 17 nt, Yersinia pestis
uauagcgcaccaccgac

SEQ ID NO: 4138421 - RNA, 12 nt, Yersinia pestis
uauagcguucau

SEQ ID NO: 4138422 - RNA, 16 nt, Yersinia pestis
uauaggcaucuuucag

SEQ ID NO: 4138423 - RNA, 21 nt, Yersinia pestis
uauaggcaucuuucaguuuua

SEQ ID NO: 4138424 - RNA, 17 nt, Yersinia pestis
uauaggcgcauaugaaa

SEQ ID NO: 4138425 - RNA, 21 nt, Yersinia pestis
uauaggcgcauaugaaaaacc

SEQ ID NO: 4138426 - RNA, 14 nt, Yersinia pestis
uauaggcuauuuua

SEQ ID NO: 4138427 - RNA, 20 nt, Yersinia pestis
uauaguaacuauuuacauaa

SEQ ID NO: 4138428 - RNA, 14 nt, Yersinia pestis
uauaguaucacugc

SEQ ID NO: 4138429 - RNA, 14 nt, Yersinia pestis
uauaguuaaacuga

SEQ ID NO: 4138430 - RNA, 21 nt, Yersinia pestis
uauaguuuauuuuauuuaauc

SEQ ID NO: 4138431 - RNA, 15 nt, Yersinia pestis
uauauaagagaugaa

SEQ ID NO: 4138432 - RNA, 23 nt, Yersinia pestis
uauauaagagaugaaauuuuauu

SEQ ID NO: 4138433 - RNA, 20 nt, Yersinia pestis
uauauacagucaauugagaa

SEQ ID NO: 4138434 - RNA, 16 nt, Yersinia pestis
uauauagagaaaucua

SEQ ID NO: 4138435 - RNA, 18 nt, Yersinia pestis
uauauagagaaaucuaca

SEQ ID NO: 4138436 - RNA, 13 nt, Yersinia pestis
uauauauuuugaa

SEQ ID NO: 4138437 - RNA, 16 nt, Yersinia pestis
uauauauuuugaauau

SEQ ID NO: 4138438 - RNA, 24 nt, Yersinia pestis
uauaucaaggcggcagagccaauc

SEQ ID NO: 4138439 - RNA, 12 nt, Yersinia pestis
uauaucacuauu

SEQ ID NO: 4138440 - RNA, 15 nt, Yersinia pestis
uauaucacuucugcu

SEQ ID NO: 4138441 - RNA, 20 nt, Yersinia pestis
uauaucgaucugauaucucu

SEQ ID NO: 4138442 - RNA, 19 nt, Yersinia pestis
uauaucggcucauuuuuug

SEQ ID NO: 4138443 - RNA, 17 nt, Yersinia pestis
uauaucguguuuaguug

SEQ ID NO: 4138444 - RNA, 16 nt, Yersinia pestis
uauaugaucagugggg

SEQ ID NO: 4138445 - RNA, 20 nt, Yersinia pestis
uauaugcgcuggcucuauuu

SEQ ID NO: 4138446 - RNA, 21 nt, Yersinia pestis
uauaugcgcuggcucuauuuu

SEQ ID NO: 4138447 - RNA, 16 nt, Yersinia pestis
uauauguugggaaaua

SEQ ID NO: 4138448 - RNA, 21 nt, Yersinia pestis
uauauguugggaaauaaccaa

SEQ ID NO: 4138449 - RNA, 14 nt, Yersinia pestis
uauauuauuaacga

SEQ ID NO: 4138450 - RNA, 23 nt, Yersinia pestis
uauauucuauugaggacaauuca

SEQ ID NO: 4138451 - RNA, 16 nt, Yersinia pestis
uauauucuggcaccug

SEQ ID NO: 4138452 - RNA, 15 nt, Yersinia pestis
uauauugauaaaaau

SEQ ID NO: 4138453 - RNA, 18 nt, Yersinia pestis
uauauugaugugaaacau

SEQ ID NO: 4138454 - RNA, 23 nt, Yersinia pestis
uauauugccaucgggcaauugaa

SEQ ID NO: 4138455 - RNA, 21 nt, Yersinia pestis
uauauugcgccgcauuguucu

SEQ ID NO: 4138456 - RNA, 17 nt, Yersinia pestis
uauauuggccugcacau

SEQ ID NO: 4138457 - RNA, 22 nt, Yersinia pestis
uauauuuuuggggucugaauau

SEQ ID NO: 4138458 - RNA, 16 nt, Yersinia pestis
uaucaaaacgccagau

SEQ ID NO: 4138459 - RNA, 15 nt, Yersinia pestis
uaucaaaauaaaaau

SEQ ID NO: 4138460 - RNA, 17 nt, Yersinia pestis
uaucaaagaauuccggc

SEQ ID NO: 4138461 - RNA, 21 nt, Yersinia pestis
uaucaacgcccagcuuuagca

SEQ ID NO: 4138462 - RNA, 19 nt, Yersinia pestis
uaucaacguagcugaauug

SEQ ID NO: 4138463 - RNA, 18 nt, Yersinia pestis
uaucaaggcggcagagcc

SEQ ID NO: 4138464 - RNA, 16 nt, Yersinia pestis
uaucaaguuaaauacu

SEQ ID NO: 4138465 - RNA, 16 nt, Yersinia pestis
uaucaauaagugcaaa

SEQ ID NO: 4138466 - RNA, 20 nt, Yersinia pestis
uaucaauaggauuuucauga

SEQ ID NO: 4138467 - RNA, 13 nt, Yersinia pestis
uaucaauagguca

SEQ ID NO: 4138468 - RNA, 15 nt, Yersinia pestis
uaucaaucaaaaaau

SEQ ID NO: 4138469 - RNA, 16 nt, Yersinia pestis
uaucaaucaaaaaaua

SEQ ID NO: 4138470 - RNA, 19 nt, Yersinia pestis
uaucaaucaaaaaauaaau

SEQ ID NO: 4138471 - RNA, 21 nt, Yersinia pestis
uaucaaucagcugauaugaaa

SEQ ID NO: 4138472 - RNA, 12 nt, Yersinia pestis
uaucaaugggau

SEQ ID NO: 4138473 - RNA, 19 nt, Yersinia pestis
uaucacaguuaaaaauaga

SEQ ID NO: 4138474 - RNA, 13 nt, Yersinia pestis
uaucacaucaucc

SEQ ID NO: 4138475 - RNA, 15 nt, Yersinia pestis
uaucacaucauccac

SEQ ID NO: 4138476 - RNA, 22 nt, Yersinia pestis
uaucacccgccaucgccccaaa

SEQ ID NO: 4138477 - RNA, 17 nt, Yersinia pestis
uaucacuauaauuauuu

SEQ ID NO: 4138478 - RNA, 15 nt, Yersinia pestis
uaucacuauuucaga

SEQ ID NO: 4138479 - RNA, 20 nt, Yersinia pestis
uaucacucuguacguaaaua

SEQ ID NO: 4138480 - RNA, 21 nt, Yersinia pestis
uaucacuggaggcguuuuuau

SEQ ID NO: 4138481 - RNA, 21 nt, Yersinia pestis
uaucagaaacaauaaauaucc

SEQ ID NO: 4138482 - RNA, 15 nt, Yersinia pestis
uaucagaaacagcag

SEQ ID NO: 4138483 - RNA, 14 nt, Yersinia pestis
uaucagaaauacgc

SEQ ID NO: 4138484 - RNA, 17 nt, Yersinia pestis
uaucagcccaucuuuga

SEQ ID NO: 4138485 - RNA, 18 nt, Yersinia pestis
uaucagccccuaaauccu

SEQ ID NO: 4138486 - RNA, 15 nt, Yersinia pestis
uaucagcgaaaaauu

SEQ ID NO: 4138487 - RNA, 20 nt, Yersinia pestis
uaucaggcuaauacaugcug

SEQ ID NO: 4138488 - RNA, 12 nt, Yersinia pestis
uaucagucuuuu

SEQ ID NO: 4138489 - RNA, 17 nt, Yersinia pestis
uaucagugacaccauug

SEQ ID NO: 4138490 - RNA, 17 nt, Yersinia pestis
uaucauaaauaaaagau

SEQ ID NO: 4138491 - RNA, 15 nt, Yersinia pestis
uaucauaauccaacu

SEQ ID NO: 4138492 - RNA, 14 nt, Yersinia pestis
uaucauauuaacau

SEQ ID NO: 4138493 - RNA, 14 nt, Yersinia pestis
uaucaucaccaccc

SEQ ID NO: 4138494 - RNA, 15 nt, Yersinia pestis
uaucaucauaaaugg

SEQ ID NO: 4138495 - RNA, 22 nt, Yersinia pestis
uaucaucgagaugcugacccug

SEQ ID NO: 4138496 - RNA, 17 nt, Yersinia pestis
uaucaucuuuuucugcc

SEQ ID NO: 4138497 - RNA, 19 nt, Yersinia pestis
uaucaucuuuuucugccug

SEQ ID NO: 4138498 - RNA, 20 nt, Yersinia pestis
uaucauuuaaauacagauca

SEQ ID NO: 4138499 - RNA, 23 nt, Yersinia pestis
uaucauuuuccugcauauuauuu

SEQ ID NO: 4138500 - RNA, 15 nt, Yersinia pestis
uauccaaccaccuua

SEQ ID NO: 4138501 - RNA, 13 nt, Yersinia pestis
uauccaacuucuu

SEQ ID NO: 4138502 - RNA, 15 nt, Yersinia pestis
uauccaaggcauccg

SEQ ID NO: 4138503 - RNA, 21 nt, Yersinia pestis
uauccaauaagcguauuuugu

SEQ ID NO: 4138504 - RNA, 20 nt, Yersinia pestis
uauccaaucuugguuaauag

SEQ ID NO: 4138505 - RNA, 19 nt, Yersinia pestis
uauccaauggcucaccuuu

SEQ ID NO: 4138506 - RNA, 12 nt, Yersinia pestis
uauccagcagcg

SEQ ID NO: 4138507 - RNA, 15 nt, Yersinia pestis
uauccagcgccauca

SEQ ID NO: 4138508 - RNA, 14 nt, Yersinia pestis
uauccaggcacugc

SEQ ID NO: 4138509 - RNA, 14 nt, Yersinia pestis
uauccauaaaauca

SEQ ID NO: 4138510 - RNA, 18 nt, Yersinia pestis
uauccauauuaaaugcau

SEQ ID NO: 4138511 - RNA, 17 nt, Yersinia pestis
uauccauccccgccuca

SEQ ID NO: 4138512 - RNA, 16 nt, Yersinia pestis
uauccaucugaugagu

SEQ ID NO: 4138513 - RNA, 11 nt, Yersinia pestis
uaucccaccac

SEQ ID NO: 4138514 - RNA, 18 nt, Yersinia pestis
uaucccauuaaugaguaa

SEQ ID NO: 4138515 - RNA, 12 nt, Yersinia pestis
uauccccuguag

SEQ ID NO: 4138516 - RNA, 15 nt, Yersinia pestis
uaucccuguuuucua

SEQ ID NO: 4138517 - RNA, 15 nt, Yersinia pestis
uauccgccaaagauu

SEQ ID NO: 4138518 - RNA, 15 nt, Yersinia pestis
uauccggauuaaauu

SEQ ID NO: 4138519 - RNA, 15 nt, Yersinia pestis
uauccguuaacccaa

SEQ ID NO: 4138520 - RNA, 16 nt, Yersinia pestis
uauccguuaacccaaa

SEQ ID NO: 4138521 - RNA, 15 nt, Yersinia pestis
uauccuaacagacca

SEQ ID NO: 4138522 - RNA, 18 nt, Yersinia pestis
uauccucaccguucaaga

SEQ ID NO: 4138523 - RNA, 19 nt, Yersinia pestis
uauccucaccguucaagau

SEQ ID NO: 4138524 - RNA, 11 nt, Yersinia pestis
uauccuccggc

SEQ ID NO: 4138525 - RNA, 12 nt, Yersinia pestis
uauccucggcca

SEQ ID NO: 4138526 - RNA, 21 nt, Yersinia pestis
uauccucuacgucaaucucac

SEQ ID NO: 4138527 - RNA, 21 nt, Yersinia pestis
uauccuguacauauauaauac

SEQ ID NO: 4138528 - RNA, 22 nt, Yersinia pestis
uauccuugauggaaauacgcuu

SEQ ID NO: 4138529 - RNA, 20 nt, Yersinia pestis
uauuagcgcugcucaaucac

SEQ ID NO: 4138530 - RNA, 13 nt, Yersinia pestis
uauuaggccgcga

SEQ ID NO: 4138531 - RNA, 16 nt, Yersinia pestis
uauuagggcugacaga

SEQ ID NO: 4138532 - RNA, 18 nt, Yersinia pestis
uauuaguccguagaaauc

SEQ ID NO: 4138533 - RNA, 15 nt, Yersinia pestis
uauuaguuucaaaua

SEQ ID NO: 4138534 - RNA, 13 nt, Yersinia pestis
uauuaucaauggc

SEQ ID NO: 4138535 - RNA, 17 nt, Yersinia pestis
uauuaucgguaucgaua

SEQ ID NO: 4138536 - RNA, 14 nt, Yersinia pestis
uauuauguauuuuu

SEQ ID NO: 4138537 - RNA, 16 nt, Yersinia pestis
uauuauuaaauuuuau

SEQ ID NO: 4138538 - RNA, 14 nt, Yersinia pestis
uauuauucaguuua

SEQ ID NO: 4138539 - RNA, 21 nt, Yersinia pestis
uauuauugcuaaguacuaucu

SEQ ID NO: 4138540 - RNA, 18 nt, Yersinia pestis
uauuauuuacacuuaauc

SEQ ID NO: 4138541 - RNA, 16 nt, Yersinia pestis
uauucaaaaucugaua

SEQ ID NO: 4138542 - RNA, 18 nt, Yersinia pestis
uauucaaacggugugcaa

SEQ ID NO: 4138543 - RNA, 21 nt, Yersinia pestis
uauucaacagccuuucccuga

SEQ ID NO: 4138544 - RNA, 20 nt, Yersinia pestis
uauucaacauuuaagugcua

SEQ ID NO: 4138545 - RNA, 13 nt, Yersinia pestis
uauucaagugcuc

SEQ ID NO: 4138546 - RNA, 16 nt, Yersinia pestis
uauucaauacuggcca

SEQ ID NO: 4138547 - RNA, 18 nt, Yersinia pestis
uauucaaugacuccugaa

SEQ ID NO: 4138548 - RNA, 15 nt, Yersinia pestis
uauucaccacacaua

SEQ ID NO: 4138549 - RNA, 16 nt, Yersinia pestis
uauucacguuuuucca

SEQ ID NO: 4138550 - RNA, 18 nt, Yersinia pestis
uauucacuauuuauuaau

SEQ ID NO: 4138551 - RNA, 11 nt, Yersinia pestis
uauucagcaag

SEQ ID NO: 4138552 - RNA, 11 nt, Yersinia pestis
uauucagccaa

SEQ ID NO: 4138553 - RNA, 16 nt, Yersinia pestis
uauucaguaaaaacug

SEQ ID NO: 4138554 - RNA, 16 nt, Yersinia pestis
uauucaguaacaacau

SEQ ID NO: 4138555 - RNA, 20 nt, Yersinia pestis
uauucauaaaucaguacuau

SEQ ID NO: 4138556 - RNA, 11 nt, Yersinia pestis
uauucauaagu

SEQ ID NO: 4138557 - RNA, 12 nt, Yersinia pestis
uauucauauuuc

SEQ ID NO: 4138558 - RNA, 14 nt, Yersinia pestis
uauucauauuucuu

SEQ ID NO: 4138559 - RNA, 15 nt, Yersinia pestis
uauucauauuucuuu

SEQ ID NO: 4138560 - RNA, 13 nt, Yersinia pestis
uauucauuaaaaa

SEQ ID NO: 4138561 - RNA, 18 nt, Yersinia pestis
uauuccacauacaaagca

SEQ ID NO: 4138562 - RNA, 18 nt, Yersinia pestis
uauuccccaccauugcaa

SEQ ID NO: 4138563 - RNA, 17 nt, Yersinia pestis
uauuccgcaccuuuguc

SEQ ID NO: 4138564 - RNA, 12 nt, Yersinia pestis
uauuccuaauua

SEQ ID NO: 4138565 - RNA, 15 nt, Yersinia pestis
uauuccucgcaggcu

SEQ ID NO: 4138566 - RNA, 14 nt, Yersinia pestis
uauuccucugccua

SEQ ID NO: 4138567 - RNA, 15 nt, Yersinia pestis
uauucgcguuucauu

SEQ ID NO: 4138568 - RNA, 17 nt, Yersinia pestis
uauucgguucaagaguu

SEQ ID NO: 4138569 - RNA, 23 nt, Yersinia pestis
uauucuaauugauauuauuuaua

SEQ ID NO: 4138570 - RNA, 15 nt, Yersinia pestis
uauucuauugaggac

SEQ ID NO: 4138571 - RNA, 16 nt, Yersinia pestis
uauucuccaacaacug

SEQ ID NO: 4138572 - RNA, 14 nt, Yersinia pestis
uauucugccuaucc

SEQ ID NO: 4138573 - RNA, 22 nt, Yersinia pestis
uauucugcuuccaggauauuca

SEQ ID NO: 4138574 - RNA, 16 nt, Yersinia pestis
uauucugcuuuuugcu

SEQ ID NO: 4138575 - RNA, 18 nt, Yersinia pestis
uauucuuaucaaucaaaa

SEQ ID NO: 4138576 - RNA, 21 nt, Yersinia pestis
uauucuuuauuuauuuuacug

SEQ ID NO: 4138577 - RNA, 13 nt, Yersinia pestis
uauugaacauuca

SEQ ID NO: 4138578 - RNA, 18 nt, Yersinia pestis
uauugaagacaaugccga

SEQ ID NO: 4138579 - RNA, 20 nt, Yersinia pestis
uauugaccaccuuauuggcc

SEQ ID NO: 4138580 - RNA, 22 nt, Yersinia pestis
uauugagcauauucaguaacaa

SEQ ID NO: 4138581 - RNA, 17 nt, Yersinia pestis
uauugagcgaugacaau

SEQ ID NO: 4138582 - RNA, 22 nt, Yersinia pestis
uauugagcguuauaacaaccuc

SEQ ID NO: 4138583 - RNA, 12 nt, Yersinia pestis
uauugauaaaac

SEQ ID NO: 4138584 - RNA, 16 nt, Yersinia pestis
uauugauaaaaccgcu

SEQ ID NO: 4138585 - RNA, 20 nt, Yersinia pestis
uauugauaaaaccgcuuauc

SEQ ID NO: 4138586 - RNA, 14 nt, Yersinia pestis
uauugauagccaca

SEQ ID NO: 4138587 - RNA, 19 nt, Yersinia pestis
uauugauagccacaucauu

SEQ ID NO: 4138588 - RNA, 15 nt, Yersinia pestis
uauugauccccgcuu

SEQ ID NO: 4138589 - RNA, 15 nt, Yersinia pestis
uauugcacugagaga

SEQ ID NO: 4138590 - RNA, 21 nt, Yersinia pestis
uauugccgaucgaugggugaa

SEQ ID NO: 4138591 - RNA, 17 nt, Yersinia pestis
uauugccgcagauaaau

SEQ ID NO: 4138592 - RNA, 22 nt, Yersinia pestis
uauugcgcaguaaauucaucac

SEQ ID NO: 4138593 - RNA, 20 nt, Yersinia pestis
uauugcguguagcgggagau

SEQ ID NO: 4138594 - RNA, 16 nt, Yersinia pestis
uauugcucagggccac

SEQ ID NO: 4138595 - RNA, 18 nt, Yersinia pestis
uauugcugaguaaauuaa

SEQ ID NO: 4138596 - RNA, 18 nt, Yersinia pestis
uauugcugugguugaucc

SEQ ID NO: 4138597 - RNA, 22 nt, Yersinia pestis
uauuggaaaaaucaguauuaua

SEQ ID NO: 4138598 - RNA, 19 nt, Yersinia pestis
uauuggccgacugacacaa

SEQ ID NO: 4138599 - RNA, 17 nt, Yersinia pestis
uauuggccgucagcaga

SEQ ID NO: 4138600 - RNA, 21 nt, Yersinia pestis
uauuggccgucagcagauaag

SEQ ID NO: 4138601 - RNA, 12 nt, Yersinia pestis
uauuggcgagca

SEQ ID NO: 4138602 - RNA, 24 nt, Yersinia pestis
uauuggcgaucgcaguaugcgaaa

SEQ ID NO: 4138603 - RNA, 22 nt, Yersinia pestis
uauuggcuaaaguguacuguua

SEQ ID NO: 4138604 - RNA, 17 nt, Yersinia pestis
uauuggucaauaaaauu

SEQ ID NO: 4138605 - RNA, 20 nt, Yersinia pestis
uauuggucauuuuucccuuc

SEQ ID NO: 4138606 - RNA, 14 nt, Yersinia pestis
uauuguaagucagc

SEQ ID NO: 4138607 - RNA, 15 nt, Yersinia pestis
uauuguauaaaacac

SEQ ID NO: 4138608 - RNA, 17 nt, Yersinia pestis
uauuguauauaccuguc

SEQ ID NO: 4138609 - RNA, 17 nt, Yersinia pestis
uauuguccaaaggaagg

SEQ ID NO: 4138610 - RNA, 19 nt, Yersinia pestis
uauugucuuuaauaaaauc

SEQ ID NO: 4138611 - RNA, 14 nt, Yersinia pestis
uauuguggcuacca

SEQ ID NO: 4138612 - RNA, 20 nt, Yersinia pestis
uauuguggggccuuuauuca

SEQ ID NO: 4138613 - RNA, 22 nt, Yersinia pestis
uauuguggggccuuuauucauu

SEQ ID NO: 4138614 - RNA, 20 nt, Yersinia pestis
uauugugucaauaccuuacu

SEQ ID NO: 4138615 - RNA, 17 nt, Yersinia pestis
uauuguucaaaaacgca

SEQ ID NO: 4138616 - RNA, 20 nt, Yersinia pestis
uauuguuucugauaucuaaa

SEQ ID NO: 4138617 - RNA, 18 nt, Yersinia pestis
uauuguuuuuacgugaua

SEQ ID NO: 4138618 - RNA, 13 nt, Yersinia pestis
uauuuaaauuaca

SEQ ID NO: 4138619 - RNA, 21 nt, Yersinia pestis
uauuuaaauuacagacaaauc

SEQ ID NO: 4138620 - RNA, 19 nt, Yersinia pestis
uauuuaaauuuuuauauaa

SEQ ID NO: 4138621 - RNA, 19 nt, Yersinia pestis
uauuuaaccgcccucuuga

SEQ ID NO: 4138622 - RNA, 16 nt, Yersinia pestis
uauuuaauuuaaauaa

SEQ ID NO: 4138623 - RNA, 20 nt, Yersinia pestis
uauuuaauuuaaauaaaaua

SEQ ID NO: 4138624 - RNA, 15 nt, Yersinia pestis
uauuuaccugcucaa

SEQ ID NO: 4138625 - RNA, 12 nt, Yersinia pestis
uauuuacgguga

SEQ ID NO: 4138626 - RNA, 16 nt, Yersinia pestis
uauuuagagcguccug

SEQ ID NO: 4138627 - RNA, 21 nt, Yersinia pestis
uauuuagccugccaauaucca

SEQ ID NO: 4138628 - RNA, 14 nt, Yersinia pestis
uauuuaggcuacag

SEQ ID NO: 4138629 - RNA, 16 nt, Yersinia pestis
uauuuauaaaaccacu

SEQ ID NO: 4138630 - RNA, 14 nt, Yersinia pestis
uauuuauaugauaa

SEQ ID NO: 4138631 - RNA, 19 nt, Yersinia pestis
uauuuauccugugauucag

SEQ ID NO: 4138632 - RNA, 22 nt, Yersinia pestis
uauuuauccugugauucagcca

SEQ ID NO: 4138633 - RNA, 17 nt, Yersinia pestis
uauuuaucgccaacaua

SEQ ID NO: 4138634 - RNA, 17 nt, Yersinia pestis
uauuuaucugcauuaaa

SEQ ID NO: 4138635 - RNA, 19 nt, Yersinia pestis
uauuuauggggauuuugcu

SEQ ID NO: 4138636 - RNA, 16 nt, Yersinia pestis
uauuuauuaaaacaca

SEQ ID NO: 4138637 - RNA, 16 nt, Yersinia pestis
uauuuauuaauucuuu

SEQ ID NO: 4138638 - RNA, 13 nt, Yersinia pestis
uauuuauuccaca

SEQ ID NO: 4138639 - RNA, 20 nt, Yersinia pestis
uauuuauuggucaauaaaau

SEQ ID NO: 4138640 - RNA, 13 nt, Yersinia pestis
uauuuauugugag

SEQ ID NO: 4138641 - RNA, 12 nt, Yersinia pestis
uauuuauuuccg

SEQ ID NO: 4138642 - RNA, 13 nt, Yersinia pestis
uauuuauuuccga

SEQ ID NO: 4138643 - RNA, 15 nt, Yersinia pestis
uauuuauuuuauaau

SEQ ID NO: 4138644 - RNA, 20 nt, Yersinia pestis
uauuuauuuuuaugguuuuu

SEQ ID NO: 4138645 - RNA, 15 nt, Yersinia pestis
uauuuauuuuuucuu

SEQ ID NO: 4138646 - RNA, 21 nt, Yersinia pestis
uauuucaaauaaguguuucaa

SEQ ID NO: 4138647 - RNA, 22 nt, Yersinia pestis
uauuucaagcuacaugugcauu

SEQ ID NO: 4138648 - RNA, 13 nt, Yersinia pestis
uauuucaauggga

SEQ ID NO: 4138649 - RNA, 22 nt, Yersinia pestis
uauuucacgcuaauuauuuuau

SEQ ID NO: 4138650 - RNA, 20 nt, Yersinia pestis
uauuucacguucaucaauac

SEQ ID NO: 4138651 - RNA, 14 nt, Yersinia pestis
uauuucagccaugg

SEQ ID NO: 4138652 - RNA, 20 nt, Yersinia pestis
ucaacgccauagcaaaucac

SEQ ID NO: 4138653 - RNA, 22 nt, Yersinia pestis
ucaacgcccagcuuuuuacgca

SEQ ID NO: 4138654 - RNA, 13 nt, Yersinia pestis
ucaacgcuucagu

SEQ ID NO: 4138655 - RNA, 14 nt, Yersinia pestis
ucaacggcaccaca

SEQ ID NO: 4138656 - RNA, 21 nt, Yersinia pestis
ucaacuauugcaucuuuaauu

SEQ ID NO: 4138657 - RNA, 14 nt, Yersinia pestis
ucaacucaaaacaa

SEQ ID NO: 4138658 - RNA, 13 nt, Yersinia pestis
ucaacucagggcu

SEQ ID NO: 4138659 - RNA, 12 nt, Yersinia pestis
ucaacucauuua

SEQ ID NO: 4138660 - RNA, 17 nt, Yersinia pestis
ucaacucugaugaaauc

SEQ ID NO: 4138661 - RNA, 18 nt, Yersinia pestis
ucaacugcucaacugcuc

SEQ ID NO: 4138662 - RNA, 19 nt, Yersinia pestis
ucaacugcucaacugcuca

SEQ ID NO: 4138663 - RNA, 12 nt, Yersinia pestis
ucaacuucaacg

SEQ ID NO: 4138664 - RNA, 15 nt, Yersinia pestis
ucaacuucaacgacu

SEQ ID NO: 4138665 - RNA, 22 nt, Yersinia pestis
ucaacuucacccuuggcuacca

SEQ ID NO: 4138666 - RNA, 21 nt, Yersinia pestis
ucaacuuuaauaugcaaaaaa

SEQ ID NO: 4138667 - RNA, 14 nt, Yersinia pestis
ucaagaaauuuaaa

SEQ ID NO: 4138668 - RNA, 19 nt, Yersinia pestis
ucaagaaccgaaauaucau

SEQ ID NO: 4138669 - RNA, 14 nt, Yersinia pestis
ucaagaauauaaua

SEQ ID NO: 4138670 - RNA, 15 nt, Yersinia pestis
ucaagacaacaaaca

SEQ ID NO: 4138671 - RNA, 22 nt, Yersinia pestis
ucaagacucaguaaauauaauu

SEQ ID NO: 4138672 - RNA, 22 nt, Yersinia pestis
ucaagagggcgguuaaauacag

SEQ ID NO: 4138673 - RNA, 13 nt, Yersinia pestis
ucaagauaaaguu

SEQ ID NO: 4138674 - RNA, 18 nt, Yersinia pestis
ucaagauagcugucagcg

SEQ ID NO: 4138675 - RNA, 16 nt, Yersinia pestis
ucaagaucaaaagcag

SEQ ID NO: 4138676 - RNA, 19 nt, Yersinia pestis
ucaagaucaaaagcagaga

SEQ ID NO: 4138677 - RNA, 15 nt, Yersinia pestis
ucaagaucgcgucau

SEQ ID NO: 4138678 - RNA, 15 nt, Yersinia pestis
ucaagaugcagggcg

SEQ ID NO: 4138679 - RNA, 12 nt, Yersinia pestis
ucaagaugcaua

SEQ ID NO: 4138680 - RNA, 13 nt, Yersinia pestis
ucaagcaauaauu

SEQ ID NO: 4138681 - RNA, 19 nt, Yersinia pestis
ucaagcaccucaagaaauu

SEQ ID NO: 4138682 - RNA, 16 nt, Yersinia pestis
ucaagccaacccccau

SEQ ID NO: 4138683 - RNA, 15 nt, Yersinia pestis
ucaagccaccgcugg

SEQ ID NO: 4138684 - RNA, 18 nt, Yersinia pestis
ucaagccgauaaucccug

SEQ ID NO: 4138685 - RNA, 15 nt, Yersinia pestis
ucaagccguguaaau

SEQ ID NO: 4138686 - RNA, 16 nt, Yersinia pestis
ucaagccuaaucggua

SEQ ID NO: 4138687 - RNA, 15 nt, Yersinia pestis
ucaagcguacaucag

SEQ ID NO: 4138688 - RNA, 21 nt, Yersinia pestis
ucaagcuucucccuuuccagc

SEQ ID NO: 4138689 - RNA, 16 nt, Yersinia pestis
ucaaggcuuuaauauc

SEQ ID NO: 4138690 - RNA, 14 nt, Yersinia pestis
ucaagucccucccu

SEQ ID NO: 4138691 - RNA, 16 nt, Yersinia pestis
ucaaguccugcuucaa

SEQ ID NO: 4138692 - RNA, 18 nt, Yersinia pestis
ucaagugcucacucggua

SEQ ID NO: 4138693 - RNA, 21 nt, Yersinia pestis
ucaaguggucuaucauuuacg

SEQ ID NO: 4138694 - RNA, 20 nt, Yersinia pestis
ucaaguuagcaggcagcacg

SEQ ID NO: 4138695 - RNA, 16 nt, Yersinia pestis
ucaauaaaacucacuu

SEQ ID NO: 4138696 - RNA, 17 nt, Yersinia pestis
ucaauaaaacucacuug

SEQ ID NO: 4138697 - RNA, 20 nt, Yersinia pestis
ucaauaaacauugaucaggu

SEQ ID NO: 4138698 - RNA, 14 nt, Yersinia pestis
ucaauaaacgcuuu

SEQ ID NO: 4138699 - RNA, 17 nt, Yersinia pestis
ucaauaaacucuuucau

SEQ ID NO: 4138700 - RNA, 19 nt, Yersinia pestis
ucaauaaagccauuucagu

SEQ ID NO: 4138701 - RNA, 19 nt, Yersinia pestis
ucaauaaauccaucaauag

SEQ ID NO: 4138702 - RNA, 17 nt, Yersinia pestis
ucaauaacauuaccacc

SEQ ID NO: 4138703 - RNA, 12 nt, Yersinia pestis
ucaauaaccuca

SEQ ID NO: 4138704 - RNA, 19 nt, Yersinia pestis
ucaauaaccucaaaaggau

SEQ ID NO: 4138705 - RNA, 20 nt, Yersinia pestis
ucaauaaccucacacgauuu

SEQ ID NO: 4138706 - RNA, 13 nt, Yersinia pestis
ucaauaaccucag

SEQ ID NO: 4138707 - RNA, 16 nt, Yersinia pestis
ucaauaaccucagccu

SEQ ID NO: 4138708 - RNA, 18 nt, Yersinia pestis
ucaauaaccucagccuca

SEQ ID NO: 4138709 - RNA, 19 nt, Yersinia pestis
ucaauaaccucagccucau

SEQ ID NO: 4138710 - RNA, 23 nt, Yersinia pestis
ucaauaaccucagccucauucau

SEQ ID NO: 4138711 - RNA, 16 nt, Yersinia pestis
ucaauaaccucagggc

SEQ ID NO: 4138712 - RNA, 20 nt, Yersinia pestis
ucaauaaccucaggggccaa

SEQ ID NO: 4138713 - RNA, 22 nt, Yersinia pestis
ucaauaacuauuuuugacuuua

SEQ ID NO: 4138714 - RNA, 19 nt, Yersinia pestis
ucaauaagugcaaacuuaa

SEQ ID NO: 4138715 - RNA, 15 nt, Yersinia pestis
ucaauaauaugggau

SEQ ID NO: 4138716 - RNA, 20 nt, Yersinia pestis
ucaauaauuuuuacgauauc

SEQ ID NO: 4138717 - RNA, 16 nt, Yersinia pestis
ucaauaccaaauuuac

SEQ ID NO: 4138718 - RNA, 21 nt, Yersinia pestis
ucaauacccugccaccuuggc

SEQ ID NO: 4138719 - RNA, 20 nt, Yersinia pestis
ucaauaccuuacugcaucaa

SEQ ID NO: 4138720 - RNA, 19 nt, Yersinia pestis
ucaauacuguuaucacuga

SEQ ID NO: 4138721 - RNA, 19 nt, Yersinia pestis
ucaauagcauaaauaucag

SEQ ID NO: 4138722 - RNA, 23 nt, Yersinia pestis
ucaauagcuaauaauuguucaua

SEQ ID NO: 4138723 - RNA, 18 nt, Yersinia pestis
ucaauaggguaauaccac

SEQ ID NO: 4138724 - RNA, 16 nt, Yersinia pestis
ucaauaggucaguggu

SEQ ID NO: 4138725 - RNA, 20 nt, Yersinia pestis
ucaauaggucagugguuuua

SEQ ID NO: 4138726 - RNA, 13 nt, Yersinia pestis
ucaauauaccuuu

SEQ ID NO: 4138727 - RNA, 14 nt, Yersinia pestis
ucaauaucaccagu

SEQ ID NO: 4138728 - RNA, 15 nt, Yersinia pestis
ucaauaucaccagug

SEQ ID NO: 4138729 - RNA, 23 nt, Yersinia pestis
ucaauaugaacuuguucaucugg

SEQ ID NO: 4138730 - RNA, 15 nt, Yersinia pestis
ucaaucacauccccu

SEQ ID NO: 4138731 - RNA, 19 nt, Yersinia pestis
ucaaucaccgaaucaccga

SEQ ID NO: 4138732 - RNA, 19 nt, Yersinia pestis
ucaaucacgacaagucaug

SEQ ID NO: 4138733 - RNA, 22 nt, Yersinia pestis
ucaaucagcugauaugaaaaau

SEQ ID NO: 4138734 - RNA, 17 nt, Yersinia pestis
ucaauccaaaugacacu

SEQ ID NO: 4138735 - RNA, 15 nt, Yersinia pestis
ucaaucgcuuucugu

SEQ ID NO: 4138736 - RNA, 20 nt, Yersinia pestis
ucaaucggaacucagacuuc

SEQ ID NO: 4138737 - RNA, 13 nt, Yersinia pestis
ucaaucgugcacc

SEQ ID NO: 4138738 - RNA, 15 nt, Yersinia pestis
ucaaucguuuuaauu

SEQ ID NO: 4138739 - RNA, 23 nt, Yersinia pestis
ucaaucguuuuaauuugccuuca

SEQ ID NO: 4138740 - RNA, 13 nt, Yersinia pestis
ucaaucucaucaa

SEQ ID NO: 4138741 - RNA, 14 nt, Yersinia pestis
ucaaucucaucaau

SEQ ID NO: 4138742 - RNA, 20 nt, Yersinia pestis
ucaaucucuucauggcgcuu

SEQ ID NO: 4138743 - RNA, 21 nt, Yersinia pestis
ucaaucucuugcggcgcaccc

SEQ ID NO: 4138744 - RNA, 16 nt, Yersinia pestis
ucaaugaaaaaaagaa

SEQ ID NO: 4138745 - RNA, 18 nt, Yersinia pestis
ucaaugacuccugaaaua

SEQ ID NO: 4138746 - RNA, 16 nt, Yersinia pestis
ucaaugauaaaauccu

SEQ ID NO: 4138747 - RNA, 17 nt, Yersinia pestis
ucaaugaugucaucuuc

SEQ ID NO: 4138748 - RNA, 15 nt, Yersinia pestis
ucaaugcagaugcca

SEQ ID NO: 4138749 - RNA, 22 nt, Yersinia pestis
ucaauguaagcaucuuuucaug

SEQ ID NO: 4138750 - RNA, 20 nt, Yersinia pestis
ucaauguauugcuccagagg

SEQ ID NO: 4138751 - RNA, 18 nt, Yersinia pestis
ucaauguuggcccaagau

SEQ ID NO: 4138752 - RNA, 18 nt, Yersinia pestis
ucaauuaaucaauuaauc

SEQ ID NO: 4138753 - RNA, 14 nt, Yersinia pestis
ucaauucucccauu

SEQ ID NO: 4138754 - RNA, 15 nt, Yersinia pestis
ucaauugagaauaac

SEQ ID NO: 4138755 - RNA, 20 nt, Yersinia pestis
ucaauuguaacucaaugcca

SEQ ID NO: 4138756 - RNA, 21 nt, Yersinia pestis
ucaauugugcaaaaucagcau

SEQ ID NO: 4138757 - RNA, 23 nt, Yersinia pestis
ucaauugugcaaaaucagcauaa

SEQ ID NO: 4138758 - RNA, 13 nt, Yersinia pestis
ucacaaaauaacu

SEQ ID NO: 4138759 - RNA, 21 nt, Yersinia pestis
ucacaaaauaauaauucugcu

SEQ ID NO: 4138760 - RNA, 19 nt, Yersinia pestis
ucacaacccccccgaccca

SEQ ID NO: 4138761 - RNA, 22 nt, Yersinia pestis
ucacaacuuucccagucauaaa

SEQ ID NO: 4138762 - RNA, 13 nt, Yersinia pestis
ucacaacuuuuau

SEQ ID NO: 4138763 - RNA, 17 nt, Yersinia pestis
ucacaacuuuuauuggc

SEQ ID NO: 4138764 - RNA, 21 nt, Yersinia pestis
ucacaagccacgccauucauu

SEQ ID NO: 4138765 - RNA, 21 nt, Yersinia pestis
ucacaauacagcaaauagguu

SEQ ID NO: 4138766 - RNA, 16 nt, Yersinia pestis
ucacaaucucuggcaa

SEQ ID NO: 4138767 - RNA, 21 nt, Yersinia pestis
ucacaaucucuggcaacggca

SEQ ID NO: 4138768 - RNA, 12 nt, Yersinia pestis
ucacaauuucac

SEQ ID NO: 4138769 - RNA, 16 nt, Yersinia pestis
ucacacagccagccuu

SEQ ID NO: 4138770 - RNA, 14 nt, Yersinia pestis
ucacaccaacacug

SEQ ID NO: 4138771 - RNA, 22 nt, Yersinia pestis
ucacaccagacagaauauccag

SEQ ID NO: 4138772 - RNA, 18 nt, Yersinia pestis
ucacaccgagauauuauu

SEQ ID NO: 4138773 - RNA, 20 nt, Yersinia pestis
ucacacgcccaggccauagc

SEQ ID NO: 4138774 - RNA, 12 nt, Yersinia pestis
ucacuauuucag

SEQ ID NO: 4138775 - RNA, 20 nt, Yersinia pestis
ucacuauuucaggcauauca

SEQ ID NO: 4138776 - RNA, 19 nt, Yersinia pestis
ucacucaagccaguaacua

SEQ ID NO: 4138777 - RNA, 23 nt, Yersinia pestis
ucacucaagccaguaacuacuau

SEQ ID NO: 4138778 - RNA, 13 nt, Yersinia pestis
ucacucauaauuu

SEQ ID NO: 4138779 - RNA, 16 nt, Yersinia pestis
ucacucgggauaugac

SEQ ID NO: 4138780 - RNA, 13 nt, Yersinia pestis
ucacugaauccca

SEQ ID NO: 4138781 - RNA, 17 nt, Yersinia pestis
ucacugaguugcuggaa

SEQ ID NO: 4138782 - RNA, 19 nt, Yersinia pestis
ucacugcuauuuaccccca

SEQ ID NO: 4138783 - RNA, 19 nt, Yersinia pestis
ucacugcuuuaucaccagu

SEQ ID NO: 4138784 - RNA, 21 nt, Yersinia pestis
ucacuggaguuaaaucccugu

SEQ ID NO: 4138785 - RNA, 22 nt, Yersinia pestis
ucacuggaguuaaaucccugug

SEQ ID NO: 4138786 - RNA, 14 nt, Yersinia pestis
ucacuggcaccauu

SEQ ID NO: 4138787 - RNA, 14 nt, Yersinia pestis
ucacuggcuuuauu

SEQ ID NO: 4138788 - RNA, 19 nt, Yersinia pestis
ucacuggugaguagcugug

SEQ ID NO: 4138789 - RNA, 23 nt, Yersinia pestis
ucacugucaaaaccaauagauuu

SEQ ID NO: 4138790 - RNA, 14 nt, Yersinia pestis
ucacugucuauuuu

SEQ ID NO: 4138791 - RNA, 19 nt, Yersinia pestis
ucacuguggcggccagugc

SEQ ID NO: 4138792 - RNA, 13 nt, Yersinia pestis
ucacuuaaauaac

SEQ ID NO: 4138793 - RNA, 14 nt, Yersinia pestis
ucacuuaaauaacu

SEQ ID NO: 4138794 - RNA, 20 nt, Yersinia pestis
ucacuuagugguucuggccc

SEQ ID NO: 4138795 - RNA, 16 nt, Yersinia pestis
ucacuuauucccacuu

SEQ ID NO: 4138796 - RNA, 21 nt, Yersinia pestis
ucacuucugcuguucagauga

SEQ ID NO: 4138797 - RNA, 18 nt, Yersinia pestis
ucacuuggguagcagccc

SEQ ID NO: 4138798 - RNA, 13 nt, Yersinia pestis
ucacuuucuuuug

SEQ ID NO: 4138799 - RNA, 11 nt, Yersinia pestis
ucagaaaacag

SEQ ID NO: 4138800 - RNA, 20 nt, Yersinia pestis
ucagaaaacagccaccagcc

SEQ ID NO: 4138801 - RNA, 17 nt, Yersinia pestis
ucagaaaacccccugcu

SEQ ID NO: 4138802 - RNA, 14 nt, Yersinia pestis
ucagaaacaucuuc

SEQ ID NO: 4138803 - RNA, 16 nt, Yersinia pestis
ucagaaacaucuucau

SEQ ID NO: 4138804 - RNA, 17 nt, Yersinia pestis
ucagaaacggugaaaau

SEQ ID NO: 4138805 - RNA, 20 nt, Yersinia pestis
ucagaaccuguuacaucaga

SEQ ID NO: 4138806 - RNA, 23 nt, Yersinia pestis
ucagaaccuguuacaucagagcu

SEQ ID NO: 4138807 - RNA, 22 nt, Yersinia pestis
ucagaaugaaguucaccagcuu

SEQ ID NO: 4138808 - RNA, 14 nt, Yersinia pestis
ucagacaacgcuug

SEQ ID NO: 4138809 - RNA, 15 nt, Yersinia pestis
ucagacagcacgggc

SEQ ID NO: 4138810 - RNA, 21 nt, Yersinia pestis
ucagaccaaauagcaagccaa

SEQ ID NO: 4138811 - RNA, 16 nt, Yersinia pestis
ucagacccuaauauca

SEQ ID NO: 4138812 - RNA, 15 nt, Yersinia pestis
ucagaccuuuaggaa

SEQ ID NO: 4138813 - RNA, 22 nt, Yersinia pestis
ucagacgagucuauugaaaaaa

SEQ ID NO: 4138814 - RNA, 18 nt, Yersinia pestis
ucagacggaauaccaccc

SEQ ID NO: 4138815 - RNA, 17 nt, Yersinia pestis
ucagacugaaaguagaa

SEQ ID NO: 4138816 - RNA, 19 nt, Yersinia pestis
ucagacugcucuuucccuu

SEQ ID NO: 4138817 - RNA, 15 nt, Yersinia pestis
ucagacugcugacaa

SEQ ID NO: 4138818 - RNA, 21 nt, Yersinia pestis
ucagacugcugacaacccuca

SEQ ID NO: 4138819 - RNA, 20 nt, Yersinia pestis
ucagagauucagaggaaaga

SEQ ID NO: 4138820 - RNA, 23 nt, Yersinia pestis
ucagaggaaagagagccauaauu

SEQ ID NO: 4138821 - RNA, 22 nt, Yersinia pestis
ucagauaaaaaaggguaaucag

SEQ ID NO: 4138822 - RNA, 21 nt, Yersinia pestis
ucagauaaaaauaaucaauga

SEQ ID NO: 4138823 - RNA, 20 nt, Yersinia pestis
ucagauaaauucaacuucuc

SEQ ID NO: 4138824 - RNA, 16 nt, Yersinia pestis
ucagauacggcuccag

SEQ ID NO: 4138825 - RNA, 18 nt, Yersinia pestis
ucagauaucugcucauua

SEQ ID NO: 4138826 - RNA, 16 nt, Yersinia pestis
ucagaugaaaaacugu

SEQ ID NO: 4138827 - RNA, 17 nt, Yersinia pestis
ucagaugccgcuuuagu

SEQ ID NO: 4138828 - RNA, 19 nt, Yersinia pestis
ucagauuagucuuagacgu

SEQ ID NO: 4138829 - RNA, 12 nt, Yersinia pestis
ucagauugucag

SEQ ID NO: 4138830 - RNA, 17 nt, Yersinia pestis
ucagauugucagacacg

SEQ ID NO: 4138831 - RNA, 19 nt, Yersinia pestis
ucagauuguuuauaaauua

SEQ ID NO: 4138832 - RNA, 21 nt, Yersinia pestis
ucagauuguuuauaaauuaaa

SEQ ID NO: 4138833 - RNA, 22 nt, Yersinia pestis
ucagauuguuuauaaauuaaaa

SEQ ID NO: 4138834 - RNA, 20 nt, Yersinia pestis
ucagauuuagcgauauaacu

SEQ ID NO: 4138835 - RNA, 22 nt, Yersinia pestis
ucagauuuagcgauauaacuca

SEQ ID NO: 4138836 - RNA, 16 nt, Yersinia pestis
ucagcaaaguauuuau

SEQ ID NO: 4138837 - RNA, 22 nt, Yersinia pestis
ucagcaaaucuugugaugcaua

SEQ ID NO: 4138838 - RNA, 23 nt, Yersinia pestis
ucagcaaaucuugugaugcauau

SEQ ID NO: 4138839 - RNA, 22 nt, Yersinia pestis
ucagcaaauuuugcaggaguug

SEQ ID NO: 4138840 - RNA, 19 nt, Yersinia pestis
ucagcaacgcgaugcauua

SEQ ID NO: 4138841 - RNA, 22 nt, Yersinia pestis
ucagcaacgguuucaacuucaa

SEQ ID NO: 4138842 - RNA, 14 nt, Yersinia pestis
ucagcaacuuggua

SEQ ID NO: 4138843 - RNA, 13 nt, Yersinia pestis
ucagcaauaugaa

SEQ ID NO: 4138844 - RNA, 13 nt, Yersinia pestis
ucagcaauuuuua

SEQ ID NO: 4138845 - RNA, 12 nt, Yersinia pestis
ucagcaccuauc

SEQ ID NO: 4138846 - RNA, 21 nt, Yersinia pestis
ucagcagacgaaccgcuuuga

SEQ ID NO: 4138847 - RNA, 17 nt, Yersinia pestis
ucagcagacucaagcau

SEQ ID NO: 4138848 - RNA, 20 nt, Yersinia pestis
ucagcagagucgcaaaaaau

SEQ ID NO: 4138849 - RNA, 17 nt, Yersinia pestis
ucagcagcgcgcuacuc

SEQ ID NO: 4138850 - RNA, 16 nt, Yersinia pestis
ucagcaggggcaaccu

SEQ ID NO: 4138851 - RNA, 11 nt, Yersinia pestis
ucagcagucug

SEQ ID NO: 4138852 - RNA, 12 nt, Yersinia pestis
ucagcagucuga

SEQ ID NO: 4138853 - RNA, 19 nt, Yersinia pestis
ucagcagucugaggcccgc

SEQ ID NO: 4138854 - RNA, 22 nt, Yersinia pestis
ucagcagucugaggcccgcuag

SEQ ID NO: 4138855 - RNA, 18 nt, Yersinia pestis
ucagcagucugaggggcg

SEQ ID NO: 4138856 - RNA, 20 nt, Yersinia pestis
ucagcagucugauuaccuuc

SEQ ID NO: 4138857 - RNA, 20 nt, Yersinia pestis
ucagcauaucccuguuuucu

SEQ ID NO: 4138858 - RNA, 14 nt, Yersinia pestis
ucagcaucccagcc

SEQ ID NO: 4138859 - RNA, 14 nt, Yersinia pestis
ucagcaucuucaau

SEQ ID NO: 4138860 - RNA, 13 nt, Yersinia pestis
ucagcauuaauac

SEQ ID NO: 4138861 - RNA, 18 nt, Yersinia pestis
ucagccacaaaaguucac

SEQ ID NO: 4138862 - RNA, 19 nt, Yersinia pestis
ucagccacaucaaaaccgg

SEQ ID NO: 4138863 - RNA, 13 nt, Yersinia pestis
ucagccaccagau

SEQ ID NO: 4138864 - RNA, 15 nt, Yersinia pestis
ucagccaccauuggc

SEQ ID NO: 4138865 - RNA, 23 nt, Yersinia pestis
ucagccacuuguagguuaaauuc

SEQ ID NO: 4138866 - RNA, 15 nt, Yersinia pestis
ucagccaucucuggc

SEQ ID NO: 4138867 - RNA, 14 nt, Yersinia pestis
ucagccaugggcug

SEQ ID NO: 4138868 - RNA, 17 nt, Yersinia pestis
ucagcccaucuuugauu

SEQ ID NO: 4138869 - RNA, 15 nt, Yersinia pestis
ucagcccauggcuga

SEQ ID NO: 4138870 - RNA, 19 nt, Yersinia pestis
ucagcccccucaauaccgg

SEQ ID NO: 4138871 - RNA, 22 nt, Yersinia pestis
ucagccccuuugaacugcaccc

SEQ ID NO: 4138872 - RNA, 17 nt, Yersinia pestis
ucagcccgauccccugc

SEQ ID NO: 4138873 - RNA, 17 nt, Yersinia pestis
ucagcccuaccaguucu

SEQ ID NO: 4138874 - RNA, 16 nt, Yersinia pestis
ucagccgcgaaaaacc

SEQ ID NO: 4138875 - RNA, 23 nt, Yersinia pestis
ucagccguaucuucugccagccc

SEQ ID NO: 4138876 - RNA, 16 nt, Yersinia pestis
ucagccucauucauga

SEQ ID NO: 4138877 - RNA, 21 nt, Yersinia pestis
ucagccucuaaaggguaggua

SEQ ID NO: 4138878 - RNA, 13 nt, Yersinia pestis
ucagccuucaggg

SEQ ID NO: 4138879 - RNA, 12 nt, Yersinia pestis
ucagccuuuuuu

SEQ ID NO: 4138880 - RNA, 15 nt, Yersinia pestis
ucagcgcccuugcca

SEQ ID NO: 4138881 - RNA, 14 nt, Yersinia pestis
ucagcgcuuggcuc

SEQ ID NO: 4138882 - RNA, 20 nt, Yersinia pestis
ucagcgcuuggcucuggagc

SEQ ID NO: 4138883 - RNA, 21 nt, Yersinia pestis
ucagcgcuuggcucuggagcu

SEQ ID NO: 4138884 - RNA, 23 nt, Yersinia pestis
ucagcgcuuuuucgggaaaaaau

SEQ ID NO: 4138885 - RNA, 23 nt, Yersinia pestis
ucagcggagcugacgucagaucg

SEQ ID NO: 4138886 - RNA, 18 nt, Yersinia pestis
ucagcgguggcgggaaca

SEQ ID NO: 4138887 - RNA, 18 nt, Yersinia pestis
ucagcguggaauuaauau

SEQ ID NO: 4138888 - RNA, 20 nt, Yersinia pestis
ucagcguuggaugaguuuga

SEQ ID NO: 4138889 - RNA, 21 nt, Yersinia pestis
ucagcguuuuaaucacaucuc

SEQ ID NO: 4138890 - RNA, 20 nt, Yersinia pestis
ucagcguuuugaucaucaaa

SEQ ID NO: 4138891 - RNA, 15 nt, Yersinia pestis
ucagcucaccaccuc

SEQ ID NO: 4138892 - RNA, 20 nt, Yersinia pestis
ucagcucauuaaacuguucu

SEQ ID NO: 4138893 - RNA, 17 nt, Yersinia pestis
ucagcucuucaauuucc

SEQ ID NO: 4138894 - RNA, 17 nt, Yersinia pestis
ucagcuucaggccaagc

SEQ ID NO: 4138895 - RNA, 21 nt, Yersinia pestis
ucauccaacuuaccuugaucc

SEQ ID NO: 4138896 - RNA, 23 nt, Yersinia pestis
ucauccaacuuaccuugauccgc

SEQ ID NO: 4138897 - RNA, 13 nt, Yersinia pestis
ucauccagcucaa

SEQ ID NO: 4138898 - RNA, 21 nt, Yersinia pestis
ucauccaggguuuugaaauca

SEQ ID NO: 4138899 - RNA, 19 nt, Yersinia pestis
ucauccaguuuggcugcca

SEQ ID NO: 4138900 - RNA, 14 nt, Yersinia pestis
ucaucccaagagaa

SEQ ID NO: 4138901 - RNA, 18 nt, Yersinia pestis
ucaucccaagagaacgga

SEQ ID NO: 4138902 - RNA, 18 nt, Yersinia pestis
ucaucccaaucaucaucc

SEQ ID NO: 4138903 - RNA, 23 nt, Yersinia pestis
ucaucccuaaaaucauugacguu

SEQ ID NO: 4138904 - RNA, 15 nt, Yersinia pestis
ucauccgcuccagcc

SEQ ID NO: 4138905 - RNA, 14 nt, Yersinia pestis
ucauccguaaaaaa

SEQ ID NO: 4138906 - RNA, 19 nt, Yersinia pestis
ucauccugcuauuuaacaa

SEQ ID NO: 4138907 - RNA, 14 nt, Yersinia pestis
ucaucgaaauuccc

SEQ ID NO: 4138908 - RNA, 23 nt, Yersinia pestis
ucaucgauugcuggcgcugauca

SEQ ID NO: 4138909 - RNA, 22 nt, Yersinia pestis
ucaucgcaccauaaccaaucca

SEQ ID NO: 4138910 - RNA, 20 nt, Yersinia pestis
ucaucgccaaagccgucagu

SEQ ID NO: 4138911 - RNA, 21 nt, Yersinia pestis
ucaucgccgcaaauuaacaca

SEQ ID NO: 4138912 - RNA, 19 nt, Yersinia pestis
ucaucgcggcgcacaucau

SEQ ID NO: 4138913 - RNA, 19 nt, Yersinia pestis
ucaucgcggguuuuuaacu

SEQ ID NO: 4138914 - RNA, 20 nt, Yersinia pestis
ucaucgcuaacccucaguaa

SEQ ID NO: 4138915 - RNA, 17 nt, Yersinia pestis
ucaucgcucaucgccaa

SEQ ID NO: 4138916 - RNA, 20 nt, Yersinia pestis
ucaucgcugagggccaugcc

SEQ ID NO: 4138917 - RNA, 17 nt, Yersinia pestis
ucaucgcuugaucacga

SEQ ID NO: 4138918 - RNA, 21 nt, Yersinia pestis
ucaucgggguuugucagcagu

SEQ ID NO: 4138919 - RNA, 19 nt, Yersinia pestis
ucaucgggguuugucagcc

SEQ ID NO: 4138920 - RNA, 21 nt, Yersinia pestis
ucaucgucggcccggccaggc

SEQ ID NO: 4138921 - RNA, 17 nt, Yersinia pestis
ucaucuacaacaucauc

SEQ ID NO: 4138922 - RNA, 22 nt, Yersinia pestis
ucaucuacaacaucaucgucaa

SEQ ID NO: 4138923 - RNA, 21 nt, Yersinia pestis
ucaucucaauaacuauuuuug

SEQ ID NO: 4138924 - RNA, 22 nt, Yersinia pestis
ucaucucacgguagugacucau

SEQ ID NO: 4138925 - RNA, 16 nt, Yersinia pestis
ucaucugaccaaacau

SEQ ID NO: 4138926 - RNA, 23 nt, Yersinia pestis
ucaucugcgggcuaacaucaaug

SEQ ID NO: 4138927 - RNA, 18 nt, Yersinia pestis
ucaucuggugagaacacg

SEQ ID NO: 4138928 - RNA, 12 nt, Yersinia pestis
ucaucuucuuca

SEQ ID NO: 4138929 - RNA, 13 nt, Yersinia pestis
ucaucuucuucau

SEQ ID NO: 4138930 - RNA, 20 nt, Yersinia pestis
ucaucuugggcgggaucucc

SEQ ID NO: 4138931 - RNA, 16 nt, Yersinia pestis
ucaucuuuaacaacaa

SEQ ID NO: 4138932 - RNA, 15 nt, Yersinia pestis
ucaucuuuugcuauu

SEQ ID NO: 4138933 - RNA, 13 nt, Yersinia pestis
ucaucuuuuucug

SEQ ID NO: 4138934 - RNA, 18 nt, Yersinia pestis
ucaucuuuuucugccuga

SEQ ID NO: 4138935 - RNA, 14 nt, Yersinia pestis
ucaugaauaggaua

SEQ ID NO: 4138936 - RNA, 13 nt, Yersinia pestis
ucaugacaaagaa

SEQ ID NO: 4138937 - RNA, 14 nt, Yersinia pestis
ucaugacaaagaau

SEQ ID NO: 4138938 - RNA, 16 nt, Yersinia pestis
ucaugacaucccagca

SEQ ID NO: 4138939 - RNA, 23 nt, Yersinia pestis
ucaugacaucccagcacaaugca

SEQ ID NO: 4138940 - RNA, 23 nt, Yersinia pestis
ucaugacgaugaccucgcccuuu

SEQ ID NO: 4138941 - RNA, 13 nt, Yersinia pestis
ucaugagaaguuu

SEQ ID NO: 4138942 - RNA, 21 nt, Yersinia pestis
ucaugagaaguuuuuggcgaa

SEQ ID NO: 4138943 - RNA, 21 nt, Yersinia pestis
ucaugauaaaacuauucugcu

SEQ ID NO: 4138944 - RNA, 17 nt, Yersinia pestis
ucaugauagacagcaaa

SEQ ID NO: 4138945 - RNA, 15 nt, Yersinia pestis
ucaugaugaauacga

SEQ ID NO: 4138946 - RNA, 16 nt, Yersinia pestis
ucaugccggucugcug

SEQ ID NO: 4138947 - RNA, 18 nt, Yersinia pestis
ucaugccggucugcuggc

SEQ ID NO: 4138948 - RNA, 14 nt, Yersinia pestis
ucaugcgcagaaaa

SEQ ID NO: 4138949 - RNA, 18 nt, Yersinia pestis
ucaugcuaauaccacaac

SEQ ID NO: 4138950 - RNA, 20 nt, Yersinia pestis
ucaugcucugcuaauacgcu

SEQ ID NO: 4138951 - RNA, 17 nt, Yersinia pestis
ucaugcucuucauaagc

SEQ ID NO: 4138952 - RNA, 21 nt, Yersinia pestis
ucaugcucuucauaagccagu

SEQ ID NO: 4138953 - RNA, 18 nt, Yersinia pestis
ucaugcugaaucuguaag

SEQ ID NO: 4138954 - RNA, 18 nt, Yersinia pestis
ucaugcugcggguagcau

SEQ ID NO: 4138955 - RNA, 21 nt, Yersinia pestis
ucauggccugaugcaccucag

SEQ ID NO: 4138956 - RNA, 15 nt, Yersinia pestis
ucauguaaggcaaua

SEQ ID NO: 4138957 - RNA, 19 nt, Yersinia pestis
ucauguaaggcaauaccaa

SEQ ID NO: 4138958 - RNA, 15 nt, Yersinia pestis
ucaugucaugagguu

SEQ ID NO: 4138959 - RNA, 22 nt, Yersinia pestis
ucaugucaugagguugugcguu

SEQ ID NO: 4138960 - RNA, 13 nt, Yersinia pestis
ucauguugaccaa

SEQ ID NO: 4138961 - RNA, 17 nt, Yersinia pestis
ucauguuuaaacacuua

SEQ ID NO: 4138962 - RNA, 13 nt, Yersinia pestis
ucauuaaaaccac

SEQ ID NO: 4138963 - RNA, 19 nt, Yersinia pestis
ucauuaaaugcuuuuugcg

SEQ ID NO: 4138964 - RNA, 23 nt, Yersinia pestis
ucauuaagaauccucugaauaaa

SEQ ID NO: 4138965 - RNA, 20 nt, Yersinia pestis
ucauuaaggagugccaucau

SEQ ID NO: 4138966 - RNA, 18 nt, Yersinia pestis
ucauuaauagaaucugcu

SEQ ID NO: 4138967 - RNA, 16 nt, Yersinia pestis
ucauuaccgcacacua

SEQ ID NO: 4138968 - RNA, 23 nt, Yersinia pestis
ucauuacguaaucccagaaacgg

SEQ ID NO: 4138969 - RNA, 18 nt, Yersinia pestis
ucauuacucagcuuggua

SEQ ID NO: 4138970 - RNA, 11 nt, Yersinia pestis
ucauuaucaug

SEQ ID NO: 4138971 - RNA, 18 nt, Yersinia pestis
ucauuauggauaauuuaa

SEQ ID NO: 4138972 - RNA, 19 nt, Yersinia pestis
ucauuauggauaauuuaau

SEQ ID NO: 4138973 - RNA, 14 nt, Yersinia pestis
ucauuaugugucag

SEQ ID NO: 4138974 - RNA, 12 nt, Yersinia pestis
ucauuauuuuca

SEQ ID NO: 4138975 - RNA, 19 nt, Yersinia pestis
ucauucaauuguuccauau

SEQ ID NO: 4138976 - RNA, 17 nt, Yersinia pestis
ucauucauuuuaaaaaa

SEQ ID NO: 4138977 - RNA, 17 nt, Yersinia pestis
ucauuccccaucgccaa

SEQ ID NO: 4138978 - RNA, 21 nt, Yersinia pestis
ucauucccgauaauuauaaau

SEQ ID NO: 4138979 - RNA, 22 nt, Yersinia pestis
ucauucccgauaauuauaaauu

SEQ ID NO: 4138980 - RNA, 17 nt, Yersinia pestis
ucauuccgccuguuuuc

SEQ ID NO: 4138981 - RNA, 21 nt, Yersinia pestis
ucauucugaucgaguucagug

SEQ ID NO: 4138982 - RNA, 16 nt, Yersinia pestis
ucauucugucaucaag

SEQ ID NO: 4138983 - RNA, 23 nt, Yersinia pestis
ucauugaggagcgauaacauuuu

SEQ ID NO: 4138984 - RNA, 20 nt, Yersinia pestis
ucauugaggguugucagcag

SEQ ID NO: 4138985 - RNA, 21 nt, Yersinia pestis
ucauugaggguugucagcagu

SEQ ID NO: 4138986 - RNA, 21 nt, Yersinia pestis
ucauugauauuaacuggucua

SEQ ID NO: 4138987 - RNA, 22 nt, Yersinia pestis
ucauugccacgacgcagcucca

SEQ ID NO: 4138988 - RNA, 18 nt, Yersinia pestis
ucauugcucuggauagca

SEQ ID NO: 4138989 - RNA, 18 nt, Yersinia pestis
ucauugcugcuguuauua

SEQ ID NO: 4138990 - RNA, 14 nt, Yersinia pestis
ucauugguaauuuc

SEQ ID NO: 4138991 - RNA, 23 nt, Yersinia pestis
ucauuggugcugaugauuuuggu

SEQ ID NO: 4138992 - RNA, 22 nt, Yersinia pestis
ucauuguagauggccaucucaa

SEQ ID NO: 4138993 - RNA, 12 nt, Yersinia pestis
ucauuuaaaaua

SEQ ID NO: 4138994 - RNA, 16 nt, Yersinia pestis
ucauuuaauuaaauga

SEQ ID NO: 4138995 - RNA, 19 nt, Yersinia pestis
ucauuuaauuuauccaacu

SEQ ID NO: 4138996 - RNA, 15 nt, Yersinia pestis
ucauuuaucuaaaac

SEQ ID NO: 4138997 - RNA, 19 nt, Yersinia pestis
ucauuucaacuauuuggug

SEQ ID NO: 4138998 - RNA, 18 nt, Yersinia pestis
ucauuucccccaccugau

SEQ ID NO: 4138999 - RNA, 18 nt, Yersinia pestis
ucauuucccgugcacugc

SEQ ID NO: 4139000 - RNA, 21 nt, Yersinia pestis
ucauuucccgugcacugcgau

SEQ ID NO: 4139001 - RNA, 13 nt, Yersinia pestis
ucauuuuaaaaaa

SEQ ID NO: 4139002 - RNA, 22 nt, Yersinia pestis
ucauuuuaaaaaaauuaaaaua

SEQ ID NO: 4139003 - RNA, 15 nt, Yersinia pestis
ucauuuuaggugcag

SEQ ID NO: 4139004 - RNA, 19 nt, Yersinia pestis
ucauuuuccugcauauuau

SEQ ID NO: 4139005 - RNA, 14 nt, Yersinia pestis
ucauuuuuuaucuu

SEQ ID NO: 4139006 - RNA, 23 nt, Yersinia pestis
ucauuuuuugggaugaaaaauac

SEQ ID NO: 4139007 - RNA, 15 nt, Yersinia pestis
uccaaaaaacugcgg

SEQ ID NO: 4139008 - RNA, 22 nt, Yersinia pestis
uccaaaauaauauaauucaaua

SEQ ID NO: 4139009 - RNA, 15 nt, Yersinia pestis
uccaaacuuugugga

SEQ ID NO: 4139010 - RNA, 12 nt, Yersinia pestis
uccaaaggaagg

SEQ ID NO: 4139011 - RNA, 23 nt, Yersinia pestis
uccaaaggaagggguucuuccaa

SEQ ID NO: 4139012 - RNA, 14 nt, Yersinia pestis
uccaaaugaaaaau

SEQ ID NO: 4139013 - RNA, 18 nt, Yersinia pestis
uccaaaugaacuaucgcc

SEQ ID NO: 4139014 - RNA, 22 nt, Yersinia pestis
uccaaaugacagcaucaauauc

SEQ ID NO: 4139015 - RNA, 17 nt, Yersinia pestis
uccaaaugcccauuagu

SEQ ID NO: 4139016 - RNA, 14 nt, Yersinia pestis
ucccaaugaauauu

SEQ ID NO: 4139017 - RNA, 18 nt, Yersinia pestis
ucccacuuauuauaaagc

SEQ ID NO: 4139018 - RNA, 19 nt, Yersinia pestis
ucccagaauaauaagccgu

SEQ ID NO: 4139019 - RNA, 15 nt, Yersinia pestis
ucccagcacagccug

SEQ ID NO: 4139020 - RNA, 17 nt, Yersinia pestis
ucccagcagcaaacagu

SEQ ID NO: 4139021 - RNA, 11 nt, Yersinia pestis
ucccagccacu

SEQ ID NO: 4139022 - RNA, 18 nt, Yersinia pestis
ucccaggcguucuguagc

SEQ ID NO: 4139023 - RNA, 14 nt, Yersinia pestis
ucccaguaagcucu

SEQ ID NO: 4139024 - RNA, 16 nt, Yersinia pestis
ucccagucgucuucag

SEQ ID NO: 4139025 - RNA, 14 nt, Yersinia pestis
ucccaguuuuuaau

SEQ ID NO: 4139026 - RNA, 15 nt, Yersinia pestis
ucccaguuuuuaauu

SEQ ID NO: 4139027 - RNA, 17 nt, Yersinia pestis
ucccauagacggcgaac

SEQ ID NO: 4139028 - RNA, 22 nt, Yersinia pestis
ucccauagcuggcuucaaaauc

SEQ ID NO: 4139029 - RNA, 15 nt, Yersinia pestis
ucccauuaauuaauc

SEQ ID NO: 4139030 - RNA, 16 nt, Yersinia pestis
ucccauucaccguguu

SEQ ID NO: 4139031 - RNA, 14 nt, Yersinia pestis
ucccauuuauggca

SEQ ID NO: 4139032 - RNA, 13 nt, Yersinia pestis
ucccauuuauuac

SEQ ID NO: 4139033 - RNA, 23 nt, Yersinia pestis
uccccaaaucccgcuggaagucu

SEQ ID NO: 4139034 - RNA, 21 nt, Yersinia pestis
uccccaacucuuucaacuucc

SEQ ID NO: 4139035 - RNA, 17 nt, Yersinia pestis
uccccaauucacgcaag

SEQ ID NO: 4139036 - RNA, 20 nt, Yersinia pestis
uccccaccauugcaaacauc

SEQ ID NO: 4139037 - RNA, 15 nt, Yersinia pestis
uccccacucaaaauu

SEQ ID NO: 4139038 - RNA, 15 nt, Yersinia pestis
uccccagaacagcua

SEQ ID NO: 4139039 - RNA, 16 nt, Yersinia pestis
uccccagaugaauggu

SEQ ID NO: 4139040 - RNA, 20 nt, Yersinia pestis
ucccccaccaguaaacgcca

SEQ ID NO: 4139041 - RNA, 12 nt, Yersinia pestis
ucccccaccuga

SEQ ID NO: 4139042 - RNA, 23 nt, Yersinia pestis
ucccccauggggccaccuaaucc

SEQ ID NO: 4139043 - RNA, 20 nt, Yersinia pestis
uccccccccacuugaccuuc

SEQ ID NO: 4139044 - RNA, 19 nt, Yersinia pestis
ucccccggaucacuggcua

SEQ ID NO: 4139045 - RNA, 17 nt, Yersinia pestis
ucccccgguuaaugcca

SEQ ID NO: 4139046 - RNA, 20 nt, Yersinia pestis
ucccccuugauucacugauu

SEQ ID NO: 4139047 - RNA, 17 nt, Yersinia pestis
ucccccuuuggccgcuc

SEQ ID NO: 4139048 - RNA, 20 nt, Yersinia pestis
uccccggcaucccaccuuca

SEQ ID NO: 4139049 - RNA, 16 nt, Yersinia pestis
uccccuaauucuccuu

SEQ ID NO: 4139050 - RNA, 19 nt, Yersinia pestis
uccccuaauucuccuuucu

SEQ ID NO: 4139051 - RNA, 14 nt, Yersinia pestis
uccccucagagaca

SEQ ID NO: 4139052 - RNA, 22 nt, Yersinia pestis
uccccuucgauauuacaguuua

SEQ ID NO: 4139053 - RNA, 18 nt, Yersinia pestis
uccccuuugacagcaucu

SEQ ID NO: 4139054 - RNA, 21 nt, Yersinia pestis
ucccgauaauuauaaauuccu

SEQ ID NO: 4139055 - RNA, 18 nt, Yersinia pestis
ucccgauacucauugcac

SEQ ID NO: 4139056 - RNA, 18 nt, Yersinia pestis
ucccgauauaaauaaaau

SEQ ID NO: 4139057 - RNA, 17 nt, Yersinia pestis
ucccgaugauugcauca

SEQ ID NO: 4139058 - RNA, 23 nt, Yersinia pestis
ucccgauuauugugccgccuucu

SEQ ID NO: 4139059 - RNA, 14 nt, Yersinia pestis
ucccgcaaagccug

SEQ ID NO: 4139060 - RNA, 16 nt, Yersinia pestis
ucccgcaaagccugcc

SEQ ID NO: 4139061 - RNA, 16 nt, Yersinia pestis
ucccgcguuaccguaa

SEQ ID NO: 4139062 - RNA, 13 nt, Yersinia pestis
ucccgcuggaagu

SEQ ID NO: 4139063 - RNA, 19 nt, Yersinia pestis
ucccgcuggaagucugcuu

SEQ ID NO: 4139064 - RNA, 16 nt, Yersinia pestis
ucccgguugcgauaca

SEQ ID NO: 4139065 - RNA, 17 nt, Yersinia pestis
ucccguagcaaauaacc

SEQ ID NO: 4139066 - RNA, 14 nt, Yersinia pestis
ucccguauagauua

SEQ ID NO: 4139067 - RNA, 18 nt, Yersinia pestis
ucccgugccagauccucu

SEQ ID NO: 4139068 - RNA, 20 nt, Yersinia pestis
ucccgugccagauccucuuu

SEQ ID NO: 4139069 - RNA, 23 nt, Yersinia pestis
ucccgugugauuuccaucuagcu

SEQ ID NO: 4139070 - RNA, 22 nt, Yersinia pestis
ucccguuuuauuacugauacca

SEQ ID NO: 4139071 - RNA, 14 nt, Yersinia pestis
ucccuaaaaucauu

SEQ ID NO: 4139072 - RNA, 18 nt, Yersinia pestis
ucccucaauagcuaauaa

SEQ ID NO: 4139073 - RNA, 20 nt, Yersinia pestis
ucccucaauagcuaauaauu

SEQ ID NO: 4139074 - RNA, 17 nt, Yersinia pestis
ucccuccgccagcaagu

SEQ ID NO: 4139075 - RNA, 18 nt, Yersinia pestis
ucccugauggggcaauca

SEQ ID NO: 4139076 - RNA, 15 nt, Yersinia pestis
ucccugcauaaaaau

SEQ ID NO: 4139077 - RNA, 14 nt, Yersinia pestis
ucccugcgccagca

SEQ ID NO: 4139078 - RNA, 19 nt, Yersinia pestis
ucccuucaaucaaugaacc

SEQ ID NO: 4139079 - RNA, 14 nt, Yersinia pestis
ucccuucugaaacu

SEQ ID NO: 4139080 - RNA, 19 nt, Yersinia pestis
ucccuugacugaccauaaa

SEQ ID NO: 4139081 - RNA, 16 nt, Yersinia pestis
ucccuuguugccuuuc

SEQ ID NO: 4139082 - RNA, 15 nt, Yersinia pestis
ucccuuucucaguga

SEQ ID NO: 4139083 - RNA, 14 nt, Yersinia pestis
ucccuuuuccauca

SEQ ID NO: 4139084 - RNA, 16 nt, Yersinia pestis
uccgaaaaauauucuc

SEQ ID NO: 4139085 - RNA, 22 nt, Yersinia pestis
uccgaauuaucauauucaucaa

SEQ ID NO: 4139086 - RNA, 18 nt, Yersinia pestis
uccgauaaacuucacaau

SEQ ID NO: 4139087 - RNA, 15 nt, Yersinia pestis
uccgcaacauagccc

SEQ ID NO: 4139088 - RNA, 13 nt, Yersinia pestis
uccgcaccauucg

SEQ ID NO: 4139089 - RNA, 17 nt, Yersinia pestis
uccgcaccuuugucauu

SEQ ID NO: 4139090 - RNA, 21 nt, Yersinia pestis
uccgcagcuaauguuggcaac

SEQ ID NO: 4139091 - RNA, 13 nt, Yersinia pestis
uccgcaggaagca

SEQ ID NO: 4139092 - RNA, 17 nt, Yersinia pestis
uccgcauucgccaucgg

SEQ ID NO: 4139093 - RNA, 17 nt, Yersinia pestis
uccgccaaggccagcgc

SEQ ID NO: 4139094 - RNA, 24 nt, Yersinia pestis
uccgccagcaaguuaucaaucaga

SEQ ID NO: 4139095 - RNA, 17 nt, Yersinia pestis
uccgccgccaacaguga

SEQ ID NO: 4139096 - RNA, 19 nt, Yersinia pestis
uccgcgaauuccaaccaga

SEQ ID NO: 4139097 - RNA, 20 nt, Yersinia pestis
uccgcgaugacacaauuccc

SEQ ID NO: 4139098 - RNA, 14 nt, Yersinia pestis
uccgcgccagggag

SEQ ID NO: 4139099 - RNA, 17 nt, Yersinia pestis
uccgcuggcauacugac

SEQ ID NO: 4139100 - RNA, 19 nt, Yersinia pestis
uccgcuuagcaggcccuuu

SEQ ID NO: 4139101 - RNA, 22 nt, Yersinia pestis
uccgcuuagcaggcccuuucac

SEQ ID NO: 4139102 - RNA, 16 nt, Yersinia pestis
uccggaaucagcguuu

SEQ ID NO: 4139103 - RNA, 15 nt, Yersinia pestis
uccggacuucauaaa

SEQ ID NO: 4139104 - RNA, 22 nt, Yersinia pestis
uccggcgauaaaauacgcggcg

SEQ ID NO: 4139105 - RNA, 13 nt, Yersinia pestis
uccgggacgcgcc

SEQ ID NO: 4139106 - RNA, 20 nt, Yersinia pestis
uccggguuuacccagccaag

SEQ ID NO: 4139107 - RNA, 22 nt, Yersinia pestis
uccggguuuacccagccaagac

SEQ ID NO: 4139108 - RNA, 20 nt, Yersinia pestis
uccgguaaagaagcauagaa

SEQ ID NO: 4139109 - RNA, 15 nt, Yersinia pestis
uccgguacugugcug

SEQ ID NO: 4139110 - RNA, 15 nt, Yersinia pestis
uccggucugaagaga

SEQ ID NO: 4139111 - RNA, 13 nt, Yersinia pestis
uccgguguauuug

SEQ ID NO: 4139112 - RNA, 17 nt, Yersinia pestis
uccgguugccagccagg

SEQ ID NO: 4139113 - RNA, 16 nt, Yersinia pestis
uccgguuguucuacua

SEQ ID NO: 4139114 - RNA, 13 nt, Yersinia pestis
uccguaaaaaacc

SEQ ID NO: 4139115 - RNA, 20 nt, Yersinia pestis
uccguaaaucauagccagcg

SEQ ID NO: 4139116 - RNA, 21 nt, Yersinia pestis
uccguacccgcucuaaguuaa

SEQ ID NO: 4139117 - RNA, 19 nt, Yersinia pestis
uccgucaucgaacccgcua

SEQ ID NO: 4139118 - RNA, 12 nt, Yersinia pestis
uccgucgccaac

SEQ ID NO: 4139119 - RNA, 20 nt, Yersinia pestis
uccgucgcgggcacuuuguc

SEQ ID NO: 4139120 - RNA, 16 nt, Yersinia pestis
uccgucuaccucgguu

SEQ ID NO: 4139121 - RNA, 16 nt, Yersinia pestis
uccgucuauccuauuc

SEQ ID NO: 4139122 - RNA, 23 nt, Yersinia pestis
uccgugcgccugaacagccuaac

SEQ ID NO: 4139123 - RNA, 18 nt, Yersinia pestis
uccgugcugguccuuuug

SEQ ID NO: 4139124 - RNA, 19 nt, Yersinia pestis
uccguguuggcaaaaauaa

SEQ ID NO: 4139125 - RNA, 12 nt, Yersinia pestis
uccguuaaccca

SEQ ID NO: 4139126 - RNA, 13 nt, Yersinia pestis
uccguuaucuuug

SEQ ID NO: 4139127 - RNA, 14 nt, Yersinia pestis
uccuaaagauaauu

SEQ ID NO: 4139128 - RNA, 17 nt, Yersinia pestis
uccuaaagauaauuaau

SEQ ID NO: 4139129 - RNA, 19 nt, Yersinia pestis
uccuaaugaacacuuaauu

SEQ ID NO: 4139130 - RNA, 12 nt, Yersinia pestis
uccuacaccauu

SEQ ID NO: 4139131 - RNA, 14 nt, Yersinia pestis
uccuacauucagua

SEQ ID NO: 4139132 - RNA, 19 nt, Yersinia pestis
uccuacccuuugagaaagg

SEQ ID NO: 4139133 - RNA, 21 nt, Yersinia pestis
uccuagcguuucuacaauggc

SEQ ID NO: 4139134 - RNA, 15 nt, Yersinia pestis
uccuauaaauuuuaa

SEQ ID NO: 4139135 - RNA, 19 nt, Yersinia pestis
uccuauagcucagaaaaua

SEQ ID NO: 4139136 - RNA, 16 nt, Yersinia pestis
uccuaugugauauuuu

SEQ ID NO: 4139137 - RNA, 20 nt, Yersinia pestis
uccuaugugauauuuuacug

SEQ ID NO: 4139138 - RNA, 16 nt, Yersinia pestis
ucgcacugaguucugc

SEQ ID NO: 4139139 - RNA, 15 nt, Yersinia pestis
ucgcacugcucugcc

SEQ ID NO: 4139140 - RNA, 22 nt, Yersinia pestis
ucgcacugugagcggcauccag

SEQ ID NO: 4139141 - RNA, 17 nt, Yersinia pestis
ucgcagaacccagggcg

SEQ ID NO: 4139142 - RNA, 21 nt, Yersinia pestis
ucgcagacagauuuggccacg

SEQ ID NO: 4139143 - RNA, 19 nt, Yersinia pestis
ucgcagccaaaauaaucac

SEQ ID NO: 4139144 - RNA, 18 nt, Yersinia pestis
ucgcaguaauagaaaaag

SEQ ID NO: 4139145 - RNA, 16 nt, Yersinia pestis
ucgcaguuaaagacau

SEQ ID NO: 4139146 - RNA, 18 nt, Yersinia pestis
ucgcauaaauguuaccca

SEQ ID NO: 4139147 - RNA, 17 nt, Yersinia pestis
ucgcaucaggucgucua

SEQ ID NO: 4139148 - RNA, 17 nt, Yersinia pestis
ucgccaaacugcucaua

SEQ ID NO: 4139149 - RNA, 22 nt, Yersinia pestis
ucgccaacacguggguauccag

SEQ ID NO: 4139150 - RNA, 22 nt, Yersinia pestis
ucgccaacauaaguaauaagua

SEQ ID NO: 4139151 - RNA, 19 nt, Yersinia pestis
ucgccaauacaaucgucaa

SEQ ID NO: 4139152 - RNA, 15 nt, Yersinia pestis
ucgccacgcugauac

SEQ ID NO: 4139153 - RNA, 17 nt, Yersinia pestis
ucgccacggauaaggug

SEQ ID NO: 4139154 - RNA, 21 nt, Yersinia pestis
ucgccauagccgaucaccgca

SEQ ID NO: 4139155 - RNA, 21 nt, Yersinia pestis
ucgccauccgugcggaguuga

SEQ ID NO: 4139156 - RNA, 15 nt, Yersinia pestis
ucgccauuuccauca

SEQ ID NO: 4139157 - RNA, 15 nt, Yersinia pestis
ucgcccgucuggcag

SEQ ID NO: 4139158 - RNA, 15 nt, Yersinia pestis
ucgcccuguaacuuu

SEQ ID NO: 4139159 - RNA, 13 nt, Yersinia pestis
ucgccgaaaucuc

SEQ ID NO: 4139160 - RNA, 19 nt, Yersinia pestis
ucgccgacaacuucaauac

SEQ ID NO: 4139161 - RNA, 15 nt, Yersinia pestis
ucgccgcaaggcaaa

SEQ ID NO: 4139162 - RNA, 16 nt, Yersinia pestis
ucgccgccgccagccc

SEQ ID NO: 4139163 - RNA, 14 nt, Yersinia pestis
ucgccgccuccgau

SEQ ID NO: 4139164 - RNA, 16 nt, Yersinia pestis
ucgccgggucaggaag

SEQ ID NO: 4139165 - RNA, 14 nt, Yersinia pestis
ucgccguauuugua

SEQ ID NO: 4139166 - RNA, 16 nt, Yersinia pestis
ucgccgucaaacucuu

SEQ ID NO: 4139167 - RNA, 18 nt, Yersinia pestis
ucgccguucuccgucguc

SEQ ID NO: 4139168 - RNA, 21 nt, Yersinia pestis
ucgccuaaguuugacuggaau

SEQ ID NO: 4139169 - RNA, 20 nt, Yersinia pestis
ucgccuguaaaucuuguuua

SEQ ID NO: 4139170 - RNA, 22 nt, Yersinia pestis
ucgccuuaaaugcguagaguca

SEQ ID NO: 4139171 - RNA, 13 nt, Yersinia pestis
ucgccuugccgcu

SEQ ID NO: 4139172 - RNA, 16 nt, Yersinia pestis
ucgcgaccagcagaag

SEQ ID NO: 4139173 - RNA, 15 nt, Yersinia pestis
ucgcgacgaaaaccu

SEQ ID NO: 4139174 - RNA, 18 nt, Yersinia pestis
ucgcgccugaaaucauuu

SEQ ID NO: 4139175 - RNA, 16 nt, Yersinia pestis
ucgcgcugucuuucau

SEQ ID NO: 4139176 - RNA, 15 nt, Yersinia pestis
ucgcgggcacuuugu

SEQ ID NO: 4139177 - RNA, 20 nt, Yersinia pestis
ucgcgggcgcgcugcugcuc

SEQ ID NO: 4139178 - RNA, 21 nt, Yersinia pestis
ucgcgguauuuggcauucaua

SEQ ID NO: 4139179 - RNA, 12 nt, Yersinia pestis
ucgcguggcaga

SEQ ID NO: 4139180 - RNA, 16 nt, Yersinia pestis
ucgcuaucugugucag

SEQ ID NO: 4139181 - RNA, 22 nt, Yersinia pestis
ucgcuaucugugucaguaccug

SEQ ID NO: 4139182 - RNA, 19 nt, Yersinia pestis
ucgcuauuucucucuacuu

SEQ ID NO: 4139183 - RNA, 20 nt, Yersinia pestis
ucgcucaggcggucaccgaa

SEQ ID NO: 4139184 - RNA, 20 nt, Yersinia pestis
ucgcucccccggaucacugg

SEQ ID NO: 4139185 - RNA, 22 nt, Yersinia pestis
ucgcucgcauaaauguuaccca

SEQ ID NO: 4139186 - RNA, 18 nt, Yersinia pestis
ucgcucggcucgaaccug

SEQ ID NO: 4139187 - RNA, 12 nt, Yersinia pestis
ucgcucugcguu

SEQ ID NO: 4139188 - RNA, 13 nt, Yersinia pestis
ucgcugaaaugcu

SEQ ID NO: 4139189 - RNA, 21 nt, Yersinia pestis
ucgcugaacaauugccaggcc

SEQ ID NO: 4139190 - RNA, 22 nt, Yersinia pestis
ucgcugagacccgauuucacgc

SEQ ID NO: 4139191 - RNA, 21 nt, Yersinia pestis
ucgcugccaccgucgcagaac

SEQ ID NO: 4139192 - RNA, 20 nt, Yersinia pestis
ucgcuggacgcaucagaucg

SEQ ID NO: 4139193 - RNA, 21 nt, Yersinia pestis
ucgcugugaauuuaucaggcu

SEQ ID NO: 4139194 - RNA, 16 nt, Yersinia pestis
ucgcugugcccuuuuu

SEQ ID NO: 4139195 - RNA, 15 nt, Yersinia pestis
ucgcuguggcuacca

SEQ ID NO: 4139196 - RNA, 15 nt, Yersinia pestis
ucgcuucacggcacc

SEQ ID NO: 4139197 - RNA, 21 nt, Yersinia pestis
ucgcuuccaggacauccagcg

SEQ ID NO: 4139198 - RNA, 17 nt, Yersinia pestis
ucgcuuucagcagggcg

SEQ ID NO: 4139199 - RNA, 21 nt, Yersinia pestis
ucgcuuucaucuucuucuuua

SEQ ID NO: 4139200 - RNA, 21 nt, Yersinia pestis
ucggaaaucugaugauuggag

SEQ ID NO: 4139201 - RNA, 19 nt, Yersinia pestis
ucggauaaccgcauucccu

SEQ ID NO: 4139202 - RNA, 17 nt, Yersinia pestis
ucggauaguuaucuggg

SEQ ID NO: 4139203 - RNA, 21 nt, Yersinia pestis
ucggaucagcgccugcuguua

SEQ ID NO: 4139204 - RNA, 16 nt, Yersinia pestis
ucggauggucauccac

SEQ ID NO: 4139205 - RNA, 16 nt, Yersinia pestis
ucggcaauauaaagcc

SEQ ID NO: 4139206 - RNA, 22 nt, Yersinia pestis
ucggcaauauuggcgcacaacu

SEQ ID NO: 4139207 - RNA, 20 nt, Yersinia pestis
ucggcacugcccugccuggu

SEQ ID NO: 4139208 - RNA, 16 nt, Yersinia pestis
ucggcaggcaacugag

SEQ ID NO: 4139209 - RNA, 18 nt, Yersinia pestis
ucggcauacuccauuuuu

SEQ ID NO: 4139210 - RNA, 23 nt, Yersinia pestis
ucggccacccgccaucaggcaaa

SEQ ID NO: 4139211 - RNA, 14 nt, Yersinia pestis
ucggcgcgcuugcc

SEQ ID NO: 4139212 - RNA, 20 nt, Yersinia pestis
ucggcgcgguaggggugcug

SEQ ID NO: 4139213 - RNA, 22 nt, Yersinia pestis
ucggcggucugagucagucagg

SEQ ID NO: 4139214 - RNA, 14 nt, Yersinia pestis
ucggcgucgccacc

SEQ ID NO: 4139215 - RNA, 22 nt, Yersinia pestis
ucggcguucgguaaugccagcc

SEQ ID NO: 4139216 - RNA, 17 nt, Yersinia pestis
ucgggaaaacaggcaau

SEQ ID NO: 4139217 - RNA, 22 nt, Yersinia pestis
ucgggaaauugugauucaacug

SEQ ID NO: 4139218 - RNA, 18 nt, Yersinia pestis
ucgggauaucuucaauca

SEQ ID NO: 4139219 - RNA, 17 nt, Yersinia pestis
ucgggauccgccugcug

SEQ ID NO: 4139220 - RNA, 16 nt, Yersinia pestis
ucgggcuaucaucaaa

SEQ ID NO: 4139221 - RNA, 17 nt, Yersinia pestis
ucgggcuugguguugca

SEQ ID NO: 4139222 - RNA, 13 nt, Yersinia pestis
ucgggguuuguca

SEQ ID NO: 4139223 - RNA, 16 nt, Yersinia pestis
ucgggguuugucagca

SEQ ID NO: 4139224 - RNA, 14 nt, Yersinia pestis
ucggguaaaccaau

SEQ ID NO: 4139225 - RNA, 15 nt, Yersinia pestis
ucgggugagugagcg

SEQ ID NO: 4139226 - RNA, 21 nt, Yersinia pestis
ucgggugauggcugucugaug

SEQ ID NO: 4139227 - RNA, 14 nt, Yersinia pestis
ucgguaaccugaaa

SEQ ID NO: 4139228 - RNA, 18 nt, Yersinia pestis
ucgguaccgccagaauaa

SEQ ID NO: 4139229 - RNA, 19 nt, Yersinia pestis
ucgguagcgguaauuaaua

SEQ ID NO: 4139230 - RNA, 21 nt, Yersinia pestis
ucgguauuaccaaucagcgcg

SEQ ID NO: 4139231 - RNA, 20 nt, Yersinia pestis
ucggucacacuggcacgggc

SEQ ID NO: 4139232 - RNA, 19 nt, Yersinia pestis
ucggucgauuuuuauuuuc

SEQ ID NO: 4139233 - RNA, 16 nt, Yersinia pestis
ucggucuauaaaaccg

SEQ ID NO: 4139234 - RNA, 19 nt, Yersinia pestis
ucggugauauucgugauca

SEQ ID NO: 4139235 - RNA, 15 nt, Yersinia pestis
ucggugugacuuuca

SEQ ID NO: 4139236 - RNA, 15 nt, Yersinia pestis
ucgguuaaagacaua

SEQ ID NO: 4139237 - RNA, 13 nt, Yersinia pestis
ucgguuauuuauc

SEQ ID NO: 4139238 - RNA, 14 nt, Yersinia pestis
ucgguugccgccuu

SEQ ID NO: 4139239 - RNA, 16 nt, Yersinia pestis
ucgguuucacccucuu

SEQ ID NO: 4139240 - RNA, 20 nt, Yersinia pestis
ucguacaucuccgcuauuuu

SEQ ID NO: 4139241 - RNA, 18 nt, Yersinia pestis
ucguacuuuccuuccucu

SEQ ID NO: 4139242 - RNA, 21 nt, Yersinia pestis
ucguagcauggacgcuuuacu

SEQ ID NO: 4139243 - RNA, 20 nt, Yersinia pestis
ucguauguccucaccauuua

SEQ ID NO: 4139244 - RNA, 15 nt, Yersinia pestis
ucguauuaucaauag

SEQ ID NO: 4139245 - RNA, 13 nt, Yersinia pestis
ucguauuuccagu

SEQ ID NO: 4139246 - RNA, 15 nt, Yersinia pestis
ucgucaaguucauau

SEQ ID NO: 4139247 - RNA, 21 nt, Yersinia pestis
ucgucacugucagacaguucu

SEQ ID NO: 4139248 - RNA, 13 nt, Yersinia pestis
ucgucagccccug

SEQ ID NO: 4139249 - RNA, 11 nt, Yersinia pestis
ucguccaaagg

SEQ ID NO: 4139250 - RNA, 14 nt, Yersinia pestis
ucguccaaagggag

SEQ ID NO: 4139251 - RNA, 14 nt, Yersinia pestis
ucguccagcagcag

SEQ ID NO: 4139252 - RNA, 20 nt, Yersinia pestis
ucgucccaggccuccgcaaa

SEQ ID NO: 4139253 - RNA, 17 nt, Yersinia pestis
ucgucgaggaucaccac

SEQ ID NO: 4139254 - RNA, 24 nt, Yersinia pestis
ucgugaaaacuuucuuucaguaau

SEQ ID NO: 4139255 - RNA, 21 nt, Yersinia pestis
ucgugaaguuuauacuauuua

SEQ ID NO: 4139256 - RNA, 15 nt, Yersinia pestis
ucgugaccaauaaua

SEQ ID NO: 4139257 - RNA, 19 nt, Yersinia pestis
ucgugaccccguggcggcg

SEQ ID NO: 4139258 - RNA, 18 nt, Yersinia pestis
ucgugauugagcguugau

SEQ ID NO: 4139259 - RNA, 13 nt, Yersinia pestis
ucucuccaugaua

SEQ ID NO: 4139260 - RNA, 23 nt, Yersinia pestis
ucucuccuauaucucaguugaaa

SEQ ID NO: 4139261 - RNA, 23 nt, Yersinia pestis
ucucugaguuguaaugaauucag

SEQ ID NO: 4139262 - RNA, 17 nt, Yersinia pestis
ucucugaugguaucaga

SEQ ID NO: 4139263 - RNA, 17 nt, Yersinia pestis
ucucugcugcgaauauu

SEQ ID NO: 4139264 - RNA, 21 nt, Yersinia pestis
ucucugcuuacucuuccaacu

SEQ ID NO: 4139265 - RNA, 18 nt, Yersinia pestis
ucucuggcacgcuuucug

SEQ ID NO: 4139266 - RNA, 22 nt, Yersinia pestis
ucucuggcuaaugucucuauuc

SEQ ID NO: 4139267 - RNA, 23 nt, Yersinia pestis
ucucuggguaagaacagagagaa

SEQ ID NO: 4139268 - RNA, 18 nt, Yersinia pestis
ucucugggugcugcuccc

SEQ ID NO: 4139269 - RNA, 23 nt, Yersinia pestis
ucucuguaauggcgcacauuaca

SEQ ID NO: 4139270 - RNA, 13 nt, Yersinia pestis
ucucugucuucca

SEQ ID NO: 4139271 - RNA, 23 nt, Yersinia pestis
ucucuuaaagaaaauuuacccug

SEQ ID NO: 4139272 - RNA, 14 nt, Yersinia pestis
ucucuuaggcaacc

SEQ ID NO: 4139273 - RNA, 16 nt, Yersinia pestis
ucucuucgccuuugau

SEQ ID NO: 4139274 - RNA, 16 nt, Yersinia pestis
ucucuugaaaugauaa

SEQ ID NO: 4139275 - RNA, 19 nt, Yersinia pestis
ucucuugaaaugauaacaa

SEQ ID NO: 4139276 - RNA, 21 nt, Yersinia pestis
ucucuugaaaugauaacaaua

SEQ ID NO: 4139277 - RNA, 22 nt, Yersinia pestis
ucucuugaaaugauaacaauaa

SEQ ID NO: 4139278 - RNA, 20 nt, Yersinia pestis
ucucuugauuaccaauaauu

SEQ ID NO: 4139279 - RNA, 15 nt, Yersinia pestis
ucucuuguuuugcaa

SEQ ID NO: 4139280 - RNA, 15 nt, Yersinia pestis
ucucuuuaucauuga

SEQ ID NO: 4139281 - RNA, 21 nt, Yersinia pestis
ucucuuugccuacuaccaaau

SEQ ID NO: 4139282 - RNA, 22 nt, Yersinia pestis
ucucuuugcgcugauaacuucc

SEQ ID NO: 4139283 - RNA, 16 nt, Yersinia pestis
ucucuuuuuuauucaa

SEQ ID NO: 4139284 - RNA, 13 nt, Yersinia pestis
ucucuuuuuucuc

SEQ ID NO: 4139285 - RNA, 18 nt, Yersinia pestis
ucugaaacgccagccucu

SEQ ID NO: 4139286 - RNA, 18 nt, Yersinia pestis
ucugaaacggugaggaua

SEQ ID NO: 4139287 - RNA, 22 nt, Yersinia pestis
ucugaaaucuccuccggagagg

SEQ ID NO: 4139288 - RNA, 16 nt, Yersinia pestis
ucugaagaugccaauc

SEQ ID NO: 4139289 - RNA, 17 nt, Yersinia pestis
ucugaagaugccaauca

SEQ ID NO: 4139290 - RNA, 18 nt, Yersinia pestis
ucugaagccuacgagaga

SEQ ID NO: 4139291 - RNA, 13 nt, Yersinia pestis
ucugaauaaaaaa

SEQ ID NO: 4139292 - RNA, 12 nt, Yersinia pestis
ucugaauaagag

SEQ ID NO: 4139293 - RNA, 23 nt, Yersinia pestis
ucugaaugaauucuauaaugaug

SEQ ID NO: 4139294 - RNA, 17 nt, Yersinia pestis
ucugacacacaaauccu

SEQ ID NO: 4139295 - RNA, 15 nt, Yersinia pestis
ucugaccaaacauug

SEQ ID NO: 4139296 - RNA, 14 nt, Yersinia pestis
ucugacuaacucuu

SEQ ID NO: 4139297 - RNA, 19 nt, Yersinia pestis
ucugacuaacucuucuggc

SEQ ID NO: 4139298 - RNA, 12 nt, Yersinia pestis
ucugacuaagac

SEQ ID NO: 4139299 - RNA, 19 nt, Yersinia pestis
ucugacuacugaaaccuga

SEQ ID NO: 4139300 - RNA, 12 nt, Yersinia pestis
ucugacuguuga

SEQ ID NO: 4139301 - RNA, 15 nt, Yersinia pestis
ucugagaucuaaaaa

SEQ ID NO: 4139302 - RNA, 12 nt, Yersinia pestis
ucugagccaucc

SEQ ID NO: 4139303 - RNA, 16 nt, Yersinia pestis
ucugagccucaugaau

SEQ ID NO: 4139304 - RNA, 17 nt, Yersinia pestis
ucugagccuucaacaaa

SEQ ID NO: 4139305 - RNA, 16 nt, Yersinia pestis
ucugagcgagcgguaa

SEQ ID NO: 4139306 - RNA, 13 nt, Yersinia pestis
ucugaggccaaca

SEQ ID NO: 4139307 - RNA, 23 nt, Yersinia pestis
ucugaguuucauuagucaauguu

SEQ ID NO: 4139308 - RNA, 13 nt, Yersinia pestis
ucugauaaaacag

SEQ ID NO: 4139309 - RNA, 21 nt, Yersinia pestis
ucugauagugauuuuuuucac

SEQ ID NO: 4139310 - RNA, 18 nt, Yersinia pestis
ucugauaucuaaaaaaau

SEQ ID NO: 4139311 - RNA, 15 nt, Yersinia pestis
ucugauaucucuuua

SEQ ID NO: 4139312 - RNA, 12 nt, Yersinia pestis
ucugaucaaucu

SEQ ID NO: 4139313 - RNA, 20 nt, Yersinia pestis
ucugauggucgucauguuua

SEQ ID NO: 4139314 - RNA, 17 nt, Yersinia pestis
ucugcaacaacuccuuc

SEQ ID NO: 4139315 - RNA, 19 nt, Yersinia pestis
ucugcaauacugggcuuau

SEQ ID NO: 4139316 - RNA, 22 nt, Yersinia pestis
ucugcauacagaucgagcauca

SEQ ID NO: 4139317 - RNA, 18 nt, Yersinia pestis
ucugcauuaaaauaacaa

SEQ ID NO: 4139318 - RNA, 12 nt, Yersinia pestis
ucugcauugauu

SEQ ID NO: 4139319 - RNA, 19 nt, Yersinia pestis
ucugccaaauauugcacaa

SEQ ID NO: 4139320 - RNA, 15 nt, Yersinia pestis
ucugccaaccaggcc

SEQ ID NO: 4139321 - RNA, 15 nt, Yersinia pestis
ucugccaccgcacag

SEQ ID NO: 4139322 - RNA, 16 nt, Yersinia pestis
ucugccagauagucau

SEQ ID NO: 4139323 - RNA, 23 nt, Yersinia pestis
ucugccagauagucaucuuucca

SEQ ID NO: 4139324 - RNA, 14 nt, Yersinia pestis
ucugccaugguugg

SEQ ID NO: 4139325 - RNA, 18 nt, Yersinia pestis
ucugcccacucaccuaaa

SEQ ID NO: 4139326 - RNA, 16 nt, Yersinia pestis
ucugcccagccugguu

SEQ ID NO: 4139327 - RNA, 16 nt, Yersinia pestis
ucugcccccccuuuca

SEQ ID NO: 4139328 - RNA, 17 nt, Yersinia pestis
ucugcccuuucucgccu

SEQ ID NO: 4139329 - RNA, 20 nt, Yersinia pestis
ucugccgucuaucugccaga

SEQ ID NO: 4139330 - RNA, 17 nt, Yersinia pestis
ucugccuaucuuaaaaa

SEQ ID NO: 4139331 - RNA, 20 nt, Yersinia pestis
ucugccugugggcuauaggg

SEQ ID NO: 4139332 - RNA, 13 nt, Yersinia pestis
ucugccuuaucaa

SEQ ID NO: 4139333 - RNA, 19 nt, Yersinia pestis
ucugcgagcguuuaaauac

SEQ ID NO: 4139334 - RNA, 21 nt, Yersinia pestis
ucugcgagcguuuaaauaccc

SEQ ID NO: 4139335 - RNA, 15 nt, Yersinia pestis
ucugcgcccuuaucu

SEQ ID NO: 4139336 - RNA, 16 nt, Yersinia pestis
ucugcgcuguaagcac

SEQ ID NO: 4139337 - RNA, 17 nt, Yersinia pestis
ucugcgcuguaagcacc

SEQ ID NO: 4139338 - RNA, 13 nt, Yersinia pestis
ucugcguaugggg

SEQ ID NO: 4139339 - RNA, 20 nt, Yersinia pestis
ucugcguauggggauuuuau

SEQ ID NO: 4139340 - RNA, 15 nt, Yersinia pestis
ucugcguuuuucccu

SEQ ID NO: 4139341 - RNA, 16 nt, Yersinia pestis
ucugcguuuuucccug

SEQ ID NO: 4139342 - RNA, 21 nt, Yersinia pestis
ucugcuaacaacagucaauau

SEQ ID NO: 4139343 - RNA, 14 nt, Yersinia pestis
ucugcucccauguc

SEQ ID NO: 4139344 - RNA, 17 nt, Yersinia pestis
ucugcucccaugucaga

SEQ ID NO: 4139345 - RNA, 19 nt, Yersinia pestis
ucugcucccggcacuaaaa

SEQ ID NO: 4139346 - RNA, 16 nt, Yersinia pestis
ucugcucuugcucagu

SEQ ID NO: 4139347 - RNA, 13 nt, Yersinia pestis
ucugcugcugccc

SEQ ID NO: 4139348 - RNA, 23 nt, Yersinia pestis
ucugcuuaacucaaucuuugccu

SEQ ID NO: 4139349 - RNA, 13 nt, Yersinia pestis
ucugcuuacucuu

SEQ ID NO: 4139350 - RNA, 14 nt, Yersinia pestis
ucugcuuacucuuc

SEQ ID NO: 4139351 - RNA, 18 nt, Yersinia pestis
ucuggcaaaaucccagca

SEQ ID NO: 4139352 - RNA, 19 nt, Yersinia pestis
ucuggcaauccagcgccug

SEQ ID NO: 4139353 - RNA, 15 nt, Yersinia pestis
ucuggcaauuucugu

SEQ ID NO: 4139354 - RNA, 22 nt, Yersinia pestis
ucuggcagauguaaccacccac

SEQ ID NO: 4139355 - RNA, 19 nt, Yersinia pestis
ucuggccagcgucuucagu

SEQ ID NO: 4139356 - RNA, 18 nt, Yersinia pestis
ucuggcccuaaaugggcu

SEQ ID NO: 4139357 - RNA, 16 nt, Yersinia pestis
ucuggcguuucaucuu

SEQ ID NO: 4139358 - RNA, 17 nt, Yersinia pestis
ucuggcguuucaucuuc

SEQ ID NO: 4139359 - RNA, 17 nt, Yersinia pestis
ucuggcuaauagcguca

SEQ ID NO: 4139360 - RNA, 18 nt, Yersinia pestis
ucuggcugcuaauggucu

SEQ ID NO: 4139361 - RNA, 19 nt, Yersinia pestis
ucuggcuggcauauuucuc

SEQ ID NO: 4139362 - RNA, 21 nt, Yersinia pestis
ucuggcuuaaucgccagcaaa

SEQ ID NO: 4139363 - RNA, 22 nt, Yersinia pestis
ucuggcuuucucaacagcauca

SEQ ID NO: 4139364 - RNA, 21 nt, Yersinia pestis
ucugggcugaacgugccuguc

SEQ ID NO: 4139365 - RNA, 15 nt, Yersinia pestis
ucugggcuggcaaca

SEQ ID NO: 4139366 - RNA, 18 nt, Yersinia pestis
ucuggguaagaacagaga

SEQ ID NO: 4139367 - RNA, 14 nt, Yersinia pestis
ucugggugcugcuc

SEQ ID NO: 4139368 - RNA, 15 nt, Yersinia pestis
ucugguaguuuugca

SEQ ID NO: 4139369 - RNA, 15 nt, Yersinia pestis
ucuggucuugcaccu

SEQ ID NO: 4139370 - RNA, 20 nt, Yersinia pestis
ucugguugugagguuagaaa

SEQ ID NO: 4139371 - RNA, 12 nt, Yersinia pestis
ucuguaauaaua

SEQ ID NO: 4139372 - RNA, 17 nt, Yersinia pestis
ucuguagagaaauucau

SEQ ID NO: 4139373 - RNA, 18 nt, Yersinia pestis
ucuguagaguaaaacuga

SEQ ID NO: 4139374 - RNA, 15 nt, Yersinia pestis
ucuguaucauauguu

SEQ ID NO: 4139375 - RNA, 16 nt, Yersinia pestis
ucugucguacuuuccu

SEQ ID NO: 4139376 - RNA, 17 nt, Yersinia pestis
ucugucguacuuuccuu

SEQ ID NO: 4139377 - RNA, 14 nt, Yersinia pestis
ucugucuaagugcc

SEQ ID NO: 4139378 - RNA, 21 nt, Yersinia pestis
ucugucucugguaguuuugca

SEQ ID NO: 4139379 - RNA, 22 nt, Yersinia pestis
ucugucuuccauuuuauuuaac

SEQ ID NO: 4139380 - RNA, 18 nt, Yersinia pestis
ucugugauuacgucugca

SEQ ID NO: 4139381 - RNA, 18 nt, Yersinia pestis
ugaaaggcggugaacagu

SEQ ID NO: 4139382 - RNA, 17 nt, Yersinia pestis
ugaaaguggccacucac

SEQ ID NO: 4139383 - RNA, 24 nt, Yersinia pestis
ugaaaguggccacucaccucaguc

SEQ ID NO: 4139384 - RNA, 14 nt, Yersinia pestis
ugaaaguuuauaug

SEQ ID NO: 4139385 - RNA, 16 nt, Yersinia pestis
ugaaaguuuauaugcu

SEQ ID NO: 4139386 - RNA, 14 nt, Yersinia pestis
ugaaauaaacaagc

SEQ ID NO: 4139387 - RNA, 15 nt, Yersinia pestis
ugaaauaaauaaguu

SEQ ID NO: 4139388 - RNA, 13 nt, Yersinia pestis
ugaaauaaugguu

SEQ ID NO: 4139389 - RNA, 20 nt, Yersinia pestis
ugaaauaccgauuagaaauc

SEQ ID NO: 4139390 - RNA, 20 nt, Yersinia pestis
ugaaauauacacaagucauu

SEQ ID NO: 4139391 - RNA, 19 nt, Yersinia pestis
ugaaauaucacgacuuuaa

SEQ ID NO: 4139392 - RNA, 15 nt, Yersinia pestis
ugaaaucagaucaac

SEQ ID NO: 4139393 - RNA, 19 nt, Yersinia pestis
ugaaaucagaucaacagau

SEQ ID NO: 4139394 - RNA, 16 nt, Yersinia pestis
ugaaaucaguguauua

SEQ ID NO: 4139395 - RNA, 16 nt, Yersinia pestis
ugaaaucaucacaccu

SEQ ID NO: 4139396 - RNA, 18 nt, Yersinia pestis
ugaaaucuauuguauaua

SEQ ID NO: 4139397 - RNA, 21 nt, Yersinia pestis
ugaaaugauaacaauaaaauc

SEQ ID NO: 4139398 - RNA, 21 nt, Yersinia pestis
ugaaauucuguagaguaaaac

SEQ ID NO: 4139399 - RNA, 16 nt, Yersinia pestis
ugaaauuggcuucacc

SEQ ID NO: 4139400 - RNA, 16 nt, Yersinia pestis
ugaaauuucacugugc

SEQ ID NO: 4139401 - RNA, 13 nt, Yersinia pestis
ugaaauuuuauuc

SEQ ID NO: 4139402 - RNA, 22 nt, Yersinia pestis
ugaaauuuuauucgcguuucau

SEQ ID NO: 4139403 - RNA, 15 nt, Yersinia pestis
ugaaauuuuuuaauu

SEQ ID NO: 4139404 - RNA, 16 nt, Yersinia pestis
ugaaauuuuuuaauuu

SEQ ID NO: 4139405 - RNA, 13 nt, Yersinia pestis
ugaacacagaaac

SEQ ID NO: 4139406 - RNA, 15 nt, Yersinia pestis
ugaacacagaaacga

SEQ ID NO: 4139407 - RNA, 20 nt, Yersinia pestis
ugaacagauagauaaauguu

SEQ ID NO: 4139408 - RNA, 22 nt, Yersinia pestis
ugaacauaacuuugccagugac

SEQ ID NO: 4139409 - RNA, 13 nt, Yersinia pestis
ugaacaucuggcg

SEQ ID NO: 4139410 - RNA, 18 nt, Yersinia pestis
ugaacauggauccugcaa

SEQ ID NO: 4139411 - RNA, 19 nt, Yersinia pestis
ugaacauggauccugcaaa

SEQ ID NO: 4139412 - RNA, 20 nt, Yersinia pestis
ugaaccaaugaaucgggcgu

SEQ ID NO: 4139413 - RNA, 21 nt, Yersinia pestis
ugaaccaucaacaauucgauc

SEQ ID NO: 4139414 - RNA, 23 nt, Yersinia pestis
ugaaccaucaaggacuucaucac

SEQ ID NO: 4139415 - RNA, 19 nt, Yersinia pestis
ugaacccacgacuauuuag

SEQ ID NO: 4139416 - RNA, 23 nt, Yersinia pestis
ugaaccccgguuuuuacuguucu

SEQ ID NO: 4139417 - RNA, 14 nt, Yersinia pestis
ugaaccgccauugc

SEQ ID NO: 4139418 - RNA, 19 nt, Yersinia pestis
ugaaccgccauugcauauu

SEQ ID NO: 4139419 - RNA, 13 nt, Yersinia pestis
ugaaccgcuaucu

SEQ ID NO: 4139420 - RNA, 18 nt, Yersinia pestis
ugaaccgcuaucugcuga

SEQ ID NO: 4139421 - RNA, 18 nt, Yersinia pestis
ugaaccugacgcacagca

SEQ ID NO: 4139422 - RNA, 19 nt, Yersinia pestis
ugaaccugacgcacagcac

SEQ ID NO: 4139423 - RNA, 20 nt, Yersinia pestis
ugaacgaggacuuccugccc

SEQ ID NO: 4139424 - RNA, 15 nt, Yersinia pestis
ugaacgauaaauugc

SEQ ID NO: 4139425 - RNA, 13 nt, Yersinia pestis
ugaacgcaaaccc

SEQ ID NO: 4139426 - RNA, 22 nt, Yersinia pestis
ugaacgccucaaaaaccugugu

SEQ ID NO: 4139427 - RNA, 17 nt, Yersinia pestis
ugaacggugaggauagg

SEQ ID NO: 4139428 - RNA, 16 nt, Yersinia pestis
ugaacggugaggaugg

SEQ ID NO: 4139429 - RNA, 15 nt, Yersinia pestis
ugaacguuuaucgcu

SEQ ID NO: 4139430 - RNA, 22 nt, Yersinia pestis
ugaacucaacuuucucuggcac

SEQ ID NO: 4139431 - RNA, 17 nt, Yersinia pestis
ugaacucgccuucaggu

SEQ ID NO: 4139432 - RNA, 19 nt, Yersinia pestis
ugaacucgccuucagguaa

SEQ ID NO: 4139433 - RNA, 20 nt, Yersinia pestis
ugaacugacacacaccagug

SEQ ID NO: 4139434 - RNA, 23 nt, Yersinia pestis
ugaacugacacacaccagugauu

SEQ ID NO: 4139435 - RNA, 22 nt, Yersinia pestis
ugaacuucaaaucgccaaacug

SEQ ID NO: 4139436 - RNA, 16 nt, Yersinia pestis
ugaacuucgaaagaaa

SEQ ID NO: 4139437 - RNA, 17 nt, Yersinia pestis
ugaacuuuacuuuaauc

SEQ ID NO: 4139438 - RNA, 12 nt, Yersinia pestis
ugaagaacagca

SEQ ID NO: 4139439 - RNA, 23 nt, Yersinia pestis
ugaagaacgaagguauaaccauu

SEQ ID NO: 4139440 - RNA, 18 nt, Yersinia pestis
ugaagaauucaguaucac

SEQ ID NO: 4139441 - RNA, 15 nt, Yersinia pestis
ugaagacaacucuuc

SEQ ID NO: 4139442 - RNA, 17 nt, Yersinia pestis
ugaagacaaugccgaua

SEQ ID NO: 4139443 - RNA, 15 nt, Yersinia pestis
ugaagacacuuuggu

SEQ ID NO: 4139444 - RNA, 15 nt, Yersinia pestis
ugaagagaaauaacc

SEQ ID NO: 4139445 - RNA, 18 nt, Yersinia pestis
ugaagagaaauaacccau

SEQ ID NO: 4139446 - RNA, 18 nt, Yersinia pestis
ugaagaggguuuuuaaau

SEQ ID NO: 4139447 - RNA, 22 nt, Yersinia pestis
ugaagaggguuuuuaaauuucu

SEQ ID NO: 4139448 - RNA, 18 nt, Yersinia pestis
ugaagagugaccaaagca

SEQ ID NO: 4139449 - RNA, 20 nt, Yersinia pestis
ugaagauacccuucucuuua

SEQ ID NO: 4139450 - RNA, 15 nt, Yersinia pestis
ugaagauacccuuga

SEQ ID NO: 4139451 - RNA, 18 nt, Yersinia pestis
ugaagauucaaccaauua

SEQ ID NO: 4139452 - RNA, 13 nt, Yersinia pestis
ugaagauuuaaau

SEQ ID NO: 4139453 - RNA, 17 nt, Yersinia pestis
ugaagauuuaaauaaca

SEQ ID NO: 4139454 - RNA, 17 nt, Yersinia pestis
ugaagauuuaacggcug

SEQ ID NO: 4139455 - RNA, 16 nt, Yersinia pestis
ugaagcagauaaagaa

SEQ ID NO: 4139456 - RNA, 14 nt, Yersinia pestis
ugaagccagcaccg

SEQ ID NO: 4139457 - RNA, 23 nt, Yersinia pestis
ugaagccgccggagaacuugaac

SEQ ID NO: 4139458 - RNA, 22 nt, Yersinia pestis
ugaagccuucauguuuaucaaa

SEQ ID NO: 4139459 - RNA, 19 nt, Yersinia pestis
ugaagcucauuaauccccg

SEQ ID NO: 4139460 - RNA, 13 nt, Yersinia pestis
ugaaggaugaaua

SEQ ID NO: 4139461 - RNA, 14 nt, Yersinia pestis
ugaaggccgucgug

SEQ ID NO: 4139462 - RNA, 16 nt, Yersinia pestis
ugaaggcguagguggu

SEQ ID NO: 4139463 - RNA, 21 nt, Yersinia pestis
ugaaggcugauuaauaucaaa

SEQ ID NO: 4139464 - RNA, 19 nt, Yersinia pestis
ugaaggguauugaagauac

SEQ ID NO: 4139465 - RNA, 16 nt, Yersinia pestis
ugaagguagucccuca

SEQ ID NO: 4139466 - RNA, 21 nt, Yersinia pestis
ugaagguaugagugaucauau

SEQ ID NO: 4139467 - RNA, 15 nt, Yersinia pestis
ugaagucuuuagccu

SEQ ID NO: 4139468 - RNA, 19 nt, Yersinia pestis
ugaaguggcugaauaucau

SEQ ID NO: 4139469 - RNA, 21 nt, Yersinia pestis
ugaauaaaaaauuauuaaaua

SEQ ID NO: 4139470 - RNA, 13 nt, Yersinia pestis
ugaauaaaaauaa

SEQ ID NO: 4139471 - RNA, 14 nt, Yersinia pestis
ugaauaaauaugac

SEQ ID NO: 4139472 - RNA, 14 nt, Yersinia pestis
ugaauaaaucaaag

SEQ ID NO: 4139473 - RNA, 22 nt, Yersinia pestis
ugaauaacagcuaaucauugca

SEQ ID NO: 4139474 - RNA, 21 nt, Yersinia pestis
ugaauaacuucgcgaacacaa

SEQ ID NO: 4139475 - RNA, 16 nt, Yersinia pestis
ugaauaauacugucaa

SEQ ID NO: 4139476 - RNA, 16 nt, Yersinia pestis
ugaauaccaccaucac

SEQ ID NO: 4139477 - RNA, 12 nt, Yersinia pestis
ugaauaccgcua

SEQ ID NO: 4139478 - RNA, 17 nt, Yersinia pestis
ugaauacgaauuuuuuc

SEQ ID NO: 4139479 - RNA, 17 nt, Yersinia pestis
ugaauacgauaaagaag

SEQ ID NO: 4139480 - RNA, 18 nt, Yersinia pestis
ugaauacguucaaaugau

SEQ ID NO: 4139481 - RNA, 23 nt, Yersinia pestis
ugaauagaggacuauucaaugac

SEQ ID NO: 4139482 - RNA, 17 nt, Yersinia pestis
ugaauagggaauaagua

SEQ ID NO: 4139483 - RNA, 19 nt, Yersinia pestis
ugaauagggaauaaguaga

SEQ ID NO: 4139484 - RNA, 13 nt, Yersinia pestis
ugaauauaaauuu

SEQ ID NO: 4139485 - RNA, 15 nt, Yersinia pestis
ugaauauaaauuuaa

SEQ ID NO: 4139486 - RNA, 17 nt, Yersinia pestis
ugaauauaaauuuaaua

SEQ ID NO: 4139487 - RNA, 20 nt, Yersinia pestis
ugaauaucaccauauucauc

SEQ ID NO: 4139488 - RNA, 15 nt, Yersinia pestis
ugaauaucaucuuuu

SEQ ID NO: 4139489 - RNA, 23 nt, Yersinia pestis
ugaauaucccccuccggaaucag

SEQ ID NO: 4139490 - RNA, 16 nt, Yersinia pestis
ugaauauccgccgccc

SEQ ID NO: 4139491 - RNA, 19 nt, Yersinia pestis
ugaauaugcuucaucacuu

SEQ ID NO: 4139492 - RNA, 15 nt, Yersinia pestis
ugaaucaacagauga

SEQ ID NO: 4139493 - RNA, 18 nt, Yersinia pestis
ugaaucaaggcuuuaaua

SEQ ID NO: 4139494 - RNA, 19 nt, Yersinia pestis
ugaaucacuaacguguccc

SEQ ID NO: 4139495 - RNA, 21 nt, Yersinia pestis
ugaaucagauacggcuccaga

SEQ ID NO: 4139496 - RNA, 15 nt, Yersinia pestis
ugaaucagccagaga

SEQ ID NO: 4139497 - RNA, 14 nt, Yersinia pestis
ugaaucaucaauac

SEQ ID NO: 4139498 - RNA, 16 nt, Yersinia pestis
ugaaucgccguuaccc

SEQ ID NO: 4139499 - RNA, 12 nt, Yersinia pestis
ugaaucuguaag

SEQ ID NO: 4139500 - RNA, 21 nt, Yersinia pestis
ugaaucuguaagucauucuug

SEQ ID NO: 4139501 - RNA, 20 nt, Yersinia pestis
ugaaugaccaagguuauaca

SEQ ID NO: 4139502 - RNA, 16 nt, Yersinia pestis
ugaauggaucacauca

SEQ ID NO: 4139503 - RNA, 15 nt, Yersinia pestis
ugacuuguggaacaa

SEQ ID NO: 4139504 - RNA, 16 nt, Yersinia pestis
ugacuuucaaucgcga

SEQ ID NO: 4139505 - RNA, 18 nt, Yersinia pestis
ugacuuugucagcagucu

SEQ ID NO: 4139506 - RNA, 16 nt, Yersinia pestis
ugacuuuuuuuaacca

SEQ ID NO: 4139507 - RNA, 18 nt, Yersinia pestis
ugagaaacauccuaaaaa

SEQ ID NO: 4139508 - RNA, 22 nt, Yersinia pestis
ugagaaaggauuugaagacaac

SEQ ID NO: 4139509 - RNA, 16 nt, Yersinia pestis
ugagaaccaguucugg

SEQ ID NO: 4139510 - RNA, 18 nt, Yersinia pestis
ugagaaccaguucuggua

SEQ ID NO: 4139511 - RNA, 14 nt, Yersinia pestis
ugagaagacgaaua

SEQ ID NO: 4139512 - RNA, 15 nt, Yersinia pestis
ugagaagugaaaaac

SEQ ID NO: 4139513 - RNA, 12 nt, Yersinia pestis
ugagaauaaaac

SEQ ID NO: 4139514 - RNA, 15 nt, Yersinia pestis
ugagaauaaaaccua

SEQ ID NO: 4139515 - RNA, 18 nt, Yersinia pestis
ugagaauacuucaggcca

SEQ ID NO: 4139516 - RNA, 18 nt, Yersinia pestis
ugagaaucaaaaaacaga

SEQ ID NO: 4139517 - RNA, 22 nt, Yersinia pestis
ugagaaucaguggucuuccgcc

SEQ ID NO: 4139518 - RNA, 15 nt, Yersinia pestis
ugagaauguaaauuu

SEQ ID NO: 4139519 - RNA, 13 nt, Yersinia pestis
ugagacaacagua

SEQ ID NO: 4139520 - RNA, 23 nt, Yersinia pestis
ugagacagcgcgguuugguacau

SEQ ID NO: 4139521 - RNA, 16 nt, Yersinia pestis
ugagacguccauaauc

SEQ ID NO: 4139522 - RNA, 17 nt, Yersinia pestis
ugagacguccauaaucu

SEQ ID NO: 4139523 - RNA, 20 nt, Yersinia pestis
ugagacguccauaaucugga

SEQ ID NO: 4139524 - RNA, 18 nt, Yersinia pestis
ugagagcauaaccccaac

SEQ ID NO: 4139525 - RNA, 21 nt, Yersinia pestis
ugagagcgguuuauauuuuug

SEQ ID NO: 4139526 - RNA, 18 nt, Yersinia pestis
ugagagugaaugugagug

SEQ ID NO: 4139527 - RNA, 22 nt, Yersinia pestis
ugagaucauauuguuaauuuuu

SEQ ID NO: 4139528 - RNA, 15 nt, Yersinia pestis
ugagauccuccauau

SEQ ID NO: 4139529 - RNA, 15 nt, Yersinia pestis
ugagauggcgcaaug

SEQ ID NO: 4139530 - RNA, 13 nt, Yersinia pestis
ugagauuauuggc

SEQ ID NO: 4139531 - RNA, 16 nt, Yersinia pestis
ugagauuuagaugugc

SEQ ID NO: 4139532 - RNA, 15 nt, Yersinia pestis
ugagcaccacaauac

SEQ ID NO: 4139533 - RNA, 19 nt, Yersinia pestis
ugagcaccucuuccggcgu

SEQ ID NO: 4139534 - RNA, 21 nt, Yersinia pestis
ugagcagcaacuguuuuauug

SEQ ID NO: 4139535 - RNA, 12 nt, Yersinia pestis
ugagcagcucua

SEQ ID NO: 4139536 - RNA, 18 nt, Yersinia pestis
ugagcagugcgcggcgcc

SEQ ID NO: 4139537 - RNA, 15 nt, Yersinia pestis
ugagcauauucagua

SEQ ID NO: 4139538 - RNA, 19 nt, Yersinia pestis
ugagcauauucaguaacaa

SEQ ID NO: 4139539 - RNA, 20 nt, Yersinia pestis
ugagccagaaacgaucuugg

SEQ ID NO: 4139540 - RNA, 14 nt, Yersinia pestis
ugagccgcauacau

SEQ ID NO: 4139541 - RNA, 20 nt, Yersinia pestis
ugagccgcauugauccucgu

SEQ ID NO: 4139542 - RNA, 22 nt, Yersinia pestis
ugagcgaacugaaugcguugcc

SEQ ID NO: 4139543 - RNA, 17 nt, Yersinia pestis
ugagcgcacgauaaauc

SEQ ID NO: 4139544 - RNA, 23 nt, Yersinia pestis
ugagcgcagaguccucucaccaa

SEQ ID NO: 4139545 - RNA, 21 nt, Yersinia pestis
ugagcgccaugcgcuuucagc

SEQ ID NO: 4139546 - RNA, 14 nt, Yersinia pestis
ugagcgcuauuuau

SEQ ID NO: 4139547 - RNA, 15 nt, Yersinia pestis
ugagcgcuauuuauc

SEQ ID NO: 4139548 - RNA, 18 nt, Yersinia pestis
ugagcgguugaaaaguuu

SEQ ID NO: 4139549 - RNA, 21 nt, Yersinia pestis
ugagcguagcugucaccuaac

SEQ ID NO: 4139550 - RNA, 18 nt, Yersinia pestis
ugagcguucaaaaucaaa

SEQ ID NO: 4139551 - RNA, 14 nt, Yersinia pestis
ugagcuauuccagu

SEQ ID NO: 4139552 - RNA, 18 nt, Yersinia pestis
ugagcuggcaaaacucag

SEQ ID NO: 4139553 - RNA, 15 nt, Yersinia pestis
ugagcuguaaauaua

SEQ ID NO: 4139554 - RNA, 16 nt, Yersinia pestis
ugagcuguaaauauaa

SEQ ID NO: 4139555 - RNA, 22 nt, Yersinia pestis
ugagcuguaaauauaaaauaau

SEQ ID NO: 4139556 - RNA, 20 nt, Yersinia pestis
ugagcuuauggaaguaaucc

SEQ ID NO: 4139557 - RNA, 14 nt, Yersinia pestis
ugagcuugcugcug

SEQ ID NO: 4139558 - RNA, 17 nt, Yersinia pestis
ugaggauaggcagaaga

SEQ ID NO: 4139559 - RNA, 15 nt, Yersinia pestis
ugaggauaggcagag

SEQ ID NO: 4139560 - RNA, 17 nt, Yersinia pestis
ugaggaugggcagaaga

SEQ ID NO: 4139561 - RNA, 21 nt, Yersinia pestis
ugaggauuauaauucauuuuu

SEQ ID NO: 4139562 - RNA, 15 nt, Yersinia pestis
ugaggauucaagaac

SEQ ID NO: 4139563 - RNA, 19 nt, Yersinia pestis
ugaggcaacauuuguugca

SEQ ID NO: 4139564 - RNA, 21 nt, Yersinia pestis
ugaggcagugaauagggaaua

SEQ ID NO: 4139565 - RNA, 23 nt, Yersinia pestis
ugaggccaacacucaugacaaaa

SEQ ID NO: 4139566 - RNA, 22 nt, Yersinia pestis
ugaggcccgcuagugauagcgg

SEQ ID NO: 4139567 - RNA, 16 nt, Yersinia pestis
ugaggcucuucugggc

SEQ ID NO: 4139568 - RNA, 13 nt, Yersinia pestis
ugagggcaauuaa

SEQ ID NO: 4139569 - RNA, 12 nt, Yersinia pestis
ugagggccacuu

SEQ ID NO: 4139570 - RNA, 16 nt, Yersinia pestis
ugagggugaugacaau

SEQ ID NO: 4139571 - RNA, 22 nt, Yersinia pestis
ugagggugaugacaaugcguua

SEQ ID NO: 4139572 - RNA, 18 nt, Yersinia pestis
ugaggguugucagcaguc

SEQ ID NO: 4139573 - RNA, 11 nt, Yersinia pestis
ugaggucagcg

SEQ ID NO: 4139574 - RNA, 13 nt, Yersinia pestis
ugagguucccaac

SEQ ID NO: 4139575 - RNA, 20 nt, Yersinia pestis
ugagguuuuaccaauccccg

SEQ ID NO: 4139576 - RNA, 22 nt, Yersinia pestis
ugaguaaacaccuucagacuga

SEQ ID NO: 4139577 - RNA, 16 nt, Yersinia pestis
ugaguaaauuaaauuu

SEQ ID NO: 4139578 - RNA, 16 nt, Yersinia pestis
ugaguaauauuauuca

SEQ ID NO: 4139579 - RNA, 19 nt, Yersinia pestis
ugaguaauucgcagacaga

SEQ ID NO: 4139580 - RNA, 15 nt, Yersinia pestis
ugaguaauuucagau

SEQ ID NO: 4139581 - RNA, 19 nt, Yersinia pestis
ugaguaauuucagauaaaa

SEQ ID NO: 4139582 - RNA, 22 nt, Yersinia pestis
ugaguagcuaauaaaauggcua

SEQ ID NO: 4139583 - RNA, 18 nt, Yersinia pestis
ugaguauacuaaaacagc

SEQ ID NO: 4139584 - RNA, 23 nt, Yersinia pestis
ugaguauccaauaagcguauuuu

SEQ ID NO: 4139585 - RNA, 18 nt, Yersinia pestis
ugaguauuucuuucacuu

SEQ ID NO: 4139586 - RNA, 18 nt, Yersinia pestis
ugagucagguggcuauuc

SEQ ID NO: 4139587 - RNA, 15 nt, Yersinia pestis
ugagucagucagggu

SEQ ID NO: 4139588 - RNA, 21 nt, Yersinia pestis
ugagucgucgaauccaugaug

SEQ ID NO: 4139589 - RNA, 12 nt, Yersinia pestis
ugagucucaggg

SEQ ID NO: 4139590 - RNA, 22 nt, Yersinia pestis
ugagucucagggaugaagcuca

SEQ ID NO: 4139591 - RNA, 15 nt, Yersinia pestis
ugagugaauagauaa

SEQ ID NO: 4139592 - RNA, 23 nt, Yersinia pestis
ugagugugccuuggucucagaac

SEQ ID NO: 4139593 - RNA, 21 nt, Yersinia pestis
ugaguguuuuuuucgcuacug

SEQ ID NO: 4139594 - RNA, 12 nt, Yersinia pestis
ugaguuccagcc

SEQ ID NO: 4139595 - RNA, 14 nt, Yersinia pestis
ugaguuccagcccc

SEQ ID NO: 4139596 - RNA, 17 nt, Yersinia pestis
ugaguucugaucauuau

SEQ ID NO: 4139597 - RNA, 20 nt, Yersinia pestis
ugaguugcuggaauccaagu

SEQ ID NO: 4139598 - RNA, 21 nt, Yersinia pestis
ugaguuuuagcccaaaauaga

SEQ ID NO: 4139599 - RNA, 22 nt, Yersinia pestis
ugaguuuuagcccaaaauagaa

SEQ ID NO: 4139600 - RNA, 17 nt, Yersinia pestis
ugaguuuucgauaacca

SEQ ID NO: 4139601 - RNA, 22 nt, Yersinia pestis
ugauaaaacuauucugcuugga

SEQ ID NO: 4139602 - RNA, 15 nt, Yersinia pestis
ugauaaaaucaccgc

SEQ ID NO: 4139603 - RNA, 21 nt, Yersinia pestis
ugauaaaauucguuugggcua

SEQ ID NO: 4139604 - RNA, 14 nt, Yersinia pestis
ugauaaacaauaaa

SEQ ID NO: 4139605 - RNA, 20 nt, Yersinia pestis
ugauaaaucuuauuuaaucu

SEQ ID NO: 4139606 - RNA, 13 nt, Yersinia pestis
ugauaaauucuug

SEQ ID NO: 4139607 - RNA, 18 nt, Yersinia pestis
ugauaacaauaaaaucuu

SEQ ID NO: 4139608 - RNA, 23 nt, Yersinia pestis
ugauaaccguuuuuucaacuggc

SEQ ID NO: 4139609 - RNA, 21 nt, Yersinia pestis
ugauaaccucgguggcucaau

SEQ ID NO: 4139610 - RNA, 19 nt, Yersinia pestis
ugauaacgccggauaaauu

SEQ ID NO: 4139611 - RNA, 21 nt, Yersinia pestis
ugauaacgccggauaaauuaa

SEQ ID NO: 4139612 - RNA, 15 nt, Yersinia pestis
ugauaauaauauuga

SEQ ID NO: 4139613 - RNA, 14 nt, Yersinia pestis
ugauaauaguucau

SEQ ID NO: 4139614 - RNA, 15 nt, Yersinia pestis
ugauaaugccuuuua

SEQ ID NO: 4139615 - RNA, 17 nt, Yersinia pestis
ugauaauuuauuucaga

SEQ ID NO: 4139616 - RNA, 18 nt, Yersinia pestis
ugauacaacaacggguca

SEQ ID NO: 4139617 - RNA, 17 nt, Yersinia pestis
ugauacaggaaacucca

SEQ ID NO: 4139618 - RNA, 15 nt, Yersinia pestis
ugauacccagcaggu

SEQ ID NO: 4139619 - RNA, 21 nt, Yersinia pestis
ugauagauucaucaccaguca

SEQ ID NO: 4139620 - RNA, 18 nt, Yersinia pestis
ugauagcgggcagacguu

SEQ ID NO: 4139621 - RNA, 18 nt, Yersinia pestis
ugauagguauugcgggug

SEQ ID NO: 4139622 - RNA, 14 nt, Yersinia pestis
ugauagguuuuucc

SEQ ID NO: 4139623 - RNA, 19 nt, Yersinia pestis
ugauagugauuuuuuucac

SEQ ID NO: 4139624 - RNA, 14 nt, Yersinia pestis
ugauuuaaauauua

SEQ ID NO: 4139625 - RNA, 13 nt, Yersinia pestis
ugauuuccaucua

SEQ ID NO: 4139626 - RNA, 22 nt, Yersinia pestis
ugauuugcuggcgcaaagacuu

SEQ ID NO: 4139627 - RNA, 16 nt, Yersinia pestis
ugauuuuuaucaucau

SEQ ID NO: 4139628 - RNA, 18 nt, Yersinia pestis
ugauuuuuaucaucauaa

SEQ ID NO: 4139629 - RNA, 18 nt, Yersinia pestis
ugauuuuuauggcagaaa

SEQ ID NO: 4139630 - RNA, 11 nt, Yersinia pestis
ugcaaaaaaag

SEQ ID NO: 4139631 - RNA, 21 nt, Yersinia pestis
ugcaaaauacaaaguaaacuu

SEQ ID NO: 4139632 - RNA, 14 nt, Yersinia pestis
ugcaaaaucagcau

SEQ ID NO: 4139633 - RNA, 16 nt, Yersinia pestis
ugcaaaaucguuaccg

SEQ ID NO: 4139634 - RNA, 18 nt, Yersinia pestis
ugcaaaaugcucuucacc

SEQ ID NO: 4139635 - RNA, 19 nt, Yersinia pestis
ugcaaacaggcccacugca

SEQ ID NO: 4139636 - RNA, 22 nt, Yersinia pestis
ugcaaaccaugggggcaacggu

SEQ ID NO: 4139637 - RNA, 20 nt, Yersinia pestis
ugcaaacccuaauaccaaca

SEQ ID NO: 4139638 - RNA, 16 nt, Yersinia pestis
ugcaaaugucagaucg

SEQ ID NO: 4139639 - RNA, 19 nt, Yersinia pestis
ugcaaaugucagaucgcga

SEQ ID NO: 4139640 - RNA, 22 nt, Yersinia pestis
ugcaaauuaaccugcuggcgca

SEQ ID NO: 4139641 - RNA, 14 nt, Yersinia pestis
ugcaaauuuaucca

SEQ ID NO: 4139642 - RNA, 13 nt, Yersinia pestis
ugcaacaacuccu

SEQ ID NO: 4139643 - RNA, 23 nt, Yersinia pestis
ugcaacagauaauuggcaauaau

SEQ ID NO: 4139644 - RNA, 14 nt, Yersinia pestis
ugcaacauuaaaaa

SEQ ID NO: 4139645 - RNA, 18 nt, Yersinia pestis
ugcaaccacuuauccagc

SEQ ID NO: 4139646 - RNA, 15 nt, Yersinia pestis
ugcaacgcaggcacu

SEQ ID NO: 4139647 - RNA, 14 nt, Yersinia pestis
ugcaacgccaauga

SEQ ID NO: 4139648 - RNA, 13 nt, Yersinia pestis
ugcaacucauuaa

SEQ ID NO: 4139649 - RNA, 14 nt, Yersinia pestis
ugcaacucauuaac

SEQ ID NO: 4139650 - RNA, 16 nt, Yersinia pestis
ugcaacucggccgcua

SEQ ID NO: 4139651 - RNA, 20 nt, Yersinia pestis
ugcaagaguccagcacuggu

SEQ ID NO: 4139652 - RNA, 16 nt, Yersinia pestis
ugcaagcaauguucaa

SEQ ID NO: 4139653 - RNA, 21 nt, Yersinia pestis
ugcaagcccccaaaguagaac

SEQ ID NO: 4139654 - RNA, 19 nt, Yersinia pestis
ugcaaggggcgagccacga

SEQ ID NO: 4139655 - RNA, 23 nt, Yersinia pestis
ugcaaguguaugaguaucaauau

SEQ ID NO: 4139656 - RNA, 24 nt, Yersinia pestis
ugcaaguguaugaguaucaauauu

SEQ ID NO: 4139657 - RNA, 14 nt, Yersinia pestis
ugcaauaagccaga

SEQ ID NO: 4139658 - RNA, 16 nt, Yersinia pestis
ugcaauagcuagcccc

SEQ ID NO: 4139659 - RNA, 13 nt, Yersinia pestis
ugcaauagcucau

SEQ ID NO: 4139660 - RNA, 18 nt, Yersinia pestis
ugcaaucagaggccauca

SEQ ID NO: 4139661 - RNA, 12 nt, Yersinia pestis
ugcaaucaugau

SEQ ID NO: 4139662 - RNA, 13 nt, Yersinia pestis
ugcaauccgcuga

SEQ ID NO: 4139663 - RNA, 19 nt, Yersinia pestis
ugcaauccgcugacauugc

SEQ ID NO: 4139664 - RNA, 14 nt, Yersinia pestis
ugcaaugcccagag

SEQ ID NO: 4139665 - RNA, 15 nt, Yersinia pestis
ugcaaugcuuauuuc

SEQ ID NO: 4139666 - RNA, 21 nt, Yersinia pestis
ugcaauggcuggcaaggcacg

SEQ ID NO: 4139667 - RNA, 15 nt, Yersinia pestis
ugcaauuguuuuacg

SEQ ID NO: 4139668 - RNA, 20 nt, Yersinia pestis
ugcaauuuuuagccaaauag

SEQ ID NO: 4139669 - RNA, 23 nt, Yersinia pestis
ugcacaaauaugaagaugcuuca

SEQ ID NO: 4139670 - RNA, 20 nt, Yersinia pestis
ugcacaaucucguuaucagc

SEQ ID NO: 4139671 - RNA, 21 nt, Yersinia pestis
ugcacaaucucguuaucagcc

SEQ ID NO: 4139672 - RNA, 22 nt, Yersinia pestis
ugcacacgggcgguaaucugcg

SEQ ID NO: 4139673 - RNA, 20 nt, Yersinia pestis
ugcacagguaguaagcaugc

SEQ ID NO: 4139674 - RNA, 22 nt, Yersinia pestis
ugcacaguaggcugaaggccug

SEQ ID NO: 4139675 - RNA, 18 nt, Yersinia pestis
ugcacaguugucugaggc

SEQ ID NO: 4139676 - RNA, 14 nt, Yersinia pestis
ugcacaucaaguac

SEQ ID NO: 4139677 - RNA, 21 nt, Yersinia pestis
ugcacaucaaguacuucaauu

SEQ ID NO: 4139678 - RNA, 11 nt, Yersinia pestis
ugcacaucauu

SEQ ID NO: 4139679 - RNA, 17 nt, Yersinia pestis
ugcaccaauaacugccc

SEQ ID NO: 4139680 - RNA, 22 nt, Yersinia pestis
ugcaccaaugacuaauugugca

SEQ ID NO: 4139681 - RNA, 23 nt, Yersinia pestis
ugcaccgcugauaaccagcagcu

SEQ ID NO: 4139682 - RNA, 14 nt, Yersinia pestis
ugcaccguaacuuc

SEQ ID NO: 4139683 - RNA, 19 nt, Yersinia pestis
ugcaccuaacaaacguuca

SEQ ID NO: 4139684 - RNA, 20 nt, Yersinia pestis
ugcaccucugcugaugucag

SEQ ID NO: 4139685 - RNA, 20 nt, Yersinia pestis
ugcacgacaacaaagccgcu

SEQ ID NO: 4139686 - RNA, 11 nt, Yersinia pestis
ugcacgauacc

SEQ ID NO: 4139687 - RNA, 15 nt, Yersinia pestis
ugcacggcagugauc

SEQ ID NO: 4139688 - RNA, 13 nt, Yersinia pestis
ugcacgguauagc

SEQ ID NO: 4139689 - RNA, 19 nt, Yersinia pestis
ugcacucguuguauuuucc

SEQ ID NO: 4139690 - RNA, 20 nt, Yersinia pestis
ugcacucguuguauuuuccu

SEQ ID NO: 4139691 - RNA, 10 nt, Yersinia pestis
ugcagaaaau

SEQ ID NO: 4139692 - RNA, 16 nt, Yersinia pestis
ugcagaaaguaaucuu

SEQ ID NO: 4139693 - RNA, 18 nt, Yersinia pestis
ugcagaacaaaagugaaa

SEQ ID NO: 4139694 - RNA, 17 nt, Yersinia pestis
ugcagaaucacuggcag

SEQ ID NO: 4139695 - RNA, 23 nt, Yersinia pestis
ugcagaaucacuggcagaaguug

SEQ ID NO: 4139696 - RNA, 13 nt, Yersinia pestis
ugcagaccaauca

SEQ ID NO: 4139697 - RNA, 14 nt, Yersinia pestis
ugcagacucuuaua

SEQ ID NO: 4139698 - RNA, 15 nt, Yersinia pestis
ugcagagaugcagag

SEQ ID NO: 4139699 - RNA, 15 nt, Yersinia pestis
ugcagauaaacuccg

SEQ ID NO: 4139700 - RNA, 17 nt, Yersinia pestis
ugcagauaccacaucaa

SEQ ID NO: 4139701 - RNA, 16 nt, Yersinia pestis
ugcagaucaaucgcau

SEQ ID NO: 4139702 - RNA, 17 nt, Yersinia pestis
ugcagaucggcauuauu

SEQ ID NO: 4139703 - RNA, 20 nt, Yersinia pestis
ugcagcaacaggguauuggc

SEQ ID NO: 4139704 - RNA, 21 nt, Yersinia pestis
ugcagcauuuucagcaacuga

SEQ ID NO: 4139705 - RNA, 17 nt, Yersinia pestis
ugcagcgauauacauca

SEQ ID NO: 4139706 - RNA, 20 nt, Yersinia pestis
ugcagcgcuauuuguaucaa

SEQ ID NO: 4139707 - RNA, 20 nt, Yersinia pestis
ugcagcggaugauaaauauc

SEQ ID NO: 4139708 - RNA, 21 nt, Yersinia pestis
ugcagcucaaagaccacauca

SEQ ID NO: 4139709 - RNA, 21 nt, Yersinia pestis
ugcaggaucuggauuuuccag

SEQ ID NO: 4139710 - RNA, 19 nt, Yersinia pestis
ugcaggcccugguugcagc

SEQ ID NO: 4139711 - RNA, 17 nt, Yersinia pestis
ugcaggcugucaggaac

SEQ ID NO: 4139712 - RNA, 15 nt, Yersinia pestis
ugcagggccuuuagc

SEQ ID NO: 4139713 - RNA, 16 nt, Yersinia pestis
ugcagggccuuuagcg

SEQ ID NO: 4139714 - RNA, 20 nt, Yersinia pestis
ugcaggggaguauugcugag

SEQ ID NO: 4139715 - RNA, 17 nt, Yersinia pestis
ugcagguuuugccagau

SEQ ID NO: 4139716 - RNA, 15 nt, Yersinia pestis
ugcaguaacauaauc

SEQ ID NO: 4139717 - RNA, 13 nt, Yersinia pestis
ugcaguaaccagu

SEQ ID NO: 4139718 - RNA, 14 nt, Yersinia pestis
ugcaguacagauaa

SEQ ID NO: 4139719 - RNA, 16 nt, Yersinia pestis
ugcaguagggcgcuga

SEQ ID NO: 4139720 - RNA, 17 nt, Yersinia pestis
ugcaguagggcgcugau

SEQ ID NO: 4139721 - RNA, 16 nt, Yersinia pestis
ugcaguaucuggguga

SEQ ID NO: 4139722 - RNA, 13 nt, Yersinia pestis
ugcagucgcuuca

SEQ ID NO: 4139723 - RNA, 15 nt, Yersinia pestis
ugcagucuccaucac

SEQ ID NO: 4139724 - RNA, 17 nt, Yersinia pestis
ugcaguuaaggcuggcu

SEQ ID NO: 4139725 - RNA, 22 nt, Yersinia pestis
ugcaguuaagguuagcuaugca

SEQ ID NO: 4139726 - RNA, 14 nt, Yersinia pestis
ugcaguuaaugaca

SEQ ID NO: 4139727 - RNA, 14 nt, Yersinia pestis
ugcauaaucgcguu

SEQ ID NO: 4139728 - RNA, 18 nt, Yersinia pestis
ugcauacucaggcccuga

SEQ ID NO: 4139729 - RNA, 19 nt, Yersinia pestis
ugcauagcgugauuuuuau

SEQ ID NO: 4139730 - RNA, 14 nt, Yersinia pestis
ugcauagcuaaccu

SEQ ID NO: 4139731 - RNA, 17 nt, Yersinia pestis
ugcauagcuaaccuuaa

SEQ ID NO: 4139732 - RNA, 14 nt, Yersinia pestis
ugcauauaaaacac

SEQ ID NO: 4139733 - RNA, 19 nt, Yersinia pestis
ugcauauaaaacacgcaua

SEQ ID NO: 4139734 - RNA, 22 nt, Yersinia pestis
ugcauauguagggguacagcag

SEQ ID NO: 4139735 - RNA, 14 nt, Yersinia pestis
ugcauauuucucuu

SEQ ID NO: 4139736 - RNA, 17 nt, Yersinia pestis
ugcaucaauaaauagag

SEQ ID NO: 4139737 - RNA, 13 nt, Yersinia pestis
ugcaucagcagug

SEQ ID NO: 4139738 - RNA, 17 nt, Yersinia pestis
ugcaucaucacauucaa

SEQ ID NO: 4139739 - RNA, 21 nt, Yersinia pestis
ugcauccacuuuuucucuccu

SEQ ID NO: 4139740 - RNA, 18 nt, Yersinia pestis
ugcauccgcaaaaugggu

SEQ ID NO: 4139741 - RNA, 17 nt, Yersinia pestis
ugcaucggauugcaaca

SEQ ID NO: 4139742 - RNA, 17 nt, Yersinia pestis
ugcaucgucaugauuga

SEQ ID NO: 4139743 - RNA, 21 nt, Yersinia pestis
ugcaucuuuaauuaaugguca

SEQ ID NO: 4139744 - RNA, 17 nt, Yersinia pestis
ugcauguagcugcagcc

SEQ ID NO: 4139745 - RNA, 18 nt, Yersinia pestis
ugcauuaaaauaacaauu

SEQ ID NO: 4139746 - RNA, 13 nt, Yersinia pestis
ugccuguucucuc

SEQ ID NO: 4139747 - RNA, 18 nt, Yersinia pestis
ugccuuacaaagcauuuc

SEQ ID NO: 4139748 - RNA, 19 nt, Yersinia pestis
ugccuuagguaagucagcg

SEQ ID NO: 4139749 - RNA, 13 nt, Yersinia pestis
ugccuuaucaauc

SEQ ID NO: 4139750 - RNA, 15 nt, Yersinia pestis
ugccuuauccccgcc

SEQ ID NO: 4139751 - RNA, 15 nt, Yersinia pestis
ugccuuccugccacu

SEQ ID NO: 4139752 - RNA, 22 nt, Yersinia pestis
ugccuucuccuuucuguuccau

SEQ ID NO: 4139753 - RNA, 15 nt, Yersinia pestis
ugccuugccauccau

SEQ ID NO: 4139754 - RNA, 20 nt, Yersinia pestis
ugccuugcugcaacgccaau

SEQ ID NO: 4139755 - RNA, 16 nt, Yersinia pestis
ugccuuggucucagaa

SEQ ID NO: 4139756 - RNA, 20 nt, Yersinia pestis
ugccuuggucucagaacaag

SEQ ID NO: 4139757 - RNA, 14 nt, Yersinia pestis
ugccuuuaauggca

SEQ ID NO: 4139758 - RNA, 14 nt, Yersinia pestis
ugccuuuucuuccg

SEQ ID NO: 4139759 - RNA, 14 nt, Yersinia pestis
ugcgaaaacggcaa

SEQ ID NO: 4139760 - RNA, 18 nt, Yersinia pestis
ugcgaaagacggccaacu

SEQ ID NO: 4139761 - RNA, 22 nt, Yersinia pestis
ugcgaaagacggccaacugcug

SEQ ID NO: 4139762 - RNA, 16 nt, Yersinia pestis
ugcgaagcuuuuauug

SEQ ID NO: 4139763 - RNA, 19 nt, Yersinia pestis
ugcgaauauugcguuaccu

SEQ ID NO: 4139764 - RNA, 15 nt, Yersinia pestis
ugcgacaaugccccc

SEQ ID NO: 4139765 - RNA, 16 nt, Yersinia pestis
ugcgacaaugccccca

SEQ ID NO: 4139766 - RNA, 20 nt, Yersinia pestis
ugcgacaaugcccccagcgg

SEQ ID NO: 4139767 - RNA, 13 nt, Yersinia pestis
ugcgacaauuucc

SEQ ID NO: 4139768 - RNA, 17 nt, Yersinia pestis
ugcgacaccugcuauca

SEQ ID NO: 4139769 - RNA, 17 nt, Yersinia pestis
ugcgacacgcucaucca

SEQ ID NO: 4139770 - RNA, 21 nt, Yersinia pestis
ugcgacaggcucagcacaaac

SEQ ID NO: 4139771 - RNA, 18 nt, Yersinia pestis
ugcgaccaaaagccaccg

SEQ ID NO: 4139772 - RNA, 19 nt, Yersinia pestis
ugcgaccaaggcucuggca

SEQ ID NO: 4139773 - RNA, 18 nt, Yersinia pestis
ugcgagcaaggcauccac

SEQ ID NO: 4139774 - RNA, 23 nt, Yersinia pestis
ugcgauacaccauuuccaggcua

SEQ ID NO: 4139775 - RNA, 18 nt, Yersinia pestis
ugcgauccuggcguaaua

SEQ ID NO: 4139776 - RNA, 20 nt, Yersinia pestis
ugcgauuucacggauaucaa

SEQ ID NO: 4139777 - RNA, 19 nt, Yersinia pestis
ugcgcaagcgcugcuuuaa

SEQ ID NO: 4139778 - RNA, 23 nt, Yersinia pestis
ugcgcaggcggucaaacuccccu

SEQ ID NO: 4139779 - RNA, 23 nt, Yersinia pestis
ugcgcaguaaauucaucacuuag

SEQ ID NO: 4139780 - RNA, 14 nt, Yersinia pestis
ugcgcaucagccag

SEQ ID NO: 4139781 - RNA, 16 nt, Yersinia pestis
ugcgcauuucacccuc

SEQ ID NO: 4139782 - RNA, 18 nt, Yersinia pestis
ugcgcauuucacccucug

SEQ ID NO: 4139783 - RNA, 21 nt, Yersinia pestis
ugcgcauuucacccucugcag

SEQ ID NO: 4139784 - RNA, 23 nt, Yersinia pestis
ugcgcauuucacccucugcagcu

SEQ ID NO: 4139785 - RNA, 22 nt, Yersinia pestis
ugcgccauuaaggccacugacg

SEQ ID NO: 4139786 - RNA, 21 nt, Yersinia pestis
ugcgccuguuagggcgcggcu

SEQ ID NO: 4139787 - RNA, 22 nt, Yersinia pestis
ugcgccuguuagggcgcggcug

SEQ ID NO: 4139788 - RNA, 23 nt, Yersinia pestis
ugcgccuucgaaacugaucacug

SEQ ID NO: 4139789 - RNA, 16 nt, Yersinia pestis
ugcgcgaaauauugcc

SEQ ID NO: 4139790 - RNA, 17 nt, Yersinia pestis
ugcgcgaccaaguuuga

SEQ ID NO: 4139791 - RNA, 19 nt, Yersinia pestis
ugcgcgguugucggcauaa

SEQ ID NO: 4139792 - RNA, 23 nt, Yersinia pestis
ugcgcucaaccgaagcugcggcu

SEQ ID NO: 4139793 - RNA, 20 nt, Yersinia pestis
ugcgcuccacgccccaacgg

SEQ ID NO: 4139794 - RNA, 19 nt, Yersinia pestis
ugcgcucuguauuguaaua

SEQ ID NO: 4139795 - RNA, 22 nt, Yersinia pestis
ugcgcucuugcaugugaucacg

SEQ ID NO: 4139796 - RNA, 16 nt, Yersinia pestis
ugcgcugagugauagu

SEQ ID NO: 4139797 - RNA, 12 nt, Yersinia pestis
ugcgcuggcucu

SEQ ID NO: 4139798 - RNA, 16 nt, Yersinia pestis
ugcgcuucaucaauau

SEQ ID NO: 4139799 - RNA, 23 nt, Yersinia pestis
ugcgcuuucagcacgcuuuccag

SEQ ID NO: 4139800 - RNA, 14 nt, Yersinia pestis
ugcgcuuugcagua

SEQ ID NO: 4139801 - RNA, 23 nt, Yersinia pestis
ugcggaagcgccgacacccagcc

SEQ ID NO: 4139802 - RNA, 19 nt, Yersinia pestis
ugcggaguaacacuucaga

SEQ ID NO: 4139803 - RNA, 18 nt, Yersinia pestis
ugcggauauaguuuuuac

SEQ ID NO: 4139804 - RNA, 21 nt, Yersinia pestis
ugcggauucacccauuaauag

SEQ ID NO: 4139805 - RNA, 21 nt, Yersinia pestis
ugcggauuuacucgccuuuca

SEQ ID NO: 4139806 - RNA, 19 nt, Yersinia pestis
ugcggcaauaagcauuauu

SEQ ID NO: 4139807 - RNA, 22 nt, Yersinia pestis
ugcggcauaaauucuagcaaca

SEQ ID NO: 4139808 - RNA, 20 nt, Yersinia pestis
ugcggccacucgcaucgccu

SEQ ID NO: 4139809 - RNA, 22 nt, Yersinia pestis
ugcggccagccuugagccugca

SEQ ID NO: 4139810 - RNA, 20 nt, Yersinia pestis
ugcggccaucuaacugcaca

SEQ ID NO: 4139811 - RNA, 16 nt, Yersinia pestis
ugcggcuuucugccug

SEQ ID NO: 4139812 - RNA, 19 nt, Yersinia pestis
ugcggcuuucugccugugg

SEQ ID NO: 4139813 - RNA, 13 nt, Yersinia pestis
ugcgggaauagcu

SEQ ID NO: 4139814 - RNA, 19 nt, Yersinia pestis
ugcgggcuaaaacuggcac

SEQ ID NO: 4139815 - RNA, 15 nt, Yersinia pestis
ugcggguuagcggca

SEQ ID NO: 4139816 - RNA, 19 nt, Yersinia pestis
ugcggguucaagucccgcc

SEQ ID NO: 4139817 - RNA, 18 nt, Yersinia pestis
ugcgguagaccaccaacu

SEQ ID NO: 4139818 - RNA, 13 nt, Yersinia pestis
ugcgguaguucag

SEQ ID NO: 4139819 - RNA, 16 nt, Yersinia pestis
ugcgguggccgccuua

SEQ ID NO: 4139820 - RNA, 16 nt, Yersinia pestis
ugcgguuauuugcuau

SEQ ID NO: 4139821 - RNA, 20 nt, Yersinia pestis
ugcgguuuguuugcaucugg

SEQ ID NO: 4139822 - RNA, 18 nt, Yersinia pestis
ugcguaauaggcugcgca

SEQ ID NO: 4139823 - RNA, 23 nt, Yersinia pestis
ugcguaauaggcugcgcauuuca

SEQ ID NO: 4139824 - RNA, 18 nt, Yersinia pestis
ugcguaauuacccaagau

SEQ ID NO: 4139825 - RNA, 19 nt, Yersinia pestis
ugcguacgccaacuuuugc

SEQ ID NO: 4139826 - RNA, 14 nt, Yersinia pestis
ugcgucaccaggcc

SEQ ID NO: 4139827 - RNA, 23 nt, Yersinia pestis
ugcgugacauacuuugccuuauc

SEQ ID NO: 4139828 - RNA, 23 nt, Yersinia pestis
ugcgugcaauaaagcgauaaaua

SEQ ID NO: 4139829 - RNA, 21 nt, Yersinia pestis
ugcguguggucagcacaaaca

SEQ ID NO: 4139830 - RNA, 15 nt, Yersinia pestis
ugcguuggcugccuu

SEQ ID NO: 4139831 - RNA, 14 nt, Yersinia pestis
ugcguuuagcuucc

SEQ ID NO: 4139832 - RNA, 19 nt, Yersinia pestis
ugcguuuccgggcaauaau

SEQ ID NO: 4139833 - RNA, 19 nt, Yersinia pestis
ugcuaacaacagucaauau

SEQ ID NO: 4139834 - RNA, 18 nt, Yersinia pestis
ugcuaacuuguucagaaa

SEQ ID NO: 4139835 - RNA, 16 nt, Yersinia pestis
ugcuaauaccacaaca

SEQ ID NO: 4139836 - RNA, 13 nt, Yersinia pestis
ugcuacagcagca

SEQ ID NO: 4139837 - RNA, 14 nt, Yersinia pestis
ugcuacagcagcag

SEQ ID NO: 4139838 - RNA, 17 nt, Yersinia pestis
ugcuacuuaauaucuaa

SEQ ID NO: 4139839 - RNA, 13 nt, Yersinia pestis
ugcuagugauaaa

SEQ ID NO: 4139840 - RNA, 23 nt, Yersinia pestis
ugcuagugcugguugagauuauc

SEQ ID NO: 4139841 - RNA, 23 nt, Yersinia pestis
ugcuauagaaaacaaaaaguuaa

SEQ ID NO: 4139842 - RNA, 19 nt, Yersinia pestis
ugcuauccucuuaaugucu

SEQ ID NO: 4139843 - RNA, 18 nt, Yersinia pestis
ugcuaucggcggagagaa

SEQ ID NO: 4139844 - RNA, 14 nt, Yersinia pestis
ugcuauuaaacauu

SEQ ID NO: 4139845 - RNA, 16 nt, Yersinia pestis
ugcuauuaaacauuua

SEQ ID NO: 4139846 - RNA, 13 nt, Yersinia pestis
ugcuauucauaaa

SEQ ID NO: 4139847 - RNA, 18 nt, Yersinia pestis
ugcuauucauaaaucagu

SEQ ID NO: 4139848 - RNA, 23 nt, Yersinia pestis
ugcuauucauaaaucaguacuau

SEQ ID NO: 4139849 - RNA, 15 nt, Yersinia pestis
ugcuauuuuauaucg

SEQ ID NO: 4139850 - RNA, 15 nt, Yersinia pestis
ugcucaaacucagca

SEQ ID NO: 4139851 - RNA, 11 nt, Yersinia pestis
ugcucaacaua

SEQ ID NO: 4139852 - RNA, 12 nt, Yersinia pestis
ugcucaacugcu

SEQ ID NO: 4139853 - RNA, 13 nt, Yersinia pestis
ugcucaacugcuc

SEQ ID NO: 4139854 - RNA, 15 nt, Yersinia pestis
ugcucaacugcucaa

SEQ ID NO: 4139855 - RNA, 18 nt, Yersinia pestis
ugcucaaucgaaugcaau

SEQ ID NO: 4139856 - RNA, 19 nt, Yersinia pestis
ugcucacccauuuuauccu

SEQ ID NO: 4139857 - RNA, 23 nt, Yersinia pestis
ugcucacccauuuuauccucuuc

SEQ ID NO: 4139858 - RNA, 15 nt, Yersinia pestis
ugcucacgcaaauaa

SEQ ID NO: 4139859 - RNA, 21 nt, Yersinia pestis
ugcucacgguagguuucuggg

SEQ ID NO: 4139860 - RNA, 15 nt, Yersinia pestis
ugcucacuacccuua

SEQ ID NO: 4139861 - RNA, 21 nt, Yersinia pestis
ugcucacuggaguuaaauccc

SEQ ID NO: 4139862 - RNA, 15 nt, Yersinia pestis
ugcucagggccacuu

SEQ ID NO: 4139863 - RNA, 16 nt, Yersinia pestis
ugcucaucaaccucag

SEQ ID NO: 4139864 - RNA, 18 nt, Yersinia pestis
ugcucaucaaccucagcc

SEQ ID NO: 4139865 - RNA, 17 nt, Yersinia pestis
ugcucaucaaguauuuu

SEQ ID NO: 4139866 - RNA, 23 nt, Yersinia pestis
ugcucauguucgcacugcucugc

SEQ ID NO: 4139867 - RNA, 14 nt, Yersinia pestis
uggaggaaggcggu

SEQ ID NO: 4139868 - RNA, 20 nt, Yersinia pestis
uggaggaaggcgguuaucug

SEQ ID NO: 4139869 - RNA, 23 nt, Yersinia pestis
uggaggaaggcgguuaucuggaa

SEQ ID NO: 4139870 - RNA, 19 nt, Yersinia pestis
uggagguguauuuuuaugg

SEQ ID NO: 4139871 - RNA, 19 nt, Yersinia pestis
uggagucgcauguaggcag

SEQ ID NO: 4139872 - RNA, 14 nt, Yersinia pestis
uggauaaaaacauu

SEQ ID NO: 4139873 - RNA, 14 nt, Yersinia pestis
uggauaaaauauua

SEQ ID NO: 4139874 - RNA, 19 nt, Yersinia pestis
uggauaacccccugacauu

SEQ ID NO: 4139875 - RNA, 17 nt, Yersinia pestis
uggauaaggugaugaau

SEQ ID NO: 4139876 - RNA, 19 nt, Yersinia pestis
uggauacugcauuucaaca

SEQ ID NO: 4139877 - RNA, 21 nt, Yersinia pestis
uggauacugcauuucaacaaa

SEQ ID NO: 4139878 - RNA, 22 nt, Yersinia pestis
uggauacugcauuucaacaaaa

SEQ ID NO: 4139879 - RNA, 14 nt, Yersinia pestis
uggauauauuuaca

SEQ ID NO: 4139880 - RNA, 14 nt, Yersinia pestis
uggaucauggcuuu

SEQ ID NO: 4139881 - RNA, 18 nt, Yersinia pestis
uggaucucuccagccugc

SEQ ID NO: 4139882 - RNA, 16 nt, Yersinia pestis
uggauuaacuucuucc

SEQ ID NO: 4139883 - RNA, 17 nt, Yersinia pestis
uggauuaaguccaagaa

SEQ ID NO: 4139884 - RNA, 15 nt, Yersinia pestis
uggauugagccaccg

SEQ ID NO: 4139885 - RNA, 14 nt, Yersinia pestis
uggcaaaaagaauu

SEQ ID NO: 4139886 - RNA, 18 nt, Yersinia pestis
uggcaaaaauaaucaacg

SEQ ID NO: 4139887 - RNA, 18 nt, Yersinia pestis
uggcaaaacucaggugag

SEQ ID NO: 4139888 - RNA, 15 nt, Yersinia pestis
uggcaaacucagcca

SEQ ID NO: 4139889 - RNA, 12 nt, Yersinia pestis
uggcaaaggaua

SEQ ID NO: 4139890 - RNA, 18 nt, Yersinia pestis
uggcaaccccuaauccag

SEQ ID NO: 4139891 - RNA, 19 nt, Yersinia pestis
uggcaaccccuaauccagc

SEQ ID NO: 4139892 - RNA, 19 nt, Yersinia pestis
uggcaaccccugccaauau

SEQ ID NO: 4139893 - RNA, 14 nt, Yersinia pestis
uggcaacgacuggg

SEQ ID NO: 4139894 - RNA, 19 nt, Yersinia pestis
uggcaacucuagcgccagc

SEQ ID NO: 4139895 - RNA, 14 nt, Yersinia pestis
uggcaagguaaacg

SEQ ID NO: 4139896 - RNA, 17 nt, Yersinia pestis
uggcaagguaaacgggu

SEQ ID NO: 4139897 - RNA, 18 nt, Yersinia pestis
uggcaauaauucagauga

SEQ ID NO: 4139898 - RNA, 13 nt, Yersinia pestis
uggcaaucauggg

SEQ ID NO: 4139899 - RNA, 16 nt, Yersinia pestis
uggcaauccagcgccu

SEQ ID NO: 4139900 - RNA, 15 nt, Yersinia pestis
uggcaaucucuugau

SEQ ID NO: 4139901 - RNA, 17 nt, Yersinia pestis
uggcaccauuugcccug

SEQ ID NO: 4139902 - RNA, 19 nt, Yersinia pestis
uggcaccguggauaaacaa

SEQ ID NO: 4139903 - RNA, 16 nt, Yersinia pestis
uggcacugauuuuuuc

SEQ ID NO: 4139904 - RNA, 19 nt, Yersinia pestis
uggcacuggaaacaaaacc

SEQ ID NO: 4139905 - RNA, 23 nt, Yersinia pestis
uggcacuggaaacaaaaccuaac

SEQ ID NO: 4139906 - RNA, 13 nt, Yersinia pestis
uggcagaaaucag

SEQ ID NO: 4139907 - RNA, 23 nt, Yersinia pestis
uggcaggccccaucauaaaggcu

SEQ ID NO: 4139908 - RNA, 15 nt, Yersinia pestis
uggcauaaccaauca

SEQ ID NO: 4139909 - RNA, 16 nt, Yersinia pestis
uggcauaaccaaucau

SEQ ID NO: 4139910 - RNA, 17 nt, Yersinia pestis
uggcauccucaggaugg

SEQ ID NO: 4139911 - RNA, 14 nt, Yersinia pestis
uggcaugccaauua

SEQ ID NO: 4139912 - RNA, 16 nt, Yersinia pestis
uggcauggauaucagc

SEQ ID NO: 4139913 - RNA, 19 nt, Yersinia pestis
uggcauuagacauucaagc

SEQ ID NO: 4139914 - RNA, 12 nt, Yersinia pestis
uggcauuuucag

SEQ ID NO: 4139915 - RNA, 14 nt, Yersinia pestis
uggccaacugcgcc

SEQ ID NO: 4139916 - RNA, 15 nt, Yersinia pestis
uggccaacugcgccu

SEQ ID NO: 4139917 - RNA, 23 nt, Yersinia pestis
uggccacccaacgcaauugcacc

SEQ ID NO: 4139918 - RNA, 19 nt, Yersinia pestis
uggccagcgggaaucaaac

SEQ ID NO: 4139919 - RNA, 15 nt, Yersinia pestis
uggccaguaaaaccu

SEQ ID NO: 4139920 - RNA, 18 nt, Yersinia pestis
uggccaguugccacucau

SEQ ID NO: 4139921 - RNA, 14 nt, Yersinia pestis
uggccaguuuuagu

SEQ ID NO: 4139922 - RNA, 14 nt, Yersinia pestis
uggccaugaaucaa

SEQ ID NO: 4139923 - RNA, 18 nt, Yersinia pestis
uggccaugaaucaaauua

SEQ ID NO: 4139924 - RNA, 13 nt, Yersinia pestis
uggccauguugug

SEQ ID NO: 4139925 - RNA, 18 nt, Yersinia pestis
uggccauuaaccuaaaaa

SEQ ID NO: 4139926 - RNA, 19 nt, Yersinia pestis
uggcccaagccauccuuuu

SEQ ID NO: 4139927 - RNA, 16 nt, Yersinia pestis
uggcccaaugcuguca

SEQ ID NO: 4139928 - RNA, 18 nt, Yersinia pestis
uggcccauaacaauuaau

SEQ ID NO: 4139929 - RNA, 14 nt, Yersinia pestis
uggcccaucuaugg

SEQ ID NO: 4139930 - RNA, 21 nt, Yersinia pestis
uggcccaucuauggaccucac

SEQ ID NO: 4139931 - RNA, 23 nt, Yersinia pestis
uggccccuaaugcgcucaccaag

SEQ ID NO: 4139932 - RNA, 13 nt, Yersinia pestis
uggcccgcugguc

SEQ ID NO: 4139933 - RNA, 16 nt, Yersinia pestis
uggcccggaagguuuc

SEQ ID NO: 4139934 - RNA, 13 nt, Yersinia pestis
uggcccucugccg

SEQ ID NO: 4139935 - RNA, 14 nt, Yersinia pestis
uggccgaaauggaa

SEQ ID NO: 4139936 - RNA, 17 nt, Yersinia pestis
uggccgacauuauguuc

SEQ ID NO: 4139937 - RNA, 14 nt, Yersinia pestis
uggccgacugacac

SEQ ID NO: 4139938 - RNA, 13 nt, Yersinia pestis
uggccgcuacugg

SEQ ID NO: 4139939 - RNA, 18 nt, Yersinia pestis
uggccuggcauuuuacug

SEQ ID NO: 4139940 - RNA, 15 nt, Yersinia pestis
uggccugugaugaug

SEQ ID NO: 4139941 - RNA, 21 nt, Yersinia pestis
uggccuuagcacguuuuucag

SEQ ID NO: 4139942 - RNA, 14 nt, Yersinia pestis
uggcgaaaaucaag

SEQ ID NO: 4139943 - RNA, 22 nt, Yersinia pestis
uggcgauuuaauguauucaagc

SEQ ID NO: 4139944 - RNA, 12 nt, Yersinia pestis
uggcgauuucag

SEQ ID NO: 4139945 - RNA, 20 nt, Yersinia pestis
uggcgauuuugcggcugagu

SEQ ID NO: 4139946 - RNA, 13 nt, Yersinia pestis
uggcgcaauggcg

SEQ ID NO: 4139947 - RNA, 14 nt, Yersinia pestis
uggcgcacauuaca

SEQ ID NO: 4139948 - RNA, 23 nt, Yersinia pestis
uggcgcauccccacuuguaccug

SEQ ID NO: 4139949 - RNA, 23 nt, Yersinia pestis
uggcgccauuuuuauaucagauu

SEQ ID NO: 4139950 - RNA, 15 nt, Yersinia pestis
uggcgcgccacuucu

SEQ ID NO: 4139951 - RNA, 21 nt, Yersinia pestis
uggcggcacgcguugguuguc

SEQ ID NO: 4139952 - RNA, 19 nt, Yersinia pestis
uggcggcguaaaucaugca

SEQ ID NO: 4139953 - RNA, 13 nt, Yersinia pestis
uggcggcuaucua

SEQ ID NO: 4139954 - RNA, 13 nt, Yersinia pestis
uggcggcuugguu

SEQ ID NO: 4139955 - RNA, 19 nt, Yersinia pestis
uggcgggcgcuucgucauu

SEQ ID NO: 4139956 - RNA, 16 nt, Yersinia pestis
uggcggucgcacugug

SEQ ID NO: 4139957 - RNA, 14 nt, Yersinia pestis
uggcguaacugcug

SEQ ID NO: 4139958 - RNA, 15 nt, Yersinia pestis
uggcguuaaucaagc

SEQ ID NO: 4139959 - RNA, 24 nt, Yersinia pestis
uggcguuucugaagaugccaauca

SEQ ID NO: 4139960 - RNA, 16 nt, Yersinia pestis
uggcuaagcaugccgc

SEQ ID NO: 4139961 - RNA, 16 nt, Yersinia pestis
uggcuaauuaauuuaa

SEQ ID NO: 4139962 - RNA, 15 nt, Yersinia pestis
uggcuaauuuuauua

SEQ ID NO: 4139963 - RNA, 22 nt, Yersinia pestis
uggcuacguaaucuuuaccgcu

SEQ ID NO: 4139964 - RNA, 22 nt, Yersinia pestis
uggcuagccugcaccucaucaa

SEQ ID NO: 4139965 - RNA, 23 nt, Yersinia pestis
uggcuagccugcaccucaucaac

SEQ ID NO: 4139966 - RNA, 14 nt, Yersinia pestis
uggcuaucugaaac

SEQ ID NO: 4139967 - RNA, 21 nt, Yersinia pestis
uggcucaauccaaaugacacu

SEQ ID NO: 4139968 - RNA, 21 nt, Yersinia pestis
uggcugaauaucaucuuuuuc

SEQ ID NO: 4139969 - RNA, 18 nt, Yersinia pestis
uggcugaaucguacuucu

SEQ ID NO: 4139970 - RNA, 13 nt, Yersinia pestis
uggcugagagccg

SEQ ID NO: 4139971 - RNA, 21 nt, Yersinia pestis
uggcugcgggugccgcauuac

SEQ ID NO: 4139972 - RNA, 19 nt, Yersinia pestis
uggcuggggcgaugcgagu

SEQ ID NO: 4139973 - RNA, 11 nt, Yersinia pestis
uggcugguuga

SEQ ID NO: 4139974 - RNA, 18 nt, Yersinia pestis
uggcuuaaucgccagcaa

SEQ ID NO: 4139975 - RNA, 17 nt, Yersinia pestis
uggcuuagucauuaaga

SEQ ID NO: 4139976 - RNA, 14 nt, Yersinia pestis
uggcuucuggaugg

SEQ ID NO: 4139977 - RNA, 15 nt, Yersinia pestis
uggcuucuggauggg

SEQ ID NO: 4139978 - RNA, 13 nt, Yersinia pestis
uggcuucuuuuuc

SEQ ID NO: 4139979 - RNA, 22 nt, Yersinia pestis
uggcuugcaaucagaggccauc

SEQ ID NO: 4139980 - RNA, 17 nt, Yersinia pestis
uggcuugcuugauggca

SEQ ID NO: 4139981 - RNA, 20 nt, Yersinia pestis
uggcuugcuugauggcauca

SEQ ID NO: 4139982 - RNA, 23 nt, Yersinia pestis
uggcuuuacggcucaccuggccu

SEQ ID NO: 4139983 - RNA, 13 nt, Yersinia pestis
uggcuuuauuaua

SEQ ID NO: 4139984 - RNA, 13 nt, Yersinia pestis
uggcuuucgcuuu

SEQ ID NO: 4139985 - RNA, 16 nt, Yersinia pestis
uggcuuucucaacagc

SEQ ID NO: 4139986 - RNA, 15 nt, Yersinia pestis
uggcuuucucccauu

SEQ ID NO: 4139987 - RNA, 18 nt, Yersinia pestis
uggcuuucucccauucac

SEQ ID NO: 4139988 - RNA, 16 nt, Yersinia pestis
uggcuuuuucuuccag

SEQ ID NO: 4139989 - RNA, 17 nt, Yersinia pestis
uggcuuuuucuuccagc

SEQ ID NO: 4139990 - RNA, 14 nt, Yersinia pestis
ugguuggcuaucaa

SEQ ID NO: 4139991 - RNA, 18 nt, Yersinia pestis
ugguugguggcuuuacca

SEQ ID NO: 4139992 - RNA, 23 nt, Yersinia pestis
ugguuguuuuuucccagaacaua

SEQ ID NO: 4139993 - RNA, 14 nt, Yersinia pestis
ugguuuauaacaag

SEQ ID NO: 4139994 - RNA, 12 nt, Yersinia pestis
ugguuucaaacu

SEQ ID NO: 4139995 - RNA, 16 nt, Yersinia pestis
ugguuugaauucaaga

SEQ ID NO: 4139996 - RNA, 17 nt, Yersinia pestis
ugguuugaauucaagaa

SEQ ID NO: 4139997 - RNA, 17 nt, Yersinia pestis
ugguuugauagcaaaac

SEQ ID NO: 4139998 - RNA, 12 nt, Yersinia pestis
ugguuuggccau

SEQ ID NO: 4139999 - RNA, 13 nt, Yersinia pestis
ugguuuggccauu

SEQ ID NO: 4140000 - RNA, 17 nt, Yersinia pestis
ugguuuucuauuuccac

SEQ ID NO: 4140001 - RNA, 19 nt, Yersinia pestis
ugguuuucuauuuccacaa

SEQ ID NO: 4140002 - RNA, 14 nt, Yersinia pestis
ugguuuuguuaaua

SEQ ID NO: 4140003 - RNA, 12 nt, Yersinia pestis
ugguuuuuauug

SEQ ID NO: 4140004 - RNA, 21 nt, Yersinia pestis
ugguuuuuuaaaaaagugcua

SEQ ID NO: 4140005 - RNA, 20 nt, Yersinia pestis
uguaaaaaccaucugaugca

SEQ ID NO: 4140006 - RNA, 20 nt, Yersinia pestis
uguaaaacgaguaaauacaa

SEQ ID NO: 4140007 - RNA, 22 nt, Yersinia pestis
uguaaaggcaaagaagaauaag

SEQ ID NO: 4140008 - RNA, 13 nt, Yersinia pestis
uguaaauauaaaa

SEQ ID NO: 4140009 - RNA, 15 nt, Yersinia pestis
uguaaauauaaaaua

SEQ ID NO: 4140010 - RNA, 13 nt, Yersinia pestis
uguaaauauccug

SEQ ID NO: 4140011 - RNA, 18 nt, Yersinia pestis
uguaaauguacagucauu

SEQ ID NO: 4140012 - RNA, 13 nt, Yersinia pestis
uguaaauuaauac

SEQ ID NO: 4140013 - RNA, 19 nt, Yersinia pestis
uguaaauuaauacaccggg

SEQ ID NO: 4140014 - RNA, 16 nt, Yersinia pestis
uguaacaacugaacca

SEQ ID NO: 4140015 - RNA, 20 nt, Yersinia pestis
uguaacaauccgaacaaaau

SEQ ID NO: 4140016 - RNA, 22 nt, Yersinia pestis
uguaacagagcagaaagcagca

SEQ ID NO: 4140017 - RNA, 22 nt, Yersinia pestis
uguaacgaugaauuaucaaccg

SEQ ID NO: 4140018 - RNA, 17 nt, Yersinia pestis
uguaacgggcaauggua

SEQ ID NO: 4140019 - RNA, 14 nt, Yersinia pestis
uguaagauaauucg

SEQ ID NO: 4140020 - RNA, 21 nt, Yersinia pestis
uguaagcaccagcaccaacaa

SEQ ID NO: 4140021 - RNA, 15 nt, Yersinia pestis
uguaagcaucuuuuc

SEQ ID NO: 4140022 - RNA, 21 nt, Yersinia pestis
uguaagccagauugugcggcu

SEQ ID NO: 4140023 - RNA, 18 nt, Yersinia pestis
uguaauaaucuaaauuaa

SEQ ID NO: 4140024 - RNA, 19 nt, Yersinia pestis
uguaauaaucuaaauuaau

SEQ ID NO: 4140025 - RNA, 13 nt, Yersinia pestis
uguaaugccuggu

SEQ ID NO: 4140026 - RNA, 18 nt, Yersinia pestis
uguaauuauauuuaauuu

SEQ ID NO: 4140027 - RNA, 13 nt, Yersinia pestis
uguacaacaagau

SEQ ID NO: 4140028 - RNA, 20 nt, Yersinia pestis
uguacaacuucuucauaacg

SEQ ID NO: 4140029 - RNA, 17 nt, Yersinia pestis
uguacaccuaaaacaua

SEQ ID NO: 4140030 - RNA, 14 nt, Yersinia pestis
uguacauccaacuu

SEQ ID NO: 4140031 - RNA, 21 nt, Yersinia pestis
uguacauccaauuuuuucauc

SEQ ID NO: 4140032 - RNA, 12 nt, Yersinia pestis
uguacauuauuc

SEQ ID NO: 4140033 - RNA, 17 nt, Yersinia pestis
uguacauuucguagccu

SEQ ID NO: 4140034 - RNA, 20 nt, Yersinia pestis
uguaccaaaacgaacaaaau

SEQ ID NO: 4140035 - RNA, 19 nt, Yersinia pestis
uguaccgccauaguacaua

SEQ ID NO: 4140036 - RNA, 14 nt, Yersinia pestis
uguaccugugccag

SEQ ID NO: 4140037 - RNA, 16 nt, Yersinia pestis
uguacgaaauugauau

SEQ ID NO: 4140038 - RNA, 16 nt, Yersinia pestis
uguacguauggcauga

SEQ ID NO: 4140039 - RNA, 17 nt, Yersinia pestis
uguacugcugcaacuca

SEQ ID NO: 4140040 - RNA, 21 nt, Yersinia pestis
uguacugcugcaacucauuaa

SEQ ID NO: 4140041 - RNA, 20 nt, Yersinia pestis
uguacuuaauacugaacaug

SEQ ID NO: 4140042 - RNA, 18 nt, Yersinia pestis
uguacuuugauucaaaau

SEQ ID NO: 4140043 - RNA, 22 nt, Yersinia pestis
uguacuuugauucaaaaugcca

SEQ ID NO: 4140044 - RNA, 24 nt, Yersinia pestis
uguacuuugauucaaaaugccagu

SEQ ID NO: 4140045 - RNA, 18 nt, Yersinia pestis
uguagaauguugauauaa

SEQ ID NO: 4140046 - RNA, 23 nt, Yersinia pestis
uguagaucccgugugauuuccau

SEQ ID NO: 4140047 - RNA, 12 nt, Yersinia pestis
uguagcaaaccc

SEQ ID NO: 4140048 - RNA, 17 nt, Yersinia pestis
uguagcaaacccacaau

SEQ ID NO: 4140049 - RNA, 17 nt, Yersinia pestis
uguagcccacugacacu

SEQ ID NO: 4140050 - RNA, 14 nt, Yersinia pestis
uguagcgccaggua

SEQ ID NO: 4140051 - RNA, 15 nt, Yersinia pestis
uguagcgccagguaa

SEQ ID NO: 4140052 - RNA, 15 nt, Yersinia pestis
uguagcuuuuuaaau

SEQ ID NO: 4140053 - RNA, 19 nt, Yersinia pestis
uguaggcaauacaccgcca

SEQ ID NO: 4140054 - RNA, 12 nt, Yersinia pestis
uguaggcaccac

SEQ ID NO: 4140055 - RNA, 21 nt, Yersinia pestis
uguagguuggggaugaaaaug

SEQ ID NO: 4140056 - RNA, 17 nt, Yersinia pestis
uguaguaacucaaguau

SEQ ID NO: 4140057 - RNA, 13 nt, Yersinia pestis
uguaguacagcac

SEQ ID NO: 4140058 - RNA, 20 nt, Yersinia pestis
uguaguacagcacucaguac

SEQ ID NO: 4140059 - RNA, 22 nt, Yersinia pestis
uguagugacguaaaaaggcagu

SEQ ID NO: 4140060 - RNA, 14 nt, Yersinia pestis
uguaguuagaugac

SEQ ID NO: 4140061 - RNA, 18 nt, Yersinia pestis
uguaguuauugauuaauu

SEQ ID NO: 4140062 - RNA, 22 nt, Yersinia pestis
uguaguucagucgcgauaaaau

SEQ ID NO: 4140063 - RNA, 20 nt, Yersinia pestis
uguauacccgccgcaucuaa

SEQ ID NO: 4140064 - RNA, 18 nt, Yersinia pestis
uguauaucacuauuucag

SEQ ID NO: 4140065 - RNA, 19 nt, Yersinia pestis
uguauaugcugauaaaauu

SEQ ID NO: 4140066 - RNA, 13 nt, Yersinia pestis
uguaucauauguu

SEQ ID NO: 4140067 - RNA, 17 nt, Yersinia pestis
uguaucauauguucgau

SEQ ID NO: 4140068 - RNA, 13 nt, Yersinia pestis
uguauccaaggca

SEQ ID NO: 4140069 - RNA, 14 nt, Yersinia pestis
uguauccagcagcg

SEQ ID NO: 4140070 - RNA, 20 nt, Yersinia pestis
uguauccguagacauuaucc

SEQ ID NO: 4140071 - RNA, 23 nt, Yersinia pestis
uguaucgaugaucaaugugguua

SEQ ID NO: 4140072 - RNA, 18 nt, Yersinia pestis
uguaugguauagacuguu

SEQ ID NO: 4140073 - RNA, 22 nt, Yersinia pestis
uguauguggcuguauucacgua

SEQ ID NO: 4140074 - RNA, 14 nt, Yersinia pestis
uguauuaccucacg

SEQ ID NO: 4140075 - RNA, 18 nt, Yersinia pestis
uguauucccucaauagcu

SEQ ID NO: 4140076 - RNA, 18 nt, Yersinia pestis
uguauucgcaucuuccaa

SEQ ID NO: 4140077 - RNA, 19 nt, Yersinia pestis
uguauucgcaucuuccaaa

SEQ ID NO: 4140078 - RNA, 16 nt, Yersinia pestis
uguauugaugcaguga

SEQ ID NO: 4140079 - RNA, 12 nt, Yersinia pestis
uguauugcucca

SEQ ID NO: 4140080 - RNA, 23 nt, Yersinia pestis
uguauuguugcucaacauauugc

SEQ ID NO: 4140081 - RNA, 13 nt, Yersinia pestis
uguauuuaaaaga

SEQ ID NO: 4140082 - RNA, 15 nt, Yersinia pestis
uguauuuaacauuag

SEQ ID NO: 4140083 - RNA, 15 nt, Yersinia pestis
uguauuucucaaacu

SEQ ID NO: 4140084 - RNA, 14 nt, Yersinia pestis
uguauuugaugguu

SEQ ID NO: 4140085 - RNA, 19 nt, Yersinia pestis
uguauuuggguuaaauagu

SEQ ID NO: 4140086 - RNA, 18 nt, Yersinia pestis
uguauuuucaaucgcuuu

SEQ ID NO: 4140087 - RNA, 19 nt, Yersinia pestis
uguauuuuguuuuuuugau

SEQ ID NO: 4140088 - RNA, 13 nt, Yersinia pestis
ugucaaaaaccca

SEQ ID NO: 4140089 - RNA, 16 nt, Yersinia pestis
ugucaacgcuucagua

SEQ ID NO: 4140090 - RNA, 16 nt, Yersinia pestis
ugucaagagugcgagu

SEQ ID NO: 4140091 - RNA, 22 nt, Yersinia pestis
ugucaauaaaaugggccugagu

SEQ ID NO: 4140092 - RNA, 14 nt, Yersinia pestis
ugucaauaaacuga

SEQ ID NO: 4140093 - RNA, 20 nt, Yersinia pestis
ugucaauaaccucauuggcg

SEQ ID NO: 4140094 - RNA, 14 nt, Yersinia pestis
ugucaauaccuuac

SEQ ID NO: 4140095 - RNA, 18 nt, Yersinia pestis
ugucaauggguuugguua

SEQ ID NO: 4140096 - RNA, 18 nt, Yersinia pestis
ugucaauguguugaauau

SEQ ID NO: 4140097 - RNA, 15 nt, Yersinia pestis
ugucaauuaaaaacg

SEQ ID NO: 4140098 - RNA, 14 nt, Yersinia pestis
ugucaccuaccacc

SEQ ID NO: 4140099 - RNA, 18 nt, Yersinia pestis
ugucaccugucaccuguc

SEQ ID NO: 4140100 - RNA, 19 nt, Yersinia pestis
ugucaccugucaccuguca

SEQ ID NO: 4140101 - RNA, 16 nt, Yersinia pestis
ugucacugcacuccug

SEQ ID NO: 4140102 - RNA, 17 nt, Yersinia pestis
ugucacugccaucucau

SEQ ID NO: 4140103 - RNA, 19 nt, Yersinia pestis
ugucagaucgcgaugcgcc

SEQ ID NO: 4140104 - RNA, 21 nt, Yersinia pestis
ugucagauggugcgccauuaa

SEQ ID NO: 4140105 - RNA, 12 nt, Yersinia pestis
ugucagauuagu

SEQ ID NO: 4140106 - RNA, 13 nt, Yersinia pestis
ugucagcagucug

SEQ ID NO: 4140107 - RNA, 16 nt, Yersinia pestis
ugucagcagucugaaa

SEQ ID NO: 4140108 - RNA, 21 nt, Yersinia pestis
ugucagcagucugaagccuac

SEQ ID NO: 4140109 - RNA, 17 nt, Yersinia pestis
ugucagcagucugaggg

SEQ ID NO: 4140110 - RNA, 23 nt, Yersinia pestis
ugucagcagucugagggccacuu

SEQ ID NO: 4140111 - RNA, 18 nt, Yersinia pestis
ugucaggcgugucgaucc

SEQ ID NO: 4140112 - RNA, 15 nt, Yersinia pestis
uguucauaaauuaaa

SEQ ID NO: 4140113 - RNA, 16 nt, Yersinia pestis
uguucauaaauuaaaa

SEQ ID NO: 4140114 - RNA, 20 nt, Yersinia pestis
uguuccacuguaucuuugcu

SEQ ID NO: 4140115 - RNA, 22 nt, Yersinia pestis
uguuccagugcguuuuauucaa

SEQ ID NO: 4140116 - RNA, 16 nt, Yersinia pestis
uguuccugauuccaaa

SEQ ID NO: 4140117 - RNA, 22 nt, Yersinia pestis
uguucgaucaaaacaauaaaaa

SEQ ID NO: 4140118 - RNA, 15 nt, Yersinia pestis
uguucgcacugcucu

SEQ ID NO: 4140119 - RNA, 15 nt, Yersinia pestis
uguucggcaaugggu

SEQ ID NO: 4140120 - RNA, 20 nt, Yersinia pestis
uguucggggguugucagcag

SEQ ID NO: 4140121 - RNA, 15 nt, Yersinia pestis
uguucuaucucaucu

SEQ ID NO: 4140122 - RNA, 22 nt, Yersinia pestis
uguucucuggguaagaacagag

SEQ ID NO: 4140123 - RNA, 20 nt, Yersinia pestis
uguucuuacuguuuucauua

SEQ ID NO: 4140124 - RNA, 19 nt, Yersinia pestis
uguugaauaccaagccaaa

SEQ ID NO: 4140125 - RNA, 12 nt, Yersinia pestis
uguugaccucaa

SEQ ID NO: 4140126 - RNA, 18 nt, Yersinia pestis
uguugaccucaaaauaca

SEQ ID NO: 4140127 - RNA, 16 nt, Yersinia pestis
uguugacucaccggcu

SEQ ID NO: 4140128 - RNA, 22 nt, Yersinia pestis
uguugagaaauauuugagauau

SEQ ID NO: 4140129 - RNA, 21 nt, Yersinia pestis
uguugauaaaaaucuuuuaau

SEQ ID NO: 4140130 - RNA, 21 nt, Yersinia pestis
uguugauacggccuauuucuu

SEQ ID NO: 4140131 - RNA, 22 nt, Yersinia pestis
uguugauuaacauccauuguau

SEQ ID NO: 4140132 - RNA, 20 nt, Yersinia pestis
uguugcagucuccaucacuc

SEQ ID NO: 4140133 - RNA, 22 nt, Yersinia pestis
uguugcaugcgccauauaccca

SEQ ID NO: 4140134 - RNA, 22 nt, Yersinia pestis
uguugccaaugggccaagguca

SEQ ID NO: 4140135 - RNA, 16 nt, Yersinia pestis
uguugccaccugcugg

SEQ ID NO: 4140136 - RNA, 16 nt, Yersinia pestis
uguugccauggccgcc

SEQ ID NO: 4140137 - RNA, 17 nt, Yersinia pestis
uguugcccccugcucca

SEQ ID NO: 4140138 - RNA, 16 nt, Yersinia pestis
uguugccgcuucauau

SEQ ID NO: 4140139 - RNA, 20 nt, Yersinia pestis
uguugccggcggcgcuggcg

SEQ ID NO: 4140140 - RNA, 14 nt, Yersinia pestis
uguugcgccauaau

SEQ ID NO: 4140141 - RNA, 21 nt, Yersinia pestis
uguuggaucucuccagccugc

SEQ ID NO: 4140142 - RNA, 13 nt, Yersinia pestis
uguuggcaaauaa

SEQ ID NO: 4140143 - RNA, 13 nt, Yersinia pestis
uguuggggcacaa

SEQ ID NO: 4140144 - RNA, 14 nt, Yersinia pestis
uguuguagcgccag

SEQ ID NO: 4140145 - RNA, 19 nt, Yersinia pestis
uguuguagcgccagguaag

SEQ ID NO: 4140146 - RNA, 13 nt, Yersinia pestis
uguuguauaaccc

SEQ ID NO: 4140147 - RNA, 21 nt, Yersinia pestis
uguugugauguuuuugaccau

SEQ ID NO: 4140148 - RNA, 19 nt, Yersinia pestis
uguuguuauuacugucacu

SEQ ID NO: 4140149 - RNA, 15 nt, Yersinia pestis
uguuguuauugacca

SEQ ID NO: 4140150 - RNA, 22 nt, Yersinia pestis
uguuguuggcuaaugcgagugc

SEQ ID NO: 4140151 - RNA, 22 nt, Yersinia pestis
uguuuaaucaccgcuguggaau

SEQ ID NO: 4140152 - RNA, 16 nt, Yersinia pestis
uguuuauaaauuaaaa

SEQ ID NO: 4140153 - RNA, 13 nt, Yersinia pestis
uguuuaucuucua

SEQ ID NO: 4140154 - RNA, 13 nt, Yersinia pestis
uguuucaaauaag

SEQ ID NO: 4140155 - RNA, 22 nt, Yersinia pestis
uguuucaaauaaguacuuccaa

SEQ ID NO: 4140156 - RNA, 11 nt, Yersinia pestis
uguuucaagau

SEQ ID NO: 4140157 - RNA, 17 nt, Yersinia pestis
uguuucaauacuauucc

SEQ ID NO: 4140158 - RNA, 18 nt, Yersinia pestis
uguuucgacgguuuuuug

SEQ ID NO: 4140159 - RNA, 21 nt, Yersinia pestis
uguuucggguauucggcggcu

SEQ ID NO: 4140160 - RNA, 15 nt, Yersinia pestis
uguuucuauccgaaa

SEQ ID NO: 4140161 - RNA, 21 nt, Yersinia pestis
uguuucuauccgaaaaauauu

SEQ ID NO: 4140162 - RNA, 19 nt, Yersinia pestis
uguuucugauaucuaaaaa

SEQ ID NO: 4140163 - RNA, 17 nt, Yersinia pestis
uguuugauuacuggccg

SEQ ID NO: 4140164 - RNA, 13 nt, Yersinia pestis
uguuugcccuaga

SEQ ID NO: 4140165 - RNA, 21 nt, Yersinia pestis
uguuugcgcagcaaauaaaca

SEQ ID NO: 4140166 - RNA, 16 nt, Yersinia pestis
uguuuggauaaaaaca

SEQ ID NO: 4140167 - RNA, 14 nt, Yersinia pestis
uguuuguuuggaua

SEQ ID NO: 4140168 - RNA, 14 nt, Yersinia pestis
uguuuuauuauaua

SEQ ID NO: 4140169 - RNA, 22 nt, Yersinia pestis
uguuuuauuauauauuuugaau

SEQ ID NO: 4140170 - RNA, 15 nt, Yersinia pestis
uguuuuguaaaugcu

SEQ ID NO: 4140171 - RNA, 18 nt, Yersinia pestis
uguuuuuaacaaaaugga

SEQ ID NO: 4140172 - RNA, 13 nt, Yersinia pestis
uguuuuuuugaua

SEQ ID NO: 4140173 - RNA, 20 nt, Yersinia pestis
uguuuuuuugauauucucac

SEQ ID NO: 4140174 - RNA, 14 nt, Yersinia pestis
uguuuuuuuuauuc

SEQ ID NO: 4140175 - RNA, 15 nt, Yersinia pestis
uuaaaaaaauuauca

SEQ ID NO: 4140176 - RNA, 18 nt, Yersinia pestis
uuaaaaaauaauuuuaug

SEQ ID NO: 4140177 - RNA, 19 nt, Yersinia pestis
uuaaaaacugugccugaau

SEQ ID NO: 4140178 - RNA, 18 nt, Yersinia pestis
uuaaaaauacaaccaaca

SEQ ID NO: 4140179 - RNA, 14 nt, Yersinia pestis
uuaaaaaucagaga

SEQ ID NO: 4140180 - RNA, 15 nt, Yersinia pestis
uuaaaacauauuaag

SEQ ID NO: 4140181 - RNA, 13 nt, Yersinia pestis
uuaaaaguaggcu

SEQ ID NO: 4140182 - RNA, 22 nt, Yersinia pestis
uuaaaauacugccaaucgcucu

SEQ ID NO: 4140183 - RNA, 14 nt, Yersinia pestis
uuaaaauaguggca

SEQ ID NO: 4140184 - RNA, 23 nt, Yersinia pestis
uuaaaauaguggcacaaauaaaa

SEQ ID NO: 4140185 - RNA, 21 nt, Yersinia pestis
uuaaaaucguauaacauaaua

SEQ ID NO: 4140186 - RNA, 20 nt, Yersinia pestis
uuaaacagucuuauuacuca

SEQ ID NO: 4140187 - RNA, 16 nt, Yersinia pestis
uuaaacccggcaucaa

SEQ ID NO: 4140188 - RNA, 19 nt, Yersinia pestis
uuaaacccggcaucaacca

SEQ ID NO: 4140189 - RNA, 22 nt, Yersinia pestis
uuaaacugaccgauaaacgcca

SEQ ID NO: 4140190 - RNA, 19 nt, Yersinia pestis
uuaaacuugcucuuucacg

SEQ ID NO: 4140191 - RNA, 13 nt, Yersinia pestis
uuaaagaagacga

SEQ ID NO: 4140192 - RNA, 14 nt, Yersinia pestis
uuaaagacauauca

SEQ ID NO: 4140193 - RNA, 22 nt, Yersinia pestis
uuaaagaccaacgcuguaaucu

SEQ ID NO: 4140194 - RNA, 23 nt, Yersinia pestis
uuaaagacgcaugagcuuaugcg

SEQ ID NO: 4140195 - RNA, 17 nt, Yersinia pestis
uuaaagauuaagacuuu

SEQ ID NO: 4140196 - RNA, 19 nt, Yersinia pestis
uuaaagauuucaucauuca

SEQ ID NO: 4140197 - RNA, 22 nt, Yersinia pestis
uuaaagauuucaucauucaaua

SEQ ID NO: 4140198 - RNA, 20 nt, Yersinia pestis
uuaaagccuucaacuaauau

SEQ ID NO: 4140199 - RNA, 19 nt, Yersinia pestis
uuaaagccuuucagcgcug

SEQ ID NO: 4140200 - RNA, 19 nt, Yersinia pestis
uuaaaguaucgcuaucacc

SEQ ID NO: 4140201 - RNA, 17 nt, Yersinia pestis
uuaaaguuuagcaaagc

SEQ ID NO: 4140202 - RNA, 19 nt, Yersinia pestis
uuaaaguuuuuuauuuaua

SEQ ID NO: 4140203 - RNA, 11 nt, Yersinia pestis
uuaaauaacuc

SEQ ID NO: 4140204 - RNA, 17 nt, Yersinia pestis
uuaaauaagaaguagaa

SEQ ID NO: 4140205 - RNA, 21 nt, Yersinia pestis
uuaaauacugcacguuuaauu

SEQ ID NO: 4140206 - RNA, 17 nt, Yersinia pestis
uuaaauauuauuuaauu

SEQ ID NO: 4140207 - RNA, 18 nt, Yersinia pestis
uuaaauauuauuuaauua

SEQ ID NO: 4140208 - RNA, 20 nt, Yersinia pestis
uuaaaucaagcugcucgcca

SEQ ID NO: 4140209 - RNA, 12 nt, Yersinia pestis
uuaaaugaaaca

SEQ ID NO: 4140210 - RNA, 13 nt, Yersinia pestis
uuaaaugaagcag

SEQ ID NO: 4140211 - RNA, 19 nt, Yersinia pestis
uuaaaugaccacccacguu

SEQ ID NO: 4140212 - RNA, 18 nt, Yersinia pestis
uuaaaugcguagagucag

SEQ ID NO: 4140213 - RNA, 14 nt, Yersinia pestis
uuaaauggagggca

SEQ ID NO: 4140214 - RNA, 19 nt, Yersinia pestis
uuaaauggugguuuucuua

SEQ ID NO: 4140215 - RNA, 20 nt, Yersinia pestis
uuaaauguauaaaaaagaua

SEQ ID NO: 4140216 - RNA, 15 nt, Yersinia pestis
uuaaauuacagacaa

SEQ ID NO: 4140217 - RNA, 17 nt, Yersinia pestis
uuaaauuacagacaaau

SEQ ID NO: 4140218 - RNA, 20 nt, Yersinia pestis
uuaaauuaucccguucaaua

SEQ ID NO: 4140219 - RNA, 20 nt, Yersinia pestis
uuaaauuauugaguaacauu

SEQ ID NO: 4140220 - RNA, 17 nt, Yersinia pestis
uuaaauucuaccuggcu

SEQ ID NO: 4140221 - RNA, 20 nt, Yersinia pestis
uuaaauugucuccaucccug

SEQ ID NO: 4140222 - RNA, 11 nt, Yersinia pestis
uuaaauuucug

SEQ ID NO: 4140223 - RNA, 16 nt, Yersinia pestis
uuaaauuucuguuuuu

SEQ ID NO: 4140224 - RNA, 13 nt, Yersinia pestis
uuaaauuuuaauu

SEQ ID NO: 4140225 - RNA, 17 nt, Yersinia pestis
uuaaauuuuaauuauaa

SEQ ID NO: 4140226 - RNA, 15 nt, Yersinia pestis
uuaaauuuuuauaua

SEQ ID NO: 4140227 - RNA, 20 nt, Yersinia pestis
uuaaauuuuuauauaauuga

SEQ ID NO: 4140228 - RNA, 17 nt, Yersinia pestis
uuaacaauauuauauuc

SEQ ID NO: 4140229 - RNA, 13 nt, Yersinia pestis
uuaacaauguuau

SEQ ID NO: 4140230 - RNA, 19 nt, Yersinia pestis
uuaacaauuacuuuggcau

SEQ ID NO: 4140231 - RNA, 13 nt, Yersinia pestis
uuaacaauucucu

SEQ ID NO: 4140232 - RNA, 14 nt, Yersinia pestis
uuaacaauuuauca

SEQ ID NO: 4140233 - RNA, 15 nt, Yersinia pestis
uuaacaauuuuauug

SEQ ID NO: 4140234 - RNA, 21 nt, Yersinia pestis
uuaccaccgucaagacaacaa

SEQ ID NO: 4140235 - RNA, 22 nt, Yersinia pestis
uuaccacgacgaucuuguucac

SEQ ID NO: 4140236 - RNA, 18 nt, Yersinia pestis
uuaccagcgucaaaccau

SEQ ID NO: 4140237 - RNA, 18 nt, Yersinia pestis
uuacccacauucaggccg

SEQ ID NO: 4140238 - RNA, 19 nt, Yersinia pestis
uuacccacauucaggccga

SEQ ID NO: 4140239 - RNA, 17 nt, Yersinia pestis
uuacccgaaucacugac

SEQ ID NO: 4140240 - RNA, 22 nt, Yersinia pestis
uuacccgcgaucauuucaacua

SEQ ID NO: 4140241 - RNA, 14 nt, Yersinia pestis
uuacccguacaaaa

SEQ ID NO: 4140242 - RNA, 19 nt, Yersinia pestis
uuacccucuaucgcucacu

SEQ ID NO: 4140243 - RNA, 22 nt, Yersinia pestis
uuacccugcgggugcuuuaaug

SEQ ID NO: 4140244 - RNA, 11 nt, Yersinia pestis
uuacccuucgu

SEQ ID NO: 4140245 - RNA, 18 nt, Yersinia pestis
uuaccgccgucaugcuga

SEQ ID NO: 4140246 - RNA, 15 nt, Yersinia pestis
uuaccguaagauucg

SEQ ID NO: 4140247 - RNA, 23 nt, Yersinia pestis
uuaccgucgaacauaaaaaugca

SEQ ID NO: 4140248 - RNA, 20 nt, Yersinia pestis
uuaccgucgucucuauuggc

SEQ ID NO: 4140249 - RNA, 11 nt, Yersinia pestis
uuaccuaacca

SEQ ID NO: 4140250 - RNA, 18 nt, Yersinia pestis
uuaccuaaccaaacauug

SEQ ID NO: 4140251 - RNA, 19 nt, Yersinia pestis
uuaccuaaccaaacauugu

SEQ ID NO: 4140252 - RNA, 21 nt, Yersinia pestis
uuaccuauaaacuugauucac

SEQ ID NO: 4140253 - RNA, 16 nt, Yersinia pestis
uuaccuauuuuaaaac

SEQ ID NO: 4140254 - RNA, 15 nt, Yersinia pestis
uuaccugcaauaaug

SEQ ID NO: 4140255 - RNA, 22 nt, Yersinia pestis
uuacgauaaaggcgagucagca

SEQ ID NO: 4140256 - RNA, 15 nt, Yersinia pestis
uuacgaucugccugu

SEQ ID NO: 4140257 - RNA, 22 nt, Yersinia pestis
uuacgcaacguaauaucugcca

SEQ ID NO: 4140258 - RNA, 14 nt, Yersinia pestis
uuacgcaaguaaaa

SEQ ID NO: 4140259 - RNA, 15 nt, Yersinia pestis
uuacgcagguuaucu

SEQ ID NO: 4140260 - RNA, 22 nt, Yersinia pestis
uuacgccaccuucuuauuuauc

SEQ ID NO: 4140261 - RNA, 18 nt, Yersinia pestis
uuacgcgugauauucgua

SEQ ID NO: 4140262 - RNA, 18 nt, Yersinia pestis
uuacggcggccaucauuc

SEQ ID NO: 4140263 - RNA, 22 nt, Yersinia pestis
uuacgguauuugaacuucaaau

SEQ ID NO: 4140264 - RNA, 21 nt, Yersinia pestis
uuacguacgccgaacuucauc

SEQ ID NO: 4140265 - RNA, 13 nt, Yersinia pestis
uuacgugauauac

SEQ ID NO: 4140266 - RNA, 18 nt, Yersinia pestis
uuacgugaugaugcuagu

SEQ ID NO: 4140267 - RNA, 19 nt, Yersinia pestis
uuacguguucuuaauuuaa

SEQ ID NO: 4140268 - RNA, 14 nt, Yersinia pestis
uuacuaucuuuauu

SEQ ID NO: 4140269 - RNA, 18 nt, Yersinia pestis
uuacucagcacauuuuua

SEQ ID NO: 4140270 - RNA, 18 nt, Yersinia pestis
uuacucaggaacaagacu

SEQ ID NO: 4140271 - RNA, 17 nt, Yersinia pestis
uuacucccuuguugccu

SEQ ID NO: 4140272 - RNA, 21 nt, Yersinia pestis
uuacuccucugccuauccuca

SEQ ID NO: 4140273 - RNA, 22 nt, Yersinia pestis
uuacuccucugccuauccucac

SEQ ID NO: 4140274 - RNA, 18 nt, Yersinia pestis
uuacucguauaaaaaaua

SEQ ID NO: 4140275 - RNA, 17 nt, Yersinia pestis
uuacucguuuuacauug

SEQ ID NO: 4140276 - RNA, 14 nt, Yersinia pestis
uuacucucgccaaa

SEQ ID NO: 4140277 - RNA, 21 nt, Yersinia pestis
uuacucuucagccuauccuca

SEQ ID NO: 4140278 - RNA, 22 nt, Yersinia pestis
uuacucuucagccuauccucac

SEQ ID NO: 4140279 - RNA, 14 nt, Yersinia pestis
uuacucuuccaacu

SEQ ID NO: 4140280 - RNA, 14 nt, Yersinia pestis
uuacucuucugccu

SEQ ID NO: 4140281 - RNA, 17 nt, Yersinia pestis
uuacugaaaagaggcac

SEQ ID NO: 4140282 - RNA, 15 nt, Yersinia pestis
uuacugaugucauca

SEQ ID NO: 4140283 - RNA, 21 nt, Yersinia pestis
uuacugcaucuauugugucaa

SEQ ID NO: 4140284 - RNA, 21 nt, Yersinia pestis
uuacugcggcuuucugccugu

SEQ ID NO: 4140285 - RNA, 16 nt, Yersinia pestis
uuacugcguaacccca

SEQ ID NO: 4140286 - RNA, 12 nt, Yersinia pestis
uuacugcuuuca

SEQ ID NO: 4140287 - RNA, 11 nt, Yersinia pestis
uuacuguaaga

SEQ ID NO: 4140288 - RNA, 15 nt, Yersinia pestis
uuacuguaucaauac

SEQ ID NO: 4140289 - RNA, 20 nt, Yersinia pestis
uuacuguaucaauaccuuac

SEQ ID NO: 4140290 - RNA, 14 nt, Yersinia pestis
uuacugucaaugcu

SEQ ID NO: 4140291 - RNA, 17 nt, Yersinia pestis
uuacuguccuuuaacuc

SEQ ID NO: 4140292 - RNA, 18 nt, Yersinia pestis
uuacuuacccgaaucacu

SEQ ID NO: 4140293 - RNA, 20 nt, Yersinia pestis
uuacuuacuguauuaccuca

SEQ ID NO: 4140294 - RNA, 12 nt, Yersinia pestis
uuacuuuauuua

SEQ ID NO: 4140295 - RNA, 20 nt, Yersinia pestis
uuacuuuuuauuaaugcuua

SEQ ID NO: 4140296 - RNA, 11 nt, Yersinia pestis
uuagaaaacag

SEQ ID NO: 4140297 - RNA, 13 nt, Yersinia pestis
uuagaaaacauuu

SEQ ID NO: 4140298 - RNA, 22 nt, Yersinia pestis
uuagacaugggcagugcacagu

SEQ ID NO: 4140299 - RNA, 18 nt, Yersinia pestis
uuagacgucagauuagcu

SEQ ID NO: 4140300 - RNA, 22 nt, Yersinia pestis
uuagacgucagauuagcuuuaa

SEQ ID NO: 4140301 - RNA, 17 nt, Yersinia pestis
uuagacgucagauuagu

SEQ ID NO: 4140302 - RNA, 23 nt, Yersinia pestis
uuagacgucagauuaguuuuaga

SEQ ID NO: 4140303 - RNA, 21 nt, Yersinia pestis
uuagaggauuuaacugaauca

SEQ ID NO: 4140304 - RNA, 14 nt, Yersinia pestis
uuagaguaaguaaa

SEQ ID NO: 4140305 - RNA, 20 nt, Yersinia pestis
uuagaguaaguaaaaaggau

SEQ ID NO: 4140306 - RNA, 14 nt, Yersinia pestis
uuagagucuauaau

SEQ ID NO: 4140307 - RNA, 19 nt, Yersinia pestis
uuagaugauugaaaaucag

SEQ ID NO: 4140308 - RNA, 20 nt, Yersinia pestis
uuagauguguuuaaaucuuu

SEQ ID NO: 4140309 - RNA, 16 nt, Yersinia pestis
uuagauuacagccuaa

SEQ ID NO: 4140310 - RNA, 14 nt, Yersinia pestis
uuagcaauaauaga

SEQ ID NO: 4140311 - RNA, 18 nt, Yersinia pestis
uuagcacguuuuucagcu

SEQ ID NO: 4140312 - RNA, 15 nt, Yersinia pestis
uuagcaugcauccau

SEQ ID NO: 4140313 - RNA, 19 nt, Yersinia pestis
uuagcauugcagauuucuu

SEQ ID NO: 4140314 - RNA, 20 nt, Yersinia pestis
uuagcauugcagauuucuuc

SEQ ID NO: 4140315 - RNA, 16 nt, Yersinia pestis
uuagccaaauacccua

SEQ ID NO: 4140316 - RNA, 20 nt, Yersinia pestis
uuagccacugguugaaaguu

SEQ ID NO: 4140317 - RNA, 15 nt, Yersinia pestis
uuagccauaagauaa

SEQ ID NO: 4140318 - RNA, 15 nt, Yersinia pestis
uuagccccaaaugcc

SEQ ID NO: 4140319 - RNA, 13 nt, Yersinia pestis
uuagccccuucac

SEQ ID NO: 4140320 - RNA, 20 nt, Yersinia pestis
uuagccgaguugacuuuuuu

SEQ ID NO: 4140321 - RNA, 18 nt, Yersinia pestis
uuagccuucguuugucaa

SEQ ID NO: 4140322 - RNA, 15 nt, Yersinia pestis
uuagcgagaaaguca

SEQ ID NO: 4140323 - RNA, 15 nt, Yersinia pestis
uuagcgcuaagcccg

SEQ ID NO: 4140324 - RNA, 20 nt, Yersinia pestis
uuagcucccccguguucuga

SEQ ID NO: 4140325 - RNA, 12 nt, Yersinia pestis
uuagcuguuuua

SEQ ID NO: 4140326 - RNA, 15 nt, Yersinia pestis
uuagcuuacaccaug

SEQ ID NO: 4140327 - RNA, 15 nt, Yersinia pestis
uuaggcauaaauaau

SEQ ID NO: 4140328 - RNA, 13 nt, Yersinia pestis
uuagggcgcggcu

SEQ ID NO: 4140329 - RNA, 16 nt, Yersinia pestis
uuagguaauaccaaug

SEQ ID NO: 4140330 - RNA, 14 nt, Yersinia pestis
uuagguugaaauac

SEQ ID NO: 4140331 - RNA, 14 nt, Yersinia pestis
uuaguaaucaauaa

SEQ ID NO: 4140332 - RNA, 21 nt, Yersinia pestis
uuagucagcgcggcccauaua

SEQ ID NO: 4140333 - RNA, 23 nt, Yersinia pestis
uuagucccauugacgaauuaaaa

SEQ ID NO: 4140334 - RNA, 18 nt, Yersinia pestis
uuagugcuacagcagcag

SEQ ID NO: 4140335 - RNA, 21 nt, Yersinia pestis
uuaguggcuuuaagauccagu

SEQ ID NO: 4140336 - RNA, 23 nt, Yersinia pestis
uuaguugaccuugguaaauacca

SEQ ID NO: 4140337 - RNA, 20 nt, Yersinia pestis
uuaguugguaauaaggucac

SEQ ID NO: 4140338 - RNA, 15 nt, Yersinia pestis
uuaguuuuagacguc

SEQ ID NO: 4140339 - RNA, 14 nt, Yersinia pestis
uuauacauauguug

SEQ ID NO: 4140340 - RNA, 16 nt, Yersinia pestis
uuauacccauacaaau

SEQ ID NO: 4140341 - RNA, 20 nt, Yersinia pestis
uuauacccauacaaauagua

SEQ ID NO: 4140342 - RNA, 22 nt, Yersinia pestis
uuauacccauacaaauaguaau

SEQ ID NO: 4140343 - RNA, 17 nt, Yersinia pestis
uuauacccguuauauuu

SEQ ID NO: 4140344 - RNA, 15 nt, Yersinia pestis
uuauacuaaagaaau

SEQ ID NO: 4140345 - RNA, 14 nt, Yersinia pestis
uuauacuauuuaug

SEQ ID NO: 4140346 - RNA, 16 nt, Yersinia pestis
uuauagaacggcagug

SEQ ID NO: 4140347 - RNA, 20 nt, Yersinia pestis
uuauagaauacaggguaaau

SEQ ID NO: 4140348 - RNA, 15 nt, Yersinia pestis
uuauagguauacacc

SEQ ID NO: 4140349 - RNA, 22 nt, Yersinia pestis
uuauaguccuuccaugacacau

SEQ ID NO: 4140350 - RNA, 13 nt, Yersinia pestis
uuauaguuaaaac

SEQ ID NO: 4140351 - RNA, 13 nt, Yersinia pestis
uuauauaacagcc

SEQ ID NO: 4140352 - RNA, 17 nt, Yersinia pestis
uuauauaacagccauuu

SEQ ID NO: 4140353 - RNA, 19 nt, Yersinia pestis
uuauauagaccaagcauuu

SEQ ID NO: 4140354 - RNA, 22 nt, Yersinia pestis
uuauauaguaacuauuuacaua

SEQ ID NO: 4140355 - RNA, 23 nt, Yersinia pestis
uuauauaguaacuauuuacauaa

SEQ ID NO: 4140356 - RNA, 16 nt, Yersinia pestis
uucaaagaagacaucu

SEQ ID NO: 4140357 - RNA, 19 nt, Yersinia pestis
uucaaaguaaaauaaaaaa

SEQ ID NO: 4140358 - RNA, 17 nt, Yersinia pestis
uucaaauaauucagacg

SEQ ID NO: 4140359 - RNA, 14 nt, Yersinia pestis
uucaaauaucauua

SEQ ID NO: 4140360 - RNA, 18 nt, Yersinia pestis
uucaacgccaauaccggu

SEQ ID NO: 4140361 - RNA, 22 nt, Yersinia pestis
uucaacgcugcccgucaauauc

SEQ ID NO: 4140362 - RNA, 18 nt, Yersinia pestis
uucaacgucaaucaucca

SEQ ID NO: 4140363 - RNA, 17 nt, Yersinia pestis
uucaacugcucauccau

SEQ ID NO: 4140364 - RNA, 14 nt, Yersinia pestis
uucaacuucuccug

SEQ ID NO: 4140365 - RNA, 19 nt, Yersinia pestis
uucaacuucuccuguauuu

SEQ ID NO: 4140366 - RNA, 12 nt, Yersinia pestis
uucaacuuuuuu

SEQ ID NO: 4140367 - RNA, 16 nt, Yersinia pestis
uucaagaaccgaaaua

SEQ ID NO: 4140368 - RNA, 23 nt, Yersinia pestis
uucaagacgggucgcguuggcua

SEQ ID NO: 4140369 - RNA, 14 nt, Yersinia pestis
uucaagaugcaggg

SEQ ID NO: 4140370 - RNA, 15 nt, Yersinia pestis
uucaagcaauucaga

SEQ ID NO: 4140371 - RNA, 18 nt, Yersinia pestis
uucaagcagcauguguug

SEQ ID NO: 4140372 - RNA, 23 nt, Yersinia pestis
uucaaguacgaaggggauaaaug

SEQ ID NO: 4140373 - RNA, 14 nt, Yersinia pestis
uucaagucccuccc

SEQ ID NO: 4140374 - RNA, 14 nt, Yersinia pestis
uucaaguccugcuu

SEQ ID NO: 4140375 - RNA, 13 nt, Yersinia pestis
uucaagugcucac

SEQ ID NO: 4140376 - RNA, 22 nt, Yersinia pestis
uucaauaaaacucacuugugug

SEQ ID NO: 4140377 - RNA, 22 nt, Yersinia pestis
uucaauaacaccgucuuugacc

SEQ ID NO: 4140378 - RNA, 13 nt, Yersinia pestis
uucaauacauggu

SEQ ID NO: 4140379 - RNA, 22 nt, Yersinia pestis
uucaauacccuaacucuuugga

SEQ ID NO: 4140380 - RNA, 18 nt, Yersinia pestis
uucaauacuggccaugug

SEQ ID NO: 4140381 - RNA, 14 nt, Yersinia pestis
uucaaucaacugaa

SEQ ID NO: 4140382 - RNA, 16 nt, Yersinia pestis
uucaaucacuucugcu

SEQ ID NO: 4140383 - RNA, 20 nt, Yersinia pestis
uucaaucacuucugcugcca

SEQ ID NO: 4140384 - RNA, 14 nt, Yersinia pestis
uucaaucacuuuau

SEQ ID NO: 4140385 - RNA, 23 nt, Yersinia pestis
uucaaucauugagaucaguucag

SEQ ID NO: 4140386 - RNA, 23 nt, Yersinia pestis
uucaauggcguuauguaaaacga

SEQ ID NO: 4140387 - RNA, 19 nt, Yersinia pestis
uucaauggucaugcacagu

SEQ ID NO: 4140388 - RNA, 16 nt, Yersinia pestis
uucaauuccugauauu

SEQ ID NO: 4140389 - RNA, 21 nt, Yersinia pestis
uucaauugcccccuagugaug

SEQ ID NO: 4140390 - RNA, 20 nt, Yersinia pestis
uucaauuucgacaacgccaa

SEQ ID NO: 4140391 - RNA, 22 nt, Yersinia pestis
uucacaagccaaacaaaugaac

SEQ ID NO: 4140392 - RNA, 21 nt, Yersinia pestis
uucaccaaaaaaaccaccaaa

SEQ ID NO: 4140393 - RNA, 15 nt, Yersinia pestis
uucaccaaaccauca

SEQ ID NO: 4140394 - RNA, 18 nt, Yersinia pestis
uucaccaaaccaucagcg

SEQ ID NO: 4140395 - RNA, 17 nt, Yersinia pestis
uucaccaaauugcagaa

SEQ ID NO: 4140396 - RNA, 16 nt, Yersinia pestis
uucaccaauacaaaca

SEQ ID NO: 4140397 - RNA, 19 nt, Yersinia pestis
uucaccacgauuagccaua

SEQ ID NO: 4140398 - RNA, 10 nt, Yersinia pestis
uucaccagua

SEQ ID NO: 4140399 - RNA, 22 nt, Yersinia pestis
uucaccauccggguuuauccca

SEQ ID NO: 4140400 - RNA, 20 nt, Yersinia pestis
uucacccaggcugugguggc

SEQ ID NO: 4140401 - RNA, 18 nt, Yersinia pestis
uucacccauaccaaccau

SEQ ID NO: 4140402 - RNA, 14 nt, Yersinia pestis
uucacccauuaaua

SEQ ID NO: 4140403 - RNA, 14 nt, Yersinia pestis
uucaccccagauaa

SEQ ID NO: 4140404 - RNA, 20 nt, Yersinia pestis
uucaccccagcaaagccaaa

SEQ ID NO: 4140405 - RNA, 13 nt, Yersinia pestis
uucacccucuuuc

SEQ ID NO: 4140406 - RNA, 14 nt, Yersinia pestis
uucacccugagugu

SEQ ID NO: 4140407 - RNA, 23 nt, Yersinia pestis
uucaccgccuuucauucugaaga

SEQ ID NO: 4140408 - RNA, 17 nt, Yersinia pestis
uucaccgcuuuucuggu

SEQ ID NO: 4140409 - RNA, 18 nt, Yersinia pestis
uucaccgcuuuucuggua

SEQ ID NO: 4140410 - RNA, 23 nt, Yersinia pestis
uucaccgugacuguuaacaucca

SEQ ID NO: 4140411 - RNA, 23 nt, Yersinia pestis
uucaccguguuucagcaucaacu

SEQ ID NO: 4140412 - RNA, 20 nt, Yersinia pestis
uucaccuauaauuaacagca

SEQ ID NO: 4140413 - RNA, 23 nt, Yersinia pestis
uucaccuaucgguaucucccgca

SEQ ID NO: 4140414 - RNA, 16 nt, Yersinia pestis
uucacgauggaaaaaa

SEQ ID NO: 4140415 - RNA, 23 nt, Yersinia pestis
uucacgauggaaaaaauacaggu

SEQ ID NO: 4140416 - RNA, 17 nt, Yersinia pestis
uucacggcaccaaccau

SEQ ID NO: 4140417 - RNA, 20 nt, Yersinia pestis
uucacguuuuuccauucgca

SEQ ID NO: 4140418 - RNA, 17 nt, Yersinia pestis
uucacucauaauuuuga

SEQ ID NO: 4140419 - RNA, 21 nt, Yersinia pestis
uucacucauaauuuugaugcu

SEQ ID NO: 4140420 - RNA, 18 nt, Yersinia pestis
uucacucuguuuuaaaaa

SEQ ID NO: 4140421 - RNA, 19 nt, Yersinia pestis
uucacucuguuuuaaaaaa

SEQ ID NO: 4140422 - RNA, 21 nt, Yersinia pestis
uucacuggccuauuaagauaa

SEQ ID NO: 4140423 - RNA, 21 nt, Yersinia pestis
uucacuggggagaucagugcc

SEQ ID NO: 4140424 - RNA, 23 nt, Yersinia pestis
uucacuggggagaucagugccag

SEQ ID NO: 4140425 - RNA, 23 nt, Yersinia pestis
uucacugugcuuuucuuaauacc

SEQ ID NO: 4140426 - RNA, 20 nt, Yersinia pestis
uucacuuacugccaaagaau

SEQ ID NO: 4140427 - RNA, 18 nt, Yersinia pestis
uucacuuauucccacuua

SEQ ID NO: 4140428 - RNA, 22 nt, Yersinia pestis
uucacuucuggggucaucaacg

SEQ ID NO: 4140429 - RNA, 22 nt, Yersinia pestis
uucacuuuuaaaacuucccgca

SEQ ID NO: 4140430 - RNA, 19 nt, Yersinia pestis
uucagaaaacccccugcua

SEQ ID NO: 4140431 - RNA, 13 nt, Yersinia pestis
uucagacauacaa

SEQ ID NO: 4140432 - RNA, 22 nt, Yersinia pestis
uucagacugaaaguagaaauaa

SEQ ID NO: 4140433 - RNA, 17 nt, Yersinia pestis
uucagacugaaaugaca

SEQ ID NO: 4140434 - RNA, 13 nt, Yersinia pestis
uucagagcagcau

SEQ ID NO: 4140435 - RNA, 16 nt, Yersinia pestis
uucagaguaagucuuu

SEQ ID NO: 4140436 - RNA, 15 nt, Yersinia pestis
uucagcaacggaacg

SEQ ID NO: 4140437 - RNA, 19 nt, Yersinia pestis
uucagcaacgguuucaacu

SEQ ID NO: 4140438 - RNA, 15 nt, Yersinia pestis
uucagcaagccaaua

SEQ ID NO: 4140439 - RNA, 16 nt, Yersinia pestis
uucagcaccauaaaaa

SEQ ID NO: 4140440 - RNA, 14 nt, Yersinia pestis
uucagcacugcuuu

SEQ ID NO: 4140441 - RNA, 15 nt, Yersinia pestis
uucagcacugcuuuu

SEQ ID NO: 4140442 - RNA, 15 nt, Yersinia pestis
uucagcagcaagaaa

SEQ ID NO: 4140443 - RNA, 20 nt, Yersinia pestis
uucagcagggcgguuaauaa

SEQ ID NO: 4140444 - RNA, 16 nt, Yersinia pestis
uucagcauaaauauuc

SEQ ID NO: 4140445 - RNA, 19 nt, Yersinia pestis
uucagcauaucccuguuuu

SEQ ID NO: 4140446 - RNA, 16 nt, Yersinia pestis
uucagccaugggcuga

SEQ ID NO: 4140447 - RNA, 16 nt, Yersinia pestis
uucagccuauccucac

SEQ ID NO: 4140448 - RNA, 20 nt, Yersinia pestis
uucagccucuguaaaacgau

SEQ ID NO: 4140449 - RNA, 21 nt, Yersinia pestis
uucagcguauugugauucaua

SEQ ID NO: 4140450 - RNA, 19 nt, Yersinia pestis
uucagcgucagucaaugag

SEQ ID NO: 4140451 - RNA, 18 nt, Yersinia pestis
uucagcguugacaccaga

SEQ ID NO: 4140452 - RNA, 19 nt, Yersinia pestis
uucagcguuuugaucauca

SEQ ID NO: 4140453 - RNA, 16 nt, Yersinia pestis
uucagcucccgccgca

SEQ ID NO: 4140454 - RNA, 19 nt, Yersinia pestis
uucagcuuccgcuucaacu

SEQ ID NO: 4140455 - RNA, 18 nt, Yersinia pestis
uucaggaauaaacagcag

SEQ ID NO: 4140456 - RNA, 22 nt, Yersinia pestis
uucaggaaugguguaaaugccc

SEQ ID NO: 4140457 - RNA, 23 nt, Yersinia pestis
uucaggagauagccucaccgcca

SEQ ID NO: 4140458 - RNA, 13 nt, Yersinia pestis
uucaggccaauag

SEQ ID NO: 4140459 - RNA, 20 nt, Yersinia pestis
uucaggccacgcaauucauc

SEQ ID NO: 4140460 - RNA, 13 nt, Yersinia pestis
uucaggcuuuuuu

SEQ ID NO: 4140461 - RNA, 21 nt, Yersinia pestis
uucagguaccccauaaauccc

SEQ ID NO: 4140462 - RNA, 18 nt, Yersinia pestis
uucaguaaagcgcaggaa

SEQ ID NO: 4140463 - RNA, 15 nt, Yersinia pestis
uucaguacauaaacc

SEQ ID NO: 4140464 - RNA, 20 nt, Yersinia pestis
uucaguauuguauacaugcc

SEQ ID NO: 4140465 - RNA, 17 nt, Yersinia pestis
uucagucaaucgcucuu

SEQ ID NO: 4140466 - RNA, 16 nt, Yersinia pestis
uucagucgcgauaaaa

SEQ ID NO: 4140467 - RNA, 13 nt, Yersinia pestis
uucaguuacucac

SEQ ID NO: 4140468 - RNA, 19 nt, Yersinia pestis
uucaguuuauuuaagcuga

SEQ ID NO: 4140469 - RNA, 20 nt, Yersinia pestis
uucaguuuauuuaagcugaa

SEQ ID NO: 4140470 - RNA, 17 nt, Yersinia pestis
uucaguuuuaauuuaug

SEQ ID NO: 4140471 - RNA, 16 nt, Yersinia pestis
uucauaaaaaaagaag

SEQ ID NO: 4140472 - RNA, 22 nt, Yersinia pestis
uucauaaaccaacgguucauau

SEQ ID NO: 4140473 - RNA, 14 nt, Yersinia pestis
uucauaagccagug

SEQ ID NO: 4140474 - RNA, 22 nt, Yersinia pestis
uucauaauugaagaguugaucc

SEQ ID NO: 4140475 - RNA, 13 nt, Yersinia pestis
uucauacaucauu

SEQ ID NO: 4140476 - RNA, 20 nt, Yersinia pestis
uucauaccuuaauuaacucu

SEQ ID NO: 4140477 - RNA, 22 nt, Yersinia pestis
uucgaaagaaauaaaagaaaac

SEQ ID NO: 4140478 - RNA, 23 nt, Yersinia pestis
uucgaaagaaauaaaagaaaacc

SEQ ID NO: 4140479 - RNA, 18 nt, Yersinia pestis
uucgacaggcaauuaucc

SEQ ID NO: 4140480 - RNA, 21 nt, Yersinia pestis
uucgacagucacuaauaccug

SEQ ID NO: 4140481 - RNA, 19 nt, Yersinia pestis
uucgacauggaugguauuu

SEQ ID NO: 4140482 - RNA, 20 nt, Yersinia pestis
uucgaccaauaauaggguca

SEQ ID NO: 4140483 - RNA, 18 nt, Yersinia pestis
uucgacccagaggguuaa

SEQ ID NO: 4140484 - RNA, 14 nt, Yersinia pestis
uucgagcaccgcgc

SEQ ID NO: 4140485 - RNA, 15 nt, Yersinia pestis
uucgagcaccgcgcu

SEQ ID NO: 4140486 - RNA, 16 nt, Yersinia pestis
uucgagcuugacgcug

SEQ ID NO: 4140487 - RNA, 21 nt, Yersinia pestis
uucgagguggcgauaaagagu

SEQ ID NO: 4140488 - RNA, 23 nt, Yersinia pestis
uucgagguggcgauaaagaguga

SEQ ID NO: 4140489 - RNA, 17 nt, Yersinia pestis
uucgagugugaugaugg

SEQ ID NO: 4140490 - RNA, 15 nt, Yersinia pestis
uucgaguugaacuca

SEQ ID NO: 4140491 - RNA, 22 nt, Yersinia pestis
uucgauaugaucagauuucuga

SEQ ID NO: 4140492 - RNA, 14 nt, Yersinia pestis
uucgaucaaaacaa

SEQ ID NO: 4140493 - RNA, 15 nt, Yersinia pestis
uucgaugauuuauau

SEQ ID NO: 4140494 - RNA, 17 nt, Yersinia pestis
uucgcaaaaugccaaca

SEQ ID NO: 4140495 - RNA, 16 nt, Yersinia pestis
uucgcacuuuaaauac

SEQ ID NO: 4140496 - RNA, 19 nt, Yersinia pestis
uucgcagccaaaauaauca

SEQ ID NO: 4140497 - RNA, 16 nt, Yersinia pestis
uucgcagcuuccagca

SEQ ID NO: 4140498 - RNA, 22 nt, Yersinia pestis
uucgcauaggguucuagagcau

SEQ ID NO: 4140499 - RNA, 14 nt, Yersinia pestis
uucgcaucuuccaa

SEQ ID NO: 4140500 - RNA, 15 nt, Yersinia pestis
uucgcaucuuccaaa

SEQ ID NO: 4140501 - RNA, 19 nt, Yersinia pestis
uucgcauucgugccauaaa

SEQ ID NO: 4140502 - RNA, 19 nt, Yersinia pestis
uucgccacgcugauacauu

SEQ ID NO: 4140503 - RNA, 11 nt, Yersinia pestis
uucgccccuua

SEQ ID NO: 4140504 - RNA, 23 nt, Yersinia pestis
uucgcggacgcuggcacugccau

SEQ ID NO: 4140505 - RNA, 18 nt, Yersinia pestis
uucgcggggcguauuauc

SEQ ID NO: 4140506 - RNA, 15 nt, Yersinia pestis
uucgcguuucauuuu

SEQ ID NO: 4140507 - RNA, 21 nt, Yersinia pestis
uucgcuauuucaaugggaugc

SEQ ID NO: 4140508 - RNA, 22 nt, Yersinia pestis
uucgcucggcucgaaccugaac

SEQ ID NO: 4140509 - RNA, 16 nt, Yersinia pestis
uucggcaggcagaaau

SEQ ID NO: 4140510 - RNA, 13 nt, Yersinia pestis
uucggccacccgc

SEQ ID NO: 4140511 - RNA, 17 nt, Yersinia pestis
uucggcgucgccacccc

SEQ ID NO: 4140512 - RNA, 18 nt, Yersinia pestis
uucggcuuucucuugcca

SEQ ID NO: 4140513 - RNA, 17 nt, Yersinia pestis
uucggggguugucagca

SEQ ID NO: 4140514 - RNA, 17 nt, Yersinia pestis
uucggguaucuguuuuu

SEQ ID NO: 4140515 - RNA, 22 nt, Yersinia pestis
uucgggugagugagcgcaggua

SEQ ID NO: 4140516 - RNA, 23 nt, Yersinia pestis
uucgggugagugagcgcggguaa

SEQ ID NO: 4140517 - RNA, 16 nt, Yersinia pestis
uucggugacuaaaauc

SEQ ID NO: 4140518 - RNA, 13 nt, Yersinia pestis
uucgguggcccug

SEQ ID NO: 4140519 - RNA, 13 nt, Yersinia pestis
uucgguggcccuu

SEQ ID NO: 4140520 - RNA, 22 nt, Yersinia pestis
uucguagaaacaucgccagcgg

SEQ ID NO: 4140521 - RNA, 19 nt, Yersinia pestis
uucguauguuuuuaacaaa

SEQ ID NO: 4140522 - RNA, 20 nt, Yersinia pestis
uucgucaauuuuugccuuuc

SEQ ID NO: 4140523 - RNA, 22 nt, Yersinia pestis
uucgucaccaucaauauaagag

SEQ ID NO: 4140524 - RNA, 23 nt, Yersinia pestis
uucgucgggggugccguagguaa

SEQ ID NO: 4140525 - RNA, 20 nt, Yersinia pestis
uucgucuaaugucauuuccu

SEQ ID NO: 4140526 - RNA, 14 nt, Yersinia pestis
uucgucucaucaau

SEQ ID NO: 4140527 - RNA, 14 nt, Yersinia pestis
uucgugcucaucaa

SEQ ID NO: 4140528 - RNA, 20 nt, Yersinia pestis
uucgugcucaucaaccucag

SEQ ID NO: 4140529 - RNA, 22 nt, Yersinia pestis
uucguggaaaucgggugauaaa

SEQ ID NO: 4140530 - RNA, 23 nt, Yersinia pestis
uucguggugggcgguaguauuug

SEQ ID NO: 4140531 - RNA, 13 nt, Yersinia pestis
uucguguauauca

SEQ ID NO: 4140532 - RNA, 16 nt, Yersinia pestis
uucguguauaucacua

SEQ ID NO: 4140533 - RNA, 16 nt, Yersinia pestis
uucguuagcucuucac

SEQ ID NO: 4140534 - RNA, 13 nt, Yersinia pestis
uucguuucugucu

SEQ ID NO: 4140535 - RNA, 15 nt, Yersinia pestis
uucuaaaaaaugaac

SEQ ID NO: 4140536 - RNA, 19 nt, Yersinia pestis
uucuaaccaggugcagaua

SEQ ID NO: 4140537 - RNA, 17 nt, Yersinia pestis
uucuaauugauauuauu

SEQ ID NO: 4140538 - RNA, 22 nt, Yersinia pestis
uucuacaaauuuuuuauauucc

SEQ ID NO: 4140539 - RNA, 15 nt, Yersinia pestis
uucuacaauggccuu

SEQ ID NO: 4140540 - RNA, 21 nt, Yersinia pestis
uucuacccuggcggcaaacgc

SEQ ID NO: 4140541 - RNA, 17 nt, Yersinia pestis
uucuaccguaucagccc

SEQ ID NO: 4140542 - RNA, 22 nt, Yersinia pestis
uucuaccuggcucaaauuuggg

SEQ ID NO: 4140543 - RNA, 16 nt, Yersinia pestis
uucuacuccauucaga

SEQ ID NO: 4140544 - RNA, 13 nt, Yersinia pestis
uucuauaaugaug

SEQ ID NO: 4140545 - RNA, 23 nt, Yersinia pestis
uucuauccgaaaaauauucucaa

SEQ ID NO: 4140546 - RNA, 17 nt, Yersinia pestis
uucuaucgggcagguaa

SEQ ID NO: 4140547 - RNA, 18 nt, Yersinia pestis
uucuaucgggcagguaaa

SEQ ID NO: 4140548 - RNA, 18 nt, Yersinia pestis
uucuauuuccacaagcgu

SEQ ID NO: 4140549 - RNA, 17 nt, Yersinia pestis
uucucaaugauaaaauc

SEQ ID NO: 4140550 - RNA, 13 nt, Yersinia pestis
uucucagcaaggu

SEQ ID NO: 4140551 - RNA, 16 nt, Yersinia pestis
uucucauuaauaauga

SEQ ID NO: 4140552 - RNA, 15 nt, Yersinia pestis
uucuccacaccaacg

SEQ ID NO: 4140553 - RNA, 18 nt, Yersinia pestis
uucucgacauccaauuca

SEQ ID NO: 4140554 - RNA, 17 nt, Yersinia pestis
uucucuacaucauaacg

SEQ ID NO: 4140555 - RNA, 24 nt, Yersinia pestis
uucucuacugaauggaucacauca

SEQ ID NO: 4140556 - RNA, 23 nt, Yersinia pestis
uucucuaugcguguugccaccug

SEQ ID NO: 4140557 - RNA, 19 nt, Yersinia pestis
uucucuauucugcuuuuug

SEQ ID NO: 4140558 - RNA, 21 nt, Yersinia pestis
uucucugaacgcacuucaauc

SEQ ID NO: 4140559 - RNA, 22 nt, Yersinia pestis
uucucugcgcuguaagcaccag

SEQ ID NO: 4140560 - RNA, 21 nt, Yersinia pestis
uucucuggaguuauacccaua

SEQ ID NO: 4140561 - RNA, 17 nt, Yersinia pestis
uucucuggcuaaugucu

SEQ ID NO: 4140562 - RNA, 13 nt, Yersinia pestis
uucucuuuaucaa

SEQ ID NO: 4140563 - RNA, 15 nt, Yersinia pestis
uucugagauauguag

SEQ ID NO: 4140564 - RNA, 15 nt, Yersinia pestis
uucugaucauuauua

SEQ ID NO: 4140565 - RNA, 23 nt, Yersinia pestis
uucugaucguugccgcuaauucu

SEQ ID NO: 4140566 - RNA, 15 nt, Yersinia pestis
uucugcaauagccau

SEQ ID NO: 4140567 - RNA, 16 nt, Yersinia pestis
uucugccuauccucac

SEQ ID NO: 4140568 - RNA, 14 nt, Yersinia pestis
uucugcgagcguuu

SEQ ID NO: 4140569 - RNA, 20 nt, Yersinia pestis
uucugcucccaugucagaca

SEQ ID NO: 4140570 - RNA, 11 nt, Yersinia pestis
uucugcugcca

SEQ ID NO: 4140571 - RNA, 23 nt, Yersinia pestis
uucuggcagauguaaccacccac

SEQ ID NO: 4140572 - RNA, 13 nt, Yersinia pestis
uucuggcccuaaa

SEQ ID NO: 4140573 - RNA, 19 nt, Yersinia pestis
uucugggggugauauuugu

SEQ ID NO: 4140574 - RNA, 13 nt, Yersinia pestis
uucuggggucauc

SEQ ID NO: 4140575 - RNA, 17 nt, Yersinia pestis
uucuggguacaacacaa

SEQ ID NO: 4140576 - RNA, 18 nt, Yersinia pestis
uucuggguacaacacaaa

SEQ ID NO: 4140577 - RNA, 21 nt, Yersinia pestis
uucuggguacaacacaaaaac

SEQ ID NO: 4140578 - RNA, 17 nt, Yersinia pestis
uucuguagugccgccag

SEQ ID NO: 4140579 - RNA, 22 nt, Yersinia pestis
uucuguagugccgccagugcuu

SEQ ID NO: 4140580 - RNA, 13 nt, Yersinia pestis
uucuguuccaggc

SEQ ID NO: 4140581 - RNA, 16 nt, Yersinia pestis
uucuguuccaggcaag

SEQ ID NO: 4140582 - RNA, 14 nt, Yersinia pestis
uucuuaauaauauc

SEQ ID NO: 4140583 - RNA, 17 nt, Yersinia pestis
uucuuaauaccuaaaau

SEQ ID NO: 4140584 - RNA, 13 nt, Yersinia pestis
uucuuaauuuuau

SEQ ID NO: 4140585 - RNA, 18 nt, Yersinia pestis
uucuuacaagaaugcaga

SEQ ID NO: 4140586 - RNA, 16 nt, Yersinia pestis
uucuuacuaaaauauc

SEQ ID NO: 4140587 - RNA, 17 nt, Yersinia pestis
uucuuacuaaaauauca

SEQ ID NO: 4140588 - RNA, 17 nt, Yersinia pestis
uucuuagaccaccgcca

SEQ ID NO: 4140589 - RNA, 18 nt, Yersinia pestis
uucuuaggauaaccaauu

SEQ ID NO: 4140590 - RNA, 13 nt, Yersinia pestis
uucuuauauuauu

SEQ ID NO: 4140591 - RNA, 18 nt, Yersinia pestis
uucuuaucaaucaaaaaa

SEQ ID NO: 4140592 - RNA, 14 nt, Yersinia pestis
uucuuauuaaucaa

SEQ ID NO: 4140593 - RNA, 21 nt, Yersinia pestis
uucuucauugcugcuguuauu

SEQ ID NO: 4140594 - RNA, 10 nt, Yersinia pestis
uucuuccaac

SEQ ID NO: 4140595 - RNA, 12 nt, Yersinia pestis
uucuuccaucuu

SEQ ID NO: 4140596 - RNA, 15 nt, Yersinia pestis
uucuucucucacuuu

SEQ ID NO: 4140597 - RNA, 20 nt, Yersinia pestis
uucuucugggucuaucaggu

SEQ ID NO: 4140598 - RNA, 21 nt, Yersinia pestis
uucuugguacaaggucuugga

SEQ ID NO: 4140599 - RNA, 20 nt, Yersinia pestis
uugccacgccaguaaacagc

SEQ ID NO: 4140600 - RNA, 17 nt, Yersinia pestis
uugccacucauauucaa

SEQ ID NO: 4140601 - RNA, 19 nt, Yersinia pestis
uugccagccaucuugggcc

SEQ ID NO: 4140602 - RNA, 22 nt, Yersinia pestis
uugccagcggcggccaucccag

SEQ ID NO: 4140603 - RNA, 20 nt, Yersinia pestis
uugccagugaaucagccaga

SEQ ID NO: 4140604 - RNA, 14 nt, Yersinia pestis
uugccagugacucu

SEQ ID NO: 4140605 - RNA, 22 nt, Yersinia pestis
uugccauaaaugggaagggcgc

SEQ ID NO: 4140606 - RNA, 18 nt, Yersinia pestis
uugcccguuagccaugca

SEQ ID NO: 4140607 - RNA, 22 nt, Yersinia pestis
uugccgaucgaugggugaaagc

SEQ ID NO: 4140608 - RNA, 16 nt, Yersinia pestis
uugccgugguucaaau

SEQ ID NO: 4140609 - RNA, 16 nt, Yersinia pestis
uugccguguaagaacu

SEQ ID NO: 4140610 - RNA, 21 nt, Yersinia pestis
uugccucugcuagcaaauucc

SEQ ID NO: 4140611 - RNA, 16 nt, Yersinia pestis
uugccugaugccuuug

SEQ ID NO: 4140612 - RNA, 16 nt, Yersinia pestis
uugccugugcgcuggu

SEQ ID NO: 4140613 - RNA, 14 nt, Yersinia pestis
uugccuuucugggc

SEQ ID NO: 4140614 - RNA, 21 nt, Yersinia pestis
uugcgcacaaucagggcacuc

SEQ ID NO: 4140615 - RNA, 20 nt, Yersinia pestis
uugcgccgcauuguucucau

SEQ ID NO: 4140616 - RNA, 16 nt, Yersinia pestis
uugcgccggaauaaag

SEQ ID NO: 4140617 - RNA, 13 nt, Yersinia pestis
uugcgcgaaauau

SEQ ID NO: 4140618 - RNA, 15 nt, Yersinia pestis
uugcgcucaaccgaa

SEQ ID NO: 4140619 - RNA, 14 nt, Yersinia pestis
uugcgcuccacgcc

SEQ ID NO: 4140620 - RNA, 16 nt, Yersinia pestis
uugcgcugauaacuuc

SEQ ID NO: 4140621 - RNA, 21 nt, Yersinia pestis
uugcggaagguauccaauacc

SEQ ID NO: 4140622 - RNA, 21 nt, Yersinia pestis
uugcggcaaccaaacggcccu

SEQ ID NO: 4140623 - RNA, 14 nt, Yersinia pestis
uugcggcaauggcu

SEQ ID NO: 4140624 - RNA, 21 nt, Yersinia pestis
uugcggcgcacccuccaauaa

SEQ ID NO: 4140625 - RNA, 20 nt, Yersinia pestis
uugcggcguuucucagacug

SEQ ID NO: 4140626 - RNA, 15 nt, Yersinia pestis
uugcggcugaguggu

SEQ ID NO: 4140627 - RNA, 20 nt, Yersinia pestis
uugcgugacauacuuugccu

SEQ ID NO: 4140628 - RNA, 23 nt, Yersinia pestis
uugcguuaacugcgcuguucauc

SEQ ID NO: 4140629 - RNA, 19 nt, Yersinia pestis
uugcguuaccuaaaacuga

SEQ ID NO: 4140630 - RNA, 15 nt, Yersinia pestis
uugcucauguucgca

SEQ ID NO: 4140631 - RNA, 18 nt, Yersinia pestis
uugcucucgcuccagcuc

SEQ ID NO: 4140632 - RNA, 20 nt, Yersinia pestis
uugcugaguaaauuaaauuu

SEQ ID NO: 4140633 - RNA, 18 nt, Yersinia pestis
uugcugaugucauucuau

SEQ ID NO: 4140634 - RNA, 12 nt, Yersinia pestis
uugcugcaaccg

SEQ ID NO: 4140635 - RNA, 21 nt, Yersinia pestis
uugcuggagcauugcgcucug

SEQ ID NO: 4140636 - RNA, 15 nt, Yersinia pestis
uugcuggcgcugauc

SEQ ID NO: 4140637 - RNA, 22 nt, Yersinia pestis
uugcugugcgauuucacggaua

SEQ ID NO: 4140638 - RNA, 19 nt, Yersinia pestis
uugcuguuguaggacaaag

SEQ ID NO: 4140639 - RNA, 14 nt, Yersinia pestis
uugcuuaucacccc

SEQ ID NO: 4140640 - RNA, 17 nt, Yersinia pestis
uugcuuauccagccgcu

SEQ ID NO: 4140641 - RNA, 22 nt, Yersinia pestis
uugcuuaucgucaaguucauau

SEQ ID NO: 4140642 - RNA, 14 nt, Yersinia pestis
uugcuucugaacga

SEQ ID NO: 4140643 - RNA, 13 nt, Yersinia pestis
uugcuugcugccu

SEQ ID NO: 4140644 - RNA, 15 nt, Yersinia pestis
uugcuuucaggggcu

SEQ ID NO: 4140645 - RNA, 22 nt, Yersinia pestis
uugcuuuuaacuccuugaaacu

SEQ ID NO: 4140646 - RNA, 19 nt, Yersinia pestis
uugcuuuuugccagugguu

SEQ ID NO: 4140647 - RNA, 14 nt, Yersinia pestis
uugcuuuuugcuuu

SEQ ID NO: 4140648 - RNA, 22 nt, Yersinia pestis
uuggaaaaaucaguauuauaaa

SEQ ID NO: 4140649 - RNA, 14 nt, Yersinia pestis
uuggaaagggcaua

SEQ ID NO: 4140650 - RNA, 15 nt, Yersinia pestis
uuggaaaugacaaau

SEQ ID NO: 4140651 - RNA, 11 nt, Yersinia pestis
uuggaaugagu

SEQ ID NO: 4140652 - RNA, 15 nt, Yersinia pestis
uuggacccgucacca

SEQ ID NO: 4140653 - RNA, 19 nt, Yersinia pestis
uuggagucgcauguaggca

SEQ ID NO: 4140654 - RNA, 20 nt, Yersinia pestis
uuggauaauaaccugauauu

SEQ ID NO: 4140655 - RNA, 15 nt, Yersinia pestis
uuggauugagccacc

SEQ ID NO: 4140656 - RNA, 15 nt, Yersinia pestis
uuggauuggucaggu

SEQ ID NO: 4140657 - RNA, 14 nt, Yersinia pestis
uuggcaaaaauaau

SEQ ID NO: 4140658 - RNA, 17 nt, Yersinia pestis
uuggcaaucacaacccc

SEQ ID NO: 4140659 - RNA, 20 nt, Yersinia pestis
uuggcaugaaguuuaaccaa

SEQ ID NO: 4140660 - RNA, 13 nt, Yersinia pestis
uuggccgcuuugg

SEQ ID NO: 4140661 - RNA, 13 nt, Yersinia pestis
uuggcggcaccuu

SEQ ID NO: 4140662 - RNA, 16 nt, Yersinia pestis
uuggcuaaauaaccag

SEQ ID NO: 4140663 - RNA, 16 nt, Yersinia pestis
uuggcuaacuggcgcu

SEQ ID NO: 4140664 - RNA, 19 nt, Yersinia pestis
uuggcuagccugacaggcu

SEQ ID NO: 4140665 - RNA, 18 nt, Yersinia pestis
uuggcucgugaucagcag

SEQ ID NO: 4140666 - RNA, 15 nt, Yersinia pestis
uuggcuuggacagaa

SEQ ID NO: 4140667 - RNA, 17 nt, Yersinia pestis
uuggcuuuuucuuccag

SEQ ID NO: 4140668 - RNA, 15 nt, Yersinia pestis
uugggaacuggcgau

SEQ ID NO: 4140669 - RNA, 21 nt, Yersinia pestis
uugggcaauguugagaaauau

SEQ ID NO: 4140670 - RNA, 19 nt, Yersinia pestis
uugggcgggaucuccagaa

SEQ ID NO: 4140671 - RNA, 17 nt, Yersinia pestis
uugggguauaacgauca

SEQ ID NO: 4140672 - RNA, 22 nt, Yersinia pestis
uugggucgaucuguugauaaaa

SEQ ID NO: 4140673 - RNA, 15 nt, Yersinia pestis
uugggugaacacaga

SEQ ID NO: 4140674 - RNA, 16 nt, Yersinia pestis
uuggguuugagcagug

SEQ ID NO: 4140675 - RNA, 18 nt, Yersinia pestis
uugguaaaauauuuugcu

SEQ ID NO: 4140676 - RNA, 13 nt, Yersinia pestis
uugguaacgcaga

SEQ ID NO: 4140677 - RNA, 16 nt, Yersinia pestis
uugguaacgcagaaau

SEQ ID NO: 4140678 - RNA, 21 nt, Yersinia pestis
uugguagcuccgcagcuaaug

SEQ ID NO: 4140679 - RNA, 13 nt, Yersinia pestis
uuggucaaucaag

SEQ ID NO: 4140680 - RNA, 13 nt, Yersinia pestis
uugguggcuuuac

SEQ ID NO: 4140681 - RNA, 18 nt, Yersinia pestis
uuggugucccaaacucug

SEQ ID NO: 4140682 - RNA, 14 nt, Yersinia pestis
uugguguugcaaaa

SEQ ID NO: 4140683 - RNA, 18 nt, Yersinia pestis
uugguugaacauuuccac

SEQ ID NO: 4140684 - RNA, 14 nt, Yersinia pestis
uugguuggcuuuaa

SEQ ID NO: 4140685 - RNA, 14 nt, Yersinia pestis
uuguaaauuuuuuu

SEQ ID NO: 4140686 - RNA, 17 nt, Yersinia pestis
uuguaaccgacuugccc

SEQ ID NO: 4140687 - RNA, 15 nt, Yersinia pestis
uuguaacucaaugcc

SEQ ID NO: 4140688 - RNA, 18 nt, Yersinia pestis
uuguaaggugcuagugcu

SEQ ID NO: 4140689 - RNA, 20 nt, Yersinia pestis
uuguaagucagauugucaga

SEQ ID NO: 4140690 - RNA, 15 nt, Yersinia pestis
uuguaccccugaauc

SEQ ID NO: 4140691 - RNA, 20 nt, Yersinia pestis
uuguagcgccagguaagaaa

SEQ ID NO: 4140692 - RNA, 13 nt, Yersinia pestis
uuguaguaaccac

SEQ ID NO: 4140693 - RNA, 20 nt, Yersinia pestis
uuguauacaauugccugauu

SEQ ID NO: 4140694 - RNA, 14 nt, Yersinia pestis
uuguauugcucagg

SEQ ID NO: 4140695 - RNA, 14 nt, Yersinia pestis
uuguauuuugaaug

SEQ ID NO: 4140696 - RNA, 11 nt, Yersinia pestis
uuguauuuugu

SEQ ID NO: 4140697 - RNA, 24 nt, Yersinia pestis
uugucaauaaccucuaaucuccuc

SEQ ID NO: 4140698 - RNA, 18 nt, Yersinia pestis
uugucaccuaaccaaaca

SEQ ID NO: 4140699 - RNA, 12 nt, Yersinia pestis
uugucagcaguc

SEQ ID NO: 4140700 - RNA, 20 nt, Yersinia pestis
uugucagcagucugaaaucu

SEQ ID NO: 4140701 - RNA, 19 nt, Yersinia pestis
uugucagcagucugaagcc

SEQ ID NO: 4140702 - RNA, 22 nt, Yersinia pestis
uugucagcagucugaagccuac

SEQ ID NO: 4140703 - RNA, 22 nt, Yersinia pestis
uugucagcagucugagccucau

SEQ ID NO: 4140704 - RNA, 19 nt, Yersinia pestis
uugucagcagucugaggcc

SEQ ID NO: 4140705 - RNA, 13 nt, Yersinia pestis
uugucagccaugc

SEQ ID NO: 4140706 - RNA, 19 nt, Yersinia pestis
uugucaggcugaugccauc

SEQ ID NO: 4140707 - RNA, 18 nt, Yersinia pestis
uugucagguuaauaccug

SEQ ID NO: 4140708 - RNA, 16 nt, Yersinia pestis
uugucaugaaaaucuu

SEQ ID NO: 4140709 - RNA, 16 nt, Yersinia pestis
uugucauguugaccaa

SEQ ID NO: 4140710 - RNA, 15 nt, Yersinia pestis
uugucguauuuccag

SEQ ID NO: 4140711 - RNA, 13 nt, Yersinia pestis
uugucgucaggcg

SEQ ID NO: 4140712 - RNA, 17 nt, Yersinia pestis
uugucguuauuuucuau

SEQ ID NO: 4140713 - RNA, 17 nt, Yersinia pestis
uugucucuacucucugu

SEQ ID NO: 4140714 - RNA, 18 nt, Yersinia pestis
uugucuguaauaauaauu

SEQ ID NO: 4140715 - RNA, 16 nt, Yersinia pestis
uugucuuuaauaaaau

SEQ ID NO: 4140716 - RNA, 20 nt, Yersinia pestis
uugugaacgguaugaguggu

SEQ ID NO: 4140717 - RNA, 18 nt, Yersinia pestis
uugugagcgauauuuauc

SEQ ID NO: 4140718 - RNA, 19 nt, Yersinia pestis
uugugagguuagaaaacag

SEQ ID NO: 4140719 - RNA, 20 nt, Yersinia pestis
uugugagugacaugcuuaau

SEQ ID NO: 4140720 - RNA, 20 nt, Yersinia pestis
uugugcgccaaccgcuugca

SEQ ID NO: 4140721 - RNA, 13 nt, Yersinia pestis
uuuaucgauaacc

SEQ ID NO: 4140722 - RNA, 14 nt, Yersinia pestis
uuuaucgcaguaau

SEQ ID NO: 4140723 - RNA, 19 nt, Yersinia pestis
uuuaucugaugaaaaaguc

SEQ ID NO: 4140724 - RNA, 19 nt, Yersinia pestis
uuuaucugcauuaaaauaa

SEQ ID NO: 4140725 - RNA, 21 nt, Yersinia pestis
uuuaucugcauuaaaauaaca

SEQ ID NO: 4140726 - RNA, 14 nt, Yersinia pestis
uuuaucuucuucag

SEQ ID NO: 4140727 - RNA, 13 nt, Yersinia pestis
uuuaugcugccca

SEQ ID NO: 4140728 - RNA, 20 nt, Yersinia pestis
uuuauggcagaaaucagcca

SEQ ID NO: 4140729 - RNA, 21 nt, Yersinia pestis
uuuauggcgaugaugauuauu

SEQ ID NO: 4140730 - RNA, 14 nt, Yersinia pestis
uuuauuaaguuuuu

SEQ ID NO: 4140731 - RNA, 14 nt, Yersinia pestis
uuuauuacagagua

SEQ ID NO: 4140732 - RNA, 14 nt, Yersinia pestis
uuuauuagacauag

SEQ ID NO: 4140733 - RNA, 11 nt, Yersinia pestis
uuuauuauuca

SEQ ID NO: 4140734 - RNA, 16 nt, Yersinia pestis
uuuauugacuguaaau

SEQ ID NO: 4140735 - RNA, 19 nt, Yersinia pestis
uuuauugagaaucacuacg

SEQ ID NO: 4140736 - RNA, 19 nt, Yersinia pestis
uuuauugagcgaugacaau

SEQ ID NO: 4140737 - RNA, 21 nt, Yersinia pestis
uuuauuggucaauaaaauuaa

SEQ ID NO: 4140738 - RNA, 19 nt, Yersinia pestis
uuuauugucuuuaauaaaa

SEQ ID NO: 4140739 - RNA, 15 nt, Yersinia pestis
uuuauuguuaucaaa

SEQ ID NO: 4140740 - RNA, 16 nt, Yersinia pestis
uuuauuguuaucaaau

SEQ ID NO: 4140741 - RNA, 16 nt, Yersinia pestis
uuuauuuauuuccgcu

SEQ ID NO: 4140742 - RNA, 20 nt, Yersinia pestis
uuucaaaccacuguuuuuca

SEQ ID NO: 4140743 - RNA, 16 nt, Yersinia pestis
uuucaaaguaaaauaa

SEQ ID NO: 4140744 - RNA, 19 nt, Yersinia pestis
uuucaaauaguagaucuau

SEQ ID NO: 4140745 - RNA, 21 nt, Yersinia pestis
uuucaaauuaucgaucacaug

SEQ ID NO: 4140746 - RNA, 18 nt, Yersinia pestis
uuucaacgcauccaaaua

SEQ ID NO: 4140747 - RNA, 23 nt, Yersinia pestis
uuucaaguggucuaucauuuacg

SEQ ID NO: 4140748 - RNA, 14 nt, Yersinia pestis
uuucaaucacugcg

SEQ ID NO: 4140749 - RNA, 17 nt, Yersinia pestis
uuucaaugggaugccca

SEQ ID NO: 4140750 - RNA, 12 nt, Yersinia pestis
uuucaauugccc

SEQ ID NO: 4140751 - RNA, 14 nt, Yersinia pestis
uuucacccucugcg

SEQ ID NO: 4140752 - RNA, 15 nt, Yersinia pestis
uuucacccucugcgu

SEQ ID NO: 4140753 - RNA, 20 nt, Yersinia pestis
uuucacccuugauuuuacca

SEQ ID NO: 4140754 - RNA, 17 nt, Yersinia pestis
uuucacggauaucaaca

SEQ ID NO: 4140755 - RNA, 20 nt, Yersinia pestis
uuucacuggccuauuaagau

SEQ ID NO: 4140756 - RNA, 22 nt, Yersinia pestis
uuucacuggccuauuaagauaa

SEQ ID NO: 4140757 - RNA, 23 nt, Yersinia pestis
uuucacuggccuauuaagauaau

SEQ ID NO: 4140758 - RNA, 13 nt, Yersinia pestis
uuucacuuccauu

SEQ ID NO: 4140759 - RNA, 11 nt, Yersinia pestis
uuucagacucc

SEQ ID NO: 4140760 - RNA, 22 nt, Yersinia pestis
uuucagacugcugacaacccuc

SEQ ID NO: 4140761 - RNA, 15 nt, Yersinia pestis
uuucagcauaucccu

SEQ ID NO: 4140762 - RNA, 18 nt, Yersinia pestis
uuucagcuugcaacaaaa

SEQ ID NO: 4140763 - RNA, 20 nt, Yersinia pestis
uuucaggacugucuucaacu

SEQ ID NO: 4140764 - RNA, 15 nt, Yersinia pestis
uuucauaauaaugau

SEQ ID NO: 4140765 - RNA, 12 nt, Yersinia pestis
uuucauauguca

SEQ ID NO: 4140766 - RNA, 23 nt, Yersinia pestis
uuucaucccauaugcuauagcca

SEQ ID NO: 4140767 - RNA, 19 nt, Yersinia pestis
uuucaucccauauuccggu

SEQ ID NO: 4140768 - RNA, 22 nt, Yersinia pestis
uuucauccuaaagauaauuaau

SEQ ID NO: 4140769 - RNA, 17 nt, Yersinia pestis
uuucaucgaaaaaaaua

SEQ ID NO: 4140770 - RNA, 19 nt, Yersinia pestis
uuucaucgaaaaaaauacu

SEQ ID NO: 4140771 - RNA, 18 nt, Yersinia pestis
uuucaucgcugaauuuag

SEQ ID NO: 4140772 - RNA, 16 nt, Yersinia pestis
uuucaucucaauaacu

SEQ ID NO: 4140773 - RNA, 22 nt, Yersinia pestis
uuucaucucaauaacuauuuuu

SEQ ID NO: 4140774 - RNA, 16 nt, Yersinia pestis
uuucauggguuucuau

SEQ ID NO: 4140775 - RNA, 13 nt, Yersinia pestis
uuucauuacggcg

SEQ ID NO: 4140776 - RNA, 17 nt, Yersinia pestis
uuucauuagucaauguu

SEQ ID NO: 4140777 - RNA, 21 nt, Yersinia pestis
uuucauuccagauaaaauacu

SEQ ID NO: 4140778 - RNA, 21 nt, Yersinia pestis
uuucauucggcacagccagug

SEQ ID NO: 4140779 - RNA, 23 nt, Yersinia pestis
uuucauucggcacagccagugcu

SEQ ID NO: 4140780 - RNA, 21 nt, Yersinia pestis
uuucauuuguuggcaaauuaa

SEQ ID NO: 4140781 - RNA, 20 nt, Yersinia pestis
uuucauuuuaacaauuuuau

SEQ ID NO: 4140782 - RNA, 21 nt, Yersinia pestis
uuuccacgcccaacucuuuag

SEQ ID NO: 4140783 - RNA, 19 nt, Yersinia pestis
uuuccagcggcguaucaaa

SEQ ID NO: 4140784 - RNA, 20 nt, Yersinia pestis
uuuccagcggcguaucaaac

SEQ ID NO: 4140785 - RNA, 20 nt, Yersinia pestis
uuuccccuggcguuccugga

SEQ ID NO: 4140786 - RNA, 15 nt, Yersinia pestis
uuuccccuucauuug

SEQ ID NO: 4140787 - RNA, 16 nt, Yersinia pestis
uuucccgacagaacug

SEQ ID NO: 4140788 - RNA, 23 nt, Yersinia pestis
uuucccgaggagagaaaauuucu

SEQ ID NO: 4140789 - RNA, 17 nt, Yersinia pestis
uuucccgcuccaaauua

SEQ ID NO: 4140790 - RNA, 18 nt, Yersinia pestis
uuucccgcucuucaccaa

SEQ ID NO: 4140791 - RNA, 15 nt, Yersinia pestis
uuucccgugcacugc

SEQ ID NO: 4140792 - RNA, 13 nt, Yersinia pestis
uuucccguugaua

SEQ ID NO: 4140793 - RNA, 18 nt, Yersinia pestis
uuucccucagccaaagca

SEQ ID NO: 4140794 - RNA, 21 nt, Yersinia pestis
uuuccgucagcccaacgucau

SEQ ID NO: 4140795 - RNA, 14 nt, Yersinia pestis
uuuccguuaaccca

SEQ ID NO: 4140796 - RNA, 15 nt, Yersinia pestis
uuuccuacacuggcc

SEQ ID NO: 4140797 - RNA, 13 nt, Yersinia pestis
uuuccucuucauc

SEQ ID NO: 4140798 - RNA, 15 nt, Yersinia pestis
uuuccucuucaucua

SEQ ID NO: 4140799 - RNA, 11 nt, Yersinia pestis
uuuccucuuua

SEQ ID NO: 4140800 - RNA, 15 nt, Yersinia pestis
uuuccuguauuuccu

SEQ ID NO: 4140801 - RNA, 18 nt, Yersinia pestis
uuucgaguaguuuggcua

SEQ ID NO: 4140802 - RNA, 14 nt, Yersinia pestis
uuucgaguugaacu

SEQ ID NO: 4140803 - RNA, 13 nt, Yersinia pestis
uuucgcaguugcc

SEQ ID NO: 4140804 - RNA, 21 nt, Yersinia pestis
uuucgcccaagccgaccauua

SEQ ID NO: 4140805 - RNA, 17 nt, Yersinia pestis
uuucgcuuuacauugcu

SEQ ID NO: 4140806 - RNA, 21 nt, Yersinia pestis
uuucggaucagcgccugcugu

SEQ ID NO: 4140807 - RNA, 13 nt, Yersinia pestis
uuucgucauuauu

SEQ ID NO: 4140808 - RNA, 17 nt, Yersinia pestis
uuucguuguagacuucc

SEQ ID NO: 4140809 - RNA, 21 nt, Yersinia pestis
uuucguuuaaaaaauaucuau

SEQ ID NO: 4140810 - RNA, 13 nt, Yersinia pestis
uuucuaccgcuuc

SEQ ID NO: 4140811 - RNA, 16 nt, Yersinia pestis
uuucuacugcaugauu

SEQ ID NO: 4140812 - RNA, 13 nt, Yersinia pestis
uuucuaucccuau

SEQ ID NO: 4140813 - RNA, 15 nt, Yersinia pestis
uuucuaucucaucca

SEQ ID NO: 4140814 - RNA, 21 nt, Yersinia pestis
uuucuauguagaaguugccgu

SEQ ID NO: 4140815 - RNA, 12 nt, Yersinia pestis
uuucuauuucug

SEQ ID NO: 4140816 - RNA, 17 nt, Yersinia pestis
uuucuauuuucagcaua

SEQ ID NO: 4140817 - RNA, 15 nt, Yersinia pestis
uuucucaauacgcug

SEQ ID NO: 4140818 - RNA, 20 nt, Yersinia pestis
uuucucagguguuacacagu

SEQ ID NO: 4140819 - RNA, 15 nt, Yersinia pestis
uuucuccaacuaauc

SEQ ID NO: 4140820 - RNA, 14 nt, Yersinia pestis
uuucucccuuucac

SEQ ID NO: 4140821 - RNA, 19 nt, Yersinia pestis
uuucucgacauccaauuca

SEQ ID NO: 4140822 - RNA, 16 nt, Yersinia pestis
uuucucuaaaauuuua

SEQ ID NO: 4140823 - RNA, 17 nt, Yersinia pestis
uuucucugaugaacgga

SEQ ID NO: 4140824 - RNA, 12 nt, Yersinia pestis
uuucucugccgc

SEQ ID NO: 4140825 - RNA, 21 nt, Yersinia pestis
uuucugaagaugccaaucaaa

SEQ ID NO: 4140826 - RNA, 23 nt, Yersinia pestis
uuucugaagggcaaauugccgcu

SEQ ID NO: 4140827 - RNA, 21 nt, Yersinia pestis
uuucugcggcaagcugugccu

SEQ ID NO: 4140828 - RNA, 17 nt, Yersinia pestis
uuucuggcaauuucugu

SEQ ID NO: 4140829 - RNA, 13 nt, Yersinia pestis
uuucugucgaucu

SEQ ID NO: 4140830 - RNA, 23 nt, Yersinia pestis
uuucuguugaugaguaaacagag

SEQ ID NO: 4140831 - RNA, 15 nt, Yersinia pestis
uuucuuaauaauauc

SEQ ID NO: 4140832 - RNA, 15 nt, Yersinia pestis
uuucuuacuaaaaua

SEQ ID NO: 4140833 - RNA, 23 nt, Yersinia pestis
uuucuuacuaaaauaucacuaua

SEQ ID NO: 4140834 - RNA, 21 nt, Yersinia pestis
uuucuucaauaauguggcaug

SEQ ID NO: 4140835 - RNA, 22 nt, Yersinia pestis
uuucuuccgccagcagaaccau

SEQ ID NO: 4140836 - RNA, 15 nt, Yersinia pestis
uuucuucguuugcua

SEQ ID NO: 4140837 - RNA, 14 nt, Yersinia pestis
uuucuuucaguaau

SEQ ID NO: 4140838 - RNA, 18 nt, Yersinia pestis
uuucuuuuaaaucagaag

SEQ ID NO: 4140839 - RNA, 20 nt, Yersinia pestis
uuucuuuucgcuauuucucu

SEQ ID NO: 4140840 - RNA, 21 nt, Yersinia pestis
uuugaaauaacgccacaauau

SEQ ID NO: 4140841 - RNA, 22 nt, Yersinia pestis
uuugaagauuuaacgcauuagc

SEQ ID NO: 4140842 - RNA, 18 nt, Yersinia pestis
uuugaauggcugccauca

SEQ ID NO: 4140843 - RNA, 14 nt, Yersinia pestis
uuuuauuauuuuuu

SEQ ID NO: 4140844 - RNA, 15 nt, Yersinia pestis
uuuuauuauuuuuug

SEQ ID NO: 4140845 - RNA, 19 nt, Yersinia pestis
uuuuauugucuuuaauaaa

SEQ ID NO: 4140846 - RNA, 19 nt, Yersinia pestis
uuuucacuccggcaucauc

SEQ ID NO: 4140847 - RNA, 21 nt, Yersinia pestis
uuuucaggcuaaugcgcucug

SEQ ID NO: 4140848 - RNA, 15 nt, Yersinia pestis
uuuucauaaucaccu

SEQ ID NO: 4140849 - RNA, 18 nt, Yersinia pestis
uuuuccaggguccaacau

SEQ ID NO: 4140850 - RNA, 14 nt, Yersinia pestis
uuuucccucagcca

SEQ ID NO: 4140851 - RNA, 18 nt, Yersinia pestis
uuuucccuguagaacacc

SEQ ID NO: 4140852 - RNA, 15 nt, Yersinia pestis
uuuuccuauaaacca

SEQ ID NO: 4140853 - RNA, 21 nt, Yersinia pestis
uuuucgaacuuaacuacugca

SEQ ID NO: 4140854 - RNA, 15 nt, Yersinia pestis
uuuucgacaaaaaag

SEQ ID NO: 4140855 - RNA, 23 nt, Yersinia pestis
uuuucgggccacuacggcgacuu

SEQ ID NO: 4140856 - RNA, 15 nt, Yersinia pestis
uuuucucuuucuucu

SEQ ID NO: 4140857 - RNA, 13 nt, Yersinia pestis
uuuucugccuauc

SEQ ID NO: 4140858 - RNA, 14 nt, Yersinia pestis
uuuucugccuaucu

SEQ ID NO: 4140859 - RNA, 16 nt, Yersinia pestis
uuuucugcggaaugcu

SEQ ID NO: 4140860 - RNA, 19 nt, Yersinia pestis
uuuucuucugagauaugua

SEQ ID NO: 4140861 - RNA, 15 nt, Yersinia pestis
uuuugaacaaaccac

SEQ ID NO: 4140862 - RNA, 19 nt, Yersinia pestis
uuuugaauagguaaaacau

SEQ ID NO: 4140863 - RNA, 20 nt, Yersinia pestis
uuuugaggauauuagggcug

SEQ ID NO: 4140864 - RNA, 16 nt, Yersinia pestis
uuuugccaauauugcc

SEQ ID NO: 4140865 - RNA, 18 nt, Yersinia pestis
uuuugccacauuucccuu

SEQ ID NO: 4140866 - RNA, 18 nt, Yersinia pestis
uuuugcccgcgcuuccag

SEQ ID NO: 4140867 - RNA, 22 nt, Yersinia pestis
uuuugcgacaggcucagcacaa

SEQ ID NO: 4140868 - RNA, 23 nt, Yersinia pestis
uuuugcgccacaacccaauaaua

SEQ ID NO: 4140869 - RNA, 11 nt, Yersinia pestis
uuuugcugcca

SEQ ID NO: 4140870 - RNA, 15 nt, Yersinia pestis
uuuugcuuaaaacag

SEQ ID NO: 4140871 - RNA, 15 nt, Yersinia pestis
uuuuggccgcuacug

SEQ ID NO: 4140872 - RNA, 15 nt, Yersinia pestis
uuuuggccuucaucc

SEQ ID NO: 4140873 - RNA, 13 nt, Yersinia pestis
uuuuggcuugaaa

SEQ ID NO: 4140874 - RNA, 23 nt, Yersinia pestis
uuuuggggucugaauauaaauuu

SEQ ID NO: 4140875 - RNA, 17 nt, Yersinia pestis
uuuuggucguauucaua

SEQ ID NO: 4140876 - RNA, 17 nt, Yersinia pestis
uuuuggugacaaacgcu

SEQ ID NO: 4140877 - RNA, 14 nt, Yersinia pestis
uuuugguggcugcu

SEQ ID NO: 4140878 - RNA, 23 nt, Yersinia pestis
uuuuguuacugcuuaccuuguuu

SEQ ID NO: 4140879 - RNA, 14 nt, Yersinia pestis
uuuuguuuccccua

SEQ ID NO: 4140880 - RNA, 17 nt, Yersinia pestis
uuuuguuuucucuuaaa

SEQ ID NO: 4140881 - RNA, 19 nt, Yersinia pestis
uuuuuaaacuuguaucaaa

SEQ ID NO: 4140882 - RNA, 17 nt, Yersinia pestis
uuuuuaauuuagccauu

SEQ ID NO: 4140883 - RNA, 18 nt, Yersinia pestis
uuuuuacaagcacucaau

SEQ ID NO: 4140884 - RNA, 20 nt, Yersinia pestis
uuuuuacauauaauccaaaa

SEQ ID NO: 4140885 - RNA, 21 nt, Yersinia pestis
uuuuuacccguacaaaaauaa

SEQ ID NO: 4140886 - RNA, 18 nt, Yersinia pestis
uuuuuacugcguaacccc

SEQ ID NO: 4140887 - RNA, 12 nt, Yersinia pestis
uuuuuagaaaac

SEQ ID NO: 4140888 - RNA, 19 nt, Yersinia pestis
uuuuuauaggucaucccag

SEQ ID NO: 4140889 - RNA, 13 nt, Yersinia pestis
uuuuuaucccccu

SEQ ID NO: 4140890 - RNA, 12 nt, Yersinia pestis
uuuuuaucccua

SEQ ID NO: 4140891 - RNA, 21 nt, Yersinia pestis
uuuuucauaaucaccuucaau

SEQ ID NO: 4140892 - RNA, 17 nt, Yersinia pestis
uuuuucauagcguugcu

SEQ ID NO: 4140893 - RNA, 15 nt, Yersinia pestis
uuuuucccuucaacu

SEQ ID NO: 4140894 - RNA, 11 nt, Yersinia pestis
uuuuucucaau

SEQ ID NO: 4140895 - RNA, 15 nt, Yersinia pestis
uuuuucucaaucuca

SEQ ID NO: 4140896 - RNA, 13 nt, Yersinia pestis
uuuuucucuacau

SEQ ID NO: 4140897 - RNA, 22 nt, Yersinia pestis
uuuuucuguucagauuuaccau

SEQ ID NO: 4140898 - RNA, 19 nt, Yersinia pestis
uuuuucuuucaccaguggu

SEQ ID NO: 4140899 - RNA, 14 nt, Yersinia pestis
uuuuugaauaaucc

SEQ ID NO: 4140900 - RNA, 19 nt, Yersinia pestis
uuuuugacuuuaauuaaaa

SEQ ID NO: 4140901 - RNA, 19 nt, Yersinia pestis
uuuuugcauauaaaacacg

SEQ ID NO: 4140902 - RNA, 21 nt, Yersinia pestis
uuuuugcccggcugauauaac

SEQ ID NO: 4140903 - RNA, 23 nt, Yersinia pestis
uuuuugcgggacagaaagaaguc

SEQ ID NO: 4140904 - RNA, 14 nt, Yersinia pestis
uuuuugcuggaacu

SEQ ID NO: 4140905 - RNA, 15 nt, Yersinia pestis
uuuuugcuuuuugcu

SEQ ID NO: 4140906 - RNA, 20 nt, Yersinia pestis
uuuuuggggucugaauauaa

SEQ ID NO: 4140907 - RNA, 21 nt, Yersinia pestis
uuuuugguuuucuauuuccac

SEQ ID NO: 4140908 - RNA, 21 nt, Yersinia pestis
uuuuuguaucuauaauucagc

SEQ ID NO: 4140909 - RNA, 20 nt, Yersinia pestis
uuuuugucgcccugcgaggc

SEQ ID NO: 4140910 - RNA, 16 nt, Yersinia pestis
uuuuugugcuucauau

SEQ ID NO: 4140911 - RNA, 14 nt, Yersinia pestis
uuuuuuaaccaauu

SEQ ID NO: 4140912 - RNA, 13 nt, Yersinia pestis
uuuuuuaucagcc

SEQ ID NO: 4140913 - RNA, 17 nt, Yersinia pestis
uuuuuuauuuauagaau

SEQ ID NO: 4140914 - RNA, 18 nt, Yersinia pestis
uuuuuucaccaaccaauu

SEQ ID NO: 4140915 - RNA, 13 nt, Yersinia pestis
uuuuuucugcaaa

SEQ ID NO: 4140916 - RNA, 11 nt, Yersinia pestis
uuuuuugccag

SEQ ID NO: 4140917 - RNA, 14 nt, Yersinia pestis
aaaaaaaagaaaau

SEQ ID NO: 4140918 - RNA, 17 nt, Yersinia pestis
aaaaaaagaagaaaaau

SEQ ID NO: 4140919 - RNA, 12 nt, Yersinia pestis
aaaaaaagacac

SEQ ID NO: 4140920 - RNA, 11 nt, Yersinia pestis
aaaaaaauaaa

SEQ ID NO: 4140921 - RNA, 13 nt, Yersinia pestis
aaaaaaauuaaaa

SEQ ID NO: 4140922 - RNA, 10 nt, Yersinia pestis
aaaaaacagc

SEQ ID NO: 4140923 - RNA, 17 nt, Yersinia pestis
aaaaaaccaccaaaaua

SEQ ID NO: 4140924 - RNA, 20 nt, Yersinia pestis
aaaaaaccuuauuuuugcau

SEQ ID NO: 4140925 - RNA, 19 nt, Yersinia pestis
aaaaaagaguaaauaaaua

SEQ ID NO: 4140926 - RNA, 13 nt, Yersinia pestis
aaaaaauacgcuu

SEQ ID NO: 4140927 - RNA, 21 nt, Yersinia pestis
aaaaaaugccagccccaauca

SEQ ID NO: 4140928 - RNA, 16 nt, Yersinia pestis
aaaaaauuaaaauaau

SEQ ID NO: 4140929 - RNA, 13 nt, Yersinia pestis
aaaaaauuaucau

SEQ ID NO: 4140930 - RNA, 13 nt, Yersinia pestis
aaaaacaaauaau

SEQ ID NO: 4140931 - RNA, 23 nt, Yersinia pestis
aaaaacaaaugauuauuuauuua

SEQ ID NO: 4140932 - RNA, 17 nt, Yersinia pestis
aaaaacagacuaaaaac

SEQ ID NO: 4140933 - RNA, 19 nt, Yersinia pestis
aaaaacagcgaucuauucu

SEQ ID NO: 4140934 - RNA, 15 nt, Yersinia pestis
aaaaacagucauuaa

SEQ ID NO: 4140935 - RNA, 20 nt, Yersinia pestis
aaaaaccaauggaaaauaca

SEQ ID NO: 4140936 - RNA, 19 nt, Yersinia pestis
aaaaacccauuaaaaacaa

SEQ ID NO: 4140937 - RNA, 21 nt, Yersinia pestis
aaaaacccauuaaaaacaaau

SEQ ID NO: 4140938 - RNA, 22 nt, Yersinia pestis
aaaaacccucucauccugcuau

SEQ ID NO: 4140939 - RNA, 19 nt, Yersinia pestis
aaaaaccggcguaaauaaa

SEQ ID NO: 4140940 - RNA, 15 nt, Yersinia pestis
aaaaacgcaacacag

SEQ ID NO: 4140941 - RNA, 17 nt, Yersinia pestis
aaaaacgccaucaauaa

SEQ ID NO: 4140942 - RNA, 19 nt, Yersinia pestis
aaaaacgccaucaauaauu

SEQ ID NO: 4140943 - RNA, 17 nt, Yersinia pestis
aaaaacgccuccaguga

SEQ ID NO: 4140944 - RNA, 23 nt, Yersinia pestis
aaaaacggacgaccuguagcuuu

SEQ ID NO: 4140945 - RNA, 21 nt, Yersinia pestis
aaaaacguuacugcucgccca

SEQ ID NO: 4140946 - RNA, 20 nt, Yersinia pestis
aaaaacugcggcaauaagca

SEQ ID NO: 4140947 - RNA, 19 nt, Yersinia pestis
aaaaacugugcaaauggcu

SEQ ID NO: 4140948 - RNA, 20 nt, Yersinia pestis
aaaaacugugcaaauggcuu

SEQ ID NO: 4140949 - RNA, 11 nt, Yersinia pestis
aaaaagaaaau

SEQ ID NO: 4140950 - RNA, 18 nt, Yersinia pestis
aaaaagaauuaauaaaua

SEQ ID NO: 4140951 - RNA, 14 nt, Yersinia pestis
aaaaagacacuaac

SEQ ID NO: 4140952 - RNA, 13 nt, Yersinia pestis
aaaaagagucagu

SEQ ID NO: 4140953 - RNA, 18 nt, Yersinia pestis
aaaaagauaauaaaacuc

SEQ ID NO: 4140954 - RNA, 12 nt, Yersinia pestis
aaaaagauggcu

SEQ ID NO: 4140955 - RNA, 13 nt, Yersinia pestis
aaaaagccugaau

SEQ ID NO: 4140956 - RNA, 22 nt, Yersinia pestis
aaaaagcgcgacgguacugauc

SEQ ID NO: 4140957 - RNA, 20 nt, Yersinia pestis
aaaaaggacacgauuuuuac

SEQ ID NO: 4140958 - RNA, 21 nt, Yersinia pestis
aaaaaggcaccagcgcacuga

SEQ ID NO: 4140959 - RNA, 17 nt, Yersinia pestis
aaaaaggcagugacagu

SEQ ID NO: 4140960 - RNA, 21 nt, Yersinia pestis
aaaaagguggccauuacgcca

SEQ ID NO: 4140961 - RNA, 14 nt, Yersinia pestis
aaaaauaaauuaga

SEQ ID NO: 4140962 - RNA, 15 nt, Yersinia pestis
aaaaauaaucaauga

SEQ ID NO: 4140963 - RNA, 12 nt, Yersinia pestis
aaaaauacaacc

SEQ ID NO: 4140964 - RNA, 13 nt, Yersinia pestis
aaaaauacaacca

SEQ ID NO: 4140965 - RNA, 21 nt, Yersinia pestis
aaaaauacaggugucaucaag

SEQ ID NO: 4140966 - RNA, 23 nt, Yersinia pestis
aaaaauagacagcaguuaaugcu

SEQ ID NO: 4140967 - RNA, 17 nt, Yersinia pestis
aaaaauagauuaaaagu

SEQ ID NO: 4140968 - RNA, 15 nt, Yersinia pestis
aaaaauaucuauuuc

SEQ ID NO: 4140969 - RNA, 18 nt, Yersinia pestis
aaaaauaucuauuuccau

SEQ ID NO: 4140970 - RNA, 23 nt, Yersinia pestis
aaaaauauuaacugcagugaaaa

SEQ ID NO: 4140971 - RNA, 12 nt, Yersinia pestis
aaaaauauuaau

SEQ ID NO: 4140972 - RNA, 14 nt, Yersinia pestis
aaaaaucaaguaca

SEQ ID NO: 4140973 - RNA, 22 nt, Yersinia pestis
aaaaaucaauaaacucuuucau

SEQ ID NO: 4140974 - RNA, 21 nt, Yersinia pestis
aaaaauccauaacauccuaaa

SEQ ID NO: 4140975 - RNA, 16 nt, Yersinia pestis
aaaaaucuuguuaauu

SEQ ID NO: 4140976 - RNA, 21 nt, Yersinia pestis
aaaaaugcacugaacaaugcc

SEQ ID NO: 4140977 - RNA, 12 nt, Yersinia pestis
aaaaauuaaauu

SEQ ID NO: 4140978 - RNA, 12 nt, Yersinia pestis
aaaaauuaucau

SEQ ID NO: 4140979 - RNA, 14 nt, Yersinia pestis
aaaaauuaucauca

SEQ ID NO: 4140980 - RNA, 19 nt, Yersinia pestis
aaaaauucacaacagugca

SEQ ID NO: 4140981 - RNA, 19 nt, Yersinia pestis
aaaaauucugagaucuaaa

SEQ ID NO: 4140982 - RNA, 23 nt, Yersinia pestis
aaaaauugacgaaaguuaaacaa

SEQ ID NO: 4140983 - RNA, 13 nt, Yersinia pestis
aaaacaaaguagu

SEQ ID NO: 4140984 - RNA, 14 nt, Yersinia pestis
aaaacaaauaauua

SEQ ID NO: 4140985 - RNA, 17 nt, Yersinia pestis
aaaacaacccgaauuaa

SEQ ID NO: 4140986 - RNA, 13 nt, Yersinia pestis
aaaacaauaaaaa

SEQ ID NO: 4140987 - RNA, 15 nt, Yersinia pestis
aaaacaauaaaaaga

SEQ ID NO: 4140988 - RNA, 16 nt, Yersinia pestis
aaaacaaucuggcagc

SEQ ID NO: 4140989 - RNA, 12 nt, Yersinia pestis
aaaacaauuucg

SEQ ID NO: 4140990 - RNA, 15 nt, Yersinia pestis
aaaacacaauuuuua

SEQ ID NO: 4140991 - RNA, 22 nt, Yersinia pestis
aaaacacagucugucguacuuu

SEQ ID NO: 4140992 - RNA, 14 nt, Yersinia pestis
aaaacaccucuaag

SEQ ID NO: 4140993 - RNA, 14 nt, Yersinia pestis
aaaacacucuuuuu

SEQ ID NO: 4140994 - RNA, 16 nt, Yersinia pestis
aaaacacuggcagcca

SEQ ID NO: 4140995 - RNA, 14 nt, Yersinia pestis
aaaacagacuaaaa

SEQ ID NO: 4140996 - RNA, 15 nt, Yersinia pestis
aaaacagacuaaaaa

SEQ ID NO: 4140997 - RNA, 19 nt, Yersinia pestis
aaaacagcagccaccaaaa

SEQ ID NO: 4140998 - RNA, 20 nt, Yersinia pestis
aaaacagcagccaccaaaaa

SEQ ID NO: 4140999 - RNA, 22 nt, Yersinia pestis
aaaacagcgaucuauucucugu

SEQ ID NO: 4141000 - RNA, 22 nt, Yersinia pestis
aaaacaguucggucuauaaaac

SEQ ID NO: 4141001 - RNA, 14 nt, Yersinia pestis
aaaaccaaauuacu

SEQ ID NO: 4141002 - RNA, 12 nt, Yersinia pestis
aaaaccaauuca

SEQ ID NO: 4141003 - RNA, 15 nt, Yersinia pestis
aaaaccaccaaaaua

SEQ ID NO: 4141004 - RNA, 11 nt, Yersinia pestis
aaaaccacuga

SEQ ID NO: 4141005 - RNA, 16 nt, Yersinia pestis
aaaacccauuaaaaac

SEQ ID NO: 4141006 - RNA, 21 nt, Yersinia pestis
aaaaccgcagcagacaacuga

SEQ ID NO: 4141007 - RNA, 21 nt, Yersinia pestis
aaaaccggcguaaauaaaagc

SEQ ID NO: 4141008 - RNA, 15 nt, Yersinia pestis
aaaaccgguuuuggu

SEQ ID NO: 4141009 - RNA, 19 nt, Yersinia pestis
aaaaccgugacuaaaacaa

SEQ ID NO: 4141010 - RNA, 15 nt, Yersinia pestis
aaaaccuaacgccaa

SEQ ID NO: 4141011 - RNA, 21 nt, Yersinia pestis
aaaaccuccgcgauaccaaua

SEQ ID NO: 4141012 - RNA, 14 nt, Yersinia pestis
aaaaccuccggcua

SEQ ID NO: 4141013 - RNA, 18 nt, Yersinia pestis
aaaaccugcuugaaagca

SEQ ID NO: 4141014 - RNA, 22 nt, Yersinia pestis
aaaaccuuauuuuugcauauaa

SEQ ID NO: 4141015 - RNA, 21 nt, Yersinia pestis
aaaaccuuuacaauuacacac

SEQ ID NO: 4141016 - RNA, 16 nt, Yersinia pestis
aaaacgaguaaauaca

SEQ ID NO: 4141017 - RNA, 23 nt, Yersinia pestis
aaaacgauuagcuugugugcuua

SEQ ID NO: 4141018 - RNA, 21 nt, Yersinia pestis
aaaacgcccuugccauaaaug

SEQ ID NO: 4141019 - RNA, 13 nt, Yersinia pestis
aaaacgccgguaa

SEQ ID NO: 4141020 - RNA, 16 nt, Yersinia pestis
aaaacgccuccaguga

SEQ ID NO: 4141021 - RNA, 12 nt, Yersinia pestis
aaaacggcaaaa

SEQ ID NO: 4141022 - RNA, 23 nt, Yersinia pestis
aaaacgugaaacgccuccucuug

SEQ ID NO: 4141023 - RNA, 15 nt, Yersinia pestis
aaaacgugaaagcac

SEQ ID NO: 4141024 - RNA, 17 nt, Yersinia pestis
aaaacguuaacugcagu

SEQ ID NO: 4141025 - RNA, 14 nt, Yersinia pestis
aaaacucaaacuga

SEQ ID NO: 4141026 - RNA, 15 nt, Yersinia pestis
aaaacucaaacugau

SEQ ID NO: 4141027 - RNA, 13 nt, Yersinia pestis
aaaacugaaaagu

SEQ ID NO: 4141028 - RNA, 17 nt, Yersinia pestis
aaaacugaagcaucaau

SEQ ID NO: 4141029 - RNA, 22 nt, Yersinia pestis
aaaacugacugccauaauccag

SEQ ID NO: 4141030 - RNA, 12 nt, Yersinia pestis
aaaacugagguc

SEQ ID NO: 4141031 - RNA, 21 nt, Yersinia pestis
aaaacugaugguuuccugaau

SEQ ID NO: 4141032 - RNA, 16 nt, Yersinia pestis
aaaacugugccugaau

SEQ ID NO: 4141033 - RNA, 17 nt, Yersinia pestis
aaaacuuaucuaaaaaa

SEQ ID NO: 4141034 - RNA, 21 nt, Yersinia pestis
aaaacuuuuauugucuuuaau

SEQ ID NO: 4141035 - RNA, 16 nt, Yersinia pestis
aaaagaaaaaaacaga

SEQ ID NO: 4141036 - RNA, 23 nt, Yersinia pestis
aaaagaaaauggcuuuuuuaaua

SEQ ID NO: 4141037 - RNA, 22 nt, Yersinia pestis
aaaagaaauuuuuagaaaacau

SEQ ID NO: 4141038 - RNA, 15 nt, Yersinia pestis
aaaagaagaaaaaua

SEQ ID NO: 4141039 - RNA, 24 nt, Yersinia pestis
aaaagaaugcgaagaaaaacacuu

SEQ ID NO: 4141040 - RNA, 20 nt, Yersinia pestis
aaaagagauccguuuaauca

SEQ ID NO: 4141041 - RNA, 17 nt, Yersinia pestis
aaaagagucgaugaaac

SEQ ID NO: 4141042 - RNA, 13 nt, Yersinia pestis
aaaagaucugcau

SEQ ID NO: 4141043 - RNA, 13 nt, Yersinia pestis
aaaagcaacuugg

SEQ ID NO: 4141044 - RNA, 14 nt, Yersinia pestis
aaaagcacagacaa

SEQ ID NO: 4141045 - RNA, 12 nt, Yersinia pestis
aaaagcaccgca

SEQ ID NO: 4141046 - RNA, 12 nt, Yersinia pestis
aaaagcagcagu

SEQ ID NO: 4141047 - RNA, 14 nt, Yersinia pestis
aaaagcaugcccag

SEQ ID NO: 4141048 - RNA, 19 nt, Yersinia pestis
aaaagcaugcccagccucu

SEQ ID NO: 4141049 - RNA, 20 nt, Yersinia pestis
aaaagccaccgcaucaauga

SEQ ID NO: 4141050 - RNA, 23 nt, Yersinia pestis
aaaagcccguucguugccaaaac

SEQ ID NO: 4141051 - RNA, 19 nt, Yersinia pestis
aaaagccugaauucuguag

SEQ ID NO: 4141052 - RNA, 16 nt, Yersinia pestis
aaaagcgaucagcaau

SEQ ID NO: 4141053 - RNA, 14 nt, Yersinia pestis
aaaaggauggccca

SEQ ID NO: 4141054 - RNA, 17 nt, Yersinia pestis
aaaaggauggcccaagc

SEQ ID NO: 4141055 - RNA, 20 nt, Yersinia pestis
aaaaggcaccagcgcacuga

SEQ ID NO: 4141056 - RNA, 18 nt, Yersinia pestis
aaaagggaguucaucaaa

SEQ ID NO: 4141057 - RNA, 17 nt, Yersinia pestis
aaaagguuaacugcagu

SEQ ID NO: 4141058 - RNA, 21 nt, Yersinia pestis
aaaaguauugcacugagagaa

SEQ ID NO: 4141059 - RNA, 15 nt, Yersinia pestis
aaaagucacuuaaac

SEQ ID NO: 4141060 - RNA, 15 nt, Yersinia pestis
aaaagucagcaaauc

SEQ ID NO: 4141061 - RNA, 22 nt, Yersinia pestis
aaaagucagcaaaucaaacaaa

SEQ ID NO: 4141062 - RNA, 16 nt, Yersinia pestis
aaaagucuaucucggc

SEQ ID NO: 4141063 - RNA, 21 nt, Yersinia pestis
aaaagugcuauccucuuaaug

SEQ ID NO: 4141064 - RNA, 21 nt, Yersinia pestis
aaaaguuaggguucaguaaaa

SEQ ID NO: 4141065 - RNA, 14 nt, Yersinia pestis
aaaaguuuuuugaa

SEQ ID NO: 4141066 - RNA, 12 nt, Yersinia pestis
aaaauaaaaauu

SEQ ID NO: 4141067 - RNA, 13 nt, Yersinia pestis
aaaauaacguagu

SEQ ID NO: 4141068 - RNA, 22 nt, Yersinia pestis
aaaauaacugggauauucugga

SEQ ID NO: 4141069 - RNA, 14 nt, Yersinia pestis
aaaauaauaauucu

SEQ ID NO: 4141070 - RNA, 16 nt, Yersinia pestis
aaaauacauaucaaca

SEQ ID NO: 4141071 - RNA, 16 nt, Yersinia pestis
aaaauacccaacaggu

SEQ ID NO: 4141072 - RNA, 17 nt, Yersinia pestis
aaaauacugccaaucgc

SEQ ID NO: 4141073 - RNA, 17 nt, Yersinia pestis
aaaauagaggaaauaaa

SEQ ID NO: 4141074 - RNA, 15 nt, Yersinia pestis
aaaauagcuucccug

SEQ ID NO: 4141075 - RNA, 13 nt, Yersinia pestis
aaaauauccagca

SEQ ID NO: 4141076 - RNA, 16 nt, Yersinia pestis
aaaauauccagcaacg

SEQ ID NO: 4141077 - RNA, 19 nt, Yersinia pestis
aaaauaucgcgcuucaggu

SEQ ID NO: 4141078 - RNA, 14 nt, Yersinia pestis
aaaauaucuuucaa

SEQ ID NO: 4141079 - RNA, 19 nt, Yersinia pestis
aaaauaugauaguguaaaa

SEQ ID NO: 4141080 - RNA, 22 nt, Yersinia pestis
aaaauaugauaguguaaaaacc

SEQ ID NO: 4141081 - RNA, 22 nt, Yersinia pestis
aaaauauuaacugcagugaaaa

SEQ ID NO: 4141082 - RNA, 15 nt, Yersinia pestis
aaaaucaaaaaugau

SEQ ID NO: 4141083 - RNA, 13 nt, Yersinia pestis
aaaaucaaaacag

SEQ ID NO: 4141084 - RNA, 19 nt, Yersinia pestis
aaaaucaccucaaacugac

SEQ ID NO: 4141085 - RNA, 22 nt, Yersinia pestis
aaaaucacgcggguuaucacau

SEQ ID NO: 4141086 - RNA, 14 nt, Yersinia pestis
aaaaucauugacgu

SEQ ID NO: 4141087 - RNA, 11 nt, Yersinia pestis
aaaauccccca

SEQ ID NO: 4141088 - RNA, 14 nt, Yersinia pestis
aaaaucccccacca

SEQ ID NO: 4141089 - RNA, 19 nt, Yersinia pestis
aaaauccccggaccagccg

SEQ ID NO: 4141090 - RNA, 19 nt, Yersinia pestis
aaaauccgguaauggccaa

SEQ ID NO: 4141091 - RNA, 18 nt, Yersinia pestis
aaaauccugaauaauacu

SEQ ID NO: 4141092 - RNA, 16 nt, Yersinia pestis
aaaaucgauggaauaa

SEQ ID NO: 4141093 - RNA, 13 nt, Yersinia pestis
aaaaucgcacuga

SEQ ID NO: 4141094 - RNA, 18 nt, Yersinia pestis
aaaaucguauaacauaau

SEQ ID NO: 4141095 - RNA, 22 nt, Yersinia pestis
aaaaucguauaacauaauaaau

SEQ ID NO: 4141096 - RNA, 19 nt, Yersinia pestis
aaaaucuuccuuuccauuu

SEQ ID NO: 4141097 - RNA, 15 nt, Yersinia pestis
aaaaucuuucuguuc

SEQ ID NO: 4141098 - RNA, 18 nt, Yersinia pestis
aaaaucuuucuguucagc

SEQ ID NO: 4141099 - RNA, 19 nt, Yersinia pestis
aaaaugaaauuuuauuacu

SEQ ID NO: 4141100 - RNA, 22 nt, Yersinia pestis
aaaaugagccgaccgucguaau

SEQ ID NO: 4141101 - RNA, 18 nt, Yersinia pestis
aaaaugauaaauucuugc

SEQ ID NO: 4141102 - RNA, 21 nt, Yersinia pestis
aaaaugcacugaacaaugcca

SEQ ID NO: 4141103 - RNA, 18 nt, Yersinia pestis
aaaaugccaacaacuggg

SEQ ID NO: 4141104 - RNA, 17 nt, Yersinia pestis
aaaaugccagccgguga

SEQ ID NO: 4141105 - RNA, 16 nt, Yersinia pestis
aaaaugccagucaaug

SEQ ID NO: 4141106 - RNA, 19 nt, Yersinia pestis
aaaaugccguacaacaaua

SEQ ID NO: 4141107 - RNA, 13 nt, Yersinia pestis
aaaaugguuucag

SEQ ID NO: 4141108 - RNA, 12 nt, Yersinia pestis
aaaauuaaaaua

SEQ ID NO: 4141109 - RNA, 13 nt, Yersinia pestis
aaaauuaaaauaa

SEQ ID NO: 4141110 - RNA, 22 nt, Yersinia pestis
aaaauuacaguucuuuauccac

SEQ ID NO: 4141111 - RNA, 20 nt, Yersinia pestis
aaaauuagcauuaccgguaa

SEQ ID NO: 4141112 - RNA, 15 nt, Yersinia pestis
aaaauuagccaagca

SEQ ID NO: 4141113 - RNA, 17 nt, Yersinia pestis
aaaauucaaacaaauau

SEQ ID NO: 4141114 - RNA, 22 nt, Yersinia pestis
aaaauucguuucucuaaaauuu

SEQ ID NO: 4141115 - RNA, 18 nt, Yersinia pestis
aaaauuugcuucguuucc

SEQ ID NO: 4141116 - RNA, 11 nt, Yersinia pestis
aaaauuuuaag

SEQ ID NO: 4141117 - RNA, 15 nt, Yersinia pestis
aaaauuuuaccgaug

SEQ ID NO: 4141118 - RNA, 12 nt, Yersinia pestis
aaacaaauacac

SEQ ID NO: 4141119 - RNA, 22 nt, Yersinia pestis
aaacaaaucuuaaauugaagag

SEQ ID NO: 4141120 - RNA, 19 nt, Yersinia pestis
aaacaacccgaauuaauaa

SEQ ID NO: 4141121 - RNA, 13 nt, Yersinia pestis
aaacaaccuaaaa

SEQ ID NO: 4141122 - RNA, 15 nt, Yersinia pestis
aaacaaccuaaaaaa

SEQ ID NO: 4141123 - RNA, 23 nt, Yersinia pestis
aaacaaugugauaccuaaaccuu

SEQ ID NO: 4141124 - RNA, 18 nt, Yersinia pestis
aaacaccuucacugaaua

SEQ ID NO: 4141125 - RNA, 23 nt, Yersinia pestis
aaacacgcgcuacgaugcagcuu

SEQ ID NO: 4141126 - RNA, 16 nt, Yersinia pestis
aaacacucaauaagua

SEQ ID NO: 4141127 - RNA, 16 nt, Yersinia pestis
aaacacuuagccagca

SEQ ID NO: 4141128 - RNA, 18 nt, Yersinia pestis
aaacacuuggauccgcag

SEQ ID NO: 4141129 - RNA, 16 nt, Yersinia pestis
aaacagacuaaaaacc

SEQ ID NO: 4141130 - RNA, 23 nt, Yersinia pestis
aaacagauacaucgccaguguug

SEQ ID NO: 4141131 - RNA, 23 nt, Yersinia pestis
aaacagaucacccgcaaaacuga

SEQ ID NO: 4141132 - RNA, 15 nt, Yersinia pestis
aaacagcaacaccau

SEQ ID NO: 4141133 - RNA, 17 nt, Yersinia pestis
aaacagcacuaucccca

SEQ ID NO: 4141134 - RNA, 16 nt, Yersinia pestis
aaacagcuuaucagcg

SEQ ID NO: 4141135 - RNA, 16 nt, Yersinia pestis
aaacagggcagaaaau

SEQ ID NO: 4141136 - RNA, 13 nt, Yersinia pestis
aaacaguagcagg

SEQ ID NO: 4141137 - RNA, 16 nt, Yersinia pestis
aaacagucuuauuacu

SEQ ID NO: 4141138 - RNA, 18 nt, Yersinia pestis
aaacaguuaaagguaaaa

SEQ ID NO: 4141139 - RNA, 22 nt, Yersinia pestis
aaacaguuacuccuacaccauu

SEQ ID NO: 4141140 - RNA, 13 nt, Yersinia pestis
aaacauaaaaaau

SEQ ID NO: 4141141 - RNA, 23 nt, Yersinia pestis
aaacaucaucccuauagacaaua

SEQ ID NO: 4141142 - RNA, 14 nt, Yersinia pestis
aaacaucaugacaa

SEQ ID NO: 4141143 - RNA, 17 nt, Yersinia pestis
aaacaucaugacaaaaa

SEQ ID NO: 4141144 - RNA, 18 nt, Yersinia pestis
aaacaucaugacaaaaau

SEQ ID NO: 4141145 - RNA, 17 nt, Yersinia pestis
aaacaucgacaccaaga

SEQ ID NO: 4141146 - RNA, 19 nt, Yersinia pestis
aaacauggcggcagcacag

SEQ ID NO: 4141147 - RNA, 23 nt, Yersinia pestis
aaacauuuucaucugaccaaaca

SEQ ID NO: 4141148 - RNA, 13 nt, Yersinia pestis
aaaccaaaaccuu

SEQ ID NO: 4141149 - RNA, 16 nt, Yersinia pestis
aaaccaaauuacuuua

SEQ ID NO: 4141150 - RNA, 17 nt, Yersinia pestis
aaaccaacugaaacugg

SEQ ID NO: 4141151 - RNA, 16 nt, Yersinia pestis
aaaccaagaagacuaa

SEQ ID NO: 4141152 - RNA, 15 nt, Yersinia pestis
aaaccacauuuuuua

SEQ ID NO: 4141153 - RNA, 18 nt, Yersinia pestis
aaaccaccaaaauagcgg

SEQ ID NO: 4141154 - RNA, 12 nt, Yersinia pestis
aaaccacgcggu

SEQ ID NO: 4141155 - RNA, 10 nt, Yersinia pestis
aaaccacuga

SEQ ID NO: 4141156 - RNA, 12 nt, Yersinia pestis
aaaccacugacc

SEQ ID NO: 4141157 - RNA, 14 nt, Yersinia pestis
aaaccacugaccua

SEQ ID NO: 4141158 - RNA, 21 nt, Yersinia pestis
aaaccacugaccuauugauaa

SEQ ID NO: 4141159 - RNA, 15 nt, Yersinia pestis
aaaccacugcgguca

SEQ ID NO: 4141160 - RNA, 14 nt, Yersinia pestis
aaaccagccaguga

SEQ ID NO: 4141161 - RNA, 12 nt, Yersinia pestis
aaaccauuuuac

SEQ ID NO: 4141162 - RNA, 14 nt, Yersinia pestis
aaacccaaccccau

SEQ ID NO: 4141163 - RNA, 20 nt, Yersinia pestis
aaacccaaccccaucagcau

SEQ ID NO: 4141164 - RNA, 20 nt, Yersinia pestis
aaacccauaaguccuuaaaa

SEQ ID NO: 4141165 - RNA, 20 nt, Yersinia pestis
aaaccccacccugugaaaua

SEQ ID NO: 4141166 - RNA, 19 nt, Yersinia pestis
aaacccgcgcagccuaaaa

SEQ ID NO: 4141167 - RNA, 17 nt, Yersinia pestis
aaaccgccuucuggugg

SEQ ID NO: 4141168 - RNA, 19 nt, Yersinia pestis
aaaccgcuggugacggcuu

SEQ ID NO: 4141169 - RNA, 12 nt, Yersinia pestis
aaaccgcuuauc

SEQ ID NO: 4141170 - RNA, 19 nt, Yersinia pestis
aaaccggcuaacgaggcau

SEQ ID NO: 4141171 - RNA, 22 nt, Yersinia pestis
aaaccggcuaacgaggcauaau

SEQ ID NO: 4141172 - RNA, 22 nt, Yersinia pestis
aaaccgggccuaauuuaacuuu

SEQ ID NO: 4141173 - RNA, 22 nt, Yersinia pestis
aaaccguacauuaaaugaauac

SEQ ID NO: 4141174 - RNA, 19 nt, Yersinia pestis
aaaccgugauugguuuauc

SEQ ID NO: 4141175 - RNA, 20 nt, Yersinia pestis
aaaccuagcugcugcaagag

SEQ ID NO: 4141176 - RNA, 19 nt, Yersinia pestis
aaaccuccgcgauaccaau

SEQ ID NO: 4141177 - RNA, 13 nt, Yersinia pestis
aaaccugauuuac

SEQ ID NO: 4141178 - RNA, 16 nt, Yersinia pestis
aaaccugugugaccuc

SEQ ID NO: 4141179 - RNA, 19 nt, Yersinia pestis
aaaccugugugaccuccgu

SEQ ID NO: 4141180 - RNA, 20 nt, Yersinia pestis
aaaccuuauuuuugcauaua

SEQ ID NO: 4141181 - RNA, 21 nt, Yersinia pestis
aaaccuucacuuuuaaaacuu

SEQ ID NO: 4141182 - RNA, 14 nt, Yersinia pestis
aaaccuugaauauc

SEQ ID NO: 4141183 - RNA, 17 nt, Yersinia pestis
aaaccuuuauguaacac

SEQ ID NO: 4141184 - RNA, 17 nt, Yersinia pestis
aaacgacacuaaccgua

SEQ ID NO: 4141185 - RNA, 16 nt, Yersinia pestis
aaacgacgggcugcug

SEQ ID NO: 4141186 - RNA, 18 nt, Yersinia pestis
aaacgacgggcugcugca

SEQ ID NO: 4141187 - RNA, 23 nt, Yersinia pestis
aaacgaguuuccaguucaagaua

SEQ ID NO: 4141188 - RNA, 13 nt, Yersinia pestis
aaacgcaacacag

SEQ ID NO: 4141189 - RNA, 21 nt, Yersinia pestis
aaacgccagauaugaucaaaa

SEQ ID NO: 4141190 - RNA, 17 nt, Yersinia pestis
aaacgccaucaauaauu

SEQ ID NO: 4141191 - RNA, 14 nt, Yersinia pestis
aaacgccccgauaa

SEQ ID NO: 4141192 - RNA, 20 nt, Yersinia pestis
aaacgccccgauaaaccaac

SEQ ID NO: 4141193 - RNA, 18 nt, Yersinia pestis
aaacgccgcgucaauaac

SEQ ID NO: 4141194 - RNA, 18 nt, Yersinia pestis
aaacgccuccucuuggau

SEQ ID NO: 4141195 - RNA, 14 nt, Yersinia pestis
aaacgccucguuua

SEQ ID NO: 4141196 - RNA, 20 nt, Yersinia pestis
aaacgccugauccaacaucg

SEQ ID NO: 4141197 - RNA, 17 nt, Yersinia pestis
aaacgccugggauccau

SEQ ID NO: 4141198 - RNA, 14 nt, Yersinia pestis
aaacgcugcacauc

SEQ ID NO: 4141199 - RNA, 22 nt, Yersinia pestis
aaacggcacaugggucucgccg

SEQ ID NO: 4141200 - RNA, 14 nt, Yersinia pestis
aaacggcgguuaau

SEQ ID NO: 4141201 - RNA, 17 nt, Yersinia pestis
aaacggcgguuaaucgg

SEQ ID NO: 4141202 - RNA, 15 nt, Yersinia pestis
aaacggcuuuuuaaa

SEQ ID NO: 4141203 - RNA, 20 nt, Yersinia pestis
aaacgggccgcgcagauuau

SEQ ID NO: 4141204 - RNA, 21 nt, Yersinia pestis
aaacggucauuguagauggcc

SEQ ID NO: 4141205 - RNA, 22 nt, Yersinia pestis
aaacggucauuguagauggcca

SEQ ID NO: 4141206 - RNA, 13 nt, Yersinia pestis
aaacgguugcugu

SEQ ID NO: 4141207 - RNA, 14 nt, Yersinia pestis
aaacguaaugcgaa

SEQ ID NO: 4141208 - RNA, 15 nt, Yersinia pestis
aaacguuacugcucg

SEQ ID NO: 4141209 - RNA, 16 nt, Yersinia pestis
aaacuaacgcgugaag

SEQ ID NO: 4141210 - RNA, 21 nt, Yersinia pestis
aaacuaagaguccuuaaaaac

SEQ ID NO: 4141211 - RNA, 13 nt, Yersinia pestis
aaacuaauaucuu

SEQ ID NO: 4141212 - RNA, 17 nt, Yersinia pestis
aaacuaccgaucaucag

SEQ ID NO: 4141213 - RNA, 14 nt, Yersinia pestis
aaacuauucugcuu

SEQ ID NO: 4141214 - RNA, 15 nt, Yersinia pestis
aaacucaccgagcau

SEQ ID NO: 4141215 - RNA, 20 nt, Yersinia pestis
aaacucaccgagcauauuuu

SEQ ID NO: 4141216 - RNA, 18 nt, Yersinia pestis
aaacucagccaauccagc

SEQ ID NO: 4141217 - RNA, 17 nt, Yersinia pestis
aaacucagcgaauaaau

SEQ ID NO: 4141218 - RNA, 19 nt, Yersinia pestis
aaacucaugacaucccagc

SEQ ID NO: 4141219 - RNA, 20 nt, Yersinia pestis
aaacucggccgggcugacau

SEQ ID NO: 4141220 - RNA, 13 nt, Yersinia pestis
aaacucuggaugg

SEQ ID NO: 4141221 - RNA, 18 nt, Yersinia pestis
aaacugaaaaaggcacca

SEQ ID NO: 4141222 - RNA, 17 nt, Yersinia pestis
aaacugaauaucccccu

SEQ ID NO: 4141223 - RNA, 20 nt, Yersinia pestis
aaacugaccgauaaacgcca

SEQ ID NO: 4141224 - RNA, 21 nt, Yersinia pestis
aaacugacugccauaauccag

SEQ ID NO: 4141225 - RNA, 20 nt, Yersinia pestis
aaacugaucaucaacgcgcc

SEQ ID NO: 4141226 - RNA, 19 nt, Yersinia pestis
aaacugauuaauaguguug

SEQ ID NO: 4141227 - RNA, 14 nt, Yersinia pestis
aaacugccuauuua

SEQ ID NO: 4141228 - RNA, 16 nt, Yersinia pestis
aaacugcgcuuccagc

SEQ ID NO: 4141229 - RNA, 14 nt, Yersinia pestis
aaacugugcaaaug

SEQ ID NO: 4141230 - RNA, 15 nt, Yersinia pestis
aaacugugcaaaugg

SEQ ID NO: 4141231 - RNA, 15 nt, Yersinia pestis
aaacuguucuuauug

SEQ ID NO: 4141232 - RNA, 13 nt, Yersinia pestis
aaacuuaauuuca

SEQ ID NO: 4141233 - RNA, 16 nt, Yersinia pestis
aaacuucacuuucuuu

SEQ ID NO: 4141234 - RNA, 14 nt, Yersinia pestis
aaacuuguaucaaa

SEQ ID NO: 4141235 - RNA, 18 nt, Yersinia pestis
aaacuuugccguuggcaa

SEQ ID NO: 4141236 - RNA, 21 nt, Yersinia pestis
aaacuuuuauugucuuuaaua

SEQ ID NO: 4141237 - RNA, 13 nt, Yersinia pestis
aaacuuuucaguu

SEQ ID NO: 4141238 - RNA, 22 nt, Yersinia pestis
aaacuuuucaguuuuaauuuau

SEQ ID NO: 4141239 - RNA, 12 nt, Yersinia pestis
aaagaaaaauag

SEQ ID NO: 4141240 - RNA, 13 nt, Yersinia pestis
aaagaaaauuuac

SEQ ID NO: 4141241 - RNA, 19 nt, Yersinia pestis
aaagaaauaaaagaaaacc

SEQ ID NO: 4141242 - RNA, 14 nt, Yersinia pestis
aaagaaauuuuuag

SEQ ID NO: 4141243 - RNA, 20 nt, Yersinia pestis
aaagaaauuuuuagaaaaca

SEQ ID NO: 4141244 - RNA, 20 nt, Yersinia pestis
aaagaaccgguguaccgacc

SEQ ID NO: 4141245 - RNA, 20 nt, Yersinia pestis
aaagaagaauccacauaaaa

SEQ ID NO: 4141246 - RNA, 20 nt, Yersinia pestis
aaagaagacgaguaaugaaa

SEQ ID NO: 4141247 - RNA, 17 nt, Yersinia pestis
aaagaaggguuagcauu

SEQ ID NO: 4141248 - RNA, 18 nt, Yersinia pestis
aaagacauaucacaguua

SEQ ID NO: 4141249 - RNA, 18 nt, Yersinia pestis
aaagacccaauacaccac

SEQ ID NO: 4141250 - RNA, 19 nt, Yersinia pestis
aaagacgccggcuucccug

SEQ ID NO: 4141251 - RNA, 23 nt, Yersinia pestis
aaagacgccguaaauacauccau

SEQ ID NO: 4141252 - RNA, 23 nt, Yersinia pestis
aaagacgccuuccggcaucuuuu

SEQ ID NO: 4141253 - RNA, 18 nt, Yersinia pestis
aaagacgcuaauuaaaga

SEQ ID NO: 4141254 - RNA, 19 nt, Yersinia pestis
aaagacggccaacugcugg

SEQ ID NO: 4141255 - RNA, 23 nt, Yersinia pestis
aaagacggccaacugcuggccaa

SEQ ID NO: 4141256 - RNA, 16 nt, Yersinia pestis
aaagacgucauaaaua

SEQ ID NO: 4141257 - RNA, 20 nt, Yersinia pestis
aaagacuuuauucacagcag

SEQ ID NO: 4141258 - RNA, 21 nt, Yersinia pestis
aaagacuuuauucacagcaga

SEQ ID NO: 4141259 - RNA, 23 nt, Yersinia pestis
aaagacuuuauucacagcagaac

SEQ ID NO: 4141260 - RNA, 21 nt, Yersinia pestis
aaagacuuuuccaacggcucu

SEQ ID NO: 4141261 - RNA, 19 nt, Yersinia pestis
aaagagauccguuuaauca

SEQ ID NO: 4141262 - RNA, 22 nt, Yersinia pestis
aaagagcgcucuggcgcucuug

SEQ ID NO: 4141263 - RNA, 19 nt, Yersinia pestis
aaagaggccagcuucccug

SEQ ID NO: 4141264 - RNA, 21 nt, Yersinia pestis
aaagagguguucuugaaaaaa

SEQ ID NO: 4141265 - RNA, 16 nt, Yersinia pestis
aaagaguaaauaaaua

SEQ ID NO: 4141266 - RNA, 15 nt, Yersinia pestis
aaagauaauaaaacu

SEQ ID NO: 4141267 - RNA, 18 nt, Yersinia pestis
aaagauaauuuagcaaag

SEQ ID NO: 4141268 - RNA, 14 nt, Yersinia pestis
aaagauagcaaaag

SEQ ID NO: 4141269 - RNA, 17 nt, Yersinia pestis
aaagauagcaaaagaau

SEQ ID NO: 4141270 - RNA, 21 nt, Yersinia pestis
aaagauagcaaaagaaucagu

SEQ ID NO: 4141271 - RNA, 23 nt, Yersinia pestis
aaagaucugcauugauuaaauca

SEQ ID NO: 4141272 - RNA, 12 nt, Yersinia pestis
aaagauuaagac

SEQ ID NO: 4141273 - RNA, 18 nt, Yersinia pestis
aaagauuauguagauccc

SEQ ID NO: 4141274 - RNA, 16 nt, Yersinia pestis
aaagauucauaaaaaa

SEQ ID NO: 4141275 - RNA, 20 nt, Yersinia pestis
aaagauucauaaaaaaagaa

SEQ ID NO: 4141276 - RNA, 16 nt, Yersinia pestis
aaagauuucaucauuc

SEQ ID NO: 4141277 - RNA, 23 nt, Yersinia pestis
aaagauuuccuuucgcacuuuaa

SEQ ID NO: 4141278 - RNA, 22 nt, Yersinia pestis
aaagcaaacgccgcucuucagc

SEQ ID NO: 4141279 - RNA, 17 nt, Yersinia pestis
aaagcacagacaaacaa

SEQ ID NO: 4141280 - RNA, 17 nt, Yersinia pestis
aaagcacgauaaaugua

SEQ ID NO: 4141281 - RNA, 20 nt, Yersinia pestis
aaagcagacuugaacuucga

SEQ ID NO: 4141282 - RNA, 17 nt, Yersinia pestis
aaagcagagaaugagua

SEQ ID NO: 4141283 - RNA, 13 nt, Yersinia pestis
aaagcagcagcuu

SEQ ID NO: 4141284 - RNA, 21 nt, Yersinia pestis
aaagcagucgacaguguaaaa

SEQ ID NO: 4141285 - RNA, 14 nt, Yersinia pestis
aaagcagugcugaa

SEQ ID NO: 4141286 - RNA, 19 nt, Yersinia pestis
aaagcaucaaucaucugcu

SEQ ID NO: 4141287 - RNA, 14 nt, Yersinia pestis
aaagcaucaccaaa

SEQ ID NO: 4141288 - RNA, 17 nt, Yersinia pestis
aaagcauggcagguauc

SEQ ID NO: 4141289 - RNA, 14 nt, Yersinia pestis
aaagcauuuaucau

SEQ ID NO: 4141290 - RNA, 20 nt, Yersinia pestis
aaagcauuuaucauauuaac

SEQ ID NO: 4141291 - RNA, 13 nt, Yersinia pestis
aaagccaaacccc

SEQ ID NO: 4141292 - RNA, 12 nt, Yersinia pestis
aaagccaucgcc

SEQ ID NO: 4141293 - RNA, 17 nt, Yersinia pestis
aaagcccauagccaugg

SEQ ID NO: 4141294 - RNA, 13 nt, Yersinia pestis
aaagcccaucgcc

SEQ ID NO: 4141295 - RNA, 22 nt, Yersinia pestis
aaagccccauccguccaaugaa

SEQ ID NO: 4141296 - RNA, 15 nt, Yersinia pestis
aaagccgagcaagug

SEQ ID NO: 4141297 - RNA, 15 nt, Yersinia pestis
aaagccgccgccuuc

SEQ ID NO: 4141298 - RNA, 17 nt, Yersinia pestis
aaagccugaauucugua

SEQ ID NO: 4141299 - RNA, 19 nt, Yersinia pestis
aaagccugaauucuguaga

SEQ ID NO: 4141300 - RNA, 20 nt, Yersinia pestis
aaagcgauaucguuaucaac

SEQ ID NO: 4141301 - RNA, 14 nt, Yersinia pestis
aaagcgccuuccuu

SEQ ID NO: 4141302 - RNA, 18 nt, Yersinia pestis
aaagcgccuuccuuuuau

SEQ ID NO: 4141303 - RNA, 15 nt, Yersinia pestis
aaagcgccuuuuauu

SEQ ID NO: 4141304 - RNA, 23 nt, Yersinia pestis
aaagcgcguaucguccagcagca

SEQ ID NO: 4141305 - RNA, 15 nt, Yersinia pestis
aaagcggaucguguu

SEQ ID NO: 4141306 - RNA, 19 nt, Yersinia pestis
aaagcgggccagcaaccac

SEQ ID NO: 4141307 - RNA, 14 nt, Yersinia pestis
aaagcgguuaucac

SEQ ID NO: 4141308 - RNA, 20 nt, Yersinia pestis
aaagcguauuaccacgccgu

SEQ ID NO: 4141309 - RNA, 11 nt, Yersinia pestis
aaagcgucagc

SEQ ID NO: 4141310 - RNA, 23 nt, Yersinia pestis
aaagcguccgcgccaaggauggc

SEQ ID NO: 4141311 - RNA, 24 nt, Yersinia pestis
aaagcgugacgcugaacagccugu

SEQ ID NO: 4141312 - RNA, 14 nt, Yersinia pestis
aaagcuaauauucu

SEQ ID NO: 4141313 - RNA, 15 nt, Yersinia pestis
aaagcuauucaucug

SEQ ID NO: 4141314 - RNA, 23 nt, Yersinia pestis
aaagcucuacacugauugaaguc

SEQ ID NO: 4141315 - RNA, 14 nt, Yersinia pestis
aaagcugauaaccu

SEQ ID NO: 4141316 - RNA, 15 nt, Yersinia pestis
aaagcugauaaccug

SEQ ID NO: 4141317 - RNA, 13 nt, Yersinia pestis
aaagcuguaucga

SEQ ID NO: 4141318 - RNA, 11 nt, Yersinia pestis
aaaggaaggga

SEQ ID NO: 4141319 - RNA, 11 nt, Yersinia pestis
aaaggaagggg

SEQ ID NO: 4141320 - RNA, 18 nt, Yersinia pestis
aaaggacacgauuuuuac

SEQ ID NO: 4141321 - RNA, 21 nt, Yersinia pestis
aaaggauggcccaagccaucc

SEQ ID NO: 4141322 - RNA, 18 nt, Yersinia pestis
aaaggauuugaagacaac

SEQ ID NO: 4141323 - RNA, 16 nt, Yersinia pestis
aaaggcaaaaauugac

SEQ ID NO: 4141324 - RNA, 17 nt, Yersinia pestis
aaaggcaaaagcaucac

SEQ ID NO: 4141325 - RNA, 12 nt, Yersinia pestis
aaaggcaaagaa

SEQ ID NO: 4141326 - RNA, 13 nt, Yersinia pestis
aaaggcaaagaag

SEQ ID NO: 4141327 - RNA, 15 nt, Yersinia pestis
aaaggcaaagaagaa

SEQ ID NO: 4141328 - RNA, 21 nt, Yersinia pestis
aaaggcaacgaaggcaacaac

SEQ ID NO: 4141329 - RNA, 17 nt, Yersinia pestis
aaaggcaagauuucucu

SEQ ID NO: 4141330 - RNA, 20 nt, Yersinia pestis
aaaggccaccaaauugcggc

SEQ ID NO: 4141331 - RNA, 18 nt, Yersinia pestis
aaaggccccguaaucaug

SEQ ID NO: 4141332 - RNA, 22 nt, Yersinia pestis
aaaggcccgcuagugauagcgg

SEQ ID NO: 4141333 - RNA, 21 nt, Yersinia pestis
aaaggccggauguaaaacacg

SEQ ID NO: 4141334 - RNA, 19 nt, Yersinia pestis
aaaggcggugauaaacccu

SEQ ID NO: 4141335 - RNA, 15 nt, Yersinia pestis
aaaggguaaucagaa

SEQ ID NO: 4141336 - RNA, 18 nt, Yersinia pestis
aaagguaugugccaaaaa

SEQ ID NO: 4141337 - RNA, 20 nt, Yersinia pestis
aaagguaugugccaaaaaaa

SEQ ID NO: 4141338 - RNA, 21 nt, Yersinia pestis
aaagguaugugccaaaaaaag

SEQ ID NO: 4141339 - RNA, 14 nt, Yersinia pestis
aaagguuaacugca

SEQ ID NO: 4141340 - RNA, 22 nt, Yersinia pestis
aaagguuucugccuuaucaauc

SEQ ID NO: 4141341 - RNA, 15 nt, Yersinia pestis
aaaguaagcaagcau

SEQ ID NO: 4141342 - RNA, 13 nt, Yersinia pestis
aaaguaucgcuau

SEQ ID NO: 4141343 - RNA, 22 nt, Yersinia pestis
aaaguauucuuaucaaucaaaa

SEQ ID NO: 4141344 - RNA, 13 nt, Yersinia pestis
aaagucacacugu

SEQ ID NO: 4141345 - RNA, 23 nt, Yersinia pestis
aaagugagaaggguauugaagau

SEQ ID NO: 4141346 - RNA, 18 nt, Yersinia pestis
aaagugcuauccucuuaa

SEQ ID NO: 4141347 - RNA, 22 nt, Yersinia pestis
aaagugcuauccucuuaauguc

SEQ ID NO: 4141348 - RNA, 20 nt, Yersinia pestis
aaagugcugcaaggcauuaa

SEQ ID NO: 4141349 - RNA, 14 nt, Yersinia pestis
aaagugcuucucug

SEQ ID NO: 4141350 - RNA, 23 nt, Yersinia pestis
aaaguggcauaaccaaucaucac

SEQ ID NO: 4141351 - RNA, 22 nt, Yersinia pestis
aaaguggugagcugaucugcca

SEQ ID NO: 4141352 - RNA, 14 nt, Yersinia pestis
aaaguuaucaccaa

SEQ ID NO: 4141353 - RNA, 21 nt, Yersinia pestis
aaaguugagcagcaauaacuc

SEQ ID NO: 4141354 - RNA, 12 nt, Yersinia pestis
aaaguugcuguu

SEQ ID NO: 4141355 - RNA, 20 nt, Yersinia pestis
aaaguuuauaugcuugacug

SEQ ID NO: 4141356 - RNA, 21 nt, Yersinia pestis
aaaguuuuuccucaaacguga

SEQ ID NO: 4141357 - RNA, 17 nt, Yersinia pestis
aaauaaaauaauaaugg

SEQ ID NO: 4141358 - RNA, 14 nt, Yersinia pestis
aaauaaaauagcgu

SEQ ID NO: 4141359 - RNA, 14 nt, Yersinia pestis
aaauaaacaucaau

SEQ ID NO: 4141360 - RNA, 20 nt, Yersinia pestis
aaauaaacgcgaguuaggaa

SEQ ID NO: 4141361 - RNA, 21 nt, Yersinia pestis
aaauaaacgggcuuccaucag

SEQ ID NO: 4141362 - RNA, 19 nt, Yersinia pestis
aaauaaagggccugcaaac

SEQ ID NO: 4141363 - RNA, 19 nt, Yersinia pestis
aaauaaaguccagaggccg

SEQ ID NO: 4141364 - RNA, 11 nt, Yersinia pestis
aaauaaauaag

SEQ ID NO: 4141365 - RNA, 19 nt, Yersinia pestis
aaauaaauaaguucagauu

SEQ ID NO: 4141366 - RNA, 13 nt, Yersinia pestis
aaauaaauacucu

SEQ ID NO: 4141367 - RNA, 18 nt, Yersinia pestis
aaauaaccagagacagca

SEQ ID NO: 4141368 - RNA, 19 nt, Yersinia pestis
aaauaaccagagacagcaa

SEQ ID NO: 4141369 - RNA, 17 nt, Yersinia pestis
aaauaaccgccaaaaua

SEQ ID NO: 4141370 - RNA, 21 nt, Yersinia pestis
aaauaaccgccaaaauaucgc

SEQ ID NO: 4141371 - RNA, 14 nt, Yersinia pestis
aaauaaccucuaau

SEQ ID NO: 4141372 - RNA, 15 nt, Yersinia pestis
aaauaacguaguacu

SEQ ID NO: 4141373 - RNA, 16 nt, Yersinia pestis
aaauaacugccagggc

SEQ ID NO: 4141374 - RNA, 16 nt, Yersinia pestis
aaauaagaauaagggu

SEQ ID NO: 4141375 - RNA, 12 nt, Yersinia pestis
aaauaagccagu

SEQ ID NO: 4141376 - RNA, 20 nt, Yersinia pestis
aaauaagcguagggauaaau

SEQ ID NO: 4141377 - RNA, 21 nt, Yersinia pestis
aaauaauaauggugaaccaga

SEQ ID NO: 4141378 - RNA, 18 nt, Yersinia pestis
aaauaauaauucugcuau

SEQ ID NO: 4141379 - RNA, 23 nt, Yersinia pestis
aaauaauaucaagucuugaagag

SEQ ID NO: 4141380 - RNA, 13 nt, Yersinia pestis
aaauaauaucaau

SEQ ID NO: 4141381 - RNA, 20 nt, Yersinia pestis
aaauaauaucugucugacgg

SEQ ID NO: 4141382 - RNA, 18 nt, Yersinia pestis
aaauaaucagcucauuaa

SEQ ID NO: 4141383 - RNA, 20 nt, Yersinia pestis
aaauaaucauaucaaaauaa

SEQ ID NO: 4141384 - RNA, 19 nt, Yersinia pestis
aaauaaucggcaaaccgaa

SEQ ID NO: 4141385 - RNA, 15 nt, Yersinia pestis
aaauaaugaauuauu

SEQ ID NO: 4141386 - RNA, 14 nt, Yersinia pestis
aaauaauggccaag

SEQ ID NO: 4141387 - RNA, 15 nt, Yersinia pestis
aaauaaugguuucca

SEQ ID NO: 4141388 - RNA, 14 nt, Yersinia pestis
aaauaauuuguauu

SEQ ID NO: 4141389 - RNA, 23 nt, Yersinia pestis
aaauaauuuguauucucaucauc

SEQ ID NO: 4141390 - RNA, 15 nt, Yersinia pestis
aaauacaaccaacaa

SEQ ID NO: 4141391 - RNA, 20 nt, Yersinia pestis
aaauacauccauguaggcuc

SEQ ID NO: 4141392 - RNA, 18 nt, Yersinia pestis
aaauacccagcuucuuuu

SEQ ID NO: 4141393 - RNA, 22 nt, Yersinia pestis
aaauacccagcuucuuuuaaag

SEQ ID NO: 4141394 - RNA, 18 nt, Yersinia pestis
aaauaccgcgaucaacaa

SEQ ID NO: 4141395 - RNA, 13 nt, Yersinia pestis
aaauaccgcugcu

SEQ ID NO: 4141396 - RNA, 19 nt, Yersinia pestis
aaauaccggauuguucagc

SEQ ID NO: 4141397 - RNA, 24 nt, Yersinia pestis
aaauacggcgaaauauaaaacagu

SEQ ID NO: 4141398 - RNA, 23 nt, Yersinia pestis
aaauacggucaacgauuguuacg

SEQ ID NO: 4141399 - RNA, 20 nt, Yersinia pestis
aaauacuuaucuguuuucca

SEQ ID NO: 4141400 - RNA, 22 nt, Yersinia pestis
aaauagaagguaaucagacugc

SEQ ID NO: 4141401 - RNA, 16 nt, Yersinia pestis
aaauagacucaacaaa

SEQ ID NO: 4141402 - RNA, 17 nt, Yersinia pestis
aaauagaggaaauaaau

SEQ ID NO: 4141403 - RNA, 13 nt, Yersinia pestis
aaauagauuaaaa

SEQ ID NO: 4141404 - RNA, 13 nt, Yersinia pestis
aaauagauuuaac

SEQ ID NO: 4141405 - RNA, 15 nt, Yersinia pestis
aaauagcaagccaaa

SEQ ID NO: 4141406 - RNA, 22 nt, Yersinia pestis
aaauagccaaccagauuaaaua

SEQ ID NO: 4141407 - RNA, 15 nt, Yersinia pestis
aaauagcccucccug

SEQ ID NO: 4141408 - RNA, 13 nt, Yersinia pestis
aaauagccuguaa

SEQ ID NO: 4141409 - RNA, 15 nt, Yersinia pestis
aaauagccuucccug

SEQ ID NO: 4141410 - RNA, 18 nt, Yersinia pestis
aaauagcggccaacauaa

SEQ ID NO: 4141411 - RNA, 21 nt, Yersinia pestis
aaauagcggccaacauaauca

SEQ ID NO: 4141412 - RNA, 23 nt, Yersinia pestis
aaauagcggccaacauaaucaau

SEQ ID NO: 4141413 - RNA, 14 nt, Yersinia pestis
aaauagcuucccug

SEQ ID NO: 4141414 - RNA, 13 nt, Yersinia pestis
aaauaggcgucag

SEQ ID NO: 4141415 - RNA, 21 nt, Yersinia pestis
aaauaggcguuaucggcgcag

SEQ ID NO: 4141416 - RNA, 15 nt, Yersinia pestis
aaauaggcuaauuua

SEQ ID NO: 4141417 - RNA, 16 nt, Yersinia pestis
aaauagggcugucagc

SEQ ID NO: 4141418 - RNA, 19 nt, Yersinia pestis
aaauaguaauaauuaaucu

SEQ ID NO: 4141419 - RNA, 14 nt, Yersinia pestis
aaauagucaguaaa

SEQ ID NO: 4141420 - RNA, 23 nt, Yersinia pestis
aaauaguuagugaguuauucgcc

SEQ ID NO: 4141421 - RNA, 22 nt, Yersinia pestis
aaauauaagauuccuuaccuga

SEQ ID NO: 4141422 - RNA, 20 nt, Yersinia pestis
aaauauaauuucaaaguaaa

SEQ ID NO: 4141423 - RNA, 19 nt, Yersinia pestis
aaauauaccgccaagcgcc

SEQ ID NO: 4141424 - RNA, 15 nt, Yersinia pestis
aaauaucacgacuuu

SEQ ID NO: 4141425 - RNA, 22 nt, Yersinia pestis
aaauaucacuauaauuauuucu

SEQ ID NO: 4141426 - RNA, 19 nt, Yersinia pestis
aaauaucauccccuuucug

SEQ ID NO: 4141427 - RNA, 18 nt, Yersinia pestis
aaauauccccugcaagug

SEQ ID NO: 4141428 - RNA, 22 nt, Yersinia pestis
aaauauccuccgacauagccgg

SEQ ID NO: 4141429 - RNA, 21 nt, Yersinia pestis
aaauauccuccggcauagccg

SEQ ID NO: 4141430 - RNA, 10 nt, Yersinia pestis
aaauauccug

SEQ ID NO: 4141431 - RNA, 20 nt, Yersinia pestis
aaauauccugcucagcuaaa

SEQ ID NO: 4141432 - RNA, 16 nt, Yersinia pestis
aaauaugcugaccacu

SEQ ID NO: 4141433 - RNA, 16 nt, Yersinia pestis
aaauauggcggcauca

SEQ ID NO: 4141434 - RNA, 18 nt, Yersinia pestis
aaauauggguuaaaaacu

SEQ ID NO: 4141435 - RNA, 20 nt, Yersinia pestis
aaauauggguuaaaaacuuu

SEQ ID NO: 4141436 - RNA, 12 nt, Yersinia pestis
aaauauuaacau

SEQ ID NO: 4141437 - RNA, 22 nt, Yersinia pestis
aaauauucauuaaaaaauaauu

SEQ ID NO: 4141438 - RNA, 21 nt, Yersinia pestis
aaauauucuaaguaaaacaaa

SEQ ID NO: 4141439 - RNA, 21 nt, Yersinia pestis
aaauauucucaauauuaauaa

SEQ ID NO: 4141440 - RNA, 22 nt, Yersinia pestis
aaauauucucaauauuaauaau

SEQ ID NO: 4141441 - RNA, 18 nt, Yersinia pestis
aaauauuggcaacaacag

SEQ ID NO: 4141442 - RNA, 14 nt, Yersinia pestis
aaauauuguugcca

SEQ ID NO: 4141443 - RNA, 13 nt, Yersinia pestis
aaaucaaaaauga

SEQ ID NO: 4141444 - RNA, 20 nt, Yersinia pestis
aaaucaaacaaaucuuaaau

SEQ ID NO: 4141445 - RNA, 14 nt, Yersinia pestis
aaaucaaagugaga

SEQ ID NO: 4141446 - RNA, 10 nt, Yersinia pestis
aaaucaaaua

SEQ ID NO: 4141447 - RNA, 14 nt, Yersinia pestis
aaaucaaguacacu

SEQ ID NO: 4141448 - RNA, 14 nt, Yersinia pestis
aaaucaccccccug

SEQ ID NO: 4141449 - RNA, 19 nt, Yersinia pestis
aaaucacccgcaagaauaa

SEQ ID NO: 4141450 - RNA, 15 nt, Yersinia pestis
aaaucaccgccggau

SEQ ID NO: 4141451 - RNA, 19 nt, Yersinia pestis
aaaucacguuuccaaaacu

SEQ ID NO: 4141452 - RNA, 22 nt, Yersinia pestis
aaaucacguuuccaaaacucau

SEQ ID NO: 4141453 - RNA, 17 nt, Yersinia pestis
aaaucagacgagucuau

SEQ ID NO: 4141454 - RNA, 23 nt, Yersinia pestis
aaaucagacgagucuauugaaaa

SEQ ID NO: 4141455 - RNA, 12 nt, Yersinia pestis
aaaucagcaagc

SEQ ID NO: 4141456 - RNA, 16 nt, Yersinia pestis
aaaucagcaagcugcu

SEQ ID NO: 4141457 - RNA, 22 nt, Yersinia pestis
aaaucagccacuuccuguuuau

SEQ ID NO: 4141458 - RNA, 20 nt, Yersinia pestis
aaaucagcguuuuaaucaca

SEQ ID NO: 4141459 - RNA, 15 nt, Yersinia pestis
aaaucagcuucauua

SEQ ID NO: 4141460 - RNA, 23 nt, Yersinia pestis
aaaucagugaaggaugaauaaau

SEQ ID NO: 4141461 - RNA, 16 nt, Yersinia pestis
aaaucaguguaucaau

SEQ ID NO: 4141462 - RNA, 16 nt, Yersinia pestis
aaaucauaagugcauu

SEQ ID NO: 4141463 - RNA, 23 nt, Yersinia pestis
aaaucaucgcucaucgccaaagc

SEQ ID NO: 4141464 - RNA, 22 nt, Yersinia pestis
aaaucaugcaguuaaugacaua

SEQ ID NO: 4141465 - RNA, 14 nt, Yersinia pestis
aaauccacuacucg

SEQ ID NO: 4141466 - RNA, 22 nt, Yersinia pestis
aaauccagaucacggaaguaag

SEQ ID NO: 4141467 - RNA, 16 nt, Yersinia pestis
aaauccaucaauaggu

SEQ ID NO: 4141468 - RNA, 15 nt, Yersinia pestis
aaaucccagcagcaa

SEQ ID NO: 4141469 - RNA, 20 nt, Yersinia pestis
aaaucccccacgaucuccuc

SEQ ID NO: 4141470 - RNA, 21 nt, Yersinia pestis
aaaucccggcauauuauuugu

SEQ ID NO: 4141471 - RNA, 21 nt, Yersinia pestis
aaaucccgggaauaaucaauu

SEQ ID NO: 4141472 - RNA, 20 nt, Yersinia pestis
aaauccugaauaauacuguc

SEQ ID NO: 4141473 - RNA, 22 nt, Yersinia pestis
aaauccuguagcucagccuguu

SEQ ID NO: 4141474 - RNA, 13 nt, Yersinia pestis
aaaucgaaauuaa

SEQ ID NO: 4141475 - RNA, 16 nt, Yersinia pestis
aaaucgccaaacugcu

SEQ ID NO: 4141476 - RNA, 19 nt, Yersinia pestis
aaaucgccaaacugcucau

SEQ ID NO: 4141477 - RNA, 15 nt, Yersinia pestis
aaaucggcggccaug

SEQ ID NO: 4141478 - RNA, 14 nt, Yersinia pestis
aaaucuaaguucag

SEQ ID NO: 4141479 - RNA, 16 nt, Yersinia pestis
aaaucuaaguucagcg

SEQ ID NO: 4141480 - RNA, 19 nt, Yersinia pestis
aaaucuacaaagucugaua

SEQ ID NO: 4141481 - RNA, 20 nt, Yersinia pestis
aaaucuccuguggcacauca

SEQ ID NO: 4141482 - RNA, 22 nt, Yersinia pestis
aaaucuccuguggcacaucaau

SEQ ID NO: 4141483 - RNA, 18 nt, Yersinia pestis
aaaucucuugauuaccaa

SEQ ID NO: 4141484 - RNA, 19 nt, Yersinia pestis
aaaucugcuccaucaauaa

SEQ ID NO: 4141485 - RNA, 18 nt, Yersinia pestis
aaaucuggauaaugucgu

SEQ ID NO: 4141486 - RNA, 13 nt, Yersinia pestis
aaaucuuaaucag

SEQ ID NO: 4141487 - RNA, 21 nt, Yersinia pestis
aaaucuuccuuuccauuuuca

SEQ ID NO: 4141488 - RNA, 22 nt, Yersinia pestis
aaaucuugugaugcauauuauu

SEQ ID NO: 4141489 - RNA, 19 nt, Yersinia pestis
aaaucuuguuaauuuaaac

SEQ ID NO: 4141490 - RNA, 23 nt, Yersinia pestis
aaaucuuuuuguaauguuucuau

SEQ ID NO: 4141491 - RNA, 10 nt, Yersinia pestis
aaaugaaaca

SEQ ID NO: 4141492 - RNA, 13 nt, Yersinia pestis
aaaugaaacacua

SEQ ID NO: 4141493 - RNA, 13 nt, Yersinia pestis
aaaugacaaauca

SEQ ID NO: 4141494 - RNA, 18 nt, Yersinia pestis
aaaugacaaaucagcguu

SEQ ID NO: 4141495 - RNA, 12 nt, Yersinia pestis
aaaugacacuuu

SEQ ID NO: 4141496 - RNA, 16 nt, Yersinia pestis
aaaugacuaucccuuc

SEQ ID NO: 4141497 - RNA, 21 nt, Yersinia pestis
aaaugacuaucccuucaauca

SEQ ID NO: 4141498 - RNA, 17 nt, Yersinia pestis
aaaugagggauauaccc

SEQ ID NO: 4141499 - RNA, 14 nt, Yersinia pestis
aaaugauaacaaua

SEQ ID NO: 4141500 - RNA, 15 nt, Yersinia pestis
aaaugauaacaauaa

SEQ ID NO: 4141501 - RNA, 18 nt, Yersinia pestis
aaaugauaacaauaaaau

SEQ ID NO: 4141502 - RNA, 19 nt, Yersinia pestis
aaaugauaauaaaaaaacg

SEQ ID NO: 4141503 - RNA, 21 nt, Yersinia pestis
aaaugaucaucaagccaaugg

SEQ ID NO: 4141504 - RNA, 24 nt, Yersinia pestis
aaaugauuauuuauuuacagccac

SEQ ID NO: 4141505 - RNA, 19 nt, Yersinia pestis
aaaugcaccgcccagauuc

SEQ ID NO: 4141506 - RNA, 12 nt, Yersinia pestis
aaaugccaguaa

SEQ ID NO: 4141507 - RNA, 17 nt, Yersinia pestis
aaaugccgauaaaaacu

SEQ ID NO: 4141508 - RNA, 15 nt, Yersinia pestis
aaaugccgccugacu

SEQ ID NO: 4141509 - RNA, 19 nt, Yersinia pestis
aaaugcggcggcugaccac

SEQ ID NO: 4141510 - RNA, 19 nt, Yersinia pestis
aaaugcguagagucaguga

SEQ ID NO: 4141511 - RNA, 14 nt, Yersinia pestis
aaaugcucaucaag

SEQ ID NO: 4141512 - RNA, 21 nt, Yersinia pestis
aaaugcucucgagaaauaaau

SEQ ID NO: 4141513 - RNA, 18 nt, Yersinia pestis
aaauggaauaaaaaguca

SEQ ID NO: 4141514 - RNA, 20 nt, Yersinia pestis
aaauggcacuggaaacaaaa

SEQ ID NO: 4141515 - RNA, 18 nt, Yersinia pestis
aaauggcagcccuuauuc

SEQ ID NO: 4141516 - RNA, 21 nt, Yersinia pestis
aaauggcagggccgauaaaaa

SEQ ID NO: 4141517 - RNA, 15 nt, Yersinia pestis
aaauggccuugccca

SEQ ID NO: 4141518 - RNA, 18 nt, Yersinia pestis
aaaugggccacaggcugc

SEQ ID NO: 4141519 - RNA, 19 nt, Yersinia pestis
aaaugggccugaguggggg

SEQ ID NO: 4141520 - RNA, 18 nt, Yersinia pestis
aaauggguauauuuacca

SEQ ID NO: 4141521 - RNA, 14 nt, Yersinia pestis
aaauggucaggaac

SEQ ID NO: 4141522 - RNA, 16 nt, Yersinia pestis
aaauggucaguuuaau

SEQ ID NO: 4141523 - RNA, 17 nt, Yersinia pestis
aaauguacagucauuua

SEQ ID NO: 4141524 - RNA, 19 nt, Yersinia pestis
aaauguacagucauuuacu

SEQ ID NO: 4141525 - RNA, 20 nt, Yersinia pestis
aaaugucagaucgcgaugcg

SEQ ID NO: 4141526 - RNA, 21 nt, Yersinia pestis
aaaugucagaucgcgaugcgc

SEQ ID NO: 4141527 - RNA, 21 nt, Yersinia pestis
aaaugucgaaagauagcaaaa

SEQ ID NO: 4141528 - RNA, 13 nt, Yersinia pestis
aaaugucguacau

SEQ ID NO: 4141529 - RNA, 12 nt, Yersinia pestis
aaauuaaaaauu

SEQ ID NO: 4141530 - RNA, 15 nt, Yersinia pestis
aaauuaaaaauuaau

SEQ ID NO: 4141531 - RNA, 15 nt, Yersinia pestis
aaauuaaaacugaaa

SEQ ID NO: 4141532 - RNA, 13 nt, Yersinia pestis
aaauuaaaauaau

SEQ ID NO: 4141533 - RNA, 17 nt, Yersinia pestis
aaauuaaaauaaugagu

SEQ ID NO: 4141534 - RNA, 14 nt, Yersinia pestis
aaauuaaauuaaua

SEQ ID NO: 4141535 - RNA, 15 nt, Yersinia pestis
aaauuaaauuucugu

SEQ ID NO: 4141536 - RNA, 18 nt, Yersinia pestis
aaauuaaauuuuaauuau

SEQ ID NO: 4141537 - RNA, 19 nt, Yersinia pestis
aaauuaauuacuuuauuua

SEQ ID NO: 4141538 - RNA, 20 nt, Yersinia pestis
aaauuacagacaaaucacaa

SEQ ID NO: 4141539 - RNA, 12 nt, Yersinia pestis
aaauuaccacca

SEQ ID NO: 4141540 - RNA, 16 nt, Yersinia pestis
aaauuacgguuuacca

SEQ ID NO: 4141541 - RNA, 20 nt, Yersinia pestis
aaauuacucguauaaaaaau

SEQ ID NO: 4141542 - RNA, 22 nt, Yersinia pestis
aaauuacucguauaaaaaauaa

SEQ ID NO: 4141543 - RNA, 23 nt, Yersinia pestis
aaauuacucguauaaaaaauaag

SEQ ID NO: 4141544 - RNA, 16 nt, Yersinia pestis
aaauuagaaaacaagu

SEQ ID NO: 4141545 - RNA, 23 nt, Yersinia pestis
aaauuagaugguuaacucauuua

SEQ ID NO: 4141546 - RNA, 18 nt, Yersinia pestis
aaauuaucgcaauuucag

SEQ ID NO: 4141547 - RNA, 19 nt, Yersinia pestis
aaauuaugccagucuucca

SEQ ID NO: 4141548 - RNA, 22 nt, Yersinia pestis
aaauuauucaucguaucgugca

SEQ ID NO: 4141549 - RNA, 17 nt, Yersinia pestis
aaauuauugaguaacau

SEQ ID NO: 4141550 - RNA, 20 nt, Yersinia pestis
aaauuauugaguaacauuaa

SEQ ID NO: 4141551 - RNA, 19 nt, Yersinia pestis
aaauuauugccgcagauaa

SEQ ID NO: 4141552 - RNA, 13 nt, Yersinia pestis
aaauuauuuagaa

SEQ ID NO: 4141553 - RNA, 14 nt, Yersinia pestis
aaauuauuuagaaa

SEQ ID NO: 4141554 - RNA, 16 nt, Yersinia pestis
aaauuauuuagaaacc

SEQ ID NO: 4141555 - RNA, 23 nt, Yersinia pestis
aaauuauuuagaaacccggauuc

SEQ ID NO: 4141556 - RNA, 15 nt, Yersinia pestis
aaauucaaaauagag

SEQ ID NO: 4141557 - RNA, 21 nt, Yersinia pestis
aaauucaaaauagaggaaaua

SEQ ID NO: 4141558 - RNA, 22 nt, Yersinia pestis
aaauucaaccucuuguaaacca

SEQ ID NO: 4141559 - RNA, 17 nt, Yersinia pestis
aaauucaacuucuccug

SEQ ID NO: 4141560 - RNA, 11 nt, Yersinia pestis
aaauucaauuc

SEQ ID NO: 4141561 - RNA, 17 nt, Yersinia pestis
aaauucacaacagugca

SEQ ID NO: 4141562 - RNA, 14 nt, Yersinia pestis
aaauucacagcgcg

SEQ ID NO: 4141563 - RNA, 15 nt, Yersinia pestis
aaauucacguuuacu

SEQ ID NO: 4141564 - RNA, 14 nt, Yersinia pestis
aaauucaucucacg

SEQ ID NO: 4141565 - RNA, 20 nt, Yersinia pestis
aaauucaucuuuaacaacaa

SEQ ID NO: 4141566 - RNA, 15 nt, Yersinia pestis
aaauucauuaucagg

SEQ ID NO: 4141567 - RNA, 16 nt, Yersinia pestis
aaauuccgcuucacau

SEQ ID NO: 4141568 - RNA, 16 nt, Yersinia pestis
aaauucgggcuuuaau

SEQ ID NO: 4141569 - RNA, 18 nt, Yersinia pestis
aaauucgugcucaucaac

SEQ ID NO: 4141570 - RNA, 22 nt, Yersinia pestis
aaauucguuugggcuaagacua

SEQ ID NO: 4141571 - RNA, 14 nt, Yersinia pestis
aaauucuaccuggc

SEQ ID NO: 4141572 - RNA, 18 nt, Yersinia pestis
aaauucuauccggauuaa

SEQ ID NO: 4141573 - RNA, 19 nt, Yersinia pestis
aaauucucaaugauaaaau

SEQ ID NO: 4141574 - RNA, 21 nt, Yersinia pestis
aaauucuguagaguaaaacug

SEQ ID NO: 4141575 - RNA, 12 nt, Yersinia pestis
aaauugaagagu

SEQ ID NO: 4141576 - RNA, 23 nt, Yersinia pestis
aaauugcacaugcagcauuucag

SEQ ID NO: 4141577 - RNA, 18 nt, Yersinia pestis
aaauugcccgcguaaucu

SEQ ID NO: 4141578 - RNA, 15 nt, Yersinia pestis
aaauugccgcuuuag

SEQ ID NO: 4141579 - RNA, 20 nt, Yersinia pestis
aaauugcgcccggcccacuu

SEQ ID NO: 4141580 - RNA, 17 nt, Yersinia pestis
aaauugcugaaaaaaaa

SEQ ID NO: 4141581 - RNA, 23 nt, Yersinia pestis
aaauuggcuucacccuggcucug

SEQ ID NO: 4141582 - RNA, 14 nt, Yersinia pestis
aaauuguaacucuu

SEQ ID NO: 4141583 - RNA, 20 nt, Yersinia pestis
aaauuguauguuucuuuaau

SEQ ID NO: 4141584 - RNA, 21 nt, Yersinia pestis
aaauuguuccguuucucuuug

SEQ ID NO: 4141585 - RNA, 13 nt, Yersinia pestis
aaauuuaaaguuu

SEQ ID NO: 4141586 - RNA, 22 nt, Yersinia pestis
aaauuuaaaguuuuuuauuuau

SEQ ID NO: 4141587 - RNA, 17 nt, Yersinia pestis
aaauuuaagaaaucuau

SEQ ID NO: 4141588 - RNA, 16 nt, Yersinia pestis
aaauuuaauaaaaacc

SEQ ID NO: 4141589 - RNA, 14 nt, Yersinia pestis
aaauuuaauaaguu

SEQ ID NO: 4141590 - RNA, 12 nt, Yersinia pestis
aaauuucccccu

SEQ ID NO: 4141591 - RNA, 22 nt, Yersinia pestis
aaauuucugguuugaauccagu

SEQ ID NO: 4141592 - RNA, 20 nt, Yersinia pestis
aaauuugcaguauucaggug

SEQ ID NO: 4141593 - RNA, 22 nt, Yersinia pestis
aaauuuuauucgcguuucauuu

SEQ ID NO: 4141594 - RNA, 20 nt, Yersinia pestis
aaauuuuguacaacuucuuc

SEQ ID NO: 4141595 - RNA, 13 nt, Yersinia pestis
aaauuuuuauaua

SEQ ID NO: 4141596 - RNA, 17 nt, Yersinia pestis
aaauuuuuuauauucca

SEQ ID NO: 4141597 - RNA, 16 nt, Yersinia pestis
aacaaaaaguuaaaua

SEQ ID NO: 4141598 - RNA, 20 nt, Yersinia pestis
aacaaaaugcgguggcacug

SEQ ID NO: 4141599 - RNA, 22 nt, Yersinia pestis
aacaaaccuaaaccuuucagac

SEQ ID NO: 4141600 - RNA, 22 nt, Yersinia pestis
aacaaacuacuugguuuaaauu

SEQ ID NO: 4141601 - RNA, 14 nt, Yersinia pestis
aacaaaguuaugcc

SEQ ID NO: 4141602 - RNA, 12 nt, Yersinia pestis
aacaaauaauua

SEQ ID NO: 4141603 - RNA, 22 nt, Yersinia pestis
aacaaaucuuaaauugaagagu

SEQ ID NO: 4141604 - RNA, 16 nt, Yersinia pestis
aacaaaugaacccuuu

SEQ ID NO: 4141605 - RNA, 21 nt, Yersinia pestis
aacaaaugggccacaggcugc

SEQ ID NO: 4141606 - RNA, 18 nt, Yersinia pestis
aacaaaugggucgggaau

SEQ ID NO: 4141607 - RNA, 24 nt, Yersinia pestis
aacaaaugggucgggaaucauuug

SEQ ID NO: 4141608 - RNA, 20 nt, Yersinia pestis
aacaaauguuuaauggcauu

SEQ ID NO: 4141609 - RNA, 13 nt, Yersinia pestis
aacaaauucggcu

SEQ ID NO: 4141610 - RNA, 18 nt, Yersinia pestis
aacaacaaaggcgccaag

SEQ ID NO: 4141611 - RNA, 13 nt, Yersinia pestis
aacaacacaauua

SEQ ID NO: 4141612 - RNA, 12 nt, Yersinia pestis
aacaacagucaa

SEQ ID NO: 4141613 - RNA, 23 nt, Yersinia pestis
aacaaccauuguggcuaaaccca

SEQ ID NO: 4141614 - RNA, 23 nt, Yersinia pestis
aacaacccauuuccccuuucugg

SEQ ID NO: 4141615 - RNA, 18 nt, Yersinia pestis
aacaaccuaaaaaaaaca

SEQ ID NO: 4141616 - RNA, 19 nt, Yersinia pestis
aacaaccuaaaaaaaacaa

SEQ ID NO: 4141617 - RNA, 15 nt, Yersinia pestis
aacaacggugaacag

SEQ ID NO: 4141618 - RNA, 16 nt, Yersinia pestis
aacaacgucauuugug

SEQ ID NO: 4141619 - RNA, 18 nt, Yersinia pestis
aacaacucgaauuauuuu

SEQ ID NO: 4141620 - RNA, 16 nt, Yersinia pestis
aacaacuggugucaau

SEQ ID NO: 4141621 - RNA, 15 nt, Yersinia pestis
aacaagaacaccaga

SEQ ID NO: 4141622 - RNA, 23 nt, Yersinia pestis
aacaagacugcuaauaccaccac

SEQ ID NO: 4141623 - RNA, 18 nt, Yersinia pestis
aacaagauuacaucagug

SEQ ID NO: 4141624 - RNA, 17 nt, Yersinia pestis
aacaagccccacaguac

SEQ ID NO: 4141625 - RNA, 23 nt, Yersinia pestis
aacaaggaaaucgaaauuaagga

SEQ ID NO: 4141626 - RNA, 16 nt, Yersinia pestis
aacaagggguuucaga

SEQ ID NO: 4141627 - RNA, 18 nt, Yersinia pestis
aacaaguuacauuuuuaa

SEQ ID NO: 4141628 - RNA, 14 nt, Yersinia pestis
aacaaguugcuuaa

SEQ ID NO: 4141629 - RNA, 21 nt, Yersinia pestis
aacaauaaaaagaucugcauu

SEQ ID NO: 4141630 - RNA, 21 nt, Yersinia pestis
aacaauauucauuuugcugga

SEQ ID NO: 4141631 - RNA, 17 nt, Yersinia pestis
aacaauccuauauacaa

SEQ ID NO: 4141632 - RNA, 20 nt, Yersinia pestis
aacaaucuggcagccgguga

SEQ ID NO: 4141633 - RNA, 23 nt, Yersinia pestis
aacaaugaccaucuuccagcauc

SEQ ID NO: 4141634 - RNA, 16 nt, Yersinia pestis
aacaaugcuuuuugga

SEQ ID NO: 4141635 - RNA, 23 nt, Yersinia pestis
aacaauugcuccaguugauacag

SEQ ID NO: 4141636 - RNA, 20 nt, Yersinia pestis
aacaauuuaucagacaaucu

SEQ ID NO: 4141637 - RNA, 12 nt, Yersinia pestis
aacaauuucgaa

SEQ ID NO: 4141638 - RNA, 20 nt, Yersinia pestis
aacaauuuuauuguuuucgu

SEQ ID NO: 4141639 - RNA, 12 nt, Yersinia pestis
aacacaauugau

SEQ ID NO: 4141640 - RNA, 14 nt, Yersinia pestis
aacacaauuuuuag

SEQ ID NO: 4141641 - RNA, 22 nt, Yersinia pestis
aacacaccugcaacguuaaaga

SEQ ID NO: 4141642 - RNA, 23 nt, Yersinia pestis
aacacacuuagcuaagcucuucc

SEQ ID NO: 4141643 - RNA, 21 nt, Yersinia pestis
aacacacuucgccgggucagg

SEQ ID NO: 4141644 - RNA, 23 nt, Yersinia pestis
aacacagagguagacguaucaug

SEQ ID NO: 4141645 - RNA, 21 nt, Yersinia pestis
aacacagguucuccaggguuu

SEQ ID NO: 4141646 - RNA, 14 nt, Yersinia pestis
aacacaguggaacc

SEQ ID NO: 4141647 - RNA, 15 nt, Yersinia pestis
aacacauacaaauau

SEQ ID NO: 4141648 - RNA, 14 nt, Yersinia pestis
aacacauauuucau

SEQ ID NO: 4141649 - RNA, 14 nt, Yersinia pestis
aacacaucacgcuu

SEQ ID NO: 4141650 - RNA, 16 nt, Yersinia pestis
aacacauuacugcguu

SEQ ID NO: 4141651 - RNA, 20 nt, Yersinia pestis
aacacauuccaguaaaaaaa

SEQ ID NO: 4141652 - RNA, 21 nt, Yersinia pestis
aacacauuccaguaaaaaaau

SEQ ID NO: 4141653 - RNA, 13 nt, Yersinia pestis
aacaccaacacca

SEQ ID NO: 4141654 - RNA, 21 nt, Yersinia pestis
aacaccagagaugauagcaau

SEQ ID NO: 4141655 - RNA, 15 nt, Yersinia pestis
aacacccuuccuuuu

SEQ ID NO: 4141656 - RNA, 20 nt, Yersinia pestis
aacaccguaacgcccuccug

SEQ ID NO: 4141657 - RNA, 22 nt, Yersinia pestis
aacaccgugcuggguaauucau

SEQ ID NO: 4141658 - RNA, 15 nt, Yersinia pestis
aacaccuucagacug

SEQ ID NO: 4141659 - RNA, 17 nt, Yersinia pestis
aacaccuuuaccuuuac

SEQ ID NO: 4141660 - RNA, 13 nt, Yersinia pestis
aacacgaaaagca

SEQ ID NO: 4141661 - RNA, 14 nt, Yersinia pestis
aacacgaaaagcag

SEQ ID NO: 4141662 - RNA, 19 nt, Yersinia pestis
aacacgacuuuuggccccc

SEQ ID NO: 4141663 - RNA, 15 nt, Yersinia pestis
aacacgauauaccuc

SEQ ID NO: 4141664 - RNA, 14 nt, Yersinia pestis
aacacgauccgcuu

SEQ ID NO: 4141665 - RNA, 19 nt, Yersinia pestis
aacacgauccgcuuuuuag

SEQ ID NO: 4141666 - RNA, 15 nt, Yersinia pestis
aacacgaugccagua

SEQ ID NO: 4141667 - RNA, 20 nt, Yersinia pestis
aacacggugaauaaacccuu

SEQ ID NO: 4141668 - RNA, 18 nt, Yersinia pestis
aacacgguugaaaaguuu

SEQ ID NO: 4141669 - RNA, 19 nt, Yersinia pestis
aacacguggguauccagug

SEQ ID NO: 4141670 - RNA, 20 nt, Yersinia pestis
aacacguggguauccagugu

SEQ ID NO: 4141671 - RNA, 22 nt, Yersinia pestis
aacacguggguauccaguguca

SEQ ID NO: 4141672 - RNA, 23 nt, Yersinia pestis
aacacguucggcgucgccacccc

SEQ ID NO: 4141673 - RNA, 23 nt, Yersinia pestis
aacacucuacuuucuacuccauu

SEQ ID NO: 4141674 - RNA, 19 nt, Yersinia pestis
aacacucuuuuuaauuuau

SEQ ID NO: 4141675 - RNA, 18 nt, Yersinia pestis
aacacuggcuuagaucuu

SEQ ID NO: 4141676 - RNA, 14 nt, Yersinia pestis
aacacuuaauucca

SEQ ID NO: 4141677 - RNA, 18 nt, Yersinia pestis
aacacuuaauugguuuau

SEQ ID NO: 4141678 - RNA, 19 nt, Yersinia pestis
aacacuuaugaucuugaau

SEQ ID NO: 4141679 - RNA, 16 nt, Yersinia pestis
aacacuuauuaaccua

SEQ ID NO: 4141680 - RNA, 18 nt, Yersinia pestis
aacacuucagacugaaag

SEQ ID NO: 4141681 - RNA, 14 nt, Yersinia pestis
aacacuugaccaac

SEQ ID NO: 4141682 - RNA, 20 nt, Yersinia pestis
aacacuuuaucgaccacuuu

SEQ ID NO: 4141683 - RNA, 16 nt, Yersinia pestis
aacacuuuauugagaa

SEQ ID NO: 4141684 - RNA, 19 nt, Yersinia pestis
aacacuuugcgcuuuuuaa

SEQ ID NO: 4141685 - RNA, 20 nt, Yersinia pestis
aacagaacccccgcgaacag

SEQ ID NO: 4141686 - RNA, 22 nt, Yersinia pestis
aacagaauguuggugaucagca

SEQ ID NO: 4141687 - RNA, 22 nt, Yersinia pestis
aacagacgccccgaaccauuua

SEQ ID NO: 4141688 - RNA, 17 nt, Yersinia pestis
aacagagcagaaagcag

SEQ ID NO: 4141689 - RNA, 19 nt, Yersinia pestis
aacagagcagaaagcagca

SEQ ID NO: 4141690 - RNA, 20 nt, Yersinia pestis
aacagauaauuggcaauaau

SEQ ID NO: 4141691 - RNA, 19 nt, Yersinia pestis
aacagauaugcauuauuga

SEQ ID NO: 4141692 - RNA, 20 nt, Yersinia pestis
aacagauauugcgcaguaaa

SEQ ID NO: 4141693 - RNA, 21 nt, Yersinia pestis
aacagauauugcgcaguaaau

SEQ ID NO: 4141694 - RNA, 17 nt, Yersinia pestis
aacagaugaugauuuuu

SEQ ID NO: 4141695 - RNA, 19 nt, Yersinia pestis
aacagaugaugauuuuuac

SEQ ID NO: 4141696 - RNA, 15 nt, Yersinia pestis
aacagauuuuccauc

SEQ ID NO: 4141697 - RNA, 16 nt, Yersinia pestis
aacagcaucacugucu

SEQ ID NO: 4141698 - RNA, 22 nt, Yersinia pestis
aacagcaucacugucuauuuuu

SEQ ID NO: 4141699 - RNA, 15 nt, Yersinia pestis
aacagcaucaucaaa

SEQ ID NO: 4141700 - RNA, 21 nt, Yersinia pestis
aacagcauuaccaaggaaacc

SEQ ID NO: 4141701 - RNA, 15 nt, Yersinia pestis
aacagccagcaucac

SEQ ID NO: 4141702 - RNA, 17 nt, Yersinia pestis
aacagccagcaucacga

SEQ ID NO: 4141703 - RNA, 17 nt, Yersinia pestis
aacagccccaaccaucu

SEQ ID NO: 4141704 - RNA, 16 nt, Yersinia pestis
aacagccggccauuca

SEQ ID NO: 4141705 - RNA, 17 nt, Yersinia pestis
aacagccggccauucag

SEQ ID NO: 4141706 - RNA, 17 nt, Yersinia pestis
aacagccguauaucuua

SEQ ID NO: 4141707 - RNA, 21 nt, Yersinia pestis
aacagccuaaggccaucaaua

SEQ ID NO: 4141708 - RNA, 20 nt, Yersinia pestis
aacagcgaaucaagcuacgc

SEQ ID NO: 4141709 - RNA, 20 nt, Yersinia pestis
aacagcggcgauuaucggcu

SEQ ID NO: 4141710 - RNA, 15 nt, Yersinia pestis
aacagcguugaccaa

SEQ ID NO: 4141711 - RNA, 15 nt, Yersinia pestis
aacagcuaaaaugau

SEQ ID NO: 4141712 - RNA, 19 nt, Yersinia pestis
aacagcuaaucauugcaau

SEQ ID NO: 4141713 - RNA, 13 nt, Yersinia pestis
aacagcucacucg

SEQ ID NO: 4141714 - RNA, 20 nt, Yersinia pestis
aacagcugacuaaaucgcuu

SEQ ID NO: 4141715 - RNA, 13 nt, Yersinia pestis
aacaggcagaucg

SEQ ID NO: 4141716 - RNA, 21 nt, Yersinia pestis
aacaggcgcaucgcgaucuga

SEQ ID NO: 4141717 - RNA, 14 nt, Yersinia pestis
aacagggcagaaaa

SEQ ID NO: 4141718 - RNA, 15 nt, Yersinia pestis
aacagggcagccaau

SEQ ID NO: 4141719 - RNA, 22 nt, Yersinia pestis
aacagguuggcgguacggucac

SEQ ID NO: 4141720 - RNA, 14 nt, Yersinia pestis
aacaguaaauuauu

SEQ ID NO: 4141721 - RNA, 17 nt, Yersinia pestis
aacaguaagcuuugugc

SEQ ID NO: 4141722 - RNA, 14 nt, Yersinia pestis
aacaguagcagggc

SEQ ID NO: 4141723 - RNA, 21 nt, Yersinia pestis
aacaguagcagggccgcccag

SEQ ID NO: 4141724 - RNA, 13 nt, Yersinia pestis
aacaguaucaaua

SEQ ID NO: 4141725 - RNA, 15 nt, Yersinia pestis
aacagucacaccaac

SEQ ID NO: 4141726 - RNA, 17 nt, Yersinia pestis
aacagucacaccaacac

SEQ ID NO: 4141727 - RNA, 16 nt, Yersinia pestis
aacagucauuaacaca

SEQ ID NO: 4141728 - RNA, 16 nt, Yersinia pestis
aacagugauucgcucg

SEQ ID NO: 4141729 - RNA, 18 nt, Yersinia pestis
aacagugcaacauuaaaa

SEQ ID NO: 4141730 - RNA, 20 nt, Yersinia pestis
aacagugcauucaucaugcu

SEQ ID NO: 4141731 - RNA, 16 nt, Yersinia pestis
aacaguuacuccuaca

SEQ ID NO: 4141732 - RNA, 15 nt, Yersinia pestis
aacaguuguuucaau

SEQ ID NO: 4141733 - RNA, 23 nt, Yersinia pestis
aacauaaagcuauuacugcucgg

SEQ ID NO: 4141734 - RNA, 16 nt, Yersinia pestis
aacauaacuuugccag

SEQ ID NO: 4141735 - RNA, 21 nt, Yersinia pestis
aacauaacuuugccagugacu

SEQ ID NO: 4141736 - RNA, 14 nt, Yersinia pestis
aacauaaucaaucc

SEQ ID NO: 4141737 - RNA, 23 nt, Yersinia pestis
aacauaauccgcuccugauuuaa

SEQ ID NO: 4141738 - RNA, 14 nt, Yersinia pestis
aacauaauuaaaua

SEQ ID NO: 4141739 - RNA, 16 nt, Yersinia pestis
aacauaauuaaauauu

SEQ ID NO: 4141740 - RNA, 17 nt, Yersinia pestis
aacauaauuaaauauua

SEQ ID NO: 4141741 - RNA, 22 nt, Yersinia pestis
aacauaauuaaauauuaacauu

SEQ ID NO: 4141742 - RNA, 18 nt, Yersinia pestis
aacauacggacgcucuau

SEQ ID NO: 4141743 - RNA, 18 nt, Yersinia pestis
aacauacugauacaacaa

SEQ ID NO: 4141744 - RNA, 17 nt, Yersinia pestis
aacauaguugaauaacu

SEQ ID NO: 4141745 - RNA, 20 nt, Yersinia pestis
aacauaucaauaagugcaaa

SEQ ID NO: 4141746 - RNA, 10 nt, Yersinia pestis
aacauaugaa

SEQ ID NO: 4141747 - RNA, 16 nt, Yersinia pestis
aacauauuaaguuaau

SEQ ID NO: 4141748 - RNA, 21 nt, Yersinia pestis
aacauauugcucugccgcagu

SEQ ID NO: 4141749 - RNA, 21 nt, Yersinia pestis
aacaucacauccgaucagcca

SEQ ID NO: 4141750 - RNA, 21 nt, Yersinia pestis
aacaucaggccuucuuuucuc

SEQ ID NO: 4141751 - RNA, 16 nt, Yersinia pestis
aacaucauauauuaaa

SEQ ID NO: 4141752 - RNA, 17 nt, Yersinia pestis
aacauccagaccuucac

SEQ ID NO: 4141753 - RNA, 17 nt, Yersinia pestis
aacauccgaauuuuuac

SEQ ID NO: 4141754 - RNA, 11 nt, Yersinia pestis
aacauccggcu

SEQ ID NO: 4141755 - RNA, 16 nt, Yersinia pestis
aacaucgacaccaaga

SEQ ID NO: 4141756 - RNA, 20 nt, Yersinia pestis
aacaucgacaccaagacuga

SEQ ID NO: 4141757 - RNA, 22 nt, Yersinia pestis
aacaucgacaccaagacugaag

SEQ ID NO: 4141758 - RNA, 13 nt, Yersinia pestis
aacaucgcccuuu

SEQ ID NO: 4141759 - RNA, 14 nt, Yersinia pestis
aacaucgcggaugc

SEQ ID NO: 4141760 - RNA, 17 nt, Yersinia pestis
aacaucuggcgauuuug

SEQ ID NO: 4141761 - RNA, 19 nt, Yersinia pestis
aacaugagccacacauuca

SEQ ID NO: 4141762 - RNA, 13 nt, Yersinia pestis
aacaugcugaagc

SEQ ID NO: 4141763 - RNA, 15 nt, Yersinia pestis
aacauggauccugca

SEQ ID NO: 4141764 - RNA, 18 nt, Yersinia pestis
aacaugggguaaucccga

SEQ ID NO: 4141765 - RNA, 12 nt, Yersinia pestis
aacauguagcac

SEQ ID NO: 4141766 - RNA, 13 nt, Yersinia pestis
aacauuaaaaaua

SEQ ID NO: 4141767 - RNA, 21 nt, Yersinia pestis
aacauuaauccucucuugaaa

SEQ ID NO: 4141768 - RNA, 23 nt, Yersinia pestis
aacauuaccaccgucaagacaac

SEQ ID NO: 4141769 - RNA, 16 nt, Yersinia pestis
aacauuauuuuucacc

SEQ ID NO: 4141770 - RNA, 17 nt, Yersinia pestis
aacauucaaggucgcca

SEQ ID NO: 4141771 - RNA, 16 nt, Yersinia pestis
aacauugccaaauuau

SEQ ID NO: 4141772 - RNA, 21 nt, Yersinia pestis
aacauuuaucuaucuguucac

SEQ ID NO: 4141773 - RNA, 12 nt, Yersinia pestis
aacauuucauuc

SEQ ID NO: 4141774 - RNA, 20 nt, Yersinia pestis
aacauuuccacucuuugagu

SEQ ID NO: 4141775 - RNA, 23 nt, Yersinia pestis
aacauuuucaucugaccaaacau

SEQ ID NO: 4141776 - RNA, 12 nt, Yersinia pestis
aaccaaaagccc

SEQ ID NO: 4141777 - RNA, 24 nt, Yersinia pestis
aaccaaaauauucgcauugugcuu

SEQ ID NO: 4141778 - RNA, 16 nt, Yersinia pestis
aaccaaauuacuuuaa

SEQ ID NO: 4141779 - RNA, 14 nt, Yersinia pestis
aaccaacaugagcc

SEQ ID NO: 4141780 - RNA, 19 nt, Yersinia pestis
aaccaacgggcacaaucca

SEQ ID NO: 4141781 - RNA, 14 nt, Yersinia pestis
aaccaagacauaau

SEQ ID NO: 4141782 - RNA, 22 nt, Yersinia pestis
aaccaauagauuucacuuuccc

SEQ ID NO: 4141783 - RNA, 14 nt, Yersinia pestis
aaccaauauugagu

SEQ ID NO: 4141784 - RNA, 13 nt, Yersinia pestis
aaccaaucaagca

SEQ ID NO: 4141785 - RNA, 15 nt, Yersinia pestis
aaccaauccaugcca

SEQ ID NO: 4141786 - RNA, 21 nt, Yersinia pestis
aaccacacuuggugcuuagca

SEQ ID NO: 4141787 - RNA, 17 nt, Yersinia pestis
aaccacauaacgcacug

SEQ ID NO: 4141788 - RNA, 20 nt, Yersinia pestis
aaccacauuccagaccggca

SEQ ID NO: 4141789 - RNA, 18 nt, Yersinia pestis
aaccaccuaauacagcac

SEQ ID NO: 4141790 - RNA, 18 nt, Yersinia pestis
aaccaccugaccuagcaa

SEQ ID NO: 4141791 - RNA, 19 nt, Yersinia pestis
aaccacgaagagcgccuca

SEQ ID NO: 4141792 - RNA, 20 nt, Yersinia pestis
aaccacgcauuccaucagcc

SEQ ID NO: 4141793 - RNA, 21 nt, Yersinia pestis
aaccacgucuacgcucuccuc

SEQ ID NO: 4141794 - RNA, 15 nt, Yersinia pestis
aaccacucucccuca

SEQ ID NO: 4141795 - RNA, 19 nt, Yersinia pestis
aaccacugaccuauugaua

SEQ ID NO: 4141796 - RNA, 19 nt, Yersinia pestis
aaccacugcggucaaagaa

SEQ ID NO: 4141797 - RNA, 22 nt, Yersinia pestis
aaccacugguuaaaucaccgac

SEQ ID NO: 4141798 - RNA, 22 nt, Yersinia pestis
aaccagacguuaugaauaaacc

SEQ ID NO: 4141799 - RNA, 18 nt, Yersinia pestis
aaccagagaaagguuuac

SEQ ID NO: 4141800 - RNA, 13 nt, Yersinia pestis
aaccagagucagu

SEQ ID NO: 4141801 - RNA, 17 nt, Yersinia pestis
aaccagauaacaacaaa

SEQ ID NO: 4141802 - RNA, 19 nt, Yersinia pestis
aaccagauaacaacaaaga

SEQ ID NO: 4141803 - RNA, 21 nt, Yersinia pestis
aaccagauaacaacaaagaua

SEQ ID NO: 4141804 - RNA, 11 nt, Yersinia pestis
aaccagcaagc

SEQ ID NO: 4141805 - RNA, 18 nt, Yersinia pestis
aaccagcguccugugcaa

SEQ ID NO: 4141806 - RNA, 21 nt, Yersinia pestis
aaccagcguucuaucaaugcc

SEQ ID NO: 4141807 - RNA, 20 nt, Yersinia pestis
aaccaggccgccaucaucau

SEQ ID NO: 4141808 - RNA, 21 nt, Yersinia pestis
aaccaggucaguuuuacccuu

SEQ ID NO: 4141809 - RNA, 16 nt, Yersinia pestis
aaccaguuagaaucca

SEQ ID NO: 4141810 - RNA, 14 nt, Yersinia pestis
aaccaucaaauaca

SEQ ID NO: 4141811 - RNA, 22 nt, Yersinia pestis
aaccaucaaggacuucaucacc

SEQ ID NO: 4141812 - RNA, 13 nt, Yersinia pestis
aaccauccauauu

SEQ ID NO: 4141813 - RNA, 14 nt, Yersinia pestis
aaccaugagaauac

SEQ ID NO: 4141814 - RNA, 17 nt, Yersinia pestis
aaccauggcacucucuu

SEQ ID NO: 4141815 - RNA, 12 nt, Yersinia pestis
aaccaugggggc

SEQ ID NO: 4141816 - RNA, 13 nt, Yersinia pestis
aaccauuuauaua

SEQ ID NO: 4141817 - RNA, 18 nt, Yersinia pestis
aaccauuuucaauugccc

SEQ ID NO: 4141818 - RNA, 15 nt, Yersinia pestis
aacccaaagcccuua

SEQ ID NO: 4141819 - RNA, 20 nt, Yersinia pestis
aacccacaucccggcagcag

SEQ ID NO: 4141820 - RNA, 23 nt, Yersinia pestis
aacccagccccuaacagcagugc

SEQ ID NO: 4141821 - RNA, 13 nt, Yersinia pestis
aacccauagcaaa

SEQ ID NO: 4141822 - RNA, 12 nt, Yersinia pestis
aacccauucauc

SEQ ID NO: 4141823 - RNA, 22 nt, Yersinia pestis
aacccauuugcacagcauuuau

SEQ ID NO: 4141824 - RNA, 23 nt, Yersinia pestis
aaccccaugaccgccagugccgc

SEQ ID NO: 4141825 - RNA, 21 nt, Yersinia pestis
aacccccgaagggauaugaca

SEQ ID NO: 4141826 - RNA, 22 nt, Yersinia pestis
aaccccuagccagccaccgcac

SEQ ID NO: 4141827 - RNA, 15 nt, Yersinia pestis
aacccgaauuaauaa

SEQ ID NO: 4141828 - RNA, 17 nt, Yersinia pestis
aacccgcgggagucagu

SEQ ID NO: 4141829 - RNA, 20 nt, Yersinia pestis
aacccgcuuaaucauauuuu

SEQ ID NO: 4141830 - RNA, 19 nt, Yersinia pestis
aacccggcgcaucuuucga

SEQ ID NO: 4141831 - RNA, 17 nt, Yersinia pestis
aacccguuuagcucuca

SEQ ID NO: 4141832 - RNA, 15 nt, Yersinia pestis
aacccuaccuaggcc

SEQ ID NO: 4141833 - RNA, 13 nt, Yersinia pestis
aacccucaguaaa

SEQ ID NO: 4141834 - RNA, 16 nt, Yersinia pestis
aacccucaguaaaagc

SEQ ID NO: 4141835 - RNA, 19 nt, Yersinia pestis
aacccuuucagcgcuuuuu

SEQ ID NO: 4141836 - RNA, 20 nt, Yersinia pestis
aacccuuuuugaaucaagca

SEQ ID NO: 4141837 - RNA, 14 nt, Yersinia pestis
aaccgaaaugaucu

SEQ ID NO: 4141838 - RNA, 14 nt, Yersinia pestis
aaccgaacgcucua

SEQ ID NO: 4141839 - RNA, 14 nt, Yersinia pestis
aaccgaagauaacc

SEQ ID NO: 4141840 - RNA, 13 nt, Yersinia pestis
aaccgauaacgcc

SEQ ID NO: 4141841 - RNA, 15 nt, Yersinia pestis
aaccgaugagugaaa

SEQ ID NO: 4141842 - RNA, 15 nt, Yersinia pestis
aaccgcagcaggcag

SEQ ID NO: 4141843 - RNA, 18 nt, Yersinia pestis
aaccgcagcaggcagagc

SEQ ID NO: 4141844 - RNA, 15 nt, Yersinia pestis
aaccgcauucccugc

SEQ ID NO: 4141845 - RNA, 13 nt, Yersinia pestis
aaccgccaaaaua

SEQ ID NO: 4141846 - RNA, 12 nt, Yersinia pestis
aaccgccacagc

SEQ ID NO: 4141847 - RNA, 17 nt, Yersinia pestis
aaccgccauugcauauu

SEQ ID NO: 4141848 - RNA, 18 nt, Yersinia pestis
aaccgcccucuugaacgg

SEQ ID NO: 4141849 - RNA, 20 nt, Yersinia pestis
aaccgcgaagaggguuuuuu

SEQ ID NO: 4141850 - RNA, 13 nt, Yersinia pestis
aaccgcugauaac

SEQ ID NO: 4141851 - RNA, 13 nt, Yersinia pestis
aaccggaauaaau

SEQ ID NO: 4141852 - RNA, 19 nt, Yersinia pestis
aaccggggcgauacaccaa

SEQ ID NO: 4141853 - RNA, 22 nt, Yersinia pestis
aaccgggggcguauuaucggau

SEQ ID NO: 4141854 - RNA, 12 nt, Yersinia pestis
aaccguaaagua

SEQ ID NO: 4141855 - RNA, 21 nt, Yersinia pestis
aaccgugacguuuuuaacguc

SEQ ID NO: 4141856 - RNA, 21 nt, Yersinia pestis
aaccgugcaccauacccuuug

SEQ ID NO: 4141857 - RNA, 13 nt, Yersinia pestis
aaccguucaguuu

SEQ ID NO: 4141858 - RNA, 12 nt, Yersinia pestis
aaccguuugccg

SEQ ID NO: 4141859 - RNA, 17 nt, Yersinia pestis
aaccguuuuuucaacug

SEQ ID NO: 4141860 - RNA, 12 nt, Yersinia pestis
aaccuaauacuu

SEQ ID NO: 4141861 - RNA, 22 nt, Yersinia pestis
aaccuaaucucuacauuuaguc

SEQ ID NO: 4141862 - RNA, 17 nt, Yersinia pestis
aaccucaaaaggauggc

SEQ ID NO: 4141863 - RNA, 20 nt, Yersinia pestis
aaccucaaaaggauggccca

SEQ ID NO: 4141864 - RNA, 19 nt, Yersinia pestis
aaccucacacgauuuuuac

SEQ ID NO: 4141865 - RNA, 14 nt, Yersinia pestis
aaccucagccucau

SEQ ID NO: 4141866 - RNA, 17 nt, Yersinia pestis
aaccucagccucauuca

SEQ ID NO: 4141867 - RNA, 20 nt, Yersinia pestis
aaccucggucugaauaagag

SEQ ID NO: 4141868 - RNA, 17 nt, Yersinia pestis
aaccucgguggcucaau

SEQ ID NO: 4141869 - RNA, 22 nt, Yersinia pestis
aaccucuaaucuccucuccgga

SEQ ID NO: 4141870 - RNA, 17 nt, Yersinia pestis
aaccucugcaaugccca

SEQ ID NO: 4141871 - RNA, 13 nt, Yersinia pestis
aaccugagcacca

SEQ ID NO: 4141872 - RNA, 16 nt, Yersinia pestis
aaccugcaauuuuuag

SEQ ID NO: 4141873 - RNA, 17 nt, Yersinia pestis
aaccugcccguuaucuu

SEQ ID NO: 4141874 - RNA, 19 nt, Yersinia pestis
aaccugcuugaaagcaccg

SEQ ID NO: 4141875 - RNA, 19 nt, Yersinia pestis
aaccuuaacuacaccgcua

SEQ ID NO: 4141876 - RNA, 24 nt, Yersinia pestis
aaccuuauuuuugcauauaaaaca

SEQ ID NO: 4141877 - RNA, 19 nt, Yersinia pestis
aaccuucgccuuucaguuc

SEQ ID NO: 4141878 - RNA, 13 nt, Yersinia pestis
aaccuucucugca

SEQ ID NO: 4141879 - RNA, 15 nt, Yersinia pestis
aaccuugaucaaaaa

SEQ ID NO: 4141880 - RNA, 20 nt, Yersinia pestis
aaccuugggggaccagcaca

SEQ ID NO: 4141881 - RNA, 22 nt, Yersinia pestis
aaccuuguuuuaucgcaguaau

SEQ ID NO: 4141882 - RNA, 18 nt, Yersinia pestis
aaccuuuauguaacacau

SEQ ID NO: 4141883 - RNA, 20 nt, Yersinia pestis
aaccuuuauguaguucaguc

SEQ ID NO: 4141884 - RNA, 19 nt, Yersinia pestis
aaccuuucgaguugaacuc

SEQ ID NO: 4141885 - RNA, 23 nt, Yersinia pestis
aacgaaaugucgaaagauagcaa

SEQ ID NO: 4141886 - RNA, 18 nt, Yersinia pestis
aacgaacacaguccuguu

SEQ ID NO: 4141887 - RNA, 15 nt, Yersinia pestis
aacgaacgcucuuua

SEQ ID NO: 4141888 - RNA, 18 nt, Yersinia pestis
aacgaacgcucuuuaaca

SEQ ID NO: 4141889 - RNA, 19 nt, Yersinia pestis
aacgaacgcucuuuaacaa

SEQ ID NO: 4141890 - RNA, 21 nt, Yersinia pestis
aacgaacgcucuuuaacaauu

SEQ ID NO: 4141891 - RNA, 22 nt, Yersinia pestis
aacgaagucgauaugagucagu

SEQ ID NO: 4141892 - RNA, 15 nt, Yersinia pestis
aacgaauucagcagc

SEQ ID NO: 4141893 - RNA, 16 nt, Yersinia pestis
aacgaauucagcagcg

SEQ ID NO: 4141894 - RNA, 12 nt, Yersinia pestis
aacgaauuucau

SEQ ID NO: 4141895 - RNA, 18 nt, Yersinia pestis
aacgaauuucauuuuaaa

SEQ ID NO: 4141896 - RNA, 19 nt, Yersinia pestis
aacgaccaauuucaauaau

SEQ ID NO: 4141897 - RNA, 24 nt, Yersinia pestis
aacgacggccaaacguauugguaa

SEQ ID NO: 4141898 - RNA, 19 nt, Yersinia pestis
aacgacuaaauaauccaga

SEQ ID NO: 4141899 - RNA, 21 nt, Yersinia pestis
aacgagggcucaaucucugcc

SEQ ID NO: 4141900 - RNA, 12 nt, Yersinia pestis
aacgaguaaaua

SEQ ID NO: 4141901 - RNA, 18 nt, Yersinia pestis
aacgaguuuccaguucaa

SEQ ID NO: 4141902 - RNA, 19 nt, Yersinia pestis
aacgauaugcuccagauca

SEQ ID NO: 4141903 - RNA, 19 nt, Yersinia pestis
aacgaucaguuugccuugu

SEQ ID NO: 4141904 - RNA, 19 nt, Yersinia pestis
aacgaucgcuuaacgaggc

SEQ ID NO: 4141905 - RNA, 16 nt, Yersinia pestis
aacgaucuggucugcc

SEQ ID NO: 4141906 - RNA, 21 nt, Yersinia pestis
aacgaucuggucugccagaau

SEQ ID NO: 4141907 - RNA, 17 nt, Yersinia pestis
aacgauuauuaaacuau

SEQ ID NO: 4141908 - RNA, 20 nt, Yersinia pestis
aacgcaauucaauauagggu

SEQ ID NO: 4141909 - RNA, 15 nt, Yersinia pestis
aacgcaauuuuaugg

SEQ ID NO: 4141910 - RNA, 13 nt, Yersinia pestis
aacgcacaugccg

SEQ ID NO: 4141911 - RNA, 14 nt, Yersinia pestis
aacgcacgaaaaca

SEQ ID NO: 4141912 - RNA, 13 nt, Yersinia pestis
aacgcacgacugc

SEQ ID NO: 4141913 - RNA, 14 nt, Yersinia pestis
aacgcacugagagc

SEQ ID NO: 4141914 - RNA, 13 nt, Yersinia pestis
aacgcagauaaau

SEQ ID NO: 4141915 - RNA, 13 nt, Yersinia pestis
aacgcaucccagg

SEQ ID NO: 4141916 - RNA, 19 nt, Yersinia pestis
aacgcauucaucagggcag

SEQ ID NO: 4141917 - RNA, 21 nt, Yersinia pestis
aacgcauuugaguaaacaucc

SEQ ID NO: 4141918 - RNA, 17 nt, Yersinia pestis
aacgccaaacaguaaau

SEQ ID NO: 4141919 - RNA, 16 nt, Yersinia pestis
aacgccaacugcggca

SEQ ID NO: 4141920 - RNA, 22 nt, Yersinia pestis
aacgcccagcuuuuuacgcaac

SEQ ID NO: 4141921 - RNA, 22 nt, Yersinia pestis
aacgcccugccgggcaaugugu

SEQ ID NO: 4141922 - RNA, 14 nt, Yersinia pestis
aacgccgaugaagg

SEQ ID NO: 4141923 - RNA, 17 nt, Yersinia pestis
aacgccucaaaaaccug

SEQ ID NO: 4141924 - RNA, 20 nt, Yersinia pestis
aacgccuccucuuggauuau

SEQ ID NO: 4141925 - RNA, 17 nt, Yersinia pestis
aacgccugauucaucgc

SEQ ID NO: 4141926 - RNA, 22 nt, Yersinia pestis
aacgcgccggaauuagcgaaau

SEQ ID NO: 4141927 - RNA, 15 nt, Yersinia pestis
aacgcgucacuggcc

SEQ ID NO: 4141928 - RNA, 12 nt, Yersinia pestis
aacgcuaagcgu

SEQ ID NO: 4141929 - RNA, 23 nt, Yersinia pestis
aacgcucauaccaugccaucaau

SEQ ID NO: 4141930 - RNA, 18 nt, Yersinia pestis
aacgcucuguugacucgc

SEQ ID NO: 4141931 - RNA, 19 nt, Yersinia pestis
aacgcugaauaaguugaua

SEQ ID NO: 4141932 - RNA, 17 nt, Yersinia pestis
aacgcugauuaaccugu

SEQ ID NO: 4141933 - RNA, 12 nt, Yersinia pestis
aacgcuucagua

SEQ ID NO: 4141934 - RNA, 15 nt, Yersinia pestis
aacgcuucaucaugg

SEQ ID NO: 4141935 - RNA, 19 nt, Yersinia pestis
aacgcuuuuaacugugcag

SEQ ID NO: 4141936 - RNA, 15 nt, Yersinia pestis
aacggaguaacaaau

SEQ ID NO: 4141937 - RNA, 17 nt, Yersinia pestis
aacggcacguuuccccu

SEQ ID NO: 4141938 - RNA, 20 nt, Yersinia pestis
aacggcgcggcaucaccaaa

SEQ ID NO: 4141939 - RNA, 14 nt, Yersinia pestis
aacggcucaucgcu

SEQ ID NO: 4141940 - RNA, 21 nt, Yersinia pestis
aacggcuuaaaguuauguuuu

SEQ ID NO: 4141941 - RNA, 14 nt, Yersinia pestis
aacgggcaaccugu

SEQ ID NO: 4141942 - RNA, 11 nt, Yersinia pestis
aacgggcuucc

SEQ ID NO: 4141943 - RNA, 19 nt, Yersinia pestis
aacgggcuuccaucaggaa

SEQ ID NO: 4141944 - RNA, 20 nt, Yersinia pestis
aacgggcuuccaucaggaag

SEQ ID NO: 4141945 - RNA, 16 nt, Yersinia pestis
aacgggguuagcagac

SEQ ID NO: 4141946 - RNA, 17 nt, Yersinia pestis
aacgggugauguuuaac

SEQ ID NO: 4141947 - RNA, 18 nt, Yersinia pestis
aacggguggccgccgcgg

SEQ ID NO: 4141948 - RNA, 21 nt, Yersinia pestis
aacggucagauccacauucug

SEQ ID NO: 4141949 - RNA, 22 nt, Yersinia pestis
aacggucucuuucgggcaaaaa

SEQ ID NO: 4141950 - RNA, 16 nt, Yersinia pestis
aacggucuguuaaucc

SEQ ID NO: 4141951 - RNA, 17 nt, Yersinia pestis
aacggugaggauaggca

SEQ ID NO: 4141952 - RNA, 18 nt, Yersinia pestis
aacggugaggauaggcag

SEQ ID NO: 4141953 - RNA, 17 nt, Yersinia pestis
aacguaauaucugccac

SEQ ID NO: 4141954 - RNA, 18 nt, Yersinia pestis
aacguaauaucugccacc

SEQ ID NO: 4141955 - RNA, 14 nt, Yersinia pestis
aacguacccuccca

SEQ ID NO: 4141956 - RNA, 15 nt, Yersinia pestis
aacgucacuuccauc

SEQ ID NO: 4141957 - RNA, 20 nt, Yersinia pestis
aacgucagauaaaaaagggu

SEQ ID NO: 4141958 - RNA, 12 nt, Yersinia pestis
aacgucagauua

SEQ ID NO: 4141959 - RNA, 16 nt, Yersinia pestis
aacgucauaauugcca

SEQ ID NO: 4141960 - RNA, 18 nt, Yersinia pestis
aacgucauaauugccaaa

SEQ ID NO: 4141961 - RNA, 23 nt, Yersinia pestis
aacgucauaauugccaaacgaua

SEQ ID NO: 4141962 - RNA, 21 nt, Yersinia pestis
aacgucauugguguuacagca

SEQ ID NO: 4141963 - RNA, 12 nt, Yersinia pestis
aacgucccauuc

SEQ ID NO: 4141964 - RNA, 18 nt, Yersinia pestis
aacgucuuaugccauaac

SEQ ID NO: 4141965 - RNA, 18 nt, Yersinia pestis
aacgugaacauugcagua

SEQ ID NO: 4141966 - RNA, 19 nt, Yersinia pestis
aacgugacucuuuguuacu

SEQ ID NO: 4141967 - RNA, 20 nt, Yersinia pestis
aacguguuagguaauaccaa

SEQ ID NO: 4141968 - RNA, 16 nt, Yersinia pestis
aacguguuuaucgauc

SEQ ID NO: 4141969 - RNA, 18 nt, Yersinia pestis
aacguguuuaucgaucaa

SEQ ID NO: 4141970 - RNA, 14 nt, Yersinia pestis
aacguuaacugcag

SEQ ID NO: 4141971 - RNA, 16 nt, Yersinia pestis
aacguucguagauaau

SEQ ID NO: 4141972 - RNA, 21 nt, Yersinia pestis
aacguucguagauaauuucua

SEQ ID NO: 4141973 - RNA, 14 nt, Yersinia pestis
aacguucugccaau

SEQ ID NO: 4141974 - RNA, 16 nt, Yersinia pestis
aacguucugccaauuu

SEQ ID NO: 4141975 - RNA, 14 nt, Yersinia pestis
aacguugucaggcg

SEQ ID NO: 4141976 - RNA, 19 nt, Yersinia pestis
aacguuuaucgcuaccgcg

SEQ ID NO: 4141977 - RNA, 21 nt, Yersinia pestis
aacuaaacagggcagaaaaua

SEQ ID NO: 4141978 - RNA, 14 nt, Yersinia pestis
aacuaacaucagcg

SEQ ID NO: 4141979 - RNA, 15 nt, Yersinia pestis
aacuaacaucagcga

SEQ ID NO: 4141980 - RNA, 22 nt, Yersinia pestis
aacuaacgauugacggaaaauu

SEQ ID NO: 4141981 - RNA, 15 nt, Yersinia pestis
aacuaauauuuucua

SEQ ID NO: 4141982 - RNA, 22 nt, Yersinia pestis
aacuaauguuuguuucucugcc

SEQ ID NO: 4141983 - RNA, 13 nt, Yersinia pestis
aacuacuccaucc

SEQ ID NO: 4141984 - RNA, 23 nt, Yersinia pestis
aacuacuccauccccaacucuuu

SEQ ID NO: 4141985 - RNA, 20 nt, Yersinia pestis
aacuaucuccggccugccgg

SEQ ID NO: 4141986 - RNA, 12 nt, Yersinia pestis
aacuauuaacuc

SEQ ID NO: 4141987 - RNA, 19 nt, Yersinia pestis
aacuauuuuugacuuuaau

SEQ ID NO: 4141988 - RNA, 23 nt, Yersinia pestis
aacuauuuuugacuuuaauuaaa

SEQ ID NO: 4141989 - RNA, 13 nt, Yersinia pestis
aacucaaagauuu

SEQ ID NO: 4141990 - RNA, 12 nt, Yersinia pestis
aacucaaauuau

SEQ ID NO: 4141991 - RNA, 13 nt, Yersinia pestis
aacucaaauuauu

SEQ ID NO: 4141992 - RNA, 16 nt, Yersinia pestis
aacucaauaaauucau

SEQ ID NO: 4141993 - RNA, 20 nt, Yersinia pestis
aacucaauuuuggcugaugu

SEQ ID NO: 4141994 - RNA, 14 nt, Yersinia pestis
aacucacaaaauaa

SEQ ID NO: 4141995 - RNA, 17 nt, Yersinia pestis
aacucaccuaaaucaua

SEQ ID NO: 4141996 - RNA, 20 nt, Yersinia pestis
aacucacgguuucuaaaaaa

SEQ ID NO: 4141997 - RNA, 18 nt, Yersinia pestis
aacucagccaauccagca

SEQ ID NO: 4141998 - RNA, 23 nt, Yersinia pestis
aacucagccaucaguucacugaa

SEQ ID NO: 4141999 - RNA, 20 nt, Yersinia pestis
aacucagccauugcuuugcg

SEQ ID NO: 4142000 - RNA, 15 nt, Yersinia pestis
aacucaugcucuuca

SEQ ID NO: 4142001 - RNA, 21 nt, Yersinia pestis
aacucaugcucuucauaagcc

SEQ ID NO: 4142002 - RNA, 19 nt, Yersinia pestis
aacucauuuaucuaaaacu

SEQ ID NO: 4142003 - RNA, 20 nt, Yersinia pestis
aacuccaggguaauaaguga

SEQ ID NO: 4142004 - RNA, 20 nt, Yersinia pestis
aacuccaggucgaucgacuu

SEQ ID NO: 4142005 - RNA, 21 nt, Yersinia pestis
aacucccgauucagcucugcc

SEQ ID NO: 4142006 - RNA, 20 nt, Yersinia pestis
aacuccuuuguuauuucugg

SEQ ID NO: 4142007 - RNA, 17 nt, Yersinia pestis
aacucgagcauuugacc

SEQ ID NO: 4142008 - RNA, 18 nt, Yersinia pestis
aacucgagcauuugaccg

SEQ ID NO: 4142009 - RNA, 19 nt, Yersinia pestis
aacucgaucaccacgucac

SEQ ID NO: 4142010 - RNA, 16 nt, Yersinia pestis
aacucgccaacagagu

SEQ ID NO: 4142011 - RNA, 16 nt, Yersinia pestis
aacucgccacucacaa

SEQ ID NO: 4142012 - RNA, 18 nt, Yersinia pestis
aacucgccuucagguaau

SEQ ID NO: 4142013 - RNA, 19 nt, Yersinia pestis
aacucggccgggcugacau

SEQ ID NO: 4142014 - RNA, 19 nt, Yersinia pestis
aacucuacauugacuaauu

SEQ ID NO: 4142015 - RNA, 15 nt, Yersinia pestis
aacucugaugaaauc

SEQ ID NO: 4142016 - RNA, 21 nt, Yersinia pestis
aacucuggauggguaaugcau

SEQ ID NO: 4142017 - RNA, 23 nt, Yersinia pestis
aacucuucagccauaacuucugg

SEQ ID NO: 4142018 - RNA, 14 nt, Yersinia pestis
aacucuucuguugc

SEQ ID NO: 4142019 - RNA, 21 nt, Yersinia pestis
aacucuuucaucccauaugcu

SEQ ID NO: 4142020 - RNA, 21 nt, Yersinia pestis
aacugaaccgccauugcauau

SEQ ID NO: 4142021 - RNA, 13 nt, Yersinia pestis
aacugaaugcguu

SEQ ID NO: 4142022 - RNA, 16 nt, Yersinia pestis
aacugacaacaucaaa

SEQ ID NO: 4142023 - RNA, 19 nt, Yersinia pestis
aacugacacacaccaguga

SEQ ID NO: 4142024 - RNA, 21 nt, Yersinia pestis
aacugacccaagguacuauug

SEQ ID NO: 4142025 - RNA, 14 nt, Yersinia pestis
aacugacugaaguu

SEQ ID NO: 4142026 - RNA, 15 nt, Yersinia pestis
aacugauacccacuc

SEQ ID NO: 4142027 - RNA, 17 nt, Yersinia pestis
aacugcaccuaacaaac

SEQ ID NO: 4142028 - RNA, 15 nt, Yersinia pestis
aacugcaguaaaaau

SEQ ID NO: 4142029 - RNA, 15 nt, Yersinia pestis
aacugcauagcuaac

SEQ ID NO: 4142030 - RNA, 20 nt, Yersinia pestis
aacugcauagcuaaccuuaa

SEQ ID NO: 4142031 - RNA, 22 nt, Yersinia pestis
aacugcauuucaauucguucaa

SEQ ID NO: 4142032 - RNA, 19 nt, Yersinia pestis
aacugcgaccaaaagccac

SEQ ID NO: 4142033 - RNA, 17 nt, Yersinia pestis
aacugcucaacugcuca

SEQ ID NO: 4142034 - RNA, 18 nt, Yersinia pestis
aacugcucaacugcucaa

SEQ ID NO: 4142035 - RNA, 16 nt, Yersinia pestis
aacugcucuaccaacu

SEQ ID NO: 4142036 - RNA, 17 nt, Yersinia pestis
aacugcugauuuuguag

SEQ ID NO: 4142037 - RNA, 20 nt, Yersinia pestis
aacugcugauuuuguagaau

SEQ ID NO: 4142038 - RNA, 13 nt, Yersinia pestis
aacugcugggcug

SEQ ID NO: 4142039 - RNA, 15 nt, Yersinia pestis
aacuggaauaugggu

SEQ ID NO: 4142040 - RNA, 16 nt, Yersinia pestis
aacuggcgcaauguca

SEQ ID NO: 4142041 - RNA, 23 nt, Yersinia pestis
aacuggcgcuggaccuuaucauc

SEQ ID NO: 4142042 - RNA, 14 nt, Yersinia pestis
aacuguaaggccaa

SEQ ID NO: 4142043 - RNA, 20 nt, Yersinia pestis
aacugucgggggcucguugg

SEQ ID NO: 4142044 - RNA, 22 nt, Yersinia pestis
aacugugccaaugccucuucaa

SEQ ID NO: 4142045 - RNA, 19 nt, Yersinia pestis
aacuguggauuaugugcgg

SEQ ID NO: 4142046 - RNA, 13 nt, Yersinia pestis
aacuguucuuauu

SEQ ID NO: 4142047 - RNA, 19 nt, Yersinia pestis
aacuguucuuauugcuauc

SEQ ID NO: 4142048 - RNA, 15 nt, Yersinia pestis
aacuuaaaaaucaaa

SEQ ID NO: 4142049 - RNA, 12 nt, Yersinia pestis
aacuuacaggcu

SEQ ID NO: 4142050 - RNA, 18 nt, Yersinia pestis
aacuuacaggcugccugc

SEQ ID NO: 4142051 - RNA, 13 nt, Yersinia pestis
aacuuacucccuu

SEQ ID NO: 4142052 - RNA, 15 nt, Yersinia pestis
aacuuacucccuugu

SEQ ID NO: 4142053 - RNA, 10 nt, Yersinia pestis
aacuuacugc

SEQ ID NO: 4142054 - RNA, 18 nt, Yersinia pestis
aacuuauagcucaucggu

SEQ ID NO: 4142055 - RNA, 12 nt, Yersinia pestis
aacuuaucacug

SEQ ID NO: 4142056 - RNA, 19 nt, Yersinia pestis
aacuuauuacaccuuaaaa

SEQ ID NO: 4142057 - RNA, 14 nt, Yersinia pestis
aacuucaaaaucaa

SEQ ID NO: 4142058 - RNA, 22 nt, Yersinia pestis
aacuucaagccgauaaucccug

SEQ ID NO: 4142059 - RNA, 18 nt, Yersinia pestis
aacuucaauaccaaauuu

SEQ ID NO: 4142060 - RNA, 16 nt, Yersinia pestis
aacuucagguucaccu

SEQ ID NO: 4142061 - RNA, 15 nt, Yersinia pestis
aacuuccacacaaac

SEQ ID NO: 4142062 - RNA, 16 nt, Yersinia pestis
aacuucccgcacaauu

SEQ ID NO: 4142063 - RNA, 14 nt, Yersinia pestis
aacuuccuaacaau

SEQ ID NO: 4142064 - RNA, 16 nt, Yersinia pestis
aacuuccuaacaauau

SEQ ID NO: 4142065 - RNA, 21 nt, Yersinia pestis
aacuuccuaacaauauuacca

SEQ ID NO: 4142066 - RNA, 15 nt, Yersinia pestis
aacuuccuuugcccu

SEQ ID NO: 4142067 - RNA, 22 nt, Yersinia pestis
aacuuccuuugcccuuacuauu

SEQ ID NO: 4142068 - RNA, 17 nt, Yersinia pestis
aacuucgaaagaaauaa

SEQ ID NO: 4142069 - RNA, 18 nt, Yersinia pestis
aacuucgaaagaaauaaa

SEQ ID NO: 4142070 - RNA, 18 nt, Yersinia pestis
aacuucuucauaacgcuu

SEQ ID NO: 4142071 - RNA, 15 nt, Yersinia pestis
aacuugccguaaaau

SEQ ID NO: 4142072 - RNA, 22 nt, Yersinia pestis
aacuuggacaucugcuuuacug

SEQ ID NO: 4142073 - RNA, 18 nt, Yersinia pestis
aacuugguaccagucuaa

SEQ ID NO: 4142074 - RNA, 14 nt, Yersinia pestis
aacuuguucauaua

SEQ ID NO: 4142075 - RNA, 19 nt, Yersinia pestis
aacuuuaauaugcaaaaaa

SEQ ID NO: 4142076 - RNA, 15 nt, Yersinia pestis
aacuuuaguuucuuu

SEQ ID NO: 4142077 - RNA, 15 nt, Yersinia pestis
aacuuuaucagucug

SEQ ID NO: 4142078 - RNA, 20 nt, Yersinia pestis
aacuuuauugacuguaaaua

SEQ ID NO: 4142079 - RNA, 22 nt, Yersinia pestis
aacuuugcuuugacuaauacug

SEQ ID NO: 4142080 - RNA, 23 nt, Yersinia pestis
aacuuugcuuugacuaauacugc

SEQ ID NO: 4142081 - RNA, 20 nt, Yersinia pestis
aacuuuggguauaugacugu

SEQ ID NO: 4142082 - RNA, 20 nt, Yersinia pestis
aacuuuuauugucuuuaaua

SEQ ID NO: 4142083 - RNA, 13 nt, Yersinia pestis
aacuuuuuucauc

SEQ ID NO: 4142084 - RNA, 19 nt, Yersinia pestis
aagaaaacccauaccacug

SEQ ID NO: 4142085 - RNA, 13 nt, Yersinia pestis
aagaaaagcaccg

SEQ ID NO: 4142086 - RNA, 13 nt, Yersinia pestis
aagaaaaucacuu

SEQ ID NO: 4142087 - RNA, 16 nt, Yersinia pestis
aagaaacucccuucaa

SEQ ID NO: 4142088 - RNA, 13 nt, Yersinia pestis
aagaaagaaaaau

SEQ ID NO: 4142089 - RNA, 14 nt, Yersinia pestis
aagaaagaaaaaua

SEQ ID NO: 4142090 - RNA, 16 nt, Yersinia pestis
aagaaagaaaaauaga

SEQ ID NO: 4142091 - RNA, 13 nt, Yersinia pestis
aagaaauaaaaga

SEQ ID NO: 4142092 - RNA, 17 nt, Yersinia pestis
aagaaauaaaagaaaac

SEQ ID NO: 4142093 - RNA, 18 nt, Yersinia pestis
aagaaauaaaagaaaacc

SEQ ID NO: 4142094 - RNA, 15 nt, Yersinia pestis
aagaaauaccugagu

SEQ ID NO: 4142095 - RNA, 18 nt, Yersinia pestis
aagaaauuuuuagaaaac

SEQ ID NO: 4142096 - RNA, 19 nt, Yersinia pestis
aagaaccccccaccaucaa

SEQ ID NO: 4142097 - RNA, 22 nt, Yersinia pestis
aagaaccccccaccaucaacau

SEQ ID NO: 4142098 - RNA, 15 nt, Yersinia pestis
aagaaccgaaauauc

SEQ ID NO: 4142099 - RNA, 16 nt, Yersinia pestis
aagaaccgcagacaua

SEQ ID NO: 4142100 - RNA, 20 nt, Yersinia pestis
aagaaccggugauuacuguc

SEQ ID NO: 4142101 - RNA, 22 nt, Yersinia pestis
aagaacgcgccaaccaucggaa

SEQ ID NO: 4142102 - RNA, 16 nt, Yersinia pestis
aagaagacaauagagu

SEQ ID NO: 4142103 - RNA, 13 nt, Yersinia pestis
aagaagcauagaa

SEQ ID NO: 4142104 - RNA, 14 nt, Yersinia pestis
aagaagccucauga

SEQ ID NO: 4142105 - RNA, 16 nt, Yersinia pestis
aagaagccucaugaau

SEQ ID NO: 4142106 - RNA, 17 nt, Yersinia pestis
aagaagccucaugaaug

SEQ ID NO: 4142107 - RNA, 13 nt, Yersinia pestis
aagaauaaauaau

SEQ ID NO: 4142108 - RNA, 23 nt, Yersinia pestis
aagaauaaaugucacuugcccug

SEQ ID NO: 4142109 - RNA, 18 nt, Yersinia pestis
aagaaucaccgaaagaag

SEQ ID NO: 4142110 - RNA, 14 nt, Yersinia pestis
aagaaucaguaggu

SEQ ID NO: 4142111 - RNA, 18 nt, Yersinia pestis
aagaaugccugccgcaau

SEQ ID NO: 4142112 - RNA, 20 nt, Yersinia pestis
aagaaugcgaagaaaaacac

SEQ ID NO: 4142113 - RNA, 22 nt, Yersinia pestis
aagaaugcgaagaaaaacacuu

SEQ ID NO: 4142114 - RNA, 22 nt, Yersinia pestis
aagaaugucaugguuaaacuga

SEQ ID NO: 4142115 - RNA, 16 nt, Yersinia pestis
aagaauuccggcgcau

SEQ ID NO: 4142116 - RNA, 18 nt, Yersinia pestis
aagaauugagguaaacca

SEQ ID NO: 4142117 - RNA, 16 nt, Yersinia pestis
aagaauugcagauacc

SEQ ID NO: 4142118 - RNA, 14 nt, Yersinia pestis
aagaauugcgcagc

SEQ ID NO: 4142119 - RNA, 13 nt, Yersinia pestis
aagacaacaaaca

SEQ ID NO: 4142120 - RNA, 15 nt, Yersinia pestis
aagacaaggaaaagg

SEQ ID NO: 4142121 - RNA, 17 nt, Yersinia pestis
aagacaauaaaucgcca

SEQ ID NO: 4142122 - RNA, 11 nt, Yersinia pestis
aagacacccgu

SEQ ID NO: 4142123 - RNA, 23 nt, Yersinia pestis
aagacagggguuuuuaucccccu

SEQ ID NO: 4142124 - RNA, 22 nt, Yersinia pestis
aagacauaaugccggcggccca

SEQ ID NO: 4142125 - RNA, 13 nt, Yersinia pestis
aagacauaucaca

SEQ ID NO: 4142126 - RNA, 19 nt, Yersinia pestis
aagacauaucacaguuaaa

SEQ ID NO: 4142127 - RNA, 20 nt, Yersinia pestis
aagacauaucacaguuaaaa

SEQ ID NO: 4142128 - RNA, 22 nt, Yersinia pestis
aagacauaucacaguuaaaaau

SEQ ID NO: 4142129 - RNA, 16 nt, Yersinia pestis
aagacgaauagaaccg

SEQ ID NO: 4142130 - RNA, 16 nt, Yersinia pestis
aagacgaguaaugaaa

SEQ ID NO: 4142131 - RNA, 18 nt, Yersinia pestis
aagacgccggcuucccug

SEQ ID NO: 4142132 - RNA, 21 nt, Yersinia pestis
aagacgccguaaauacaucca

SEQ ID NO: 4142133 - RNA, 20 nt, Yersinia pestis
aagacguaucgcaguuaaag

SEQ ID NO: 4142134 - RNA, 24 nt, Yersinia pestis
aagacguaucgcaguuaaagacau

SEQ ID NO: 4142135 - RNA, 19 nt, Yersinia pestis
aagacgucauaaauauuuu

SEQ ID NO: 4142136 - RNA, 15 nt, Yersinia pestis
aagacuucagcccau

SEQ ID NO: 4142137 - RNA, 20 nt, Yersinia pestis
aagacuucaugacuaccuug

SEQ ID NO: 4142138 - RNA, 17 nt, Yersinia pestis
aagacuuuccacaacag

SEQ ID NO: 4142139 - RNA, 15 nt, Yersinia pestis
aagagaaaagcagac

SEQ ID NO: 4142140 - RNA, 14 nt, Yersinia pestis
aagagacugggcug

SEQ ID NO: 4142141 - RNA, 16 nt, Yersinia pestis
aagagauaaccguuaa

SEQ ID NO: 4142142 - RNA, 15 nt, Yersinia pestis
aagagaugaaauuuu

SEQ ID NO: 4142143 - RNA, 17 nt, Yersinia pestis
aagagaugaaauuuuau

SEQ ID NO: 4142144 - RNA, 11 nt, Yersinia pestis
aagagaugacc

SEQ ID NO: 4142145 - RNA, 21 nt, Yersinia pestis
aagagaugacccaaagucauu

SEQ ID NO: 4142146 - RNA, 22 nt, Yersinia pestis
aagagauguucgcagaaaagag

SEQ ID NO: 4142147 - RNA, 20 nt, Yersinia pestis
aagagcccgcaacgggagag

SEQ ID NO: 4142148 - RNA, 23 nt, Yersinia pestis
aagagcgacucaauaauauggga

SEQ ID NO: 4142149 - RNA, 14 nt, Yersinia pestis
aagagcgauugacu

SEQ ID NO: 4142150 - RNA, 22 nt, Yersinia pestis
aagagcgauugacugaauguga

SEQ ID NO: 4142151 - RNA, 18 nt, Yersinia pestis
aagagcugcuaaucccuu

SEQ ID NO: 4142152 - RNA, 18 nt, Yersinia pestis
aagaggguuuuuaaauuu

SEQ ID NO: 4142153 - RNA, 21 nt, Yersinia pestis
aagagguguucuugaaaaaau

SEQ ID NO: 4142154 - RNA, 16 nt, Yersinia pestis
aagaguaaauaaauau

SEQ ID NO: 4142155 - RNA, 20 nt, Yersinia pestis
aagagucacagcauucagau

SEQ ID NO: 4142156 - RNA, 17 nt, Yersinia pestis
aagaguccagcacuggu

SEQ ID NO: 4142157 - RNA, 22 nt, Yersinia pestis
aagaguccagcacugguagcau

SEQ ID NO: 4142158 - RNA, 15 nt, Yersinia pestis
aagaguccuuaaaaa

SEQ ID NO: 4142159 - RNA, 20 nt, Yersinia pestis
aagaguccuuaaaaacccau

SEQ ID NO: 4142160 - RNA, 16 nt, Yersinia pestis
aagagucgcaaaacuu

SEQ ID NO: 4142161 - RNA, 22 nt, Yersinia pestis
aagagucgcuuugggauucaau

SEQ ID NO: 4142162 - RNA, 18 nt, Yersinia pestis
aagagucuggauuugaga

SEQ ID NO: 4142163 - RNA, 13 nt, Yersinia pestis
aagagugaaauau

SEQ ID NO: 4142164 - RNA, 14 nt, Yersinia pestis
aagagugaccaaag

SEQ ID NO: 4142165 - RNA, 23 nt, Yersinia pestis
aagagugaccaaagcaguaaaca

SEQ ID NO: 4142166 - RNA, 21 nt, Yersinia pestis
aagaguguucauaaauuaaaa

SEQ ID NO: 4142167 - RNA, 23 nt, Yersinia pestis
aagauaaacagcuuaucagcgua

SEQ ID NO: 4142168 - RNA, 18 nt, Yersinia pestis
aagauaaugaagauuuaa

SEQ ID NO: 4142169 - RNA, 20 nt, Yersinia pestis
aagauacccuugagguuauu

SEQ ID NO: 4142170 - RNA, 14 nt, Yersinia pestis
aagauagcaaaaga

SEQ ID NO: 4142171 - RNA, 16 nt, Yersinia pestis
aagauagcaaaagaau

SEQ ID NO: 4142172 - RNA, 14 nt, Yersinia pestis
aagauagccacuaa

SEQ ID NO: 4142173 - RNA, 17 nt, Yersinia pestis
aagauaggcagaaaagc

SEQ ID NO: 4142174 - RNA, 21 nt, Yersinia pestis
aagauaggcagaaaagcaaag

SEQ ID NO: 4142175 - RNA, 19 nt, Yersinia pestis
aagauaucgcuaccuccgg

SEQ ID NO: 4142176 - RNA, 13 nt, Yersinia pestis
aagaucaaaagca

SEQ ID NO: 4142177 - RNA, 14 nt, Yersinia pestis
aagaucaauauguu

SEQ ID NO: 4142178 - RNA, 16 nt, Yersinia pestis
aagauccaccacauca

SEQ ID NO: 4142179 - RNA, 14 nt, Yersinia pestis
aagauccaguucag

SEQ ID NO: 4142180 - RNA, 13 nt, Yersinia pestis
aagaucugcauug

SEQ ID NO: 4142181 - RNA, 17 nt, Yersinia pestis
aagaucugcauugauua

SEQ ID NO: 4142182 - RNA, 20 nt, Yersinia pestis
aagaugaccaccaauuucau

SEQ ID NO: 4142183 - RNA, 23 nt, Yersinia pestis
aagaugauaaauacaaaauuaac

SEQ ID NO: 4142184 - RNA, 12 nt, Yersinia pestis
aagaugcauauu

SEQ ID NO: 4142185 - RNA, 18 nt, Yersinia pestis
aagaugcauauuugcaga

SEQ ID NO: 4142186 - RNA, 20 nt, Yersinia pestis
aagaugccaaucaaaaaacc

SEQ ID NO: 4142187 - RNA, 14 nt, Yersinia pestis
aagauuacaucagu

SEQ ID NO: 4142188 - RNA, 20 nt, Yersinia pestis
aagauuaggggaugacaccu

SEQ ID NO: 4142189 - RNA, 21 nt, Yersinia pestis
aagauugagggcgucucuacg

SEQ ID NO: 4142190 - RNA, 17 nt, Yersinia pestis
aagauugccaccuucac

SEQ ID NO: 4142191 - RNA, 13 nt, Yersinia pestis
aagauuuaaauaa

SEQ ID NO: 4142192 - RNA, 23 nt, Yersinia pestis
aagauuuaacggcuguuguucug

SEQ ID NO: 4142193 - RNA, 21 nt, Yersinia pestis
aagauuucaucggcaaaaaca

SEQ ID NO: 4142194 - RNA, 20 nt, Yersinia pestis
aagauuucucuuaggcaacc

SEQ ID NO: 4142195 - RNA, 16 nt, Yersinia pestis
aagauuuuguagccca

SEQ ID NO: 4142196 - RNA, 22 nt, Yersinia pestis
aagauuuuuagcgugccgcagu

SEQ ID NO: 4142197 - RNA, 19 nt, Yersinia pestis
aagcaaaggcccgcuauca

SEQ ID NO: 4142198 - RNA, 13 nt, Yersinia pestis
aagcaagaaacug

SEQ ID NO: 4142199 - RNA, 14 nt, Yersinia pestis
aagcaauaaacuca

SEQ ID NO: 4142200 - RNA, 20 nt, Yersinia pestis
aagcaauaccgacaucaaca

SEQ ID NO: 4142201 - RNA, 14 nt, Yersinia pestis
aagcaaugaaauau

SEQ ID NO: 4142202 - RNA, 20 nt, Yersinia pestis
aagcaauggcacgugcaggu

SEQ ID NO: 4142203 - RNA, 21 nt, Yersinia pestis
aagcacagacaaacaaccuaa

SEQ ID NO: 4142204 - RNA, 12 nt, Yersinia pestis
aagcaccagcac

SEQ ID NO: 4142205 - RNA, 21 nt, Yersinia pestis
aagcacccacaccgcagcagu

SEQ ID NO: 4142206 - RNA, 12 nt, Yersinia pestis
aagcacgauaaa

SEQ ID NO: 4142207 - RNA, 13 nt, Yersinia pestis
aagcagauaaaga

SEQ ID NO: 4142208 - RNA, 16 nt, Yersinia pestis
aagcagauaaagaaaa

SEQ ID NO: 4142209 - RNA, 16 nt, Yersinia pestis
aagcaggaaugcgguu

SEQ ID NO: 4142210 - RNA, 22 nt, Yersinia pestis
aagcaggggaucgggcugauaa

SEQ ID NO: 4142211 - RNA, 19 nt, Yersinia pestis
aagcaguaagcaugaaaca

SEQ ID NO: 4142212 - RNA, 14 nt, Yersinia pestis
aagcagucagcaug

SEQ ID NO: 4142213 - RNA, 21 nt, Yersinia pestis
aagcagugucagggcaauaac

SEQ ID NO: 4142214 - RNA, 16 nt, Yersinia pestis
aagcaguucacugagu

SEQ ID NO: 4142215 - RNA, 17 nt, Yersinia pestis
aagcauacguugccagc

SEQ ID NO: 4142216 - RNA, 21 nt, Yersinia pestis
aagcauacguugccagccauc

SEQ ID NO: 4142217 - RNA, 13 nt, Yersinia pestis
aagcauauggaug

SEQ ID NO: 4142218 - RNA, 17 nt, Yersinia pestis
aagcauauggaugugau

SEQ ID NO: 4142219 - RNA, 15 nt, Yersinia pestis
aagcaucgacgagcg

SEQ ID NO: 4142220 - RNA, 15 nt, Yersinia pestis
aagcaucggaaucca

SEQ ID NO: 4142221 - RNA, 14 nt, Yersinia pestis
aagcaugaaacaca

SEQ ID NO: 4142222 - RNA, 15 nt, Yersinia pestis
aagcaugaaacacag

SEQ ID NO: 4142223 - RNA, 22 nt, Yersinia pestis
aagcaugugauguggcuugcaa

SEQ ID NO: 4142224 - RNA, 19 nt, Yersinia pestis
aagcauucaagccaccggc

SEQ ID NO: 4142225 - RNA, 13 nt, Yersinia pestis
aagccaaaacagc

SEQ ID NO: 4142226 - RNA, 18 nt, Yersinia pestis
aagccaaaaccauuggaa

SEQ ID NO: 4142227 - RNA, 19 nt, Yersinia pestis
aagccaccggcaucgagaa

SEQ ID NO: 4142228 - RNA, 20 nt, Yersinia pestis
aagccacgaguuuucccugc

SEQ ID NO: 4142229 - RNA, 20 nt, Yersinia pestis
aagccagauugugcggcugg

SEQ ID NO: 4142230 - RNA, 14 nt, Yersinia pestis
aagccagugcuauu

SEQ ID NO: 4142231 - RNA, 15 nt, Yersinia pestis
aagccauuagcguug

SEQ ID NO: 4142232 - RNA, 16 nt, Yersinia pestis
aagccauucagcagca

SEQ ID NO: 4142233 - RNA, 19 nt, Yersinia pestis
aagccauucagcagcaaga

SEQ ID NO: 4142234 - RNA, 18 nt, Yersinia pestis
aagcccauagccauggcu

SEQ ID NO: 4142235 - RNA, 13 nt, Yersinia pestis
aagccccacagua

SEQ ID NO: 4142236 - RNA, 16 nt, Yersinia pestis
aagcccccguaucaug

SEQ ID NO: 4142237 - RNA, 17 nt, Yersinia pestis
aagcccccuuuuucaua

SEQ ID NO: 4142238 - RNA, 18 nt, Yersinia pestis
aagcccggaaacguccag

SEQ ID NO: 4142239 - RNA, 15 nt, Yersinia pestis
aagcccuguuucauu

SEQ ID NO: 4142240 - RNA, 16 nt, Yersinia pestis
aagcccuguuucauuu

SEQ ID NO: 4142241 - RNA, 18 nt, Yersinia pestis
aagcccuugucaggauuu

SEQ ID NO: 4142242 - RNA, 18 nt, Yersinia pestis
aagccgaccauuaagccg

SEQ ID NO: 4142243 - RNA, 20 nt, Yersinia pestis
aagccgauccgggaaaaaau

SEQ ID NO: 4142244 - RNA, 14 nt, Yersinia pestis
aagccgcgccaucu

SEQ ID NO: 4142245 - RNA, 20 nt, Yersinia pestis
aagccguaauucagauaaga

SEQ ID NO: 4142246 - RNA, 15 nt, Yersinia pestis
aagccgucagcuuac

SEQ ID NO: 4142247 - RNA, 13 nt, Yersinia pestis
aagccgucaguuc

SEQ ID NO: 4142248 - RNA, 15 nt, Yersinia pestis
aagccgugaccaaag

SEQ ID NO: 4142249 - RNA, 16 nt, Yersinia pestis
aagccgugaccaaagu

SEQ ID NO: 4142250 - RNA, 22 nt, Yersinia pestis
aagccgugaccaaagugcucac

SEQ ID NO: 4142251 - RNA, 19 nt, Yersinia pestis
aagccucaugaaugaggcu

SEQ ID NO: 4142252 - RNA, 21 nt, Yersinia pestis
aagccucuuguguaauuauau

SEQ ID NO: 4142253 - RNA, 11 nt, Yersinia pestis
aagccugugcu

SEQ ID NO: 4142254 - RNA, 16 nt, Yersinia pestis
aagcgauccugcucaa

SEQ ID NO: 4142255 - RNA, 22 nt, Yersinia pestis
aagcgaucgaccgaguguaaaa

SEQ ID NO: 4142256 - RNA, 13 nt, Yersinia pestis
aagcgaugggggg

SEQ ID NO: 4142257 - RNA, 12 nt, Yersinia pestis
aagcgcaggaua

SEQ ID NO: 4142258 - RNA, 21 nt, Yersinia pestis
aagcgcagguuaugcagcuca

SEQ ID NO: 4142259 - RNA, 18 nt, Yersinia pestis
aagcgcagugcucauuaa

SEQ ID NO: 4142260 - RNA, 20 nt, Yersinia pestis
aagcgccguaaaaagcagca

SEQ ID NO: 4142261 - RNA, 22 nt, Yersinia pestis
aagcgccgugcauaauggacga

SEQ ID NO: 4142262 - RNA, 23 nt, Yersinia pestis
aagcgccugugggcggcuuucau

SEQ ID NO: 4142263 - RNA, 18 nt, Yersinia pestis
aagcgcggucauauccua

SEQ ID NO: 4142264 - RNA, 21 nt, Yersinia pestis
aagcgcguaucguccagcagc

SEQ ID NO: 4142265 - RNA, 22 nt, Yersinia pestis
aagcgcguaucguccagcagca

SEQ ID NO: 4142266 - RNA, 22 nt, Yersinia pestis
aagcgcuauguuggcaaauaau

SEQ ID NO: 4142267 - RNA, 19 nt, Yersinia pestis
aagcgcugcuuuaaaggcu

SEQ ID NO: 4142268 - RNA, 17 nt, Yersinia pestis
aagcgcuguuaacgcuu

SEQ ID NO: 4142269 - RNA, 21 nt, Yersinia pestis
aagcggaucggguugaugaug

SEQ ID NO: 4142270 - RNA, 20 nt, Yersinia pestis
aagcggaucucuucagcaau

SEQ ID NO: 4142271 - RNA, 19 nt, Yersinia pestis
aagcgguauccaccuucca

SEQ ID NO: 4142272 - RNA, 15 nt, Yersinia pestis
aagcguaaagcaccc

SEQ ID NO: 4142273 - RNA, 20 nt, Yersinia pestis
aagcguaggggacauugagg

SEQ ID NO: 4142274 - RNA, 18 nt, Yersinia pestis
aagcgucagaugcugacg

SEQ ID NO: 4142275 - RNA, 21 nt, Yersinia pestis
aagcuacuaauggagagaugu

SEQ ID NO: 4142276 - RNA, 15 nt, Yersinia pestis
aagcuagucgcccgg

SEQ ID NO: 4142277 - RNA, 18 nt, Yersinia pestis
aagcuauuacugcucggc

SEQ ID NO: 4142278 - RNA, 11 nt, Yersinia pestis
aagcucaagcu

SEQ ID NO: 4142279 - RNA, 12 nt, Yersinia pestis
aagcucaagcug

SEQ ID NO: 4142280 - RNA, 13 nt, Yersinia pestis
aagcucauaugca

SEQ ID NO: 4142281 - RNA, 19 nt, Yersinia pestis
aagcucauaugcagcaucc

SEQ ID NO: 4142282 - RNA, 17 nt, Yersinia pestis
aagcucaucuaacucau

SEQ ID NO: 4142283 - RNA, 22 nt, Yersinia pestis
aagcucuacacugauugaaguc

SEQ ID NO: 4142284 - RNA, 22 nt, Yersinia pestis
aagcucugggacgugcauaaaa

SEQ ID NO: 4142285 - RNA, 14 nt, Yersinia pestis
aagcucuuccaaua

SEQ ID NO: 4142286 - RNA, 17 nt, Yersinia pestis
aagcucuuccaauagca

SEQ ID NO: 4142287 - RNA, 13 nt, Yersinia pestis
aagcugaaauuuu

SEQ ID NO: 4142288 - RNA, 16 nt, Yersinia pestis
aagcugacgcacauua

SEQ ID NO: 4142289 - RNA, 21 nt, Yersinia pestis
aagcuggcagcgcuugcaaca

SEQ ID NO: 4142290 - RNA, 18 nt, Yersinia pestis
aagcuguuggcuuuaucu

SEQ ID NO: 4142291 - RNA, 15 nt, Yersinia pestis
aagcuucaacuuaau

SEQ ID NO: 4142292 - RNA, 21 nt, Yersinia pestis
aagcuucaacuuccagugcca

SEQ ID NO: 4142293 - RNA, 22 nt, Yersinia pestis
aagcuuuugccacauuucccuu

SEQ ID NO: 4142294 - RNA, 17 nt, Yersinia pestis
aaggaaaaggcagagag

SEQ ID NO: 4142295 - RNA, 18 nt, Yersinia pestis
aaggaaaaggcagagagg

SEQ ID NO: 4142296 - RNA, 14 nt, Yersinia pestis
aaggaaacucauga

SEQ ID NO: 4142297 - RNA, 19 nt, Yersinia pestis
aaggaagggguucuuccaa

SEQ ID NO: 4142298 - RNA, 16 nt, Yersinia pestis
aaggacacgauuuuua

SEQ ID NO: 4142299 - RNA, 21 nt, Yersinia pestis
aaggacaguaauauuuucauc

SEQ ID NO: 4142300 - RNA, 16 nt, Yersinia pestis
aaggacccguuuauaa

SEQ ID NO: 4142301 - RNA, 23 nt, Yersinia pestis
aaggacuuggcguaacugcauuu

SEQ ID NO: 4142302 - RNA, 16 nt, Yersinia pestis
aaggauaagcaguucu

SEQ ID NO: 4142303 - RNA, 18 nt, Yersinia pestis
aaggauggcccaagccau

SEQ ID NO: 4142304 - RNA, 18 nt, Yersinia pestis
aaggauggucaacauugc

SEQ ID NO: 4142305 - RNA, 15 nt, Yersinia pestis
aaggauugaccaaua

SEQ ID NO: 4142306 - RNA, 13 nt, Yersinia pestis
aaggcaaagaaga

SEQ ID NO: 4142307 - RNA, 20 nt, Yersinia pestis
aaggcaacgaaggcaacaac

SEQ ID NO: 4142308 - RNA, 15 nt, Yersinia pestis
aaggcaauaccaaua

SEQ ID NO: 4142309 - RNA, 13 nt, Yersinia pestis
aaggcaauaccgg

SEQ ID NO: 4142310 - RNA, 22 nt, Yersinia pestis
aaggcacaucuccagaauauaa

SEQ ID NO: 4142311 - RNA, 23 nt, Yersinia pestis
aaggcacaucuccagaauauaaa

SEQ ID NO: 4142312 - RNA, 13 nt, Yersinia pestis
aaggcagugacag

SEQ ID NO: 4142313 - RNA, 13 nt, Yersinia pestis
aaggcauccacau

SEQ ID NO: 4142314 - RNA, 14 nt, Yersinia pestis
aaggcauccacauc

SEQ ID NO: 4142315 - RNA, 14 nt, Yersinia pestis
aaggccaauuggcu

SEQ ID NO: 4142316 - RNA, 18 nt, Yersinia pestis
aaggccagaguuaugggc

SEQ ID NO: 4142317 - RNA, 13 nt, Yersinia pestis
aaggccccucggg

SEQ ID NO: 4142318 - RNA, 19 nt, Yersinia pestis
aaggcccgcuaucacuagc

SEQ ID NO: 4142319 - RNA, 19 nt, Yersinia pestis
aaggccggauguaaaacac

SEQ ID NO: 4142320 - RNA, 19 nt, Yersinia pestis
aaggcgaugauuugucaau

SEQ ID NO: 4142321 - RNA, 16 nt, Yersinia pestis
aaggcggcagagccaa

SEQ ID NO: 4142322 - RNA, 14 nt, Yersinia pestis
aaggcggugaacag

SEQ ID NO: 4142323 - RNA, 15 nt, Yersinia pestis
aaggcggugaacagu

SEQ ID NO: 4142324 - RNA, 16 nt, Yersinia pestis
aaggcggugaacagua

SEQ ID NO: 4142325 - RNA, 16 nt, Yersinia pestis
aaggcguuacccacau

SEQ ID NO: 4142326 - RNA, 14 nt, Yersinia pestis
aaggcucuguuacc

SEQ ID NO: 4142327 - RNA, 21 nt, Yersinia pestis
aaggcucuguuaccagccgcg

SEQ ID NO: 4142328 - RNA, 14 nt, Yersinia pestis
aaggcugauuaaua

SEQ ID NO: 4142329 - RNA, 20 nt, Yersinia pestis
aaggcuggucagcggagcag

SEQ ID NO: 4142330 - RNA, 16 nt, Yersinia pestis
aaggcuuuauauugcc

SEQ ID NO: 4142331 - RNA, 16 nt, Yersinia pestis
aagggcaagcgcuguu

SEQ ID NO: 4142332 - RNA, 20 nt, Yersinia pestis
aagggccaccacgaaaaaau

SEQ ID NO: 4142333 - RNA, 22 nt, Yersinia pestis
aagggccacccugccaaaaaau

SEQ ID NO: 4142334 - RNA, 14 nt, Yersinia pestis
aagggccaugccug

SEQ ID NO: 4142335 - RNA, 20 nt, Yersinia pestis
aagggccauuuugcugccag

SEQ ID NO: 4142336 - RNA, 16 nt, Yersinia pestis
aaggggagcuuccccc

SEQ ID NO: 4142337 - RNA, 17 nt, Yersinia pestis
aaggggcggaaaugccg

SEQ ID NO: 4142338 - RNA, 23 nt, Yersinia pestis
aaggguaaaauaaauauccuccg

SEQ ID NO: 4142339 - RNA, 18 nt, Yersinia pestis
aaggguaauagaagauaa

SEQ ID NO: 4142340 - RNA, 14 nt, Yersinia pestis
aaggguacagucua

SEQ ID NO: 4142341 - RNA, 16 nt, Yersinia pestis
aaggguauugaagaua

SEQ ID NO: 4142342 - RNA, 11 nt, Yersinia pestis
aagguaaaaaa

SEQ ID NO: 4142343 - RNA, 18 nt, Yersinia pestis
aagguaaaaaagaaugcg

SEQ ID NO: 4142344 - RNA, 17 nt, Yersinia pestis
aagguaaaaggcccgcu

SEQ ID NO: 4142345 - RNA, 17 nt, Yersinia pestis
aagguaaacagacacag

SEQ ID NO: 4142346 - RNA, 18 nt, Yersinia pestis
aagguaaugcgaaaaaag

SEQ ID NO: 4142347 - RNA, 22 nt, Yersinia pestis
aagguagaucggggacaggcug

SEQ ID NO: 4142348 - RNA, 21 nt, Yersinia pestis
aagguauaaccauuaacaaua

SEQ ID NO: 4142349 - RNA, 20 nt, Yersinia pestis
aagguauagcgauagaguug

SEQ ID NO: 4142350 - RNA, 14 nt, Yersinia pestis
aagguaucgcagug

SEQ ID NO: 4142351 - RNA, 19 nt, Yersinia pestis
aagguaugugccaaaaaaa

SEQ ID NO: 4142352 - RNA, 22 nt, Yersinia pestis
aaggucaacgacaagucaguga

SEQ ID NO: 4142353 - RNA, 15 nt, Yersinia pestis
aaggucuuucgccca

SEQ ID NO: 4142354 - RNA, 15 nt, Yersinia pestis
aagguguacucuccc

SEQ ID NO: 4142355 - RNA, 19 nt, Yersinia pestis
aaggugugcucacaaucuu

SEQ ID NO: 4142356 - RNA, 13 nt, Yersinia pestis
aagguuaacugca

SEQ ID NO: 4142357 - RNA, 13 nt, Yersinia pestis
aagguuagcuaug

SEQ ID NO: 4142358 - RNA, 19 nt, Yersinia pestis
aagguuagcuaugcaguua

SEQ ID NO: 4142359 - RNA, 19 nt, Yersinia pestis
aagguucacccugaguguu

SEQ ID NO: 4142360 - RNA, 12 nt, Yersinia pestis
aaguaaaagcca

SEQ ID NO: 4142361 - RNA, 14 nt, Yersinia pestis
aaguaaaauaaaaa

SEQ ID NO: 4142362 - RNA, 23 nt, Yersinia pestis
aaguaaagaaccccccaccauca

SEQ ID NO: 4142363 - RNA, 20 nt, Yersinia pestis
aaguaaauuccguggcuuag

SEQ ID NO: 4142364 - RNA, 22 nt, Yersinia pestis
aaguaacuugccguaaaauuua

SEQ ID NO: 4142365 - RNA, 19 nt, Yersinia pestis
aaguacggugccagcagca

SEQ ID NO: 4142366 - RNA, 16 nt, Yersinia pestis
aaguacuuauuugaaa

SEQ ID NO: 4142367 - RNA, 13 nt, Yersinia pestis
aaguagucagcaa

SEQ ID NO: 4142368 - RNA, 23 nt, Yersinia pestis
aaguaugcguggguucuucaaag

SEQ ID NO: 4142369 - RNA, 23 nt, Yersinia pestis
aagucaaauuuaaaguuuuuuau

SEQ ID NO: 4142370 - RNA, 16 nt, Yersinia pestis
aagucacgcacccacc

SEQ ID NO: 4142371 - RNA, 19 nt, Yersinia pestis
aagucacuuaaacccuuuc

SEQ ID NO: 4142372 - RNA, 13 nt, Yersinia pestis
aagucagcaaauc

SEQ ID NO: 4142373 - RNA, 17 nt, Yersinia pestis
aagucaugguacaacug

SEQ ID NO: 4142374 - RNA, 21 nt, Yersinia pestis
aagucauucuugguggagccu

SEQ ID NO: 4142375 - RNA, 20 nt, Yersinia pestis
aaguccaagaagauaacuuu

SEQ ID NO: 4142376 - RNA, 13 nt, Yersinia pestis
aaguccuuaaaaa

SEQ ID NO: 4142377 - RNA, 20 nt, Yersinia pestis
aagucgugaucguuuuaugg

SEQ ID NO: 4142378 - RNA, 16 nt, Yersinia pestis
aagucugaaaugauca

SEQ ID NO: 4142379 - RNA, 17 nt, Yersinia pestis
aagucuuaaucuuuaau

SEQ ID NO: 4142380 - RNA, 18 nt, Yersinia pestis
aagucuugaagagugacc

SEQ ID NO: 4142381 - RNA, 20 nt, Yersinia pestis
aagugaaacccgcgcagccu

SEQ ID NO: 4142382 - RNA, 19 nt, Yersinia pestis
aagugaacgaacacaucuu

SEQ ID NO: 4142383 - RNA, 16 nt, Yersinia pestis
aagugaauaaaucaaa

SEQ ID NO: 4142384 - RNA, 13 nt, Yersinia pestis
aagugagaagggu

SEQ ID NO: 4142385 - RNA, 20 nt, Yersinia pestis
aagugagaaggguauugaag

SEQ ID NO: 4142386 - RNA, 21 nt, Yersinia pestis
aagugagaaggguauugaaga

SEQ ID NO: 4142387 - RNA, 19 nt, Yersinia pestis
aagugauucgggugaguga

SEQ ID NO: 4142388 - RNA, 21 nt, Yersinia pestis
aagugauucgggugagugagc

SEQ ID NO: 4142389 - RNA, 18 nt, Yersinia pestis
aagugcaaacuuaaaaau

SEQ ID NO: 4142390 - RNA, 20 nt, Yersinia pestis
aagugcaaacuuaaaaauca

SEQ ID NO: 4142391 - RNA, 22 nt, Yersinia pestis
aagugcaaacuuaaaaaucaaa

SEQ ID NO: 4142392 - RNA, 18 nt, Yersinia pestis
aagugcaucgggagccac

SEQ ID NO: 4142393 - RNA, 21 nt, Yersinia pestis
aagugcccccuguaacgcuaa

SEQ ID NO: 4142394 - RNA, 23 nt, Yersinia pestis
aagugccugcggcggagagaaca

SEQ ID NO: 4142395 - RNA, 17 nt, Yersinia pestis
aaguggcauaaccaauc

SEQ ID NO: 4142396 - RNA, 19 nt, Yersinia pestis
aaguggccacucaccucag

SEQ ID NO: 4142397 - RNA, 23 nt, Yersinia pestis
aaguggccacucaccucagucau

SEQ ID NO: 4142398 - RNA, 15 nt, Yersinia pestis
aaguggcccuuguaa

SEQ ID NO: 4142399 - RNA, 22 nt, Yersinia pestis
aaguggcuaucugaaacugaga

SEQ ID NO: 4142400 - RNA, 16 nt, Yersinia pestis
aaguggcugaauauca

SEQ ID NO: 4142401 - RNA, 21 nt, Yersinia pestis
aagugguagccggacucaaaa

SEQ ID NO: 4142402 - RNA, 24 nt, Yersinia pestis
aagugucaauaacccuugccaccu

SEQ ID NO: 4142403 - RNA, 21 nt, Yersinia pestis
aaguguuaguuuuaauaacuu

SEQ ID NO: 4142404 - RNA, 21 nt, Yersinia pestis
aaguguucacucaguugauca

SEQ ID NO: 4142405 - RNA, 16 nt, Yersinia pestis
aaguguuucaaauaag

SEQ ID NO: 4142406 - RNA, 15 nt, Yersinia pestis
aaguuaaaaagccug

SEQ ID NO: 4142407 - RNA, 21 nt, Yersinia pestis
aaguuaaaaagccugaauucu

SEQ ID NO: 4142408 - RNA, 22 nt, Yersinia pestis
aaguuaaacaauguuaaacuuu

SEQ ID NO: 4142409 - RNA, 16 nt, Yersinia pestis
aaguuaacgcuuuaau

SEQ ID NO: 4142410 - RNA, 17 nt, Yersinia pestis
aaguuaaugacaaagug

SEQ ID NO: 4142411 - RNA, 19 nt, Yersinia pestis
aaguuagcgugagaauaau

SEQ ID NO: 4142412 - RNA, 21 nt, Yersinia pestis
aaguuagcgugagaauaauaa

SEQ ID NO: 4142413 - RNA, 18 nt, Yersinia pestis
aaguuaggguucaguaaa

SEQ ID NO: 4142414 - RNA, 22 nt, Yersinia pestis
aaguuaggguucaguaaaacca

SEQ ID NO: 4142415 - RNA, 14 nt, Yersinia pestis
aaguuagugguguu

SEQ ID NO: 4142416 - RNA, 13 nt, Yersinia pestis
aaguuaucaccaa

SEQ ID NO: 4142417 - RNA, 21 nt, Yersinia pestis
aaguuauuucagccaugggcu

SEQ ID NO: 4142418 - RNA, 19 nt, Yersinia pestis
aaguucaagaaccgaaaua

SEQ ID NO: 4142419 - RNA, 21 nt, Yersinia pestis
aaguucacuugagagaaacuu

SEQ ID NO: 4142420 - RNA, 22 nt, Yersinia pestis
aaguucacuugagagaaacuuu

SEQ ID NO: 4142421 - RNA, 22 nt, Yersinia pestis
aaguugaaccaaugaaucgggc

SEQ ID NO: 4142422 - RNA, 13 nt, Yersinia pestis
aaguugaauaaga

SEQ ID NO: 4142423 - RNA, 17 nt, Yersinia pestis
aaguugagcagcaauaa

SEQ ID NO: 4142424 - RNA, 15 nt, Yersinia pestis
aaguugauaaagcug

SEQ ID NO: 4142425 - RNA, 13 nt, Yersinia pestis
aaguugauaacgc

SEQ ID NO: 4142426 - RNA, 19 nt, Yersinia pestis
aaguugauaacgccggaua

SEQ ID NO: 4142427 - RNA, 16 nt, Yersinia pestis
aaguuuaaucaguucu

SEQ ID NO: 4142428 - RNA, 21 nt, Yersinia pestis
aaguuuacuuuguauuuugca

SEQ ID NO: 4142429 - RNA, 19 nt, Yersinia pestis
aaguuucagcguggaauua

SEQ ID NO: 4142430 - RNA, 19 nt, Yersinia pestis
aaguuuucuggcaauuucu

SEQ ID NO: 4142431 - RNA, 21 nt, Yersinia pestis
aaguuuucuggcaauuucugu

SEQ ID NO: 4142432 - RNA, 22 nt, Yersinia pestis
aaguuuucuggcaauuucuguu

SEQ ID NO: 4142433 - RNA, 13 nt, Yersinia pestis
aauaaaaaaaaau

SEQ ID NO: 4142434 - RNA, 14 nt, Yersinia pestis
aauaaaaaaaaaua

SEQ ID NO: 4142435 - RNA, 23 nt, Yersinia pestis
aauaaaaagucagcuggaacaag

SEQ ID NO: 4142436 - RNA, 22 nt, Yersinia pestis
aauaaaaaugauaauaaaaaaa

SEQ ID NO: 4142437 - RNA, 13 nt, Yersinia pestis
aauaaaacacccu

SEQ ID NO: 4142438 - RNA, 16 nt, Yersinia pestis
aauaaaaccuuuacaa

SEQ ID NO: 4142439 - RNA, 13 nt, Yersinia pestis
aauaaaauaaauu

SEQ ID NO: 4142440 - RNA, 15 nt, Yersinia pestis
aauaaaauaaauugg

SEQ ID NO: 4142441 - RNA, 16 nt, Yersinia pestis
aauaaaauacggcguu

SEQ ID NO: 4142442 - RNA, 14 nt, Yersinia pestis
aauaaacaaaauag

SEQ ID NO: 4142443 - RNA, 14 nt, Yersinia pestis
aauaaacaaccuuc

SEQ ID NO: 4142444 - RNA, 12 nt, Yersinia pestis
aauaaaccagca

SEQ ID NO: 4142445 - RNA, 15 nt, Yersinia pestis
aauaaaccagcaagc

SEQ ID NO: 4142446 - RNA, 19 nt, Yersinia pestis
aauaaacgggcuuccauca

SEQ ID NO: 4142447 - RNA, 23 nt, Yersinia pestis
aauaaacuaccgaucaucaggca

SEQ ID NO: 4142448 - RNA, 16 nt, Yersinia pestis
aauaaagaguccccau

SEQ ID NO: 4142449 - RNA, 22 nt, Yersinia pestis
aauaaagaguccccauaagcgg

SEQ ID NO: 4142450 - RNA, 23 nt, Yersinia pestis
aauaaagauacccgccauaaaua

SEQ ID NO: 4142451 - RNA, 21 nt, Yersinia pestis
aauaaagccauuucaguaacu

SEQ ID NO: 4142452 - RNA, 18 nt, Yersinia pestis
aauaaagcgauaaauacu

SEQ ID NO: 4142453 - RNA, 16 nt, Yersinia pestis
aauaaagggccugcaa

SEQ ID NO: 4142454 - RNA, 16 nt, Yersinia pestis
aauaaaggggguuuuc

SEQ ID NO: 4142455 - RNA, 13 nt, Yersinia pestis
aauaaauaauugg

SEQ ID NO: 4142456 - RNA, 12 nt, Yersinia pestis
aauaaauacccu

SEQ ID NO: 4142457 - RNA, 20 nt, Yersinia pestis
aauaaauagagugaaguauc

SEQ ID NO: 4142458 - RNA, 15 nt, Yersinia pestis
aauaaauccaucaau

SEQ ID NO: 4142459 - RNA, 15 nt, Yersinia pestis
aauaaauuacucgcc

SEQ ID NO: 4142460 - RNA, 16 nt, Yersinia pestis
aauaaauucaaaauag

SEQ ID NO: 4142461 - RNA, 21 nt, Yersinia pestis
aauaaauuuaauaaguuaaua

SEQ ID NO: 4142462 - RNA, 23 nt, Yersinia pestis
aauaacacggccuauugaauaac

SEQ ID NO: 4142463 - RNA, 15 nt, Yersinia pestis
aauaacagcuaauca

SEQ ID NO: 4142464 - RNA, 20 nt, Yersinia pestis
aauaacaggcuggccgugga

SEQ ID NO: 4142465 - RNA, 19 nt, Yersinia pestis
aauaacagggaggccagca

SEQ ID NO: 4142466 - RNA, 18 nt, Yersinia pestis
aauaaccagagacagcaa

SEQ ID NO: 4142467 - RNA, 20 nt, Yersinia pestis
aauaaccauaaaauaaauaa

SEQ ID NO: 4142468 - RNA, 13 nt, Yersinia pestis
aauaaccauuuau

SEQ ID NO: 4142469 - RNA, 16 nt, Yersinia pestis
aauaaccauuuauaua

SEQ ID NO: 4142470 - RNA, 22 nt, Yersinia pestis
aauaaccauuuauauaacagcc

SEQ ID NO: 4142471 - RNA, 21 nt, Yersinia pestis
aauaaccuacuccaacaacca

SEQ ID NO: 4142472 - RNA, 15 nt, Yersinia pestis
aauaaccucaaaagg

SEQ ID NO: 4142473 - RNA, 23 nt, Yersinia pestis
aauaaccucagggcgucucuacg

SEQ ID NO: 4142474 - RNA, 17 nt, Yersinia pestis
aauaaccucaggggcca

SEQ ID NO: 4142475 - RNA, 18 nt, Yersinia pestis
aauaacgaauuucauuuu

SEQ ID NO: 4142476 - RNA, 23 nt, Yersinia pestis
aauaacgccccuguaaauaaaua

SEQ ID NO: 4142477 - RNA, 22 nt, Yersinia pestis
aauaacgccguuaaaaugagca

SEQ ID NO: 4142478 - RNA, 17 nt, Yersinia pestis
aauaacgcggcacauac

SEQ ID NO: 4142479 - RNA, 17 nt, Yersinia pestis
aauaacgguuuuaacau

SEQ ID NO: 4142480 - RNA, 18 nt, Yersinia pestis
aauaacuauuuuugacuu

SEQ ID NO: 4142481 - RNA, 19 nt, Yersinia pestis
aauaacucagccauugcuu

SEQ ID NO: 4142482 - RNA, 20 nt, Yersinia pestis
aauaacucagccauugcuuu

SEQ ID NO: 4142483 - RNA, 16 nt, Yersinia pestis
aauaacucagggcuuu

SEQ ID NO: 4142484 - RNA, 22 nt, Yersinia pestis
aauaacugccaauauugaccaa

SEQ ID NO: 4142485 - RNA, 23 nt, Yersinia pestis
aauaacugcccuguuuccgguaa

SEQ ID NO: 4142486 - RNA, 20 nt, Yersinia pestis
aauaacugggauauucugga

SEQ ID NO: 4142487 - RNA, 23 nt, Yersinia pestis
aauaacugggccacgaugugaag

SEQ ID NO: 4142488 - RNA, 17 nt, Yersinia pestis
aauaagaucaauauguu

SEQ ID NO: 4142489 - RNA, 11 nt, Yersinia pestis
aauaagaucca

SEQ ID NO: 4142490 - RNA, 14 nt, Yersinia pestis
aauaagaucccaga

SEQ ID NO: 4142491 - RNA, 21 nt, Yersinia pestis
aauaagccgcaggcaaacaau

SEQ ID NO: 4142492 - RNA, 12 nt, Yersinia pestis
aauaagcguagg

SEQ ID NO: 4142493 - RNA, 18 nt, Yersinia pestis
aauaagcuaucauuaaau

SEQ ID NO: 4142494 - RNA, 15 nt, Yersinia pestis
aauaaggaauaacuu

SEQ ID NO: 4142495 - RNA, 17 nt, Yersinia pestis
aauaaggcuuaccgccu

SEQ ID NO: 4142496 - RNA, 13 nt, Yersinia pestis
aauaagggccacc

SEQ ID NO: 4142497 - RNA, 19 nt, Yersinia pestis
aauaaggguagguucaaua

SEQ ID NO: 4142498 - RNA, 21 nt, Yersinia pestis
aauaagucaaugcauuguaaa

SEQ ID NO: 4142499 - RNA, 14 nt, Yersinia pestis
aauaagucacuuuc

SEQ ID NO: 4142500 - RNA, 20 nt, Yersinia pestis
aauaaguguuucaaauaagu

SEQ ID NO: 4142501 - RNA, 22 nt, Yersinia pestis
aauaaguuacgucagaaauaaa

SEQ ID NO: 4142502 - RNA, 22 nt, Yersinia pestis
aauaaguucagguugaaauaaa

SEQ ID NO: 4142503 - RNA, 17 nt, Yersinia pestis
aauaaguugaaccauaa

SEQ ID NO: 4142504 - RNA, 13 nt, Yersinia pestis
aauaauaaaaaaa

SEQ ID NO: 4142505 - RNA, 18 nt, Yersinia pestis
aauaauaaaaaaaaauaa

SEQ ID NO: 4142506 - RNA, 13 nt, Yersinia pestis
aauaauaacgaau

SEQ ID NO: 4142507 - RNA, 11 nt, Yersinia pestis
aauaauaaugc

SEQ ID NO: 4142508 - RNA, 15 nt, Yersinia pestis
aauaauaauggugaa

SEQ ID NO: 4142509 - RNA, 12 nt, Yersinia pestis
aauaaucaauga

SEQ ID NO: 4142510 - RNA, 19 nt, Yersinia pestis
aauaaucacaucaucuuuu

SEQ ID NO: 4142511 - RNA, 19 nt, Yersinia pestis
aauaauccgguuagcaaaa

SEQ ID NO: 4142512 - RNA, 20 nt, Yersinia pestis
aauaaugaacguugucaggc

SEQ ID NO: 4142513 - RNA, 15 nt, Yersinia pestis
aauaaugaauuauua

SEQ ID NO: 4142514 - RNA, 16 nt, Yersinia pestis
aauaaugaauuauuag

SEQ ID NO: 4142515 - RNA, 22 nt, Yersinia pestis
aauaaugaccacgcaucaauaa

SEQ ID NO: 4142516 - RNA, 15 nt, Yersinia pestis
aauaaugagccauaa

SEQ ID NO: 4142517 - RNA, 16 nt, Yersinia pestis
aauaaugcaccaauca

SEQ ID NO: 4142518 - RNA, 21 nt, Yersinia pestis
aauaauguccccuugaguauc

SEQ ID NO: 4142519 - RNA, 20 nt, Yersinia pestis
aauaauguggcauguucagc

SEQ ID NO: 4142520 - RNA, 15 nt, Yersinia pestis
aauaauuacagcugg

SEQ ID NO: 4142521 - RNA, 23 nt, Yersinia pestis
aauaauucauaugacaaauaagg

SEQ ID NO: 4142522 - RNA, 22 nt, Yersinia pestis
aauaauucaugcuaauaccaca

SEQ ID NO: 4142523 - RNA, 13 nt, Yersinia pestis
aauaauuuauaca

SEQ ID NO: 4142524 - RNA, 20 nt, Yersinia pestis
aauaauuuauacauaucaga

SEQ ID NO: 4142525 - RNA, 17 nt, Yersinia pestis
aauacaaccaacaaaca

SEQ ID NO: 4142526 - RNA, 18 nt, Yersinia pestis
aauacaaccaacaaacaa

SEQ ID NO: 4142527 - RNA, 20 nt, Yersinia pestis
aauacaaccaacaaacaauc

SEQ ID NO: 4142528 - RNA, 16 nt, Yersinia pestis
aauacaauuauuuuua

SEQ ID NO: 4142529 - RNA, 17 nt, Yersinia pestis
aauacaauuauuuuuac

SEQ ID NO: 4142530 - RNA, 23 nt, Yersinia pestis
aauacacgaaugcgacaccugcu

SEQ ID NO: 4142531 - RNA, 13 nt, Yersinia pestis
aauacagcaaaua

SEQ ID NO: 4142532 - RNA, 12 nt, Yersinia pestis
aauacagccagc

SEQ ID NO: 4142533 - RNA, 22 nt, Yersinia pestis
aauacaggggcguuauugagaa

SEQ ID NO: 4142534 - RNA, 18 nt, Yersinia pestis
aauacaggugucaucaag

SEQ ID NO: 4142535 - RNA, 14 nt, Yersinia pestis
aauacauaagcucc

SEQ ID NO: 4142536 - RNA, 22 nt, Yersinia pestis
aauacauaagcuccugagacuu

SEQ ID NO: 4142537 - RNA, 22 nt, Yersinia pestis
aauacauagaagcucauaugca

SEQ ID NO: 4142538 - RNA, 18 nt, Yersinia pestis
aauacauauaaccaucaa

SEQ ID NO: 4142539 - RNA, 19 nt, Yersinia pestis
aauacauauaaccaucaaa

SEQ ID NO: 4142540 - RNA, 15 nt, Yersinia pestis
aauacauaucaacac

SEQ ID NO: 4142541 - RNA, 17 nt, Yersinia pestis
aauacauaucaacacug

SEQ ID NO: 4142542 - RNA, 16 nt, Yersinia pestis
aauacaucaucaaaac

SEQ ID NO: 4142543 - RNA, 12 nt, Yersinia pestis
aauacauccaug

SEQ ID NO: 4142544 - RNA, 23 nt, Yersinia pestis
aauacauccauguaggcucgagc

SEQ ID NO: 4142545 - RNA, 20 nt, Yersinia pestis
aauacauguacuagaucaca

SEQ ID NO: 4142546 - RNA, 20 nt, Yersinia pestis
aauacauugucgcacuugau

SEQ ID NO: 4142547 - RNA, 14 nt, Yersinia pestis
aauaccaaauuuac

SEQ ID NO: 4142548 - RNA, 14 nt, Yersinia pestis
aauaccaaugcugu

SEQ ID NO: 4142549 - RNA, 13 nt, Yersinia pestis
aauaccacaacau

SEQ ID NO: 4142550 - RNA, 14 nt, Yersinia pestis
aauaccacaacauu

SEQ ID NO: 4142551 - RNA, 13 nt, Yersinia pestis
aauaccacggcac

SEQ ID NO: 4142552 - RNA, 18 nt, Yersinia pestis
aauaccacuagcagagca

SEQ ID NO: 4142553 - RNA, 17 nt, Yersinia pestis
aauaccauaacgcugcu

SEQ ID NO: 4142554 - RNA, 14 nt, Yersinia pestis
aauaccauauaccc

SEQ ID NO: 4142555 - RNA, 20 nt, Yersinia pestis
aauaccauuucuuauaucug

SEQ ID NO: 4142556 - RNA, 13 nt, Yersinia pestis
aauaccauuuuag

SEQ ID NO: 4142557 - RNA, 18 nt, Yersinia pestis
aauacccaaaauuugcuu

SEQ ID NO: 4142558 - RNA, 17 nt, Yersinia pestis
aauaccgccacacaaua

SEQ ID NO: 4142559 - RNA, 18 nt, Yersinia pestis
aauaccgccacacaauac

SEQ ID NO: 4142560 - RNA, 19 nt, Yersinia pestis
aauaccgccggcaacagcg

SEQ ID NO: 4142561 - RNA, 18 nt, Yersinia pestis
aauaccgcgaucaacaag

SEQ ID NO: 4142562 - RNA, 19 nt, Yersinia pestis
aauaccgcugcuaccagca

SEQ ID NO: 4142563 - RNA, 14 nt, Yersinia pestis
aauaccggcaccaa

SEQ ID NO: 4142564 - RNA, 23 nt, Yersinia pestis
aauaccguuuucuuucaacugcu

SEQ ID NO: 4142565 - RNA, 12 nt, Yersinia pestis
aauaccuaaaau

SEQ ID NO: 4142566 - RNA, 21 nt, Yersinia pestis
aauaccuaaaauuaucgcaau

SEQ ID NO: 4142567 - RNA, 16 nt, Yersinia pestis
aauaccugcaccaaug

SEQ ID NO: 4142568 - RNA, 13 nt, Yersinia pestis
aauaccuuacugc

SEQ ID NO: 4142569 - RNA, 19 nt, Yersinia pestis
aauaccuuacuguaucaau

SEQ ID NO: 4142570 - RNA, 21 nt, Yersinia pestis
aauaccuuacuguaucaauac

SEQ ID NO: 4142571 - RNA, 16 nt, Yersinia pestis
aauacgaccgucacca

SEQ ID NO: 4142572 - RNA, 18 nt, Yersinia pestis
aauacgaccgucaccaaa

SEQ ID NO: 4142573 - RNA, 15 nt, Yersinia pestis
aauacgauaaagaag

SEQ ID NO: 4142574 - RNA, 23 nt, Yersinia pestis
aauacgauccgcuauuuucucug

SEQ ID NO: 4142575 - RNA, 12 nt, Yersinia pestis
aauacgccaguu

SEQ ID NO: 4142576 - RNA, 18 nt, Yersinia pestis
aauacgcugucugaauag

SEQ ID NO: 4142577 - RNA, 17 nt, Yersinia pestis
aauacguuccaacgcac

SEQ ID NO: 4142578 - RNA, 22 nt, Yersinia pestis
aauacguugaauuaaaaacccu

SEQ ID NO: 4142579 - RNA, 20 nt, Yersinia pestis
aauacuauuuguaguuuuuc

SEQ ID NO: 4142580 - RNA, 18 nt, Yersinia pestis
aauacucuguuaccaaug

SEQ ID NO: 4142581 - RNA, 23 nt, Yersinia pestis
aauacucuugagaaaugaauauu

SEQ ID NO: 4142582 - RNA, 21 nt, Yersinia pestis
aauacugcacguuuaauuuca

SEQ ID NO: 4142583 - RNA, 15 nt, Yersinia pestis
aauacugucaaaauc

SEQ ID NO: 4142584 - RNA, 14 nt, Yersinia pestis
aauacuguuaucac

SEQ ID NO: 4142585 - RNA, 18 nt, Yersinia pestis
aauacuuaacaaucagug

SEQ ID NO: 4142586 - RNA, 14 nt, Yersinia pestis
aauacuuaucuguu

SEQ ID NO: 4142587 - RNA, 13 nt, Yersinia pestis
aauacuucaggcc

SEQ ID NO: 4142588 - RNA, 23 nt, Yersinia pestis
aauagaaaaacacuggcagccau

SEQ ID NO: 4142589 - RNA, 16 nt, Yersinia pestis
aauagaaccggcugac

SEQ ID NO: 4142590 - RNA, 22 nt, Yersinia pestis
aauagaagagaggcaaugauuu

SEQ ID NO: 4142591 - RNA, 20 nt, Yersinia pestis
aauagaagguuaaauuuaau

SEQ ID NO: 4142592 - RNA, 22 nt, Yersinia pestis
aauagagacggaaagagccagc

SEQ ID NO: 4142593 - RNA, 13 nt, Yersinia pestis
aauagagccucua

SEQ ID NO: 4142594 - RNA, 21 nt, Yersinia pestis
aauagagccucuauuaccuca

SEQ ID NO: 4142595 - RNA, 16 nt, Yersinia pestis
aauagaggaaauaaau

SEQ ID NO: 4142596 - RNA, 13 nt, Yersinia pestis
aauagaggacuau

SEQ ID NO: 4142597 - RNA, 14 nt, Yersinia pestis
aauagagucacaga

SEQ ID NO: 4142598 - RNA, 21 nt, Yersinia pestis
aauagauacugaaauauacac

SEQ ID NO: 4142599 - RNA, 14 nt, Yersinia pestis
aauagauaguacgu

SEQ ID NO: 4142600 - RNA, 15 nt, Yersinia pestis
aauagaucccauacc

SEQ ID NO: 4142601 - RNA, 22 nt, Yersinia pestis
aauagcaagccaaaacagccua

SEQ ID NO: 4142602 - RNA, 14 nt, Yersinia pestis
aauagcaccauuag

SEQ ID NO: 4142603 - RNA, 18 nt, Yersinia pestis
aauagcaccgagcaugcu

SEQ ID NO: 4142604 - RNA, 13 nt, Yersinia pestis
aauagcauaaaua

SEQ ID NO: 4142605 - RNA, 15 nt, Yersinia pestis
aauagcauaaauauc

SEQ ID NO: 4142606 - RNA, 21 nt, Yersinia pestis
aauagccggcucuucucgaau

SEQ ID NO: 4142607 - RNA, 13 nt, Yersinia pestis
aauagcggccauu

SEQ ID NO: 4142608 - RNA, 21 nt, Yersinia pestis
aauagcggccauuaggcguga

SEQ ID NO: 4142609 - RNA, 16 nt, Yersinia pestis
aauagcguuaacgaua

SEQ ID NO: 4142610 - RNA, 14 nt, Yersinia pestis
aauagcuaauaauu

SEQ ID NO: 4142611 - RNA, 19 nt, Yersinia pestis
aauagcuaccccuucaguc

SEQ ID NO: 4142612 - RNA, 23 nt, Yersinia pestis
aauagcuaucuugccuguugaua

SEQ ID NO: 4142613 - RNA, 16 nt, Yersinia pestis
aauagcugcuucugaa

SEQ ID NO: 4142614 - RNA, 19 nt, Yersinia pestis
aauagcuggcggauaaaaa

SEQ ID NO: 4142615 - RNA, 20 nt, Yersinia pestis
aauagcuuaaucaucaucac

SEQ ID NO: 4142616 - RNA, 13 nt, Yersinia pestis
aauagcuuccauu

SEQ ID NO: 4142617 - RNA, 16 nt, Yersinia pestis
aauaggauuuucauga

SEQ ID NO: 4142618 - RNA, 13 nt, Yersinia pestis
aauaggccagcaa

SEQ ID NO: 4142619 - RNA, 14 nt, Yersinia pestis
aauaggcugcgcau

SEQ ID NO: 4142620 - RNA, 19 nt, Yersinia pestis
aauagggcgccccgauaaa

SEQ ID NO: 4142621 - RNA, 20 nt, Yersinia pestis
aauagggcugucagccaccg

SEQ ID NO: 4142622 - RNA, 20 nt, Yersinia pestis
aauaggggcaccguaaauga

SEQ ID NO: 4142623 - RNA, 14 nt, Yersinia pestis
aauaggucaguggu

SEQ ID NO: 4142624 - RNA, 17 nt, Yersinia pestis
aauaguacuugccacaa

SEQ ID NO: 4142625 - RNA, 21 nt, Yersinia pestis
aauagucagugggcuauuuau

SEQ ID NO: 4142626 - RNA, 15 nt, Yersinia pestis
aauagucauauauuu

SEQ ID NO: 4142627 - RNA, 16 nt, Yersinia pestis
aauagucauauauuuu

SEQ ID NO: 4142628 - RNA, 22 nt, Yersinia pestis
aauagucuuuuuaauaugugac

SEQ ID NO: 4142629 - RNA, 20 nt, Yersinia pestis
aauaguguguguauuuaaaa

SEQ ID NO: 4142630 - RNA, 14 nt, Yersinia pestis
aauauaaaauaaua

SEQ ID NO: 4142631 - RNA, 14 nt, Yersinia pestis
aauauaaauuuaau

SEQ ID NO: 4142632 - RNA, 13 nt, Yersinia pestis
aauauaacaaugu

SEQ ID NO: 4142633 - RNA, 19 nt, Yersinia pestis
aauauaacguuuaccuauu

SEQ ID NO: 4142634 - RNA, 18 nt, Yersinia pestis
aauauaauaaucuauaua

SEQ ID NO: 4142635 - RNA, 12 nt, Yersinia pestis
aauauaaugcug

SEQ ID NO: 4142636 - RNA, 14 nt, Yersinia pestis
aauauaauuucaaa

SEQ ID NO: 4142637 - RNA, 23 nt, Yersinia pestis
aauauacacaagucauuggaguc

SEQ ID NO: 4142638 - RNA, 21 nt, Yersinia pestis
aauauacccgacuaaucugau

SEQ ID NO: 4142639 - RNA, 20 nt, Yersinia pestis
aauauacuguuaacucgcca

SEQ ID NO: 4142640 - RNA, 14 nt, Yersinia pestis
aauauauaaaauaa

SEQ ID NO: 4142641 - RNA, 16 nt, Yersinia pestis
aauaucaaaacuccau

SEQ ID NO: 4142642 - RNA, 14 nt, Yersinia pestis
aauaucaaaacuga

SEQ ID NO: 4142643 - RNA, 18 nt, Yersinia pestis
aauaucaaaacugauuaa

SEQ ID NO: 4142644 - RNA, 14 nt, Yersinia pestis
aauaucaacgccgu

SEQ ID NO: 4142645 - RNA, 15 nt, Yersinia pestis
aauaucaaugaaaaa

SEQ ID NO: 4142646 - RNA, 18 nt, Yersinia pestis
aauaucaccagugauaaa

SEQ ID NO: 4142647 - RNA, 19 nt, Yersinia pestis
aauaucacugauaucggua

SEQ ID NO: 4142648 - RNA, 19 nt, Yersinia pestis
aauaucagcaaaguaccgc

SEQ ID NO: 4142649 - RNA, 21 nt, Yersinia pestis
aauaucagugacaccauugau

SEQ ID NO: 4142650 - RNA, 14 nt, Yersinia pestis
aauaucauccccuu

SEQ ID NO: 4142651 - RNA, 18 nt, Yersinia pestis
aauaucaucuuuuucugc

SEQ ID NO: 4142652 - RNA, 14 nt, Yersinia pestis
aauaucauuaacaa

SEQ ID NO: 4142653 - RNA, 13 nt, Yersinia pestis
aauaucauuauuu

SEQ ID NO: 4142654 - RNA, 21 nt, Yersinia pestis
aauaucccgagaaacaaaacc

SEQ ID NO: 4142655 - RNA, 23 nt, Yersinia pestis
aauauccgugggcaaaggcccaa

SEQ ID NO: 4142656 - RNA, 21 nt, Yersinia pestis
aauaugaagaugcuucagcca

SEQ ID NO: 4142657 - RNA, 21 nt, Yersinia pestis
aauaugauaguguaaaaacca

SEQ ID NO: 4142658 - RNA, 15 nt, Yersinia pestis
aauaugauuaaucau

SEQ ID NO: 4142659 - RNA, 15 nt, Yersinia pestis
aauaugcugaccacu

SEQ ID NO: 4142660 - RNA, 18 nt, Yersinia pestis
aauauggcggcaucagca

SEQ ID NO: 4142661 - RNA, 17 nt, Yersinia pestis
aauauggguuaaaaacu

SEQ ID NO: 4142662 - RNA, 20 nt, Yersinia pestis
aauaugguagaauuuaccuc

SEQ ID NO: 4142663 - RNA, 12 nt, Yersinia pestis
aauaugugcuuc

SEQ ID NO: 4142664 - RNA, 17 nt, Yersinia pestis
aauauuaacugcaguga

SEQ ID NO: 4142665 - RNA, 13 nt, Yersinia pestis
aauauuaauaaug

SEQ ID NO: 4142666 - RNA, 17 nt, Yersinia pestis
aauauuauuuaauuaaa

SEQ ID NO: 4142667 - RNA, 17 nt, Yersinia pestis
aauauucaauaggguaa

SEQ ID NO: 4142668 - RNA, 19 nt, Yersinia pestis
aauauuccccaccauugca

SEQ ID NO: 4142669 - RNA, 21 nt, Yersinia pestis
aauauugcguuaccuaaaacu

SEQ ID NO: 4142670 - RNA, 14 nt, Yersinia pestis
aauauuggauaaua

SEQ ID NO: 4142671 - RNA, 20 nt, Yersinia pestis
aauauuggauaauaaccuga

SEQ ID NO: 4142672 - RNA, 21 nt, Yersinia pestis
aauauuggauaauaaccugau

SEQ ID NO: 4142673 - RNA, 19 nt, Yersinia pestis
aauauuggcgcacaacugc

SEQ ID NO: 4142674 - RNA, 19 nt, Yersinia pestis
aauauugucuuaugauaua

SEQ ID NO: 4142675 - RNA, 15 nt, Yersinia pestis
aauauugugcacucg

SEQ ID NO: 4142676 - RNA, 16 nt, Yersinia pestis
aauauuuaaagccucu

SEQ ID NO: 4142677 - RNA, 19 nt, Yersinia pestis
aauauuuacggugagaaua

SEQ ID NO: 4142678 - RNA, 19 nt, Yersinia pestis
aauauuuaucugcauuaaa

SEQ ID NO: 4142679 - RNA, 21 nt, Yersinia pestis
aauauuuaucugcauuaaaau

SEQ ID NO: 4142680 - RNA, 22 nt, Yersinia pestis
aauauuuaucugcauuaaaaua

SEQ ID NO: 4142681 - RNA, 14 nt, Yersinia pestis
aauauuucaagcug

SEQ ID NO: 4142682 - RNA, 16 nt, Yersinia pestis
aauauuugagauauag

SEQ ID NO: 4142683 - RNA, 16 nt, Yersinia pestis
aauauuuucaucccaa

SEQ ID NO: 4142684 - RNA, 15 nt, Yersinia pestis
aaucaaaaaaccggc

SEQ ID NO: 4142685 - RNA, 14 nt, Yersinia pestis
aaucaaaaaauaaa

SEQ ID NO: 4142686 - RNA, 15 nt, Yersinia pestis
aaucaaaaaauaaau

SEQ ID NO: 4142687 - RNA, 23 nt, Yersinia pestis
aaucaaaaguuaggguucaguaa

SEQ ID NO: 4142688 - RNA, 14 nt, Yersinia pestis
aaucaaaauaccca

SEQ ID NO: 4142689 - RNA, 19 nt, Yersinia pestis
aaucaaaauacccauugag

SEQ ID NO: 4142690 - RNA, 14 nt, Yersinia pestis
aaucaaacaaaucu

SEQ ID NO: 4142691 - RNA, 13 nt, Yersinia pestis
aaucaacagauau

SEQ ID NO: 4142692 - RNA, 22 nt, Yersinia pestis
aaucaacgcuccgguuuucacc

SEQ ID NO: 4142693 - RNA, 18 nt, Yersinia pestis
aaucaagauauuacuucu

SEQ ID NO: 4142694 - RNA, 14 nt, Yersinia pestis
aaucaagcccgcaa

SEQ ID NO: 4142695 - RNA, 18 nt, Yersinia pestis
aaucaagcuacgcaaaaa

SEQ ID NO: 4142696 - RNA, 17 nt, Yersinia pestis
aaucaagcuacgccaag

SEQ ID NO: 4142697 - RNA, 19 nt, Yersinia pestis
aaucaagggcgauaccaua

SEQ ID NO: 4142698 - RNA, 23 nt, Yersinia pestis
aaucaagugcgaaaauuuaacua

SEQ ID NO: 4142699 - RNA, 14 nt, Yersinia pestis
aaucaaguugaaug

SEQ ID NO: 4142700 - RNA, 14 nt, Yersinia pestis
aaucaauaagcuac

SEQ ID NO: 4142701 - RNA, 15 nt, Yersinia pestis
aaucaaucaauugcc

SEQ ID NO: 4142702 - RNA, 17 nt, Yersinia pestis
aaucaaugggauauuau

SEQ ID NO: 4142703 - RNA, 15 nt, Yersinia pestis
aaucaauugccccca

SEQ ID NO: 4142704 - RNA, 20 nt, Yersinia pestis
aaucaauugcccccaucacu

SEQ ID NO: 4142705 - RNA, 14 nt, Yersinia pestis
aaucacauacuggc

SEQ ID NO: 4142706 - RNA, 12 nt, Yersinia pestis
aaucacaucauu

SEQ ID NO: 4142707 - RNA, 21 nt, Yersinia pestis
aaucacaucauucagcgucac

SEQ ID NO: 4142708 - RNA, 22 nt, Yersinia pestis
aaucacauuucaaauuaucgau

SEQ ID NO: 4142709 - RNA, 16 nt, Yersinia pestis
aaucaccauaacugcu

SEQ ID NO: 4142710 - RNA, 17 nt, Yersinia pestis
aaucacccgcaagaaua

SEQ ID NO: 4142711 - RNA, 19 nt, Yersinia pestis
aaucaccucaaacugacuu

SEQ ID NO: 4142712 - RNA, 17 nt, Yersinia pestis
aaucaccuggccaggaa

SEQ ID NO: 4142713 - RNA, 12 nt, Yersinia pestis
aaucaccuucaa

SEQ ID NO: 4142714 - RNA, 19 nt, Yersinia pestis
aaucaccuuggaaaacagc

SEQ ID NO: 4142715 - RNA, 21 nt, Yersinia pestis
aaucaccuuggaaaacagcaa

SEQ ID NO: 4142716 - RNA, 15 nt, Yersinia pestis
aaucacgacaaguca

SEQ ID NO: 4142717 - RNA, 16 nt, Yersinia pestis
aaucacgacaagucau

SEQ ID NO: 4142718 - RNA, 18 nt, Yersinia pestis
aaucacgauacgacuucu

SEQ ID NO: 4142719 - RNA, 17 nt, Yersinia pestis
aaucacgcagcaggcca

SEQ ID NO: 4142720 - RNA, 23 nt, Yersinia pestis
aaucacggagaauaaaaaugaua

SEQ ID NO: 4142721 - RNA, 14 nt, Yersinia pestis
aaucacguuuccaa

SEQ ID NO: 4142722 - RNA, 13 nt, Yersinia pestis
aaucacugacuga

SEQ ID NO: 4142723 - RNA, 19 nt, Yersinia pestis
aaucacugauucagaaagg

SEQ ID NO: 4142724 - RNA, 19 nt, Yersinia pestis
aaucacuggcaauaauuca

SEQ ID NO: 4142725 - RNA, 17 nt, Yersinia pestis
aaucacuucugcugcca

SEQ ID NO: 4142726 - RNA, 18 nt, Yersinia pestis
aaucagauacggcuccag

SEQ ID NO: 4142727 - RNA, 14 nt, Yersinia pestis
aaucagaucaacag

SEQ ID NO: 4142728 - RNA, 20 nt, Yersinia pestis
aaucagaucaacagauuuuc

SEQ ID NO: 4142729 - RNA, 20 nt, Yersinia pestis
aaucagauggucgccuuucc

SEQ ID NO: 4142730 - RNA, 17 nt, Yersinia pestis
aaucagcaagcugcuca

SEQ ID NO: 4142731 - RNA, 21 nt, Yersinia pestis
aaucagcaucuuaccggccuc

SEQ ID NO: 4142732 - RNA, 14 nt, Yersinia pestis
aaucagcauucuca

SEQ ID NO: 4142733 - RNA, 16 nt, Yersinia pestis
aaucagcuaauaucau

SEQ ID NO: 4142734 - RNA, 13 nt, Yersinia pestis
aaucagcucauua

SEQ ID NO: 4142735 - RNA, 15 nt, Yersinia pestis
aaucagcugauauga

SEQ ID NO: 4142736 - RNA, 20 nt, Yersinia pestis
aaucagcugauaugaaaaau

SEQ ID NO: 4142737 - RNA, 13 nt, Yersinia pestis
aaucagcuucauu

SEQ ID NO: 4142738 - RNA, 14 nt, Yersinia pestis
aaucagggcacucu

SEQ ID NO: 4142739 - RNA, 21 nt, Yersinia pestis
aaucaguaccgacaccaauac

SEQ ID NO: 4142740 - RNA, 22 nt, Yersinia pestis
aaucaguacuauucacgagcua

SEQ ID NO: 4142741 - RNA, 15 nt, Yersinia pestis
aaucagugacaagaa

SEQ ID NO: 4142742 - RNA, 14 nt, Yersinia pestis
aaucagugcaauaa

SEQ ID NO: 4142743 - RNA, 13 nt, Yersinia pestis
aaucauaauggua

SEQ ID NO: 4142744 - RNA, 19 nt, Yersinia pestis
aaucauacgcagccugaau

SEQ ID NO: 4142745 - RNA, 17 nt, Yersinia pestis
aaucauagccaucccaa

SEQ ID NO: 4142746 - RNA, 22 nt, Yersinia pestis
aaucaucagggaauugacuaaa

SEQ ID NO: 4142747 - RNA, 10 nt, Yersinia pestis
aaucaucauc

SEQ ID NO: 4142748 - RNA, 15 nt, Yersinia pestis
aaucaucaucacaaa

SEQ ID NO: 4142749 - RNA, 18 nt, Yersinia pestis
aaucaucaucacaaauaa

SEQ ID NO: 4142750 - RNA, 14 nt, Yersinia pestis
aaucaucaucccag

SEQ ID NO: 4142751 - RNA, 15 nt, Yersinia pestis
aaucaucguggcuuu

SEQ ID NO: 4142752 - RNA, 21 nt, Yersinia pestis
aaucaucugcuguacacuaac

SEQ ID NO: 4142753 - RNA, 12 nt, Yersinia pestis
aaucaugauggu

SEQ ID NO: 4142754 - RNA, 17 nt, Yersinia pestis
aaucaugcucugcuaau

SEQ ID NO: 4142755 - RNA, 21 nt, Yersinia pestis
aaucaugggccaauccaauag

SEQ ID NO: 4142756 - RNA, 10 nt, Yersinia pestis
aaucaugggg

SEQ ID NO: 4142757 - RNA, 18 nt, Yersinia pestis
aaucaugggguuuauugg

SEQ ID NO: 4142758 - RNA, 21 nt, Yersinia pestis
aaucauuuaggcguuucuucc

SEQ ID NO: 4142759 - RNA, 13 nt, Yersinia pestis
aaucauuuauaua

SEQ ID NO: 4142760 - RNA, 14 nt, Yersinia pestis
aaucauuuuuuuau

SEQ ID NO: 4142761 - RNA, 18 nt, Yersinia pestis
aauccaaccuauauagcc

SEQ ID NO: 4142762 - RNA, 14 nt, Yersinia pestis
aauccaacucaccu

SEQ ID NO: 4142763 - RNA, 16 nt, Yersinia pestis
aauccaauuuaccacu

SEQ ID NO: 4142764 - RNA, 18 nt, Yersinia pestis
aauccacauaaaaagaaa

SEQ ID NO: 4142765 - RNA, 16 nt, Yersinia pestis
aauccacugaaauaaa

SEQ ID NO: 4142766 - RNA, 21 nt, Yersinia pestis
aauccacugaaauaaacaagc

SEQ ID NO: 4142767 - RNA, 18 nt, Yersinia pestis
aauccagugcgcgauaaa

SEQ ID NO: 4142768 - RNA, 14 nt, Yersinia pestis
aauccaguguauua

SEQ ID NO: 4142769 - RNA, 22 nt, Yersinia pestis
aauccauagugauuauuuaaac

SEQ ID NO: 4142770 - RNA, 17 nt, Yersinia pestis
aauccccagaagcgcac

SEQ ID NO: 4142771 - RNA, 18 nt, Yersinia pestis
aauccccaugaugauauc

SEQ ID NO: 4142772 - RNA, 23 nt, Yersinia pestis
aauccccccuuuuucaaucacuu

SEQ ID NO: 4142773 - RNA, 16 nt, Yersinia pestis
aauccccggaccagcc

SEQ ID NO: 4142774 - RNA, 22 nt, Yersinia pestis
aauccccggucacuuaaauaac

SEQ ID NO: 4142775 - RNA, 15 nt, Yersinia pestis
aaucccucggcuuau

SEQ ID NO: 4142776 - RNA, 23 nt, Yersinia pestis
aaucccugccagaaucagcccca

SEQ ID NO: 4142777 - RNA, 17 nt, Yersinia pestis
aauccgcgccaaaauua

SEQ ID NO: 4142778 - RNA, 19 nt, Yersinia pestis
aauccgcuaguuaacccua

SEQ ID NO: 4142779 - RNA, 15 nt, Yersinia pestis
aauccggugcaacca

SEQ ID NO: 4142780 - RNA, 14 nt, Yersinia pestis
aauccuacauucag

SEQ ID NO: 4142781 - RNA, 17 nt, Yersinia pestis
aauccugaauaauacug

SEQ ID NO: 4142782 - RNA, 14 nt, Yersinia pestis
aauccuucuggcuu

SEQ ID NO: 4142783 - RNA, 15 nt, Yersinia pestis
aauccuuguaagacc

SEQ ID NO: 4142784 - RNA, 18 nt, Yersinia pestis
aaucgaacccuucagcau

SEQ ID NO: 4142785 - RNA, 15 nt, Yersinia pestis
aaucgaaugcaauaa

SEQ ID NO: 4142786 - RNA, 17 nt, Yersinia pestis
aaucgacggaaacagca

SEQ ID NO: 4142787 - RNA, 21 nt, Yersinia pestis
aaucgauacugccaucaucau

SEQ ID NO: 4142788 - RNA, 22 nt, Yersinia pestis
aaucgauacugccaucaucauu

SEQ ID NO: 4142789 - RNA, 15 nt, Yersinia pestis
aaucgccaaacugcu

SEQ ID NO: 4142790 - RNA, 18 nt, Yersinia pestis
aaucgcccaaugucagga

SEQ ID NO: 4142791 - RNA, 16 nt, Yersinia pestis
aaucgccgaaaucuca

SEQ ID NO: 4142792 - RNA, 20 nt, Yersinia pestis
aaucgcucugcguuuuuccc

SEQ ID NO: 4142793 - RNA, 13 nt, Yersinia pestis
aaucgcuuucgga

SEQ ID NO: 4142794 - RNA, 20 nt, Yersinia pestis
aaucggauggucauccacaa

SEQ ID NO: 4142795 - RNA, 18 nt, Yersinia pestis
aaucgguagacacaaggg

SEQ ID NO: 4142796 - RNA, 18 nt, Yersinia pestis
aaucguauaacauaauaa

SEQ ID NO: 4142797 - RNA, 12 nt, Yersinia pestis
aaucuagaacua

SEQ ID NO: 4142798 - RNA, 15 nt, Yersinia pestis
aaucuauuguauaua

SEQ ID NO: 4142799 - RNA, 16 nt, Yersinia pestis
aaucuauuguauauac

SEQ ID NO: 4142800 - RNA, 12 nt, Yersinia pestis
aaucucaucaau

SEQ ID NO: 4142801 - RNA, 16 nt, Yersinia pestis
aaucuccuccggagag

SEQ ID NO: 4142802 - RNA, 16 nt, Yersinia pestis
aaucucuccaugauau

SEQ ID NO: 4142803 - RNA, 17 nt, Yersinia pestis
aaucucuccaugauaua

SEQ ID NO: 4142804 - RNA, 18 nt, Yersinia pestis
aaucucuccaugauauau

SEQ ID NO: 4142805 - RNA, 19 nt, Yersinia pestis
aaucucuccaugauauauc

SEQ ID NO: 4142806 - RNA, 22 nt, Yersinia pestis
aaucucuggcaacggcacaucc

SEQ ID NO: 4142807 - RNA, 19 nt, Yersinia pestis
aaucucuugauuaccaaua

SEQ ID NO: 4142808 - RNA, 20 nt, Yersinia pestis
aaucucuugauuaccaauaa

SEQ ID NO: 4142809 - RNA, 14 nt, Yersinia pestis
aaucugaauagggg

SEQ ID NO: 4142810 - RNA, 17 nt, Yersinia pestis
aaucugagcgaacugaa

SEQ ID NO: 4142811 - RNA, 12 nt, Yersinia pestis
aaucugauacug

SEQ ID NO: 4142812 - RNA, 16 nt, Yersinia pestis
aaucugauacugaacg

SEQ ID NO: 4142813 - RNA, 22 nt, Yersinia pestis
aaucugaugaauuaaagauuaa

SEQ ID NO: 4142814 - RNA, 15 nt, Yersinia pestis
aaucugcgcccuuau

SEQ ID NO: 4142815 - RNA, 14 nt, Yersinia pestis
aaucugucgcugug

SEQ ID NO: 4142816 - RNA, 16 nt, Yersinia pestis
aaucugucgcugugaa

SEQ ID NO: 4142817 - RNA, 23 nt, Yersinia pestis
aaucuucauaaaccaacgguuca

SEQ ID NO: 4142818 - RNA, 17 nt, Yersinia pestis
aaucuugauccugcaau

SEQ ID NO: 4142819 - RNA, 18 nt, Yersinia pestis
aaucuugcagcgaucaca

SEQ ID NO: 4142820 - RNA, 21 nt, Yersinia pestis
aaucuuggcacucgaucaauc

SEQ ID NO: 4142821 - RNA, 12 nt, Yersinia pestis
aaucuuguuaau

SEQ ID NO: 4142822 - RNA, 19 nt, Yersinia pestis
aaucuuuuuaaaucaugca

SEQ ID NO: 4142823 - RNA, 20 nt, Yersinia pestis
aaugaaccgccaaucgaacc

SEQ ID NO: 4142824 - RNA, 20 nt, Yersinia pestis
aaugaacuguguuuauacca

SEQ ID NO: 4142825 - RNA, 23 nt, Yersinia pestis
aaugaagguacgcaccauugagc

SEQ ID NO: 4142826 - RNA, 21 nt, Yersinia pestis
aaugacagcaucaauaucgcc

SEQ ID NO: 4142827 - RNA, 14 nt, Yersinia pestis
aaugacauauucaa

SEQ ID NO: 4142828 - RNA, 18 nt, Yersinia pestis
aaugaccaagguuauaca

SEQ ID NO: 4142829 - RNA, 16 nt, Yersinia pestis
aaugacgaucacugcu

SEQ ID NO: 4142830 - RNA, 17 nt, Yersinia pestis
aaugacgaucacugcuu

SEQ ID NO: 4142831 - RNA, 20 nt, Yersinia pestis
aaugacuaauugugcagcau

SEQ ID NO: 4142832 - RNA, 20 nt, Yersinia pestis
aaugacuaucccuucaauca

SEQ ID NO: 4142833 - RNA, 17 nt, Yersinia pestis
aaugacuuaacugaaag

SEQ ID NO: 4142834 - RNA, 12 nt, Yersinia pestis
aaugagccuguc

SEQ ID NO: 4142835 - RNA, 16 nt, Yersinia pestis
aaugagccuuaccccu

SEQ ID NO: 4142836 - RNA, 22 nt, Yersinia pestis
aaugagcgccaaauguagagcg

SEQ ID NO: 4142837 - RNA, 17 nt, Yersinia pestis
aaugaggguaagugaau

SEQ ID NO: 4142838 - RNA, 20 nt, Yersinia pestis
aaugagguuuacauuuaaac

SEQ ID NO: 4142839 - RNA, 15 nt, Yersinia pestis
aaugagugacaacau

SEQ ID NO: 4142840 - RNA, 18 nt, Yersinia pestis
aaugagugauauccgcca

SEQ ID NO: 4142841 - RNA, 22 nt, Yersinia pestis
aaugauaacguuccauggcuga

SEQ ID NO: 4142842 - RNA, 16 nt, Yersinia pestis
aaugauaauaaaaaaa

SEQ ID NO: 4142843 - RNA, 20 nt, Yersinia pestis
aaugauacgugcuauagaaa

SEQ ID NO: 4142844 - RNA, 12 nt, Yersinia pestis
aaugauagcgag

SEQ ID NO: 4142845 - RNA, 15 nt, Yersinia pestis
aaugauauuccgagc

SEQ ID NO: 4142846 - RNA, 18 nt, Yersinia pestis
aaugaugacuugauuaac

SEQ ID NO: 4142847 - RNA, 13 nt, Yersinia pestis
aaugauggcggcu

SEQ ID NO: 4142848 - RNA, 23 nt, Yersinia pestis
aaugauggcggcuaaauguucaa

SEQ ID NO: 4142849 - RNA, 17 nt, Yersinia pestis
aaugaugguauuaauca

SEQ ID NO: 4142850 - RNA, 17 nt, Yersinia pestis
aaugauuaacggauacc

SEQ ID NO: 4142851 - RNA, 20 nt, Yersinia pestis
aaugauuauugaccagauag

SEQ ID NO: 4142852 - RNA, 14 nt, Yersinia pestis
aaugauucagugau

SEQ ID NO: 4142853 - RNA, 15 nt, Yersinia pestis
aaugauucauugagu

SEQ ID NO: 4142854 - RNA, 17 nt, Yersinia pestis
aaugauugauuaucaag

SEQ ID NO: 4142855 - RNA, 23 nt, Yersinia pestis
aaugauugauuaucaaguuaaau

SEQ ID NO: 4142856 - RNA, 24 nt, Yersinia pestis
aaugcaaaccaggcaacgacagca

SEQ ID NO: 4142857 - RNA, 14 nt, Yersinia pestis
aaugcaauuuuugc

SEQ ID NO: 4142858 - RNA, 12 nt, Yersinia pestis
aaugcaccaauc

SEQ ID NO: 4142859 - RNA, 17 nt, Yersinia pestis
aaugcaccaaucaacau

SEQ ID NO: 4142860 - RNA, 16 nt, Yersinia pestis
aaugcaccgacaaaga

SEQ ID NO: 4142861 - RNA, 16 nt, Yersinia pestis
aaugcacugaacaaug

SEQ ID NO: 4142862 - RNA, 22 nt, Yersinia pestis
aaugcacuucaucauucauuuu

SEQ ID NO: 4142863 - RNA, 12 nt, Yersinia pestis
aaugcagaugcc

SEQ ID NO: 4142864 - RNA, 20 nt, Yersinia pestis
aaugcagaugccaaugaucg

SEQ ID NO: 4142865 - RNA, 14 nt, Yersinia pestis
aaugcagcauccca

SEQ ID NO: 4142866 - RNA, 20 nt, Yersinia pestis
aaugcagguucauuacacag

SEQ ID NO: 4142867 - RNA, 23 nt, Yersinia pestis
aaugcagguucauuacacagcau

SEQ ID NO: 4142868 - RNA, 18 nt, Yersinia pestis
aaugcauccaagccauca

SEQ ID NO: 4142869 - RNA, 14 nt, Yersinia pestis
aaugccacccccag

SEQ ID NO: 4142870 - RNA, 16 nt, Yersinia pestis
aaugccacgucaucga

SEQ ID NO: 4142871 - RNA, 14 nt, Yersinia pestis
aaugccagcgaaaa

SEQ ID NO: 4142872 - RNA, 16 nt, Yersinia pestis
aaugccauagcugcug

SEQ ID NO: 4142873 - RNA, 16 nt, Yersinia pestis
aaugcccauugcgguu

SEQ ID NO: 4142874 - RNA, 19 nt, Yersinia pestis
aaugccccacuucacgcac

SEQ ID NO: 4142875 - RNA, 14 nt, Yersinia pestis
aaugccccuuuuuu

SEQ ID NO: 4142876 - RNA, 21 nt, Yersinia pestis
aaugcccgucgggauaucuuc

SEQ ID NO: 4142877 - RNA, 14 nt, Yersinia pestis
aaugccgagaacag

SEQ ID NO: 4142878 - RNA, 18 nt, Yersinia pestis
aaugccgagucuggucgg

SEQ ID NO: 4142879 - RNA, 21 nt, Yersinia pestis
aaugccgcgcccccagccauu

SEQ ID NO: 4142880 - RNA, 18 nt, Yersinia pestis
aaugccgcugaucaggaa

SEQ ID NO: 4142881 - RNA, 19 nt, Yersinia pestis
aaugccgcugaucaggaag

SEQ ID NO: 4142882 - RNA, 21 nt, Yersinia pestis
aaugccgcugugauuaagcgu

SEQ ID NO: 4142883 - RNA, 16 nt, Yersinia pestis
aaugccguacaacaau

SEQ ID NO: 4142884 - RNA, 18 nt, Yersinia pestis
aaugccuuagguaaguca

SEQ ID NO: 4142885 - RNA, 16 nt, Yersinia pestis
aaugcgaaaaaauaua

SEQ ID NO: 4142886 - RNA, 18 nt, Yersinia pestis
aaugcgaccggccgcuug

SEQ ID NO: 4142887 - RNA, 21 nt, Yersinia pestis
aaugcgaccggccgcuugcca

SEQ ID NO: 4142888 - RNA, 17 nt, Yersinia pestis
aaugcgauggucuauau

SEQ ID NO: 4142889 - RNA, 20 nt, Yersinia pestis
aaugcgauggucuauaugcc

SEQ ID NO: 4142890 - RNA, 16 nt, Yersinia pestis
aaugcgcucaccaaga

SEQ ID NO: 4142891 - RNA, 17 nt, Yersinia pestis
aaugcuaccuguaacau

SEQ ID NO: 4142892 - RNA, 12 nt, Yersinia pestis
aaugcuauauuu

SEQ ID NO: 4142893 - RNA, 16 nt, Yersinia pestis
aaugcucgcucaucau

SEQ ID NO: 4142894 - RNA, 21 nt, Yersinia pestis
aaugcucgcucaucauaaaaa

SEQ ID NO: 4142895 - RNA, 19 nt, Yersinia pestis
aaugcuuauuucacacugu

SEQ ID NO: 4142896 - RNA, 16 nt, Yersinia pestis
aauggaucacaucaca

SEQ ID NO: 4142897 - RNA, 18 nt, Yersinia pestis
aauggauugaucauucuc

SEQ ID NO: 4142898 - RNA, 13 nt, Yersinia pestis
aauggcaauggcc

SEQ ID NO: 4142899 - RNA, 18 nt, Yersinia pestis
aauggcaccucaucccaa

SEQ ID NO: 4142900 - RNA, 19 nt, Yersinia pestis
aauggccagcgggaaucaa

SEQ ID NO: 4142901 - RNA, 16 nt, Yersinia pestis
aauggccggacucauu

SEQ ID NO: 4142902 - RNA, 12 nt, Yersinia pestis
aauggccuugcc

SEQ ID NO: 4142903 - RNA, 15 nt, Yersinia pestis
aauggcgcucuuauu

SEQ ID NO: 4142904 - RNA, 21 nt, Yersinia pestis
aauggcguuauguaaaacgac

SEQ ID NO: 4142905 - RNA, 13 nt, Yersinia pestis
aauggcugccccc

SEQ ID NO: 4142906 - RNA, 22 nt, Yersinia pestis
aaugggccacaggcugcauggg

SEQ ID NO: 4142907 - RNA, 20 nt, Yersinia pestis
aauggguuugguuauuauga

SEQ ID NO: 4142908 - RNA, 13 nt, Yersinia pestis
aauggucaggaac

SEQ ID NO: 4142909 - RNA, 14 nt, Yersinia pestis
aauggugcccauca

SEQ ID NO: 4142910 - RNA, 18 nt, Yersinia pestis
aauggugcccaucacauc

SEQ ID NO: 4142911 - RNA, 18 nt, Yersinia pestis
aauggugcuauuucuggc

SEQ ID NO: 4142912 - RNA, 22 nt, Yersinia pestis
aauggugucaucgcuaaauacu

SEQ ID NO: 4142913 - RNA, 15 nt, Yersinia pestis
aauggugucuuuacu

SEQ ID NO: 4142914 - RNA, 17 nt, Yersinia pestis
aaugguugaaugaccaa

SEQ ID NO: 4142915 - RNA, 23 nt, Yersinia pestis
aaugguuuccuucaccaaaaaaa

SEQ ID NO: 4142916 - RNA, 12 nt, Yersinia pestis
aaugguuuugcc

SEQ ID NO: 4142917 - RNA, 23 nt, Yersinia pestis
aauguaaaacgaguaaauacaaa

SEQ ID NO: 4142918 - RNA, 15 nt, Yersinia pestis
aauguaagcaucuuu

SEQ ID NO: 4142919 - RNA, 19 nt, Yersinia pestis
aauguaagcaucuuuucau

SEQ ID NO: 4142920 - RNA, 14 nt, Yersinia pestis
aauguacaccuaaa

SEQ ID NO: 4142921 - RNA, 14 nt, Yersinia pestis
aauguauaaaaaag

SEQ ID NO: 4142922 - RNA, 15 nt, Yersinia pestis
aaugucaccacggcu

SEQ ID NO: 4142923 - RNA, 14 nt, Yersinia pestis
aaugucaggaaaug

SEQ ID NO: 4142924 - RNA, 18 nt, Yersinia pestis
aaugugccguaacucacc

SEQ ID NO: 4142925 - RNA, 15 nt, Yersinia pestis
aauguguugaauauc

SEQ ID NO: 4142926 - RNA, 21 nt, Yersinia pestis
aauguguugauuaacauccau

SEQ ID NO: 4142927 - RNA, 17 nt, Yersinia pestis
aauguguuuuugucauu

SEQ ID NO: 4142928 - RNA, 23 nt, Yersinia pestis
aauguguuuuugucauuuaauua

SEQ ID NO: 4142929 - RNA, 20 nt, Yersinia pestis
aauguuauauuucuuagaga

SEQ ID NO: 4142930 - RNA, 14 nt, Yersinia pestis
aauguuaucgccaa

SEQ ID NO: 4142931 - RNA, 22 nt, Yersinia pestis
aauguuccggacuucauaaaua

SEQ ID NO: 4142932 - RNA, 18 nt, Yersinia pestis
aauguucgcugacagagu

SEQ ID NO: 4142933 - RNA, 16 nt, Yersinia pestis
aauguucggucauaau

SEQ ID NO: 4142934 - RNA, 19 nt, Yersinia pestis
aauguucugcggaagucau

SEQ ID NO: 4142935 - RNA, 14 nt, Yersinia pestis
aauguugagaaaua

SEQ ID NO: 4142936 - RNA, 15 nt, Yersinia pestis
aauguugagaaauau

SEQ ID NO: 4142937 - RNA, 16 nt, Yersinia pestis
aauguugagaaauauu

SEQ ID NO: 4142938 - RNA, 24 nt, Yersinia pestis
aauguugauacuccauuugaacug

SEQ ID NO: 4142939 - RNA, 16 nt, Yersinia pestis
aauguugcugaauaaa

SEQ ID NO: 4142940 - RNA, 21 nt, Yersinia pestis
aauguuucuauccgaaaaaua

SEQ ID NO: 4142941 - RNA, 20 nt, Yersinia pestis
aauguuuuuauccaaacaaa

SEQ ID NO: 4142942 - RNA, 20 nt, Yersinia pestis
aauuaaaaaagguggccauu

SEQ ID NO: 4142943 - RNA, 23 nt, Yersinia pestis
aauuaaaaaagguggccauuacg

SEQ ID NO: 4142944 - RNA, 21 nt, Yersinia pestis
aauuaaaaacccucucauccu

SEQ ID NO: 4142945 - RNA, 15 nt, Yersinia pestis
aauuaaaaagagugu

SEQ ID NO: 4142946 - RNA, 18 nt, Yersinia pestis
aauuaaaaauagauuaaa

SEQ ID NO: 4142947 - RNA, 11 nt, Yersinia pestis
aauuaaaaauu

SEQ ID NO: 4142948 - RNA, 15 nt, Yersinia pestis
aauuaaaaauuaauu

SEQ ID NO: 4142949 - RNA, 19 nt, Yersinia pestis
aauuaaaacauauuaaguu

SEQ ID NO: 4142950 - RNA, 17 nt, Yersinia pestis
aauuaaaacugaaaagu

SEQ ID NO: 4142951 - RNA, 14 nt, Yersinia pestis
aauuaaaauaauga

SEQ ID NO: 4142952 - RNA, 19 nt, Yersinia pestis
aauuaaacgcucaucaacc

SEQ ID NO: 4142953 - RNA, 13 nt, Yersinia pestis
aauuaaauauuaa

SEQ ID NO: 4142954 - RNA, 18 nt, Yersinia pestis
aauuaaauuaauauuuaa

SEQ ID NO: 4142955 - RNA, 14 nt, Yersinia pestis
aauuaaauuuuaau

SEQ ID NO: 4142956 - RNA, 22 nt, Yersinia pestis
aauuaacacccaauaauaaaaa

SEQ ID NO: 4142957 - RNA, 16 nt, Yersinia pestis
aauuaacagcaucacu

SEQ ID NO: 4142958 - RNA, 23 nt, Yersinia pestis
aauuaaccugcuggcgcaacugu

SEQ ID NO: 4142959 - RNA, 12 nt, Yersinia pestis
aauuaaggaaaa

SEQ ID NO: 4142960 - RNA, 19 nt, Yersinia pestis
aauuaauaaccauaaaaua

SEQ ID NO: 4142961 - RNA, 15 nt, Yersinia pestis
aauuaauauauaaaa

SEQ ID NO: 4142962 - RNA, 11 nt, Yersinia pestis
aauuaauaucc

SEQ ID NO: 4142963 - RNA, 16 nt, Yersinia pestis
aauuaauaucuuuaaa

SEQ ID NO: 4142964 - RNA, 23 nt, Yersinia pestis
aauuaauaugccgacaaccaaca

SEQ ID NO: 4142965 - RNA, 13 nt, Yersinia pestis
aauuaauauuuaa

SEQ ID NO: 4142966 - RNA, 16 nt, Yersinia pestis
aauuaaucaauuaaau

SEQ ID NO: 4142967 - RNA, 22 nt, Yersinia pestis
aauuaaucuuguaaagacgcua

SEQ ID NO: 4142968 - RNA, 20 nt, Yersinia pestis
aauuaauuacuuuauuuaaa

SEQ ID NO: 4142969 - RNA, 19 nt, Yersinia pestis
aauuaauuuauuuucauua

SEQ ID NO: 4142970 - RNA, 13 nt, Yersinia pestis
aauuacacacccu

SEQ ID NO: 4142971 - RNA, 21 nt, Yersinia pestis
aauuacacacccucaacucaa

SEQ ID NO: 4142972 - RNA, 21 nt, Yersinia pestis
aauuaccaccaccuccacagg

SEQ ID NO: 4142973 - RNA, 15 nt, Yersinia pestis
aauuacgcacugccu

SEQ ID NO: 4142974 - RNA, 18 nt, Yersinia pestis
aauuacggcucaguugau

SEQ ID NO: 4142975 - RNA, 22 nt, Yersinia pestis
aauuacggcucaguugaugcaa

SEQ ID NO: 4142976 - RNA, 17 nt, Yersinia pestis
aauuacucguauaaaaa

SEQ ID NO: 4142977 - RNA, 20 nt, Yersinia pestis
aauuacucguauaaaaaaua

SEQ ID NO: 4142978 - RNA, 20 nt, Yersinia pestis
aauuacugacgcuuauccug

SEQ ID NO: 4142979 - RNA, 19 nt, Yersinia pestis
aauuacuuuaaagccaaau

SEQ ID NO: 4142980 - RNA, 22 nt, Yersinia pestis
aauuagccaagcaaccuuguuu

SEQ ID NO: 4142981 - RNA, 14 nt, Yersinia pestis
aauuagcgaaauau

SEQ ID NO: 4142982 - RNA, 22 nt, Yersinia pestis
aauuagcugaucgggcuuuaca

SEQ ID NO: 4142983 - RNA, 19 nt, Yersinia pestis
aauuagcuguacucacuca

SEQ ID NO: 4142984 - RNA, 21 nt, Yersinia pestis
aauuaggggaagguaaaaaag

SEQ ID NO: 4142985 - RNA, 19 nt, Yersinia pestis
aauuauagccaaaucugga

SEQ ID NO: 4142986 - RNA, 22 nt, Yersinia pestis
aauuauagccaaaucuggauaa

SEQ ID NO: 4142987 - RNA, 15 nt, Yersinia pestis
aauuauauaagagau

SEQ ID NO: 4142988 - RNA, 12 nt, Yersinia pestis
aauuauauuuaa

SEQ ID NO: 4142989 - RNA, 13 nt, Yersinia pestis
aauuaucaucaau

SEQ ID NO: 4142990 - RNA, 15 nt, Yersinia pestis
aauuaucaucaauag

SEQ ID NO: 4142991 - RNA, 18 nt, Yersinia pestis
aauuauccauuuucugcc

SEQ ID NO: 4142992 - RNA, 22 nt, Yersinia pestis
aauuaucgaucacaugcucagu

SEQ ID NO: 4142993 - RNA, 18 nt, Yersinia pestis
aauuaucuuauccacagc

SEQ ID NO: 4142994 - RNA, 20 nt, Yersinia pestis
aauuaucuuauccacagcau

SEQ ID NO: 4142995 - RNA, 17 nt, Yersinia pestis
aauuauugccgcagaua

SEQ ID NO: 4142996 - RNA, 13 nt, Yersinia pestis
aauuauuguggcu

SEQ ID NO: 4142997 - RNA, 17 nt, Yersinia pestis
aauuauuguucaaaaac

SEQ ID NO: 4142998 - RNA, 14 nt, Yersinia pestis
aauuauuucaguag

SEQ ID NO: 4142999 - RNA, 18 nt, Yersinia pestis
aauuauuucucugaugaa

SEQ ID NO: 4143000 - RNA, 16 nt, Yersinia pestis
aauuauuuuauuuaaa

SEQ ID NO: 4143001 - RNA, 20 nt, Yersinia pestis
aauuauuuuccagaugaaua

SEQ ID NO: 4143002 - RNA, 21 nt, Yersinia pestis
aauuauuuuggaguauacauu

SEQ ID NO: 4143003 - RNA, 23 nt, Yersinia pestis
aauucaaaauguauuauuuugua

SEQ ID NO: 4143004 - RNA, 18 nt, Yersinia pestis
aauucaauccauugaucu

SEQ ID NO: 4143005 - RNA, 20 nt, Yersinia pestis
aauucaccaauugcggucag

SEQ ID NO: 4143006 - RNA, 15 nt, Yersinia pestis
aauucaccagcaaua

SEQ ID NO: 4143007 - RNA, 19 nt, Yersinia pestis
aauucacgcaaggccaggu

SEQ ID NO: 4143008 - RNA, 18 nt, Yersinia pestis
aauucagauaagaucuca

SEQ ID NO: 4143009 - RNA, 22 nt, Yersinia pestis
aauucagaugagaaucucucca

SEQ ID NO: 4143010 - RNA, 20 nt, Yersinia pestis
aauucagguugaucaguaaa

SEQ ID NO: 4143011 - RNA, 15 nt, Yersinia pestis
aauucauaugacaaa

SEQ ID NO: 4143012 - RNA, 15 nt, Yersinia pestis
aauucaucuuuaaca

SEQ ID NO: 4143013 - RNA, 18 nt, Yersinia pestis
aauucaugcuaauaccac

SEQ ID NO: 4143014 - RNA, 20 nt, Yersinia pestis
aauucaugcuaauaccacaa

SEQ ID NO: 4143015 - RNA, 22 nt, Yersinia pestis
aauucaugcuaauaccacaaca

SEQ ID NO: 4143016 - RNA, 15 nt, Yersinia pestis
aauucauguugccaa

SEQ ID NO: 4143017 - RNA, 16 nt, Yersinia pestis
aauucauguugccaau

SEQ ID NO: 4143018 - RNA, 22 nt, Yersinia pestis
aauucauguugccaaugggcca

SEQ ID NO: 4143019 - RNA, 14 nt, Yersinia pestis
aauucauuauuacu

SEQ ID NO: 4143020 - RNA, 15 nt, Yersinia pestis
aauucauuauuacuc

SEQ ID NO: 4143021 - RNA, 23 nt, Yersinia pestis
aauuccacauaaaauagcccagu

SEQ ID NO: 4143022 - RNA, 22 nt, Yersinia pestis
aauuccaccauucucaaaauaa

SEQ ID NO: 4143023 - RNA, 19 nt, Yersinia pestis
aauuccauaauaagugaac

SEQ ID NO: 4143024 - RNA, 22 nt, Yersinia pestis
aauuccaugcaaaauaugguag

SEQ ID NO: 4143025 - RNA, 12 nt, Yersinia pestis
aauuccgcuucu

SEQ ID NO: 4143026 - RNA, 13 nt, Yersinia pestis
aauuccuauaaau

SEQ ID NO: 4143027 - RNA, 19 nt, Yersinia pestis
aauuccuauaaauuuuaag

SEQ ID NO: 4143028 - RNA, 22 nt, Yersinia pestis
aauuccuauaaauuuuaaguua

SEQ ID NO: 4143029 - RNA, 22 nt, Yersinia pestis
aauuccuuagcggcaaaccacu

SEQ ID NO: 4143030 - RNA, 12 nt, Yersinia pestis
aauucggcuggc

SEQ ID NO: 4143031 - RNA, 19 nt, Yersinia pestis
aauucguagcuaucuuugc

SEQ ID NO: 4143032 - RNA, 20 nt, Yersinia pestis
aauucuauccggauuaaauu

SEQ ID NO: 4143033 - RNA, 15 nt, Yersinia pestis
aauucuaucugguuu

SEQ ID NO: 4143034 - RNA, 16 nt, Yersinia pestis
aauucugagaucuaaa

SEQ ID NO: 4143035 - RNA, 18 nt, Yersinia pestis
aauucugccgacuaauau

SEQ ID NO: 4143036 - RNA, 20 nt, Yersinia pestis
aauucuggguacaacacaaa

SEQ ID NO: 4143037 - RNA, 17 nt, Yersinia pestis
aauucuguagaguaaaa

SEQ ID NO: 4143038 - RNA, 21 nt, Yersinia pestis
aauucuuucaacgcauccaaa

SEQ ID NO: 4143039 - RNA, 15 nt, Yersinia pestis
aauugacuuuaaaaa

SEQ ID NO: 4143040 - RNA, 23 nt, Yersinia pestis
aauugacuuuaaaaaaauuauca

SEQ ID NO: 4143041 - RNA, 20 nt, Yersinia pestis
aauugagauauuugucgcau

SEQ ID NO: 4143042 - RNA, 19 nt, Yersinia pestis
aauugaguaguaaaaccua

SEQ ID NO: 4143043 - RNA, 13 nt, Yersinia pestis
aauugauaugauu

SEQ ID NO: 4143044 - RNA, 21 nt, Yersinia pestis
aauugauauuauuuauaugau

SEQ ID NO: 4143045 - RNA, 22 nt, Yersinia pestis
aauugauauuauuuauaugaua

SEQ ID NO: 4143046 - RNA, 23 nt, Yersinia pestis
aauugauauuauuuauaugauaa

SEQ ID NO: 4143047 - RNA, 14 nt, Yersinia pestis
aauugaucagggca

SEQ ID NO: 4143048 - RNA, 13 nt, Yersinia pestis
aauugauccugug

SEQ ID NO: 4143049 - RNA, 14 nt, Yersinia pestis
aauugaucugauau

SEQ ID NO: 4143050 - RNA, 22 nt, Yersinia pestis
aauugaugcacaguaggcugaa

SEQ ID NO: 4143051 - RNA, 21 nt, Yersinia pestis
aauugaugucaauuaaaaacg

SEQ ID NO: 4143052 - RNA, 21 nt, Yersinia pestis
aauugccgccacaggcgacua

SEQ ID NO: 4143053 - RNA, 17 nt, Yersinia pestis
aauugccugauuuuuau

SEQ ID NO: 4143054 - RNA, 13 nt, Yersinia pestis
aauugcugaaaaa

SEQ ID NO: 4143055 - RNA, 21 nt, Yersinia pestis
aauugcuggcggucacgcuga

SEQ ID NO: 4143056 - RNA, 17 nt, Yersinia pestis
aauuggaagagccugaa

SEQ ID NO: 4143057 - RNA, 17 nt, Yersinia pestis
aauugggggucagggcg

SEQ ID NO: 4143058 - RNA, 18 nt, Yersinia pestis
aauugggggucagggcgg

SEQ ID NO: 4143059 - RNA, 22 nt, Yersinia pestis
aauuggugcuuuauguauucuu

SEQ ID NO: 4143060 - RNA, 23 nt, Yersinia pestis
aauugguuagcgccuuuuuuaua

SEQ ID NO: 4143061 - RNA, 15 nt, Yersinia pestis
aauugugucaucgcg

SEQ ID NO: 4143062 - RNA, 14 nt, Yersinia pestis
aauuguuugcuauc

SEQ ID NO: 4143063 - RNA, 19 nt, Yersinia pestis
aauuuaaacaaccaaaaau

SEQ ID NO: 4143064 - RNA, 18 nt, Yersinia pestis
aauuuaacuuucaucccu

SEQ ID NO: 4143065 - RNA, 14 nt, Yersinia pestis
aauuuacugacggu

SEQ ID NO: 4143066 - RNA, 14 nt, Yersinia pestis
aauuuagcaaagcg

SEQ ID NO: 4143067 - RNA, 18 nt, Yersinia pestis
aauuuagccauucaaaaa

SEQ ID NO: 4143068 - RNA, 19 nt, Yersinia pestis
aauuuagccauucaaaaau

SEQ ID NO: 4143069 - RNA, 23 nt, Yersinia pestis
aauuuagccgcccucucuagauu

SEQ ID NO: 4143070 - RNA, 13 nt, Yersinia pestis
aauuuauccaacu

SEQ ID NO: 4143071 - RNA, 21 nt, Yersinia pestis
aauuuauccuguacauauaua

SEQ ID NO: 4143072 - RNA, 14 nt, Yersinia pestis
aauuuaugauuaaa

SEQ ID NO: 4143073 - RNA, 12 nt, Yersinia pestis
aauuuauuuuca

SEQ ID NO: 4143074 - RNA, 17 nt, Yersinia pestis
aauuucaauaacaccgu

SEQ ID NO: 4143075 - RNA, 16 nt, Yersinia pestis
aauuucagauaaaaau

SEQ ID NO: 4143076 - RNA, 19 nt, Yersinia pestis
aauuucagcagcacguuca

SEQ ID NO: 4143077 - RNA, 23 nt, Yersinia pestis
aauuucagcagcacguucaccaa

SEQ ID NO: 4143078 - RNA, 22 nt, Yersinia pestis
aauuucaggucgauuacauacu

SEQ ID NO: 4143079 - RNA, 14 nt, Yersinia pestis
aauuucagucaaua

SEQ ID NO: 4143080 - RNA, 19 nt, Yersinia pestis
aauuucaucucaauaacua

SEQ ID NO: 4143081 - RNA, 23 nt, Yersinia pestis
aauuucaugcgaauacuuugcua

SEQ ID NO: 4143082 - RNA, 20 nt, Yersinia pestis
aauuucauuguggaggaagg

SEQ ID NO: 4143083 - RNA, 13 nt, Yersinia pestis
aauuucauuuacg

SEQ ID NO: 4143084 - RNA, 20 nt, Yersinia pestis
aauuucauuuuaaaaucgua

SEQ ID NO: 4143085 - RNA, 16 nt, Yersinia pestis
aauuucgaaaacucaa

SEQ ID NO: 4143086 - RNA, 21 nt, Yersinia pestis
aauuucuacgccgucaucauc

SEQ ID NO: 4143087 - RNA, 12 nt, Yersinia pestis
aauuucucaaau

SEQ ID NO: 4143088 - RNA, 23 nt, Yersinia pestis
aauuucucggccaacaucuucca

SEQ ID NO: 4143089 - RNA, 18 nt, Yersinia pestis
aauuucuucuagcucuuc

SEQ ID NO: 4143090 - RNA, 23 nt, Yersinia pestis
aauuucuugaggugcuugaacaa

SEQ ID NO: 4143091 - RNA, 13 nt, Yersinia pestis
aauuugaucacca

SEQ ID NO: 4143092 - RNA, 14 nt, Yersinia pestis
aauuugaucaccaa

SEQ ID NO: 4143093 - RNA, 19 nt, Yersinia pestis
aauuugcuccuggcaugca

SEQ ID NO: 4143094 - RNA, 13 nt, Yersinia pestis
aauuuggccaaua

SEQ ID NO: 4143095 - RNA, 15 nt, Yersinia pestis
aauuugguagaacug

SEQ ID NO: 4143096 - RNA, 21 nt, Yersinia pestis
aauuugguucacggaaaguag

SEQ ID NO: 4143097 - RNA, 19 nt, Yersinia pestis
aauuuuaaaggcaacgaag

SEQ ID NO: 4143098 - RNA, 21 nt, Yersinia pestis
aauuuuaaguuaauguuuaua

SEQ ID NO: 4143099 - RNA, 14 nt, Yersinia pestis
aauuuuaauuauaa

SEQ ID NO: 4143100 - RNA, 22 nt, Yersinia pestis
aauuuuauucgcguuucauuuu

SEQ ID NO: 4143101 - RNA, 20 nt, Yersinia pestis
aauuuuauuguuuucguuua

SEQ ID NO: 4143102 - RNA, 16 nt, Yersinia pestis
aauuuugguacaggug

SEQ ID NO: 4143103 - RNA, 15 nt, Yersinia pestis
aauuuuuacauucca

SEQ ID NO: 4143104 - RNA, 16 nt, Yersinia pestis
aauuuuuagaaaacau

SEQ ID NO: 4143105 - RNA, 12 nt, Yersinia pestis
aauuuuucccuu

SEQ ID NO: 4143106 - RNA, 16 nt, Yersinia pestis
aauuuuugauacuguu

SEQ ID NO: 4143107 - RNA, 11 nt, Yersinia pestis
acaaaaacagu

SEQ ID NO: 4143108 - RNA, 15 nt, Yersinia pestis
acaaaaacgcucacg

SEQ ID NO: 4143109 - RNA, 17 nt, Yersinia pestis
acaaaaaguuaaauaug

SEQ ID NO: 4143110 - RNA, 22 nt, Yersinia pestis
acaaaagagauccguuuaauca

SEQ ID NO: 4143111 - RNA, 12 nt, Yersinia pestis
acaaaagugaaa

SEQ ID NO: 4143112 - RNA, 20 nt, Yersinia pestis
acaaaauaauaauucugcua

SEQ ID NO: 4143113 - RNA, 23 nt, Yersinia pestis
acaaaauaauaauucugcuauua

SEQ ID NO: 4143114 - RNA, 14 nt, Yersinia pestis
acaaaaucccccac

SEQ ID NO: 4143115 - RNA, 20 nt, Yersinia pestis
acaaaaugccguacaacaau

SEQ ID NO: 4143116 - RNA, 13 nt, Yersinia pestis
acaaaaugugaaa

SEQ ID NO: 4143117 - RNA, 22 nt, Yersinia pestis
acaaaaugugaaaagcagucga

SEQ ID NO: 4143118 - RNA, 22 nt, Yersinia pestis
acaaacaaccuaaaaaaaacaa

SEQ ID NO: 4143119 - RNA, 13 nt, Yersinia pestis
acaaacagauaca

SEQ ID NO: 4143120 - RNA, 16 nt, Yersinia pestis
acaaacauggcggcag

SEQ ID NO: 4143121 - RNA, 15 nt, Yersinia pestis
acaaaccuaaaccuu

SEQ ID NO: 4143122 - RNA, 14 nt, Yersinia pestis
acaaacgcuugagc

SEQ ID NO: 4143123 - RNA, 17 nt, Yersinia pestis
acaaacgcuugagcuua

SEQ ID NO: 4143124 - RNA, 18 nt, Yersinia pestis
acaaacucaugcucuuca

SEQ ID NO: 4143125 - RNA, 21 nt, Yersinia pestis
acaaacucugcguagccauua

SEQ ID NO: 4143126 - RNA, 16 nt, Yersinia pestis
acaaacuugagucagc

SEQ ID NO: 4143127 - RNA, 21 nt, Yersinia pestis
acaaagauacagcccaagaga

SEQ ID NO: 4143128 - RNA, 24 nt, Yersinia pestis
acaaagauacagcccaagagaaau

SEQ ID NO: 4143129 - RNA, 15 nt, Yersinia pestis
acaaagauagcguca

SEQ ID NO: 4143130 - RNA, 15 nt, Yersinia pestis
acaaagcccaaaaaa

SEQ ID NO: 4143131 - RNA, 16 nt, Yersinia pestis
acaaaguaccuauggc

SEQ ID NO: 4143132 - RNA, 14 nt, Yersinia pestis
acaaagugagggau

SEQ ID NO: 4143133 - RNA, 14 nt, Yersinia pestis
acaaauaaaacaga

SEQ ID NO: 4143134 - RNA, 21 nt, Yersinia pestis
acaaauagaucggguaaacca

SEQ ID NO: 4143135 - RNA, 22 nt, Yersinia pestis
acaaauagaucggguaaaccaa

SEQ ID NO: 4143136 - RNA, 17 nt, Yersinia pestis
acaaauaugaagaugcu

SEQ ID NO: 4143137 - RNA, 23 nt, Yersinia pestis
acaaauaugacgcagcgaaaugu

SEQ ID NO: 4143138 - RNA, 13 nt, Yersinia pestis
acaaauauuggcc

SEQ ID NO: 4143139 - RNA, 13 nt, Yersinia pestis
acaaauccuguag

SEQ ID NO: 4143140 - RNA, 17 nt, Yersinia pestis
acaaaucuuaaauugaa

SEQ ID NO: 4143141 - RNA, 20 nt, Yersinia pestis
acaaaucuuaaauugaagag

SEQ ID NO: 4143142 - RNA, 21 nt, Yersinia pestis
acaaaucuuaaauugaagagu

SEQ ID NO: 4143143 - RNA, 22 nt, Yersinia pestis
acaaaucuuaaauugaagaguu

SEQ ID NO: 4143144 - RNA, 18 nt, Yersinia pestis
acaaaugcugugccaugu

SEQ ID NO: 4143145 - RNA, 23 nt, Yersinia pestis
acaaauggucaggaacccauuug

SEQ ID NO: 4143146 - RNA, 18 nt, Yersinia pestis
acaaauguuuaauggcau

SEQ ID NO: 4143147 - RNA, 15 nt, Yersinia pestis
acaaauuaaauuucu

SEQ ID NO: 4143148 - RNA, 17 nt, Yersinia pestis
acaaauucaccagcaau

SEQ ID NO: 4143149 - RNA, 18 nt, Yersinia pestis
acaaauuguggaaauaac

SEQ ID NO: 4143150 - RNA, 18 nt, Yersinia pestis
acaaauuugacauuuccu

SEQ ID NO: 4143151 - RNA, 19 nt, Yersinia pestis
acaaauuuuuuauauucca

SEQ ID NO: 4143152 - RNA, 12 nt, Yersinia pestis
acaacaaaggcg

SEQ ID NO: 4143153 - RNA, 21 nt, Yersinia pestis
acaacaagcggccagcuugca

SEQ ID NO: 4143154 - RNA, 12 nt, Yersinia pestis
acaacaauaaua

SEQ ID NO: 4143155 - RNA, 16 nt, Yersinia pestis
acaacacgcuauccgc

SEQ ID NO: 4143156 - RNA, 23 nt, Yersinia pestis
acaacagugcaacauuaaaaaua

SEQ ID NO: 4143157 - RNA, 15 nt, Yersinia pestis
acaacaucaauggca

SEQ ID NO: 4143158 - RNA, 14 nt, Yersinia pestis
acaacaucauauau

SEQ ID NO: 4143159 - RNA, 23 nt, Yersinia pestis
acaacauugccaaauuauucauc

SEQ ID NO: 4143160 - RNA, 19 nt, Yersinia pestis
acaaccaacaaacaauccu

SEQ ID NO: 4143161 - RNA, 14 nt, Yersinia pestis
acaaccaacaguuu

SEQ ID NO: 4143162 - RNA, 12 nt, Yersinia pestis
acaaccaauaca

SEQ ID NO: 4143163 - RNA, 21 nt, Yersinia pestis
acaaccacccgacaucaagaa

SEQ ID NO: 4143164 - RNA, 22 nt, Yersinia pestis
acaaccauuguggcuaaaccca

SEQ ID NO: 4143165 - RNA, 14 nt, Yersinia pestis
acaacccaauaaua

SEQ ID NO: 4143166 - RNA, 16 nt, Yersinia pestis
acaaccccaugaccgc

SEQ ID NO: 4143167 - RNA, 18 nt, Yersinia pestis
acaacccgaauuaauaaa

SEQ ID NO: 4143168 - RNA, 14 nt, Yersinia pestis
acaaccgugcacca

SEQ ID NO: 4143169 - RNA, 19 nt, Yersinia pestis
acaaccuaaaaaaaacaac

SEQ ID NO: 4143170 - RNA, 17 nt, Yersinia pestis
acaaccuguagcucaua

SEQ ID NO: 4143171 - RNA, 14 nt, Yersinia pestis
acaacgagggcuca

SEQ ID NO: 4143172 - RNA, 19 nt, Yersinia pestis
acaacgagggcucaaucuc

SEQ ID NO: 4143173 - RNA, 13 nt, Yersinia pestis
acaacgcaucagu

SEQ ID NO: 4143174 - RNA, 15 nt, Yersinia pestis
acaacgcucuaacgu

SEQ ID NO: 4143175 - RNA, 20 nt, Yersinia pestis
acaacgcuuaucaaagugcu

SEQ ID NO: 4143176 - RNA, 21 nt, Yersinia pestis
acaacggguuuucuguuuuug

SEQ ID NO: 4143177 - RNA, 16 nt, Yersinia pestis
acaacgucauuuguga

SEQ ID NO: 4143178 - RNA, 18 nt, Yersinia pestis
acaacguguccgcaccau

SEQ ID NO: 4143179 - RNA, 20 nt, Yersinia pestis
acaacguguccgcaccauuc

SEQ ID NO: 4143180 - RNA, 20 nt, Yersinia pestis
acaacguuuaguaaucaaua

SEQ ID NO: 4143181 - RNA, 14 nt, Yersinia pestis
acaacugaaugucu

SEQ ID NO: 4143182 - RNA, 11 nt, Yersinia pestis
acaacuucuuc

SEQ ID NO: 4143183 - RNA, 13 nt, Yersinia pestis
acaacuugcugga

SEQ ID NO: 4143184 - RNA, 15 nt, Yersinia pestis
acaacuuucccaguc

SEQ ID NO: 4143185 - RNA, 19 nt, Yersinia pestis
acaagauaaauaccgccaa

SEQ ID NO: 4143186 - RNA, 14 nt, Yersinia pestis
acaagaucccaagc

SEQ ID NO: 4143187 - RNA, 21 nt, Yersinia pestis
acaagcacucaaugucaugca

SEQ ID NO: 4143188 - RNA, 19 nt, Yersinia pestis
acaagccagugacugagca

SEQ ID NO: 4143189 - RNA, 14 nt, Yersinia pestis
acaagccauuucac

SEQ ID NO: 4143190 - RNA, 15 nt, Yersinia pestis
acaagccauuucacc

SEQ ID NO: 4143191 - RNA, 20 nt, Yersinia pestis
acaagccgugaccaaagugc

SEQ ID NO: 4143192 - RNA, 19 nt, Yersinia pestis
acaagcgaccaucaugaau

SEQ ID NO: 4143193 - RNA, 15 nt, Yersinia pestis
acaagucagugauuc

SEQ ID NO: 4143194 - RNA, 17 nt, Yersinia pestis
acaaguuacauuuuuaa

SEQ ID NO: 4143195 - RNA, 18 nt, Yersinia pestis
acaaguuacauuuuuaac

SEQ ID NO: 4143196 - RNA, 15 nt, Yersinia pestis
acaaguugucuguaa

SEQ ID NO: 4143197 - RNA, 15 nt, Yersinia pestis
acaauaaaaucuuaa

SEQ ID NO: 4143198 - RNA, 15 nt, Yersinia pestis
acaauaaauauccuc

SEQ ID NO: 4143199 - RNA, 13 nt, Yersinia pestis
acaauaaaucaau

SEQ ID NO: 4143200 - RNA, 15 nt, Yersinia pestis
acaauaaaucgccac

SEQ ID NO: 4143201 - RNA, 22 nt, Yersinia pestis
acaauaacgcugaauacacucg

SEQ ID NO: 4143202 - RNA, 18 nt, Yersinia pestis
acaauaauaagccgcagg

SEQ ID NO: 4143203 - RNA, 13 nt, Yersinia pestis
acaauacauagaa

SEQ ID NO: 4143204 - RNA, 16 nt, Yersinia pestis
acaauaccgccacaca

SEQ ID NO: 4143205 - RNA, 21 nt, Yersinia pestis
acaauaccgccacacaauaca

SEQ ID NO: 4143206 - RNA, 17 nt, Yersinia pestis
acaauaggcuauuuuac

SEQ ID NO: 4143207 - RNA, 22 nt, Yersinia pestis
acaauaggcuauuuuacuugcc

SEQ ID NO: 4143208 - RNA, 17 nt, Yersinia pestis
acaauagucucuugggc

SEQ ID NO: 4143209 - RNA, 16 nt, Yersinia pestis
acaauauaauaaugcu

SEQ ID NO: 4143210 - RNA, 13 nt, Yersinia pestis
acaauauuauauu

SEQ ID NO: 4143211 - RNA, 23 nt, Yersinia pestis
acaauauucauuuugcuggaaaa

SEQ ID NO: 4143212 - RNA, 18 nt, Yersinia pestis
acaauauucgcagccaaa

SEQ ID NO: 4143213 - RNA, 17 nt, Yersinia pestis
acaaucaucguggcuuu

SEQ ID NO: 4143214 - RNA, 11 nt, Yersinia pestis
acaauccggug

SEQ ID NO: 4143215 - RNA, 16 nt, Yersinia pestis
acaaucgucuucgguc

SEQ ID NO: 4143216 - RNA, 19 nt, Yersinia pestis
acaaucucuggcaacggca

SEQ ID NO: 4143217 - RNA, 14 nt, Yersinia pestis
acaaucuucuucag

SEQ ID NO: 4143218 - RNA, 22 nt, Yersinia pestis
acaaugaacuguguuuauacca

SEQ ID NO: 4143219 - RNA, 13 nt, Yersinia pestis
acaaugauuucag

SEQ ID NO: 4143220 - RNA, 14 nt, Yersinia pestis
acaaugcacagugc

SEQ ID NO: 4143221 - RNA, 16 nt, Yersinia pestis
acaaugcacagugccg

SEQ ID NO: 4143222 - RNA, 22 nt, Yersinia pestis
acaaugcggccuuugcucaggu

SEQ ID NO: 4143223 - RNA, 22 nt, Yersinia pestis
acaaugguugaaugaccaaggu

SEQ ID NO: 4143224 - RNA, 22 nt, Yersinia pestis
acaaugugccgcgcaaccaucc

SEQ ID NO: 4143225 - RNA, 13 nt, Yersinia pestis
acaauuaacacuu

SEQ ID NO: 4143226 - RNA, 14 nt, Yersinia pestis
acaauuauagccaa

SEQ ID NO: 4143227 - RNA, 15 nt, Yersinia pestis
acaauuauagccaaa

SEQ ID NO: 4143228 - RNA, 15 nt, Yersinia pestis
acaauugcuccaguu

SEQ ID NO: 4143229 - RNA, 17 nt, Yersinia pestis
acaauugcuccaguuga

SEQ ID NO: 4143230 - RNA, 15 nt, Yersinia pestis
acaauuuccauauca

SEQ ID NO: 4143231 - RNA, 18 nt, Yersinia pestis
acaauuucgaaaacucaa

SEQ ID NO: 4143232 - RNA, 10 nt, Yersinia pestis
acaauuuuau

SEQ ID NO: 4143233 - RNA, 17 nt, Yersinia pestis
acacaagcgaaucuggc

SEQ ID NO: 4143234 - RNA, 22 nt, Yersinia pestis
acacaagggauuuaaaaucccu

SEQ ID NO: 4143235 - RNA, 15 nt, Yersinia pestis
acacaauaggcuauu

SEQ ID NO: 4143236 - RNA, 22 nt, Yersinia pestis
acacaauucccguuagguucaa

SEQ ID NO: 4143237 - RNA, 15 nt, Yersinia pestis
acacacagcaauaca

SEQ ID NO: 4143238 - RNA, 18 nt, Yersinia pestis
acacacagcaauacaugu

SEQ ID NO: 4143239 - RNA, 16 nt, Yersinia pestis
acacagaaucaccaac

SEQ ID NO: 4143240 - RNA, 19 nt, Yersinia pestis
acacagacuggugaacgaa

SEQ ID NO: 4143241 - RNA, 24 nt, Yersinia pestis
acacagcccugccuggcaggaagc

SEQ ID NO: 4143242 - RNA, 15 nt, Yersinia pestis
acacagcuccccccu

SEQ ID NO: 4143243 - RNA, 20 nt, Yersinia pestis
acacagucgcacugauagca

SEQ ID NO: 4143244 - RNA, 19 nt, Yersinia pestis
acacagucugucguacuuu

SEQ ID NO: 4143245 - RNA, 14 nt, Yersinia pestis
acacaguggaaccu

SEQ ID NO: 4143246 - RNA, 17 nt, Yersinia pestis
acacaguuauucccauc

SEQ ID NO: 4143247 - RNA, 16 nt, Yersinia pestis
acacauaccacacaca

SEQ ID NO: 4143248 - RNA, 19 nt, Yersinia pestis
acacauaccacacacaaag

SEQ ID NO: 4143249 - RNA, 21 nt, Yersinia pestis
acacauacuucgaugauuauu

SEQ ID NO: 4143250 - RNA, 17 nt, Yersinia pestis
acacaucacgcuuaaga

SEQ ID NO: 4143251 - RNA, 13 nt, Yersinia pestis
acacaugaaaauc

SEQ ID NO: 4143252 - RNA, 16 nt, Yersinia pestis
acacaugaaaaucaag

SEQ ID NO: 4143253 - RNA, 20 nt, Yersinia pestis
acacauuccaguaaaaaaau

SEQ ID NO: 4143254 - RNA, 19 nt, Yersinia pestis
acacauuggccacuggccu

SEQ ID NO: 4143255 - RNA, 15 nt, Yersinia pestis
acaccaaaacucccu

SEQ ID NO: 4143256 - RNA, 18 nt, Yersinia pestis
acaccaacaccacacuga

SEQ ID NO: 4143257 - RNA, 19 nt, Yersinia pestis
acaccaacacugaauaacu

SEQ ID NO: 4143258 - RNA, 21 nt, Yersinia pestis
acaccaagaacccuuuaucuu

SEQ ID NO: 4143259 - RNA, 21 nt, Yersinia pestis
acaccaagcccgauugccugu

SEQ ID NO: 4143260 - RNA, 14 nt, Yersinia pestis
acaccaccaucacu

SEQ ID NO: 4143261 - RNA, 19 nt, Yersinia pestis
acaccagagaugauagcaa

SEQ ID NO: 4143262 - RNA, 22 nt, Yersinia pestis
acaccagagaugauagcaaugu

SEQ ID NO: 4143263 - RNA, 14 nt, Yersinia pestis
acaccauaaucgca

SEQ ID NO: 4143264 - RNA, 17 nt, Yersinia pestis
acaccauauugcuguuu

SEQ ID NO: 4143265 - RNA, 12 nt, Yersinia pestis
acaccaucagua

SEQ ID NO: 4143266 - RNA, 18 nt, Yersinia pestis
acaccauugauaauaaua

SEQ ID NO: 4143267 - RNA, 17 nt, Yersinia pestis
acaccauuuccaggcua

SEQ ID NO: 4143268 - RNA, 13 nt, Yersinia pestis
acaccauuuucaa

SEQ ID NO: 4143269 - RNA, 22 nt, Yersinia pestis
acacccaacuuuuuuaccacau

SEQ ID NO: 4143270 - RNA, 18 nt, Yersinia pestis
acacccaauaauaaaaaa

SEQ ID NO: 4143271 - RNA, 12 nt, Yersinia pestis
acacccagccag

SEQ ID NO: 4143272 - RNA, 19 nt, Yersinia pestis
acacccgaaggccauugcc

SEQ ID NO: 4143273 - RNA, 22 nt, Yersinia pestis
acacccgaccagacaacaguca

SEQ ID NO: 4143274 - RNA, 16 nt, Yersinia pestis
acacccgccaaaccau

SEQ ID NO: 4143275 - RNA, 18 nt, Yersinia pestis
acacccguuccuucagcc

SEQ ID NO: 4143276 - RNA, 19 nt, Yersinia pestis
acacccucaacucaaaaca

SEQ ID NO: 4143277 - RNA, 21 nt, Yersinia pestis
acacccucaacucaaaacaau

SEQ ID NO: 4143278 - RNA, 17 nt, Yersinia pestis
acacccuccuauuaaua

SEQ ID NO: 4143279 - RNA, 20 nt, Yersinia pestis
acacccucucuuuccagcaa

SEQ ID NO: 4143280 - RNA, 23 nt, Yersinia pestis
acacccucucuuuccagcaaaag

SEQ ID NO: 4143281 - RNA, 22 nt, Yersinia pestis
acacccuuucguguugcuggau

SEQ ID NO: 4143282 - RNA, 17 nt, Yersinia pestis
acaccgagauauuauug

SEQ ID NO: 4143283 - RNA, 22 nt, Yersinia pestis
acaccgccuaucgugaacaggc

SEQ ID NO: 4143284 - RNA, 16 nt, Yersinia pestis
acaccgcuaaccuuaa

SEQ ID NO: 4143285 - RNA, 20 nt, Yersinia pestis
acaccgcuacaggcgcaacu

SEQ ID NO: 4143286 - RNA, 17 nt, Yersinia pestis
acaccggggauccauag

SEQ ID NO: 4143287 - RNA, 20 nt, Yersinia pestis
acaccggggauccauaggau

SEQ ID NO: 4143288 - RNA, 22 nt, Yersinia pestis
acaccucaacgugauaugccug

SEQ ID NO: 4143289 - RNA, 24 nt, Yersinia pestis
acaccugcaacguuaaagaugaag

SEQ ID NO: 4143290 - RNA, 13 nt, Yersinia pestis
acaccuuaaaaca

SEQ ID NO: 4143291 - RNA, 17 nt, Yersinia pestis
acaccuucaaucauuga

SEQ ID NO: 4143292 - RNA, 21 nt, Yersinia pestis
acaccuucgagagcuaaugcu

SEQ ID NO: 4143293 - RNA, 19 nt, Yersinia pestis
acaccuuuauggcuggagg

SEQ ID NO: 4143294 - RNA, 14 nt, Yersinia pestis
acacgaaaagcagc

SEQ ID NO: 4143295 - RNA, 15 nt, Yersinia pestis
acacgaaaagcagca

SEQ ID NO: 4143296 - RNA, 16 nt, Yersinia pestis
acacgaaaagcagcag

SEQ ID NO: 4143297 - RNA, 21 nt, Yersinia pestis
acacgaugccaguagccguua

SEQ ID NO: 4143298 - RNA, 21 nt, Yersinia pestis
acacgccguuuugagauuaau

SEQ ID NO: 4143299 - RNA, 22 nt, Yersinia pestis
acacgccuucauguugcaacau

SEQ ID NO: 4143300 - RNA, 14 nt, Yersinia pestis
acacgguaggcuuc

SEQ ID NO: 4143301 - RNA, 17 nt, Yersinia pestis
acacgguaggcuucugc

SEQ ID NO: 4143302 - RNA, 14 nt, Yersinia pestis
acacggugaauaaa

SEQ ID NO: 4143303 - RNA, 18 nt, Yersinia pestis
acacguggguauccagug

SEQ ID NO: 4143304 - RNA, 19 nt, Yersinia pestis
acacguggguauccagugu

SEQ ID NO: 4143305 - RNA, 14 nt, Yersinia pestis
acacguugaccgac

SEQ ID NO: 4143306 - RNA, 17 nt, Yersinia pestis
acacuacagccggauag

SEQ ID NO: 4143307 - RNA, 17 nt, Yersinia pestis
acacucaccguucauga

SEQ ID NO: 4143308 - RNA, 19 nt, Yersinia pestis
acacucagaugaaaaacug

SEQ ID NO: 4143309 - RNA, 22 nt, Yersinia pestis
acacucagaugaaaaacugugc

SEQ ID NO: 4143310 - RNA, 13 nt, Yersinia pestis
acacuccauuaau

SEQ ID NO: 4143311 - RNA, 13 nt, Yersinia pestis
acacucuacuuuc

SEQ ID NO: 4143312 - RNA, 20 nt, Yersinia pestis
acacugagcaccgcaggaac

SEQ ID NO: 4143313 - RNA, 19 nt, Yersinia pestis
acacugucaucacugcuau

SEQ ID NO: 4143314 - RNA, 19 nt, Yersinia pestis
acacugucgacugcuuuuc

SEQ ID NO: 4143315 - RNA, 16 nt, Yersinia pestis
acacuguuuaguucac

SEQ ID NO: 4143316 - RNA, 21 nt, Yersinia pestis
acacuuaauugguuuauaaca

SEQ ID NO: 4143317 - RNA, 18 nt, Yersinia pestis
acacuuauuugaaauacu

SEQ ID NO: 4143318 - RNA, 15 nt, Yersinia pestis
acacuugcucuacca

SEQ ID NO: 4143319 - RNA, 14 nt, Yersinia pestis
acacuuuugcuggu

SEQ ID NO: 4143320 - RNA, 13 nt, Yersinia pestis
acagaaaaauaac

SEQ ID NO: 4143321 - RNA, 11 nt, Yersinia pestis
acagaaaucaa

SEQ ID NO: 4143322 - RNA, 19 nt, Yersinia pestis
acagaaaucaaugugccgu

SEQ ID NO: 4143323 - RNA, 22 nt, Yersinia pestis
acagaacaucugccaggcgaca

SEQ ID NO: 4143324 - RNA, 22 nt, Yersinia pestis
acagaacccccgcgaacagcag

SEQ ID NO: 4143325 - RNA, 13 nt, Yersinia pestis
acagaacgcaauc

SEQ ID NO: 4143326 - RNA, 19 nt, Yersinia pestis
acagaagcguaaagcaccc

SEQ ID NO: 4143327 - RNA, 15 nt, Yersinia pestis
acagaaucaccaaca

SEQ ID NO: 4143328 - RNA, 24 nt, Yersinia pestis
acagaaucaccaacaccaccauca

SEQ ID NO: 4143329 - RNA, 21 nt, Yersinia pestis
acagacaaacaaccuaaaaaa

SEQ ID NO: 4143330 - RNA, 14 nt, Yersinia pestis
acagacacagcaac

SEQ ID NO: 4143331 - RNA, 23 nt, Yersinia pestis
acagacguuuaaauaagcuauca

SEQ ID NO: 4143332 - RNA, 19 nt, Yersinia pestis
acagacuaaaaaccgccac

SEQ ID NO: 4143333 - RNA, 21 nt, Yersinia pestis
acagagcagaaagcagcagcu

SEQ ID NO: 4143334 - RNA, 21 nt, Yersinia pestis
acagagccagaauaucgugga

SEQ ID NO: 4143335 - RNA, 12 nt, Yersinia pestis
acagauaaagcu

SEQ ID NO: 4143336 - RNA, 15 nt, Yersinia pestis
acagauaaauaaaau

SEQ ID NO: 4143337 - RNA, 23 nt, Yersinia pestis
acagauauauccaggcacugcca

SEQ ID NO: 4143338 - RNA, 16 nt, Yersinia pestis
acagauauuacgcagc

SEQ ID NO: 4143339 - RNA, 22 nt, Yersinia pestis
acagauauuacgcagccauacc

SEQ ID NO: 4143340 - RNA, 21 nt, Yersinia pestis
acagaucacccgcaaaacuga

SEQ ID NO: 4143341 - RNA, 15 nt, Yersinia pestis
acagaucauuaggcc

SEQ ID NO: 4143342 - RNA, 22 nt, Yersinia pestis
acagaucauuaggccacuuaac

SEQ ID NO: 4143343 - RNA, 14 nt, Yersinia pestis
acagauugcaggaa

SEQ ID NO: 4143344 - RNA, 15 nt, Yersinia pestis
acagcaacaaacagc

SEQ ID NO: 4143345 - RNA, 14 nt, Yersinia pestis
acagcaacaacccc

SEQ ID NO: 4143346 - RNA, 13 nt, Yersinia pestis
acagcaacaccau

SEQ ID NO: 4143347 - RNA, 13 nt, Yersinia pestis
acagcaacgacgc

SEQ ID NO: 4143348 - RNA, 12 nt, Yersinia pestis
acagcaccaccg

SEQ ID NO: 4143349 - RNA, 17 nt, Yersinia pestis
acagcacggcaacaggc

SEQ ID NO: 4143350 - RNA, 14 nt, Yersinia pestis
acagcacucaguac

SEQ ID NO: 4143351 - RNA, 13 nt, Yersinia pestis
acagcagaacaaa

SEQ ID NO: 4143352 - RNA, 22 nt, Yersinia pestis
acagcagaacaaaacaagcccc

SEQ ID NO: 4143353 - RNA, 13 nt, Yersinia pestis
acagcaucaauau

SEQ ID NO: 4143354 - RNA, 15 nt, Yersinia pestis
acagcaucacugucu

SEQ ID NO: 4143355 - RNA, 16 nt, Yersinia pestis
acagcaucacugucua

SEQ ID NO: 4143356 - RNA, 17 nt, Yersinia pestis
acagcauucugcuucca

SEQ ID NO: 4143357 - RNA, 21 nt, Yersinia pestis
acagcauuuugcggaucacau

SEQ ID NO: 4143358 - RNA, 15 nt, Yersinia pestis
acagccaaaucagua

SEQ ID NO: 4143359 - RNA, 12 nt, Yersinia pestis
acagccaccagc

SEQ ID NO: 4143360 - RNA, 13 nt, Yersinia pestis
acagccaccagcc

SEQ ID NO: 4143361 - RNA, 16 nt, Yersinia pestis
acagccaccagccaac

SEQ ID NO: 4143362 - RNA, 18 nt, Yersinia pestis
acagccacguaauaccac

SEQ ID NO: 4143363 - RNA, 17 nt, Yersinia pestis
acagccagccuuaacug

SEQ ID NO: 4143364 - RNA, 22 nt, Yersinia pestis
acagccagugcuggcaacagcg

SEQ ID NO: 4143365 - RNA, 15 nt, Yersinia pestis
acagcccaagagaaa

SEQ ID NO: 4143366 - RNA, 15 nt, Yersinia pestis
acagcccagauggca

SEQ ID NO: 4143367 - RNA, 21 nt, Yersinia pestis
acagcccagauggcaaucugc

SEQ ID NO: 4143368 - RNA, 21 nt, Yersinia pestis
acagcccuuguaauuaaaaaa

SEQ ID NO: 4143369 - RNA, 13 nt, Yersinia pestis
acagccgagaaau

SEQ ID NO: 4143370 - RNA, 20 nt, Yersinia pestis
acagccgcugaauuaacaua

SEQ ID NO: 4143371 - RNA, 15 nt, Yersinia pestis
acagccguguagcau

SEQ ID NO: 4143372 - RNA, 23 nt, Yersinia pestis
acagccguguagcauggcuuuau

SEQ ID NO: 4143373 - RNA, 16 nt, Yersinia pestis
acagccuaaccgcugu

SEQ ID NO: 4143374 - RNA, 20 nt, Yersinia pestis
acagccuauggcgguuccaa

SEQ ID NO: 4143375 - RNA, 20 nt, Yersinia pestis
acagcgagauaaacugugcc

SEQ ID NO: 4143376 - RNA, 14 nt, Yersinia pestis
acagcgagcggcga

SEQ ID NO: 4143377 - RNA, 16 nt, Yersinia pestis
acagcguaauaccacu

SEQ ID NO: 4143378 - RNA, 22 nt, Yersinia pestis
acagcguuggucagcaaaucuu

SEQ ID NO: 4143379 - RNA, 17 nt, Yersinia pestis
acagcuaacacuggcuu

SEQ ID NO: 4143380 - RNA, 12 nt, Yersinia pestis
acagcucacucg

SEQ ID NO: 4143381 - RNA, 15 nt, Yersinia pestis
acagcucaucaccaa

SEQ ID NO: 4143382 - RNA, 19 nt, Yersinia pestis
acagcucggccagcauuca

SEQ ID NO: 4143383 - RNA, 14 nt, Yersinia pestis
acaggaucugcucc

SEQ ID NO: 4143384 - RNA, 16 nt, Yersinia pestis
acaggccauacugggu

SEQ ID NO: 4143385 - RNA, 18 nt, Yersinia pestis
acaggccccaauccacca

SEQ ID NO: 4143386 - RNA, 19 nt, Yersinia pestis
acaggccgugggcaauaac

SEQ ID NO: 4143387 - RNA, 16 nt, Yersinia pestis
acaggcgcaucgcgau

SEQ ID NO: 4143388 - RNA, 13 nt, Yersinia pestis
acaggcgcuucac

SEQ ID NO: 4143389 - RNA, 20 nt, Yersinia pestis
acaggcucagcacaaacaug

SEQ ID NO: 4143390 - RNA, 16 nt, Yersinia pestis
acaggcucauuuugua

SEQ ID NO: 4143391 - RNA, 23 nt, Yersinia pestis
acagggaggccagcaaugaccuc

SEQ ID NO: 4143392 - RNA, 13 nt, Yersinia pestis
acagggcagaaaa

SEQ ID NO: 4143393 - RNA, 14 nt, Yersinia pestis
acagggcagaaaau

SEQ ID NO: 4143394 - RNA, 19 nt, Yersinia pestis
acaggggcguuauugagaa

SEQ ID NO: 4143395 - RNA, 15 nt, Yersinia pestis
acagguaaaaccgga

SEQ ID NO: 4143396 - RNA, 18 nt, Yersinia pestis
acagguauucuccaguug

SEQ ID NO: 4143397 - RNA, 16 nt, Yersinia pestis
acaggugcccuguggc

SEQ ID NO: 4143398 - RNA, 22 nt, Yersinia pestis
acaggugcccuguggcggauuu

SEQ ID NO: 4143399 - RNA, 16 nt, Yersinia pestis
acaggugucaucaagg

SEQ ID NO: 4143400 - RNA, 13 nt, Yersinia pestis
acaguaaagguug

SEQ ID NO: 4143401 - RNA, 17 nt, Yersinia pestis
acaguaaauuauuuucc

SEQ ID NO: 4143402 - RNA, 13 nt, Yersinia pestis
acaguaauauuuu

SEQ ID NO: 4143403 - RNA, 17 nt, Yersinia pestis
acaguacaaaaaacaaa

SEQ ID NO: 4143404 - RNA, 21 nt, Yersinia pestis
acaguaggcugaaggccugcu

SEQ ID NO: 4143405 - RNA, 16 nt, Yersinia pestis
acagucacaccaacac

SEQ ID NO: 4143406 - RNA, 18 nt, Yersinia pestis
acagucacgcuaccagaa

SEQ ID NO: 4143407 - RNA, 12 nt, Yersinia pestis
acagucauuuac

SEQ ID NO: 4143408 - RNA, 12 nt, Yersinia pestis
acagucgcugcu

SEQ ID NO: 4143409 - RNA, 18 nt, Yersinia pestis
acagucugucguacuuuc

SEQ ID NO: 4143410 - RNA, 22 nt, Yersinia pestis
acagucugucguacuuuccuuc

SEQ ID NO: 4143411 - RNA, 18 nt, Yersinia pestis
acagugauaaucacguuc

SEQ ID NO: 4143412 - RNA, 18 nt, Yersinia pestis
acagugcaacauuaaaaa

SEQ ID NO: 4143413 - RNA, 16 nt, Yersinia pestis
acagugcauucaucau

SEQ ID NO: 4143414 - RNA, 16 nt, Yersinia pestis
acagugccaacagcga

SEQ ID NO: 4143415 - RNA, 12 nt, Yersinia pestis
acaguguugacc

SEQ ID NO: 4143416 - RNA, 13 nt, Yersinia pestis
acaguuaaaaaua

SEQ ID NO: 4143417 - RNA, 15 nt, Yersinia pestis
acaguuaauuuucac

SEQ ID NO: 4143418 - RNA, 22 nt, Yersinia pestis
acaguugugucagaccaaauag

SEQ ID NO: 4143419 - RNA, 21 nt, Yersinia pestis
acauaaaaagaaaaaaacaga

SEQ ID NO: 4143420 - RNA, 24 nt, Yersinia pestis
acauaaaaagaaaaaaacagacua

SEQ ID NO: 4143421 - RNA, 15 nt, Yersinia pestis
acauaaaaauagcuu

SEQ ID NO: 4143422 - RNA, 13 nt, Yersinia pestis
acauaaacacgca

SEQ ID NO: 4143423 - RNA, 20 nt, Yersinia pestis
acauaaagcaaacgccgcuc

SEQ ID NO: 4143424 - RNA, 19 nt, Yersinia pestis
acauaaauaaguucagguu

SEQ ID NO: 4143425 - RNA, 21 nt, Yersinia pestis
acauaaauuuaucucuaucaa

SEQ ID NO: 4143426 - RNA, 22 nt, Yersinia pestis
acauaaauuuaucucuaucaau

SEQ ID NO: 4143427 - RNA, 13 nt, Yersinia pestis
acauaaccaucaa

SEQ ID NO: 4143428 - RNA, 16 nt, Yersinia pestis
acauaaccaucaaaca

SEQ ID NO: 4143429 - RNA, 13 nt, Yersinia pestis
acauaagaugacc

SEQ ID NO: 4143430 - RNA, 13 nt, Yersinia pestis
acauaaggcuaga

SEQ ID NO: 4143431 - RNA, 16 nt, Yersinia pestis
acauaauaaauuaaua

SEQ ID NO: 4143432 - RNA, 18 nt, Yersinia pestis
acauaauaaccauuuaua

SEQ ID NO: 4143433 - RNA, 21 nt, Yersinia pestis
acauaaucuuuacugcauuga

SEQ ID NO: 4143434 - RNA, 16 nt, Yersinia pestis
acauacgucuccauuu

SEQ ID NO: 4143435 - RNA, 17 nt, Yersinia pestis
acauagcacccaaugua

SEQ ID NO: 4143436 - RNA, 19 nt, Yersinia pestis
acauagcacccaauguaua

SEQ ID NO: 4143437 - RNA, 22 nt, Yersinia pestis
acauagcccggcucauccgcca

SEQ ID NO: 4143438 - RNA, 14 nt, Yersinia pestis
acauagguuuuuuc

SEQ ID NO: 4143439 - RNA, 21 nt, Yersinia pestis
acauauaaaccagccagugau

SEQ ID NO: 4143440 - RNA, 21 nt, Yersinia pestis
acauauauaauacuauuugua

SEQ ID NO: 4143441 - RNA, 19 nt, Yersinia pestis
acauaucaacacugccuga

SEQ ID NO: 4143442 - RNA, 18 nt, Yersinia pestis
acauaucacaguuaaaaa

SEQ ID NO: 4143443 - RNA, 14 nt, Yersinia pestis
acauaucgagacua

SEQ ID NO: 4143444 - RNA, 19 nt, Yersinia pestis
acauaucuuuauuaucaau

SEQ ID NO: 4143445 - RNA, 22 nt, Yersinia pestis
acauauuggucauuuuucccuu

SEQ ID NO: 4143446 - RNA, 14 nt, Yersinia pestis
acaucaaaccggcu

SEQ ID NO: 4143447 - RNA, 16 nt, Yersinia pestis
acaucaaaccggcuaa

SEQ ID NO: 4143448 - RNA, 19 nt, Yersinia pestis
acaucaaccugaucaucaa

SEQ ID NO: 4143449 - RNA, 17 nt, Yersinia pestis
acaucaauguuggccca

SEQ ID NO: 4143450 - RNA, 22 nt, Yersinia pestis
acaucaccuugcgcccuugugg

SEQ ID NO: 4143451 - RNA, 23 nt, Yersinia pestis
acaucaccuugcgcccuugugga

SEQ ID NO: 4143452 - RNA, 23 nt, Yersinia pestis
acaucacgcagcgcuugcuggua

SEQ ID NO: 4143453 - RNA, 15 nt, Yersinia pestis
acaucacgcuuaaga

SEQ ID NO: 4143454 - RNA, 14 nt, Yersinia pestis
acaucagcgccaca

SEQ ID NO: 4143455 - RNA, 18 nt, Yersinia pestis
acaucaggccuucuuuuc

SEQ ID NO: 4143456 - RNA, 12 nt, Yersinia pestis
acaucaucaccu

SEQ ID NO: 4143457 - RNA, 13 nt, Yersinia pestis
acaucaugaguaa

SEQ ID NO: 4143458 - RNA, 20 nt, Yersinia pestis
acaucaugaguaaaagauuc

SEQ ID NO: 4143459 - RNA, 14 nt, Yersinia pestis
acauccaauucagu

SEQ ID NO: 4143460 - RNA, 20 nt, Yersinia pestis
acauccaauuuuuucaucau

SEQ ID NO: 4143461 - RNA, 21 nt, Yersinia pestis
acauccagcgguguuaccaga

SEQ ID NO: 4143462 - RNA, 15 nt, Yersinia pestis
acauccauguaggcu

SEQ ID NO: 4143463 - RNA, 17 nt, Yersinia pestis
acauccauguaggcucg

SEQ ID NO: 4143464 - RNA, 16 nt, Yersinia pestis
acauccgaauuuuuac

SEQ ID NO: 4143465 - RNA, 21 nt, Yersinia pestis
acaucgaagcugucuuuuaaa

SEQ ID NO: 4143466 - RNA, 20 nt, Yersinia pestis
acaucgaccauagagcaacc

SEQ ID NO: 4143467 - RNA, 17 nt, Yersinia pestis
acaucgagcgggcuuca

SEQ ID NO: 4143468 - RNA, 13 nt, Yersinia pestis
acaucgcaccgau

SEQ ID NO: 4143469 - RNA, 12 nt, Yersinia pestis
acaucgccagcg

SEQ ID NO: 4143470 - RNA, 13 nt, Yersinia pestis
acaucgcccggua

SEQ ID NO: 4143471 - RNA, 16 nt, Yersinia pestis
acaucgguuagcguuu

SEQ ID NO: 4143472 - RNA, 15 nt, Yersinia pestis
acaucguuguauguu

SEQ ID NO: 4143473 - RNA, 16 nt, Yersinia pestis
acaucucggcuuucag

SEQ ID NO: 4143474 - RNA, 22 nt, Yersinia pestis
acaucucuugggcgcagucauc

SEQ ID NO: 4143475 - RNA, 13 nt, Yersinia pestis
acaucugccaggc

SEQ ID NO: 4143476 - RNA, 14 nt, Yersinia pestis
acaucugcuuuacu

SEQ ID NO: 4143477 - RNA, 15 nt, Yersinia pestis
acaucuggccaguaa

SEQ ID NO: 4143478 - RNA, 18 nt, Yersinia pestis
acaucuggcgauuuugcg

SEQ ID NO: 4143479 - RNA, 14 nt, Yersinia pestis
acaugagccacaca

SEQ ID NO: 4143480 - RNA, 20 nt, Yersinia pestis
acaugauuaaaucaagcugc

SEQ ID NO: 4143481 - RNA, 17 nt, Yersinia pestis
acaugcaccguaacuuc

SEQ ID NO: 4143482 - RNA, 11 nt, Yersinia pestis
acaugcagcau

SEQ ID NO: 4143483 - RNA, 18 nt, Yersinia pestis
acaugccacauagcguca

SEQ ID NO: 4143484 - RNA, 14 nt, Yersinia pestis
acaugccagaaacg

SEQ ID NO: 4143485 - RNA, 15 nt, Yersinia pestis
acaugcggauugaac

SEQ ID NO: 4143486 - RNA, 13 nt, Yersinia pestis
acaugcuguucac

SEQ ID NO: 4143487 - RNA, 17 nt, Yersinia pestis
acauggcaacgacuggg

SEQ ID NO: 4143488 - RNA, 18 nt, Yersinia pestis
acaugggcaagcucuggg

SEQ ID NO: 4143489 - RNA, 13 nt, Yersinia pestis
acaugggcagugc

SEQ ID NO: 4143490 - RNA, 14 nt, Yersinia pestis
acaugguucacccg

SEQ ID NO: 4143491 - RNA, 22 nt, Yersinia pestis
acaugguucacccgcacgccca

SEQ ID NO: 4143492 - RNA, 13 nt, Yersinia pestis
acauguacauuau

SEQ ID NO: 4143493 - RNA, 22 nt, Yersinia pestis
acaugugcguuggcuaugcgca

SEQ ID NO: 4143494 - RNA, 15 nt, Yersinia pestis
acauguuccagugcu

SEQ ID NO: 4143495 - RNA, 22 nt, Yersinia pestis
acauguugaaaucuauuguaua

SEQ ID NO: 4143496 - RNA, 14 nt, Yersinia pestis
acauuaaaugaaua

SEQ ID NO: 4143497 - RNA, 22 nt, Yersinia pestis
acauuaagcauauccaacgcuu

SEQ ID NO: 4143498 - RNA, 24 nt, Yersinia pestis
acauuaaucguuauaauauuaaaa

SEQ ID NO: 4143499 - RNA, 23 nt, Yersinia pestis
acauuacaagugccaaauggaau

SEQ ID NO: 4143500 - RNA, 17 nt, Yersinia pestis
acauuacggcccugaau

SEQ ID NO: 4143501 - RNA, 14 nt, Yersinia pestis
acauuagccgguua

SEQ ID NO: 4143502 - RNA, 13 nt, Yersinia pestis
acauuauuauuua

SEQ ID NO: 4143503 - RNA, 14 nt, Yersinia pestis
acauuauuauuuac

SEQ ID NO: 4143504 - RNA, 21 nt, Yersinia pestis
acauuauuauuuacaaaccau

SEQ ID NO: 4143505 - RNA, 18 nt, Yersinia pestis
acauuauucaugaugccg

SEQ ID NO: 4143506 - RNA, 18 nt, Yersinia pestis
acauuccacaaauuuuua

SEQ ID NO: 4143507 - RNA, 19 nt, Yersinia pestis
acauuccacaaauuuuuac

SEQ ID NO: 4143508 - RNA, 16 nt, Yersinia pestis
acauuccaguaaaaaa

SEQ ID NO: 4143509 - RNA, 20 nt, Yersinia pestis
acauucgagcuaccggcauu

SEQ ID NO: 4143510 - RNA, 20 nt, Yersinia pestis
acauucuuugguccucuuau

SEQ ID NO: 4143511 - RNA, 15 nt, Yersinia pestis
acauugaagugauau

SEQ ID NO: 4143512 - RNA, 20 nt, Yersinia pestis
acauugccaaauuauucauc

SEQ ID NO: 4143513 - RNA, 16 nt, Yersinia pestis
acauuguuauauuaac

SEQ ID NO: 4143514 - RNA, 17 nt, Yersinia pestis
acauuuaaacacucaau

SEQ ID NO: 4143515 - RNA, 14 nt, Yersinia pestis
acauuucuuuuuau

SEQ ID NO: 4143516 - RNA, 18 nt, Yersinia pestis
acauuucuuuuuauguua

SEQ ID NO: 4143517 - RNA, 17 nt, Yersinia pestis
acauuugcaucuaugga

SEQ ID NO: 4143518 - RNA, 20 nt, Yersinia pestis
acauuuguauuuuuucuuug

SEQ ID NO: 4143519 - RNA, 15 nt, Yersinia pestis
acauuuguugcaaua

SEQ ID NO: 4143520 - RNA, 14 nt, Yersinia pestis
acauuuuaaagaau

SEQ ID NO: 4143521 - RNA, 14 nt, Yersinia pestis
acauuuucuaucuc

SEQ ID NO: 4143522 - RNA, 11 nt, Yersinia pestis
acauuuugguu

SEQ ID NO: 4143523 - RNA, 11 nt, Yersinia pestis
acauuuugugc

SEQ ID NO: 4143524 - RNA, 13 nt, Yersinia pestis
acauuuuucuauu

SEQ ID NO: 4143525 - RNA, 17 nt, Yersinia pestis
acauuuuuuaaaaccaa

SEQ ID NO: 4143526 - RNA, 22 nt, Yersinia pestis
accaaaaaucuuguuaauuuaa

SEQ ID NO: 4143527 - RNA, 20 nt, Yersinia pestis
accaaaaccggcauuaagca

SEQ ID NO: 4143528 - RNA, 11 nt, Yersinia pestis
accaaaaccuu

SEQ ID NO: 4143529 - RNA, 20 nt, Yersinia pestis
accaaaacgccaccagcgcc

SEQ ID NO: 4143530 - RNA, 12 nt, Yersinia pestis
accaaaauagcg

SEQ ID NO: 4143531 - RNA, 23 nt, Yersinia pestis
accaaaauagcggccaacauaau

SEQ ID NO: 4143532 - RNA, 12 nt, Yersinia pestis
accaaaauuuaa

SEQ ID NO: 4143533 - RNA, 11 nt, Yersinia pestis
accaaacagaa

SEQ ID NO: 4143534 - RNA, 13 nt, Yersinia pestis
accaaacauuguc

SEQ ID NO: 4143535 - RNA, 17 nt, Yersinia pestis
accaaacauugucaccu

SEQ ID NO: 4143536 - RNA, 14 nt, Yersinia pestis
accaaagauauguu

SEQ ID NO: 4143537 - RNA, 18 nt, Yersinia pestis
accaaaggccaaccucuu

SEQ ID NO: 4143538 - RNA, 13 nt, Yersinia pestis
accaaauaaaaca

SEQ ID NO: 4143539 - RNA, 23 nt, Yersinia pestis
accaaauagcaagccaaaacagc

SEQ ID NO: 4143540 - RNA, 12 nt, Yersinia pestis
accaaauauuac

SEQ ID NO: 4143541 - RNA, 15 nt, Yersinia pestis
accaaaucagcaagc

SEQ ID NO: 4143542 - RNA, 21 nt, Yersinia pestis
accaaaucugacgguuauuuu

SEQ ID NO: 4143543 - RNA, 11 nt, Yersinia pestis
accaaauucag

SEQ ID NO: 4143544 - RNA, 12 nt, Yersinia pestis
accaacaaacaa

SEQ ID NO: 4143545 - RNA, 17 nt, Yersinia pestis
accaacaaacaauccua

SEQ ID NO: 4143546 - RNA, 21 nt, Yersinia pestis
accaacaacuccacuuccuca

SEQ ID NO: 4143547 - RNA, 20 nt, Yersinia pestis
accaacaauauucgcagcca

SEQ ID NO: 4143548 - RNA, 14 nt, Yersinia pestis
accaacaccaaugg

SEQ ID NO: 4143549 - RNA, 14 nt, Yersinia pestis
accaacaccaccau

SEQ ID NO: 4143550 - RNA, 20 nt, Yersinia pestis
accaacacuccucuuucuua

SEQ ID NO: 4143551 - RNA, 13 nt, Yersinia pestis
accaacagacgcc

SEQ ID NO: 4143552 - RNA, 17 nt, Yersinia pestis
accaacaguuugguaau

SEQ ID NO: 4143553 - RNA, 20 nt, Yersinia pestis
accaacaugagccacacauu

SEQ ID NO: 4143554 - RNA, 15 nt, Yersinia pestis
accaaccaucaccau

SEQ ID NO: 4143555 - RNA, 11 nt, Yersinia pestis
accaaccccac

SEQ ID NO: 4143556 - RNA, 17 nt, Yersinia pestis
accaaccgguugacguu

SEQ ID NO: 4143557 - RNA, 14 nt, Yersinia pestis
accaacgaaaucac

SEQ ID NO: 4143558 - RNA, 19 nt, Yersinia pestis
accaacgaaaucacccggc

SEQ ID NO: 4143559 - RNA, 23 nt, Yersinia pestis
accaacgaaaucacccggccauc

SEQ ID NO: 4143560 - RNA, 17 nt, Yersinia pestis
accaacggcaaugacca

SEQ ID NO: 4143561 - RNA, 19 nt, Yersinia pestis
accaacggcccaauauuga

SEQ ID NO: 4143562 - RNA, 19 nt, Yersinia pestis
accaagaacccuuuaucuu

SEQ ID NO: 4143563 - RNA, 12 nt, Yersinia pestis
accaagaacgcc

SEQ ID NO: 4143564 - RNA, 21 nt, Yersinia pestis
accaagagcugcuaaucccuu

SEQ ID NO: 4143565 - RNA, 14 nt, Yersinia pestis
accaagccaaauua

SEQ ID NO: 4143566 - RNA, 21 nt, Yersinia pestis
accaagccaaauuaaguaagc

SEQ ID NO: 4143567 - RNA, 19 nt, Yersinia pestis
accaagcccaguaaagcaa

SEQ ID NO: 4143568 - RNA, 20 nt, Yersinia pestis
accaagcccaguaaagcaaa

SEQ ID NO: 4143569 - RNA, 21 nt, Yersinia pestis
accaagcccaguaaagcaaau

SEQ ID NO: 4143570 - RNA, 20 nt, Yersinia pestis
accaagcccuuuggcaauca

SEQ ID NO: 4143571 - RNA, 13 nt, Yersinia pestis
accaagcuuuuau

SEQ ID NO: 4143572 - RNA, 15 nt, Yersinia pestis
accaaggaaaccacc

SEQ ID NO: 4143573 - RNA, 18 nt, Yersinia pestis
accaaggaaaccaccuaa

SEQ ID NO: 4143574 - RNA, 16 nt, Yersinia pestis
accaaggcucuggcaa

SEQ ID NO: 4143575 - RNA, 17 nt, Yersinia pestis
accaaguucggagauuu

SEQ ID NO: 4143576 - RNA, 24 nt, Yersinia pestis
accaauaaucgggaaauugugauu

SEQ ID NO: 4143577 - RNA, 22 nt, Yersinia pestis
accaauagaccguagaaacuaa

SEQ ID NO: 4143578 - RNA, 15 nt, Yersinia pestis
accaauagauuucac

SEQ ID NO: 4143579 - RNA, 23 nt, Yersinia pestis
accaauauugcggauucacccau

SEQ ID NO: 4143580 - RNA, 23 nt, Yersinia pestis
accaaucaucacgauaauaucga

SEQ ID NO: 4143581 - RNA, 18 nt, Yersinia pestis
accaaugacuaauugugc

SEQ ID NO: 4143582 - RNA, 17 nt, Yersinia pestis
accaaugccgguccaga

SEQ ID NO: 4143583 - RNA, 19 nt, Yersinia pestis
accaauggacggaacacgu

SEQ ID NO: 4143584 - RNA, 10 nt, Yersinia pestis
accaauggug

SEQ ID NO: 4143585 - RNA, 10 nt, Yersinia pestis
accaaugguu

SEQ ID NO: 4143586 - RNA, 14 nt, Yersinia pestis
accaauucaucagc

SEQ ID NO: 4143587 - RNA, 12 nt, Yersinia pestis
accaauucuuag

SEQ ID NO: 4143588 - RNA, 21 nt, Yersinia pestis
accaauugaugucaugauaaa

SEQ ID NO: 4143589 - RNA, 19 nt, Yersinia pestis
accaauugcaggcuuucac

SEQ ID NO: 4143590 - RNA, 19 nt, Yersinia pestis
accaauuuucccaagccua

SEQ ID NO: 4143591 - RNA, 18 nt, Yersinia pestis
accacaaaaacaguguca

SEQ ID NO: 4143592 - RNA, 19 nt, Yersinia pestis
accacaaaggucagcaugg

SEQ ID NO: 4143593 - RNA, 22 nt, Yersinia pestis
accacaacauuagggccaccag

SEQ ID NO: 4143594 - RNA, 13 nt, Yersinia pestis
accacaacgacag

SEQ ID NO: 4143595 - RNA, 14 nt, Yersinia pestis
accacaaugauuuc

SEQ ID NO: 4143596 - RNA, 19 nt, Yersinia pestis
accacacugagcaccgcag

SEQ ID NO: 4143597 - RNA, 20 nt, Yersinia pestis
accacacugagcaccgcagg

SEQ ID NO: 4143598 - RNA, 22 nt, Yersinia pestis
accacacugagcaccgcaggaa

SEQ ID NO: 4143599 - RNA, 13 nt, Yersinia pestis
accacaucaaacc

SEQ ID NO: 4143600 - RNA, 15 nt, Yersinia pestis
accacaucacgcagc

SEQ ID NO: 4143601 - RNA, 22 nt, Yersinia pestis
accacaugagauucaggagaua

SEQ ID NO: 4143602 - RNA, 15 nt, Yersinia pestis
accaccaacagcauu

SEQ ID NO: 4143603 - RNA, 14 nt, Yersinia pestis
accaccaacccgcc

SEQ ID NO: 4143604 - RNA, 11 nt, Yersinia pestis
accaccaacuc

SEQ ID NO: 4143605 - RNA, 17 nt, Yersinia pestis
accaccaacuccugccu

SEQ ID NO: 4143606 - RNA, 12 nt, Yersinia pestis
accaccaaugcg

SEQ ID NO: 4143607 - RNA, 17 nt, Yersinia pestis
accaccaauuucaucgc

SEQ ID NO: 4143608 - RNA, 13 nt, Yersinia pestis
accaccaccaaca

SEQ ID NO: 4143609 - RNA, 14 nt, Yersinia pestis
accaccacggccag

SEQ ID NO: 4143610 - RNA, 20 nt, Yersinia pestis
accaccauauugguuagcgc

SEQ ID NO: 4143611 - RNA, 17 nt, Yersinia pestis
accacccgacaucaaga

SEQ ID NO: 4143612 - RNA, 21 nt, Yersinia pestis
accacccguugcauuuuucug

SEQ ID NO: 4143613 - RNA, 20 nt, Yersinia pestis
accaccgacaccacgaucag

SEQ ID NO: 4143614 - RNA, 19 nt, Yersinia pestis
accaccgccgcaacaauaa

SEQ ID NO: 4143615 - RNA, 16 nt, Yersinia pestis
accaccgucaagacaa

SEQ ID NO: 4143616 - RNA, 20 nt, Yersinia pestis
accaccgucaagacaacaaa

SEQ ID NO: 4143617 - RNA, 19 nt, Yersinia pestis
accaccuaauacagcacca

SEQ ID NO: 4143618 - RNA, 22 nt, Yersinia pestis
accaccuaauacagcaccaccg

SEQ ID NO: 4143619 - RNA, 19 nt, Yersinia pestis
accaccuacaaccuaccac

SEQ ID NO: 4143620 - RNA, 23 nt, Yersinia pestis
accaccuacaaccuaccaccuac

SEQ ID NO: 4143621 - RNA, 16 nt, Yersinia pestis
accaccuaccaccuac

SEQ ID NO: 4143622 - RNA, 21 nt, Yersinia pestis
accaccuaccaccuaccaccu

SEQ ID NO: 4143623 - RNA, 14 nt, Yersinia pestis
accaccuccacagg

SEQ ID NO: 4143624 - RNA, 17 nt, Yersinia pestis
accacgaagagcgccuc

SEQ ID NO: 4143625 - RNA, 16 nt, Yersinia pestis
accacgauuagccaua

SEQ ID NO: 4143626 - RNA, 21 nt, Yersinia pestis
accacgcacgauauucagugc

SEQ ID NO: 4143627 - RNA, 16 nt, Yersinia pestis
accacgguaucaauca

SEQ ID NO: 4143628 - RNA, 18 nt, Yersinia pestis
accacgguaucaaucagc

SEQ ID NO: 4143629 - RNA, 12 nt, Yersinia pestis
accacuaaacca

SEQ ID NO: 4143630 - RNA, 17 nt, Yersinia pestis
accacuaaaccacauaa

SEQ ID NO: 4143631 - RNA, 22 nt, Yersinia pestis
accacuagcagagcacgcagag

SEQ ID NO: 4143632 - RNA, 17 nt, Yersinia pestis
accacuaguuaaaacca

SEQ ID NO: 4143633 - RNA, 14 nt, Yersinia pestis
accacugaccuauu

SEQ ID NO: 4143634 - RNA, 16 nt, Yersinia pestis
accacugauaggucau

SEQ ID NO: 4143635 - RNA, 18 nt, Yersinia pestis
accacugcggucaaagaa

SEQ ID NO: 4143636 - RNA, 21 nt, Yersinia pestis
accacugcuucugucaguguu

SEQ ID NO: 4143637 - RNA, 16 nt, Yersinia pestis
accacuuaguggcauu

SEQ ID NO: 4143638 - RNA, 19 nt, Yersinia pestis
accacuugcuaccaagacu

SEQ ID NO: 4143639 - RNA, 16 nt, Yersinia pestis
accagaaaguuguuca

SEQ ID NO: 4143640 - RNA, 14 nt, Yersinia pestis
accagaaaguuuaa

SEQ ID NO: 4143641 - RNA, 12 nt, Yersinia pestis
accagacaacag

SEQ ID NO: 4143642 - RNA, 17 nt, Yersinia pestis
accagacaaccaauaca

SEQ ID NO: 4143643 - RNA, 17 nt, Yersinia pestis
accagagacagcaacaa

SEQ ID NO: 4143644 - RNA, 13 nt, Yersinia pestis
accagaucauuuu

SEQ ID NO: 4143645 - RNA, 16 nt, Yersinia pestis
accagcaaaggccacc

SEQ ID NO: 4143646 - RNA, 17 nt, Yersinia pestis
accagcaaaggccacca

SEQ ID NO: 4143647 - RNA, 11 nt, Yersinia pestis
accagcaagcc

SEQ ID NO: 4143648 - RNA, 21 nt, Yersinia pestis
accagcaguugcugcucuguc

SEQ ID NO: 4143649 - RNA, 23 nt, Yersinia pestis
accagcaguugcugcucugucaa

SEQ ID NO: 4143650 - RNA, 16 nt, Yersinia pestis
accagcauacgugcca

SEQ ID NO: 4143651 - RNA, 17 nt, Yersinia pestis
accagcauccugcaaau

SEQ ID NO: 4143652 - RNA, 15 nt, Yersinia pestis
accagccaaccauca

SEQ ID NO: 4143653 - RNA, 14 nt, Yersinia pestis
accagcuuggguga

SEQ ID NO: 4143654 - RNA, 21 nt, Yersinia pestis
accagcuugggugaagacacu

SEQ ID NO: 4143655 - RNA, 23 nt, Yersinia pestis
accagcuugggugaagacacuuu

SEQ ID NO: 4143656 - RNA, 17 nt, Yersinia pestis
accaggaagcggccagg

SEQ ID NO: 4143657 - RNA, 21 nt, Yersinia pestis
accaggccacggccgccuuca

SEQ ID NO: 4143658 - RNA, 12 nt, Yersinia pestis
accaggccgcca

SEQ ID NO: 4143659 - RNA, 15 nt, Yersinia pestis
accaggugcagauaa

SEQ ID NO: 4143660 - RNA, 18 nt, Yersinia pestis
accaguaaacgccaauca

SEQ ID NO: 4143661 - RNA, 15 nt, Yersinia pestis
accaguaacugauca

SEQ ID NO: 4143662 - RNA, 15 nt, Yersinia pestis
accagucagccuuaa

SEQ ID NO: 4143663 - RNA, 20 nt, Yersinia pestis
accagucugcauacagaucg

SEQ ID NO: 4143664 - RNA, 23 nt, Yersinia pestis
accagugaauaaguucugcgacu

SEQ ID NO: 4143665 - RNA, 19 nt, Yersinia pestis
accagugccaauccccacc

SEQ ID NO: 4143666 - RNA, 12 nt, Yersinia pestis
accagugccaug

SEQ ID NO: 4143667 - RNA, 17 nt, Yersinia pestis
accagugccgcccagcg

SEQ ID NO: 4143668 - RNA, 14 nt, Yersinia pestis
accagugucuggca

SEQ ID NO: 4143669 - RNA, 23 nt, Yersinia pestis
accagugucuggcaauccagcgc

SEQ ID NO: 4143670 - RNA, 14 nt, Yersinia pestis
accaguguugggcu

SEQ ID NO: 4143671 - RNA, 13 nt, Yersinia pestis
accaguucuggua

SEQ ID NO: 4143672 - RNA, 21 nt, Yersinia pestis
accaguucugguagcugcuca

SEQ ID NO: 4143673 - RNA, 18 nt, Yersinia pestis
accaguuuauuuucccuu

SEQ ID NO: 4143674 - RNA, 14 nt, Yersinia pestis
accauaaaaggaug

SEQ ID NO: 4143675 - RNA, 18 nt, Yersinia pestis
accauaaacaaguugaac

SEQ ID NO: 4143676 - RNA, 14 nt, Yersinia pestis
accauaaauucaca

SEQ ID NO: 4143677 - RNA, 14 nt, Yersinia pestis
accauaacaauggc

SEQ ID NO: 4143678 - RNA, 15 nt, Yersinia pestis
accauaacaauggcc

SEQ ID NO: 4143679 - RNA, 13 nt, Yersinia pestis
accauagagcaac

SEQ ID NO: 4143680 - RNA, 21 nt, Yersinia pestis
accauagagcaaccguuacaa

SEQ ID NO: 4143681 - RNA, 22 nt, Yersinia pestis
accauaucagaaccaagcaaua

SEQ ID NO: 4143682 - RNA, 22 nt, Yersinia pestis
accaucaaauacacauaaccau

SEQ ID NO: 4143683 - RNA, 14 nt, Yersinia pestis
accaucaacucagg

SEQ ID NO: 4143684 - RNA, 17 nt, Yersinia pestis
accaucaaggacuucau

SEQ ID NO: 4143685 - RNA, 12 nt, Yersinia pestis
accaucaauaua

SEQ ID NO: 4143686 - RNA, 19 nt, Yersinia pestis
accaucaauauaagagaaa

SEQ ID NO: 4143687 - RNA, 12 nt, Yersinia pestis
accaucaccauc

SEQ ID NO: 4143688 - RNA, 22 nt, Yersinia pestis
accaucacggucaugcggccuu

SEQ ID NO: 4143689 - RNA, 18 nt, Yersinia pestis
accaucacucugcuacug

SEQ ID NO: 4143690 - RNA, 15 nt, Yersinia pestis
accaucaggauuaau

SEQ ID NO: 4143691 - RNA, 19 nt, Yersinia pestis
accaucagguguuguauaa

SEQ ID NO: 4143692 - RNA, 12 nt, Yersinia pestis
accauccagugc

SEQ ID NO: 4143693 - RNA, 20 nt, Yersinia pestis
accauccgacugcagaaaau

SEQ ID NO: 4143694 - RNA, 23 nt, Yersinia pestis
accaucgcgccuaccugccugcu

SEQ ID NO: 4143695 - RNA, 16 nt, Yersinia pestis
accaucugaugcaggu

SEQ ID NO: 4143696 - RNA, 15 nt, Yersinia pestis
accaucugcuuaguu

SEQ ID NO: 4143697 - RNA, 14 nt, Yersinia pestis
accaucuuccagca

SEQ ID NO: 4143698 - RNA, 19 nt, Yersinia pestis
accaucuugucauuaccaa

SEQ ID NO: 4143699 - RNA, 14 nt, Yersinia pestis
accaugagaaugcg

SEQ ID NO: 4143700 - RNA, 13 nt, Yersinia pestis
accaugaugacaa

SEQ ID NO: 4143701 - RNA, 15 nt, Yersinia pestis
accaugaugacaaug

SEQ ID NO: 4143702 - RNA, 18 nt, Yersinia pestis
accaugaugacaaugcgu

SEQ ID NO: 4143703 - RNA, 17 nt, Yersinia pestis
accaugccaucagaaua

SEQ ID NO: 4143704 - RNA, 13 nt, Yersinia pestis
accaugccuucug

SEQ ID NO: 4143705 - RNA, 16 nt, Yersinia pestis
accaugccuucugaaa

SEQ ID NO: 4143706 - RNA, 22 nt, Yersinia pestis
accaugcgauacgcccgcccca

SEQ ID NO: 4143707 - RNA, 21 nt, Yersinia pestis
accaugcugcuugauuugcug

SEQ ID NO: 4143708 - RNA, 15 nt, Yersinia pestis
accauguugaaucaa

SEQ ID NO: 4143709 - RNA, 13 nt, Yersinia pestis
accauuaacaaua

SEQ ID NO: 4143710 - RNA, 18 nt, Yersinia pestis
accauuaacaauauuaua

SEQ ID NO: 4143711 - RNA, 23 nt, Yersinia pestis
accauuaagccggauuuaguugg

SEQ ID NO: 4143712 - RNA, 18 nt, Yersinia pestis
accauuacuucuacucug

SEQ ID NO: 4143713 - RNA, 20 nt, Yersinia pestis
accauucacgccgcuccuga

SEQ ID NO: 4143714 - RNA, 14 nt, Yersinia pestis
accauucagccacu

SEQ ID NO: 4143715 - RNA, 16 nt, Yersinia pestis
accauuccgccaacag

SEQ ID NO: 4143716 - RNA, 16 nt, Yersinia pestis
accauugauaauaaua

SEQ ID NO: 4143717 - RNA, 17 nt, Yersinia pestis
accauuuauauaacagc

SEQ ID NO: 4143718 - RNA, 16 nt, Yersinia pestis
accauuuauugccacg

SEQ ID NO: 4143719 - RNA, 14 nt, Yersinia pestis
accauuugcccugg

SEQ ID NO: 4143720 - RNA, 19 nt, Yersinia pestis
accauuuuauugccagagg

SEQ ID NO: 4143721 - RNA, 14 nt, Yersinia pestis
acccaaaggcuggc

SEQ ID NO: 4143722 - RNA, 16 nt, Yersinia pestis
acccaacaguaccuuc

SEQ ID NO: 4143723 - RNA, 17 nt, Yersinia pestis
acccaacaguaccuucu

SEQ ID NO: 4143724 - RNA, 22 nt, Yersinia pestis
acccaacuuuuuuaccacauuu

SEQ ID NO: 4143725 - RNA, 22 nt, Yersinia pestis
acccaaggagaucgcucucacc

SEQ ID NO: 4143726 - RNA, 19 nt, Yersinia pestis
acccaauaaccccgugcca

SEQ ID NO: 4143727 - RNA, 15 nt, Yersinia pestis
acccaauauucgcca

SEQ ID NO: 4143728 - RNA, 20 nt, Yersinia pestis
acccaaugccauagcugcug

SEQ ID NO: 4143729 - RNA, 13 nt, Yersinia pestis
acccacaccgcag

SEQ ID NO: 4143730 - RNA, 17 nt, Yersinia pestis
acccacaccgcagcagu

SEQ ID NO: 4143731 - RNA, 22 nt, Yersinia pestis
acccacaucccggcagcaguug

SEQ ID NO: 4143732 - RNA, 14 nt, Yersinia pestis
acccaccugaaucu

SEQ ID NO: 4143733 - RNA, 21 nt, Yersinia pestis
acccacuugccauaagugaac

SEQ ID NO: 4143734 - RNA, 22 nt, Yersinia pestis
acccagacaagaaugccugccg

SEQ ID NO: 4143735 - RNA, 12 nt, Yersinia pestis
acccagcaaaau

SEQ ID NO: 4143736 - RNA, 12 nt, Yersinia pestis
acccagccaaga

SEQ ID NO: 4143737 - RNA, 21 nt, Yersinia pestis
acccagcuucuuuuaaagaag

SEQ ID NO: 4143738 - RNA, 22 nt, Yersinia pestis
acccagcuucuuuuaaagaaga

SEQ ID NO: 4143739 - RNA, 13 nt, Yersinia pestis
acccaguaacuga

SEQ ID NO: 4143740 - RNA, 19 nt, Yersinia pestis
acccauaacuugagcacau

SEQ ID NO: 4143741 - RNA, 17 nt, Yersinia pestis
acccauacaaauaguaa

SEQ ID NO: 4143742 - RNA, 15 nt, Yersinia pestis
acccauaccaaccau

SEQ ID NO: 4143743 - RNA, 18 nt, Yersinia pestis
acccauacgaucagcaag

SEQ ID NO: 4143744 - RNA, 20 nt, Yersinia pestis
acccauauuacucacacagc

SEQ ID NO: 4143745 - RNA, 19 nt, Yersinia pestis
acccauggagauugccuca

SEQ ID NO: 4143746 - RNA, 16 nt, Yersinia pestis
acccauuaaaaacaaa

SEQ ID NO: 4143747 - RNA, 20 nt, Yersinia pestis
acccauuuccccuuucuggu

SEQ ID NO: 4143748 - RNA, 13 nt, Yersinia pestis
acccauuugcaca

SEQ ID NO: 4143749 - RNA, 20 nt, Yersinia pestis
acccauuuuauccucuucca

SEQ ID NO: 4143750 - RNA, 20 nt, Yersinia pestis
accccaaagcgcauuuuucu

SEQ ID NO: 4143751 - RNA, 23 nt, Yersinia pestis
accccaauucuuaggucaucguc

SEQ ID NO: 4143752 - RNA, 17 nt, Yersinia pestis
accccacguaauuauug

SEQ ID NO: 4143753 - RNA, 12 nt, Yersinia pestis
accccagauaac

SEQ ID NO: 4143754 - RNA, 15 nt, Yersinia pestis
accccagcaaagcca

SEQ ID NO: 4143755 - RNA, 16 nt, Yersinia pestis
accccagcaaagccaa

SEQ ID NO: 4143756 - RNA, 22 nt, Yersinia pestis
accccagucacugacuuguugu

SEQ ID NO: 4143757 - RNA, 18 nt, Yersinia pestis
accccagucacuuacuga

SEQ ID NO: 4143758 - RNA, 14 nt, Yersinia pestis
accccauugcacca

SEQ ID NO: 4143759 - RNA, 16 nt, Yersinia pestis
acccccagugcugccg

SEQ ID NO: 4143760 - RNA, 12 nt, Yersinia pestis
accccccaccau

SEQ ID NO: 4143761 - RNA, 14 nt, Yersinia pestis
accccccauugcca

SEQ ID NO: 4143762 - RNA, 17 nt, Yersinia pestis
accccccauugccaaau

SEQ ID NO: 4143763 - RNA, 12 nt, Yersinia pestis
acccccccgacc

SEQ ID NO: 4143764 - RNA, 19 nt, Yersinia pestis
accccgcguugucagccau

SEQ ID NO: 4143765 - RNA, 18 nt, Yersinia pestis
accccguagcacacacag

SEQ ID NO: 4143766 - RNA, 14 nt, Yersinia pestis
accccguggcggcg

SEQ ID NO: 4143767 - RNA, 15 nt, Yersinia pestis
accccguugcucuac

SEQ ID NO: 4143768 - RNA, 18 nt, Yersinia pestis
accccguugcucuacaca

SEQ ID NO: 4143769 - RNA, 16 nt, Yersinia pestis
accccugcgauaaucu

SEQ ID NO: 4143770 - RNA, 16 nt, Yersinia pestis
accccugucuuauuuu

SEQ ID NO: 4143771 - RNA, 22 nt, Yersinia pestis
accccuucaccgggaucuauca

SEQ ID NO: 4143772 - RNA, 14 nt, Yersinia pestis
accccuuggcucuc

SEQ ID NO: 4143773 - RNA, 13 nt, Yersinia pestis
acccgaaagccau

SEQ ID NO: 4143774 - RNA, 22 nt, Yersinia pestis
acccgaaucacugacugaugua

SEQ ID NO: 4143775 - RNA, 14 nt, Yersinia pestis
acccgacaucaaga

SEQ ID NO: 4143776 - RNA, 15 nt, Yersinia pestis
acccgaccagacaac

SEQ ID NO: 4143777 - RNA, 17 nt, Yersinia pestis
acccgauacaggcucug

SEQ ID NO: 4143778 - RNA, 13 nt, Yersinia pestis
acccgauuucacg

SEQ ID NO: 4143779 - RNA, 14 nt, Yersinia pestis
acccgcaaccgggu

SEQ ID NO: 4143780 - RNA, 14 nt, Yersinia pestis
acccgcacgcccau

SEQ ID NO: 4143781 - RNA, 18 nt, Yersinia pestis
acccgccaucaggcaaaa

SEQ ID NO: 4143782 - RNA, 16 nt, Yersinia pestis
acccgccucuaaaucu

SEQ ID NO: 4143783 - RNA, 16 nt, Yersinia pestis
acccgcgggagucagu

SEQ ID NO: 4143784 - RNA, 19 nt, Yersinia pestis
acccgcgggagucagucgc

SEQ ID NO: 4143785 - RNA, 17 nt, Yersinia pestis
acccgcuauauguaaug

SEQ ID NO: 4143786 - RNA, 19 nt, Yersinia pestis
acccgcucugucagcccua

SEQ ID NO: 4143787 - RNA, 15 nt, Yersinia pestis
acccgcuguuucucu

SEQ ID NO: 4143788 - RNA, 17 nt, Yersinia pestis
acccgcuugucuugaaa

SEQ ID NO: 4143789 - RNA, 17 nt, Yersinia pestis
acccguacgaauuuuuc

SEQ ID NO: 4143790 - RNA, 15 nt, Yersinia pestis
acccguacugauuau

SEQ ID NO: 4143791 - RNA, 16 nt, Yersinia pestis
acccgucaccacaaag

SEQ ID NO: 4143792 - RNA, 17 nt, Yersinia pestis
acccguugcauuuuucu

SEQ ID NO: 4143793 - RNA, 23 nt, Yersinia pestis
acccguugcauuuuucuguucag

SEQ ID NO: 4143794 - RNA, 16 nt, Yersinia pestis
acccuaucgucacagc

SEQ ID NO: 4143795 - RNA, 18 nt, Yersinia pestis
acccuaucgucacagcaa

SEQ ID NO: 4143796 - RNA, 19 nt, Yersinia pestis
acccuaucgucacagcaau

SEQ ID NO: 4143797 - RNA, 18 nt, Yersinia pestis
acccucaacucaaaacaa

SEQ ID NO: 4143798 - RNA, 21 nt, Yersinia pestis
acccucucuuuccagcaaaag

SEQ ID NO: 4143799 - RNA, 21 nt, Yersinia pestis
acccucugcguacaacacauc

SEQ ID NO: 4143800 - RNA, 21 nt, Yersinia pestis
acccucugucggcaagcgaua

SEQ ID NO: 4143801 - RNA, 21 nt, Yersinia pestis
acccugaaggcugauuaauau

SEQ ID NO: 4143802 - RNA, 19 nt, Yersinia pestis
acccugacgaaauuuaaga

SEQ ID NO: 4143803 - RNA, 21 nt, Yersinia pestis
acccuuaugccgugacugccg

SEQ ID NO: 4143804 - RNA, 15 nt, Yersinia pestis
acccuucucuuuauc

SEQ ID NO: 4143805 - RNA, 16 nt, Yersinia pestis
acccuucucuuuauca

SEQ ID NO: 4143806 - RNA, 18 nt, Yersinia pestis
acccuugauuuuaccaac

SEQ ID NO: 4143807 - RNA, 22 nt, Yersinia pestis
acccuuguuuaucuucuacuua

SEQ ID NO: 4143808 - RNA, 22 nt, Yersinia pestis
acccuuucucgcguuugaucaa

SEQ ID NO: 4143809 - RNA, 24 nt, Yersinia pestis
acccuuugagaaaggauuugaaga

SEQ ID NO: 4143810 - RNA, 14 nt, Yersinia pestis
accgaauaaaaccu

SEQ ID NO: 4143811 - RNA, 16 nt, Yersinia pestis
accgacaccaaccggu

SEQ ID NO: 4143812 - RNA, 17 nt, Yersinia pestis
accgacgagggcuucug

SEQ ID NO: 4143813 - RNA, 21 nt, Yersinia pestis
accgacgguucccaugacgau

SEQ ID NO: 4143814 - RNA, 20 nt, Yersinia pestis
accgagcgucaagccaaccc

SEQ ID NO: 4143815 - RNA, 17 nt, Yersinia pestis
accgagcgugaagagcg

SEQ ID NO: 4143816 - RNA, 18 nt, Yersinia pestis
accgaggaugacgacaaa

SEQ ID NO: 4143817 - RNA, 20 nt, Yersinia pestis
accgaggcgggucagaaaca

SEQ ID NO: 4143818 - RNA, 17 nt, Yersinia pestis
accgagguuaucagccu

SEQ ID NO: 4143819 - RNA, 16 nt, Yersinia pestis
accgaguguaaaaagc

SEQ ID NO: 4143820 - RNA, 15 nt, Yersinia pestis
accgaguguaaucag

SEQ ID NO: 4143821 - RNA, 20 nt, Yersinia pestis
accgauaagaaaucaucagc

SEQ ID NO: 4143822 - RNA, 18 nt, Yersinia pestis
accgauggugccgucaac

SEQ ID NO: 4143823 - RNA, 18 nt, Yersinia pestis
accgcaaccuguugugga

SEQ ID NO: 4143824 - RNA, 13 nt, Yersinia pestis
accgcaccacgau

SEQ ID NO: 4143825 - RNA, 20 nt, Yersinia pestis
accgcacuugcggcaauggc

SEQ ID NO: 4143826 - RNA, 16 nt, Yersinia pestis
accgcagauaaaagaa

SEQ ID NO: 4143827 - RNA, 20 nt, Yersinia pestis
accgcagucgauaaacauca

SEQ ID NO: 4143828 - RNA, 11 nt, Yersinia pestis
accgcauaaga

SEQ ID NO: 4143829 - RNA, 13 nt, Yersinia pestis
accgcauuuucaa

SEQ ID NO: 4143830 - RNA, 17 nt, Yersinia pestis
accgccaaauacaaacc

SEQ ID NO: 4143831 - RNA, 17 nt, Yersinia pestis
accgccaauauaaggcu

SEQ ID NO: 4143832 - RNA, 15 nt, Yersinia pestis
accgccacacaauac

SEQ ID NO: 4143833 - RNA, 17 nt, Yersinia pestis
accgccacagcaacagg

SEQ ID NO: 4143834 - RNA, 23 nt, Yersinia pestis
accgccaucuugucgucacccau

SEQ ID NO: 4143835 - RNA, 17 nt, Yersinia pestis
accgccccccaucccca

SEQ ID NO: 4143836 - RNA, 20 nt, Yersinia pestis
accgccgcaacaauaaagcg

SEQ ID NO: 4143837 - RNA, 15 nt, Yersinia pestis
accgccggcaacagc

SEQ ID NO: 4143838 - RNA, 16 nt, Yersinia pestis
accgccuucugguggu

SEQ ID NO: 4143839 - RNA, 13 nt, Yersinia pestis
accgcgcaggagc

SEQ ID NO: 4143840 - RNA, 16 nt, Yersinia pestis
accgcgcucugcuggg

SEQ ID NO: 4143841 - RNA, 16 nt, Yersinia pestis
accgcgcuuuugauuu

SEQ ID NO: 4143842 - RNA, 22 nt, Yersinia pestis
accgcgucgccgcuuuuuguaa

SEQ ID NO: 4143843 - RNA, 15 nt, Yersinia pestis
accgcuauaucauca

SEQ ID NO: 4143844 - RNA, 13 nt, Yersinia pestis
accgcucuucaca

SEQ ID NO: 4143845 - RNA, 15 nt, Yersinia pestis
accgcucuucacauu

SEQ ID NO: 4143846 - RNA, 17 nt, Yersinia pestis
accgcugaaguggcuga

SEQ ID NO: 4143847 - RNA, 12 nt, Yersinia pestis
accgcugauaac

SEQ ID NO: 4143848 - RNA, 16 nt, Yersinia pestis
accgcugauaaccagc

SEQ ID NO: 4143849 - RNA, 19 nt, Yersinia pestis
accgcugauaaccagcagc

SEQ ID NO: 4143850 - RNA, 17 nt, Yersinia pestis
accgcugcagggccuuu

SEQ ID NO: 4143851 - RNA, 21 nt, Yersinia pestis
accgcugcuaccagcagugca

SEQ ID NO: 4143852 - RNA, 22 nt, Yersinia pestis
accgcuggucgggugcaggcca

SEQ ID NO: 4143853 - RNA, 23 nt, Yersinia pestis
accgcuguaaaugcgugguaaac

SEQ ID NO: 4143854 - RNA, 15 nt, Yersinia pestis
accgcuuacugaugu

SEQ ID NO: 4143855 - RNA, 22 nt, Yersinia pestis
accgcuuacugaugucaucaag

SEQ ID NO: 4143856 - RNA, 23 nt, Yersinia pestis
accgcuuacugaugucaucaagu

SEQ ID NO: 4143857 - RNA, 16 nt, Yersinia pestis
accggagcaagggcgc

SEQ ID NO: 4143858 - RNA, 17 nt, Yersinia pestis
accggagcaagggcgca

SEQ ID NO: 4143859 - RNA, 21 nt, Yersinia pestis
accggauaaaacaauagcuga

SEQ ID NO: 4143860 - RNA, 21 nt, Yersinia pestis
accggauaacguuucagggug

SEQ ID NO: 4143861 - RNA, 12 nt, Yersinia pestis
accggcaccaau

SEQ ID NO: 4143862 - RNA, 15 nt, Yersinia pestis
accggcauggauaac

SEQ ID NO: 4143863 - RNA, 17 nt, Yersinia pestis
accggcauucuucgccg

SEQ ID NO: 4143864 - RNA, 23 nt, Yersinia pestis
accggcgguuaucacaucaucca

SEQ ID NO: 4143865 - RNA, 15 nt, Yersinia pestis
accggcguaaauaaa

SEQ ID NO: 4143866 - RNA, 15 nt, Yersinia pestis
accggcuaaccacag

SEQ ID NO: 4143867 - RNA, 21 nt, Yersinia pestis
accggcuaacgaggcauaauc

SEQ ID NO: 4143868 - RNA, 16 nt, Yersinia pestis
accggcuccugccgca

SEQ ID NO: 4143869 - RNA, 21 nt, Yersinia pestis
accggcugauguucugccaac

SEQ ID NO: 4143870 - RNA, 18 nt, Yersinia pestis
accgggauacgggaucga

SEQ ID NO: 4143871 - RNA, 21 nt, Yersinia pestis
accggggauccauaggauccc
